United States Patent 7,630,836 (POLYNUCLEOTIDES) - sequence listing, part 7

SEQ ID NO: 3430 - DNA, 669 bp, Streptomyces avermitilis
  CDS (1)..(669)
atgagtttcggcgcgcccgacaatccgtacggacagccgcagaacccccagcagggttacggctacccccagcagggccagccgccctacccgcaggcgccgggaggcattccgcagcagggttacggctacccccagcagggccagcccggctacggctacccgggcggaccgggcggacccggcccgcgcgtcgcctcgatgggccgccgcctcggcgcccgcgcgatcgacggcgtggccttcttcgtcatctacttcatcctcggcgccatcggcgtggccggttccatcggcgccgcgcaggactgcgacccgaacgccgcggactacaacacctgcatcaacaacgcgagttcggacatcgccgccaagatcggcagcatgatcgccgttctcgcgatcgtcggtctgctctacgagtggctgatgaccggcctggtcggcgccaccctcggcaagctcgctgtcggcatccgcgtggtgaaggcggacaccggccagaagccgggcctgggctcctcgttcatccgctggatcatcccgctcgtcggcagcctggcctgcggtatcggccaggtcctggtctacctgtcccccttctgggacaagtcgggccgccagcagggctggcacgacaaggccgccggcacgatggtcatccagaac

SEQ ID NO: 3431 - DNA, 1581 bp, Streptomyces avermitilis
  CDS (1)..(1581)
gtgaccgccgaaggtaccgtgaccgccgagggcacgcagcgcccgatcaggcgcgcgctcatcagcgtctacgacaagacggggctcgaagacctcgcccgcggcctgcacgaggccggtgtcgagctcgtctccaccggctccaccgccgcgaagatcgccgcggccggcgtcccggtcaccaaggtcgaggagctgaccggcttccccgagtgcctggacggccgcgtcaagacgctgcatcccaaggtccacgcgggcatcctcgccgacctgcggctcgacgagcaccggcgtcagctcgaggaactgggcgtggaaccgttccagctcgtcgtcgtgaacctctacccgttccgcgagaccgtcgcctccggcgcctccccggacgagtgcgtcgagcagatcgacatcggcggcccgtccatggtccgtgccgccgccaagaaccacccgtccgtggccgtggtcaccagccccgagcggtacgccgacgtcctctccgcggtccgcggcggcggcttcgacctcaccgcccgcaagcggctcgccgccgaggccttccggcacaccgcggcgtacgacgtcgccgtcgcctcctggttcgcgtcctcgtacgcccccgtcgacgagtccgtcttcccggacttcctcggtgccaccttcgagcgcaagagcaccctgcgctacggcgagaacccgcaccagcccgccgccctctacgtcgacggcggcggcaccggcctcgccgaggccgagcagctgcacggcaaggagatgtcgtacaacaactacacggacacggacgccgcgcgccgtgccgcgtacgaccacgccgagccctgcgtcgcgatcatcaagcacgccaacccctgcggcatcgcgatcggcgcggacgtcgccgaggcgcaccgcaaggcgcacgcctgcgacccgctgtccgcgttcggcggtgtgatcgcggtcaaccgcccggtgtccaaggagctggccgagcaggtcgcggagatcttcaccgaggtcatcgtcgcgcccggttacgaggacggcgcgctggaggccctcgccaagaagaagaacatccgcgtgctgcgggcccaggacgctccggccaacccggccgagctcaagcagatcgacggcggcgcgctgctccaggtcaccgaccgtctccaggccgacggcgacgacccggcgaactggaccctggccaccggcgaggccctgtcgcccgccgagctggacgagctggccttcgcctggcgagcgtgccgcgcggtgaagtccaacgcgatcctgctcgccaaggacggtgcctcggtgggtgtcggcatgggtcaggtcaaccgggtcgactccgcgaagctggcggtcgagcgggcgggcgaggagcgtgcccgtggtgcgttcgccgcgtcggacgcgttcttcccgttccccgacggcctggagatcctcaccgcggcgggcgtcagggccgtggtccagcccggcggttcggtccgtgacgaactggtcgtggaggccgcgaagaaggcgggcgtgacgatgtacttcacgggcacgcgccacttcttccac

SEQ ID NO: 3432 - DNA, 627 bp, Streptomyces avermitilis
  CDS (1)..(627)
gtggccgccaagcccgtggccaagcgcctcgtcgtgctggtttccggatccggtacgaatctgcaggctctcctcgacgccatcgaggcccagggcatcgaggcctacggggcggagatcgtcgccgtcggcgccgaccgcgacggcatcgaaggcctcgcccgcgccgagcgtgcggccctgccgaccttcgtccgccgggtgaaggactacgacacccgtgacgagtgggacgcggcgctgaccgaggccgtcgccgcgtacgaacccgatctcgtcgtctccgccgggttcatgaagatcgtggggaaggaattcctcgccaggttcggcggtcggttcgtgaacacgcaccccgccctgctgcccagttttcccggggcccacggcgtgcgcgaggcactcgcgtacggcgtgaaggtcaccggatgcaccgtccacttcgtcgacgacggtgtcgacaccggaccgatcatcgctcagggcgtggtggagatccgggacgaggacgacgagagcgctctgcacgagcgcatcaaggaagtcgagcgaaggctgctcgtcgaggtcgtggggcggctcgcccgcaacggccatcgcattgagggacgaaaggtagttatcccg

SEQ ID NO: 3433 - DNA, 936 bp, Streptomyces avermitilis
  CDS (1)..(936)
atgccggaccgcagtctccgactccctcagctcctgctgcgcgagcggcgcccctctcccccgcagcccacgccgccgcgggagggcgaggacgcacccgcgggcgagcgtgacgccgcgggcgggcgcagcccggagaccccgtcgagcggctcgggctcctcggggtccggtgcttcgacctcggggtccggcggctcgggctcctcgggctcctcgggctcctcggggtccggcgactcgggctcctcggaggacaatccgttcgctccgccgccggaggggacgccggaccggccctggcagccgcggcgtccctcgggcggaccggagggggacgagcacggagggccgtcgggacagcccggtcagtccccctggggcagccagtggagcgaccggcagccggggcgttcgggcgagggcggcttcggtgaccgccagggacggccgggcggaccggacggacaaggcggacagggcggcggtcctgagggttcgggtggcccgggaggcccgggtgcgggcctgcgctgggaccccgcggacccggcccagcgccgcgcccgctacgcactgctctgcggcatgtgggccttcttcttcgcgctcttcagctggccgtacgtggcactgctgctgggggcgctggccgtgtactggggcgcgagctccctgcgcgccaagccccgcacgccggacccggacaacccggcgccggaggcgaccgccaacgcccgcccgcagcggacggcggcgatcagcggcctggtcaccgcttccctggcgatcgtcatggtcgcggcgacgttcaccgcgcagctggtctacagcgactactacacctgcacgaacgacgccctcacccagacggcgaagcagtcctgcaacgatctgctcccgaagaacctgcggggcctgctggggtcgcagagc

SEQ ID NO: 3434 - DNA, 393 bp, Streptomyces avermitilis
  CDS (1)..(393)
atgccgtcgccggccggcgggccagggcgggggaagggcggcgaaggcgacgtggtggtggcgacaccggcaccggcgcccgcggcgacccccgcgcctgtgctgccggtgccttcggcggtcgacgagacgtccgagctgtacgacttcctgccctcggacgcggagggctcgtcctggtacgacgacgcggcacgggagagccggtggtcggcgctgaggaaggcggcgacctccccggaaccgacggaggcggcggcgccgacggatgcgcgggaggcgcccgcgccaccggaaccacgggaggtggcggccaccccggaaccacgggaggcgccgtcctcaccggaaccgccggagggggcgacgccacccgagccgccgcaggcgccg

SEQ ID NO: 3435 - DNA, 330 bp, Streptomyces avermitilis
  CDS (1)..(330)
gtggcgggggtggtgccgtttgcggcgggggtgacggtggggtggttcacggcgggagcggccgtggcggacgggaaggcgcgctggtcgcgggcgcggacagcggcggtggccggggtggccagcgctgctgtgcggggccgttctctggatactggcacgcgctggcgggcgggccgctcaggggtgcgcacgctggcccggttcgggccggtggggtggcaggtgggcggtgccacggtcgggtggaaggcgctggtgggggtgccggtggcggtgggggcgtgggggtggcgcctgagcgggcggggaccgggggacggcgggagg

SEQ ID NO: 3436 - DNA, 972 bp, Streptomyces avermitilis
  CDS (1)..(972)
atggcgggtgtgactcaattgaccgatcaccgaacgccgttgtcgcccctgctcacccggttgcccgaccgatcgcccggactggccgccagcctcctgggtggtgcgcttgcggcggtcctgggactcggctcgttcgcggtgctggtgacggtgctgtggatcagttccccctacccggacagcgggcccggtggggcgctgcacatcggcgccgcgctgtggctgctcgcacacggtgtcgaactcgtccgcaccgacacgctggccggcgcggcccgcccggtcggcgtcaccccgctgctgctgctggcgctgccggtgtggctggtgttccgggcggggcgggacgccgtcgatgtggacgaggaaggtgacatgccgccggtggccgcgcgtacggccctgtccggggtggtggcgggctatgtggtggtgggcgtggcggccggggtgtacgcctcgggcggcgcgctgcggccctcgtggctgtggaccgccgggtgtctgccgctgctcgccgtgaccgcggccggggcgggggtgtggacggcgtacgggcgcccgcgcgggcccttgccgccgctcgcgcgccgggcgctgaacgcgctgcccgggggcgtacggcgttttgtcaccgccgatgcccgggggtggacgcgggcctccctgcgggcgggactggccggggtggcggtgctcgtcgggggtggggcgctgctggtgggggtgtcgctggtgtggcacggggggccggctcaggactcgttcctgcggctcacggaggggtggtcggggcggttcgcggtactgctgctggcgttggtgctggtgccgaacgcggcggtgctggggggccgcgtacgggctggggcccgggttcgaactgggggccgggcatatgaccgggccgctggccaccgggactccgccggcgctgctgccgccgtttccgctgctggcggcggtgcc

SEQ ID NO: 3437 - DNA, 1110 bp, Streptomyces avermitilis
  CDS (1)..(1110)
gtgggtgtcagccgcgagacggtgcgctcctgggaggccggccgtacgacaccgcgcggccgcaagcgggaagcgtacgcacgggcgctggccggactgaccgcccctcagccgcccgccgccgacccggtcgacccgaaaccggccgcaccggtaccggccgcaccggagacggagccccccgccgtgcggccgcccgccgaggcgcccctccgtcaggaacagccggtacgcgtaccggtgggtgccgccctcacccccgtgtccaccgccgacgagatcctcgcggacacggaagatcccaccgcgacgaccgcgctgacgccctctcaggccttcgacgcgctgtacgcgttctgcgcccccgccctcgtacggcagacctatctgctgaccgggcggcgcgagctggcgcgcgaggccgtggaacgggcgttccaactggcctggcagcgctggcccgaggtggccgtcgaccgggaccccggggggtgggtgcgggcgacggcgtacgagtacgcgctctcgccctggcaccggctgcgtccgcgccaccggcacccggaacccccgcccgccgacgcggccgaccgcgtactgctcgaggcgttcctcaagctgccgcccgcgcaccggcgcacgctgctgctctacgacggggtcgggctcggtctgccggagacggcggccgagacggaggcgagcacgcccgcggcggcgaaccggctgctgcacgcgcgcggggcgatcgccgcgcggctgccggagctggcggcaccggaggaactccaccgccggctcaccgcactggcgtccggggagcgcctgcgcgcggcgcggcccccgacggtacgcaccggcagcgaacagcgggcccgtcagtggacccgcgcggccgtcgccttcaccgtcgtgatcatcagcgcgacggcgctgaccctgcgggacgcccaggaccactacgagccgccggtggcgccgggcgcgacggtgcagggggtaccgcccagggtcgctccgggcccgctctcccggcaggagctggaactgcgcgcgaagctcaggtcggagctgctgaacgggccggagaggctcacgcccgacgaccac

SEQ ID NO: 3438 - DNA, 882 bp, Streptomyces avermitilis
  CDS (1)..(882)
atggctatcttcctcaacaaggacagcaaggtcatcgtccagggcatgaccggtgccacgggcatgaagcacaccaagctcatgctggccgacggcacgaacatcgtcggcggtgtgaacccgcgcaaggcgggcacgtccgtcgacatcgacggcaccgacatcccggtgttcggctcggtagccgaggccatcgagaagacgggcgccaacgtgtccgtcctcttcgtgccgccggctttcgccaaggccgccgtcgtcgaggccatcgacgcggagatccccctcgcggtcgtcatcaccgagggcatcgccgtccacgactccgccgccttctgggcgtacgcgaagtcgaagggcaacaagacccgcatcatcggcccgaactgccccggtctcatcacgccgggccagtcgaacgccggcatcatcccgggcgacatcacgaagccgggccgcatcggcctggtctcgaagtccggcacgctgacgtaccagatgatgtacgagctccgtgacatcggcttctcgtcggccgtcggcatcggtggcgacccgatcatcggtacgacgcacatcgacgcgctcgccgcgttcgaggccgaccccgacaccgacctgatcgtcatgatcggtgagatcggcggcgacgccgaggagcgtgcggcggacttcatcgcgaagaacgtgacgaagccggtcgtcggctacgtcgccggcttcaccgcgcccgagggcaagaccatgggccacgccggcgccatcgtctccggctcctccggcacggccgccgcgaagaaggaggccctcgaggccgccggcgtcaaggtcggcaagacgccgaccgagacggcgaagctggcgcgcgccatcctcggcagc

SEQ ID NO: 3439 - DNA, 1176 bp, Streptomyces avermitilis
  CDS (1)..(1176)
gtggacctgttcgagtaccaggcgagggacctcttcgccaagcacggtgtaccggtgctggccggtgaagtcatcgacacgcctgaggcggcccgcgaggcgaccgagcgtcttggcggcaagtccgtcgtcaaggcccaggtgaaggtcggtggccgcggcaaggccggtggcgtgaagctcgccgccaccccggacgaggccgtcgctcgcgcgacggacatcctcggcatggacatcaagggccacacggtccacaaggtgatgatcgccgagacggctccggagattcttgaggagtactacgtctcgtacctcctcgaccgcaccaaccgcaccttcctcgccatggcgtccgttcagggcggcatggacatcgaggaggttgccgagaagacccccgaggcccttgcgaaggtcccggtcgacgctgtggaaggcgtctccatcgagaaggcccgcgagatcgtcgccctggcgaagttcccggccgaggtcgccgagaaggtcgccgaggtcctcgtgaccctgtgggacaccttcgtcgccgaggacgcgctcctcgtcgaggtcaacccgctcgccaaggtcgcctccggcgacatcctggcgctggacggcaaggtctccctggacgagaacgccgagttccgccaggccgaccacgccgccctcgaggacaaggcgtcggccaacccgctcgaggccgccgccaaggagaagaacctcaactacgtcaagctcgacggcgaggtcggcatcatcggcaacggcgcgggtctcgtcatgagcaccctcgacgtcgtcgcgtacgctggtgagaaccacggcggagtcaagcccgccaacttcctcgacatcggcggcggcgcttccgcgcaggtcatggccaacggtctcgagatcatcctcggtgacccggacgtcaagtccgtcttcgtcaacgtcttcggtggcatcaccgcctgtgacgaggtcgccaacggcatcgtgcaggcgctgcagctgctcgccgacaagggcgaggaagtcaccaagccgctggtcgtgcgtctcgacggcaacaacgccgagctgggccgcaggatcctgtcggacgccaaccacccgctggtccagcgcgtggacaccatggacggcgcggccgacaaggccgccgagctcgcggctgcgaag

SEQ ID NO: 3440 - DNA, 1884 bp, Streptomyces avermitilis
  CDS (1)..(1884)
atgaacaagaacatccgccgttccatcgtcatagccgcaggtgtcaccggcgcgtgggcgctcggttccgccgtcgccagcgcggacgagctgcccgcgccgtccgtctccgttcccgacgcggccgacgcaaccgacgcgtccgacgcgagcgtcgacaccacggacccgttgggcgcggtgaccggcacggtcgacggcgtcgtctccggcgtccaggacacggccaccggcctcaccggcaccaatggcaccaccgcccgcgtcaccgacgccacgacctccacggtcacggatgccgccggccagacgaagacgacggccgcccgcaccacgagcacggccaccacggccacgacagccgcagcggaccaggccgaccaggcccgccggtacgtcgacgccgaggtccccgtctcccacctctcccacgcgcacaccgcgaacaccacgcacaccgtgcacgccgcccggggcaaggccaccgcggtcgcggacggtgccacgcgcgcggtagacgcggccgtgtccgacgcgggcgccccccggggcgggatcgactacctgttcggtcccctctcggccttcgcgcccgaactggagcaggccctcgcggccgcccagaccaagctccagggtgctcaggacgccgcccagcccaaggcgcagggcgtccagggcctcgtacagacgaaggcgcagaccaccaccgcgggcgcgggccgtaccgcggcgggtgcgacgagcgccgcgcaccacgcggtcggctacgcccagggccgcgccacgggcacggttgccgccgcccggggcacggcgggcgaggtcacgacggccgcccacgccaccgcctccgccgtccccggccacctcacgggcacggtcacgggggtcgagcagcaggcggtcggctcggtcttcggcacggtcgccggcgtccccggcacggtccagggcgtcaccgcgaccgtcaccccggtcgtcgacgggacggccgccgccgttgtgccgccggtcgccgtgaccgccgtcgacggggtcgccccgctcgccgaccacgccgccggcaacgcgaccggcctggcgtacggcgtggtggcggatgtgcagccgctcgcgcgggacgcggccggccatgccacgacgctcgcgtacggcgtcacgggcgacgtgcagccgctggcctcgggcgtggtccgggacgccgtgcacgagacggccgcgtccgtgctgccgcccgtcgccgcgaccgccgtccacggggtcgtccccgtcgccgggcaggcggccggggacgcgaccggcctggcgtacggagtcgtcggcgacgtgcggcccttcgcgggcggggtcgtcggccaggttccgccgctcgcccagggtgtcggcggcagcgccaccgggctcggccacggcgtcaccgacgaggtgcagccgttcacgaacggcgtggtcggctcggtccacccggcggtggacaccgtggtcggctcggtccatccggccgtggacaccgtggtcggcgcggtgcggccggtcgtggacaccgtgaccggcgcggtgcggccggtcgtggacacggcggtcggcgccgtcggcccggtcgtcgacggcgtcggcggcagcgccacgggcctcgcctacggagtggtgggcgacgtacagcccttcgcgggcggtgtggccggcgcggccgaccccttcgcgcggggcgtcgtcggccaggtcggcccgttcgcgcaggacctgaccgggaccgtcgagtcggcgggcggtccgctggccggccacgccgtgaccggcgtccagggcgtcgccgagtcggtcaccccgggctacctgccgcacgtccagcacaccggcgcgtacggcacgtacagcatc

SEQ ID NO: 3441 - DNA, 1182 bp, Streptomyces avermitilis
  CDS (1)..(1182)
gtgtccgccgtgttccgttctgtaccgcctcgtttcgtcacgttccgccgcacggaggctccgcccgtcttgaccctgccagccgcgctgcccttctccggtgccgctctgcgtgtgatgcgcggggcggccggacggcgcgcgctgcatgtggtggtgctggtgggcgggttgttcgcgctggggctcctctgcggggagcaggtgcatgcggcggacggtacgccgacggtttcgacagctgcggaaacggtttcggggacggctccgggggcggcaccgccagcgttcgtgcggtcggtgaaggggacggctcggcaagccggacggaccatcagcagcgcggcggcccaggaaccgaagggcgcgcccacgcctgcggctcgccctgtacgccctgaagcaacggccgttccctcggcacccaagggatcccccggaacgccgtcccgcgcgaacgccgcaacgccttcccgtgcgaacgccggaacgccttcccgcgcgaatgtcggccccgtcgccgacgtcaccaagacggcccccgccgtccagcgcgtcgtccgtcccgtcgccgtcggcctcgccggtggtgtcgtacggccggtcggggatctcgcggacacggtcgccgacgggctggccgacgcgtcctcgcaggtgccggtgccgtcgttcccttcgcctccctcgcctccttcgcctccttcgcttcccccgctcccttcgttgcccgcgctccccgagccgccctcgctgcccggtctcccggggctgtccggtctgcccacgtccccggtgcagaccctgccggccccggcgagtccgcggcagccgggcggcacggcggcgcacgcgggttccgcggagcagcgggagacccaggaatcaccggcggcatacggtccaccggccgtcggcgcctcctcggccggtgggaacgtgatgcaccgcgcgccccacggcgcagggcccgcacaggcgcccgcgcaacaagcccccggtgacccgaccggcgagctcggcccgcagtcggcggtcgacaacggcgcgccgcggcacggcgacgcacatgccgtgaccctggaccaccgggcgccgctgcggctggtgcccggcgccaccgcggtcgtcaccgcggacgggacccgggacaggtaccgggacattccggagttccccggc

SEQ ID NO: 3442 - DNA, 1047 bp, Streptomyces avermitilis
  CDS (1)..(1047)
atggacggggcgctgaccgcgctgtacgggaagggggacaaaccgcagacgggccgagaccgttcggcggggctcggggcgtccgcgccgtccgtcgcccgctggctcggggacatccggacgtacttcccctcctcggtcgtccaggtgatgcagcgggacgccatcgaccggctcgggctgtccaccctcctgctcgagccggagatgctggaggcggtggaggccgacgtgcacctcgtgggcacgctgctctcgctcaacaaggcgatgccggacaccacgaaggagacggcgcgggccgtggtgcgcaaggtcgtcgaggacctggagaagcggctggccacccgcacccgggccaccctcaccggtgccctcgaccgcagtgcccgcatcacccgcccacgccatcacgacatcgactggaaccgcacgatcgcggccaacctcaagcactacctgccggagtaccgcacgatcgtgcccgagcggctcatcggctacggacgcgcctcgcagtccgtcaagaaggaggtcgtcctctgtatcgaccagtcggggtcgatggcggcgtccgtcgtctacgcctcggtgttcggtgcggtgctcgcctccatgcggtccatcgccacccggctcgtcgtcttcgacacggccgtcgtcgacctcaccgaccagctcgacgatccggtcgacgtcctcttcggcacccagctcggcggcggtacggacatcaacagggcgctcgcgtactgccagtcgcagatcacccggcccgccgacacggtcgtcgtcctcatcagtgacctctacgaaggcgggatacgcgacgagatgctcaagcgggtggcggcgatgaaggcgtcgggggtgcagttcgtgacgctgctggcgctgtccgacgagggggcgcccgcatacgacagggagcacgcggcggcgctcgcggcgctgggcgcaccggcgttcgcctgcacgcccgacctgttcccggaggtcatggcggcggcgatcgagaagcggccccttccgataccggacacggca

SEQ ID NO: 3443 - DNA, 2424 bp, Streptomyces avermitilis
  CDS (1)..(2424)
gtggcaggcgatgaggaggctcagtccgtaggcgtaggcgtaggcgtcgacgtggccgtgggtgggggcggagacggcggtgagcggccgttgttgctcggcgtgcggcatcacgggcccggttcggcgcgggccgtacgggcggctctggaagcggcgcggccgcgggccgtgctgatcgaggggcccccggaggcggacgccctgatcccgctcgccggggacgaggagatgcggccgcccgtggcgctgctcgcccatgccgtggaagagccggggcggtcggcgttctggccgctggccgagttctccccggagtgggtcgcgatccgctggtccctcgaacacggggtgccggcccgcttcatcgacctcccggcgacgcacacgctggcctgggacaaggaggaaccggccgcggagaaggagcccttgccgcagcccgtcgacgaggccgtccgggtcgaccccctggccgtactcgccgaagccgccgggtacgacgacccggagcgctggtgggaggacgtggtcgagcaccgggggacggggggtgacgtgttcgcgccgttcacggtgctcgaggaggccatgggggcgctgcgggaggcgtacggcaccggggggcacgagcgggacctcgttcgggaggcgtacatgcggctccaggtgcgggcggcccagcgggagttcggtgacgacgtggcggtcgtgtgcggtgcctggcatgtgcccgcgctgcggcggaaggccaccgtcgccgccgaccgggccctgctgaaggggctgcccaaggtgaagaccgacatgacctgggtgccgtggacgcaccggcggctggcccgggccagtgggtacggcgccgggatcgactcgcccggctggtacgggcatctgttcggcgttcccgaccggccggtcgagcgatggctgaccaaggtggccgggctgctgcgcgaggaggaccggatcgtctcgtccgcccacgtcatcgaggcggtgcggctggccgaaacgctcgcggtgatgcgcggacgtccgctgcccgggctgaccgagacgaccgacgccgttcgggcggtgatgtgcgagggctcggacgtgccgttggcgctggtgcacgaccggctcgtggtcggcgatgtactgggggaggtccccgagtcggctcccgccgtcccgttgcagcgggacctgacccggctccagcgacggttgcggctcaaaccggagccgctggagcgggaggtggagctggacctgcgcaaagagaccgacgccgagcgcagcaggctgctgcaccggctccgtctgctgcgcgtggcgtggggcgagcccgccgcgtcgcgcggcagcaccggtacgttccgggagacctggcggctgcgctgggagccggagctgtcggtacgggtcgcggaagccggggtgtggggcaccaccgtgctcgccgccgcgaccgccaaggccgaggcggacgcggtcgccgcgcaggcgctggccgaggtcacggcgctcgccgagcgctgtctgccggccggactcccgggcgcgctgcccgtcgtgatgcgcgtcctcgccgaccgcgcggcactcgacaccgatgtcggccatctcgcccaggccctgcccgccctggtccgctccctgcgctacggcgatgtgcgcggcacggacacgaaggcactggccggggtcgcgacgggcctcgctgaacgcgtgttcgtcggactgccgcccgcgtgcgccgcgctcggcacggaggcggcggaggagatgcgccgccatgtggacgcggtgcacggggcggtgggtctgctgggggaggggaccgcggctcggcagggcgacgagggctcgggccagggcggtaccggcatacgcgaacgctggcactccgtgctgcgggtcctctccgggcgggacaccgtacccggagtgatccgtgggcgcgccgtgcgactgctcctggacgacggggcgctggcgcaggacgaggccgcacggctgatggggctcgtgctgtcgccggggacggcgccgggggacgcggccgcgtggatcgaggggttcgtcgggggcggttccggcggcgggatgctgctcgtgcacgacgagcggctgctcgggctggtggacgcctggctgaccggggtaccggcggaggcgttcaccgacgtactgcccctgctgcggcgcaccttctcggcatacgagcccggggtgcgcagaacgctgggcgagctggtgcggcgcggaccgggggcgcgggggagtgccgcggccgtcggctcgggcacccccggatacgccaccgacctcgacaccgagcgggccgacgcggtgctgccggtgctgcgcctgctgctcgggctggacgacctcgccgacggcgacaccaacgaccttgtgggggtgactcga

SEQ ID NO: 3444 - DNA, 1206 bp, Streptomyces avermitilis
  CDS (1)..(1206)
gtgtccgtcgaaccgacgtccgtcgacccgagccccgacaagtccgcgcccgcgaacgcgagcgggagagcggacgcgagtgcgcgtccgtccacgggcgagagcgcgcgtccgtccgggggagagacgcccgaggtcctgcgaccgcacgccgaggtcaccttcgccgccgaactcgcggcgctggccgcacaggacgaccggccgcgcccggtccggtggcggctgtcgccgtgggccgtggcgacgtatctgctgggcggcacactgccggacggcacggtcatcacaccgaagtacgtgggcccgcggcgcatcgtcgaggtcgccgtcaccaccctcgccaccgaccgggccctgctgctgctcggggtgcccggcaccgcgaagacatgggtgtccgagcatctggccgccgccgtcagcggagactccacactcctggtgcagggcacggccggcacaccggaggaggcgatccgctacggctggaactacgcgcagctgctcgcgcacggcccgagccgggacgcgctggtgccgagcccggtcatgcgggccatggccgacggaatgacggcccgcgtcgaggaactgacccgcgttccggcggacgtccaggacaccctgatcacgatcctgtcggaaaagaccctgccgatcccggagctggggcaggaggtgcaggccgtacgcggcttcaacctgatcgcgacggccaacgaccgggaccgcggggtcaatgagctgtcgagcgcgctgcgccgccgtttcaacacggtggtgctgccgctgccggagagcgccgacgccgaggtcgacatcgtctcccgccgggtggaccagatcggccgctcgctcgatctgccggccgtgcccgacggcgtcgacgagatccgccgggtcgtcacggtcttccgcgagctgcgtgacggcgtcacgaccgacgggcgtacgaagctgaagtcacccagcggcacgctctccaccgcggaggcgatctccgtcgtcaccaacgggcttgccctggccgcccacttcggtgacggcgtgctgcgcgcgagcgatgtcgccgcgggcatcctcggcgccgtcgtccgcgacccggcggccgaccgcgtgatctggcaggagtacctggaggcggtcgtccgcgagcgcgacgggtggatggacttctaccgggcgtgccgggaggtgagcgca

SEQ ID NO: 3445 - DNA, 1212 bp, Streptomyces avermitilis
  CDS (1)..(1212)
gtgtggggactgtgcaagggcagtggcagcaagccgtatcagacggtcgtcgacatcgcggacgccaccgggcccgcgtacaagtgcagttgcccgagccgcaagttcccgtgcaagcacgcgctggggctgctgctgctctgggcgggcgaggacggtgcggtgccgctggggcaggcgccggactgggcggagcagtggacaagggggcgcaagcagcgcgcggaggagaaacggacggcaagcacggcgggttccgcgtccggtgatccggaggcggcgcggcgcagggcggagcgccgggccgagcggatcacggcgggtgcggcggagctggagcagcggctggccgatctgctgcgcggcggcctggccgcggccgagcgggaggggtacgggctgtgggaggagacggcggcccgcatggtggacgcgcaggctccgggactggccgcgcgggtgcgggagttgggggcgatcccgtcgtccggtccgggctggccggtccgtctgctggaggagtgtgccctgctccacctcctcgaccagggctggctgcgccgcgaggatctgccggacgggctcgcggcgaccgtccgttcccggatcggcctgcccggctcgcccgacggcccgccggtgcgcgaccgctggctggtcctggcccagtacgacacgtcggacagccggctcaccactcgccggatctggctccacggcgaggcgtccgggcgcacgccgctgctcctctcctacggggcggcggggcgcgcaccggagttgacgcttccggtgggcctggccgtcgaggcggaagtgtccgcgtacccgggtgcgggtcagctgcgggcggccctgggcgagcagttcacaccgcccgcccccgcctcgacacggccaccgggcatcagcccggccgaggcggcggcccgctacggccgggcgctcagggacgacccgtggctggactcgttcccggtgacgctgggccgcgtcgtaccgaccccggcggacgacacctggcagctggccgacgcgtacggcgacctggccctccccctcacgccggcggcccgctcccgcccgggcctgtggcgcctgatcgccctctcgggcggtgccccggtcacggtcttcggcgagtgcggccaccggggcttcactcccctgacggcctggccggaggagacgggagaggcggtggcgctgtgc

SEQ ID NO: 3446 - DNA, 1638 bp, Streptomyces avermitilis
  CDS (1)..(1638)
atgagcacatcacccgcgcccgcccccacgcccggcagcccggccgcgccctccgtcgcgccctgggaagagctggtgactgtcgcgctgctcgggacggaccggcggacgccaccggggccggcgtccggtcgggaggcaccggcggcgctgctggacatcgcggccgtggagaccgtacggcgaagggccgggctgcgtcccgcgcgggcggcggcacggccggagcctgcggcggcggatccgcgtccgcagctgccgcccgctgcggcgcgccggctgtcgatgctgctggcggaccggcccggcacgggcggcggcggccgcagaggggctgcgcccgacctcatggaactgctgccgcagtggctctccctggcgaacgcgcgcggtttcgccgcacccccgcagaccttgcccacgctgctggacgcggccaggggacgtacggatctgcgcccggcggtcctggccttcgcgggcccgcgcgcgctgtggctggcccggctgaacccggactggcgcttcgcgctgcgcgccgcgccgggcggcggcgccgagctgccgctcccgcaggagtcggaccgcatacgacagctctggcaggaaggcctgttcgcggaacgggtggcgctgctcaccaccctccgggcgcagagccccgaaaccgcccgtgagctgctcgccacgacgtgggcgacggagcgggccgaggaccggctgatgttcctcgactcactccgggcgggcctggcggccgcggacgagccgttcctggagcagtcgctctccgatcggagccgcaatgtgcgggccacggcggcggagctgctgtcggcgctgccggaatcggcgctggccggacggatggcggaccgcgcgggctcctgcgtggcggtggaccgtacgcgtcgggtgccgacgctggtggtcgaggcaccgcacgagtgcgacgcgggcatggagcgcgacggcgtggtggccaaggcgccggcgggacggggtgagcggtcgtggtggctgggccagctggtggaggcggcaccgctcgggacgtggcagaaccggctcggggggcgtacgccggaggaggtggtcgcgttgccggtggcggacgactggcggagcgagctccacgcggcgtggtgccgggcggcggtacggcagcgggacccccgctggtccagggcgctgctggggtcgccgtcggccccggaggccggagggccgggggcggtgtcgctggcggagcgggcgaagctgctggcgacgctgggtgccgcggagcgggcggactgggtcgcggggttcgtcgccacgcacgggctgtcggaggcgtttcagctgctcggggtgtgtgcggtgccgtgggcggcgccgctggggcgggcagtggtagacgcgctgaacatcgcccgggacgcggggagttatccgtggagcttcagcggggtgatggggctggcggaacgctgcctcgatcctgcggaggccggccgcctcgacgccctgacggccgtacccgacgaaccggaggacgcgtctccgggggcgggtggttactgggcggaggccttccagcgcctcacgaccacgttgcgcctgcgggcggcgatgcgggaggagctggagggccca

SEQ ID NO: 3447 - DNA, 414 bp, Streptomyces avermitilis
  CDS (1)..(414)
atgggtgtggcagccggtccgatccgcgtggtggtggccaagccggggctcgatggccacgatcgcggggccaaggtgatcgcgcgggcgctgcgcgatgccggtatggaggtcatttacacggggctgcaccagacgccggagcagatcgtgggcacggccatccaggaggacgccgacgcgatcgggctgtcgatcctgtccggggcgcacaacacgttgttcgcggcggtcatcgatctgctcaaggagcgcgatgccgaggacatcaaggtgttcggtggcggcatcatccccgaggcggacatcgcgccgctgaaggagaagggtgtcgcggagatcttcactccgggggcgaccacggcgtcgatcgtggagtgggtgcgggcgaacgtgcggcagcctgccggggcg

SEQ ID NO: 3448 - DNA, 858 bp, Streptomyces avermitilis
  CDS (1)..(858)
atgaaggtcaccggggcagtgcagccctttctgccactctgccgatgtctgttccccagcaaactggccggactctccgtggccctcctgaaggcgaccgccctggagatcgcgatcctcgcgggccacctcatcctctatccctccgggatcgcacaggagcgccgcgccggaccgcccccgcttccggcggagaccgcaccgctgcccaccgaggccaagcccccggtcgtcctcctccatggcttcatagacaaccgctcggtcttcgtcctgctgcgccgttccctcacccagcacggcaggcagcagatcgagtcgctcaactactcaccgctgacgtgcgacatccgtaccgccgccgagctgctcggccggcacatagaggtgatctgcgagcgcacgggacacgcacgggtcgacatcgtcgggcacagcctcggcggactgatcgcgcggtactacgtgcagtgcctcggcggcgacatccgcgtccgcacgctcgtcacgctgggcaccccgcactccggcacccgggtcgcgccgctggcgaacgcgcacccgatcgtccgtcagatgcgcccgggttccgaggtgatcgaggagctccagcggcccgcaccgggctgccgtacgcacttcgtcagcttctggagcgatctggaccacctgatggatccgctggagacggcctgcgtcgagcaccccgacctgatggtgcagaacgtgcgggtcagcggtatcggacatctcgcactgcccgtgcaccccgccgtggcgaccgggatacggcaggcactcgactccgagggcacgggagccgaagccgccccccgcaccgacggcctgacggtggcg

SEQ ID NO: 3449 - DNA, 1596 bp, Streptomyces avermitilis
  CDS (1)..(1596)
gtgaacgaccgtcacccgtcggggaccgttactcccccggctccggcttccgatgccgcttcggcgcactacgcggcatatggcgggcagggtggccagtacggcgagttcactacgtacgccgacggctccgccaacggtttcgcgaccggcggccatcagatggcgagcttcgcgaccgaccccctcttcggcgatatgccgggtgacggcaccaccggctcgtacgacgccacgcagtggtccaccggcagccacgaaacgctcggcaccggtacccatcagacgctgaactacgacgcgtacgcggctcagcatcaggccgcgtacgacacgggcgcctatgacgcgaccgcgtgggcgaccggctaccagcagctcgccgacattccctcgcagcacccgggccccgacgcctcgggccagtgggacgccggctcctggcaccacggcgaccagaccgctccggccgaccggacccagcagtgggaatggggcacgcaggccttcgacacgggtgcgtacgacgccacgcagtggaactcggacggcacggccgcgcacgagacgcaggaccagtcggccccggaaccgttcgaccagcaggccacggcgacgttcgagcaggtcacgcaggaaccgttcgatcagcaggccacggcgacgttcgagcaggtcaccccggaaccgttcgaccagcaggccacggcgacgttcgagcagatctctcccgagcacgaagaactcggcgaacacggcgaacacggcgtcgaggcccccggagacattccgctcctcgacgaccaggaggaggtcactccggttccgggttcccgcgccgcgtcgcgcaccgcctcccgttcccgccgccgcattccggccaggcgctccgcgctgctgaccgtcgccgtgccgtcggcctgtgtgatgggggtcgccgggatcgccgccgcgtccgtcggcgtcggcagcagcgacagcaaggacgcgcacacgacggccagcgccgccgacgcgatcgctgtgaagccgtccgccgcgaacaacaagctcgacacccagatcgagagcctctccgcgggcgcggacgacttcgccgaccgggctagccgaacgcaggaacgtatcgacctcaaggcccagcaggccgccgagaagcagaaggcggcggcggaggcggcccgcaaggagcggctgcgtccgaagttcgcgctgccggtcgcgcagaaggggctcagcgcctactacggccaggccggcatcaactggatgtccgtacacaccggcatcgacttccccgtctcgtacggcaccaccgtgctggccgcgaccgacggaaccgtgcggacgcagtggaacagcgcgtacgggaacatggcgatagtgacggccaaggacggtacggagacctggtactgccacctgtccacgtacaaggtggcgtccggtacgaccgtgaaggccggcgacccgatcgcgttctccgggaactccggcaactcgaccggaccgcacctgcacttcgaggtccgcccggccgggggctcggcgatcgacccgctgccgtggcttcggagccatggcctggacccgacg

SEQ ID NO: 3450 - DNA, 2583 bp, Streptomyces avermitilis
  CDS (1)..(2583)
atgagcagcctctttgatgacagcttcctggcggacctcaagccctcgcgggcccacgaggaggagcccccgccgccgcccgaggacgatcacgtaccggagtcggttccggacgatctgttcggcgggaagttcgacgtgccgccggaccgggacacgtactaccgcgacggagccccccgccccgccgtggacccggccacgctcctgcacgggctgaacgagaaccagcgcgcggccgtggtgcacgccggttcccccctgctcatcgtggccggtgccggctccggcaagacgcgcgtgctcacgcaccggatcgcgcacctgctgggtgagcgccatgtgcaccccggccagatcctcgcgatcaccttcaccaacaaggccgcgggcgagatgaaggagcgcgtcgagcagctggtcggcccgcgcgccaacgcgatgtgggtgatgacgttccacagcgcgtgcgtgcgcatcctgaggcgtgaatcgaagaggctcgggttcacctcctccttctcgatctacgacgccgccgacagcaagcgtctgatggccctggtctgccgcgacctggacctcgaccccaagcgcttcccgccgaagtccttcagcgccaagatctcgaacctgaagaacgagctgatcgacgaggaggacttcgccgcccaggccgcagacggcttcgagaagaccctcgcccaggcgtacgccatgtaccagtcgcggctgcgtgaggccaacgcgctcgacttcgacgacctgatcatgacgacggtcaacctgctgcgggccttcccggacgtcgccgagcactaccgccgccgtttccgccacgtcctcgtcgacgagtaccaggacacgaaccacgcgcagtacgccctggtcagggagctggtcggggttccgggaccgggtggcggcgcccgcccggaggacgagccgccccgcgaggacgacctcgagcccgccgagctgtgcgtcgtgggtgacgccgaccagtcgatctacgccttccgcggcgcgaccatccgcaacatcctccagttcgaggaggactacccggacgcgacgacgatcctcctggagcagaactaccgctccacccagacgatcctcagcgcggccaacgcggtcatcgagcgcaacgagtcccgtcgccccaagaacctgtggaccaacgcgggcgccggcgcgcagatcaccggctatgtcgccgacaccgagcacgacgaggcgcagttcgtcgccgacgagatagaccggctgacggacgcgggcgaggcaaaggcaggagacgtcgccgtcttctaccggacgaacgcgcagtcccgtgtcttcgaagagatcttcatccgcgtcggcctgccctacaaggtcgtcggcggtgtccgcttctacgagcgcaaggaggtccgggacgtcctggcctacttgcgggtcctgtccaacccggaggactcggtcccgctgcgccgcatcctgaacgtgcccaagcgcggcatcggcgaccgcgcggaagcgatgatcgacgccctctcccagcgcgagaagatcagcttcgcgcaggcgctgcgccgcgtcgacgaggcgtacgggatggcggcccgctccacgaacgccgtcaagcggttcaacacgctgatggaggacctgcggacgatcgccgagtcgggcgcgggcccggcgacggtcctggaggccgtgctcgaacgcaccggctacctggcggagttgcaggcgtcgacggacccgcaggacgagacccgcatcgagaaccttcaggaactcgccgctgtggcgctggagttcgagcaggagtccggggcaggggaggaggccgcgacaggcgatgcggcgggcgacgcggcaggcgacgcggcaggcgacgcgccgggtggtgcgccgggcgcggcgtcaggtgatctctcggcgttcctcgagcgggtcgcgctcgtcgccgactccgaccagatcccggacgaggaggacggcaacggagtcatcaccctgatgaccctgcacaccgccaagggcctcgaattcccggtcgtcttcctcaccggcatggaggacggcgtcttcccgcacatgcggtcgctcggccagaccaaggaactggaggaggagcggcgcctcgcgtacgtcggcatcacccgcgcgcgggagcggctgtacctcacccgttcgtccctgcgcagcgcgtggggccagccctcgtacaacccgccgtcccgcttcctggaggagatcccggacgcgcatctggagtggaagcggaagggggcgtccgctgctccgctgtcttcggggccggcctcgggcgtggcggcctcgctgtcgtcgtcgcgctcgcgctccgcggtctcgggggcgtccggcttcgccacgcgccggggcggtgcgtccgagaagccggtggcctcactggcggtcggggaccgggtcacgcacgaccagttcggcctcggcacggtggtcggcgtgaagggcacgggcgggaacgcggaggcgacgatcgacttcggcgacacgaagccgaagcggctgctgctccggtatgcgccggtggagaagctt

SEQ ID NO: 3451 - DNA, 1194 bp, Streptomyces avermitilis
  CDS (1)..(1194)
atggcgccgcaccgaaagccgcgtcccgccggcacgcgcatggcaggcatacggaccccgggcctggcgacggcggctctgacctccgtggccctgctctcccagacggccaacgccgcgcccccggccgacgacaagccgagtctcgaagaagtcgagaagaaggtcgacgacctctaccgccaggccgagtcggccacggagaagtacaacgcggccaaggagaagaccaccaagcagcgcacgcgcgtcggcaccctcctcgacgaggtcgcgcagcgcacccagaagctcaacgacgcgcgggagcggctcggctcgttcgcggcggcgcagtaccggaccggggcctccgcacccgacaccacgaccttcctgctggccgacagtcctcaggactatttcgaccagacccagttgatgagtcggctgaccgaccaccagaaggacgccgtcgacgcctacgtcaccgagcaggccgcgacgacgacgaagcgacaggaggcgtcccagagcctggagaccctcaccgagtcgcagagtgcgctcaagacggccaaggcgaccgtccagcacaagctcgccacggcgcgcgagctgctgtcgaagctgaccgccgaggagaaggcgcggctcgcggcgatcgagaaggagaagcgggccgcggccgaccgcaaggcggaggaactggcgcggcagcaggccgcggccgcgcaacagaccgcccagcaggacccggcgtccggaaccggcagcacgtccggcgccaccggcgccacgggctccacggggtccacggggtccacggggtccacggggtctgccggatcgtcgtactcgaccaaggctggcaaggccctcgccttcgcccgcgcgcagatcggcaagccgtatgtctggggcgccaccggtcccggctcgtacgactgctcggggttcacccaggcggtgtggaaggccgccggcgtcacgcttccacgcaccacctatgaccaggtgaacgcgggcacgacggtctccctctcgaacatccagccgggcgacctggtcttcttctacgacgacatcagccacgtcggcctctacatcggcaacggcatgatgatccacgccccgaagccgggcgcgtacgtccgcgaggagtcgatcttctacgacggcgagtcggcgatccacagcgtggtgcggccggcc

SEQ ID NO: 3452 - DNA, 1023 bp, Streptomyces avermitilis
  CDS (1)..(1023)
gtgcgccacgcgcgcgtgccccgtaccgccatgcgcgcgtacgtccctagcatcgggcccatgccaggcacccctcagccccgcacctggtgggcgccgctcccgcccgccgacggagccgccgtgatggcgaccggcgtcgtgtcggtcggactgcatctgaccggacacgaggtcctgtcccgcatcgcgctggtggcggccggagcggcctggctcgcgctcgccgcggacttcaccgtacggctgcttcgcgagcgggaacggtgggcggccgaggcggggacaccggccgcgctcaccgccgtggccgcgaccgccgtcctcgggacccggttgtccgcgctggggtggcagggcctggccgaggcgctgctggccctggccgccgcactgtggccggggctgctcttccttgtcgtacggcgctgggaacggcacatgcccggggtggtgctcctggcgtgtgtggccacgcaggggctcgccctgctcggcgcgacgttggcggccgacctgggggtggcgtggctcgcgcacacggcgctggtgttcttctggctggggctcgtcctgtacgccgtcgccctgtggcgcttcgacctgcggcaggtcgccgaaggcgccggagaccactggatcgcgggcggtgcgctcgccctctccgcgctggccggcgcacagctcgtcgcggcccgccgcagcggcggcccctacctctggaacgacgacgacaacggcgtgctgcggaccgtgacggccgcgctgctcgtgctcgccctcggctggtactgcgtgctgtgggcggccgagctgcggtggccgcggccggcgtacgacgtccggcgctgggcgacggtcttcccgatggcgatgacggcggtggcggtgctgtccgtcgccatcgtgctcggcgtcccttggctgtgggggcctgggcaggtcctgctgtggatcgcggtggcggtgtggccggccgtctgcgcggccgccgtcgtggacatcaggtccagagcaccgcga

SEQ ID NO: 3453 - DNA, 351 bp, Streptomyces avermitilis
  CDS (1)..(351)
atggacgtactcatccatctcttcgtcggcctgcacatcatcggcatcgccgcgctcctcggcggtttcctcacccagatgaaggcgatgggccggggcacggcccgcttcgttcccgggatgctgcacggcgcgctgaccatgctggtcacgggcgtcgccctggtgggcctcaaccaggcggacgaccactcggtcaacaccatcaagatcggcgtgaaactggcgctgctgatcgtcatcctcggcctggtctacgtgaagcgcgacgaggagcaggtcgacaaggggctgttcggcctggtcggcctgctgaccacggcgaacatcttcatcgcggtgctctggacc

SEQ ID NO: 3454 - DNA, 1074 bp, Streptomyces avermitilis
  CDS (1)..(1074)
atgtgggccctcgtggcagcacaccgcaagcccagacagcgctccctcggcggtcatacggcccgtaccgccgtcacggtcgccctcgcgggtgcggcgaccgcgaccgcgttcgacgggaccgggcacgccgagccgcagctgtctccggcacaggtcaaggccgaggcggacaagctgtacgagcaggcggaggccgccaccgagaagtacaacgggacgaaggagaaggccgacaaggcggagcggcggctcaatgcgctgcgcgacgaggcggcacggcggacggaacggctcaactcggcccgggacgcactgggttcggtggcggccgcgcagtaccgctcgggcggcctcgaccccgcggtgcagctgatgctctcctccgacccgaagcagtacctggacggggccgcggtcgccgagcgggccgggagccggcaggccacggccgtggagcgcgtacggaagcagctgcgggagatcgaacagctgcgcggggcggcgcaggtcgagctggcctcgctgaagtcccggcagacggagctgaagcggcagcggaagacggtcacgacgaagctgaccgaggctcggcggctgctgtcccggctgacggacgcgcagcgggcgcagctggacacggcggggggcgccgggcatgcctcgcgctcggcggcgcgggacctggggccggcctccttgtcggccgcgaccgccgaggcgcccaactcacggtcggcggccgcggtctcctacgcgtacgcgaagctcggcagcccctatgtctggggcgcgaccggccccgacgcgttcgactgctcgggcctggcgcaggcggcgtaccgctcggccggtatctcgctgccgcgcacgacctacgcccagatcgacacgggccgccgcgtctcccgctccgaactcctccccggtgacctggtgttcttctactccgggatcagtcacgtcgggatctatgtggggcacggacagatgatccacgcgccgaatccgaccgcaccggtacggctggcgccgatcgacgagatgccgttcgcgggggccactcgggtggtg

SEQ ID NO: 3455 - DNA, 780 bp, Streptomyces avermitilis
  CDS (1)..(780)
gtgctccgtccgttgccgccgcggcctcgccccccgcggtgcccgcccgggaaggccccgatgccccgctccacgctgcctcctccgccgccgcccgcgcatctgcggacctggccggaccgttcggcgctgctggccgaccggtggcgggcgctggaggagctgcgcagacggagtcttggggtgcaccgggtgctgctgctctggctgctggcggtcacggcgatcatcggctgggcgctgctcgtcctgccgttgcagcagatcgagcaggaggaccccaccagcctcgtcctcggcccgctcttcgccattctgggcctcgcggcgctcaccccctcgctcgtcacggtcagcctcgccgtccgccgcgacggccggatacaccaacttctggacgactggctccggctggacagccacccgccgacggacgcccgtctccgcgcccccggcctcagcctcttctggctgctctcctcactctgcgtctgcgcgatcggcctgtggtcgtcgttcgcggcgacggccgacgccaagcccggtgggggcacctacggcgatgtcgccctggggatgggtatcggcctgatcctgtggctgaccggcctcatcggcgtgggcaaggccgtacgtcattaccggtgggcggtacgggcgttgcggccgcggccgggggtgcggtcaggggcggagccggctcccgggttgggggcggcaccggggccgggggcagcacccggggccggaccggcgtcgggggaagcgtcgaacggtcgg

SEQ ID NO: 3456 - DNA, 171 bp, Streptomyces avermitilis
  CDS (1)..(171)
atgcgggcgggggagtggcggggcagggacagagccggcgcatccgctgtcctggcaccgcaggcggccgggccgccggggctgccgcccggctgcgtcgcgtcaccggacacggccggggcccccgctgagggagtgacggcgatcggcgaggcgctgcgggaggtcggc

SEQ ID NO: 3457 - DNA, 729 bp, Streptomyces avermitilis
  CDS (1)..(729)
atgagtgacgcgaaggagccgagcgggtcggccgagccgaacggcggcgtgaccggagcggacgcccccgggcggcatgtgcgggtcgtactcgtggacgaccaccgcatgttccggacgggggtgcaggccgagatcgggcagaccgagcgcaccggcgtcgaggtggtcggcgaggccgcggacgtcgaccaggcgatcacggtcatcacggccacgcgccccgaggtggtcctcctcgacgtccatctgccgggcggcggcggggtcgaagtcctgcgccgctgcgcgccgttgatggccgacgcggagcagccggtccgtttcctcgccctgtccgtctcggacgcggcggaggatgtgatcggcgtcatccgcggcggggcccgcggttatgtcaccaagaccatcacgggcacggacctggtcaactccgtcttccgcgttcaggagggcgacgcggtcttctccccgcgcctggccggcttcgtcctcgacgccttcgcctcgaccgacgccccaccggtcgacgaggacctggaccgcctcacccagcgcgagcgcgaggtcctgcgcctgatcgcccgcggctacgcgtacaaggagatcgccaagcagctgttcatctccgtcaagacggtcgagtcccatgtctcggcggtgctgaggaagctccagctgtcgaaccgtcacgagctgaccagatgggccacggcccgccgactggtc

SEQ ID NO: 3458 - DNA, 1287 bp, Streptomyces avermitilis
  CDS (1)..(1287)
atgccggacgccgcagcagtgccactcgccgacccgcggctcccgcgcaagctctaccgcagcagtgacggacgctggctcgggggcgtggcgcgggggctcgccgggcatctcggtctgcccgtgatctgggtgcggctcgtgttcgtcggcctgttcatggcggacgggctgggcgcgctgctgtacgccgcgttctggttcttcgtgccgctcggcgtgggcggcgtcgacgcccagcgcccgcctgccctcaccaccgagaccgccgcggacggccgtcgcagactcgtcgcccgcaagcccgacaagggacagatcgccgctctgctcctcatggtcgtcgtggcgatggtcttcgtcggcaaggtgaatctcggcggcggagccaaggcgtatctctggcccaccgtgctcgtcggcgcgggagtcgccctggtctggcgccaggcggacaacgcacggcgggcccgctgggtggaggtcggccgccgccggcgcacactcacgctgctgcggtccgcggccggtgtcctgctggtcaccgccggtgtctccggcatcttcgtcctacagggctccgctgcccacctcggctcggtgctccaggcggcgctcgcggtcctggtcggcatagcgctcctggccggcccctacctcgtacgcatgacacaggacctctccgaggagcgcctgatgcgtatccgcgcccaggagcgcgcggaggtcgccgcccacgtccacgactcggtgctgcacaccctgaccctgatccagcgcaacgcggagagtgcgaacgaggtgcggcgcctcgcccgtgcccaggagcgcgacctgcgcgcctggctctacaagcccgagggaaccggcaaggacgaggccgacgagccggacaccctcgccgaggcggtccggcgcaacgcggcggaggtggaggacaagcacggtgtccccatcgaggtcgtcatagtcggcgactgcccgctcgacgagggcctgaccgcacagatgcaggccgcgcgggaagcaatggtgaacgccgccaagtacggtggcgacggcggagccgtacaggtctacgccgaagtcgagggcaggacggtcttcgtgtccgttcgcgaccggggccccggcttcgacctcgacgcgatacccggcgaccgcatgggcgtcagagaatcgatcatcggccgcatggagcgcaacggcggaacggcacggctgcgtgcggtgcccgacggcggtacggaggtcgagttggagatggagagggcggagaagacgtca

SEQ ID NO: 3459 - DNA, 1434 bp, Streptomyces avermitilis
  CDS (1)..(1434)
atgacagatcagcagcacgcggcaccggagccgggccccggtccgggccccggcaccggccgtggtccggagcccggcgcggaccacggcgcccgaccaccggcggccgagccacgggacgccgcgccgtccgccggcccgtcaggtgacgctgccgcgtccgaggcgacggccccgacggccccgcccaggttccgccgcgaccggcggcacagaatgctggggggtgtgtgcgcggggctggggcggcagtgcgacatggatccggtgatcttccggatcgtgctcgcggtgctctccgcgaccggcggcctcggccttatcttctacggcttcgtctggctcttcgtcccgtacgacgacgaggaggagaacgaggtgcgcaagctgctgaccggccgcgtcgacggccccgcgctggccgccgtcctcttcgccctggtcggctgcggcgtcttcctctccatgctcaacaacggcggggtgctcaccttcgcggcggtcctctccctgctcctcgcgggcgcggggtactggtcgcagcggcgcggcgcccccgatcccgacccgctggccgcccaggccgtggccgatgccccgccggaggccaaggcaccacccgtgcccgcctcctacccctcctggtggcgcgacccgatcgtcaaggacggcacgcatgtgggtggcacgggctatctgtgggggcccatggacgcccgggaccgggacgtctcggcggcggtcaacatcgcccgcggcacctcgttccgccaggacatacgcacggcgcgcgagccgaagccgcgtggtccgcgctggatcggcggctgggtgttcctgttcgccctgctggcgggagccctcggcaccgggctgacatgggacgaccacgctctcggcaccagtctccagaccggcctggcgtgcgcgctggccgtgttcggcacaggcatcgcgatcagcgcgttcctggggcgcacgggcgcgggctcactcttcctggcggtgatcacggcgggtctgctcgcggcgtccgcggccctaccgaaggacatcagcacgcactgggtgcggacgaactggacaccggcgtcggcgtcggccgtgcagccgaggtacgagctcggcacgggcgagggcaccttggatctgacccgtctgcgtctcgccaaggaccagacggtgacgacgggggcgcaggtcggggccggccggctcagggtcgtgctgcccgccgacgtgacggcagaagtggacatccgggcgggcatcggcgacatccagttgccgggcgacggaaagcaggacgtggacgtggagccgggcaagcagcagcaagtgacgctcaccccgtccggcacgaagaacggcggcacgctgaacctcgacctcgaagtcggcgtgggacaggtggaggtaactcgtgctgcgtca

SEQ ID NO: 3460 - DNA, 258 bp, Streptomyces avermitilis
  CDS (1)..(258)
gtgctgcgtcatgaattccagccaggaaagctgatagcgggcttgttcctcaccgtcgcgggcgtcgccttcgccggcgatgcgggcggctcatgggagacgccgtggttcgcgatcatcccgatggtcacgggcggcctctgcctggcgggtgcggcggcgttcctgacgcacgcgatacgccaacggcgcgcaggccacgaccatgcttctcccgagccggagggggcgtggccgtcggaccggccgtcgggggga

SEQ ID NO: 3461 - DNA, 516 bp, Streptomyces avermitilis
  CDS (1)..(516)
atgcgcaccgacacccaaagcccctacctcgaaggcgaccgggactggcgggacaccgccacccgatacgcgctgctgcctctgcgggtcttcctcggcgtcaccttcatctacgcgggcctggacaagctcaccaacagcgcgttcatgtccgagtccggcgcaggctcgatcggcgacatgatgcgcacggtgcgcgactcctcggcgatcccggcccttgtcgacctcgcgctgaagaaccccgtcggcttcggctacgccatagctctaggtgaactggccgtcggtatcggcaccctcatcggcctgctgacccgcctcgccgcgctcggcggggccctgatctccctcagtctctggctgaccgtgagctgggcctccgacccctactactacggcaacgacctcgcctatctcatggcctggctccccctggttctcgccggcgcctccgtgttctccctggacgcggccctgcgcgcacgacgcaggcaacgcggggccggctaccgc

SEQ ID NO: 3462 - DNA, 1287 bp, Streptomyces avermitilis
  CDS (1)..(1287)
gtggcggtgcaggaggcgaggcagggcgcggggcgtggaaccgggcccggtgcgcatgagggcgggtgcacctgcggggactgtccgcacggcgcgcgcgagggacatcggcgtgcggtggccgcgttcctctccaggcgggacgagttcgcgtcggggcaggggctgccggcggcggtcgcgtactccgcgtcggcctcgcggcagtgggtgtcggacgaactgacccagtccgcggacctcgtcgccgagcgagggcgggtcgagggcgaggcctggctgggccggctgtggcggcatacggcgttcgtggtctggggcgtggtcggggcgctgctcctggcacaggcgctgaccgccatcggtgcggggtggacggtggcgcggactgccgggctgctcgccgcggtggtggtgggcgggtcgctcaccggcgcgggctatctgcaccgggcgcgcggcggagccctggcgccggtcatcggcgaggacaaccggctctccacctcccgtgcggtcgcggcgagttgggtgctgttcgtggtgtacgcggtgctcgtgctggtggggcagctggcggccgcgtccgggcccggtgaacgggacgcgctgatcgccgggctcgaactcgcccgcggagtgggcgtggtgaccgtggtcgccgtggcctgcggcatcgcggtgctggtgcggcgggtggtgggcctgcgggtgctggggcagcggctccagaaggtacgcgccgaccgcccgcgcggagcggatctgctcacggacgactcggggcgggggagcttcgcggacatccagtacgtggtggtgggcgcggtggctctcgccttcgccgcggtacggctggcccggcgtcccgaccaactccccgatctgccgtgggggctggcgctgctggtgctcgtgtccgccgcgacgtatctcgccgggaagtacgcggagggcgggcgtccggtggtcctgtccgtcgtgcgggcccgggaggcgggggatctggacgcgccgatccggaccggcgacgacatcgagatccggggcgcgggcttcgtgccgccgggggcgcagacggcggaccggttgtcgcggatggtggtgcggatcggggcggtgcatgtgcatgtgccactggtgccggtggcggggggcttcagcaacccgacggatgcggtactgacggtgccggtgccggcggatgtggagccggggcgcgtggaggtgcaggtgatcacggcggcgggggtcgaaacgaatcgggtgacgatcgacgtgacggac

SEQ ID NO: 3463 - DNA, 876 bp, Streptomyces avermitilis
  CDS (1)..(876)
atggccgagatcatccagcgcgacgggagctgggccttcgacggcagtacggtccggatcacgccgggactgcaccgctccgtgccgttgttccggcagacgtacggggaggtcaccgtccccctggaggcgatctccggcatcgtctacgagcccgaacgcaagcgcggcaggctgcggctgaggctgcgcgagggcgccgatccgctgctccaggcgaccggcggacgcctgccggacgccgccgacccctaccggctggccgtggacatcgaccgctcgggggtcgccgagtacgtcgccgaggagatccggcactcgctcctgctcgagcagattccccaggagccgacgaaggcctacctcctgtccggcccacccgtcccggtctccgtccgttcgagtgacggcacggtctccttcgacggcgccgaagtgcggatcgactggagtgacacctccgaacggatcaagcgggcgacgggtccgcggatcatcgcggtcggcgatctggtgcaggtcgagtggctgcccaactccggttacgaggacggcttcctgcgcttcgtgacccgtgagaccgtcttctccaagctgccgccggagaaggacccgtacgccctcgatctgtggggcagcgcccggcgcgatctgctgacggccctcgtcgccgccgcggtcaccgcccggctgccgcacccctcgacccgcctcgccgacttcgtggagcgcccgcggctcgccaccgccgtaccacccgcggccgaccacgacgtactcctgcgccgcctcagggatctgggcgagctgcaccgcgagggcgtgctgacggacgaggagttcgccgcggccaaggcagccgtcctccggggcttc

SEQ ID NO: 3464 - DNA, 819 bp, Streptomyces avermitilis
  CDS (1)..(819)
gtgacggaactcaggcctggaggaccgatgtacgggcccacaccacccctgcccctgcccaccgaccggctgcagttcgccatgccgccgatgtacgagtcactggacgacgagcgcacgcatcgcaaggaacggctggccggcgccctgcggctcttcgggcggctcggattcgaggacggggtctccggccacatcaccgcgcgcgatcccgagtacagcgactgcttctgggtcaacccgttcggaatgccgttcaagcatgtgaccgtgagtgatcttgtgatggtgaacgcctcggggcaggtgatcgagggccgctaccacgtcaaccaggcggcattcaccgtgcacgcccaggtgcatgccgcccgccccgacgtcgtggccgtcgcccactgccactccgtgcacgggcgcgccctgtccgcgctcggcgacctgctggacccgatcacccaggagagctgcgccttctacgaggaccacgcgctgtacgacgcgtacacgggggtcgcggtggacgccgaggaaggccgccggatcgcctccgcgctcgacacccgcaaggcgctggtgctgcgcaaccacgggctgctgacggtcggcgactcggtggacgcggcggcctggtggttcgtgtcgatggaacggtcctgccaggtgcagctgaccgcgagggcggcgggccggccggtcctgatcgaccacaagcaggcggtggcgacccgcgagcagctcggcggggatctggtggcgtggatcaactaccagccgctgtggcaggacatcagccggagcgagccggacctgctgagc

SEQ ID NO: 3465 - DNA, 474 bp, Streptomyces avermitilis
  CDS (1)..(474)
atgacacagacgaactgggcggctttcaccacggcggaacccgggctcgcgaatatcgccgaggagcgtttcgggggcttcgcccatcacgtcctggcgaccctgcgcaaggacggctcgccccgcacgaccggcctcgaagtccgcttcctgcacggcgaactgtggctcggcatgatgccggactcgctgaaggcgctcgacctgcgccgcgacccgcgcttcgcgctccaggcgaaccccggggagggggccgggacggggggcggggacgtacggatcagcgggcgggcgatcgaggtcgaggacccggcgacgaaggccgcgtatgggaaagaggtggaaccgccggagccgttccacctcttccgcaccgagctgacggaggtcgtacggacctacgtcgaggacgacatgtatctggtcgtcgagatctggcggcctggcgcgccggtgcgcacgctcaggcggacg

SEQ ID NO: 3466 - DNA, 1575 bp, Streptomyces avermitilis
  CDS (1)..(1575)
gtgccatcagcaccctccgccgccgcccccgacaccgttctggtcgtcgacttcggcgcacagtacgcccagctcatcgcccgccgcgtccgcgaggcccgggtctacagcgagatcgtgccgagcaccatgccggtcgcggagatgctcgccaagaacccggcggcgatcatcctctccggcggcccctcgtcggtgtacgcggagggcgccccccgcctcgaccgcgagatcttcgaggccggcgtcccggtcttcggcatgtgctacggcttccagctgatggccacgaccctcggcggcacggtcgacaacaccggcgcccgcgagtacggccgcacgccgctgcacgtcagcaagtccggctcgacgctcttcgagggcacccccgacgagcagccggtctggatgtcgcacggcgacgcctgctccgccgcccccgagggcttcacggtcacggcctccacggacgtcgtcccggtcgcggccttcgagaacgacgagaagcgcctgtacggcgtccagtaccaccccgaggtcatgcactccacgcacggccagcaggtgctggagcacttcctgtaccggggcgcgggcctcaccccgtcctggaccaccggcaacgtcatcgacgagcaggtggagctcatccgcgagcaggtcggcacccggcgcgccatctgcggtctgtccggcggcgtcgactccgccgtggccgccgcgctcgtacagaaggccatcggttcccagctgacctgtgtgtacgtcgaccacggtctgatgcgccagggcgagaccgagcaggtcgagaaggacttcgtggccgcgaccggcgtccagttgaaggtcgtggacgcggaggagcgtttcctcaccgcgctcaagggtgtctcggaccccgaggagaagcggaagatcatcggccgcgagttcatccgggtcttcgagcaggcgcaggcggagatcatcgcggacgagggtcccgaggtggccttcctggtccagggcaccctctacccggacgtggtcgagtccggcggcggtacgggcacggccaacatcaagtcccaccacaacgtgggcggcctgcccgaggacctcgagttcgagctcatcgagccgctgcgcaagctgttcaaggacgaggtccgcatggtcggccaggagctcggcctgccggacgagatcgtccagcgccagccgttccccggcccgggcctcggcatccgcatcgtcggcgaggtcaccaaggagcgtctggacctgctccgcgaggccgacgccatcgcccgcgaggagctgacggccgccggtctcgaccgcgagatctggcagtgcccggtggtcctgctcgcggacgtccgcagcgtcggcgtccagggcgacggccgcacctacggccacccgatcgtgctgcgcccggtgtccagcgaggacgccatgaccgccgactggtcgcgcctcccgtacgacaccctggcgaagatctccacgcggatcacgaacgaggtcgcggacgtcaaccgagtcgtcctcgacgtgacgagcaagccgccgggcaccatcgagtgggag

SEQ ID NO: 3467 - DNA, 1278 bp, Streptomyces avermitilis
  CDS (1)..(1278)
atgcgccgtcgactcatccagtccaccctcgccgtcgtgctcgtggtgatcgccgtcttcggcctgtccctcgtgatcgtcgagacgaggacgatcagcaacagcgcccaggagcgggtggactcggaggcgctgcgcctcgccagcatcgtggacagccgcatcctcgggtccgagagcgtcagcgcggacatactcaaggaccaggtcggcgcgggcgggtacgccgagatcaccatgcccggccaggccccgatcgccatcggcaccaaacccgtcggcgatgtcatccacgccaccgagaagggcgaggagggcgagacggtccgggtcgaggaaccccgctcggcggtgacccgcgaagttggccgcacgctgctgatcatcgcggcggtggcgctgctcgccgtgatcgcggcggtgctgctcgcggtgcgccaggcgaaccggctcgcctccccgctcaccgacctcgcggagaccgcggagcgcctcggctcgggcgacccccggccgcgccacaagcggtacggggtcccggagctggaccgggtcgcggacgtcctggactcctccgccgagcgcatcgcccgcatgctgaccgcggagcgccgcctggccgcggacgcctcccaccagctgcgtacgcccctcaccgcgctctccatgcgcctggaggagatcaccctcacggatgacccggacacggtgaaggaggaggcgacgatcgcgctgacgcaggtcgagcggctcacggacgtcgtggagcggctgctgaccaacgcccgcgacccgcgtaccggctccgccgtctccttcgacctcgacgaggtcatccagcagcagctcgccgagtggcgcccggcctaccgcagcgagggccgcgccgtcgtcagctccgggaagcggcacctgcgggcggtcggtacaccgggagcggtcgcccaggtcctggccgccctgatcgagaactccctcatgcacggcggcggcacggtcgccctgcgcacccgggtcaccggcaaccaggccgtcgtcgaggtcaccgacgagggccccggcgtccccgccgacctcggcgcccgcatcttcgagcgcacgatcagcggccggaactcgacgggcatcggcctcgcggtcgcccgcgacctcgcggaggccgacggcggccgcctggagatgctccaggcgcagcccccggtcttcggcctgttcctgtcccgcacccccctgaagaaggccccgcagggcgaggaggagcagggaccgacggtgcgg

SEQ ID NO: 3468 - DNA, 675 bp, Streptomyces avermitilis
  CDS (1)..(675)
atgacccgtgtactgctcgccgaggacgacgcgtccatctcggagccgctggcccgcgccctgcgccgggaaggttacgaggtcgaggtgcgcgaggacggacccaccgcactcgacgccggaatgcagggcggcgtcgacctggtcgtcctggacctcggtctgcccggcatggacggcctggaagtggcccgccggctgcgcgccgagggacacaccatcccgatcctcatcctgaccgcgcgcgccgacgaggtggacaccgtcgtcggcctcgacgcgggcgccgacgactacgtcaccaagccgttccgcctcgccgaactgctggcccgggtacgggccctgctgcggcgcggcgccgccgagccccagcagccgcccgccacgcacggcgtgcgcatcgacgtcgagtcgcaccgcgcgtggatgggggacgaggaactccagctgaccgcgaaggagttcgacctgctgcgcgtcctcgtccgggacgcgggccgggtcgtcacccgcgaccagctgatgcgcgaggtctgggacaccacctggtggtcgtccacgaagacgctggacatgcacatctcctggctgcgcaagaagctgggcgacgacgcggcgaacccccgctacatcgcgacggtgcgcggcgtgggcttccgcttcgagaagagc

SEQ ID NO: 3469 - DNA, 1494 bp, Streptomyces avermitilis
  CDS (1)..(1494)
atggcgtccagcctgacgaaggactcggtcaccccgggcacccccggttccgagaagaccttcttcggccacccccgcggactggccactctcttcatgaccgagatgtgggagcggttctcctactacggcatgagagctctgctcccgctgtacctggtggcaccgggcggcctgcacctgagcgcggccaccgcgaccgcgatctactcggtgtacgtgtcgctcgtgtacctgctcgccctcccgggcggctggttcgccgaccgtgtcctcggcccccgcaagacggtcgccgtcgcgggcctgatcatcatgctcggccacctgacgctggccctgccgacgtccggcaccttcttcgcgggcctcggcctggtcgcgatcggttccggtctgctgaaggccaacatctcgacgatggtcggccacctctacgacggcccggacgacccgcgccgcgacggtggcttcaccctcttctacatcggcatcaacctcggtgccttcgccgcgccgctgatcatcggcaccgtcggtgagaacgtgaactggcacctcggcttcgcgctcgccgcgctcggcatggcgctcggcctcgcccagtacctgctcggcagccgccacctcagcgcccgctccagcgacgtcccgacgccgctgtccgccgaggagaaggccgcgacgctgcgcaagtcggcgatgtgggcggccgtcgccgtcgtcttctacgcgatcgtcggcttctccggccactacacgctcaactggctgctggtcccgatcaccgtcgccggcctgatcatcccggtcatggtcatcgcccgcatcaagcgcgacaaggccctcgaccgcgtcgagcagtcgaagatgtccgcgtacatctggttcttcgtcgccgccgccgtcttctggatgatctacgaccagggcggctcgaccctgtcgatcttcgccgactcgtcggccgagaacaccatcttcgactggcacttcccggtctcctggtaccagtccgtgaacccggtcctgatcatggccctggccccggtgttcgcctggctgtggctggcgctgaaccgccgcggcaaggagccgagcacggcgacgaagttcgcgtccggtctgctcctgatcggtgcctcgttcttcctcttcctggcgcccctggcgatcgccgacggcggtcacaaggccgccgcgatgtggctggtcgcgatctacttcgtgcagaccgtcggtgagctgaccgtctccccggtcggcctctccgtcaccacgaagatggcgcccgcgaagtacgcctcccagatgatgggtgtctggttcctggccgtcaccgccggtgacgccacgaccggtctgctctccatcgccggcgtcgacctcaacaagacgggcatcgtcgccctgcaggccacgctcgccgcggtcgccggtgtcgcggtgtggatgtaccgcaagaaggtcaaggagctgatgggcgacgtccac

SEQ ID NO: 3470 - DNA, 627 bp, Streptomyces avermitilis
  CDS (1)..(627)
atgaacgccacagcgacccgcttcctctacctcgcccggcacggcgaggcaaccgcggacgaggacgcgggcgagctgaccgcgaacggccgccgccaggccgaactcctcggcgaccggctccgtgacgtgccgctggccgcgatccaccacggcccgctgccgcgcgcggcgcagaccgcccggctgatcggcgaccggctgaaggaggtcccggtgcgggcggccgaggcggccggggactacgtgccgtacgtgcccggccgggccgagctgcccgcggacgcggccgaccggctgctcgcgttcctggcgcccgtgacgccggacgagcgcgagcggggcgcggcgctggcgcgggcggcgcaggagcggttcaccggccccgtggcgggcgacgaggtgcgccacgaactggtcgtcacccacgccttcctcatcggctggctggtccgggccgccctcgacgccccgccctggcgctggctgggcctcaaccacggcaacgccgccctgaccgtcctccgctacacgcccggccgtccgtccgccgtgctcttcttcaacgacatggcccatctgcccgccgaactgcgctggaccggcttcccgcccgaactgcgcggg

SEQ ID NO: 3471 - DNA, 1230 bp, Streptomyces avermitilis
  CDS (1)..(1230)
atgctcggcggcgcgggcctgctgctcggggtgaccgccgggccggcccaggccgccgaggtgtcgtacgcgaccaagtgcgtcccgcccgcggcctccggcctcgaccccgtcgagggcaccacgaaggtggagatcaccgcgcccgccaccgcgaaggtcggtgacacggtcgaggtggtgtggaagttcgtccaggccgcctcgaagaacccggacatcatcgatctgccgaaggactcggtgcagccgagcggcaccctgaaggcggccggcgcgcaggccgccggcatcgcgatgcagggggcgcgccagaacccggccatccccaagggcggcgccatggtgctgtccgacatgaagggcaccctgaagctgaccacgccgggcgaggtcacgctgaccccggacgcgtacgccatcaacgccttctcgacggacaccaagtgcgcgccgacggagaccgtgaagtccgccgcgaccatcaacgtcaccgcaggcggggggagttcgtccagcgccacgcccgatccctcacagagcgcgaccggcggcagtgacacgggcggatccagcggcggccagaccgacttcacgggcaaggaggtctcggtcccgtacgcgtgcaagacgccgatcggcgacaagaacgccacctcgcccgtccagatcaacgccaagaagaacggcgggagtttcgatctgacggtccagttcaagaagtcggtgatggacagtcccgccgacatcccgaaggactccgtgaagccgtcgatggaggtcgtgctgggcggcgccgacaaggggacggtgcgggtggaggggccggcgaacgccgacgcgatcaagagcggcgaccccatcgagatcccggacctgacgggcacgtacaagccgggcgcgagtggcacctcgacgctgtccccgggtgtgctgacggtcaacgccctgggcacgaccacgacatgcaccccgacgaagacggaggtctccctgtccctggacaccaccgagcaggcgaacggcgcgtcgggcggcggctcgtcgtcgacgtccgggtccggcggtacgtcgggtggtacctcggccggcggtacctcgtccggcgggggcctcgcggagacgggtgccggtgaccatggcgcgctgaaggccctggggctggtggccggcacggtgatcctgctgggcggagcggtgttcacgttcctgccgggacggcgcgtgcgc

SEQ ID NO: 3472 - DNA, 1104 bp, Streptomyces avermitilis
  CDS (1)..(1104)
atgacggcgctggtggcggtgctcgcgctcgccctgctcccgtgggcgggggcgaccgcctcggccgcggacaatccctccgtcaggctctccacgtcccaggcggggagcggcggttcgatcaccgtgaccggcagcggctggcgcccgaaggccctgctgatggtgctgatctgcggacagtccgtgccgtcccgcggggtgatcggcggcaccaactcctgcgccaacgcggacggccgcgcggtcaccaccgacgcgaagggggcgttcagcaggaagctgccggtggccgagccgcccaagccgtgcccgtgtgtggtgcacgtcgccaccgtcaccggcgagaaggccgacgccgacgccgtcttccaggtcgcgggacatccggtacgggccctgccgaaggaggacacgagcgggcgcctgtccgtgctcaccgacacccggctggacgggtcgagcgggctgctgacctggttcggggcgccgccgtcccgcacgctcgtcctcaccgtcggcaacgtcggcacgtcccccgtcaagaacccggtcttccgcgtcggcacctcccacggggtgttcgccccccagtgggaggagcagccgtggcgtggcacggtcgcgcccggcgggaaggcccggatcaagctgccggtggaactggcggcgggcgcccacggcgactacacgatctcactggagtacggcggcaaggtgctcgccgagcagccgtggggcgtcggccgcccatggggcgtgaccctcttctggatcctgctctgcgtcgtcgtacccgcggcggtgttccgcgtcgggatggccgtggtggaccgggtacggccgcggcgccgggcaccggggcggcaccgggtcctgaaactgcccgaactcaccctgcgcctgccgaaaccgggcgcacccgctcctgagacccgcaccaccccggccctcccgtggttcaccccggacggcgatccgggcaccccggcggccggtccgctctccgcaccgcaggaggagacgagtccgacgtcttccgcagaggagacgagtccgacgtcttccgcgtctccgacgactcctacgacgaagggaaacacg

SEQ ID NO: 3473 - DNA, 1050 bp, Streptomyces avermitilis
  CDS (1)..(1050)
gtgtcccgggtcctgacgcaccggacaggccccaccaccgcgtacgacccgcaggagccgccgatgccgtacgtttcccacgtccttggccttgccgccctgaccctgctcgccgccgcaccgtccgccgcggcagccgacgcctggtccgtcgcgcccgcgacgggcggcactgccgggcggccgtacatctacgcggagggcgagagcggcaccgtcctcgaggacgccgtgtccgtgctcaacccgggcggcacaccgctcaccgtgcggctgcgcggcgccgacggccccgatggcgtacggagcgggccggtcggcacgggcgcgtggatcggtttcgcccgggcgacgggcggacacagacgtgcggcgtcggcggtgtccgtgaccgtgcccgcccgcacgcgcgccgacgtgccgttcacggtgagtgttcccccgggcacgacacccggtgaccaccccggcgcgatcgtcgcggaggcgggcggccgctccagcgccgtacgcgtccggctgcgggtcggcgggccgacgctgtccgcgctcagtgtggagcacgtctcggtgggcggcgggcggatctcgtacgagctggtcaaccgcggcaacaccgtgctcgccccgagccttgcggtgcacgtcgacggcctcttcgggccgctgctcgaccggcccgcgcacgccctgtccctcgacctgccgccgggccgccgcgtcacgctcagcgagccgtggcgggacaccccggcgctcgacgcggtccaggtgcggctcacggtgaccgcggcgggcggggcccgcgcctcggcgtccgcgtcggcccggttcgtgccgtggggcgcggtggcgggaacgggcggcgcgttcgcggccgcgggcgccggtttcgtcgtacgacgtcgcgggcgcggcccgcgggacggggacgcggccccgcggcagccatggcagccatggcggccatggcgtcgagggcgccgcccgccggacggggacgcgggggagccgccgtgtgcggaagccgagctgacgggagcggtgaag

SEQ ID NO: 3474 - DNA, 693 bp, Streptomyces avermitilis
  CDS (1)..(693)
gtgtcgtaccggacgtaccagaaacgaaccgccgcgctcgcgttcgccgcggccctggccggctcggcggtgctgatggccgcccccgccgccgtggccgacgtggtggacgtcaactaccagtgcaagacgccgatcggcgacaagagcgccgtgtcgcccatcgacatcaagagcgtcaagagcggcagcggctacaagctcaccatgtccttccagaagggcgtctcgtccagcccggtcgagctgggcaagggcgcgatgaacccgagcgccgtgatcaagctgggcggcgcggacagcggcacggtggccgtgagcggtccggccaactcggccgcgatccccgccgacacccctatcaagatcaacgacttgtcgggcacgtacacgccgaagaagaccggcaaggtcaccttcaccgcgggcgtcctcaccatcaaggcgctcggcacgacgaccacgtgcacccccggcaacaaccccaagccgtcactgaccctcgacgtcacggctgcgggcggcggcggtacgtcgggctccacacagagcggtacggacaccgggagcgggctcccgcagaccggacccgaggactccgcgatcgcgctgggcaccctcggcggcaccgtgctgctcgcgggcgcggccggagcgctgtggctgacgcgccggaaccaggcggcgcgccgc

SEQ ID NO: 3475 - DNA, 657 bp, Streptomyces avermitilis
  CDS (1)..(657)
atgagcaccacccggccttgctcgccgggcgaccgcggcccggagccgggcgccggcggcgcttccgggatgtctgcggagcgggctgcgcccgaggaggaggcggccgccatggcctccgcgtcctccacggccgccacgccctccgcgacccccgctgcctccgccgaggacgcaccctccgccgaggatgcaccccccgccgagggcgggagcgtaagcggaggcgggagcacgtcgtccgccgcggcccgccgaacccgcaaactgaacttcgacgaccagagcggtgtcgttccgctcgcccgcgacttcgcccgccaggcgctgtacgagtggggctggctgcctgccgcgaccgccgaccagcgggctgccgccgaggacgtgctgctggtcgtctccgaactcgtcaccaacgcctgtctgcatgccgagggtcccgacgacctctggatcagctgcgacaacaaggtgctgcgcatcgaggtctccgacaagggcgcgggccagcccgccccgcgcaccccgcaccgcgccggccgccccggcggccacggcatgttcatcgtgcagcggctctgcctggactggggggttgtgcggacccccggggccgcgggcaagaccgtgtgggcggaactcggcgcccccgca

SEQ ID NO: 3476 - DNA, 366 bp, Streptomyces avermitilis
  CDS (1)..(366)
atggaccgcgggacggtcggcagcgcacagtcgggccggcttcttgtcgaggtgcgggaagagggcacgagtgccgtcgtgacccccgcgggtgagctggatcaccacacctccgagctattgcgtgaaccgctcgacgattgccttggaaagggcttcgcgcgcctggtggtggactgctcgcgcctggagttctgcgactccaccgggctcaatgtgctgctcggggcccgtctgaaggccgaggccgcgggcggcggagtacatctggcggggatgctgccggtggtggcccgggtcttcgagatcaccggtgccgatgccgtcttcaccgtccacgagacgctcgaggcagccctggccgac

SEQ ID NO: 3477 - DNA, 918 bp, Streptomyces avermitilis
  CDS (1)..(918)
atgtcaccccggctcgacgaatcgcatacccagcgggcgacgtcgacacgccctccggaaaacctggagcacgcatccctcgcggagcacgacgggttccccggggagcgcgacgtactcgccggacttcccgagatccccccgtacgacgaggtggggccggtcgacgcacgagccctgtccaagacgctcttcgcgcggctggagtccctcgaagagggcacccacgaatactcgtacgtccgcaacaccctggtcgaactcaacctcgccctggtgaagttcgccgcctcccggttccgctcccgcagcgaaccgatggaagacatcatccaggtcggcacgatcggcctgatcaaggcgatcgaccgcttcgaactgagccgcggcgtcgagttccccaccttcgcgatgccgacgatcgtcggcgagatcaagcgtttcttccgtgacacgtcctggtccgtgcgcgtaccgcgccgactccaggaactccgcctcgatctcgcgaaggccggcgacgaactcgcccagcggctcgaccgcgccccgaccgtgagcgaactggccgagcggctcggcatctcgaacggcgaggtcgtcgaggggatggccgcgtccaacgcgtacacggcgtcgtcgctggacgcgcagcccgaggaggacgactccgagggcgcgctcgcggaccgcatcgggtacgaggaccacgggctcgaaggcatcgagttcgtcgagtcgttgaagccgctgatcgcccaactcccttcgcgggaccggaagatcctgtccctgcggttcgtggcgaacatgacgcagtcggagatcggcgacgagctgggcatctcgcagatgcatgtgtcccggctgctgtcccggacgctggtgcggctgcgcaagggactgacggtggaggag

SEQ ID NO: 3478 - DNA, 1647 bp, Streptomyces avermitilis
  CDS (1)..(1647)
gtgcgatgtctcaggcatgcccggcggcagagccagggggtgcgaggaggcagggggatggcacgggccgaccggggcgacggcgacggtgacgccgaggccgaggacggtagacacagcacggcgtccgacgcgcggctgacccaactgctgcgcacggacaccgcgaccgcgtatccggcgctgcgtgaactgcgcacccggcaccggcccgcggtcctcggatacgcgcgcctgtgcacggtggacgacgcggcggcacgccggctcacggcgcaggcgttcgcgctcgccgcccgcgacacagcccgcggctccgacccgcgcgggccctggcgacaccaactcctgctgctggcgggccgcgtggccgcgtcctgggcggcggacgagcgggccgcccgcctcgacccggacctgctcgcacacctcggtgcggcgggctcccgcgcacaggtgccgccgctgctcgccgcgttccagtcgcttccgtcccgggtccagggcgtcgtctggtacgccgtcgtggagggcgaacccgacgaccggacggccgacttcgtgggactcacccgcgaggacgtcacgtacggcacggaaccggcgttccagagcctgcgccagtcctgcctgacgacccggctggccgcctccgacgatccgcggtgccaggacttccggcggctgatcgaggagtcggtgcgcccggacaacccccgctacagcgcggacctgcacgcccacatggtgcactgcgtgtactgcgccaccgcgtacgacgaactctccgccctgcgggacgacccgcgtacggcgctggcggcgggtctgctggcctggggcggcgcggcgtacgtcacgggcggggcggtgacccggcgggcggtcgccggcggcccgggcccctccggaccggggccgggcgaccccggtcccggcccggccccgggctggtggccgtcccgccgcttcgtactggcgtcgacggcactcggcgtggcgctgatcccgttcctggcctacctcctcgtctcgggcggcccggagccggagcgggcggccaacgccgtggccaccccgtcccggccgcccgcggtgacggtgacggcgaccgtctcggcgaccccgtccccctcgccgtcgcacaccgccggcaagtccccgaagccgtcgaggagtccgtcggcgtcgaagacgacgcgtcccccttccccgaagcccagcccgaagccccccgctccccacccgccgaacggctccttcgcccaggtggtgaacgccgactcgggcctctgcctggacatccgcgacggcgtgatggacctgggcacggacgtcgtcacggccccctgcacctcgtcccgcacgcagcgctggcgggtcgacaccgcgcgaggcgtcctccagtcgtccgaggacccggacttctgcctggacagccgcggctccacggaccggggggtcggcatctgggagtgcggcgcggtgtacgggcgcaacggccggaacctgcgcttcacggtcgacgcgcagggggtcatccgcccggccgtcgccccggaccacgcggtcaccccgtacggggacgcgctgttcctggtgccggccgagggccgcgccgcacagcgatggcgggcgggggcggcc

SEQ ID NO: 3479 - DNA, 573 bp, Streptomyces avermitilis
  CDS (1)..(573)
atgaccggcatcgtcgtcttctttttcgtggccgccgcccttttcgtggccctgggcctcgccgaccaacgcaagctgtactggcgtttcgccgccaggcgttaccgcgatccggaggccaacgagccgtcggacagcgcgtacgcatggcagcgggtgctcatcttcatcgccgcggccgtcatggccttccaggggttcaaggcgctcgacttcgccgacgacaactcgtggagtgcgggcgagctcggccaggcggtcgagcaggcggcctccgccctggaggaggaaccccacatcgacgacgagtactcggactactccgacctgatcgagcaagaagtcgaggacgcgggcgaggacatgggccccgggtacgccgtgaacgtcgagccggccgactcgcgggacgactacgagatcacggccgagggcaccgacgccgcctactgcatgagcgtctcccagaaggagtcggacgagggcggtttcaccgtcccgggcgtgggcgaccagcagggcacctacgttcccgagtacgacctcagtgccaccacggccgagggcgcctgc

SEQ ID NO: 3480 - DNA, 1242 bp, Streptomyces avermitilis
  CDS (1)..(1242)
atgagcagcacagtcaccacagcccacaccgccggcacaggcagcacggtcatcaccaacatcgccggcctggtcaccaactccccctccttcggacgggggtccccccgctcgagtaaattcgagagtgggggagcatcccctctcggtctgatccaggacgcggccgtcgtcatcgacggcgaccgggtcgcgtggatcggtgaatcaagcaaagcacccgccactgacaaccgggtcgacgccggtggccgggcggtgatccccggcttcgtcgactcccactcgcatctcgtcttcgcgggcgaccgcacccaggagttcaacgcccgtatgtcgggccggagctacacggcgggcggcatccgcacgaccgtcgcggccacccgggccgcgagcgacgcggatctggaggcgaacctcacccgctacctcgacgaggccctgcggcagggcacgaccaccttcgagacgaagtcgggttatggcctgacggtcgaggacgaggcccgcgcgctgcgcatcgcgtccgcgcacaccgacgaggtgacctacctcggcgcgcacatcgtcccgccggactacgccgacgacccggccgcgtacgtggccctggtcaccggcgagatgctggacgcctgcgccccgcacgcccggtggatcgacgtcttctgcgagaagggcgccttcgacggcgaccaggcgagggcgatcctgacggcgggccgggcgaagggcctccacccccgcgtccacgccaaccaactgtcgtacggcccgggcgtccagctcgcggtggagctggacgcggcgagcgcggaccactgcacccacctgacggacgcggacgtcgacgccctcgcgagcggccggaccgtcgccaccctcctccccggcgccgagttctccacgcgcgccgagtggccgaacgcccgccgtctcctggacgcgggcgccacggtcgcgttgtccacggactgcaaccccggctcctccttcacgtcctcggtgcccttctgcatcgccctcgcggtacgggacatgggcatgaccccggacgaggcgctctggtcggccacggcgggcggcgcggcggccctgcgccgcgaggacatcggccacctcaccccgggcgcctacgcggacctggcgttcctcgacgccccgagccacgtccacctggcgtaccggccgggggttccgctggtgtcggaggtgtggcggcgagggcgccgggtccgc

SEQ ID NO: 3481 - DNA, 1332 bp, Streptomyces avermitilis
  CDS (1)..(1332)
gtgacgcagacgtactggctggagcacgcctggctcgaccccgccgtcgagccgggggtgtccgtcgaggtcgcacagggccggatcgcggccgtccgcacgggcgtcggcaccccgccccccggcgccgagatcctgcgcggtctcaccctccccggactggcgaacgcccactcgcacgccttccaccgcgccctgcgcggcaccgtccaggtgggcagcggcaccttctggacgtggcgcgaggtcatgtacgccttcgcggacaggctgaccccggacacgtaccacgcgctggcccgcgccgtgtacgcggagatggcgctggccggggtcacggcggtcggcgagttccactatgtgcaccacgccccgggcggcaccccgtacgccgacccgaacgccatgggcgaggcgctgatcgcggccgccgccgacgccggcatccggatcaccctcctcgacaccgcgtatctctcctccggcttcggacaaccgcccaacgcccatcagctccgcttctccgacggcacggccgacgcctgggcggaacgctgttcagttctcaaggaccgtgatcacgcgcggatcggtgcggccatccactccgtacgtgccgtgcccgccggacagctggcgacggtggcgcgctgggccgaggagcggcgggccccgctccatgtgcatctgtccgagcagacggcggagaacgacgcctgccaggaggcgcacggccgcacccccacccggctgctcgccgaccacggggtcctcgggccgcgtaccaccggcgtccacagcacccacctcacggacgaggacatcgcgctgctcggcggctcctcgaccggcacctgtatgtgcccgacgacggagcgggacctggcggacggcatcggcccggccgtcgccctccagcgcgcgggctccccgctctccctcggctccgacagccacgccgtgatcgacctcctcgaagaggcccgcgcgatggagctgaacgagcgtctgcgcacccgtacccggggtcactggacggcggcggcccttctgcgggcggcctcggccgacggccacgcggccctcggctgggacgacgcgggcaccctggagcccggcgcgctcgccgacttcacgacggtcgcgctcgactcggtcagaacagcgggaccgctgccgcggctcggcgccgagacggccgtattcgccgcgacggcggccgacgtgcgccacacggtcgtgggcggacgtcatgtcgtacgcgacggagcgcacgcgctcgtgcccgacgtgccgtcggcactcgcggacgccgtcgaagccctgcgcgcg

SEQ ID NO: 3482 - DNA, 1239 bp, Streptomyces avermitilis
  CDS (1)..(1239)
gtgactttccacagcatgtgggcggagctgctgccgatcggccgcagctccgcctccggcggctaccgccgcttcgcctggaccggcgccgacgccgactgccgggcctggttcaaggcgcaggccgagtcccgggggctgacgtacgagctggaccggaacgggaaccagtgggcctggctgggcgaccccaccgcgggggacgccgtggtcacggggtctcacctggactccgtccccgacggcggcgccttcgacggccccctcggggtggtgtcctccttcgccgccctcgacgaactccgcgcgcgccaggtcacgctcgccaagcccctcgccctcgtgaacttcggggacgaggagggcgcccgcttcgggctcgcctgcgtcggctcccggctcgcggccggacagctcaccgtcgagcaggcgcaccggctgaccgacgccgacggcgtcaccctcccgcaggccatggagcgggccgggtacgacgccggcaccatcggcccggaccccgagcggctcgcccgtatcggcgccttcgtcgaactgcatgtcgaacagggccgcgccctcgacctcagcggtgaccggatcggcatcgccagcgccatctggccgcacggccgctggcgcttcgacttccggggcgaggccaaccacgcgggcacgacccgcctggcggaccgccgggacccgatgctgtcgtacgcggagacggtcctcgcggcccgccgagaggcccgactcgccggtgcggtcgccaccttcggcaagatcgccgtcgagccgaacggcgtcaacgccattccctccctcgtccgcggctggctggactcccgcgccgccgaccagcggaccctcgacacggtggtcaccggcgtcgagaaggcggcccgcgagtacgccgacgcccacggcatcgaactcgacgtcgtccgcgagtcgttcacccccgtcgtcgagttcgaccacgccctgcgcgacgaactcgcccgcatcctcggcagagacacgggaacgggcgccggcacgggcgcggacctcaaggtccccgtgctgggcaccggcgcgggacacgacgccggaatcctctccgggaccattccgaccgccatgctgttcgtacgcaaccccacgggcgtctcgcactccccggccgagtacgccgccgaggacgactgcgtggccggggtgaccgcactcgccgacgtactggaagggctggcccgcagg

SEQ ID NO: 3483 - DNA, 1662 bp, Streptomyces avermitilis
  CDS (1)..(1662)
atgtcaggaccccgccccgtacgagcgccgcgcggtacggaactgagcgccctgggatggcagcaggaagccgccctgcggatgctgcagaacaacctcgaccccgaggtcgccgagcaccccgacaagctcgtcgtctacggcggcaccggcaaggcggcgcgcgactggcgctccttcgacgccatggtgcgtacgctccggaccctcaagcaggacgagacgatgctcgtccagtccggccgcccggtgggcgtcatgcagacccacgagtgggccccgcgcgtcctcatcgccaactccaacctggtcggcgactgggccaactgggaggagttccgccgtctggaggccctcggcctgaccatgtacgggcagatgaccgccggctcctggatctacatcggcacgcagggcatcctccagggcacgtacgagacgttcgccgccgtcgccgccaagaagttcaacggcaccctcgccggcacgatcaccctcaccgccggactcggcggcatgggcggcgcccagccgctcgccgtgacgatgaacgacggcgtcgcgatctgtatcgacgtcgacccgcgcgccatcgagcgccgcatcgagcaccgctacctggacgtgaaggccgactccctggagcacgccctgcagctggcggtggaggcccgcgacgcccgtcgtccgctctccatcggcctcctcggcaacgccgccgagctgctgccccgcatgctcgccgagggcgcccccgtcgacatcgtgaccgaccagacctcggcccacgacccgctggcctacctccccgtcggcgtcgacttcgacgacatggccgcgtacgccgcgaaggacccggcgggcttcaccacccgcgcccgggagtccatggcccggcacgtcgaggccatggtcggcttcatggacgcgggcgccgaggtcttcgactacggcaactcgatccgcggcgaggcccagctcgccggatacgagcgcgcgttcgccttccccggcttcgtccccgcctacatccgccccctcttctgtgagggcaagggccccttccgctgggccgccctgtccggcgaggcctccgacatcgccaagaccgacaaggcgctcctcgagctcttcccggagaacgagtccctgcaccgctggatcaagatggccggcgagcgcgtccacttccagggcctgcccgcccgtatctgctggctcggctacggcgagcgcgacaaggcgggcgagcgcttcaacgacatggtggcgagcggcgaactccaggccccgctggccatcggccgcgaccacctcgactgcggctccgtcgcctccccgtaccgcgagaccgaggccatgctcgacggctccgacgcgatcgccgactggccgctgctgaacgccatggtgaacgtcgcctccggcgcctcctgggtctccatccaccacggcggcggtgtgggcatgggccgctccatccacgccggtcaggtctccgtcgccgacggcaccgagctcgccggcgagaagatccgccgcgtgctgaccaacgaccccggcatgggtgtcatccggcacgtcgacgccggctacgacatcgcggagtccgtcgccgacgagcgcggcgtgcgcgtcccgatgcgcgagggtgacgacgcg

SEQ ID NO: 3484 - DNA, 1455 bp, Streptomyces avermitilis
  CDS (1)..(1455)
ttgcctggacatatgggcgcggaacgcgacaggacgggggatgcgatgggtgccaccgacgcgagggacaacggggcgggcgggagcacggggaacgcgggcgagaccgacgccgcgcgggtcgcccggcgggacgaagccgtgcgggccgccgtcggacaggggcttctcggcgcggacgcgcccatcgtcgccctcctcgacgtcgccgggatccggggctcggcggccgcgctgcgggcggccttcgacgcggtggtcgcgccgggcacgccggtactgcacgccttcgccgtgaaggcgaccccgctggtgcccgtactgcggctgctcggggaggcgggcatcggggcggaggtggcgagccccggcgagctggcgctggcacaggcggcgggtgtggcgccggagcggaccgtcctcgactcgcccgccaagacccccgccgagctgcgggaggcgctggcactcgggatcgccgtcaacgcggacaatccgcaggagctggaccggatcgacgcgctcgtgcggtcggcgcccagcggctcaccggtcgggatccgggtcaatccacaggtcggaggcggttcgatcgacgcgttgtcgacggccacggccacctccaagttcggggtcgccctgcgggacgagggagcccgtgagtggatcctgcgcgcgtacgcggaccgcccctggctgacccggctgcacgcgcactccggttcgcagggcatgccgctgtcgctgatggcgcggggcatcgcggagacgtacgcgctcgccgaggagatcaaccggcacgtggggcggcggcagatcgacacgatcgacatcggcggcgggctgccggtcaacttcggctccgacgccacgacaccgacctacgcccggtacgcgcgactgctggcggagtcggtaccggggctgttcgacgggcggtacgggctggtcacggagttcgggcggtcgctgctcgccaagcacgggaccgtggtcgcgcgcgtggagtacgcgaagagcgcgggcgggcgggccgtcgcggtcacgcacgccggggtgcaggtcgcgacccgcacggtgtacgcgccggcttcgtggccgctgcggatcaccgcgtacgacgcgaaggggcaccccaaggcggggcccgaggtggtgcaggacgtggcgggaccggcctgcttcgcgggcgacctcctcgccgtgggacgtgcgctgccgttgctggaacagggcgatcacgtggccgcgctggacacgggcgcgtactacttcgcccaccactacgcgtacaactccctggccaggcccggcatctacggcttcgcgacgggcggcgtgggcggcggcgccggcgggagcggggtccgcttcgcggtcgtacgggaaccgcaggccgtcgaggagatcgtgatggagtcgggcggggggcacgcttcggcgctctcggcgctg

SEQ ID NO: 3485 - DNA, 393 bp, Streptomyces avermitilis
  CDS (1)..(393)
gtgcccggaatcgacgagtgcttgctggaagccatgcgactgcccggtgcccggggtgcctcggtggtcgactggaccagcgggctcgctcttggcaccgtcggggactcccccggcggtgaccacgagacgacggcggcggaggccgccgagctggcccgactggccgccgagcaccgggcgttcgcaccggaggagggttccgactggtccgggcaggtaccggtcgaggacctgatcatcagcaaccgggacagctaccacgtgctgcggttcgtacccaccaccttcgacagcagcgtgttcctgcatctgtggctggcccgcgcggacggcaacctcgcgctggcccgcatccggctcggcgagatggcggggcggctggtgctggga

SEQ ID NO: 3486 - DNA, 1122 bp, Streptomyces avermitilis
  CDS (1)..(1122)
atgacgaccgtcagaacacctccgccgcccccgctgcccgtacggcagcgggcggaggccccggccaccggcctctcgccgatgctgagccgcctcgccgccgagcgtgccacgggcgtactggtgcgcgagcgcggcagcctctatctgtccgagggccaggtggtgcacgccgagagccccgcgacgcccggcctcgacgtgctgctcaccgtgcgcggcgcgctgaacgccgagggctggcgcgaggcggtcgccgaggcgggcgcgcggcggctggtggggcggttcctggtcgaccggggccggatctcgaagggcgcgctggagctgtgtcacctgggagcgttgtacgacgcggcgtacttcgtgctcggccccagcagcgccccgtcccgcttccgctacggggcggcgcactggctcggccccgtccacccggtgccggtggccgccgtggagcgcgagaccctgcgccgccgcgagctgctgcaccgcatctggcccgacccggcgaccgacgacgccccgctcgtacggatcgagcgcctcgacgagccgacggtcgcgccccgccaggccgcggtgctcggccgggtggacggcacacgcacggcggcggacatatcccgcgcactgggcagaccggccttccacaccctggtcgacctgcgtcgcctggccgccgcgggcatcgtggcgccggccccgggggcggaggtaccggcgtgccacgaggagcgggagcggttcgacgcggcgatcccggcggaggcacgggccgcgctaggggcgacgtccccggccggagcccctccgggacccgcgccggtcaccccggccgcgacgaccccggccccggacactccagccccggccacctcggccggcaccgccaccgcgcggaccacgccgcccgcgccgcccgcgcccccggtagcccctccggcccccacagccctgccggcccgcggcaccccgcccctcacactcgccccgcccgacccgctcgccccgcccgacacacccaccccgcccgacccgctcgcccatctcgccctgacgtcgaccgaccccgacgtctctctgctgcgtcggctccgtgacgccctggaggccctg

SEQ ID NO: 3487 - DNA, 519 bp, Streptomyces avermitilis
  CDS (1)..(519)
atggcggccgaggccgaagtcctcgacgaactccaccggttgaggtcccgtgtgccccagctgaccggtgcgctcgcggccagcgtcgacggtctggtcctcgcccaggacacccccggcgtcgacccggacagcctggccgcgctcacggcggccgcgctgggcgtcgcgctgcgggtgacggacgccaccgggcagggcgacttccgcgagctgctggtccgcggcgtgcacggctatgtggcgacgtacgccgccggaggcaccgccgtcctgacgctgctggcccaggaccgggtcaacgtcggccgcctgcacctggagggccgccgcgccggcacccggatcggggagctgatcgaggccgcggcggcccgcgccgaaccggcgccgcagacacccgcggccaaggcacccgccaaggccgtcgccaagtccgccaccccgcggaccagaaccgcgcgcgctcccgcgaaaccccgcaccaccacgaacgcgcgcaccaccaccacggaaagc

SEQ ID NO: 3488 - DNA, 372 bp, Streptomyces avermitilis
  CDS (1)..(372)
atgaccaacaccgaaaccgcgttgaaagaggccctcgcctccatcgagggcgcgaccggagccgccctcgtcgactacaccaccggaatggcgctcggcacgatcggcggcagcaagagcttcgacctcaccgtcgcggccgcgggcaacaccgatgtcgtacgcgccaagctccgcaccatggagcacctcgggctcaagggcgagatcgaggacatcctgatcacgctgaccgaccagtaccacctgatccggctgatcaccggacgtgggggcaacggcctgttcctctatctggtgctggatgccaagcgggccaacctggcgatggcccggcaccagttgaagaggatcgaggcggacctggaggtc

SEQ ID NO: 3489 - DNA, 582 bp, Streptomyces avermitilis
  CDS (1)..(582)
atggcgcgcggagggcaggggctggctcgggtggccgtcgtggtgagggccggagccgcgccgttgtggtggtgcggggcgttcgcggcgggcgtcggagtgctcgtaccggggctgaccggacgccggatcggcgtcatggccggggccgtgctgttcctcgtcgcggccgccgtcgtgacgtacgggagccggaagcggtacaccgccctggccgccgcggccgcacgcgcgggcaagcacgatgtgctccaggaccgcgccgtgaccgtccgcaactggcgccggggccatcgctggtggctgctgctcgccttcgtggccgcgctggtcagctccttcgccgtgcccgccgccgggggcatgctgctggccgggctcggcaccggactgcggctcaaggcggcctggctcggccggcgcgagcgggccggcgacgccctgctgtgggtgcgcgtcgactggctcggcgcacatggcggacgaccggcgggcaaggcggtcaaggtctaccgcagcacgggcatcgcggcgggcgacgcggccccgggcggggcgcgtcgccgcaccgacgcactggtg

SEQ ID NO: 3490 - DNA, 858 bp, Streptomyces avermitilis
  CDS (1)..(858)
atgagcggggacagggacacggaaatgacggacagtccggccgggcggcttcaggcgctcttcgaggggcaccggctgacaccgacccagcggcgcatcgcgcacagcatggtgcggcgcgccgccgacgtgccgttcctgtcgagcgtggagctggcggagctggccggggtcagccagccgtccgtcacccgcttcgcggtggcgctcggcttcgacggctacccggcgctgcgcaagcatctgcgcgaggtcgcgcccgccgaacaggccccggacacctcctcgtacaacgagtaccagcaggccgtcgaggccgagatcgagaacctgaagcatctggcggagctgctggccgacccgcgaccgctggcgcgtgccgggcggctgctcgccgcgtcccgcccgctgccggtgctcgggctgcgggcggcggcctcccaggcgtacggcttcgcctacttcgccgccaaggtccatccggacgtacggctgctgcacgagggcggcacgatggtccaggaccgtatcgacgcggccgtccgggcgggggcgagcgcgctgctgtgcttcgcgctgccgcggcatccgcgcgaggtcgtggacacgctggcgtacgcgagggaggccgggctgaccgtcgtcacggtcgcggactccgcgttcgcgccggtcgccaaggtgtccgacctgctgctgcccgccgccgtcggcacgggcctcgccttcgacacggcgtgcgcccccatgctgctcggccgggtactgctggaggccatgtgcgacgacctgccggacgcgcaggcacgcctggaggagttcgacgcgcgggcggcggcgaaggggttgttcgtggag

SEQ ID NO: 3491 - DNA, 1644 bp, Streptomyces avermitilis
  CDS (1)..(1644)
ttgcgcgtgatgtcgtctcggatcgtggatacgtcgaccgtggaagtgagccccgcgtcgaccgggatcgtggtcctcgacggctgtggaatcggcgtctccgacgtcgtgtgcctcgccgacggggcttcgcggccggttcccggcaccgaagcgatgaagcgggtggaggagtcctgggacgcggcccggcagatcgccgcgaccggccgggtctacggccgctccaccggagtgggcgcgaaccggaacgaggacgtgcccacggaggcggccgcggggcacggactccggctgctgcgcagccatgccggggccatcggggcggagctgcccgcgcggcaggtgcgggcgatgctggccgtgcgggtcaaccagttgctggccggcggcgcggggctgcggcccaccgtggtcacggcgctgtgcgaggcgctggagaacggggcctaccccgtcgtgaacgagttcggctcggtgggcacgggcgacatcgcggccctggcccaggtgggactggcgctcgcgggggagcatccgtggcgacgggcggagacttccggggggttggggtcggagacttccggtgggccgggggcaggggcttcgggtgggcggtacgcgggaggcgtgcgcgctcttcggcggggcgcgtccgcgcgggagatcggcgctccggagccccagctcctcgacaacaacgacgccctcgcgctcatcagcagcaacgccctcaccctcggccagtccgcgctcgcgctgcacgagctgcgcgggctcatcggcgccacccaggtcgtcgcggcgctctcgctgctcgcggtcgacggctcgcacgaggcgtacgccgcccccgtgcacaccgcccgcccgcaccgcggctccgccgaagtcgcccggatcatgcgggagttgatcggcgccgccgaccggccgaccccgcccctcggccgtatccaggacccgtacggcttccgctgtctgccccagatccacggccccgcacacgaggcggccgacgcgctcgaagcggtcctcgcggtcgagatcaacgccgccgccgagaaccccctcatctcccccggggacctggccgcctaccaccacggcggcttctaccaggcccaactcgccctggccctcgaccacttcaggctggccatcacccaggtggcgcgcctgtcgacgtccaggctgtcgacgttgaacgagcccgcgtacacccggctgcgccccttcctcgccgaccacgagcccgcctcctccggcgtgatgatcctggagtacgccgccggagccgccctcggcgatctgcgcgcgttctccgcgcccgcctcgctcgggcacgctgtactctcccggggcgtcgaggaacaggccagcttcgcctcgctcgcggcacgccagacgctgcgggcgtgcgacgcgtaccgtctcgtcgtcggctgtgaactggtcgccgccgtacgggcgctgcgccagcgcgacctgcggcccgacccggagctgccggtgggccgggcgctggagctcgccgagtcggtgctcgacccggagccggccgaccggccgctcacggacgacgtgacggccgcggccgcactgctcgaccggttcacggagatctggagggggagcgagtca

SEQ ID NO: 3492 - DNA, 1068 bp, Streptomyces avermitilis
  CDS (1)..(1068)
atgacgatatgcaggccgggcaagggacacctcatgatccagttcgacgcggtccacaaacgcttcccgaacggaacgacagcagtccacgatctctccctggagatgccggaaggcggtgtgaccgtcctcgtcggatcctccggttgcggtaagacgaccacgctcaggatgatcaaccggatggtcgatccgacctccggcaccatccgggtcggcggccgggacatcctcgaacaggacgccgccgagctgcgccgctccatcggttacgtcatccagcagtcggggctcttcccgcaccgcacggtgctcgacaacatcgccaccgtgccgctgctcctcggctggggccgccgcaaggcacgggcccgggcggccgagctcctcgacaccgtgggcctcgccgccgacgccggccggcggtacccgcaccagctctccggcggccagcagcagcgcgtcggagtcgcccgcgccctcgccgccgacccgccggtcctgctcatggacgagccgttcggcgcggtcgacccggtcgtccgcacccagctccaggacgaactcctgcgcctccagaaagagctgagcaagaccatcgtcttcgtcacgcacgacatcgacgaggcggtccggctcggcgaccagatcgcggtcttccgcaccggcggccacctcgtgcagtgcgcctcgcccgccgaactgctggcccgcccggcggacgacttcgtggcggacttcctcggcgccgagcgcggcctcaagctgttgtcgctgaccacgctcgccgacgtcccgcagggccccgcccccgagggcggcgcctggaccctcgtcctcgacgaggcccgccggccgcagcactggcgttcgaaggacggtgccgaactccccgtacgaccgctcagggaccgcgactcgctgctcgccgccctgaacgagtcggtcgcctccccgaacgggctgacggtccgtgtcgacgcggacggagtcctcaccggggtgtcgtcccgcgacgacatccacgagcacgcgggccgggcgcacagcgaagcgagcgtcgccgcg

SEQ ID NO: 3493 - DNA, 639 bp, Streptomyces avermitilis
  CDS (1)..(639)
gtgagcgtcgactggtcgtggataggcgaccacaccgacgacctcaccggtctcaccctctcccacctccaggccgccctgaccgccgtcttcttcggcctgctgatctccctcccactggcggtgatcgcccaccggatccgcccgctgcgcggcttcctgctcggcctgtcgaacgtgctgttcacgatcccgtcgatcgcgatcttcgtcctcctcctgccggtctcggggctgacccgcaccacgaccgtcatcggcctgaccgtctacaccctggtcgttctgctgcggaacacggtcgagggcctcgactcggtcccggtgaagacgaaggaggccgccaaggcgatgggcacccgcccgctgcgcaccctcctcaccgtcgaactccccctcgccctccccgtgatcatggcgggcgtccggatcgcgacggtcatgtcgatctccctggtctccgtggcgacgtacatcggagacggcggcctcggccagctcttcacggacggcttccagcgcaacttcccgacgccggtgatcgtgggcgtcgtactgacgatcctgctggccctggtcgcggacgcgctcctggtggcggtccagtacgcactcaccccgtggaagaggcggcgcgcc

SEQ ID NO: 3494 - DNA, 717 bp, Streptomyces avermitilis
  CDS (1)..(717)
gtggaagaggcggcgcgcctgatgtacgaactcttcaagaacctcggcgcctggctggtcagcggcgaccagtggaccggcccggacggcatcgcgcaccgcctcgccgagcacctccagtactcgctgctcgccaccctcgtcgccgccgcgatcgcgctgcccgtcggcctgctgatcgggcacaccgggcgcggcgcgttcctcgccatcaacctcgcgtccttcggccgcgcgctgcccaccgtgggcctggtcgtgctcgtcttcctggccagcggtctgtcgatgtggccggtgtacatcgcgctggtcgccctcgcggtcccggcgatcgtgacgaacacgtacgcgggcatgaccgccgtcgacccggatgtgaaggacgccgcgcgcgggcagggcatgcgctggcaccaggtcctcttccaggtggagcttcccctcgcgctcccgctgatcatgacgggtctgaggctcgcgctgatccaggtcgtcgcgacggccacgatcgccgcgtacgtgtccttcggcggcctgggccgctatgtcttcgacggcctcgcccagcgcgacctggtccaggtcctgggcggcgcggtgctcgtcgccgcggtcgccgtcgtcctcgacctggcgctctccgccctccagcgcttcctcttcctcccccactctcggcttcgctcgagcggggggacccccacccgcaccgcc

SEQ ID NO: 3495 - DNA, 936 bp, Streptomyces avermitilis
  CDS (1)..(936)
atgaatcgtcgtactctcctcggcggcctgttcgcggccgcctccgtccccgccctcgccgcgtgcagcagcggtatcacctccctcgacagccagggaagcggcggctcgggcggcggctccagcaagggcggggtcatcatcggcaccgccaacttcaccgagaaccaggtcctcggccacctctacgcggccgccctggaggcggccggcgtcaggacgacggtccggcccaacctcggcacccgcgagatcctcatccccgcgctcaggggaggcgacatcgacctgctccccgagtaccagggcgccctgctgcactacctcgccccgaaggcgacggccacggaggagggcgcgatgcagaacgccctcaccgtcgccctcccgtccggcctccaggtgctgccgtacgggatggccgaggactccgacgccttcgtcgtcacacgggcgacggcgaagaagtacggcctgtcctccctcgccgacctgaagaagcagaacggcgagctggtcatcggcgccgccgccgaggtgaagaagcgtcaggtcggcgtggtcggcctgaaggacgtgtacggggtggagttcaaggagttcaagtccctggactcctccgggccgctggtcaagggcgccctgaggaagggcgacgtggacgtggcgaacctcttcaccaccgacaccgacatccaggccaacgactgggtggtcctgtccgaccccaggaacctcgtcccgggccagcacgtcgtcccgctcatcgccgaccgcaaggccgactccacggtccgcagggccctcgccgaactcggcaacgtcctcaccaccgcccagctgaccgagctcaaccgccaggtggacaaggacaagaaggacccggaggacgtggcgaacgcgtacgccgagcagcacgggctggtgaagaagaag

SEQ ID NO: 3496 - DNA, 423 bp, Streptomyces avermitilis
  CDS (1)..(423)
atgaccggtatggatgcccgcgacgccgaactgaagaaggaactcgacgccaccctgcacgcgcgcagggagctgggggacgagtacgagtccgcgctggtggactcgttcctggagaaggtggatcagcgcatcgacggcgcggtcgaccgccgggtgcggcgtcagctggccgagcagcagatggtggtggcccgtggcgcacggtccccgcaggccacggactcctggggtgagcgcttcggcttcggcatcgtctcgctcgtcctcgcgatccccctgtccgcgatcggcgccaccgcccacctccccggactcctgatcacctggatgggcatcgtgggcgtcaacgtggtgcaggcgatgcgcgtgttcccgtccttcggccgccgcggcgacaagccggaaccggactgggaaggc

SEQ ID NO: 3497 - DNA, 1392 bp, Streptomyces avermitilis
  CDS (1)..(1392)
gtgcaattccacgactcgatgatcagtctcgtcggcaacaccccgctggtgaggctcaacagcgtgaccgcgggcattcaggcgaccgtcctcgcgaaggtcgagtacttcaacccgggcggttccgtgaaggaccgcatcgccctgcggatgatcgaggccgcggaggagagcggcgctttgcagcccggtggcacgatcgtcgagccgaccagcggaaacaccggtgtcgggctcgccatcgtcgcgcagcagaaggggtacaagtgcatcttcgtgtgccccgacaaggtgagcactgacaagatcaatgtgctgcgtgcctacggggccgaggtggtggtctgcccgaccgccgtcgaccccgagcaccccgactcctactacaacgtctcggaccggctcgtgcgcgagacgcccggtgcgtggaagccggaccagtactccaacccgaacaaccccctttcgcactatcactccaccggccccgagctgtgggagcagacggaggggaagatcacccacttcgtcgcgggcgtgggcaccggcgggaccatttccggtaccgggcgttacctgaaggacgccagtgagggccgcgtccaggtcgtcggcgccgaccccgagggctccgtgtactccggcggctccgggcgcccgtacctcgtcgagggcgtcggcgaggacttctggccgaccgcgtacgaccgcacggtcgcggacgagatcgtcgccgtgtccgacaaggactccttccagatgacgcggcggctcgccaaggaggaggggctgctcgtcggcggttcctgcggcatggccgtcgtcgccgcgctgcgggtcgccgagcggctcgggccggacgacgtggtcgtggtgctgctgcccgacagcgggcgcgggtacctcagtaaaatcttcaacgacgaatggatggccgactacggcttcctcgaggactccgggcccagcgcccgcgtcgccgacgtcctcagcgacaaggcgggcggctccatcccctccctcgtccacatgcaccccgacgagaccgtcggcgaggcgatcgaggtgctgcgcgagtacggcgtctcgcagatgccgatcgtgaagccgggcgccggccacccggacgtcatggccgccgaggtcgtcggctcggtcgtcgaacgcgagctgctcgacgcgctgttcacgcagcgcgcctccttgcaggacccgctggagaagcacatgtccgcgccgctgccgcaggtcggttcaggcgagcccgtcggggacctgatgtccgtcctcggcacggccgacgcggcgatcgtcctcgtcgagggcaagccgaccggtgtggtcagccgccaggacctgctgtcgttcctggccaagggcggcggcaagcag

SEQ ID NO: 3498 - DNA, 1038 bp, Streptomyces avermitilis
  CDS (1)..(1038)
atgacgagcttgtcgagggcgagggtggcccggcgcatcgcggcgggtgccgcgtacggcggtggtgggatcggtctggtgggcgcggcgacgatcggcgtcgtgctggccgaggtgcagctggccaagcgccatgtgggcaacggcagtgcgccgcacccgccgagcgcggagggccgctacggatacgcgtacaccgtccccggtgaaccgccgctccggctgacgatgctcggcgactccaccgccgccggtcagggcgtacgccgatcgggtcaaactccgggcgctctgctggcctccgggctcgcggcggtcgccgagcgcccggtggtgctgcggaacgtggcgctgccgggcgcccagtcggacgatctcgaccgccaggtcggcctggtcctcggcgcctccgaacaggtgcccgacgtctgcgtgatcatggtcggggcgaacgatgtgacgcaccgcatgccggccacccgctcggtccgccatctcgccgccgcggtacgccggctgcgcaccgcgggtgcggaggtggtcgtgggcacctgccccgacctgggcacgatcgagccggtccagcagccgctgcgctggctggcccgccgcgcctcgcgccagctggcggccgcgcagacgatcggggcggtggagcagggcgggcgcacggtgtcgctgggcgacctgctcggcccggagttcgcggcgaacccccgggaactcttcggccccgaccactaccacccctcggcggagggctacgcgaccgccgcgatggcgatactgccgacggtctgcgcggcgctcggcctgtggccggcggaggaggagcgcccggacgtctcccgccgcgagggcttcctgccggtggcacgggcggcggccgaggccgcgtccgagccgggcacggaggtcacggcggcgatgccgaccggaccgcggggcccctgggccctcctcaagcggcggcgccggcggcggctgccggccgccgacgcgacggccccggcgacaccggcccgggagacgtcggcg

SEQ ID NO: 3499 - DNA, 1221 bp, Streptomyces avermitilis
  CDS (1)..(1221)
gtgatgcccgaagccgtgatcgtctcgaccgcccgctcccccatcggccgcgctttcaagggctccctcaaggacctgcgcccggacgacctgaccgccacgatcatccaggccgccctcgccaaggtccccgagctggaccccaaggacatcgacgacctgatgctcggctgtggcctccccggcggtgagcagggccacaacctcggccgcatcgtcgccgtgcagatgggcatggaccacctcccgggctgcaccatcacccgttactgttcctcctcgctccagacgtcccgcatggccctgcacgccatcaaggccggcgagggcgacgtcttcatctccgcgggcgtcgaggcggtgtcccgcagcgtcaagggcaactccgacagcctgcccgacacccacaaccccctcttcgccgaggccgaggcccgcaccgccgccgtcgccgagagcgcgggcgcgtcctggcacgacccgcgcgaggacggtctgatcccggacgcgtacatctcgatgggccagaccgccgagaacctcgcccgcatcaagggcgtcacccgtcaggacatggacgagttcggcgtccgctcccagaacctcgccgaggaagccatcaagaacggcttctgggagcgcgagatcacgccggtcacgacccccgacggcacggtcgtcagcaaggacgacggcccgcgcgccggcgtcaccctggagggcgtgcagggcctcaagccggtcttccgccccgacggcctcgtcacggccggcaactgctgccccctcaacgacggcgccgccgccctcgtgatcatgtcggacacgaaggcccgcgagctcggtctcaccccgctcgcccgcatcgtctccaccggcgtcaccggcctctccccggagatcatgggcctcggcccggtcgaggcgtccaagcaggcgctccggcgcgcgggcctgaccatcgacgacatcgacctggtcgagatcaacgaggccttcgccgcccaggtgatcccgtcctaccgcgacctcggcatcgacctggacaagctgaacgtcaacggcggcgcgatcgccgtcggccaccccttcggcatgaccggcgcccgcatcaccggcacgctcatcaattccctccagttccacgacaagcagttcggtctggagacgatgtgcgtcggcggcggccagggcatggcgatggtcatcgagcgcctcagc

SEQ ID NO: 3500 - DNA, 795 bp, Streptomyces avermitilis
  CDS (1)..(795)
gtgagcgccatgccgattgctctgctgctcaccacagccgccaccgcggttgtgggcgtcgccgtcctgcgcaccctccagtcgctgcgccggcagatagcggctctgcacaccgaactgaccgagagccgcgccgcgagcgcgcgcggtctcgtgcccgccgcccgctccaccgccgacgcggaggagatacgtgccgccgtggccgaggcgctcgccgaggagcgggagcgcgagctggccgaggcacgggcgttctgggccgcccaggaggcgcgtgacatctccgacgcgccgtccctgctgggcctgcccgacagtgatctgttcctgccgcgccagtcggacttcatgggcctggagcacgacagcctcgagccggtggccgagccgggtctggaggccgacgagctctccggggagtcgcccgagctggccgcggcccgccgccgccacccctcgcacccggacttcgtgccggtccagtcacccgtcgtgggcgaccacgagcgcacggtgacctgcctggaagagctcgccgagtcgcgtaccgaactggccgacatccgccccggcccgctgggcaccctcgacgtctacgtcttcgcggacggtacgaccctgtgcatgaccccgggccaccgggacaccgccgagcggctgtccgcggccctgcgcgccggcgacactccggtactgctcggcggctcgggcatctcgggggcgtacgcgctgacgttcgcctgcggcgaggagaccgtgtacgtcctggcggaccgcgtcatcgcgtcgctg

SEQ ID NO: 3501 - DNA, 309 bp, Streptomyces avermitilis
  CDS (1)..(309)
gtggttgatacgacgcctctgacccgtgccgtggatcatttcgccgacctgctgcgggccgctccgcagagccggctccagcgaagtgctgcggccgaagcactggggctggccagggagttggcgctgcgcgcccagcggctggaggaccccgccgccgagccccgtgagatgcccgacgcgggcatgttcgcggccgcggaccagatcaccgtcgccggacgagatctggcactcgtactgagtaacgaggaggaactcgcggaggcggtgaccctcgtggtcgaggcacagaaacgcgccggggtc

SEQ ID NO: 3502 - DNA, 228 bp, Streptomyces avermitilis
  CDS (1)..(228)
atgtcccaagtcttctccgcggagacccatcgcaacctgctcgcccgcatcccccattgcaccggtcgtgaagtgtccgactggctgcgcaccgtcgacgaaggccccgctctcttccgtttcgaggaaaaggtcagctggcttcgcgccgagcacaacctcgcgtacggccacgccaaggcgatcattcacgagtacgacctgaggagggccgcgcgcaaactgctc

SEQ ID NO: 3503 - DNA, 879 bp, Streptomyces avermitilis
  CDS (1)..(879)
atgaggagcagtaacccggtcttctcgcgtcgggggttcagccgcgacaacggctacgcgggcttcaacaccgcgccgccggccgggggacccgctgtcggcacgcaggccaacccgtacgcccagcagggcggcaacccctacgcgcagaacccgtacgcccagcagggccagcagtacggcgctccgccgcaggctccggtctccaccggccggatgacgatggacgacgtcgtcatgcgctcggcgatgacgctcggcacggtcgcggtcggcgcgatcctcgcctgggccgtgctgccggtgacgagcaccagctacgcgctggcgatcggcgccgcgctcatcgcgttcgtcctggcgatggtgcagtccttcaagcgcacggcctcgcccgcgctgatcctcgcctacgccgccttcgagggagtcttcctcggggtcatcagcgagatgttcaacagccagtggtcgggcgcgcccttccaggcggtgctcggcaccatggcggtcgccggcgcgaccctgctcgtctacaaggcgggctggatccgcgtgaccgcgcggtacgcgcgcatcggcatggccatcgccatcgccttcatcctggtcatggcggtcaacctgctgctggtcgtcttcggggtcgcccccgacggcggactgcgcagcatgggcccgctgggcgcggtcgtcggcatcatcgcgatcctgctcggcgcgttcttcctcaccctcgacttcaagcagatcgaggacggcatcgcgtacggcgcgccgcgcgaggaggcctggctggccgcgttcggcctgaccatgaccctggtgtggatctacgtcgagatgctgcggctggtcgccatcttcagcagtaacgac

SEQ ID NO: 3504 - DNA, 1389 bp, Streptomyces avermitilis
  CDS (1)..(1389)
atgcgtaccaccgtcgggatcatcggggccggaccggccggactgctgctggcccggctgctgcgcaacgccgggatcgactcggtggttctggagagccgggaccgggcgtacgtggagcggcgccagcgcgccgggatcctcgagcaggggaccgtcgacgtgctgcgggccgccggggccggggagcggatggaccgggaagggctgcggcacgacgggatcgagctgcggttcgaccggaggcggcaccgcgtcgacttccccgcgctcgccggcggccgcgccgtgatggtgtacgcgcagaccgaggtgtgcaaggacctcatcgcgctccagctcgaggagggcggaccgctgctcttcggcgccgaggcgctcgccgtggagggggcagggacggagcggccgcgcgtgccgttcacccacgaggggcgcgaggacgtcctggagtgcgactacgtcgtgggctgcgacggattccggggcgtcgcccggcaggccgtgcccgccgaggtgtcgcgcgtcttcgaacgtacgtatcccttcggctggctcggcgtcctcgccgatgtcgccccctcccacgacgaactcgtctacgcccgccacgaacgcggcttcgccctgctcagcatgcgctcgccggccgtctcccggctctacctccaggtgcccgagggcacggacgccgaggcctgggcggacgacgagatctgggcggagctggagcggcgcttcgagacggacgacgcctggcggctggagcgcgggccgatcacccagaagtccgtcacccccatgcgcggctacgtccacgagcccatgcggcacggccggctcttcctcgccggggacgcggcgcacatcgtgccgccgaccggggccaagggcctcaacctcgccgtcggggacgtcgtgaccttcgcgcgggcgctgacgcacctgaaggagacgggatcgggcgagcgcctcgacgcgtactccgcgacctgtctgcgccgcgtctggcaggccgagcggttctcgtacgacatgacgaccctgctgcaccgcccgccggccgccacgccgttcgaggagcgcgtccagctggcccgcctggagcggatcacgtcctcccgcgccgccgaggccgacctcgcggaggggtacaccggttccccctggagtgacccgaacgggcgctcggccgccggccggtcgccggccggtcgtcggcggatgactgaccgggcgccgaacgggcaccggaccactaccggtcgagcgccctgttacggcttcgtaccagtgctcgccgggcatgggacacacgcgtaccgtggcagcacaggggaaagatccttcttaagcagtagggtcaatcctttgcctacctattactct

SEQ ID NO: 3505 - DNA, 855 bp, Streptomyces avermitilis
  CDS (1)..(855)
gtggcgggcagttaccccccgctgccgtcggtgctgttcgcgttcctgtgggcgtacggggtcaccgggctgttcgcggccgtgcagccgcagagcccgccctggcggcccggaaccggcaccttcacagccgccgtcacgctcaccgtcaccctgctgctgatgcgcgccgtggatgacatccgcgatctggcgtacgaccgcgcgttccacccgaagcggccgctggccgccggaaccgtgcggatgaaggacctgctggtgctgtgcgcggccggcgcggtgctcgtgctggcactcaacgccggcagccccacggccctcgcggtcctggcggcccaactcggctactgcgggctctttctgaccgtcgaccgccttctgggctggccaccgggagaccggctgttcctgagcctcctgttcagcttccccgctcagttgctgctccacgtctacctctacgcccgctacctccacgacacgtcctcgggccccggccgcgagggagtcctggccatcgtgatcaccgtgctggtcaccgtccacatggagttcgccaagaagatcacccggcggacacggcccggcgaacgcagttatgtcgatgccctcggcctcggcgggacggtggccgtggcgctgatcgcgccggtgctgtcggtcctgctgctgatgacccaggcccgtccggtggccttgctgacgccgctggccctgctgcccctgctgctgccggcccgggccggctggcggttctggcggacccggaccccgcgctggcccgcggcgtccccggcgtactacgtcctgtccaccttcgcctgctacctggcgctgagcctgacctacgga

SEQ ID NO: 3506 - DNA, 1410 bp, Streptomyces avermitilis
  CDS (1)..(1410)
atgagcggcgcgagcgcacggtgcccgttctcgggcgccggcggcgggacggacgttctgccgctgccggccgacccgggcacggcagccggtgctccggcccccggtccgcccgacgcaccggccgcccccgccccccgtacggcggaccggtccgccccccacgcggcggacccgcacgcccccagcacggcggacctgccccgctttcccttccccggcctgtccggcatccccctggaccccgtgctcctggaccgctaccggggcgagccgttggtgccggtagggctggcgaacggccgcgaggccctgctggtgacccggtacgccgacgtcaggaccgtgctgtccgacgaccgtttcagccgggaggcgtgggccaacggcaccctgttcgcccgcaggtccggtgcgctcgcgctggtcaccagcgacgcgcccacgcacacccggcgtcgcagccgggtccagtcccgcttcacgcaccgcagagccgaggaggaccggccccgcatcgcgcggatcgccgcggaactgctcgactcccttcaggccgcggacaccggccggccggtcgacctgatcgccgagttcaccactccgttcccgtaccgggtgatctgcgagatgctcggcgtgccggtggccgatctggaccgactgctgccgtcggtgacggtgatgatgtccgccggacgcttctccgccgacgaggcagcccgcgcccacgaggtcatgtacggctacttcttcggacaactggccgcgcgccgcgaggcgatcgcggccgggtgccccggggacgacctgctgacgtcgctgctgtccgcgccgcgggagacccggctcagcgacgaggagatcgtcgtcttcggcttcggcctgatgatggcgggcggcgagaccaccgcctcccatctcgcgatgtgcgtcctccaggtactgggcacacccggcctcgccgaccggctcaggcgcgacgcgtccgcggtgccggccgtcgtggaggaactgctgcggtgggtgtggttcgccggtaccggcggccagccgcacgtggcactcgaggacgtcgaactcgcgggccgggtcctgcccgcgggccaggtcgtcatcccgctcaccgacgcggccaaccgcgaccccggtgtcttccccgacgcggacgagttccgcccggaccgcgcgcccaacccgcacatcggcttcggccacggccggcacatgtgcctgggtgccgcacacgcccgggtggagctccaggagggtctgaccgcggtcctggagcgcctggaccacctggaactggcggtcgaaccggcggaactccgctggcgcgaccagatgttcatgcgcggcgtgtgggaactgccggtgcgctggcacacgaaggaggacggacggtgc

SEQ ID NO: 3507 - DNA, 393 bp, Streptomyces avermitilis
  CDS (1)..(393)
atgaccgtggcccggtggatcggttcgctggaggcggggtggcgtgcccgcgacgcggaggcgatagccgccctcttcaccgacgacgccgtctaccaccagggcccctacggcgccccgcacaccggccgggcggccgtggccgagcactggcgcgggacgctgtcacggcagaaggacgcgaagatgtggttcggggaacccctcgtgtcgggccggcgggccgccgtggagtggtggtgcgtgctgtacgaccccgccaccggtacgccccgcaacgcggcgggctgtctggcgctgcggttcgcgccggacgggcggtgcgagtccttgcacgagtactggcacggggcgccggaccaggcgctggagcccgccgaggggtggctgcga

SEQ ID NO: 3508 - DNA, 1083 bp, Streptomyces avermitilis
  CDS (1)..(1083)
gtgcgcgtggacaacctgcacatcgccggcctcggctgctacctgcccaggccctatcccgccgagcgcgccgtcgccgagggccggtacgaggcggcggaacacaggaacggcggctggaccggcgccgccgtcgccgggaacatctccccgcccgagatggcggtgaaggccgcccgcaccgcgctggagcgctccgggcacccggccgccgacatcgcgctggtgctgcacgcctcgctgcacgagcagggccccgagctgtggacgccgcaccagtacgtgctgcggcacgcggtgggcacccaggtgcccgccatggaggtccggcagggctgcaacgcggccctgggcgccctggaactggcccacggctacctcagcgccgatccggcgagagcggcggcgctcgtgaccgccgccgagaacttcggcaccgaacgcgtcgaccgctggcgctaccaggcgggcgcgcgcatgaagcggccgtccatcctcggcgacgcggccaccgcggtcgtcctgtccagccgcggaggcttcgcccgggtcaggtcgatcgtctcggcgtcgctgccggagctggaggagatgaaccggccccgcggccccctgttcccgccgaaccggacccgcaccggccgcatcgacctggtcgcccgggtgctcgactacgcccacgacaacccgggggccgccacgctcgccaggaagtcgctggacgcgggccgtaccgagatcgcgctgcgggccatcgaggacgcggggctgcgcccgtccgacatcacccgggtcacccacgtgctctccgggggtcccgagtacatccgggccgtgctcgaacccctggggatcgacccggcgcggggcgtactcgacttcggccgacacctcggccacatgaccaccagcgaccaactcgccgcgctgcaccatctcgtcgagacccgccaggtcgtcgagggcgaccgggtcctgatgatcaacaacagcttcggggtctccctgttcggcgcggtcgtggagatcaccggcaatccgtcctgggccaccggaagcccgtcggcatacaaggagtggaag

SEQ ID NO: 3509 - DNA, 3087 bp, Streptomyces avermitilis
  CDS (1)..(3087)
atggcgcatacggtccaccaccccccttcgaccggctcgaccggccgcggaaccactgacgcgggggcccccgcttcccttgacacccatctggccgggcccgttgatacacatctggccgggcccgcggccgacgcgctggccgatccggtccaggtggggcacaagttctcccggcagcacacgatgcgccgcgccggccttcccgtgcccgccttcttcgtcctgaccgccgaggcgttcgccgcgtcggtgcccgtgcccgccggcttccccggcaccggtgcgagcgccggtgacctgatggcctgggcgcgcgccgcgcgggaccgggtccgcgccgtgcgggtgccggcggaactggccgggcggatcctcgccgccttcgacgaactcgccggacccgacgggctcgtcgccgtacgcggctgtacggcggcgcaggcggacggcagcggagaggacggcgccgacgacccgttcgccgggctgtccgacagctacctctacgtccgcagggacgccgtcctcgaccgggtcgtggactgctggtcctccgcctacaaccccgaggcggtgctctaccgggtgcggcgcggcgtcgacgtcaccgcggtacgcgtcgcggtcggggtgcagcggatggtgccgggagtgcggtcgttcgtgatgttcacccgtgatccccgcggcggtgcccaacaggcggtcgtcgccgccgcgcacggcatcggtgagggcatcgtgcaggagaaggccgacatcgaccacttcttcgtgaaccgcgccgacggtgccgtccgcggcgagctcgccgtgaagtccgtgatggtcggtctcgacccggcccgcgccgacgagggcccggtcgtcctgccggtccccgccccgctcgcccggaaggcggtgctctccgacgcggatgtccgccgcgtcggtgcgctggccgcccgcgcggaggaactgttcggcggcccccaggacatcgagggcaccatcaccagtgacggtgcgatccacctggtgcaggccaggcccgtggtgcagaccgggtccgtggtgcagaccgggtccgtggtgcagaccgggcccgtgcccggtgagggcgccgtgccgggtgccggggccgtgccgggtgccggggccgcgccgggggacgaggccgtgccgcccgtgccgtggaccaaccacaacctcaccgagtccttccccggtgtcaccagcgcgctgacgtactcacaggcccgggtcttctaccggaccggcttcgccgacttctaccggcgcgtcggcgtaccgaagcggtccctgcggcgcaaccagcaccacctgagccggatgatcggccacctggacgggcgggtgtactaccggctcgacgcctggttcgcgctgcacggccagatccccggcttcgagctcatccgccccatgtggcagcgttcgctcggcttcacacagccgcccgaccacgcccgtccggacgagggggaccgccgccgcgcgtggggggaggtgctgcgggcctcgccccgcctcggctgggcctacgtcacccaaccccgccgactgcggcagttcctgcgctggtgggacgagttgatggcgcagtggccctccttcgaggactgcaccgcggacgaactcgtcgcccgctaccgcaccatgtgggccgaggccgaacaccgctggggcatcaccatggtgtccagttacttcgccctggtggcgctgacgtgcgccgactccctgctcaagcgctgggcgccggaggggtcggcgctgctgccgcgcctgctgggcggcggccggcccaaccgcactctggcgtcggtgcgttcctccatcgccctggccgaacgcgtcgccgccgacccggcgctgcgcaccgccgtgctggagcgacccgagcgggaggtgtgggaggagatcgcctcctcggtccacggcgaagccgtcgccgaggagttcgacaggcatctgcggacctatggcgaccgggccctgcacgatctcaagctggaggtgcgcacccctcgccaggaaccgtggcagatcgtgcccgcgctacggcccttcatcacccaggggctcaccgtcgcggcgaacgaggccgacgaggccgccgcccggcgcgccgcccggcacgcgctgcgcgaggcctgcccgaatccgctgcggcgggccgtgctcagcggtgtgctcgcctcgctgcgattcagtgtcaaggcccgcgaggacacccggttctgccgcagtcagctgtacggcgtctcccgtgaggtgatgtggcggctcgcggaacggctggtcgaggcgggcatgctggaccgggcgtccgacatcgtgcacctccaggccgaggaggtactcggcgcgttcgacggcaccctgcccgagacggatctgcgcgcggtggcccggcggcgcgaggcgcggcaggacgcccgcgcggccacgccggacccgcccgcctacttcaccgtccccggcggcctgccggtgccggtggcgctggcctcgcgccgcgacacccggccccgggccggtctggcgcgggacggcgtactgcgcggcatcgcctccagcagcggcagggcccgtggccgggcgctggtcgtccgggacacgcgggtgccgcccgagcagtgcgtggaccggatactgatcgcgaaggagaccgaccccggctggctggcgctgatgatggcggccagggggatcgtggtggagcgcggcagtctggtctcgcacaccgcgatcagcggacggctgctcggggtaccgacagtggtcgcggtcacggacgccatgacggccgtcccggacggcgcctgggtggagatcgacggcgacgcgggcacggtacgcccgctgacggcggccgaggcagcccagtgcgaggcagcggaagccgcgcggcgcgacgcagacgacgcagacgatgccgacgacgccgcgcaccgtaaggccgacgacgccacggcttccggacgggaccactcggacagtgcggcgcccggacgtggcgacccggacggcacggcccccggtcatgacggcaccacggccgcgcgcggggaggcg

SEQ ID NO: 3510 - DNA, 639 bp, Streptomyces avermitilis
  CDS (1)..(639)
atgaaccagcgcctcgtcgtcctcgcgctgcgggccctgctgcccgtgacctgcgccgtgttcgtgaccgcgatcggtctgctgctcaccgaccacgcctccacgccgcagttggcgggcgccctgttcgccggcctgtacgtgctgtgggtactcgccgaggccaggatcaccgtgcggcatccctcccagtccgccgcggagaacagcaccctgctgccgtacgccctcgcccgcgccggcaccggaatgtccgcggtgctctggccgctgccgtggcaggggtggtcggcgtggctggtcgtgccggtcgtggtgttcaccgccgcggtcgcgctgcgcctggtcgccatccgtactctggggcgcttctactcccaccacgtggtccgctattccgaccattccgtggtcacgcacggcccgtaccgacacgtgcggcacccggcctacaccgggatgctgctggccaacgccgcgttcgtgtcgttcttcctcaacccgctgagtgtgctgttccttctcgccctgtgcgccgtggtcacctggcgggtccgggtcgaggaacgggtgctgtgggaggtgcccggatacgccggttacgcgggcggccgggcacggctcctgccgggggtgtgg

SEQ ID NO: 3511 - DNA, 891 bp, Streptomyces avermitilis
  CDS (1)..(891)
atgcggatgaccacgcacatagagacgacgcgagaagaagagaggaacggaagccgggtaggcctgctgccgccgccggccccgtcacccggcggggactcgtggctgacggagctgaccgtcgaccggagggaccccttcttcttcgaccacccgctggaccacgtccccggcatgctgctggtgtgcgggatggcgaacgccgtgcgtgaccgcatcgacgtgcccccgggcttacgcgccaagtgggtggtgaacttccgggtgatgccggaactgtctcccgagctcgtgctgtacgcggcgccggaggagaagggccgccgcccgctgcgcgtcacgcaggggccggccgtcgtctcggacggctggttcgtactgacccccgacagcgatccggtccgcccctccgccgccggcgcccgtcgtgaggcccccgcgcaggcctcgctggtgcatcgcacccgcccggcgaacgtgatgatcggtgaaccccgggcgaccgacggactggtcaccgcgcccgtactggtcccggcttcctggcacaccctggcgagccgcagggcgggcctgcgctccgtgaagtccgtcatcgaggccggccggcagttcgccacctggttgtcgcaccgggtgggcggctggccgccggaagtacagatgctgtggctgcggctcaccgccgacctgccgctcgacctgcccgcctcggtaccgctttcgctgcgctggcggcaggtgcgtatgtccgacgacaaggccagactcaccttcgaggtcgtcgcgggtgagggcgagggcgtcaccgtcggttccctgatctacgtcagcaagggcctgtcccccgacggctaccgtgcctttcgcgccgaccgggaggcggcggca

SEQ ID NO: 3512 - DNA, 840 bp, Streptomyces avermitilis
  CDS (1)..(840)
gtgattctggtgacgggcgcgaccggcgtggtgggccgccaggtggcacacacactggcgcggtccggccgggtgcgccttctggtccgcgacccggcgcggctcacggtcgaagggcccggcgtcgaggtcgccaccggagcgtacgaggaccacgcgtcgctgctgcgggcactgaagggcgtcgaggccgcgttcctggtcaccgtcgatccgggcggtcaggaggacgggcggttcctgcgggcggcggtggcggccgacgtacggcatgtggtgaagctgtcctcgtacgcggccggtgaggacgacgccgacgacctgatcacgcggtggcagcggaagtgcgaggagacgctgcgctcctccgggctcgactggaccctgctgcgaccgcgcgccttcatgtccaacaccctgtcctgggcggactccatccgccgggaaggcaccgtgcgagccctgtaccccggctcggagaacgcctgcgtcgacccccgtgacatcgccgaggtcgcggtgaccgcgctgacctcacccggccacgagggccgggtgtatcccctcaccggccccgaagcggtctccgcggagcaacagacgcggcacctggcggcggtcctcggccgcccgctggtctgccgcgaactgacaccacagcaggctgccgcccggtgggcgcggcgctacccgcccaaggtggtgcacgcactcgtcctgagcgcacaacgccagctgctgggccgcaagacgacgaccgaccccacgttcgcccgggtcacgggccacccaccacgctcctaccgacagtgggcgacggaccacaggaacgcgttcgcc

SEQ ID NO: 3513 - DNA, 768 bp, Streptomyces avermitilis
  CDS (1)..(768)
gtgaccagcactcccctcgccgaccggaccaccgcggtggccgcccgcgccacggaactgtcgaaggtctacggacagggcgagacccaggtggtcgccctggaccgggtcaccgccgacttccggcaggccgagttcaccgcgatcatgggcccctccgggtccggcaagtccacgctgatgcactgcgtcgcgggcctcgacaccttcagcagcggctccgtgcgcataggcgacaccgagctcggctcgctcaaggacaagcagctcacgaagctccgccgggacaagatcggcttcatcttccaggcgttcaacctgctgcccacgctgaccgccctggagaacatcaccctcccgatggacatcgcgggccgcaagccggacaagcagtggctcgacaacgtcatccagatggtgggcctgtcgggacggctgagccaccggcccgcccagctgtcgggcggccagcagcagcgcgtcgccgtggcccgcgcgctcgcgtccaagcccgacatcatcttcggcgacgagccgaccggaaacctggactcgcgctcgggcgcggaggtgctgggcttcctgcgcaactccgtacgggagctggggcagaccgtggtcatggtcacgcacgacccggtggccgcggcctacgccgaccgggtcgtcttcctggcggacggacgcatcgtggacgaggtgcacgggccgacggccgacgcggtcctcgaccgcatgaagcagttcgacgccaagggccgcacgagc

SEQ ID NO: 3514 - DNA, 2526 bp, Streptomyces avermitilis
  CDS (1)..(2526)
atgttccgtaccgccttgcgcaccgtactcgcgcacaaggccaggctcgtcatgaccgtgctcgccgtgatgctcggcgtggcgttcgtctcgggcaccctggtcttcaccaacaccatctcggacgcctaccagaagagctccgccaagggcttcgaccaggtcgacgtcgccatccaggcggagagccgccaggacgagggcgacacgatcgccgagcggcccaagctcacccaggcgctcctcgacaaggccgccgaggtgcccggcgccggctccgccatcggcgtcgtgaacggcttcaccgccatcgccgaccaggacggcaagctcgtcggcaacggcttccagtcgcagggcgggaactactgggggaccaaggacccccgttaccccctgaccgtcggacacgccccccgcggcaagaacgagatcgccctcgacgcgaggacggccgagcgcgccggatacaaggtcggcgacaccgtacggctctccgtcgacggcccggtgctcaccccgaaggtcaccggcatcttcaccaccgacgacggcaacgtcgcggccggcggcagcctcgccctcttcgacaccgcgaccgcccagcagctgttccacaaggccggcgagtacgacgagatcgatgtgaaggccgcctccgggacgagccagatcgcgctgcgcaacgcgctcgacgaggtcgtgccgaaggacgtcgcctccaccaccaccggcaagcagctcgccgacgaccaggcgacccagatcgcctccgcgatgagcggcatgaagaccggcctgctggtcttcgcgggcatcgcgctcttcgtcggcaccttcatcatcgccaacaccttcaccatgctggtcgcccagcgcaccaaggagctggcgctgctgcgcgccgtcggcgcctcccgcaggcaggtcacccggtccgtactgatcgaggcgttcgtcgtcggcgcggtcgcggccgtcaccggtctggccgcgggcatcggcatcggcgcgggcatgcgctccctgatgggcaccctgggcgccaccgtccccgacggcccgctggtcatctccccgggcacggtcgccacggcgctgctcgtcggcatcctcatcaccatgctggccgcgtggctgccgggccggcgcgccgcgaagatcccgccggtcgccgcgatgagcagcgtgcacgccaaggccaccaccaagtccctggtcctgcgcaacacgctcggcgccctgttctccgccgccggcatcgcggtcgtcctctacgccaccaccctggacggctcggacgggcaggccccgatgggcctcggggcggtgctgctcatcatcggcgtcttcatcctcacgccactgctgtcacgcccgctgatcgccgcggccgccccggtgctgcgtatcttcggggtctccggcaagctcgcccgccagaactccgtacgcaacccgcggcgcaccgccgcgaccgcctccgcgctgatgatcggcctcactctgatcaccggcatgacggtgatggcgggcagcctgcagacgtcgatcgacaagatggcgtcctccgcgatcaaggcggactacgtcgtctcgatggccaacggcaactacctctccacggacgtcgacaagaagctctccgcgacggacggcgtcaccgccaccagcccgctgcgcaacgcgccctcgcgcatcgacggcgagaccgagtacctgaccggcgtcaacggccggtccatcaacgacctgaccgatctcacggtccaggacggcgccttcaaggtcggcggcacgcaggtcgtcgtcgacgacgagaccgccgcgtcccaccactggacggccggttcgcggttcacggcctcgttcgaggacggcaagaagcagcggctcacggtcaccggggtgtaccagagcaccgagatgatgcgcggcatcatgctggacaacgccacgctcaccccgcatctgaccgacccgtccgacatgcaggtcatggtcaagacgtcggccggcgcgtccggcccggtcaaggaccggctggagaaggcactcggcgacaacccggccatcaaggtccaggacaagaaggacatctccaacgacatcgcgcagatgttcacgctgatgctgaacatgctctacggcctgctggcgatggcggtgatcgtcgccgtcctcggtgtcatcaacaccctggccatgtcggtcttcgaacgctcgcaggagatcggcatgctccgggcgatcggcctggaccgcaagggcatcaagcggatggtccggctggagtccctggtcatctcgctcttcggcggtgtgctcggcatcggcctcggcgtgttcttcggctgggcggccggtgaactgctcggcaccaagatggcgacgtacgaactggtcctgccctggggccggatggccctcttcctcctgctggccgcggcggtcggcgtcctggcggccctgtggccggcccgccgggcggcccgcctgaacatgctgacggccatcaagtcggag

SEQ ID NO: 3515 - DNA, 1287 bp, Streptomyces avermitilis
  CDS (1)..(1287)
atgccagacgccgcgctgcggctgaagagccttctcgaccagttgctgggagccccgctcccgctgcgtattcacgcgtgggacggttcggaggccggcccgcccggtgctcccaccctcgtcgtgcgcaatcgccgcgccctgcgccggctgttgtggaaacccggcgagctgggcctggcccgggcctgggtcgcgggcgacgtgacggtgcggggagacctctacgccgtcctcgacctgatcgccgggctcctctgggagcgccgcgacgacgcccgtaccctcaccgaggccctgcgtgacccggacgtacgcgccgcggtcagcggcctggtgcggatggccggacccccgctgccgcccgccccgccccgcgaggaggtccgcagacgcggccatctgcacaccaagcgcagcgaccggcgcgccatcagccaccactacgacgtcggcaacgacttctacgagatcgtcctcggcccgtccatggtgtactcctgcgcctactgggccaccccggacggcacactcgaggacgcccagcgcgacaagctcgaactcgtctcccgcaagctcggtctgacccccggtcagcggctcctggacgtcggctgcggctggggctccatggccatccacgccgcccgcgagcacggcgtgagcgtcgtcggcatcaccctctcccaggagcaggccgcgtacgcccgtaagcgcgtcgccgacgaggggctgaccgaccgggtcgagatccgcgtacaggactaccgggacgtgaccgacggcccgtacgacgcgatctcctccatcggcatggccgagcacgtcggcgccgagcggtacctggactacgcgcgggatctgtacgccctgctcaagccggacgggcggctcctcaaccaccagatcgcccggcggccgcagctcgacgaatccacgtactccgtcgacgagttcatcgacgcgtacgtcttcccggacggtgagctcgcgcccatcggcagcacggtcacccagctggagcgggccgggttcgaggtccgtgacgtcgagtccctgcgtgagcactacgccctcaccctgcggcgctgggtcgccaacctggaggcccagtgggtgcggggcgtacggctgacgagcccgggccgggcccgtgtctggcggctgtacatggccgcctgcgccctcgccttcgagcacaaccgcatcggcgtcaaccaggtgctggcggtcaggacaccggagtcgggcgcctccgggatccctctgcgggcacgtacctggaac

SEQ ID NO: 3516 - DNA, 1305 bp, Streptomyces avermitilis
  CDS (1)..(1305)
atgcgctacggcgaggcgaccgtcacggtcgtcgacccccggtcgtacatgacctaccagcccttcctccccgaaaccgccgccggcagcatctcccctcggcatgtcgtcgtcccgctgcgacgcgtgctgccgaaggcggaggtcctcaccggccgggtcaccaccatcgaccaggaccgcaaggtcgccacgatcgcccctctcgtgggtgaggcgtacgagctgcctttcgactacctcgtcatcgcgatgggcgcggtctcccgcaccttcccgatccccggcctcgccgagcagggcatcggcatgaagggcatcgaggaggccatcggcctgcgcaaccacgtcctcgagcagctcgacaaggccgactcgacgaccgatgaggaggtccgccgcaaggcgttgaccttcgtcttcgtcggcggtggcttcgccggcgccgagaccatcggcgaggtcgaggacatggcccgcgacgcggccaagtactacaacaacgtgtcgcgcgaggacatgcggttcatcctcgtcgacgccgccgacaagatcctccccgaggtcggccccaagctcggccagtacggcaaggagcacctggagagccgcggggtcgagatctacctctccacctcgatggactcctgcgtcgacggccacgtcgtgctgaagaacggcctcgaggtcgactccagcacgatcgtgtggacggccggcgtcaagccgaacccggtcctgtcccgcttcggcctgccgctcggcccgcgcggtcacgtggacacccagaccaccctccaggtgcagggcacggactacatctgggccgccggcgacaacgcgcaggtgccggacatggccgcccgcaaggccggcgtcgagaacgcctggtgcccgccgaacgcgcagcacgcgctgcgtcaggcgagggtcctcggcgacaacgtggtctccggtatgcggggcttcccgcagaaggagtacgcgcactccaacaagggtgcggtggccgggctcggcctccacaagggcgtcgcgatgatcgtcatgggcaagatgaagatcaagctcaagggccggctggcgtggtacatgcaccgcggctaccacggcctggcgatgccgacgtggaaccggaagatccgggtcttcgcggactggacgctgcagatgttcctgaagcgtgaggtcgtggcgctgggcgcgctggagtccccgcgcgaggagttctacgaggccgccaagccggcgccggctccggccgccgcggtcgcgccgaagaccgaggagaaggccaaggcctcc

SEQ ID NO: 3517 - DNA, 939 bp, Streptomyces avermitilis
  CDS (1)..(939)
atgacccgcgtcgccgccatcgactgcggtacgaactccatccggctcctcgtcgccgacgcccacccggagaccggggaactcgtcgacctcgaccggcggatgaccatcgtccggctcggccagggcgtcgaccggaccgggcggctcgcgcccgaggccctggagcggaccttcgcggcctgccgggagtacgccgcgatcatcaaggagcacggcgcggagaagatccgcttcgtcgccacctccgcctcccgcgacgccgagaaccgcgacgagttcgtgcgcggggtcatcgacatcctgggtgtcgagcccgaggtcatcaccggcgaccaggaggccgagttctccttcaccggcgcgaccaaggagctgaccggccgcgacgacctcgccaagcccttcctcgtcgtggacatcggcggcggctcgacggagttcgtggtcggcgacgaccatgtgcgcgccgcacgctccgtcgacatcggctgcgtccgtatgaccgaacgtcacctggtgcacgacggccaggtagtcgacccgccgtcgcccgaccggatcgaggcgatccgggccgacatcgacgcggcgctggacctggtggagcagaccgtgccgctgcacgaggcgcacacgctggtcggcctggccggctccgtcaccacgatctcggcgatcgcgcagaacctcccggagtacgactcggtcgccatccaccactcccggatcccgtacgaccgcgtccgcgagatcaccgagtggctgctggcctccacccacgccgaacgcgcggccgtcccctccatgcacccgggccgcgtcgacgtcatcggcgcgggcgccctcgtactgctctcgatcatggagcggatcggggcgcgggaggtcgtggtcagcgagcacgacatcctcgacggaatcgcctggtccatcgcg

SEQ ID NO: 3518 - DNA, 522 bp, Streptomyces avermitilis
  CDS (1)..(522)
atggaaacgcccccgccgaccactccgcgcaccgagccgaccgacgcggacgtcgaggccttcaagcagcagctcgggcgcccgccgcgcggactgcgcgccatcgcgcaccggtgcccgtgcggacagccggacgtcgtcgagacggcgccgcggctgcccgacggcacgccgttcccgacgacgtactacctgacgtgcccgcgggccgcgtccgcgatcggcaccctcgaggccaacggcgtcatgaaggagatgacggaccggctggcgaccgaccccgagctggccgcggcctaccgcgcggcgcacgaggactacatcgcccgccgcgactccatcgaggtcctggagggcttcccgagcgcgggcggcatgccggaccgggtgaagtgcctgcatgtgctggtggcccactccctggccgcgggcccgggtgtgaacccgctgggcgacgaggcgatcgcgatgctgccggagtggtggcgcaagggggcctgcgtggtgccggccgccgacgag

SEQ ID NO: 3519 - DNA, 492 bp, Streptomyces avermitilis
  CDS (1)..(492)
gtgaaggggaggcgggagatggccgtgaaggaccgggaccggttctccaccgcgaccaggctgcggctgctcggcgagcagacggcggcccgcgtctaccgctcccagaccaagcggcaggcccgccgctcccggctgaccagccgggccgcgctgctcgcgctggtgctgtgctcgctgatcgtggccctcgcgtacccgataaggcagtacgtgtcccagcgcgccgaggtcgccgatctccagcggcagcaggagcgggcccggcagcgcgtcgaacagctgcgtgacctcaaggcccgctggcaggacgacgcctacgccgagcagcagatccggcagcggctgcactatgtgatgccgggcgagaccggctacatcgtgatcgacccggccgcggccaagccggcgcggacgacgcagggtgcggccgaccgcccctggtacgccaacgtctgggacggggtcgacaagtccgacgcctccgaccag

SEQ ID NO: 3520 - DNA, 1284 bp, Streptomyces avermitilis
  CDS (1)..(1284)
gtgccgtccatcgacgtcgtcgtagcccgggaaatcctggactcccgaggcaaccccacggtcgaggtcgaggtcggcctcgacgacggcagcacgggtcgtgccgccgtcccgtccggcgcctccaccggtgccttcgaggccatcgagctccgcgacggtgaccccaaccgttaccagggcaagggtgtcgagaaggccgtcctcgccgtcatcgagcagatcggcccggagctcgtcggctacgacgccaccgagcagcgcctgatcgaccaggcgatgttcgacctggacgccaccgacaacaagggctcgctcggcgccaacgccatcctcggcgtctccctcgccgtcgcgcacgccgcctccgaggccagcgacctcccgctcttccgctacctgggcggcccgaacgcgcacctgctgcccgttccgatgatgaacatcctgaacggcggctcgcacgccgactccaacgtggacatccaggagttcatgatcgccccgatcggcgcggagtccttctccgaggccctgcgctggggcgccgaggtctaccacaccctcaagaaggtgctgaagaccaagggcctgtccaccggcctcggcgacgagggcggcttcgccccgaacctggagtcgaaccgcgccgcgctcgacctcatcatcgaggccatcaagcaggccggttacatcccgggcgagcagatcgcgctcgcgctcgacgtcgccgcgtccgagttctacaaggacggcaagtacgagttcgagggcaagtcccgctcggccgccgagatgaccgagtactacgaggagctcgtctccgcgtacccgctcgtctccatcgaggacccgctgtacgaggacgactgggccggctggaaggtcatcaccgacaagctgggcgacaaggtccagatcgtcggcgacgacctcttcgtcaccaacccggagcgcctggcccgcggcatcgaggagggctccgccaacgccctgctcgtcaaggtcaaccagatcggttcgctgaccgagaccctggacgccgtcgagctggcccagcgcaacggcttcaagtgcatgatgtcccaccgctccggcgagaccgaggacgtcaccatcgccgacctcgccgtcgccgtgaactgcggtcagatcaagaccggcgccccggcccgctcggaccgtgtcgccaagtacaaccagctgctgcgcatcgaggagatcctcgacgacgccgccgagtacgccggccgctcggcgttcccccggttccgctcggcgaac

SEQ ID NO: 3521 - DNA, 681 bp, Streptomyces avermitilis
  CDS (1)..(681)
atgctgctttccagcaagggcaagcaccgccgcccgtccaaggccactcgtgcgatcgccatcgccggtgtcaccggtgccgccgtcgccgccccgctcatggcggccggcaacgcctccgccgccaccgcctccgagtgggacgccgtcgcccagtgcgaggccggcggcaactggtccatcaacaccggaaacggctactacggcggccttcagttctcggcctccacctgggccgcgtacggcggcacggcctacgcctccaccgccgaccaggcctccaagtccgagcagatctcggtcggcgagaaggtcctcgccgcccagggcaagggcgcctggccgacctgcggcaccggactttcgggcgccgcgaacaacgccggctcgccggccccgagcaccccgcagcagagcaccccgaagagcagcaccacccagtcgaccgagcagcgcgcctcccgttcggacgagcggccggccgccaagaccgtcgagaccccgaccggcaagaaggtcaagaagggcgacggcgagtacaaggtcgtcaagggcgacaccctcagctccatcgccgagaagaagcacgtcgcgggcggctggcagaagctgttcaagctgaacaaggacatcgtcgacgacgccgacttcatctacccgggccagcagctccacctgagc

SEQ ID NO: 3522 - DNA, 957 bp, Streptomyces avermitilis
  CDS (1)..(957)
atgctctccgggaacggtcgacaccgacgcccccgtcaggctccggccctcctcgtcgcggccggcgtgaccggctcggccatcgcgatcccgttgctcggcgccaccggcgccagcgcggccagcggtacgacgtgggaccaggtcgcggagtgcgagagcggaggctcctggagcgccgacaccggcaacgggtactacggcgggctccagttgtcccaggggaactgggagaagtacggcggtctcgactacgcccccagtgccgaccaggccagccgctcccagcagatagccgtcgccgagaaggtcctcgccgccaagggcagctccccctggtccacctgcggcatcgctgtcggcctcagccaggactccggttcggccgacgtcgacacgggcctcctcggcagcggatccacggccgactccgactccggttccggcatcagctccggcctgtccgactcgtcctcttcgtccggctcctcgtccgcggccaaggattccaagggctccgccaaggccgacgccacgccgtccggctcttcgacttccgacagctcgtccgcggatgcggcgaagagtgacgactcggacaagtcagggcagaacggcgacgcttcgaccccctccgaggcggagtccaccagctccggccggcaccgcggcgacacggccgacgagagtgccgccgacggccgcgccgacgactccaccggccggcatgcctcccgcggctccgacggctcccgcgaggcggctcccgacgcggccgacgacgcgtacgtcgtgcgccccggagacagcctgtcggccatcgccgactcccttgggctcaggggcggatggtccgcgctgtacaccgagaacgagaagaccgtcggcgccgacccggacgtcatcgtccccggtcagagccttgcacttgctgccgaaccgggcgaaaagcagcgg

SEQ ID NO: 3523 - DNA, 1371 bp, Streptomyces avermitilis
  CDS (1)..(1371)
gtggcggggtcggcacggcggcggggtcggcacggcggcggggtcggcacggtggcggggtcggccgccggtacgcgccgactccagcgagaacgcggctcccggtaccgtcaccccgtgaacgccccacatagcgaacccgaactcttcacctgggagttcgccaccgacccctaccctgcctacgcgtggctccgcgagcatgcgcccgtgcaccgcaccacacttcccagcggtgtcgaggcgtggctggtgactcggtacgcggacgccaagcaggcgctggccgacgcgcggctctccaaaaatcccgtgcaccattccgaagacgcccccggaaagagcaagacgggtatccccggcgagcgcagcgccaacctcatgacccatctgctcaacatcgacccgccggaccacacgcgcctccgtcggctcgtctccaaagcgttcacaccccgccgagtggccgaattcgcgccccgggtccaagagctgaccgaccacctcatcgaccagttcgcgcagaccggaagcgccgacctcatccatgagttcgcgttccccctccccatctacgccatctgcgacctgctcggcgtcccccgcgaggaccaggacgacttccgggactgggcggggatgatgatccggcacgggggagggccgaggggcggtgtcgcgcggtccgtgaagaagatgcgcggctatctcgccgagctgatccaccgcaaacgggaggcgctgccggccgaccccggccccggcgaggacctcatctccggtctcatccgcgcctccgaccacggcgagcacctcaccgagaacgaagccgcggccatgtgtttcgtactgctgttcgccggttttgaaacgaccatcaacctcatcggcaacggcacatacgcgctgctgcgcaacccacagcagcgggcgcgactgcagcagtcgatcgagcggggcgaacaggacctgctcgacaccggtatcgaagagctcctccgctacgacggccccgtcgaactggctacttggcgctacgcgaccgagcccctggacatgggcggacagcgcatcgcttccggtgatcccgtgctcgtggtcctcgccgccgccgaccgtgatcccgcgcgtttcgacgagccggacacgctcgacctctcccgcagcgacaaccagcacctcggctacggacatggcatccactactgcatcggcgcgccgctcgcccgcctcgaaggccgcacggcgctggccaccctgctgcgccggctgcccgatctccgccttgccgccgatcccgcggacctgcgctggcgaggcggcctgatcatgcgcgggctgcgcaacctccccgtggagttcacggccacc

SEQ ID NO: 3524 - DNA, 1032 bp, Streptomyces avermitilis
  CDS (1)..(1032)
gtgggttacgttcgaggggtgaacgcaaccagcctcaacggcgactcgaacgtgaccggtgccgacgcccccgcccccggccgcatcgtcctgctcaccaccagtcaccgtgtcgcacccggactcctgtcctggcccgcctggcaggcgctgcacggtgccgaccgggtcctgtgcgcggacggcgcgcacccccagctgccgtatctgcgcgaggcgggcatcacggtcgacgaggcgtccccgaccgccgaggagctggtcgacgcctgcgccggcggccgcacgctggtcgtcgtcgcgaccggcgagggcgagccgcgcctcaccgacgggctggcccgcctcgcgggctccggccgcatacagatgccggacctggagctgctccccgcctcgtacgacctgccgggcgcccgtctcctcgacctcgtccaggtcatggaccgcatccgcgccgagtgcccctggtcgtcccagcagacccacaagggcctggccaagtacggcatcgaggaagcgtacgagctggtcgaggcgatcgaggagggcgaccgcgacgaactccgcgaggagctgggagacgtcctgctccaggtggtcttccacgcccggatcgcggaggaggacgaggacgagccgttctcgatcgacgacgtggcgggcggcatcgtcgccaagctgatccaccgccacccgcacgtcttcggcgacgagaccgcggccactccggaggaggtcaaggagcactggctgcgcaccaaggcggtggagaagcagcggacctcggtgaccgagggcgttccgctcggccagccgggcctggccctggccgcgaagctgtcgtcgcgggtgcgcacggcgggactcgacgtaccgctgccgcacggcgaggacgtcggctacgagctgctggcgatggccgcgcgcgccgaggcggagggcgtggacccggaggcggcactccgggcggcggcgcgggcctaccgggacgcgatccggggggcggaggagacgggcgcggcgggggac

SEQ ID NO: 3525 - DNA, 657 bp, Streptomyces avermitilis
  CDS (1)..(657)
ttgcaccgccgccgtcgcaccgcgctagtcctctccgccgcgatcgtcgcggcggctcccctcctcaccgcgtgcggcggcgaggcgcaccccggcgccgcggccgtcgtaggcggccaacggatcacggtcgcgcagctggagagccgggtgaacgaggtgcgcacggcccagcgggccgccaccacggacgacgcccagtacgagcagaccatcgccaagaccggcagcctcacccgcgacaccctgcacagcctggtcctggaccgggtcctggaccgtgcggccaaggacgcgggtgtcagcgtgacccgcaaggacgcccagcagatgcgcaccgccctggagcagcaggcgggcggcacgaaggcgctggagtcggcctggctccagcagtacggcgtggcaccggggcggctcgacgacagcctccgcaccgagatcgaggcgcagaagctggccaccacgctcggcgccgacatgaacacggtcaacggcaaggcggcgttctggaaggcgatgtccgaggcctccaagaaactccacgtcaccctgaatccgcgctacggcacgtgggacgtgcagaagagcagccgggtggacgcgaagaccccgtggctgcgggaggtcacggcgacaacgacccagcagacggcg

SEQ ID NO: 3526 - DNA, 726 bp, Streptomyces avermitilis
  CDS (1)..(726)
atggcggccacgacctggcccgcgcagcggacgttcaccggccgcgccttcgacacctgcgccgcgccctccctgtccgcgatgaaggcctggcacaccggcttctacggcgccgccgccgtctacgtgggcggcaagaaccgtggatgcggccagcccaacctcaccgcctcgtgggtcaagtcggtcagcacgctcggctggaagctcatcccgctgtacgtcggcgcccagccgccctgccagaccggctccagcccggagaagatcaccgcctccactgccgcctcgctcggcgccaccgacgccgcggacgcggtcgccaaggcgtcggccctggggatgaaggcgggcagcccgatctacctcgacatggagtcgtacgacgtcaccgacaaggcctgcaacgacgccgtactgacctatgtacgcgccttcgacaaggccctgcacgccaagacctaccgcaccggctactacggcttccgcagctccagcgcgaaggccgtcgccgacgccaccgaccgcacggacctgccgggcaacctctggtacgcgctgtgggacaagcagaacaccacgacggcggactggccgttcggcgccggtcagtggacgaaccacagccgagcccaccagtacatggtcaacagcaaggagtcgcgcggcgggtacacgatcaccgtggaccgcgacgcgtgggacgcgccggtggccatcacaggt

SEQ ID NO: 3527 - DNA, 1461 bp, Streptomyces avermitilis
  CDS (1)..(1461)
atgggccaggtctggacggcatacgacaaaaggctcgaccggcgcgtggccgtcaagctgctgcgccccgacaaggtcgcgggccaggaggccgacgagctgcgccgccgtttcgtgcgcgagtgccgggtcaccgcgcaggtcgaccacccgggtctggtcaccgtgcacgacgcgggcagcgagggcgaggagctgttcctcgtcatgcagtacgtcgacggggccgacctcgccgaccacctcgccgagcacaccccgtatccctggcagtgggtcgtcgcggtggccgcgcaactgtgcgccgtactgtccgcggtgcacgccgtgcccatcgtccaccgcgacctcaagccgcggaacgtgatggtcaagcaggacggcacggtcaccgtcctcgacctcggtgtcgcgtcggtcatggacacggacaccacccgcctgacgcacacgggttcgcccatcggcagccccgcctacatggcccccgagcaggcgatgggcggcgcggtcggcccgtacaccgatctgtacgcgctcggcgtgctcatccacgaactcctcagcggcgacgtaccgttcaccggctccaccgcgctcggcgtgctgcaccgtcacctctacgagccgccgctcccggtgcgccggctgcgccccgaggtgccggaagccctcgaagcgctcgtcctgcgcctgctggccaaggacccgcagcaccggccggcctccgcgcaggagacgtacgagcagctgctgccgctcctccccgcgcgcggcacacccaccggcgccccgctcgaccccacacgtcccttcctgcgcccgcacgccccctggccggaccgggcccgtacgcccgcgccgcagccgtcggccgccgcgtccgcgcccgccgtcgagaaacccgatgtcgtgggcgccgtggacgaggtcaagcggctcctcggagagggccgcatcacccaggccgtcgacatcctcggcgcgatcctcccggcggccgccgcccagcacggcgagcactcgcccgtcgtacgcaccctgcgcaagcagtacgccgccacgctcatggacgacggccagtaccgccgtgccctgcccgagctgcgccgcctggccgacgagcgcgccaccgaatcgggccaggccgacccgcagtccctgcgcttccgctacgacgccgcgcagtgcctcgaacagctcggcgaaccggcggccgcgctcgcggagtaccgcgccctgctcccgtactacgagaaccagtacgtcgcgggcgaccccgaactctccctcgaagtccgccgccgcatcggccacttgctgctcgccctcggcgaccgcgtcgccgcccacgacaccctcgcccggctgctgcacgacgtggagcgcctgcgtggacccggccatccgctggtggcggaggtacggcggaccttgcaatggctgggacaggtgcgcggg

SEQ ID NO: 3528 - DNA, 588 bp, Streptomyces avermitilis
  CDS (1)..(588)
atgtacggccacggcgcgccgccgcccacccgcagtcagggcacggtcatcaccttgcgcgtgctgttcgtcgccgcggggttcctctcctgcgggctgctcgcgtgcctcccgctgttccgggtcgcggtgctgcgcggcaagtggcccgactggctgctggcctggctgagcctgccgctgtccatcgccgggctcgccgtggtcggctcggtccccgagagcgaccaccggggcgacgtcgcgctcgcctccgtgctcatcctcggtgccgtcagcgccgcgtacttcgtggtcttcgacatacgccaccagcgcactctgccgtccgccgaccgccccgtaccgccgcacaccaccggctacatgcccccgcagcagccccagccgggctacggctacccgccggcccagccgtacgccgccacgcagatctcgcacacaccgcccccgtacacccccacaccgccgccgcagcccccggccccggccccggagccgcagcgtcccgcgcccgcgcgcatcgaccaggtgcgggccgagctcgacgaactgagcgactatctgcgcaagcacgaggacggcaga

SEQ ID NO: 3529 - DNA, 2034 bp, Streptomyces avermitilis
  CDS (1)..(2034)
gtgcaggacaacgcgacagaggtgaccgccgccggaatcgcccggctcgcgggggtcggccgcgccgccgtgagcaactggcgccgccggcacgccgacttccccaaaccggtcggcggcaccgagaccagcccgtccttcgcgctcgccgaggtcgaggactggctgcgccgacagggcaaactcgccgaagtacccctacgggaacgcgtctggcagcagctcgtcggccacccggagggccccgtcgcggcgctcgtccacgcgggctgcgcacttctcctgatccacgaccgccccacggtctggctggagctgagcgccgcctccgacgaacgcctggccgaactgctgcccaccgccctcgaacaggtcctcgccccccgcttcggcatggtccgccggccggccgtgcgcaccccggcccccgccgaactcctcccctcggccccgctgctgcgcggcgcggccgaactcgccgccgagctcggcgcccgccagacgtacgagttcctgctcggccggcacctcgacgccaacccgcgccagtacacgctcacgccgggcgacctcgccgccctgatggccgacctcgcgggccccgcccgcagcttcctcgacccggcttgcggcaccggcgccctgctgcgcgccgtcgcccccggcaccgaccaggagctctacggacaggacagcgcccccgaactcgccgagctcaccgcactccgcctcgccctgcacaccagggcggccgtccgcaccgcggtcggcgacagcctcagggccgacgcgtacgagaccctcagagccgacgcggtgctgtgccacccgccgttcaacgagcgcaactggggtcacgacgaactcgcctacgacccccgctgggagtacggcttcccggcccgtacggaatccgaactcgcctgggtgcagcacgcgctggcccgcctcagggacggcggcaccgccgtcctgctgatgccccccgccgccgcctcccgccgctcgggccgccgcatccgcgccgatctcctgcgccgtggcgccctgcgcgcggtcatcgccctgccggtcggcgcggcacccccgtacaacatcccgctgcacctgtgggtgctgcgccgccccgaaagggcgcccgcgcagcccgaggtgctcctcgcggacacggccggcgtctcggaggccgccgacggccgcggccgtctcgactggccggccgtccgcgccgccgtcctggacgcctggcaccccttcgaccgcaccggcaccacccgcgaagagcccggcgtgagccgctccgtgcccgtcatcgagctcctcgacgacgacgtcgacctggcccccgcccgccatctgcccccgcccgccgcgggcggcggcgcggcggaactcacggccgtacgcgaacgcctcggcgaaaccctccgcctgaccgccgacctcaccccgccccccaccggcaccgcgggccccgcccgctggccgctcaccacgatcggtgaactcgcccgcggtggcgccctgctgatgcgcaccggcggaagcggcccccacgcgcgcgtgctcaccgatcacgacgtgatcgccggcaccgcgccctccggaacgctgaccgacaacgcttcgcccgaggaacccgtcctcgtcgaggcgggcgacgtcgtcgtcccggtcctcggcggcggcgccatcgcgcgcgtggtcgacgacgcgaccgccggggccgccctcggccgcaacctcaccctgctgcgtcccgacccggccgcggtcgacccctggttcctcgccggcttcctgcgcggcaccgccaacaaccgccaggccagcagctacgcgtccaccgcgaccaggctcgacgtgcgccgtctccaactgccccggctcccgctcgaccagcagctccgctacggggagcggttccgggcgctcgccgccttcgaggaggcgctccgcctcgcggggcgcctcggtgagcagctcgtgcgcggcatgcacgacggtctcacggacgggtcggtcgccccggag

SEQ ID NO: 3530 - DNA, 747 bp, Streptomyces avermitilis
  CDS (1)..(747)
atgcgtcgcaccgcacttgccgctctctgcctcgccgccgcggccaccgcgggactcaccggctgtctgcccggccaggacaaggcggacagcaagccgaagggcccgttcgccgggctgaccggcggcgagatcgccgaccgggccgtgaaggccaccaacggtgcgtcgtcgctccggatgaagggcgacgtccccgacgacgagagcggcggcacgatccagctggacatggccctgaacaagaagggcgagtgcgccggcacgatgagcatggacggccagggcaaggccgacctgatcaagaccgacgacaccgtctacatgaagtacgacgaagccttcctgcgcgcccagagcaagggcgagcccaagggggacaccgacgcggtcgtggccatgatggccgggaagtggaccaagatgtcggcgaagggccaggacgccaaggacatcgcgagcttctgcgacctgggcacggtgctcgccggcgccgaggacgtgaactccgacgccacccggggcaaaacgacgacggtggaggggacgcctgcgatcgtcctccacgagaaggacggcaaggaccgctacaccctgtacgtcgccaccgagggcaagccgtatctgctgaaggtcgtcagcacgtccgccaaggacgcgggcacgatcgccttcagcgactaccagaagccggtccccgccgaggcgcccaagggcaaggtgctggacctggacgcgctgagcgac

SEQ ID NO: 3531 - DNA, 717 bp, Streptomyces avermitilis
  CDS (1)..(717)
gtgcgtctgaggggtggggcggccgccgccgcggcggtgctgatcgctgtcggcggcgtcggcggctgcaagaaggagaccaacggatcctcgggaccgcaggagacggcggccggcggtgccgcgatctccgcggtcgactcgctgaccgtcaaggggcgggcgccgaagacggggtacgaccggggcaggttcggtaccgcatgggcggacacggactcgaaccggtgcgacacccgggacgacatcctcaaacgggacctgaaagaggtgaagttcagcgacggcaagtgcaaggtgaccgccggggtgctggacccggacccgtacaccggtcagcaggtcaccttcgcgcgcggccgcagccaggtggacatagaccacctcgtcgcgctctcggacgcctggcagaagggcgccaagtactgggacgccggcaagcgcatagccctggccaacgacccgctcaacctcctcgccgtcgacgccggccccaaccgcagcaagggcgacggcgacacggcgacatggctgccgcagaacaaggcgtaccgctgtacgtacgtcgccgcccaggtcgccgtgaagaagaagtacgacctgtgggtgacgtccgcggagaaggccgccatgaagaaggtgctgtcgacctgccccggccagaagctcccctccgggggcaacccgaccgaggccccgaagcgcttccacgcgaac

SEQ ID NO: 3532 - DNA, 924 bp, Streptomyces avermitilis
  CDS (1)..(924)
atgtccgagaacaccagcggggcgagcgggggcggcggcacggtgcggggcgaggagcggaccggtgtcgacctgggcaccgtgcgccggctctggcatctgctggagcccttgcacgccgtgctgtattacgcgccggaagccttcgacgaggcggcggcgctgggatacgggactcaggaacgctgggagagctacttcccgtaccgcgccgcgccgttgggtgccgtcggaagcgagcgcgtgacctccgccttctacagcttcagtccgcgcatggtcgccgcgtacatggactcagcctgggacaccgcgagcccggacgcggtgctgaaggcgcgggaggcggcgatggaccgggcctaccgggcgatattcggcgaccgtgcggacagccccgaactcgccgaggcggccgcgctggcccgccgtgcggcagaggcggcgaacacggcgggacgcccgctggccgcggccaacgccgagctgccctggcccgaggccccgcaccagcagttgtggcacgcggcgacgatcctgcgtgaacaccgcggcgacggccacctcgccgcacttctcgtcgcgggcctcgacccggtcgaggccctggtctccttcgccgcgataggcgcggcctcggtggagcgcttcgagagccgtggctggacgtccgaggagtggacggccgcgcggaaccggctggccgcacggggcctggtgggcgaggacggtgtggcgacggaggccggccgcgccctgcgccgccaggtcgagcaccacaccgacgaactcgccgccgagccctggcagtccctgggcgccgacgcgaccggccgactcgccgacctgctgggggagttctgggtcgcggtactgggcacgggcctgttcccgccggagacgacactggggatcgggaaggtc

SEQ ID NO: 3533 - DNA, 600 bp, Streptomyces avermitilis
  CDS (1)..(600)
atgccgagcagccagaccgccgatcagcgcgatcaacccgaccagcgcccctaccaccacggagacctccgtcgcgcgatcctgggcgccgcactcgacgtcatcgccaccgacggcccctccgcactgagcctgcgcgacctggcacgccgggcgggcgtctcgcacgcggcgccggcccaccacttcaaggaccgcaccggcctgctcaccgccatcgcggcggagggctacgaactgctcgccaccgccctggccgacgccgatgacctgcgcgacgccggcgtccgctacgtacgcttcgcgaccgggcacccggcgcacttccaggtgatgttcacaccggagctgctccgcgcgaacgacctggagctgacgacggccaaggccctcgccggcgagcggctgcgctcggccgtctccgacgcgcccgccggccgcggccccgacccccgcctcgcgggcgtcgccgcctggtccctggcccacggcttcgccacgctccttctcagccacaacctggacggaccggtcggcgaccaggacccggaggaggtctttcgcacgctggcgggaatgctgttccagtcgaagtcgtct

SEQ ID NO: 3534 - DNA, 741 bp, Streptomyces avermitilis
  CDS (1)..(741)
atgaacagcaccagaaccgtcctcatcaccggcgccggcaccggaatcggccgggcgaccgcccgcgcgttcgccgcggagggggctcgggtcgtcgccgtgggccgccgcgaggccccgctcgccgagaccaccgaagggcaccccggaatcaccccgctccccgccgacgtcaccgccgaggacgcccccgcccgcatcatcgacaccgtcctcgacacccacggacgcctggacgtcctcgtcaacaacgcggcgatcgtcggcaccgaatccctggcgacctacacccgtacgtccatcgaaccgctgctcgccacgaacctcatcgcgcccgtcctcctgacgcaggccgcgctccccgctctcaccgagagccggggcgtgatcgtcaacgtcagtacgtccgtcgggcagcgcgcctggcccggcaactccctctatgccgccaccaagaccgcactcgaactcctcacccgcagctgggccgtggagctcgcaccgcgcggcatccgggtctcggccgtcgcgcccggcgccatcgcgacccccatcggccggcactccggtttcaccccggagcagagcgcggcgatccgcgagtggcagctcgcgcacactccgctgggccgcatcggccgccccgaggaagtggcctgggcgatcacccgactcgccgcgcccgacgcctccttcgtcaccggcgtcgtcctacccgtggacggcggcgccgtcctcacc

SEQ ID NO: 3535 - DNA, 384 bp, Streptomyces avermitilis
  CDS (1)..(384)
gtgcggataggtgagctggggagggcgacgggggccacgccgcgcgccctgcgccactacgagcgggcgggtctcatcgcgtcgcggcgcgccgccaacggctaccgcgtgtacgacgaggggaccgtcacgcgcgtacgcaacatccgccacctcctggccgcgggcctcaccctcgacgacgtacgcgtcttcctgccctgcctggacggcgacatgaccgccggccccgcctccgccagggcgctcggggtcgcgcgcgaacgtctggccgtcatcgacgagcgcatcgcggcccagctggcggtgcgggaacggctggcggcggccctacgggaggcgggggccgtgcgcggtggcggtggcggtggcggtggcggtggg

SEQ ID NO: 3536 - DNA, 3528 bp, Streptomyces avermitilis
  CDS (1)..(3528)
atgagcctgcacggtctgctcgacgccgtcgccaaggacgccgcactcgccgaagcggtgcaggccgccaccgacggcaaccgcatgcacgtcgacctggtcggacctccggccgcgcgccccttcaccgtcgccgcgctcgcccgggacaccggccgtacggtcctcgcggtgacggcgaccggacgggaggccgaggacctggcggcggccctgcgctccctgctcccgccggaccgcgtcgtggagtacccgtcgtgggagacgcttccgcacgagcggctgagcccgcgcagcgacaccgtcggacgccgtctcgccgtgctgcgccgcctcgcccacccgcgcgccgacgaccccgagaccggcccggtctcggtcgtcgtggcgccgatccgctccgtgctccagccgcaggtcaagggcctgggcgacctggagccggtggcgctgcgcacagggcagacggccgacctcggcacgatcgtggaggcgctgtccgcggccgcgtacgcgcgggtcgagctggtcgagaagcgcggcgagttcgccgtacgaggcggcatcctcgacgtgttcccgcccaccgaggagcacccgctgcgcgtggagttctggggcgacgacgtcgaggagatccgttacttcaaggtcgccgaccagcggtccctcgaagtcgccgagcacggcctgtgggcgccgccctgccgcgagctgctgctcacggacgacgtacgggagcgggccgccgccctggccgaggcccacccggagctgggcgagctgctcggcaagatcgccgagggcatcgccgtggagggcatggagtccctggcgcccgtcctcgtcgacgacatggaactgctcatcgacgtcctgccgaagggctcgatggccgtcgtgtgcgacccggagcgggtgcggacgcgggcggccgacctggtggccaccagtcaggagttcctccaggcgtcctgggccgcgaccgcgggcggcggcgaggcccccatcgacgtcgacgcggcctccctgtgggccatcgcggacgtccgggaccgggcccgcgagctggagatgatgtggtggtcggtgtcgccgttcgccgcggacgacgaactcgacgcggacaccctgaagctcggcatgcacgcccccgagagctaccgcggcgacaccgcgaaggcgctggccgacaccaagggctggctcgcggacggctggcgcacggtgtacgtcaccgagggccacggcccggcggcccgtacggtcgaggtgctgggcggcgagggcatcgcggcccgcctggacccggacctggccgagatcagcccctccctcgtgcacgtcgcctgcggctccatcgactacggcttcgtggatccgcggctcggactcgctgtcctcaccgagacggacctctccggccagcgctcggtgtccaaggacggcgcgcgcatgccggcccggcgccgcaagaccatcgacccgctgaccctcgaagcgggcgactacatcgtccacgagcagcacggcgtcggccgctacatcgagatggtgcagcggaccgtgcagggcgcgacccgcgagtatctggtggtggagtacgcgccggccaagcgcggccagcccggcgaccgcctctacatcccgaccgaccagctggagcagatcaccaagtacgtcggcggcgaggcccccaccctgcaccgcctgggcggcgcggactggacgaagaccaaggcgcgcgccaagaaggcggtcaaggagatcgcggcggacctgatcaagctgtacagcgcgcgcatggcggctcccgggcacgcgttcggttcggacacgccgtggcagcgcgagctggaggacgcgttcccgtacgcggagacccccgaccagctgacgacgatcgccgaggtcaaggaggacatggagaagacggtcccgatggaccgcctgatctgcggcgacgtgggttacggcaagacggagatcgcggtccgggcggccttcaaggcggtgcaggacggcaagcaggtcgcggtcctcgtcccgacgacgctgctggtgcagcagcacttcgggacgttcggcgaccgctactcgcagttcccggtgaacgtccgcgcgctgtcccgcttccagacggacacggaggccaaggccaccctggagggcctgcgcgagggctcggtggacgtcgtcatcggtacccaccgcctgttctcgtcggagacgaagttcaaggacctgggcctggtcatcgtcgacgaggagcagcgcttcggcgtcgagcacaaggagcagctgaagaagctgcgcgcgaacgtcgacgtcctcacgatgtcggccacccccatcccccgtacgttggagatggcggtcacgggcatccgcgagatgtccacgatcaccaccccgccggaggagcggcacccggtgctgaccttcgtgggcccgtacgaggagcggcagatcggcgcggccatccgccgcgaactgctgcgcgagggccaggtcttctacatccacaaccgggtggagtcgatcgaccgggccgcggcgaggctgcgcgagatcgtccccgaggcccgtatcgccacggcccacggccagatgtcggaacagacgctggagcaggtggtcgtcgacttctgggagaagaagtacgacgtgctcgtgtccacgacgatcgtggaatcgggcatcgacatctcgaacgcgaacacgctgatcgtggagcgcggcgacaacttcggcctgtcacagctgcaccagctgcgaggccgggtgggccgaggccgtgagcggggctacgcgtacttcctctacccgccggagaagccgctgacggagacggcccacgaacgcctggccaccatcgcccagcacacggagatgggcgcgggcatgtacgtggcgatgaaggacctggagatccgcggcgcgggcaatctgctcggcggcgagcagtcgggccacatcgcgggcgtcggcttcgacctgtacgtacgcatggtcggcgaggcggtcgcggactaccgcgcgtcgctggagggcggcgtggaggaggagccgccgctcgaggtcaagatcgaactgccggtcgacgcacacgtcccgcacgactacgcgccgggcgagcggctgcggctccaggcctaccgggcgatcgcctccgtgaacacggaggaggacatcaagtccgtacgggaggaactcgtcgaccgctacggcaagttgcccgagccggtggagaacctgctcctggtcgcgggcctgcgcatgcacgcgcgcgcgtgcggggtcggcgagatcgtgctccagggcaacaacatccgcttcgcgccggtggagctgcgggagtcgcaggaactgaggctgaagcggctgtaccccggcacggtcatcaagccggccgcgcaccaggtgctggtgccgcgccccaagacggcgaaggtgggcgggaagccgctggtcgggcgggaactgctgggctggaccggggagttcttgactacgatccttggctcg

SEQ ID NO: 3537 - DNA, 2565 bp, Streptomyces avermitilis
  CDS (1)..(2565)
atgaccgtgctgaagacctcgatgcgcaacttcttcgcgcacaaggggcggatggccctgtcggccgtcgcggtgctgctgtcggtggccttcgtctgcggcacgctggtgttcaccgacaccatgaacaccacgttcgacaagctgttcgcggccacctcctccgacgtgaccgtcacaccgaaggcggccaagagcgacgaggacccgcagagcggcaggcccgagtcgatgcccgcctcggccctgacccgggccgggaaggccgagggcgtcaagtccgccgagggcgccgtcagttcgatgaacgtgaccgtcgtcaacagcgacaacaagaacatggggtccaccaccggcgccccgacgatcgcgggcaactggacgaagaacgacctgcgttcgatgcagatcacctcaggtcacgccccgcgcggtccgaccgaggtcatggtcgacgccgacaccgccgacaagcaccacctgaagctcggcgacgaactgcgcaccatcgcggtgacgggcgacttccgcgcgaagatcgccggcatcgccaccttcaaggtgaccaaccccggtgccgccgtcgtctacttcgacaccgccacctcgcagcgtgaactgctcggcgccaccggccggttcacccacatcaacgtcacggccgcggccggcgtcggcgacgagcagctcaagcggaacgtcgccgacgcactcggcgccggcgcgtacacggtgcggacgcagaaggagaccgccgacgagaaccgcaagggcatcaacgggttcatgggcgtcatcaagtacgccatgctcggcttcgccggcatcgcgttcctggtcggcatcttcctgatcatcaacaccttctcgatgctggtggcccagcgcacccgcgagatcggcctgatgcgggcgatcggttcctcccgcgggcaggtcaaccggtccgtcctcgtcgaggcgctgctgctcggcgtcgtcggctccctcctcggggtcgccgcgggcgtcggcatcgcggtcggcctgatgaaggtcatgtcgtcgatgggcatggacctgtcgacccgggatctgacggtgaaggcgacgaccccggtggccggcctgctgctcggcatcgtcgtcaccgtcctctccgcctacctccccgcccgacgcgcgggcaaggtctccccgatggccgcgctgcgcgacgccggcaccccggcggacggcaaggcgggtctcgtacgcggcctgatcggtctggtcctcacgggcgccggcaccttcgcgctctacgcggcggccaccgccgacaaggcgagcgacggttcgctggtgctcggcctgggcgtcgtcctgaccctgatcggcttcgtgatcatcggcccgctgctcgcgggcgtcgtggtccgtgtcatcagcgcggtgctgctgcgcgccttcggctccgtgggacgcatggccgagcgcaacgccctgcgcaacccgcggcgtacgggggccaccggtgcggccctgatgatcggcctcgcgctggtcgcctgcctctccgtggtcggctcctcgatggtcgcctcggcgaccgacgaactcgacaggaccgtcggcgcggacttcatcgtccagggcaaccagcggatcgtcgcccaggccgagaaggccatgcaggccaccccgggtctggcgcacgtcacccgctacaaggatctgaaagccgagctgaccacgccggacggcaaggtcgacggctccgggatcaccgcggccgacccctcctacgccgaggacctgcaccgcaagacgaccgcgggcgagctgacggcggcgtacggcaaggacgcgatgtcggtgggttcggactacgccaagaagcacggggtgaaggtcggcgacaccgtctcggtcgccttcaccggtggcagcacggccaggctgaaggtcgcggcgatcacggacgacgacgtcgcgatcgaccagggcgcgcgctacatgtccatcgagaccatgaagaagtacgtgccggccggcaagatcccgccgaaccagatcatgttcggcgaggcgaagaagggccaggagaagcaggcgtacgcggcgctgaagaaggccatggagccctacccgcagtaccaggtccgcgaccagaccgactacaagcaggaactgaaggatcaggtcggccagctcctgaacatggtctacggcctgctggccctcgcgatcatcgtggcggtcctcggcgtgatcaacaccctcgccctgtcggtggtggagcggacacgtgagatcggtctgatgcgggccatcggcctctcccggcgccagctgcgccgcatgatccgcctggagtcggtggtgatcgcgctgttcggcgcgctgctcggcctcggcctgggcatgggctggggcaccaccgcccagaagctcctggcgctggagggcctgaacgtcctggagatcccctggccgacgatcatcggggtgttcatcggctcggccttcgtgggcctgttcgccgcactgatcccggcgttccgggcaggccggatgaacgtcctgaacgcgatcgccaccgag

SEQ ID NO: 3538 - DNA, 786 bp, Streptomyces avermitilis
  CDS (1)..(786)
gtgacatcggctgtgaccattcccaggcacgggggcactggagggcgtacggccgttgccgcgcgagctcggcaggtcgtcaaggcgtacgggtccggagagacccgtgtcgtcgctctcgaccacgtcgacgtggacatcgctcgcggccagttcaccgcgatcatgggcccctcggggtccggcaagtccaccctgatgcactgcctcgccgggctcgacaccgtcaccagcggtcagatcttcctcgacgagaccgagatcaccggcctcaaggacaagaagctcacgcggctgcgccgggaccggatcggcttcatcttccaggcgttcaacctgctgccgacgctgaacgcgctggagaacatcacgctgcccatggacatagcgggccgtaagccggacaagggctggctgagccaggtcgtcgagaccgtcgggctcggcgagcgcctcaggcaccggcccacccagctgtccggcggccagcagcagcgcgtcgccgtggcgcgggccctcgcggcccgccccgagatcatcttcggcgacgagcccaccggaaacctcgactcccgtgcgggagcggaggtactgggcttcctgcgccgctccgtggccgagctgggccagaccatcgtgatggtcacccacgacccggtggccgcctcgtacgcggaccgggtgctgtacctggccgacggccgcatcgtcgacgagatgtacgagcccaccgccgacgccgttctcgaccgcatgaaggacttcgacgcgcgggggcgtacgtca

SEQ ID NO: 3539 - DNA, 1557 bp, Streptomyces avermitilis
  CDS (1)..(1557)
gtgggcggcggatggatgcagggggaaaggaattcggtggacgacaccagacccgcactgcgcgagacggctcgaccccccggtaccgacaggcgcgggcccgtcgtcgccgccctcatgctctccatggcgctggccgcgctcgactcgacgatcgtctcgaccgccgtaccgcagatcgtcggtgacctcggcggcttctcggtcttctcctggctgttctccggctatctgctcgccgtgacggtcacgctccccgtctacggcaaactctccgacaccttcggccgcaagccggtgctcgtcgtgggcgccgccctgttcctcgccggctccctgctctgcgccaccgcctggaacatggccgcgctgatcgccttccggatcgtgcagggcctgggtggcggcgcgttgcagggcacggtgcagacgctcgccgcggacctgtacccgctgaaggagcgcccgaggatccaggccaggctgtccacggtgtgggcggtggcggcggtcgccggaccgggcatcggcggggtgctggcggcgtacgcggactggcgctggatcttcctggtcaacctgccgatcggcgcggtcgccctgtggctgatcgtccgctacctgcacgaaccggagcggaaaccgtccggtacccgcccgcgcgtcgactgggcgggcgcgctggcggtgttcgcctgcggcggcgtcctgatcacggccctggtgcagggcggggtggcgtggccgtggctgtcgacgccctcgatcgccctgtccggtacgggactcgcgctggcggcgctcgtggtcctggtcgagcgccgggcggccgagccgatcatccccgggtgggtgtggcgtcgccggacgatcgccgcggtcaatctcgccctcggcgcgctggggctgctgatggtggcaccgagcgtgttcctgcccacgtacgcccagtcggtcctcggcctggccccggtggccgccggattcgtgctctccgtatggacgctgagctggccggtgtcggccgcgctgagccagcacgtctaccggcggatcggcttccgcaacacggcgctgctgggcatcggcgcggctgccctgatcctgctggcgttccccttccttccgtacccgggcgccgcctggcagccggccctcctgatgctgctgctcggcgccgcgctgggcctcttccagctcccgctgatcgtcggcgtccagtcgaccgtcggctgggcggaacgcggcacgaccaccgcgtccgtactgttctgccgccagaccggccagaccatcggcgcgtcggtcttcggcgcgatcgccaacggggtgctggccgcgcggctgggcggcgcgagcgacctcgactcggtgacccgggccctggacgccggcaccgccccggagtcgacgcgccgggcgatcgcggacgcggtccacgcggtgtatctgggggcggcgggtgcggcggcgctggcgttcctggtgctgctggtgctggcaccgcggcgctttccggtgctgaagacccagccggccgaagacgatacggcccgc

SEQ ID NO: 3540 - DNA, 477 bp, Streptomyces avermitilis
  CDS (1)..(477)
atgtcctacgacccgtccccgtcgtatcccgttccaccgcaccacacctactccaccccaccgcaccacgcccacctcgatcctccggccaactcgtccccctcctacgccacttacccctggcagccgcaaccgtccgaacccgcccggcagcggcagccgcgccgagcggccctcggccaccacagcgacctgcggctcctgcgcggcgcctaccgctggcagcgccgcgtggccacgctcaccgcgctcggctacttcatgctcttcctgctcctgtccgcgttcgccccgtccttcatgacccgcaccgtctccggcggcctgtccctgggactgctgctcggactgctccaagtacccgtcaccggtctggcgatcgccctgtacgagtacacggcacagcacaccgtcgacccgatcgccgaccgcatccgcaagcaggccgacctggacgcccagcgggaggccgcacga

SEQ ID NO: 3541 - DNA, 1644 bp, Streptomyces avermitilis
  CDS (1)..(1644)
atgagcacgagcagcacacaacacgccgcacccgccttcaccggattcagcagttccgcgcaggcgatgtcgctcgtggcgttcacgaccgtcgccaccatcacgctcctgctgtgcgtgatgaccgggcccgaccgcgacgacctcgaagagttctacacgggctacggctccctgtccccgatgcgcaacggcctcgccatcgcgggcgactacatctccgccgcgaccgtcctcggcaccggcggagtcatcgccctcaccggctacgacggtgtcgtactcgccctcagcacggccctgtccctcatgctgctgatgttcctgctggccgaacccctgcgcaacgcgggccagttcaccatgggggacgctctcgcccggcgcatgcccggacgggcggtacgcgtcaccgcgtgcgtcgtcaccatcgccgcgctgctgccgctgatgctcgtccaactggccggaacgggcgacctgctgtcgttcatcctcggcttctccaacgacaccctgaagaccggctgcatcatcggcctcggcgcgctgatgatcagctacgcggcgatcggcggtatgaaaggcaccgccctcatccagatcatgaagatcgtcatgctgctcggttccggcgccgtcgtcgccgtgctcatcctgcaccgcttcgactgggacccgggcgccctgttctcggccgcggcggcacacagcggcgcgggaccggcgttcctgcgctccgggctcgagttcgccggcgggcccaacccgcgcctcgacatgatcactacggagctgacggtcgtcctgggcggcggctgcctcccgcacgtcaccatgcgcatgtacaccgccaacagcgcacgtcaggtgcggcggtcgatgtcctgggcggtgcccgcggtggcgctgttcgtgctcgtcatcaccgtcgtcggcttcggcgcgacggcgctggtcggccgcgaagccatcgccgccgccgacccacagggcaacacggcctacctgctgggctcgcgggcggcgttcggcccggacgtgtcgtcggcggagacactcctgttcaccaccgtgaccaccgcgctcttcctcaccctgctcgcctcggtcgccgggatgatcctcgcctgcgccaactccctcgcccacgacgtgttcgccgcgcgggtgcaggagatgtcgccgcgccgcgagatgaccctggcccgcctgtcggcgctggcggtgggcgtaccgacgatcctgctggccaccctcgtccaccaccgcagtctgcagccgctggtcaccctgtcgttctgcatcggcgcgtccgccatcgcgccggccctggtctacggcctcttctggcgccgctacacccgaaccggcctgctctgcaccctgatcggcggcaccctgtccgtggtcctgctgctgccgggcaccaacctggtcaccggttcacccgccgccgccttccccgacgccgacttcaactggttcccgttcacgacgacgggcctggccaccatccccctcggcttcctcctcggctggctcggcacgctgctctcgggccggcaaaaggcggaggcacagcgcaggcagtacgaagccgtcgagggatggatcctggcgggggcggtgcgcaggagcgga

SEQ ID NO: 3542 - DNA, 897 bp, Streptomyces avermitilis
  CDS (1)..(897)
atgggcagcgcaccggtgtcgccgcacggcttcgtgcccgtacggcgtggctaccgtcccgagcaggtcgacgcgtatgccgcggccctctcgcgggatcgcgacgccgcctgggagcgggccgcgcggctgaccgtgctggcgagggagatggagggggaggcgctgcggctgcgcgagacggtggcggggctggctccgcaggggtacgagtcgctcggcgagcgggcgcggcggatcttcgagctggggcaggaggaggccgaggccgtacgggagtccgcgcggcgggaggcccgggacgtcgtcgaggaggcggaggccgaggggcggcgggtgcgggaggccgcgcaggcgtatgccgacgaggtgtgcgaggaggcggaggagcggatccgtacgcggctgctcgcggcccgggccgaggcggacgacctgcggatctcggcgcggcgcgaggtgaaggaggggcgcggcgaggcgctggcggcgctgcgggaggtgcggcagcgcacggaggcgctgctcgccgagcaggagaaggagcacgcggagcgcgggcagcgggcggagcgggaggcggccgagcgggcggcggcgctcgacgcgcaccacgcggagcgggtggtgcgcgccgaggccgcgctggccgaggccgaacgggccctggtggaggcggcggagtcggcccggcaggcgcagcaggacgcggaggagcgggcccgggtgctgctcgccgaggcccgcgtccatgcggaccgcgtcgcccgtgagacggagcgggtgctgcgggatcacggcgagcagtgggactgcgtacgggcccatatggaccacgtacgcagcagcctcaccgcactgacggggcgggccccggcggagtgggccgagggcctt

SEQ ID NO: 3543 - DNA, 2709 bp, Streptomyces avermitilis
  CDS (1)..(2709)
atggggattccggaccggcggaacggtacgtcgggcggtgcgtccgggggtacctcgggcggtgcgtccggcggtgtggccggtggcgcgtcgggttccggggtcggtggtacgtccggtggggcggccgccgcggtgtccggtggggcgtccggtggggtttcggatgcgcgcgggaacgcggacgcgcacggtgcgtcggccgcgccgggggcgcacgccgcgtcggcggctcccggcgggggtacgccgtggcccgcggccggtggtgcggacgacgacgtacaggacgcggcgccgcaggacagcgttccgggtccgcctccgggggcgaccccgtgggccgggaccgacaccaacgcggaggcgggcgaggaccgttcggtgccgttgcccgcgaccgtgttcgcgccgccgctgagcggcctcggcgacctgagggacgaggacactccgccgccggccgcgacgccggacgccaagacggcgctgatgtcgggcggcagcgggcttccgcgtacgacggtggcgccggccctcgacgacgcggtgcccgctgctccgcagggccccgtcacgccgcccccgggccccggtgctccgcgggttccctccgggccgtcggcggcccagggtcccggtgcgccggagggtgcggccccgagtgcgccttcgtacggctatccgcagggtcccggcgcggccccgagtgcgccttcgtacggctatccgcaaggtcccggcgcggttccggggacgccgccgcccggtgccccgcaggctcccggtgctccgcacgctccgggtgctccgcaggctccgacgggttcgcccgttccggggcggccgctcgcgccgaacgccggtgacatcgccgacgccgcgaccagcaaggcggcgccgcctcggggtgcgcgcgcgggtgcgccgcgtccgccgggcgcgccgggggttccgggtgcgcctggaacgccgggtgcgcccggtgccatgcctccggcgtccgggcccggtgctccgggtacgcccgcgggcgggtacgtgccgacgcagctcgtctcgcaactgggtccggacgggcccgagggcctcgcgggcccgaatccgccgagcgcgcccggtacgccgaaccctccgggcggtacgccgcccgggggtgtccatcacgcggccacgatgttcgccgacccgggccggcccggtgccggccccggcgcgccccagccccccggtccgcccggcgctccgggccgtccgggcgtcccgaaccctccgggcccgcccggtgctcccggtcagccgggtgctcccggcgcgcccggtgccccgaacactccgggcggtacgcctcccggtggcgtccatcacgcggccaccatgctcgccggtccctcggtgggcggcccgggcgcgccgcttccgccgccgggtgcccccggtgccccgggcatgcctccgggcgcacccggtgctcctggagcccccggtggccccggtggtgtgcaccacgccgagacgatgctggccggtcccccggtcggcggtcccggtctgcccccgccgggtgctcccggtgctccgggcatgcctgccggtacgcctccgggtgtgccgcagggctggccgccgccccagccgggacaggccatggcgccgcagccgatgcccggtcagccgatgccgccgcagccgatgcccggtcagcagcccccggcgtacggctatccgccaaccggtcagccgaccgtcggtcccggctaccaggccgtgctgcgctaccgcgcccaggacggttccgagcagcagctcatccggcgttcggcgccgggcaccccgcacccggagtggcagatcctgcacgagctgcgcgccatgaacgtgccgccgcagcaggtgctggagctgcacacggagttggagtcgtgcgagctgccgggtgcgtactgtgcgcggatgatccgggagagctggccgcaggcgcggatcaccagcatcgccacgtacggcacggatcacgcgagccgtcagcagggcatgcaggaactcctcgcgcaccagggcgagttgcatcaggtggcggacggtccggcgcggccgggtccggtgcggtcgccgctgccgccggtgccgccggcgcagccgatcccgccggaggcgatcgcgcaggagctggcggccgccttcggtcccggtgtcttccacttcgaccaggccgcggtgtcccggcagggggtgccgccgatcgtggcgcacaccctggtggtggccggtctgccggtcgacatgggcccgttcttctgggcgcaggcccagccgggccgtccggtgccgaccctggcggagctggcgcaggagcgcggggtgcagccgggcccggacgcgggttcgtacctcgtgatgggaagcgacttcggcaaggcgatctgcgtccagtacggcacggcgaacatcgtcgccgtgccggtggaggcggggccgggcggtgcgcccgtatcgccgcagttcgtgaacacggggctgcccgagttcgcgcgctgtctcgcactgctgggccggatgtggcgcctgcggttcggtctcaaccaggagcaggcgggccgctggacggtcgacttccaggcgcagctcgcctccctcgatccggcggcgctcggctctccggagagctggtggtcggtgctgctggagcagatgtgggacgggttgttg

SEQ ID NO: 3544 - DNA, 984 bp, Streptomyces avermitilis
  CDS (1)..(984)
atgacgacaggtcggctcgggcagcaagccgcgccgccgaacgcggcctatgccgggcaggtcgtgcaattcccggatccggtccgggctgcccgtcacccgaggggtgtgcgggtcgacgagcacggttatcccgacttctcggcctacgcgcgtgccgcggcggagatcgcggagcctccggagggcttcggtgtcgatgagttgcgtctcacggactatgtctcggcgaacgcggcgctggccgcgtccgggcatgacttgtgggacacgattccggcggtggcgactccgcacggctggacctggcatcacgtgccggggacacggcgcgttgagctggtgccggtcgaggtgaaggcgttgctgcggcatcacggtggtctggcgacggccgtggtggaccagaacaagcggggcacgcggccgttgcaggagacgcggccggcgcatttcgggttgccgaagtcgtcggtggcggtgacggagcagcaggtccagggtgtggaagaggatctggggtaccggctgccgggcgcgtaccggtcgttcctgaaggcggcgggtggttgtgcgccggtgggtgccgcgttggacgccgagctgggtctgctggtggaccagccgttcttcacggtgcgtgacgaggccgcggtcaacgacctggtgtatgtgaacaagtgcctgcgggaccatctgaccaaggattacctgggggtcgggttcgtgcagggcggtctggtggccgtgaaggtgaagggcgacggggccgggtcggtctggttctgcgcgtatgacgatgcccgggatcaggacgcgtggccgccggcggagcgggtgcagcggctgttgttgccgtgcggtgaggacttcgaccagttcctgtcgcggctcgcgggtaatccgccggagctggagacggtggcgaatctgatggtggacggcggtttcgcgcgtgccgttcccgtctcttcggtgggggag

SEQ ID NO: 3545 - DNA, 498 bp, Streptomyces avermitilis
  CDS (1)..(498)
atgaacgcgacacaaacggacacatccggggacccccgggtcggctggagcagcaccgggacaccgcacgcacccaccctcctccaccgccgcgacggcatactccccaccgtcgccgccgccctctccgtacgcggcgccaccctcaccggcaccgccgcccgcggcgaccagcccccaccgctgcaccccctcgtccaggacttcctcgacaccctcaccagcagccagcgcgaccgcttcagcggacgctgcgccgaagtcctcctgatctcccgccacatcgccgccgtcgacgccacccgcaccaaacgcgccgcccgcaaaccgatgaccaacggcgaagcccgcaaagccctcaagcaggccaaactcaccgcgcgccgcatccgcgaggacggcgacccgctgcacggcagcttcgccacaccctgccgcgcctgcacagccctcagcgaccacttcggcgtacgcatcgtcgaccccacggcacagggc

SEQ ID NO: 3546 - DNA, 492 bp, Streptomyces avermitilis
  CDS (1)..(492)
atgcacgccgaccgcacctccaccacacgcttctccgtccccgtggacgccgccctgcgcaccgcgggctggcagccgggacgctgggacataaagcaggcggaattctgggccgacaccctccgcagccacacctcccccgcaggccaccgccacaccgtgttccccgcagccgtcgaagcgtgggcggaattcggcggcctgcacctcaccgcgcagggccccggccgccaactcgcccccgccacgctccacctcgacccgctgcacggcctccacctggcccgcaccctcggcgacctcggccgcgccctcgacaccgaggtctgccccctcggcgaggaatccgacagccgcgccctcgtcgccatcgacaccgagggccgcgtctacgccctcgaccacaccggcgactggtacctcggccccgacatcgaccagggcctcaccaccctcctgaccggcatcgaacccgtacgcctcaccgcgggc

SEQ ID NO: 3547 - DNA, 1317 bp, Streptomyces avermitilis
  CDS (1)..(1317)
atgaccacgacgggggaagcggaaaccggggccttgaccgggccctggtggtggacgcggtggcggagtgcggtgctcgatatcgggctggctctgctgtccgcggtcgaatgcgtgatcgagggtgccaggttcgcgcgggatgccgcgctgccgctccctgtcggcatggtgttcgggttgttcgccggcctggtgctggtgctgcggcgcaagtggccgatcgcggtcgtgctcgtctccatcgccatcgcgccggcccagatgggcttcctcatgggggtcgtggggctgtacaccctggccgcctcggagctgccccggcggatcatcggctcgctcgccggtatgtcgttcgtcgggatgctgatcgtgacgtacgtgcgggcccatcagggtgtggtgcgcggcgatctgaccatcggtgactggttcgttcccttcctgtccatcaccaccgctctggggatgaccacccctccggtgctgctcgggctgtatgtcggggcgcggcggcggctcatggagagtctgcgggagcgggccgacagtcttgagcgtgagttgatgctgttggccgagcgggcggaggagcgggccgagtgggcccggaacgaggagcggacgcggatcgcgcgggagatgcacgatgtcgtcgctcatcgggtgagtctgatggtggtgcatgccgcggcgttgcaggctgtcgcgcgcaaggatcccgagaaggcggtgaagaacgcggcgctggtgggggacatggggcggcaggcgctcaccgagttgcgggagatgctcggggtgctgcggacgggtgacgggacggtgtcccgggtgcgggcggtgccgctggtcgctgtcggggtcgccgccgccgctgccgcgtcgcgggccgtggaggatccctcggacgggccgtgtcttgccgacctcgacgtgttggtggggcagtcggcggcggccgggatggcggtcgatctgtcggtggagggggatgcgcggtcgtatgcgcgtgaggtggagcagacggcgtaccgggtggtgcaggaggcgttgaccaacgttcacaagcatgcggcgggggccaagacgcgggtgcggctcgcgcaccggagtgcggagatcgcgatgcaggtggagaacgggccgccgccggagccggggtccgcggagtccgcgcggctgccgagcggggggaacgggctggtggggatgaaggagcgggtctccgcgctgggcggggtgtttgtgtccgggcccacggacgcgggtggttttcgggtgtcggcggtgattccggcgggggcggaggcggcc

SEQ ID NO: 3548 - DNA, 1446 bp, Streptomyces avermitilis
  CDS (1)..(1446)
gtgagcgccatccgcccggcagccgtcgtcgttctcgcagcgggtgagggcacccgtatgaagtcggccacacccaaggtcctccacgacatctgcggccgctccctcgtcggtcatgtactcgccgccgcgcgcgagttggagcccgagaacctggtcgtcgtcgtgggacacgcccgtgagcaggtcaccgcgcacctcgccgagatcgacccggccgtgcgtacggccgtccaggccgagcagaacgggaccgggcacgccgtccggatgggcctcgaagagctcggcggcgtcgtcgacgggaccgtggtcgtcgtctgcggcgacacccccctgctcagcggggagacgctgcggcagctcgccgccacgcacaccgccgacggcaacgccgtcaccgtgctgaccgccgaggtccccgacgccaccggctacggccgcatcgtgcgcgacggcgcctccggtgccgtgacggccatcgtcgagcacaaggacgccagcgagtcgcagcgcgccgtccgtgagatcaactccggggtcttcgccttcgacgggcggctcctcgccgacgcgctcggcaaggtgcgtaccgacaacagccagggcgaggagtacctcaccgacgtcctcgggatcctgcgcgaggccgggcaccgggtgggcgcctccgtggccgccgaccaccgggagatcgccggcatcaacaaccgcgtgcagctggcggaggcccgccgcatcctcaacgaccggctcctcacccgggccatgctcgccggcgtgacggtggtggacccggcgaccacgtggatcgacgtgacggtcaccttcgggcaggacgcgatcgtgcacccggggacgcagctccagggcaccacgcagctgggtgagggtgccgaggtcggccccaactcgcggctcaaggacacccgggtcggcgcgggcgcgcggatcgacaacacggtggccgagagggcggacgtgggggcgcaggccagcgtcggtccgttcgcgtatctgcgtcccggtacgcggctcggggcgaaggccaaggtgggcacgtacgtcgagaccaagaacgcctcgatcggcgagggcacgaaggtgccgcacctgtcgtacgtgggtgacgcgacgatcggcgagtactccaacatcggtgccgcgagcgtgttcgtgaactacgacggtcaggacaagcaccacaccacggtggggtcgcactgccgcaccggttcggacaacatgtttgtggctcctgtcacggtcggggacggcgcgtacaccgcggcgggctcggtcatcacgaaggacgtgccgcccggttcgctggccgtggcccgtggccagcagcggaatatcgagggctgggtggcccgtaagcgtccgggaagtgctgccgcgaaggcggccgaggtggcttcccggaagccggaaggcgaagac

SEQ ID NO: 3549 - DNA, 972 bp, Streptomyces avermitilis
  CDS (1)..(972)
gtgaccgggatcaagacgaccggcgagaagaagatgatgttcttctccggccgcgcccaccccgagcttgccgaggaggtcgcccacaagctgggtgtcggggtagtcccgacgaaggccttcgacttcgccaacggtgagatctacgtccgctatcaggagtcggcgcgcggtgccgactgcttcctgatccagagccacacggctccgatcaacaagtggatcatggagcagttgatcatgatcgacgctctgaagcgggcgtccgcccggagcatcacggtgatcgtgccgttctacggttacgcgcggcaggacaagaagcaccgtgggcgtgaaccgatttcggcgcgtctgatcgccgacctgatgaagacggcgggcgcggaccgcatcctcaccgtcgatctgcacacggaccagatccagggcttcttcgacggtccggtcgatcacctcttcgcgctgccgatcctggcggactacgtgggcgcgaaggtcgaccgcagcaagctgaccgtcgtctctcccgacgccggccgcgtgcgggtcgcggaccgctggtgcgaccgtctggacgctccgctggcgatcgtccacaagcgtcgcgacaaggacgtggccaaccaggtcaccgtccacgaggtggtcggtgacgtgaagggccgcgtctgcgtgctcgtcgacgacatgatcgacacgggtggcacgatctgtgccgccgcggacgcgctgttcgcgcatggcgcggaggacgtcatcgtgacggcgacgcacggtgtgctctccggtccggcggccgaccgtctgaagaactccaaggtcagtgagttcgtcttcacggacaccctgccgacgccgggtgagctggagctcgacaagatcacggtgttgtcgatcgcgccgacgatcgccaacgcggtgcgtgaggtgttcgaggacggttcggtgacgagcctcttcgacgagcag

SEQ ID NO: 3550 - DNA, 591 bp, Streptomyces avermitilis
  CDS (1)..(591)
atgtccgaggtcaagctcgccgctgagccccgcaccgagttcggcaagggtgccgcgcgtcgcatccgccgtgagagcaaggttcccgccgttgtctacggtcacggtgccgagccggtccacatcacgctgccgggccacgagctgctgctcgccctgcgcaccccgaacgttctgctctccctggacatcgagggcaaggcgcagctggcgatcccgaaggccgtgcagcgtgacgcgatcaagggcttcctcgagcacgtcgacctgctgctcgtccgcagtggcgagaaggtcaacgtcgaggtctacgtgcacaccgagggcgacctggctccgggtgcctacctgctcgagcacgtgctgagcacgctgacggtcgaggccgaggccacgcacatccccgagtcggtcacggtttccatcgagggcctggaggccggcgcctccatcctcgccaaggacatcccgctgccctccggcaccaccctggccatcgacgaggacgcggtcgttctccaggtcctggccgctcaggcggaggaggccgccgaggaggccgccggtaccgccgaggtcggttccgaggcc

SEQ ID NO: 3551 - DNA, 609 bp, Streptomyces avermitilis
  CDS (1)..(609)
atgggagacacggacgtgacgagcgacgccaatgcgccctggttgatcgtagggctcgggaatccggggccggagtacgcgcggaaccggcacaacgtggggttcatggtggccgatctgctggcggagcggatcggggggaagttcaagcgggccggtaaggcgcaggcgcaggtgatcgaggggcgcatcgggccgcccggtccggcgaaccggcgggtgattctggcgaagccgatgtcgtacatgaatctgtccggcggtccggtgaacgcgctgcgggagttctacaaggtgccggtggcgaacatcgtggcggtccacgacgagttggacatcgactacggcgtcctgcggctcaagctcggcggcggcgacaacggccacaacgggctcaagtcgatgacgaaggcgatgggcccggactaccaccgggtgcggttcggcatcggacgccctccgggccgtatgcaggtcgccgatttcgtgctgaaggacttcgcgtcggcggagcgcaaggagctcgactacctcgtcgaccgcgcggcggacgccgcggagtgtctggtgatcgaggggctggagcgggcgcaggggacgtacaactcc

SEQ ID NO: 3552 - DNA, 510 bp, Streptomyces avermitilis
  CDS (1)..(510)
ttgtcatggccaaggatcgccgccatgcctgccgtctcctccactcagagcgcgtacgcggtgctgcggttcgggcggatcgcggcgatgggaacggtcgccgtgctgattctgatcgcgggtgtctggggctcgtggggtaccgctcagcacgtgatgctgacgaaggggcgcgagcggggcacgatgacggtggcgcggtgctcgggggaccggtgtacgggcccgtacgtgcccgcgaccgagggttcgaaggcccgggcacgggtcgtcatcgagcagcccgtggcggtgcggcggggcgaggtgctgacggtcgtggtgaagccggggtccgaccaggtggtgcggaccggtccggccggggttctctacgcgtgggtgccgctcggcggtgcgttgctgctggcgtcggtcgtggtggcgggtggtctgcggatggcgcgtacggcgtgggcgctggcgggttcggggctggtgttgctgacggcggcgttcgcggcgcttcag

SEQ ID NO: 3553 - DNA, 2730 bp, Streptomyces avermitilis
  CDS (1)..(2730)
gtgagcagtgccgacgaccagaccaccacgaccagcagcgagctgcgcgccgacatcaggcgcctgggcgacctcctgggcgagaccctcgtccgtcaggagggccccgaactcctcgacctggtcgagaaggtccgccgcctgacccgcgaggacggcgaagcagccgccgagctgctgcgtggcacggaactcgagaccgcggccaagctggtccgcgccttctccacctacttccacctggcgaacgtcaccgaacaggtgcaccgtggccgagaactgcgcaccaagcgcgccgccgaaggcggacttctcgcccgtaccgccgaccggctgaaggacgcggaccccgagcacctgcgcgcgacggtcaagaacctcaacgtccgccccgtgttcaccgcccaccccacggaagccgcccgccgctcggtgctgaacaagctccgccggatcgccgcactcctggagaccccggtcatcgaggcggaccgccgccgctacgacacccggctggccgagaacatcgacctcgtctggcagaccgacgaactgcgcgtcgtccgccccgagcccgccgacgaggcccgcaacgccatctactacctcgacgaactgcacgccggcgccgtgggcgacgtcctggaagacctcacggccgagctcgagcgggtcggcgtacagctccccgacgacacccgccccctcaccttcggcacctggatcggcggcgaccgcgacggcaaccccaacgtcacccccgaggtgacctgggacgtcctcatcctccagcacgagcacggcatcaacgacgccctcgagctcatcgacgaactccgcggcttcctctccaactccatccgctacacgggagcgaccgaggaactgctgacgtcgctcgggaccgacctcgaacgcctgcccgagatcagcccgcgctacaagcgcctcaacgccgaagagccctaccggctcaaggccacctgcatccggcagaagctcgagaacaccaagcagcgcctcgccaagggcaccgcccaccagcccggccgcgactacctcggcaccggcgaactgctccacgacctcaagctgatccagacctccctgcgcgagcaccgcggcggcctcttcgccgacggccgcatggaccgcaccatccgcacactcgccgccttcggcctccagctcgccaccatggacgtacgcgaacacgccgacgcccaccactacgcactcggccagctcttcgaccgcctcggcgaggaatcctggcgctacgccgacatgccccgcgactaccgcggcaagctcctcgccaaggaactgcgttccagaaggccgctcgctcccagccccgccccgctcgacgcggccggcgccaagaccctcggcgtcttccacaccgtcaagcgagccctcgcagtcttcggacccgaggtcatcgagtcgtacatcatctcgatgtgccagggcgccgacgacgtcttcgccgccgccgtcctcgcccgcgaggccggactcctcgacctgcacgccggctgggccaagatcggcatcgtgccgctcctggagaccaccgacgagctcaaggccgcggacaccatcctcgaagacatgctctccgacccgtcctaccgccgcctggtcgccctgcgcggcgacgtccaggaggtcatgctcgggtactccgactcgtccaagttcggcggcatcaccaccagccagtgggagatccaccgcgcccagcgacgcctgcgcgacgtcgctcaccgctacggcgtacgcctgcgcctcttccacggccgcggcggcaccgtgggccgtggcggcggcccctcccacgacgcgatcctcgcccagccctggggcaccctggagggcgagatcaaggtgaccgagcagggcgaggtcatctccgacaagtacctcgtcccctcgctcgcccgcgagaacctcgaactgacggtcgccgcgacgctccaggcgtccgccctgcacaccgcgccccgccagtccgacgaggcgctggcccgctgggacgcggcgatggacgtcgtctccgacgccgcccactccgcttaccggcggctcgtcgaggaccctgacctgccgacgtacttcctcgcctccacgccggtcgaccagctcgccgacctgcacctgggctcgcggccctcccgtcgccccggctcgggcgtctcgctcgacggactgcgcgccatcccgtgggtcttcggctggacccagtcccggcagatcgtgcccggctggttcggcgtcggctccggtctcaaggcactgcgcgaggcgggcctggacaccgtgctcgacgagatgcacgagcagtggcacttcttccggaacttcctctcgaacgtcgagatgaccctcgcgaagaccgacctgcggatcgcccgccactacgtcgacaccctcgtcccggaccacctcaagcacgtcttcgccaccatcgaggccgagcacgaactcaccgtccgtgaggtcctgcggatcaccggcggggagaagctcctggacacccaccccgtcctccagcagaccttcgccatccgcgacgcctacctcgacccgatctcctacctccaggtcgccctgctcaagcgccagcgcgacgccgcggcagcggacacgccccccgacccgctcctggcccgcgccctgctcctcaccgtcaacggcgtggcggccggcctgcgcaacaccggc

SEQ ID NO: 3554 - DNA, 1008 bp, Streptomyces avermitilis
  CDS (1)..(1008)
atgaccccaggctccgatgtgatcgacgacgttccgaaggcgaacaacgactccatggccgcgtccgcgacgctgggcggcgagcggaaacgttcgctcgagcagatcacgctgctgctcttcatcatcgttccgttcctggcgctgctcgcggcggtgccgctggcctgggggtggggggtgagctggctcgacatgggcctgatggtgttcttctactacctcggctgccacggcatcacgatcggcttccaccgctacttcacgcatggttcgttcaaggccaagcggcccttgcggatcgcgctggcgatcgccggttcgatggcggtcgagggacctctggtccgctgggtggccgaccaccgcaagcatcacaagttctccgacgcggagggtgacccgcattcgccgtggcgtttcggcgagacggttccggctctgatgaagggcctgtggtgggcgcacatcggatggatgttcgacgaggagcagacgtcgcaggagaagtacgcgccggatctgatcaaggacggtgcgatccgtgcgatctcgcgtcagttcgtcctgtggacgggtctctcgctggcgctgcccccgttgatcggcggtctggtgacgatgtcctggtggggggcgttcaccggcttcttctggggttcgctcgtgcgggtggcgctgctgcaccatgtgacgtggtcgatcaactcgatctgtcatgcggtgggcaagcgtcccttcaagtcgcgtgaccggtcggggaacgtgtggtggctggcggtgctgtcctgcggtgagtcgtggcacaacctgcaccacgccgacccgacgtcggcgcggcacggggtggagcgcggccagctggattcctcggcgcggatcatccgctggtgcgagcggctgggctgggcttatgacgtgcgctggccgtcacgctcgcgtatcgattcccgccgtcacaccggtgaggaaggctcccggcgcaagagggagagcgccgacgcggca

SEQ ID NO: 3555 - DNA, 675 bp, Streptomyces avermitilis
  CDS (1)..(675)
atgattgacagcgtggcgaccgactccagcagcaccccgagcaatgaaaagccgcggcgtgcgcgccgcacgcggatgactggtgcggaaaggcgccagcagcttcttgagattggtcgcaccctgttcgccgcgaagggcttcgaggggacgtcggtggaggagatcgcggcgaaggccggggtctccaagcctgtcgtgtacgagcatttcggcggcaaggagggcctgtacgcggtggtggtggatcgtgagatgcggcggctgctggacatggtcaccggctccctcacggcgggtcacccgcgtgagctgtgcgagcaggccgctttcgcgctcctcgactacatcgaggagtacacggacggcttccgcatcctggtccgcgactcgccgatcccccagtcgacgggttcgttcgcgtcgttgatctcggacatcgccacccaggtggaggacatcctgggccgcgagttcaagagccggggtttcgacccgaagctggcgccgctgtatgcgcaggcgctggtcggcatggtcgcgctgaccggtcagtggtggctggacgtgcgccgcccgaagaaggccgaggtggcggcgcacctggtgaacctggcgtggcacgggctggacggcctggagccgaagccgcggctgataggacaccgcaagtcc

SEQ ID NO: 3556 - DNA, 366 bp, Streptomyces avermitilis
  CDS (1)..(366)
atgctcaccgccgtcgaccacgtccagctggccgcaccaccggggtcggagaacgccctgcgcgcctactacgtcgacatcctcggcatgagggagctccccaaaccgccggtcctcgcggcgcgcggcggctgctggttccaggcgggcgcggtgcacctgcacctgggcatcgaggcggacttccgcccggcgaggaaggcgcacccaggactgcgggtcacggacatcgagtcgtacgggggtcggctcgccgcccggggagcgacggtcacctgggacgccaacctcccgggccaccgccgcttctactccgaggaccccgtcggcaaccgactggagttcctggagccgctcgccccggag

SEQ ID NO: 3557 - DNA, 807 bp, Streptomyces avermitilis
  CDS (1)..(807)
atgcccgccgccgtccccagctgggatcccagccagtacctgcgccacgcggatcaccgcgcccgccccttcgccgacctgctggcccgcgtccccgagctgccccgggaccccgcccgcatcgccgacctgggctgcggccccggcaacgtcacccgcctgatcgcggagcgctggcccaccgcccgcatcaccggactcgacaactccccggagatgctggcgaaggccgccgcgtacgcgggtcccacggccggcggcggccgcctcgacttcgccgccgcggacgcccggacctggacacccgcgcagccctacgacctgatcgtcagcaacgccacgctgcaatgggtgcccgggcacatcgaccgcctccccgcctggacggacgggctggctcccggcggcaccctcgccttccaggtgcccggcaacttcgactcgcccagccaccggctgatgcgcgaactcgcccactcggcccgctggaaggaccgcctggccgacaccctgcgccacgacgacgccgtgcacacgcccgccgcgtacctggaggcgctcaccgccctcggctgcgcggccgacgtctgggagaccacgtatctgcacctcctccagggcgaggaccccgtactggactgggtgaagggaacgggcctgcgccccgtcctcacggaactgggggcggcggacgcggaggccttcgtcgccgaataccgggaggcactgcgcgaggcgtacccggcgacggagcgcggcacggtgttcccgttccgccgcgtcttcgccgtggcccacaaggaggcg

SEQ ID NO: 3558 - DNA, 495 bp, Streptomyces avermitilis
  CDS (1)..(495)
atggaggacgaggtcgatcggctggtcgcagcatggcgccgggagcgccccgacctcgacgtggaaccgctcgaggtgctcagccgggtgagcaggctcgcccggcatctggaccgggcccgtcggctcgcgttctccgagcacagcctggagccctgggagttcgacgtcctcacctcgctcaggcgcgcgggggccccgtaccagctctcccccggccagctcctcacccagacgctcgtcacctccggcacgatgaccaaccgtatcgaccggctcgcgaagaagagcctggtcgagcggctgcccgaccccagcgaccgccggggcgtgctggtccggctcaccgaggagggccgcgaccgcgccgaccaggcgctcgccggactcctcgaccaggagcgcgcgatcctcgccgaactcagccgggcccagcgcgctgaactcgcggccctgctacgccagttgaccgccccgttcgacaacatccccggc

SEQ ID NO: 3559 - DNA, 777 bp, Streptomyces avermitilis
  CDS (1)..(777)
gtgggggtttcagtgcttcgcatccgtgtcctggtcgttgacgaccatcgcatcttcgccgagtcgctcgccgctgcccttgccgcggagcccgacgtcgacgtctccgcggccggcagcggtccggccgcgctgcgcgccctggagcgggcggtggcggaaggccgcagattcgacgtgttgctcgtcgacgccgacctgggcggcaacgtgcccggcacccgcccggccgtctccgtccgcgacggcaacgaggaggggctcgtcgacggcatctcgctcgtcgcgggcgtccgctccgggcagccgagcgtacgcaccgtcgtcctggccgagaaggacgacccgcgccgcgccgccctcgccctccaggccggtgcctccgggtgggtcgccaaggactgctcactgtcccggctgctcaccgtcatacggggagtgctgcgggacgagacgcacctcccgcccgccctgctcaccggcgtgctgcgcgagctgaccgccgcccgcaagcaccgcaccgagagcgagcggctggtcgagtcgctgacgccgagggagcgggaagtactgcggtgcatggtcgcgggcctcgggcgcaaggccgtcgccgaacggctgttcctctccccgcacaccgtccgcacccatatgcagaacgtgctcgggaagctgggcgtgcactccaccctggccgccgtcgcgctcgcccgccgcgccggggtcgggcccgccgacctagccggggatgttgtcgaacggggcggtcaactggcg

SEQ ID NO: 3560 - DNA, 489 bp, Streptomyces avermitilis
  CDS (1)..(489)
ttgcagaactggttggccagcgcgtttatggtgagccgtatgtttcgtatggagacagaagtcgacaacgagcggcggaatctgcttcggcggcggctgctggacacgaacacggcggcgtcccccgctctgcgcgcgctgcgcggaacgccggacgaacgtgaacgtccgctgcatgtgtgggcgttgtccgaggacggtgacctggccggcggcctggtgggccacacctggacgacgtggctgcacgtcacctacctctgggtggacgagcgccaccggggcacggggctcggctcccggctgctggccgacgccgagcggacggcccacgacgagcgcggctgccgggccgcccgcctggagacctgggacttccaggccccggatttctaccggaagcggggctacgaggtggtgtgcgtgatccccgactatccgccggggaccacggagtacacgctgacgaagcgcctcgaccgcctcagc

SEQ ID NO: 3561 - DNA, 1143 bp, Streptomyces avermitilis
  CDS (1)..(1143)
gtggtgggggttcgcgaagggttcgaggagctgtacggggccgcgccggagggcgtctgggccgcccccggccgggtcaacctcatcggcgagtacaccgacttcaacgagggcttcgtgatgccgctcgccctgccgcacacggcggtcgcggcggtgtcccggcgcaccgacggagtcctgcggctgcactcggcggacatcgagggccccgtggtcgagctgcgcgtcgacgagctggagccgctgacgaacaccagctgggccgcgtacccggcgggtgtggtgtgggcgctgcgctccgcgggacacccggtgacgggcgcggacatccacctcgcctcgacggtgccgacgggcgccggcctgtcctcgtcggcggccctggaggtcgtgacggcgctggccctgaacgacctctacgaactgggcctgacccgccccgaactggcgcgcctcgcccagcgcgcggagaacgacttcgccggcgtcccgtgcggcgtgatggaccagacggcgtcggcctgctgcaccgagggccacgtcctgcacctggactgccgggacctgtccatccgccaggtccccttcgacctgccggcccacggcctcgaactcctggtcgtcgacagccgggtgaagcacgcgctgggcgacggcgcctacgcggaacggcgcgcggggtgcgaagagggcgcacggcagctcggggtctcgcatctgcgggacgtcgcgtacgaggagctggacggcgcgctgtcccgcctgcccgacgagcgggtacgccgctacgtacgccatgtcgtctcggacgaccaccgggtggagcgggtcatcgccctgctggacgcgggcgacgtacgcgcgatcggcccgatcctgacggacggccatgtctccctccgcgacgacctgcgcatctcctgcccggagctggacctggtggtcagcacggcgaacgcggcgggcgcgctcggcgcgcgcatgacgggcggcggcttcggcggctcggcggtggtcctggtcgagtccgccgacgtggacacggtcaccaaggcggtgacggaggcgttcgcggcggccggtcacacggcgccacgggtgttcccggcagtgccctcggagggcgcccggcggctcagc

SEQ ID NO: 3562 - DNA, 957 bp, Streptomyces avermitilis
  CDS (1)..(957)
atgagtgggaagtacctggtcaccggcggtgccggctatgtcggcagcgtggtcgcgcagcacctgatcgaggccggccacgaggtcgtcgtcctcgacaacctctcgaccggcttccgcgagggcgtgccggcgggcgcctccttcgtcgagggcgacatccgcgacgccgccaagtggctggactcctccttcgacgcggtcctgcacttcgccgcgttctcgcaggtcggcgagtcggtcgtgaagcccgagaagtactgggacaacaacgtcggcggcacgctggccctgctggccgcgatgcgcgaggccggcgtacgcaagctggtcttctcctcgacggccgcgacctacggcgagccggaggaggtgccgatcgtcgagacggcgccgaccaggcccaccaacccctacggcgcctcgaagctcgcggtcgaccacatgatcaccggtgaggccggggcccacgggctcgccgcggtcagcctgcgctacttcaacgtggccggcgcgtacggcagctgcggtgagcggcacgaccccgagtcgcacctcatcccgctcgtgctccaggtcgcccagggccgccgcgacgccatctccgtctacggcgacgactacccgacgccggacggcacctgcgtccgcgactacatccacgtcgcggacctggccgaggcccacctgctcgcgctggacgcggccacgcccggcgagcacctggtctgcaacctcggcaacggcaacggcttctccgtccgcgaggtcatcgagaccgtccgccaggtcaccgggcacccgatcccggagatcgtggccccgcgccgcgccggcgacccggcggtgctcgtggcctccgcggccacggcccgcgagcgactcggctggaacccggcccgcgcggatctcgcgggcatcgtcgcggacgcctgggcgttcgctcagcacaaggag

SEQ ID NO: 3563 - DNA, 1083 bp, Streptomyces avermitilis
  CDS (1)..(1083)
gtgaagaagacctcgaccccgctggccgacggtcgcgagctcatctactacgacctgcgcgacgacgccgtgcgcgacgccgtggaccggcgcccgctcgaccggaccgtcaccagctcggagatccgccgcgacccgctgctcggcgactcggtcgcgatcgcctcgcaccgccagggccgcacctaccaccccccggcgaacgaatgtccgctctgcccctccgagggcgagcggctgagcgagatcccggactcctcgtacgacgtggtcgtcttcgagaaccgcttcccctcgctggccggagactccggccgctgcgaggtggtctgcttcacctccgaccacgactcctccttcgccgacctgaccgaggagcaggcgggcctggtcctggacgcctggaccgaccggacggcggagctgtcgcatcttccctccgtccagcaggtgttctgcttcgagaaccgcggcgccgagatcggcgtgacactcggccacccgcacggacagatctacggctaccccttcaccacgccccgtactgcgctgatgctgcgttcggcggccgcgcacaaggaggcgacggggggcggcaacctcttcgacgacgtactcgccggcgaactggccggggagcggatcgtccttcagggagagcactgggtcgccttcgttccgtacgcggcgcactggccctacgaggtccacctctacccgcgccgccgggtccccgacctgctggccctcgacgaggacgcacgcacagagttccccaaggtgtatctggaactcttgaggcgcttcgaccggatcttcgatgggacgggtggagggaaagaaggggtgggcgagcctccgacgccgtacatcgccgcctggcaccaggcgccgttcggcccgttggaggagttcgaaggcgtcaaccgtgacgacttcgcactccacctcgagcttttcaccattcgccgcacttccggcaagctgaagtttctcgcgggttccgagtccggcatgagcgtgttcatcaacgacgtgccgccggagaccgcggcccagcgactgcgagaggtagcgagttca

SEQ ID NO: 3564 - DNA, 1707 bp, Streptomyces avermitilis
  CDS (1)..(1707)
atgcagtcccccacgcatctgcccacacatccactcgaagcgacgtacctcgccgacgggctccgactccccacgaacgggctcgactacacgatcctcgcgatctacttcgccgtcgtgctgggcatcggcttcgccgcccgccgctcggtgaagacaagcctcgacttcttcctctccgggcgctccctgcccgcctgggtcaccggcctcgcgttcatcgccgccaacctgggcgcgacggagatcctgggcatggcggcgaccggcgcgcagtacggcgtcgcggtcgtccactggtactggatcggcgccatcccggccatggtcttcctgggcctggtgatgatgccgttctactacggctccaaggtccggtcggtccccgagtatctgctccagcgcttcgacaagccggcacacctgctgagttcggtcctgttcgccttcgcggcgatactgatcgcgggcgtcaacctgtacgcgctggcgatcgtcgtcgaggcgctgctcggctggccgcagtgggtggcgatcgtggtcgcgggcttcctggtgctcgcgtacatcacggtcggcggtctctcctcggcgatctacaacgaggtgcttcagttcttcgtgatcctcgccgcgctcatccccatctcggtcctcggcctgaagaaggtcggcggctgggacggcctgagcgactcgctcaccaagagccacggcgacaacttcctgtccgcctggggcggtacgggcatcggcgaccccaacccgctgggcgcgaactggctgaccatcatcctgggcctgggcttcgtgctctccttcggctactggacgaccaacttcgccgaggtgcagcgcgccctgtccgcgaagaacctgtccgccgcccagcgcactccgctgatcgccgcgttcccgaagatcttcatcgtgttcctggtgatgatcccgggtctggtcgccgcggtcctcgtcccgaagatcggcaccagcggctcggacctccagtacaacgaggcgatcccgtacctgatgcaggagttgctgcccaacggcgtgctcggtatcgcggtcacgggtctgctcgcggccttcatggcgggcatggcggcgaacgtctcgtccttcaacacggtcttcaccaccgacatctggcagcggtacgtggtcaaggaccgcgaggacgcctactacgtgcggttcggccggctgatcacggcggtcggcgtcatggcgtcgatcggtacggcgttcatcgcgtcgtcgttctccaacatcatgagctacctccagacgctgttctccttcttcaacgtgccgatgttcgtggtcttcatcatcggcatgttctggaagcgcgcctcgatgaagtccggcgtgtggggcctgctcgcgggcaccacggccgcgatggtcaactacttctggatctacaagcagggcgtcatcgacatccccagcgaccagggcgcgaacttcgtctcggcgatcgtcggcttcgtggcgggcgcggtggtcatggtggccgtcaccctctttacggctccgaagccggaggcggaactggccggcctggtctacggcacgcgctccccgggtgtgccggagccgccggccaccggtgacgacgcctggtaccgcaagccggcgctgctcggctggtcggcgatcgtcctggccgccctctgctacatcccgtactcgttc

SEQ ID NO: 3565 - DNA, 285 bp, Streptomyces avermitilis
  CDS (1)..(285)
atgtccgacctgcaacgcgaagtcaccgatctggagagcaagtccgcgaccgccgcccgcctcttcgacatccgccggatcatcggcggcctgttcgtggtctacgggatcatcgtcacgatcgccgggatctccccgtccgacgccgacctggacaaggcacagggcgtcaacatcaacctgtggacggggctcgggatgcttgccctggggctgttcttcctggggtggatgtggctgcggcccacggtgccgccgacgcctgccgatgaggagccgtcgcag

SEQ ID NO: 3566 - DNA, 795 bp, Streptomyces avermitilis
  CDS (1)..(795)
gtggaaaagactctggagttttccgatctgctgcgactgatcgacgaacgatcgaccgccttccgcgccgcggtcgccgccgcgcccagtctcgacgtacaggtgccgacctgccccgagtggacgctgttcgatctggcgcagcacatcggcgaggggcgccgcgactgggccgccaccgtcgccgcagggcctgctccggccaagtccgcagcggagggcgccccggctgcgccccgggagcgcgaggccctgctggcctggttggcggagtccacggagcaactgctggacgcgttgcggaaggccggcccggatcgcggttgctggacgtggtgggggacgtcgcagtcgccaccgacctccggtgccgtagctcggcaccagctccagcagctcgcggtgcacacgtacgacgcccagatcaccgtaggtgccccgcagccgctgcccgacgaggtggcgctcgacggtgtcgacgagttcctgtccacctgcgtcgcaacgacaagcgcctggccgcacgagcccgctgccgtcgacttccacgcctccgagggccgctcctggcgcctctcgctctccgccgacggcgcacgggccacccgtcttcccgcgcccggcacggcgcccgccgccgctgccggcgaggacccggacgcggccgacgcctccttccggggcaccgccggtgagctggtcctggccctgtacggccgtattccggtggactccctgaagctcgacggcggccgacgtctcttcgacctgctcgaggcctgggacccggacgag

SEQ ID NO: 3567 - DNA, 483 bp, Streptomyces avermitilis
  CDS (1)..(483)
atgttccaaatcaagcgctttgggtccgcagtcgcgacggccgcggccctggcatctctgtctatggctatcgcccccgtggccgtcgccgccacggtcccgcagcccagcacgtcagtcgcgcagggggtcaagggcccgaagcccccgacgcccccgaccgtctgtgccgctctgagcggtcagctctccacgcagctgcaggccgccgcgacggcgctggccgccacgccgcccgacgtccccgcggcccaggcggcgatcgccgcggcccaggtcaccgtcgcacagctccgtgccaacgggtgcctcccggcggcgcctccgacgccgcccacctgcgcggcgctcaccctgcaactgcaggcgcagctccaggtccttgccgccgcgctggcggccaacccgcaggacccggccgccatcaccgcggcgttcaacgcggtggtcgccaccgctgcgcagctcgctgccgtttgtgtg

SEQ ID NO: 3568 - DNA, 723 bp, Streptomyces avermitilis
  CDS (1)..(723)
atgggagtgcggctgatggtggtcgacgaccaccgattgctcgccgaggcgctggcctcggctctgaagctgcgcgggcaccgcgtgctcgccgcggccgcgcccgccgcgggcgcggcggagctggtgatcaccagggcgccggaggtgtgcctgctcggtacggcgacaccggacgagccgggcatcttcgacccggtggtgaagatcaagcgggagcgtccgcaggtggcggttctggtgctggggccggtgccgaatccgcgtgggatcgcggcggccttcgccgccggcgcctccggttacgtacggcacgacgaacggatagaaggcgtcgagcgcgccatcatgaaagcgcggtccggggaggccgccgtggcgccacagctgctccagggcgccttcagcgagctgctcaacccggccgcccagcccgacgacgaaggtcagcgtctgctccagatgctgacgccgcgcgaggtggaggtcctggtgcgggtggccgacggcgaggacacccggctgatcgcggccggcatgggcatagccccgagcacggcccgcacccatgtgcagcgggtgctgatgaaactgggggtggggtcgaggctggaggcggcggcgctcgcggcgcgtaccgggctgctggaccgggcggggccggtggcggcggggcccgggagtgcggaggattctcggcctgcggagcaaccaggccggggg

SEQ ID NO: 3569 - DNA, 1491 bp, Streptomyces avermitilis
  CDS (1)..(1491)
gtgccgatgcagcctcagcccccgcagggcgggcggaaggggcccggcgccacgacctggatcatcgtcgcggcggtcgcggccatcgcactgatcgtgggcggcggtgtgtacatgtactccgccaccggcggcgacgacagcaagaacaactcctccggcacgaccggcggcagtggcggcagcggcggcaaggacgacgacgccacctcgggcggcaccgacacctccagcggcgaagccaaggagaaggcgccggccgaccccagcgccaaggtcctcttccaggtgcccgcgccgacgatcaccgacaagcaggagatcgacagcgtcagcggctcctggctcaccgactccgtctacgcgaaggccggcgtcgccaagatcgtcggatacgacgcggactccggctcgagcaagtggacgctgccgctgaccggccagacctgtgccgcctcgccggagatctccgcctccggcatcgccgcggtcgtcaccgagtcgggcaagcgcgccggcagcagcgaccgcaagccgtgcagcgaggtcaccgcgttcgaggtggccaccggcaagaagctgtggaccaagaacgtgtccgtcggcgacgccaaggtcgcgttcgaggaggtcaccctctccggcggcaccgtcggggtcggcggcctgtacggcggcgccgccttcgacctgtcgtccggcaaggtcctgtggcagccgaaggccagcggctgccaggacctcggctacgcgggcggcgagcagctcgtcgcggtgcgcaagtgcggcgagtacggcgacgagaagtacgaggtccagctcctcgacccgaagtcgggcaacgtgaagtggagttacaagctccccaccggcatcgacaacgccaaggtgatctccagcaagccggtcgtcttcggcgtcgactcgggtgacgtcaccgcctccggcgtcaccgacgtcttctccctcgacgacagcggcaagctgcgcacgaagatcacgctcgcggacggcaagtacgagcacgactgcggtgtcggcgacgtccacgactgccacgcgatcacggtcggcaacgacaagctgtacgtcccgaccaaggagcacgacggcacggcccagggcagccggaccaacgagatcgtcacgttctcgctggccaccggcaagaccgccggcgacaagatcgacgcgggcgacgactacgagatcttcccgatccgcatggacggcgggaacgtcatcgcgtacaaggacggaccgtacaacaagggttcccaggtcgtctcggtgaacggcacgtccctgaaggagaccaagctcctggagaccccgtccaccgacgccgtgcgcagcgccatcagcagcatggtgccgaagtcgtccgaactgctctacacggacggccgcctcttcatgggcaaggatctggtcagcaagccgtactcgaccgaccaaaaggagtacgcggccctgggcttcggcgccaag

SEQ ID NO: 3570 - DNA, 1869 bp, Streptomyces avermitilis
  CDS (1)..(1869)
atgactcagccgcccaaccagccgccgcagggcggcttcggggcaccgcaggaccagccgaccgtaggcttcggcggcccgcaggacccgcgtcaggacccgagacaggaaccacggcagggcacgcccccgccgcccgcccagccaccgcagacgccgccgcctccgccgcagtcgccgcctccgccgcagcccggctacggctatccccagcagcccggcccgtacgggcagccccagcagccgggccagccgggccagccgggaccctacgggcagccccagcagccggggccgtacgcccagcagcccggcccctacggcgccccgcagcctggttacggctatccccagcagcagcccggctacggctacccgcagcagccgccgcagttccccggcgcgcccaccccgccgcccggcgggggttccaagaaccccttcaagggcaggccggcggtgctcatcgcggccgccgtcgccgccgcgctgctcgtcggcggcaccgtgtgggccgtcacctccgagggcgggagcgacgacaagaagcccgtggccgagaagagcgagaagagcaagggcggcaagacctccgcctccgacgatccggtcaaccccggcgacggcagcggcgacggcggcgcggaccccgagaacctcaacgaaggccgccaggcgggcgagtcgaaggtgctctggtacaaggaggcgcccgacgcgcccggttccggcgccgacgcccccggcatgtggatcaccggcaagacggcggtgaaggccgcgtacaagcaggtcttcgcgtacaacgtcggcaacgggaacccggcctgggacccgatcaccttcccgcagaagatctgctcggtcacccagcagaagacggccgacgacaagatcgtcgtcgcctacatgagcggcgtcagcgacaacgccaagtgcaaccagctccagcagatcgacctcgacaccggcaagaagggctggaagggcgagatcgccgagggcgctctcttcgacagcaccttcaacgtcagcctgaccatcaccggtgacacgctgctggtgggccgttcgcagtcgggcaccgcgtacgacgtcgccaccggcaagaagcgctgggacaagaagaagtacggcaccgcctgcttccccaccgcgttcgccggcggcgccaagatgatctccgtcgcctcctgcgcggccggcaccggcaccgagcacgacgaggtgcaggaactggacccggcgaccggcaaggccaggtggaccaagaagatccccaagggctggaccgtcgcgcgcacgtactccgtcgcccccgtcgtcctctacctcaccaacgaggacaagaagcagtggaacgtctccacgctgaagaacgacggcacgctgcgctcccaggtcgacgtcgacgagtccttcgccccgcagtgcggctgggccatcctcgaccgtgacctccagggctgcaccggtgtcgcggccgacgccaacacgctctacctgccgaccgaggcgaagaccggcgccaacgaggtcgtcgcggtcagcctggagaccggcaaggagaagtggcgcgtcaagtccccggcggacgagtcgatgctgccgctgaagatggacggcacccacctgatcgcgtacgtcgagccgtcgtacgacgcgggcggccaggtcgtctccatcccgacggccggcagcagccacaagccggccaagctgctccagaacccgcagggcaccgcgcagatcgagagcggcttctactcgaaggccctcgactgggtggacggccgcttctacctctccacgacccggctgacgggcagcaacgagtccaaggagaagctgatgctggcctacggcaag

SEQ ID NO: 3571 - DNA, 1803 bp, Streptomyces avermitilis
  CDS (1)..(1803)
atggccgtcaatctggtcaatgtcgaggccgtcagcaaggtgtacggcacccgtgccctgctcgacggcgtctccctcggcgtgtccgaaggggaccggatcggagtggtggggcgcaacggcgacggcaagaccacgctgatccggatgctcgccaagctggaggaggccgacaccgggcgcgtcacccactccggcgggctgcacatcggcgtgctcacccagcacgactcgctggaccccgaggcgaccgtccggcacgaggtcatccgggacatggaagaccacgagtgggccggcaacgcgaagatccgggacgtactcaccggcctgttcggcggcctcgacctgccaggcttcccgcagggcctggacacggtgatcggtccgctctccggtggtgagcggcgccgcatcgcgctggccaagctgctcatcgaggagcaggacctgatcatcctcgacgagcccacgaaccacctggacgtcgagggcatcgcctggctggcgaaccacctgcgcgagcggcggtccgcgctcgtgtgcgtcacccacgaccgctggttcctcgaccaggtctgcacgcgcatgtgggacgtgcagaagggcgacgtgtacgagtacgagggcggctactccgactacgtcttcgcgcgcgccgagcgggagcgcatcgccgcgaccgaggaggtcaagcggcagaacctggtgcgcaaggagttggcgtggctgcggcgcggcgcgcccgcccgtacgtccaagccgcgcttccgcgtcgaggccgccaacgagctgatcgccgacgtcccgccgccccgcgacagcagcgagctgatgaagttcgcctcgtcgcggctcggcaagaccgtcttcgacctgaaggacgtgaccgtccaggccgggcccaaggtgctgctcaagcatctgacctggcagctcggccccggtgaccgcgtcggcctggtgggcgtgaacggggcgggcaagacctcgctgctgcgcgccatggccgaggccgcccgcagcgagggcgagaagcagcccgcggccggacggatcagcaccggcaagaccgtcaagctcgcctatctctcccaggaggtcgccgaactcgacccggccctgcgggtgttgcaggccgtgcagcaggtccgtgaccgcgtcgatctcggcaagggccgcgagctgaccgccggacagctgtgcgagaccttcggcttcaacaaggagaagcagtggacgccggtgggggacctgtccggtggtgagcggcgccggctccagctgctgcggctgctgatggacgagcccaacgtgctcttcctcgacgaaccgaccaacgacctcgacatcgagacgctcacccagctggaagacctcctcgacggctggcccggctcgatggtcgtcatctcccacgaccggttcttcgtcgagcggaccaccgacaaggtgtacgcgctcctcggcgacgccacgttgcggatgctgccccgcgggatcgacgagtacctggagcgacggcaccgcatggaggaggtcgccgctgccgccgtactcgccgcggcgcccgctcccgccaaggccacttcggccgcggacgcccgtgccgccaagaaggaactccagaagatcgagcggcagctggacaagatctccgagcgggaaaccaagctgcacacccagatcgccgacaacgccacggacttcgagaaggtggcgaaactggacgcggaactgcgggagttggccggcgagcgcgaggaactggagctgcgctggctggaactcgcagaggacgcc

SEQ ID NO: 3572 - DNA, 1332 bp, Streptomyces avermitilis
  CDS (1)..(1332)
atgagaccaagcgaccttgccgcggccaccccggcctcccgcgaccgctacgtcgacctgctgcgggtcgcctcgctcggcacggtcgtcctcggccactggctgatggcggccgtggacgtcgggacggacgggcgggtgcgggtcggcaatctgctcgccgtcgagccccggctccaactcctcacctgggccctgcagatcatgccggtgttcttcttcgtcggcggcttctcgcacgccctctcctaccgctcgctcagccggaagacccccgacacgtccgtctactcggcgttcctgcgcgcccggctccagcggctgctgcggccgaccgtcgtcttcatcggggtgtggggcgcggcggcgctcggcctccaactggcgggcagcggcggtgggttgctcgacgtgtcgctgcggctcgtcgcccagccgctctggttcatcgggatctatctcgccatggtcgccttcacgccgcccctgctcaggctccatgagcggtacgggtggggcgcgttcggcgggctcgtcgcggcggcggggacggtggacgtgctgcggttcgccctcggtgtgccgtacgtcgagttcctcaacttcgccttcgtctggctcgccgtccaccagctcggattcctgcgcgcggacgggaagccgggcaggccgtacgtcctcgccggcgccgggctcgcgggggccgcgctgctggtggcgtacgggccgtatccgctgtccatggtcgggatgcccggggagaagatctccaacatggcgccgcccagcttcgcgctgctctgccacgggctgtggctggtcggcgcggtggagctgatgcgcgcccccgcgacgcggtggctggaccggccgcgggtgtggcggaccgtggtcgccgccaacgggatctcgatgaccgccttcctgtggcacctcaccgcgatgctcggcgtgtacggggcgctgctcgccgccgacgtgcgactgccggcgcccggcacaggtgcgtggtgggtacaggtaccatttcggatcatggtcgccgcgctgctcaccgcggtgctggtggccgccttccgcgccttcgaaaaaccctcgggggtacgggagccgagtgcgccgcgcgcgtatgcgggacccgctgccgcgttcggcgtcaccctctgtctgttcggggtcctcgggctgtcgatggtcggcttcggagggctgctggaggggcgttcggcggtactggtcgccgtccgggtgaccgcccccgccgccgtgctgatgaccctggccggatggctcctggtcgaacggtcgggccggagaagacctcgcggtgca

SEQ ID NO: 3573 - DNA, 891 bp, Streptomyces avermitilis
  CDS (1)..(891)
gtgagcgtgaccgtacgcgtccccgccaaggtcaacgtccagctcgcggtcggcggcgcccgccccgacggcttccacgacctggccaacgtcttcctcgccgtcggcctgtacgacgaggtcaccgcgaccccggccgacgagctgcgcatcacgtgcgaggggcccgacgccgcacaggtcccgctcgaccgcacgaacctcgccgcccgcgcggcgatcgcgctcgccgcgcgacacggcctcgcacccgacgtccacctccacatcgccaaggacatccccgtcgccggcggcatggccggcggcagcgcggacgcggccggcgcgctgctcgcctgcgacaccctgtggggtacgaacgcctcacgcggcgaactcctcgacatctgcgccgagttgggcagcgacgtgcccttcagcctggtcggcggcgccgcgctcggcaccgggcggggggagcggctgcgggagctggaggtcggcgggaccttccactgggtgttcgcggtggccgacggcgggctgtcgaccccggccgtgtacggggagttcgaccggctgagcgagggcgtacgcgtacccgagcccgtcgcctcccaggaactgctcgacgcgctggccaagggggacgccgtggccctcgccgccgccgtctccaacgacctccagcccgccgcgctgtccctcttcccgtccctcagcgacacgctggaggcgggccgtgccgccggcgccctcgccgcgctggtctccggctccgggccgaccacggcgttcctcacccgggacgcggacggcgcggacgccgtggcccaggcgctgctcgcgtccggtacatgccggacggcgcgggtcgccccgtctcccgcaccgggcgccaccgtcctg

SEQ ID NO: 3574 - DNA, 885 bp, Streptomyces avermitilis
  CDS (1)..(885)
gtgagcagccccgcccccgacgccctcctgggccccgccgacatccgcgaactcgcggcagccctcggcgtgcggcccaccaagcagcgcggacagaacttcgtcatcgacgccaacaccgtgcgccgtatcgtgcgcaccgccggagtacggcccgacgacgtggtggtggaggtggggcccgggctcgggtcgctcaccctcgccctgctggaggccgccgaccgcgtcatcgccgtcgagatcgacgacgtcctcgcgggggcgctgcccgccaccatcgccgcccgtatgcccgagcgggccgagcggttcgcgctcgtccactccgacgccatgcacgtacgggagctgccgggcccgccgcccaccgcgctcgtcgccaatctgccgtacaacgtcgccgtgcccgtcctgctgcacatgctcgacaccttcccgagcatcgagcgcaccctcgtgatggtgcaggccgaggtcgccgaccggctcgccgccgaccccggatcgagggtgtacggcgtgccgtccgtgaaagccaactggcacgccgaggtgaagcgggccggctccatcggacgcaatgtcttctggccggcacccaacgtcgacagcgggctcgtgtcgctggtccggcggaccgagccgatcaagacgaccgcgtccaagaccgaggtcttcgcggtcgtcgacgcggccttcgcccagcgcaggaagacgctgcgggccgcgctggccggctgggccgggtcggccgccgccgccgaggccgccctcgtcgccgccggggtgtccccgcaggcgcgcggggagtcgctcacggtcgaggagttcgcccgtatcgccgagaaccgcggcgccgaccacgccgacgacgccaacaac

SEQ ID NO: 3575 - DNA, 1533 bp, Streptomyces avermitilis
  CDS (1)..(1533)
ttggagagtgacgaccgctccgctaggttctggtcgcccgatccggacgcccttggagctgtcgtcgtgagcaactcgcagcacgagacgtacgagacgtacggcacgtacgggccgccgtacgacccgtacgacccgtacgagctgtcgtacgggccggctgagccgccgtacaggatgaccgagccgtcgtacggggcggccgagccctcgtacgagatgaccgagccgtcgtacgggacggccgggccgtacggcccggtccccgagccgcccgggccgcacaccgcgccgaccctgccctacggggtctacgaggacacctaccggcccgcctacgagtcgggcgggtccccgcttccccggcggacggacgccgccggtcacccgggcgggcgcgccgaggcccggcgggcggcccggcgccggaagatctccgtacgccccgacccgctgcgccgactgctgccgcaggccctggtcgtcgtcttcctggccggtggcaccacggcgttcgtcgccaaggacaaggcgatcgagctgagcgtcgacggcaagccccgcacgctgcacaccttcgccgacgacgtgaccgagctgctcgccgaggagggcgtcggcgtcggcgcccacgacgtcgtggcccccacccggggctccgcactggccagcggggacgaggtcgcggtgcgctacggcaggcccgtgcacctcacgctcgacgggcagcggcgcagggtgtggacgacggcgcgcacggtggacggcgcgctccagcagctcggggtgcgtgcggagggcgcgtacgtgtccacctcgcgctcccggccgatcggccgggcggggctcgcgctcgacgtccgtaccgagcggacggtgacgatcatggcggacggccgggagcggacgatccgtacgaacgcggcgaccgtgggggaggccgtggagcaggccgggatcaccctgcacggccaggacacgacgtcggtggcgccggggagctacccgcgcgacgggcagaccgtgacggtgatgcggatcaccgggtcgagggaggtccgcgaggaggtgatcccgttcggcgtggagcgcatggacgaccccgcgctgttccggggcacggagctggtggagcgggccgggcagccgggggcgcggcgggtcacgtactcgctgcgcacggtcaacggtgtgcggcagacgccgaagcggatcgactccgaggtggtgcgccagccgcagaaccgggtggtgaaggtcggcacgaagccgccgccgccgtcggtcgcgggcgcggacgatctgaactggggcggtctcgcggcctgcgagtcgggcggacggccgggggcggtggatccgtccggcacgtacgggggcctgtaccagttcgacacccggacctggcacgatctcggcggctccggccgcccccaggacgccccggccgccgagcagacctaccgcgcgaagaagctgtacgtacgccggggagcaagcccctggccacactgcggctcccgcctccacgac

SEQ ID NO: 3576 - DNA, 885 bp, Streptomyces avermitilis
  CDS (1)..(885)
atgccttcccgcgcctccgacgccgacaagaacgccgccccgccgctcccggcgccgctgcgcgtgcccgtcgccgactcgcacacccacctcgacatgcagtccggcacggtggaggagggcctcgccaaggccgcgtcggtgggcgtgacgacggtcgtacaggtcggctgcgacatcgacggttcgcggtgggcggccgagacggcggccgcgtacgacgccgtccacgcgacggtcgcgctgcacccgaacgaggctccgcgcatcgtccacggcgaccccgacggatggtcgaggcagggcgcgcgccggcccggcggcgacggcgcgctcgacgaggcgctcgccgagatcgaccgcctcgcggcgctgccccaggtcaagggcgtcggcgagactggtctcgactacttccgcaccgggcccgagggcaaggccgcccaggagcggtccttccgcgcccacatcgagatcgccaaacggcacggcaaggcgctcgtcatccacgaccgcgacgcccacgccgacgtactgcgcgtcctcaaggaggagggcgcccccgagcggaccgtcttccactgctactccggggacgcggagatggccgaggtctgcgcccataacggctacttcatgtccttcgccggcaacatgaccttcaagaacgcgcagccgctgcgcgacgcgctcgccgtggcgcccctggaactcgtcctcgtcgagaccgacgcgcccttcctgacgcccgcgccgtaccgcggacggcccaacgccccgtatctcattccggtcacggtccgcgcgatggccgccgtgcggggcatcgacgaggacgcgctggcgacggcgctcgcggcgaacaccgcccgcgcgttcgattac

SEQ ID NO: 3577 - DNA, 414 bp, Streptomyces avermitilis
  CDS (1)..(414)
atgagtgagatcgcagggcagaccggccagagcacgggcaaccgcacctcggcgaccgccatcgtccacgagtcgtattccttcgcctgcatgcgctgcgggcacggctgggaacagtcgtacgagatagagcaccacctcgacgccgagggcagtgagttcgtgatgtacgtggcgaacggcaaggtcgtgccgtccccgctgagccggccgacctgcgtgaactgcgacggccatgtcgtgcgcatcatgcgcccggggcaggtgtcctccgtgctggacttgctgcaccggccgcaccggcccgagcccggaaggcggcccctggccgagccggaggcggcgccggtccgggagacccaccactggcacctctccgacctgctgcacccgttccaccaccgcaaggccggc

SEQ ID NO: 3578 - DNA, 864 bp, Streptomyces avermitilis
  CDS (1)..(864)
gtgaccacagcgcctggaaccctcgtactcgccggaacccccatcggggacatcaccgacgcaccgccccggctcgcccaggagctggcgggtgccgatgtcgtcgcagccgaggacacccggcggctgcggcggctgacccaggcgctcggcgtgcagccggccgggcgcgtcgtgtcgtacttcgagggcaacgaggccgcccgtacgccggaactcgtcgaggcgctcctcgacggctcgcgcgtgctgctcgtgaccgacgcagggatgccgtccgtctccgaccccggttaccggctggtcgccgccgccgtggcgaaggacatccgcgtcaccgccgtaccgggcccgtccgccgtactgaccgcgctcgcgctgtccgggctgcccgtcgaccggttctgcttcgaggggttcctgccgcgcaaggcgggggagcggctgtcgcggctgaaggaggtcgccgaggagcggcgcaccctcgtctacttcgaggcgccccaccgcctcgacgacaccctcgccgccatggccgaggtgttcggcgaggaccggcgcgccgccgtctgccgtgagctgaccaagacgtacgaggagatcaagcgcggcccgctggaggagctggccgcgtgggccgcggaaggcgtacggggcgagatcaccgtcgtcgtcgagggcgcgccggtcaggggagccgacgagctggacgccgacgagctggtgcgccgggtccaggtgcgggaagaggccggggagcggcgcaaagaggccatcgcggccgttgccgccgaggccgggattcccaagcgggacgtgttcgacgcggtcgtcgcggcgaagaacgcggcgcggaccggcgcg

SEQ ID NO: 3579 - DNA, 1737 bp, Streptomyces avermitilis
  CDS (1)..(1737)
gtgaccagtaccgcgtcctccacggacatccggcagggccaggccgccgacgagcagtggccgtcgtggcagcagcggctgcgccgcttcggatacacggcgccgccgagaaccgacgtgcgcgaccggctggtgccgccgttcagcgagcccagcccacggctgtgggcggcgatcggcctgcgccaggaggtcgcggaccgtgtgacgcgctggtcggcgtggggcggcccgctgctcgtgacgctgctggcgggcctgctgcgcttctggaacctgggcagccccaaggcggtgatattcgacgagacgtactacgccaaggacgcctgggcgctcatccacaacgggtacgaggcgaactgggccaaggacgccaacgacctgatcctccagggcaacggccatgtggcgatcccgacggaccccgcctatgtggtgcaccccccggtcggcaagtacgtcatcggcctcggcgaatggctgttcgggttcaccccgttcggctggcgcttcatgacggcgctgctcggcacgctctccgtcctgctgctgtgccgcatcggccgccgtctgttccgctcgacgttcctcggctgcctggcgggcgcgctgatggcggtggacggcctgcacttcgtgatgagccgcacctcgctgctcgacggggtgctgatgttcttcgtgctggccgcgttcggctgtctggtcgtcgaccgggacagggcgcgcgcccggctggcggcggcgctcccggccgacgcggacggtgtcgtacgcccggacgcgcacaccgccgagacgacccgcctcggcccgcgcccgtggcgctggctggccggcctgatgctgggcctggccctgggcaccaagtggaacgcgctctacgtcatggccgcgttctgtgtgatggcggtcctttgggacgtcggctcccgccgcgtcgcgggcgcccgccgcccgtacgcggccgtgctccggcgcgacacgggcatcacgttcctggcgacggtcccggtggccgtggccacctacctggtctcctggacgggctggatcctctccccggccaacggcagcggcggctacttccgcaactgggccgcgaccgacggcaagggcggccactggacctggctcccggactggctgcgcagcctgtggcactacgagcacgaggtgtacgagttccacgtaggcctctcgtctccgcaccagtaccagtcgaacccctggagctggctggtcgccggccgcccggtctcgtacttctacgagtccccgtcgcccggcaaggacggctgtcccgccgacgcgggcgagaagtgcgcccgcgaggtcctcgccctcggcaccccgctgctgtggtgggcggcctgcttcgcggtcctgtacgtcctgtggcgctggctcttccgccgcgactggcgggcgggcgcgatcgcctgcggaatcgcggccggctggctgccgtggatgatgtaccaggaacgcacgatcttctacttctacgcggtcgtcttcgtcccgttcctgtgcctggcggtggccatgatgatcggcgcgatcctggggccgcccggctcgggcgaacgccgccgggtggtgggcgcggcgggcgcgggcgtcctggtcctcctgatcgcctggaacttcatctacttctggcccctgtacacgggcacggcgatcccgatcgacgactggcggtcgcggatgtggctggatacgtgggtc

SEQ ID NO: 3580 - DNA, 453 bp, Streptomyces avermitilis
  CDS (1)..(453)
atggaagaatgcctctgtttggcgcgagaggcggcaacgactggtaattatgcgttaggggctgtggtaatcaaaggcggacaagttatcgggaagtcggggagcaagctggttcaagggaatgaccctaccggccacccggagattaccgctattaggcaggctgccgagcgacttggatccaggtatctgccggacgcctatttggtgaccacgctggagccatgccctatgtgcacctccgctgcgatctgggccaagatgcgcggcattgcgtacggggcaacccaaattgatgctgtcacctggtcgcaagagcaccctgatcagaaatacacatggcggcagattcgcatgcgtgcacgagatgtgatccgtgcgggaactccctcccttgagttgcatgaggaggttcgcagggaggaatgcgcgaaattgtttaccctctcgcat

SEQ ID NO: 3581 - DNA, 777 bp, Streptomyces avermitilis
  CDS (1)..(777)
gtgcgtgccgtccggcatccccggcctgagcgacggcagcagttctcgggcctggagagcgtcaaagggggaggacttgtgcaacgtcggcgtgtgcgcaagcagccgagcaacgctttctgccgcaatctaatgagacaacaagtgccccgcgtggatgcatccgtgacagaccccgaagaccgggagcagcaggcggatatcacccgcctgctgctgtaccacctgaacgcacccgttgccgagtactgccgcctgcgcggtgttctgcccgcccccggtgccgtacggatcgccgtccgcgccggagacgacgagaacggcatgaacttcctgtacgagatcccccacgacacggtgaccccgtacgacatccccggcctgctgcgcacggtcctgaccggcccccagatctacagcagcggtgatgtcagcgaggtcttggggatgacactggttcgcctccgcccggaggagatctccccggatccggagcccgtgcagggccaggcgcttaccgtcgtacgcgctctgtcgggccccggcgatgacgagaaccccttcctgatcggcttcctgatgcacggcgagggcctgctgcgtctgtacgtgcaacgcccagaccgccccggcatcatcggcgccgacatccgcctgaccgagactccccccaccgcgctgatcgcctcactgccctccctcgtcagggaagagcagtaccagcggccgtcccaagacgacccgcactgcgacctactggtagacctgaccaactgg

SEQ ID NO: 3582 - DNA, 708 bp, Streptomyces avermitilis
  CDS (1)..(708)
gtgaagacacgaccaggggccataccggcacccgtcagcttcgatgccgcgtggtgcgccaccgatctcggcggataccgtgcctgccgttacacctacgagcactatccctacgagagcctgccgccgcttgactccgatcagttcaccggggcgtttccgtggctcggtggtgtcggcgactccatcccggagcaggtcgcaggactggacaccctggccggggagctggccgccgagggcctcgcgctcccgcgcgatttcgtcacgttccagaccagcgcgaatctgcgcggctcgttgcacgaggtttcggtgactggctgctggaccagcatctctcacccgttgcccagccccgttgaacccggcgccttcctcgtccggttcctcagggatcagcaggactgcgtcatctggtacctctaccttcgcccgtcgagtgaggcgttcgtagttcactcccaccttgactacgagttcgagtacgaggcgcggcgtgccggagaggagaccgggaccgacctcgatgacggcgaggagcagagaacagcgatcctttggtgcgcgcctacgttcgaggagttcgcccatcggttctggactgagaaccgcctctggcatgcggtcaacggcggtgatctgtcacgggtcgagccccggttgcggcgctacctggatcattacgcggcacctgagacctctcca

SEQ ID NO: 3583 - DNA, 297 bp, Streptomyces avermitilis
  CDS (1)..(297)
gtggcacgagtcctcccccctttgacgctcgtcaggaccctatggtggaagagcagccggggtgatcgccagatggcgtggcccggccccttgttgatcgccaacgtcatccggcatgtgggcgacggcacgccggtgcgcgtacgggtgtcacgtcgcgaggacggcggcacccgcatcgaggtcaccgaccccgacccgcgcgccaaccgtacggtcatggagaggtctcaggtgccgcgtaatgatccaggtagcgccgcaaccggggctcgacccgtgacagatcaccgccgt

SEQ ID NO: 3584 - DNA, 675 bp, Streptomyces avermitilis
  CDS (1)..(675)
atgggcaaagttctcggtgacgtgctgggtcttgcggccggcgtcgcgatcagcccgctcccgatcatcgccatcatcctcatactcgcgacgccccggggacgtctcaacggacccctcttcaccctcggctggatcctgggactctcggcactgggcgcggtgatgctggcaatcgcttcccccgcaggtgcctccgcccacaatcaaccggccacctgggtgggagccgtcaagctcgctctgggcgtggtcctcgtcctcttcggcgcccggcaatggcaccggcgcccgaaggatccctcacaagcccagctgccgaagtggatgggcgcgatcgaccgcctcacgccggtcaaggtcttcggactcggactggccctcgccgcgctcaacgccaagaacgccccgctgaccatcgccgcggccgcctccatcggctcagccggactgccggtcgggcagcagatcgcgtcgctggcaatcttcgtcctgatcgccaccctcggcctgctggccccgctgggagtcttcctgctcggaggagagcgagcgaagaccacgctcggcaactggaaagactgggccgcgcagcacaacgtcgccgtgatggcggtcctgttcttcgttctcgggttgaaactgctcggtgacggcatcggcatcctcgtctcc

SEQ ID NO: 3585 - DNA, 660 bp, Streptomyces avermitilis
  CDS (1)..(660)
gtgagggcgatggcgcctcatgttcgggcgcttggcgaccctcgcaccgatccgtggcaggagaatctcacgatgactgcgacgacaggcgcaccccagtcagctcagcccgagcgcccgggcaggtcggacggggtctgtagcgagttcaccgtcttcaccaagatcaagccgggccacgcggacgcgctgcgtgaggatctcgccgcgttcgccgaagcggcgaccgacgcgaaagcccgtgaggcactgcgccagatcggcaccctgcacgacgcacggcacgtgatcttcgacaacgacacccggttcatgttcgccagcgtcttcgacggctcctgggacacgtacatcgacgacttcgccaagacggtggtcggggcccgcttcgacaagatcttctcgcacaccgaagggttccccggcgtcgccgatcccggggtgaaggactggttcgtgtcccagcaggagcccgcgggagtcttcgtcagctcgtaccccgatctgaccgttcagcagatctggaaggaccagcgcgtggacgaggcgttcgaggcgctgttggacaccgctgagttccgggcggcgctggacaacccggcgaacgccgagttgctggccacgcctgccttccagaagctgatggaggaagccgcggcc

SEQ ID NO: 3586 - DNA, 1368 bp, Streptomyces avermitilis
  CDS (1)..(1368)
atggaggcacaggcgagcatgaacacgacggcaagcagcagcgcgggcgacgtgcgcgtcgagatcgacgacgtccaaagcggggcactgcgtccacggcccgtgccgtacgaggggaagttcatcctcctgcgcgtcgatgaccgccacgccgggcgcgccctgctgcggcggctgctcccggtgacctcgggtggtctgcccagcgtggaccggagccaggacgcctgggtggctgtggcgttcacctaccagggactgcgggccctgggggtgcctcaggagtcgctggacagctttccgcgggcgttccgtgagggcatggccgctcgggcggagctgatcggtgacgtgggcgagagtgccgcggcccactgggaggcaccgttcgggacgggcgatgtccacatcgcgttgagcgccctctcctcggatacggcgcagctggacaaggagctggaccgggcccgtgtcgcctacgaggacacgcccggtgtccaggtgatctggcagcaggaggtccaccagctcccgaccgggcgcaccaccttcggattccgcgacggcatcagccatccgaacatcgagggcgtcggcctgcccggctccaacccgcaggaagtccccatcaaggccggtgagttcatcctcggctaccccgacgaaaccggcagtctgccccccatgcccagccccgatgtgctggggcgcaacggaacctacgcggccgttcgcaagatccacaccaacgtggcggcctggcggcagtacctgcgcgcgaacacctccagcgcccaggaggaggcacttctggcggcgaagatggtcgggcgctggcccagcggggcgccgctgacactgacgccggagcacgatgatccagagctggcggccgatccgcaccgcgtcaacaacttcctgtaccgggaggacgacgaccgagggttccggtgccccgccggtgcgcacatccggcgcaccaacccccgcgacgccacgatcatcggcgacgcacgcatgcaccgcctcatccgccgcggcaccacctacggcccgccgctgccggagggcgtgctggaagacgacggcgccgagcggggcctggtcggagtcttcatcggagcccatctggagcggcagttcgaattcatcaaggccgagtgggtcaacgacggcaacttcatcggctatcccggcgagaaggacccggtggccgggcatcacggcggcaccggcagcgtcaccatcccggagaagccggtccggcgccgcctgcggaacctgcccagcttcgtggtcacccggggcggtgagtactgcttcgtgccgggtctgcgcgccttgcgctggcttgccgagctggaggac

SEQ ID NO: 3587 - DNA, 1128 bp, Streptomyces avermitilis
  CDS (1)..(1128)
atggcagcacagttcgtcccctacacgccggacgtcgaagacgatgacccgcacttcgaccagaacgtgcagacggtgatcgcaaagaccgaggcctacatcaccgagtcggtcaaggccggtggcaccggccgggccctgcgcgacgcccatgccaagggctacgggctggtccgcggtgaagtggagatcctggacgggcttccccccgagtacgcccaaggcatctacgcgactccgggaacccatgacgcgctcatccgcttctccaacggctcgcctcacgccggagccgacgcgcgactgggcgccgccaccggactggcactgaagatcttcgacatccccggcccgaccctgctggaagacgaaccggacacgggcaccttcgactacgccaacatcaacggaccgatcttcttctgcaacacggtcgagcactacctgttcatccaggaactgttcctgaacgcgccggcctacttctcccagggccgccccggcgcgcatcgtttcttcaccgacttcgtgaccggaaagggaacgctggaccaggacgactgggcgtgggacgagttcctggccttcctgcgcctgtcgaagacccctccggcaaacctgctgctgtcgagctactggacgatgggcgcggtccggcacggggactacatcgccaaggtgcgcatcacccccgacccgtccttcgccgccgcggtggtccggcgcgacatcgacccgacctccgcgcaggaggtcttccggccggcccttgaggccgagctccaggagcggccctacgccttcgacatccaggttcagctctgcaccgacctggagcggatgccggtggaggacaccaccgtggagtggcccgagcagctctcgccgtccgtcaccgtggccaaactgcggttgccgcggcaggacatctccggcccggaaaacctggagaagatggactcactgtccttcacgccctggcgggtcaccgccgagcacgcgcccctgggcaacatcatgcggtcccgcaaggaggtctaccggcagtcctccatggagcgccacaagctcaaccagcagccgcgcacagagccccgcagcgtcgccgaggtacttggcccggcccaa

SEQ ID NO: 3588 - DNA, 1362 bp, Streptomyces avermitilis
  CDS (1)..(1362)
atgaccaagagagacgtcgcggccctgttcggaaaccgcttcctgaccgagcccgctccctcgcagaccttccccgaggagggcatgaccgcgacggacaccatgaggctgctggatgaggacctcgtcatggaaggcgacccgcagcgcaacctcgccacgttcgtcaccacctggatggagccggaggcgcaacggatcatcgccgagaacctccaccgcaacttcatcgaccacgcggagtaccccatctccgccgagatcgagcagcgctgcgtgcgcatgctcgccgacctcttccacgcaccgggcaagaccaccggatgccggacccagggctcgtccgaggcgatcatgctcggcgcgctgtcgctgaagtggaagtggcgggagcgccgccaggcggccaacctgccggccgaccggcccaacctggtcttcggcggcgacgtccatgtcgtgtgggagaagttctgccgctacttcgacgtcgagccgcggatcgtgccgcttgccgaggacaagtacacgatcggcccagaggacgtggagccccacatcgacgagaacaccatcggtgtcgtcgccgtcgtcggcaccacgttcaccggccacaaggacgacgtcgtcgggatcgacaagctcctgcgggacgtccgcaaggagcgggacctcgacatcccgatccacgtcgacggcgccagcggcggctttgtgtggcccttcctctatccggactcgaaatgggacttccggctcgagcaggtccgctcgatcaacgtgtcgggacacaagtacggcctggtctaccccggcatcggctggctggtcttccgcgaggagtccgacctggccaaggacctcgtgttctacgagaactacctgggcaagaccgacgcgacgttcacgctgaacttctcgaccggcgcgtcgatggtcctcgcccagtactacaacttcgtgcggctgggtcgtcagggctacacctacgtcatggagacgatgcagaagaacgcccacgcgttggcggacaacctgcggagcagcggccgcttcgaagtgatcggcagcgacctcgagcagctgccgctggtcgctttccgcctcgccggcgagcacgcctacgacgagtccgacatcgcctggcagctctcggccgagcgtggctggatggtgccggcgtacacgctcccgcccaacgcggagcgggtgaagatcctgcgcgccctggtcaaggagaccctgagccgcgagcagatcgagcgtctgacccaggacatcgccgacgcgtgcgccaccctggaccacaagggcgggaccaccgaggtcgagcgggcccagatcaagcgcggcaccggttac

SEQ ID NO: 3589 - DNA, 1140 bp, Streptomyces avermitilis
  CDS (1)..(1140)
gtgaggggagtttccggaagttgtccgaagagtgatcagggggatggtcggaaacgggccagatccagccgcccagccacatacatgaacgcacgccgacgtccggcatcggaccgccggtacagcctcgtactgggcttaccgggcttactgggctcgtactgggccgtattcggctgttcggccaacgaaacgggatgtcgtgccgggcgtcgcgagcgtcaacagtccccgaactgtgatcatggagcgttccttgcaggtgatcgacgaggagctccaggtcgcgggggccgatgtgccgccgccgtgtggcgctcgcgacaacgcgctgtgggtgatgtggtgaactggttgacctcgctgccggcggtggtgctggttgtgggcgggctcctgcttgccttactggtcgcggccgtggcgcgggtcggcgtccgggcgctcgtaccggtcgaggaacgggaccgggtgccgcagatcgccacgcccctgatgccgacactcggcgctgccttcgcgatcttcgcggcactcacactggccagcgaggccggctacctgcgcgcggccgaggggctggtgagcgacgaggcggccgcggcctcccgcctggcatgggcggcgacaagtccgcgagtccggtcggagccgatccacacggcactgctgaactacttgcagaccacgcgcgccggggagtgggaagccaccgcggcggcgtccggtgacgaccccgccaccgctcgcgcgatcgcacggctggagcggagtgtgcgcgccgaggcggcccggccagaggtgggcaccccgacaggcacggagctggtggcttccgtcgacggtgtcaccagtagtcgtcgcgcccgcgtcgcggccgcctcgcgcgacgttcccgcgctgtacgtcgtcacgctcgtggtcagcggactggccttgatcgtgaacgcgggcgcactggtcttccgcagcagcctgcgaacatcactgctgatcgtaggtgttgcgagtgtggtcgggctgagcctggcgttgctcttcgcactcagcgggccctggagcggaccgctcatcgtcagtgggcatccgctcgacgccgtcatcggaaacctgaagtccggcttcttcgacggcgggccg

SEQ ID NO: 3590 - DNA, 1629 bp, Streptomyces avermitilis
  CDS (1)..(1629)
atgcgcaagggggcaaaggtcgccatcgtcggtggggtgttcgccgtcatggtggggggcgccgggtacggggcgttcaatgtggtgtccgcgctcagcggggacggggcgggcggctcgcccgagaccaaggccgcgaggagcgggccgccgagcggcgcggaggtcaaggaggcgagtgccaagttcttctcgtcctgggcgaagggcgacgccgagacggcggcctcctacaccaacgacgccgtggcggcgggcagtctgctggccggctaccgcgcggaagcgcacatcaccaaggtgcacatcacgccgggcacgccgtccggcaccaccgtgccgttctccgtcaaggcgacggtggcgtacgagggccggagcaagccgctcgcgtacgactccgagctgaccgtcgtccgtggtgagaccaccgggcgggcgctcgtcggctggaagccggccctcgtccacccggacctcaccgccgcggacgacaccctggtcaccggcgaggcggccaccccgccgatcgaggccgtggaccgcgacgacgtcgtcctgaccgagaagaagtacccctccctcgggccggtcctggacgcgctgcgcgagaagtacggcgagaaggcgggcggcagacccggggtcgaactgtcggtccaccacacgggcgagggcgcggccgacaagacactcgtgacgctcgccaagggcactccgggcaagctgcgtacgacgctcagcgcgagcgcgcaggcggcggcagagaaggcggtggcccagtactccgagtcgtcggtggtcgcggtgaagccgagcaccggtgaggtgctggcggtcgccaaccaccgcgaggacgcgttcaacgcggccttcgaggggcggctcgcgcccggctccaccatgaagatcatcagcgccgcgacactgatcgacaacggcatcgcgaccatgaacggtccggccccctgcccggacaccgcgacctggcagagccagaccttccacaacctcacgggcatggagcccaacgagaaggcgacgctcgccaacagcttcctgcgctcgtgcaacacggccttcgtgaagtacgcggacgaggtgaaggtcgactcgctcaccaaggaggccgaggaccgcttcgggctcggcggcgacaactggaagaccggcatcatctccttcgacggttcggtccccgcctccggcggcccgaacaccgcggccaacatgatcgggcagggcgaggtccagatgaacccgctgaacatggcctcggtcacggcgaccgccatgacgggcgccttccgccagccctacctggtcccgaggtcgctcgacgaccgggagttcgccgccgccaagggcctggcgtcgaacacggtcacccagctgaaggcgatgatgcgcctcaccgcgacccagggcaccgccgcgggcgtgatggccgggctcggcggggacatcggcgcgaagacggggtccgcggaggtcgacgggcaggccaagtccaacagctggttcaccgggtaccggaacgacatcgcggcggccgccaccaccgaggagggcggtcacggcggcgacgcggccggtccgatcgtcgcagctgtgctacgaacgggcggc

SEQ ID NO: 3591 - DNA, 1671 bp, Streptomyces avermitilis
  CDS (1)..(1671)
gtgggcaagagaaggcgcgccgccgagcgcaacaggagcggtcgtccgctcgtcatcggcgggctgatcgccgtcgtcgccgtcggcggggcggtcggtgcctacagcctgtacggcagtggggccgcggccgaggaacgcgcgtctcaggcccgccaccgggccgtgaagacgggcccgctgtcggcgacggagatccgtacgacggccacggagttcctgaatgcctggcagcggggcaaggtcaccggggccgcggccgccaccgacgactcggcggcggcgcgcacggccctgaccggctacaccaaggacgcgcacatcaccgacgtgacactgacgcgcggcaagcgctcgggggcgtcggtcccgttctccgtcaaggcgacggtgtcgtacaagggccggagcaagccgctcgcgtacgagtcgaagctgacggtcgtgcggcgggccaaggacggcgtaccgctggtgagctggcggccgtcggtggtgcacccggatctcggtgcgggcgaccgtctcgtgaccggcgaggcgggcacgccgccgatcaaggccctggaccgcgacggcggcgagctgaccacggccacgtacccgtccctgggctcggtgctggacgggctgcgcgagaagtacggcaagaaggccggcggcaaggcgggcatcgagctgcgggtggtccgcaaggcggtgaaggggaccggcaaggacaagacccccgacaagacgctcgtcacgctgagcgaggggacgccggggacgctgaagacgacgctgagcccgacgctccaggcgaaggcggagcagcaggtgacgacgaaggagcgcgcgtcggtcgtggtcatgcgcccgtcgacgggtgagatcctcgccttcgccaactcctcccacggcttcaacacggcgctccagggttcgctggcgccgggctcgacgatgaagatcgtgacgtcgacgctgctgttcgagaagaacctggcgtcggcggacaagacgcacccgtgccccaagtacgtgacgtacggcggctggaagttccagaacgacgacaagttcgagatcaagggcggcacgttcaaggcgagcttcgcgcggtcctgcaacacggccttcatcagccaggcgaagaagctgaaggacggcgacctcacggcggtggcgcagcagatctacggcctgagcatgaacaactggtccatcggggtcccgtccttcgacggcgcggtcccggtgcagagcgcggcgcagatggcggcctcgctgatcggccagggcggggtgcgcatgaacccgctgaacatggcgtcggtggtgtcgacggcgaagacgggtgtcttccaccagccgtacctggtgtcgccgtcgctggacgaccgcgcgctcgcgaagacgacccgcacgatgtcgtcgtcgacgcgggcgcagttgaaggaggtcctccagtacaccgccgcggccggcacggcggcgcaggcgatgtcggggctcggcccggactacggcgcgaagacgggctcggcggaggtcgacaaccagaagcagccgaacggctggttcacggcctggaagggcgacctggcctcggcgggcgtggtccaggccggcggccacggcggtgactcggcgggcccgatcgtggcggcactgctcagggcgggcagc

SEQ ID NO: 3592 - DNA, 339 bp, Streptomyces avermitilis
  CDS (1)..(339)
atgtcggtcgtcgaacagtacgcacgagcccatgtcgtctcggacgccccggaagcccaggacaccgtcccggtcgtcctgcgctacgaccccgaagtcgacccccgatcggtccgcatcggcttgcccggcccgcacgagtgggccttctcccgcgacctcctggaacgcggcctgcgcaccccgacgggcacgggcgaggtgcgcatctggccgtgcggccgggtccaggcggtcatggagttccactcggcgcagggggtggcggtggtcgagttcgaggcgaagaccctgttccgcttcttgcgccggacctatctggcgacgcccgtaccccat

SEQ ID NO: 3593 - DNA, 1053 bp, Streptomyces avermitilis
  CDS (1)..(1053)
gtgcatgtgcctgacggattcatcaacgccccggtctccgcggtctccggagtggtcgccgccggcgccatcgccgtgagcctgcgcggtgcccgccgtgaactggacgagcggaccgccccgctcgccggtctggtcgccgcgttcatcttcgccgtacagatgctgaacttcccggtcgcggccgggaccagcggacatctgctcggcggtgcgctcgccgcgatactcgtcggccccttcaccggggtgctgtgcgtgtcggtcgtcctgctgatgcaggggatcctgttcgccgacggcggtctcaccgcgctcggcgtcaacatcaccgacatggcgatcgtcacgaccgtcgtgtcctacgccgtcttccgcggcctcgtgaaggtgctcccccgcaagcgacgctccgtcacggtcgccgccttcgtctccgcgctgctgtcggtgccggccgccgccgtcgccttcaccctcttctacgcggtcggcggcaccacagacatcgcgatcggcaaggtcgccaccgccatgatcggcgtgcatgtgctcatcggcatcggcgaggccgcgatcaccgccctcaccgtcggcgccgtcatcgccgtacggccggatctcgtccacggggcccgcgggctccagcagcgtctgaagctgcgggtcggcggcgatctggtggacgcgcccgccgcgcccgccgcccccgcgacccccgtcgccgcccgcacctcgcaccgcaaggtgtggatcaccggcctcgtcacctccctcgtcctcgccgggttcgtcagcttctacgcctccgccagccccgacggcctggagaaggtcgccaaggaccagggcatcgacgccaaggccaagaagcaccacaccgaggactccccgctcgccggctacggcgtcaaggacgtctccgacgcccggatctccggcggtctcgcgggcgtgatcggcgtcggcatcaccgtcgtcgcgggcaccggcgtcttctgggccgtccgcaggcggcgcaccgtcgacgcctcccccgtgaacacgagcgtc

SEQ ID NO: 3594 - DNA, 759 bp, Streptomyces avermitilis
  CDS (1)..(759)
atgggtgcgggacacgcccacaagctctaccggcacgggcactccgccgtgcacgccctgcccccgcacaccaagctcgccgccgccttcgccttcgtggtcgtcgtcgtgtcgacgccccgcgaggcgatgtgggcgttcgcgctgtacgccgcgctcctggcggtggccgcccaccgggcccgggtgcccgcccccttcctgctcaagcggctgctcatcgaggtcccgttcgtcgccttcgccgtgctcatgccgttcgtggcggagggcgagcgggtcgacgtgctgggactctcgctgagcgtcaacggcctgtggggcgcctggaacgtgctggccaagggaaccctgggcgtcgccgcctcggtcctgctcgcctccaccaccgaactgcgcgaactgctgctcggactccagcggctcaggctcccgccgctcctcgtgcagatcgcgtccttcatgatccgctacggggacgtcatcacggacgagatgcggcggatgcggatcgcccgggagtcccgcgggttcgaggcgcgcgggatccggcactggggcgtgctcgccaagtccgcgggggcactgttcatccgctcctacgagcgcggggaacgcgtccatctcgccatggtcagccgggggtacgccggttcgatgccggtcatcgacgaggtgaccgcttcccgggcacagtggtcgtacgccctcgccctccccttcgccgcccttgtcgtatgcctgctcggatggacgctg

SEQ ID NO: 3595 - DNA, 786 bp, Streptomyces avermitilis
  CDS (1)..(786)
gtgaactcccccgcgcccgtgggctcccccgcgcccgtgagcgcgccctccctggacgtggccggcctcgccttcgcctaccccgacggccaccaggctctcttcggcgtggacttccgcgtcgaacgaggtgaacgcgtcgccctgctcgggccgaacggcgccggcaagaccaccctcgtgctccacctcaacggcatcctcaccggcggggcggggaccgtgacggtggccgggctgccggtgggcaagcggcacatggcccagatccggcgcaaggtcgggatcgtcttccaggacccggacgaccagctgttcatgccgacggtccgggaggacgtggccttcggaccggcggccgccgggctgaccggcgcggagctggaagcccgggtggaccgggccctcgaccaggtcggcatggccgagttcaagggccgcccgccgcaccacctctcgttcggacagcggcgccgggtggccgtggcgaccgtgctcgcgatggagccggagatcctcgtcctcgacgagccgtcctccaacctcgaccccgcctcacgccgcgaactcgccgacatcctgcggtcgctggacgtcaccgtgctcatggtcacgcacgacctcccgtacgccctggagctgtgcccgcgttcgctgatcctgagcgagggcgtgatcgcggcggacggcaggacgggcgagctgctcgcggacgacacgctgatgcgggcccaccgtctggagttgcccttcggcttcgacccgcgctccgtgacaatgggcgcg

SEQ ID NO: 3596 - DNA, 459 bp, Streptomyces avermitilis
  CDS (1)..(459)
gtgacgaatcaagagaacaccgggtcactgctgctcgacgatcagctgtgcttcgcgctgtacgcggcccagcgcgccgtgaccgccgcgtaccgcccgcttctcgacgaactcgggctgacgtatccgcagtatctggtgctcctggtcctgtgggagcgcggcgagacgacggtcaaggagctggcggccgcgctgcggctcgactacggcacggtgtcgccgctgctgaagcggctggagtcggcgggtctggtcagccgggagcgctcggcgcgcgacgagcggtcggtgctcgtggcggtcaccgggcggggcgaggagctgcgggagcgcgcggcgcatgtgccgcaggcgctgctggcggcgaccggactgcgcgggggcgaggtggcagcgctgcgggaagagctgtggcggctggccgaacgggcggagtcggcggcggcacagagccgc

SEQ ID NO: 3597 - DNA, 402 bp, Streptomyces avermitilis
  CDS (1)..(402)
atgtacgtcgccgaggccaccgcacacggcggccgcgacggctacgtcaccagccaggacggccggctggagctgaaggtcgcgatgccgccggcgctcggcgggaacggcgacggcacgaacccggagcagctgttcgcggccggatacagcgcctgcttccacaacgcgctggtgctggtcggccgccgcgagggctacgacctgtccggctccacggtcgccgcgaaggtcggcatcggccccaacaagcagcgcggttacggcctcgcggtcgccctcagcgtgtccctgccggtggtggaccaggacctggcgacgaagctcgtggacgcggcccacgaggtctgcccgtactcgaacgcgacccgcggcaacatcgaggtcacgatcgtgctgggc

SEQ ID NO: 3598 - DNA, 1200 bp, Streptomyces avermitilis
  CDS (1)..(1200)
gtgttgcatccactgtcgttgaacggtggaaggagcacgggcgtggatgtgaacggcacggtggccgagggcttcgagccggtcagggacgcgttcgcgcggaacttcgagacgctcggggagcggggcgcggccgtcgccgtgtaccgggacgggcgcagggtcgtcgatctgtggggcggcacccgggacgtcgacggtacggcgggctgggagcgggggaccgcgcagatcgtgcgctcggcgaccaagggtgtcgccgcggccgtcctgctgatgctcgccgagcgcggggagctggacctggacgctccggtgggccactactggccggagttcaaggcgcagcacaaggaacggacgctcgtcagccatgttctgtcgcaccgcgccggggtcccggtcctcgaccgcccgctgacgcccgccgaggccgcggacccggacctcggcgccgccgcggtggccgcgcaggcgcccgcctgggagccgggtacggaccacggctatcacgcacagacgtacagctggctgacgggcgagctggtccgccgggtcacgggccgcgggatcggcgagtggatcgcggcggagatcgccgggccgctgggtctcgacctgtgggtcgggctgccggcggcgcgggcccaccgggtcggccggggcggacagaccgaggctccggcggcggacggcgccctgcgcacccgccccaagcgcgcggtcgctcaggcgtacgcggacccctcctccctcacccgccgggccttcgccgcgatcaccccgctcccggacgagaacgaccccggctaccgcgccgccgtcctccccgcctccaacggcatcgcgacggcggacgctctggcccgcttctacgcggcgctgaccggcgaggtggacggcgtacggctgtggcggccggagacggtcgccctggcccgcgcggagcggtccgcgggccccgaccgtgtcctggtcgtgaacacccgcttcggcctcggtcacatgctgcacggcagcgcgtccccgctgctgtccccggcctccttcggccacccgggccgtggcggccccctcggcttcgccgaccccgagtcgggcatagcgttcggctatgtgacgaacggctaccgcacgagcgtcacggcggacccgcgggcgcaggcactggtacgggcggtacgggcggccctggggaac

SEQ ID NO: 3599 - DNA, 273 bp, Streptomyces avermitilis
  CDS (1)..(273)
atgacgcacaccattgtgggatggcatgtcgagctggaattccaggaggacgaccagcgcacccgcgcggcggccctcgtacggcttcccgacgggagcgaagtacgggcgcacggctacgcgagccgtcaccgttccgacgagaatcagccgcgcgtcggcgaggagatcgcggcggcgcgggcgctgaacgagctggcgatgcagctactgaccaaggcgcacgacgagatcgacggcgcgtcggggcggacgtcgcatccgttgacccag

SEQ ID NO: 3600 - DNA, 843 bp, Streptomyces avermitilis
  CDS (1)..(843)
gtgaccccggccgtcacggcggccgtcctgctcgccgcggtcacccacgcgagctggaacgcgatcgcccaccgcgtcacggacaagctggtcggatttacgctgatctcgggcggcggcatgctgatcggcctcgcggcgatcccgttcgcggcgctcccggcgggcgggtcgtggccgtatctgctgatctcctgcgccatccacatcgcctactacgcgctgctgatgcgatcgttccggctgggcgacttcggccaggcctaccccatcgcgcgcggcaccgccccgctcgtcgtcacggtgctggcggcggtcttcgcgcacgaggtgccggacggctgggcggcggcgggcgtcgtcgtgtcgtgcgcggggctgacgggtgtggcgctgtggggcctgcgcgggcgccgcccgaactgggcggcgatcggcgcggcactggcgacggggctgaccatagcggcgtacaccgtggtggacggcctcggagtgcgcgcctcgggctcgtcgttcgggtacatcgcgtggctgatggcgatccagggcgtggtgatcccggcgtacgcgctgtaccgctggcgcggtgcggcggtggggctgctgcggccggtcgccgggctcggcctcgtcggcgcggcgctgtccgtggcggcgtacgccctggtcctgtgggcccagacccgggccgaactggcgcccatcgccgccctgcgcgagtcctcgatcatcgtgggcgcggcgatcggggcggtcttcttcaaggagcgcttcggggcgccgcggatcgcggcggccggcctgctggtcgtcgggatcggcctgatgctgcacgcgggc

SEQ ID NO: 3601 - DNA, 549 bp, Streptomyces avermitilis
  CDS (1)..(549)
gtgcccggtacacgcaccgctagcgtgccgtgcatgacgacgtcgactgccaccgaaggcacggaagactccggcgcccacccccgattcaccgaggccctgcgcgagatggggctcggtgacctgcagacacggatccggcggttcccggacggcacccgcaccgccgccgaggccgccgccgcgatcggctgcgagctggaccagatctgcaagtcgctgatcttcgcggcggacggggtgccggtgctcgtcctcatggacggggcgtcgcgcgtcgacgtggagctcgtccggcgggagctctgcgccgcgaaggtcacgcgagccaaggccgacctcgtgcgggagacgaccgggtacgcgatcggcggcgtcccgcccttcgggcaccgcacgaggacccgcgtcctcgcggaccgttcgctgctggagcacgacacggtgtgggccgccgccgggaccccctacgccgtgttcccgatggagcccgaggccctgatcgcccacgcgggggccgccctggtggacgtgcgcgagcgcaccgcg

SEQ ID NO: 3602 - DNA, 186 bp, Streptomyces avermitilis
  CDS (1)..(186)
atgagcacctcggaactccactggttcaagagcagctacagcgacagcagcaacccaagtgactgcgtcgaaatagccacgacccccgccacgatccacatccgcgactccaagaccccccacaccccccatctcaccctgacgcccgccacctggaccggcttcctcgcgtacgtgtccgggaag

SEQ ID NO: 3603 - DNA, 807 bp, Streptomyces avermitilis
  CDS (1)..(807)
gtggaggttgtggttgccgtacagctgaagctcaaccgcacgctcctccagctgcgccagctcgcgcaccttcttcggataccgggccttctccagacggtggagggcgacttcctccttgccgtcgaggcgcaaggaaagaaggatctggacaagccccacagttgggcctactacttggcccacttgtacgccaagtacaagctgcccccggtactcctcgtcgtctgccaggaccggaacaccgccgcctgggctgccctccctgtggatatcggaccgccagagtggcccgccctcacggtgcgtcccctggtcctggggccggacaacgtgcctatggtcagcgccccggccgaagccgcccgcgacatcccgctggccgtcctctccgccatgctgcacggccgagaccggggtatcgatgcgatactgaaagcgctggcagcggccttgaagggcttggaagtcctcgacccggagaccgcaacgatcttcgtagaactcacatctcaaggcttggacaagacctgggccgccaaaatctggagggacctcgtggccgtcgatacttcgttcttcacgtcatcgctgtcccaggagatccgggccgaaggggaggccaagggccgggccgccgacatactgcgtatcctcgaccgccgcggcatccccgtcgctgacaccgaccgcgagcgcatcacctcctgcgacgacctcgacgccctcaccctctggttcgaccgcgccatcaccgctgcctccatcgccgaggtgttcgcggaagacctgtccgaccaggagcag

SEQ ID NO: 3604 - DNA, 645 bp, Streptomyces avermitilis
  CDS (1)..(645)
gtggggcttgtccagatccttctttccttgcgcctcgacggcaaggaggaagtcgccctccaccgtctggagaaggcccggtatccgaagaaggtgcgcgagctggcgcagctggaggagcgtgcggttgagcttcagctgtacggcaaccacaacctccacgggctgttgcagacgccggagtacgcacgggcgctgctggggacacggcggcccaagctgtcggcgggcgagatggagcgggcgttggccgcacggatggctcgtcagtccatcctggaaaaggagtcgggtcccgaactcagctttgttcaggagcaggtgacgctcgaacgtccggtcggggggaaaatggtgctgagccgacagctggaacacctcctggaggtcgcccggttgccgaacgtcgaactccaagtgatgccgaccgcacgcgcggagcacccgggtacgggcggtcggatccaggtactgaagttcgcggacggcacgggagccgggcgcaccgacgacgagttcggcggacggccggtctccgacccgaggcagctccggatcctcgaactgcggtatggcatcatccgggcgcaggctctctcgccaggggagtcgctggacttcatcgagcaagcgctgggggaatta

SEQ ID NO: 3605 - DNA, 2223 bp, Streptomyces avermitilis
  CDS (1)..(2223)
gtggccacgttcctctataaaatcggccggttcgccttcaggcgacggcacttcgtcgccctgatatgggtggcgctgctgacgctcgcgggtgtcggcgccgcctccgcgcccaccgcgggctccagctcgttctcgatccccggcaccgaggcgcagaaggccttcgacctgctggagagccgttacccgggcatgagcgccgacggcgcgaccgcacgggtcgtcttccgggcgccgagcggcgagaagatgtcggccgcggccaacaaggcggccgtcaagaagaccgtcaaggcgctgggcgacggctcggaggtcacctccgtcaccgaccccttcaagacgcactcgctctccaaggacggggcgatcgcgtacacgcaggtgcgctacgacgtctccggcatggagctgaaggacgcctccaaggacgccctgaacgaggcggcgcaggaggcgcgggacacgggcctgaccgtggaggtcggcggtgacgcgctccaggcggcacccgagaccgggtccaccgaggtcatcggcatcgcggtcgccgcggtcgtcctcgtcatcaccttcggctcgctgatcgcggccgggctgccgctgctgaccgcgctgatcggcgtgggcatcggcgtctccacgatcacggcactcgcgaaggcgctcgacctgggctccaccacctccacgctggcgatgatgatcggcctcgccgtcggcatcgactacgccctgttcatcgtctcccgctaccgggccgaactggccgagggcagggagcgcgaggaggcggcgggccgggcggtcggcacggcgggttccgcggtggtcttcgccggtctcacggtcgtgatcgccctcgtcggcctggccgtggtcaacatcccgatgctgacgaagatgggtgtcgccgcggcgggcacggtcgccatcgccgtactgatcgcgctgacgatgatcccggcgctgctcggctacacgggcaggatggtgcagccggcgggcaagaagagcaagctgctcggcggcgggcgcgcggcgaagaagccggccaggccgaacatgggtacgcgctgggcgagcttcgtcgtccggcgtccggtggcggtcctgctgctgggcgtggtcgggctcggtgccgcggccgtgcccgccacctcgctggagctgggcctgccggacgacggttcgcagccgacgtccacgacgcagcgccgggcctacgacctgctgtcggacggcttcggccccggcttcaacggtccgctgatggtcgtcgtcgacgccaagtcgagcacccacccgaaggcggccgtcaccaaggtgacggacaccgtcaaggacctcaagggcgtcgtgtcggtgactccggcgacgtacaacaaggccggcgacaccgcgatgatcacggtcgtccccgactcgaagccgtcctccgtgaagaccgaggacctggtgcacgccatccgtgacgcgggcggcgagatcaaggccggcacggacgcggaggtgctggtcaccggcacgacggcgatgaacatcgacttctcgcagaagctgaacgacgcgctggtcccgtacctggcgctcgtcgtcggcctggcgttcctgctgctgatcgtggtcttccgctcggtcctggtcccgttgaaggcggccctcggcttcctgctctcggtgatggccgcgctcggcgccgtcgtcgcggtcttccagtggggctggctggccggcctgatgggcgtcgaggagaccggcccgatcatgtcgatgatgccgatcttcatggtgggcgtcgtcttcggcctcgcgatggactacgaggtgttcctcgtgacccggatgcgcgaggcgtacgtccacggggagaagcccgcccaggcgatcgtcacgggcttcaagcacggcgcacgggtggtcacggccgcggccgtcatcatgatcgccgtcttctccggcttcatcggctccagcgagtcgatgatcaagatgatcggcttcgggctcgcgatcgccgtcttcttcgacgcgttcgtggtccgcatggcgatcgtcccggcggtgctcgcgctgctgggcaagcgggcctggtggctgccgaagtggctggaccgcgcgcttcccaacgtggacgtggagggcgagggcctgcgcgcccacgacaccgaccggcccaaggacggggacgcggacgaggaccggaagctggcacgggtc

SEQ ID NO: 3606 - DNA, 588 bp, Streptomyces avermitilis
  CDS (1)..(588)
atgactgagaccgcaacggtgcgccgcagtcggatcacgcccgagcgcgaggccgagctgtactcggcggtgctcgacctgctccgggaagtcggctacgacgccctgaccatggacgccgtggcctcccgcacccggtccagcaaggccactctctaccgccagtggggcggcaaggccgagctggtggtgaaggcgctgcggcaccagaagcactcgcatttcggcgaggtcgacaccggctcgctgcgcggtgacttccacgccctcgtgacgcgggagaacaactgcgagatggagcagaactccgcgctcatgcggggtctggccgtggcggtgcacgcgaaccccgatctcctggacgctttccgggacctgatcatcgatcccgagacgaacgagatgcagcgactgctgcaacgcgccgtcgaccggggcgagatcagagcggacaaccccgcgacgcagtacgtgctgcacatgctgatcggtgccttcgcggcccgcaccctgatcgacgaactgcctcccacgcaggaattcctcacctcgtacgtcgacgccgtggtcctccccgccctcggcgcc

SEQ ID NO: 3607 - DNA, 3303 bp, Streptomyces avermitilis
  CDS (1)..(3303)
gtgaaccccgagtccgagaacgtccccggctatctccgcttcccgcatctccacggcgcgcggctgtgcttcgcggccgaggacgacctgtggctggcccccctcgacggagcggggcgggcctggcggatcaccgtcgaccgcaccaaggtcggccatccgcgcttctcgcccgacggccgccacatcgcgtacacgagctggcgcagcctcgtcccggagatccacctggcgccggtggacggcggccccggccggcggctcacctactggggcagcaccgacacccgggtgtgcggctggtcgccgcccgacaaggaggggcacagcgacatcctcgccgtcgcctcccacggcgagcccttctcctacttcacctgggcctactgcgtccccaccgacggcgaccccggcggccggctcccctggggcccggtctccgacatcgcggtcgccgacatcgacggcgagcgcaagaccctgctgctcaccggcaccccaccgcacgaaccggcctcctggaagcgctaccggggcggcgcgacggggcggctctggctgcacggacagcggctcctcgcggacatcgacgggcacctcgacagccccctgttcgtgggcggccggatcgcgttcctctccgaccacgagggcatcgggaacctctactcgtgcgcctacgacggctcggacctgcggcgccactcggaccacgacgcgttctacgcgcggcacgcgtcgagcgacggcacccgggtcgtgtaccagtgcgccggtgacctgtggatcgtcgacgacctgtcccccgactcggtgccccgccggctcgacgtgcggctcggcgggccgcgggccggacgccgtacgtaccaggtgccggccgcgcagcacgtcgacgggatctccgtggacgagacgggccgggccagcgccgtcgtcgtacgcggcagtctgtactggctcacgcaccgggacggacccgcgcgcacgatcacggacacgccgggggtgcgggtgcggctgcccgagatgctcggctcgggcggtcaggtcgcgtacatcacggacgcggagggcgaggacgccgtcgagatcgcccatctgcccagggtctccggcgagcgcgagccgcgccgcctcgcctcggggcggctcggccgcgtacaggaactggcggcggacccgcggggcgaacggctcgcgatcgcctcgaacgacgggcggctgctgctcatcacggtgtccgaggccgccggcgaggaggccggggccgacgccgtggagagcggggagccggacggcgaggtcaccgagctgatccggtcgatcaacgggccggtgcgggatctcgccttctccccggacggggcgtggctgacgtggtcgcatccgggcatcgggcggtcgctgcggcagatcaagatggcgcggataaaggaccggctgatcgtcgatgtcaccaacgggcgcttcgaggacgagaatccggtgttcacccgggacggacggtatctggccttcctctcctggcgcggcttcgaccccgtgtacgacgtgcacaccggggatctgtcgttcccgctgggctgccgcccgtacctggtgccgctgtcctcggcgaccctctccccgttcgcgctgaacccggaggggcggccggtggccggcggtctcgatccggtcgaggacgagagcggcgacggcgcggtgaccgtcgagctggagggactggagagccgggtcacgcccttcccggtcacggcgtcgaagtactcggcgctgtatcccgtcgcgggcggcggcctggtgtggctgcggtggccgatctcgggcgcgctcggcgagaccttcgcgaaccccgacgacaccagcggccggccgaccctcgagtacttcaacatcaacaaggcgaagaagtccgaactcgtcggccacctggactggttcgcggtgagcggggacgggtcacggctggtggtcgtggacgaaggagatctgcgggcggtgccctccaccgagtccggggacggcgacaccaccgtctggatcgacctgcggcgcatcatgcacgaggtggatccgggggcggagtggcggcaggcgtacgcggaggcgggccggatcacccgcgcgtacttctgggaccccggtatgtccggcgtcgactgggacgcggtcctcgaccagtaccgcccgctggtcgaacgggtcgcgtcgcccgacgagttcgcggatctgctgcgggaggtgctgggcgagctgtgcacctcgcacgcgtatgtgacccccgcccgccgcaacgaggggccgcggcactaccagcgctggcaggggctgctgggcgccaacttcgtccgccgggagggtggctggatgctgaagcggatcctgcccggcgactcctccgactccaaggcccgctcgccgctggccggtacggggatcagggagggcgcgatgctgacgcatgtggacgggcgcccggtgaacctggtgacgggcccgtatccgctgctcgcgggggcgggcggtacgacggtggagctgacgttcgcccccgcggagggggacgggcccccacggcgggtggccgtggtcccgctgatcgacgagcggccgctgcgctaccaggactgggtggccaaacggcgcgaggtggtacgggagttgagcgggggccactgcggctatctacacatcccggacatgggcggctcgggctgggcccagttcaaccgggacctgcggatggaggtgtcgcggcccgcgctgatcgtggacgtccgcggcaacgcgggcgggcacatcagcgagctggtcgtcgagaagctgacccgcaagatcctgggctgggacctcacgcgcgacgcccagccggtgtcgtacgcgtcgaacgcgccacgcggtccggtggtcgccctcgccgacgaggcgacggcctcggacggcgacatgatcacggcggcgttcaagctgctgaagctggggccggtggtggggcagcgcacctggggcggcgtcgtcggcatgaccggccggcaccgcctcggcgacggcacggtgatcacggtgccgatgaacgcggcgtggttcgaggagtacggctggtccatcgagaaccacggcgtcgccccggacctggagatcctccgcacgcccctggactgggcggagggccgccatgcccagatggacgacgcgatccagctggcccaggacctgctccgcacccatccggcggccacgcctccggaccaccacgacgtcccggtccacacccggccgaagctgccgccgagacga

SEQ ID NO: 3608 - DNA, 171 bp, Streptomyces avermitilis
  CDS (1)..(171)
atgggtaagaaggacaagttccaggacaaggcgaacgagctcaaggaccaggcgcagaaggccaaggaagaggccggcaagcgctcctccgagcagcgtgaccgttcccgcgagagcctggaggacacgcagcaggacatggacgaccgcatgaaccaggactacgacgcc

SEQ ID NO: 3609 - DNA, 243 bp, Streptomyces avermitilis
  CDS (1)..(243)
atgggtatgaaggaccagttccaggacaaggcgaacgagctcaaggacaaggcgaagaaggccaggtccggcgaccgcgacgacatgagccagcgggcccgcaaggaccgcgagcaggggcagaagcccatgcgcgagccgatgcgggaccccatgcgcgagcccatgcgggacccgatgcgcgagtccatggacgaccccatggacgacccgctcgacgagcttgacgagcaccggggcgcc

SEQ ID NO: 3610 - DNA, 882 bp, Streptomyces avermitilis
  CDS (1)..(882)
atgagcagggtgagcctggagggccaggtcgcggtcgtcaccggggccgcgcgcggtgtcggcgagctgctggcccgcaaactgtcggcacgcggcgcgaaggtggctctggtcggtctggagccggacgcgctcaagcaggtcgccgagcggctgcacaccgacagcggccactggtacgccgacgtcaccgaccatgaggcgatggtgcgggtcgcggcggaggtgaagcagcggttcgggaaggtggacatcgtggtcgccaacgcgggtgtggcgaacggcggtccgttcgccgagtccgacccggtggcgtggcggcgggtgatcgaggtgaacctgatcggctcggcggtgacggcccgcgcgttcctgccggtgctgacggagagccgtggctacctgctccagatcgcctcgctcgcggcgatcaccccggcgccgatgatgaccgcgtactgcgcctcgaaggcgggcgtggaggcgtatgcgcacagtctgcgcgccgaggtcggccacaagggcgtgcgggtcggggtgggttacctctcctggaccgacacggacatggtgcggggcgccgaccaggacgaggtgatgcgggagttgcggcagcggctgccgtggccggccggcaagacgtatccgctgggtcccgcggtcgaccggatcgtggccgggatcgagcgcaggtcgagccatgtgtacgcgcagtggtggctgcgcgggatgcagggcgtgcgcgggtatctgccgatggtcatcggggcggtggggcagcgggagatgcgccgcttcgagccgcggctgaagaacgtgggaacgaagctcgtcggtgcaggtggggcggctgatgaggaggcgcggaacacagcgcgtaat

SEQ ID NO: 3611 - DNA, 921 bp, Streptomyces avermitilis
  CDS (1)..(921)
gtgagcaggctgacgcacacgggcgcggcgagcggtccctacgccccgcccgtccccgtccgcgcgctgaccgcggtctccgccgacggcgcccggctgcacgtcgaggtgcacggacccgagaacgcgcccgccgtcgtcctcgcgcacggctggacctgctcgaccgccttctgggcggcgcagatccgggacctcgccgccgaccaccgtgtgatcgcctacgaccagcgcgggcacggacgcagcccggcgagtgccctgtgcggcaccgaggcgctcgccgacgacctggaagccgtcctcgccgccacgctcgcacccggcgagaaggcggtgctggtcgggcactccatgggtgggatggcgctgatggccacggccgggcgggcgcggttcagggagcacgcggcggcggccctgctgtgcagcacggccagttcgaggctggtcgccgaggcgaaggtggtgccgctggtcgccgggcggctgcgtacctggctcaccgggcggatcctccgctcccgcgccccgctcggccccgtcacgccggtggcgatgcgggtcctcaagtacggcaccatgggcgccggttcgtccccggtcatggtcgaggcgtgcgcgcggatcgtgcacgcctgtccgcggcaggtgcggtacgcctggtcgcgggtgctcggcctgctcgatctcgaccacggcgtacgggagttgacggtgccgacggcggtcttggtgggcgccgaggaccggatgacaccgccggtgcacgcccgtgccctggtcgccgcgctgccgaactgcgtcggtgtcaccgagctgccggggctcgggcacatgacaccggtcgaggcccccgagctggtcaccgcccggatgcgtgaactcgtcgcggcatacgtacacatcaaggagggcgca

SEQ ID NO: 3612 - DNA, 1560 bp, Streptomyces avermitilis
  CDS (1)..(1560)
gtgcggctaggaggcgtcgggatgaccgagggcgatcaggtgcggcgcgagcgggtgccccatgtgcgggtggcggtgatcgggtccgggttcggcgggctcggggccgcggtgcggctgcgccgcgagggcgtgaccgacttcgtggtcctggagcgggccgacagcgtcggcggcacctggcgggacaacagctaccccggctgcgcctgcgacgtgccgtcccacctctactcgttctccttcgcgccccaccccgactggccgcgcaccttctccggccaggagcacatccgcgcgtacctggaacacgtcacggacaccttccggctccgcccgcacctccgcttcaactccgaggtcaagcgcatgacctgggacgcggaccagctccactggacggtcgagacggccaccggcacgctcaccgccgacctcgtcgtctccgccaccgggccgctgtccgaccccaggatcccggacgtgcccggcatcgagaccttccccggcaaggtcttccactcggcccgctgggaccacgactacgacctgcgcggcaagcgcgtcgcgatgatcggcacgggtgcctccgcgatccagatcgttcccgagatccagccgcgggtcgcgaagctcaccctcttccagcgcaccccgccctgggtgatgccccgcgtcgatcgcgccatcggccgggccgagcgcgggctgcaccgcatgttgccgttcaccacccaggtccgccgcggactgctctggggcatcagggagttgcaggtccaggcgttcaccaagcaccccgacgagctcggtctcgtggagcggctggccaggcgcaacatcgcgcgcgccatcgaggaccccggcctgcgcgcccggctgacccccgactaccgcatcggctgcaagcgcatcctgctctccaacacctactatccggcgctcgcgcggcccaatgtcgacgtggtcgcgagcggcctggcgaagatcgacggatccacgctcgtcgccgccgacggcagcagcgccgaggtcgacgcgatcgtcttcggtacgggcttccacgtcacggacatgccgatcgccgagcgggtcgtcggcgccgacggcacctcgctcgcccagtcctggagcggcggcatgaaggcgctgcgcggcgcgtccgcccccggcttccccaactggatgtcgatcatcggccccaacaccgggctcgggaactcctcgatgatcctgatgatcgagtcccagctcaactacctggccgacttcatacggcagttggacgtcctcggcggcaaagtcgccctcgacgcccgtcccggcgcggtgcacgcctggaacagcaaggtccaggagcggatgcggcgcacggtgtggaacaccggcggctgcacgagctggtacctcgacgcgaacggcgtcaacaccaccgtctggccggggacgacgacggagttccgcaacgccacgcggcgtgtggacctcgcggagtacgaggtcgtacgggctccgaggcccgccgccgcgggtgtccgcgcgaaggcggaggcggacgcg

SEQ ID NO: 3613 - DNA, 666 bp, Streptomyces avermitilis
  CDS (1)..(666)
gtggcagagaaggcaggcaggcgtgagtaccgcatggaggagctggccaaggaggccggcatcacggtgcgcaccctgcgcttctaccgcgagcgcaagctgatcccgccgccccgccgggagggccgtatcgcctggtacgacgagacgcacctggcccggctgcgcacgatctcggggctgctggagcgcggccacacgctgagcggcatcgcggagctggcggaggccttcgaccacggacggaacgtgggggagctcctgggcctcggcgcgcccaccgaggagaccccggtccgcctctcccccgaggagctggccgacgtgttcgccggccaggcgaccccggagaacctcgccgcggcgctcgacctcggctatctcggcacggacggcggcgagatcgtgcacatcagccggcgcctgctggacgtctcggcggcactggtccgcgagggcatcccgctcgccgacgtcctcgcggcggccggccgggttcgcgtccacacggaggcactggcggcgctcttcaccgacctggtcctgaagcgagaccgcacaccggaggacctgcgccggctgcgccccctggcgaagagcgtggtggaggcggaactgtcgatggcactggaccggcggctgtcggccgcgcgggatgagaggccg

SEQ ID NO: 3614 - DNA, 489 bp, Streptomyces avermitilis
  CDS (1)..(489)
atgactatccagcttctccagcttcgccccgtcgccttcgatcaccccgacgccgtccggctcaacgacgaggtgcagctcgagtacgccgagcgctacggcgacgacggcgacgcgaccccgctcgacccgaccatgttcgcgccaccgcgggggctttacctgatcgcgtacgacgagcgggaccagccggtcgccacgggcggctggcgctcccaggacgagaacggcgaggggtacacggacggcgacgccgagctcaagcggatgtatgtgattcccgccgcacgcgggctcggcctggcccgccgcatactcgcggccctggaggacgacgcgcgtgcggcgggccggctgcggatggtcctggagaccggggccaagcagccggaggcgatctctctgtacgcctccagcggctatgaacagtgccccaagttcggctactaccgttttcacgagctgagccagtgcttcgcgaaggccctg

SEQ ID NO: 3615 - DNA, 861 bp, Streptomyces avermitilis
  CDS (1)..(861)
atgcgcgcaagcgtacatctatgcgcacgtccgctctcctggattaagtatcgtgccggggtgctcactgtgacctctgtgaatgtgaacggactccgcgccgccgcgaagaagggcttcgtggagtggctcgcggagacctccgcggacgtgctgtgccttcaggaggtacgggccgagccggaccagctgcccgcgggcgtgcgcgcgcccgacggctggcacgtcgtccacgcgcccgccgccgccaaggggcgcgcgggcgtctccctctacacccgccgcgagcccgatcgcgtccgcgtcggcttcgggtcggcggagttcgacggcggcggccggtacgtcgaggccgacctgcccggcgtcaccgtcgccagcctctacctgccctccggcgaggtcggcaccgaacggcaggacgagaagtaccggttcatgggggagttcctcacccacctgaaggacctgcgcgagcgcgccgccgccgacggccgcgaggtcctcgtgtgcggcgactggaacatcgcccaccaggaggccgacctcaagaactggcgcggcaaccggaagaacgcggggttcctgccggaggaacgggagtggctgggccgcgtcctctcgcccgaggacggcggatacgtcgacgtcatgcgagccctgcacccggacgtcgaaggcccctattcgtggtggtcgtaccgggggcgggccttcgacaacgattcagggtggaggatcgattacgaggtcgccacgccgggcctcgccgccaaggcggtcaagggcttcgtggagcgggcggccacgcacgaggagcgctggtcggaccacgccccggtgacggtggtctacgacctc

SEQ ID NO: 3616 - DNA, 450 bp, Streptomyces avermitilis
  CDS (1)..(450)
atgcgccgtcgcgtcgccgccacgctggccaccaccgccctcgcgctgaccgccgccctcgtacccgtcacgtcggcatccgccgcacccgccgacaaggcgacggtcctcagcaactggacccagaccagcgccgccagctacaacgccttcttcgcggcccgcgccgaccagggcgcctggagcgcgtacggcttcgactggtccaccgactactgcaccacctcgccggacaacccgttcggcttccccttcgccaactcgtgcgtccggcacgacttcggctaccgcaactacacggcggccggctccttcgacgccaacaagtcccgcctggacagcgccttctacgccgacctcaagcgggtctgcacggcctactccggagtgaagaaggcgtcgtgcgacgcgacggcctggacctactaccaggcggtcgtcaacctgggc

SEQ ID NO: 3617 - DNA, 657 bp, Streptomyces avermitilis
  CDS (1)..(657)
ttgcgagcgaaccgacccctgcgcgtagtcctggccgaggacagcgtgttgctgcgggagggcctcatcggcctgctcacccgctgcggtcacgaggtggtggcggccgtcggcgacgcgcaggcgctgctcgtcgcggtcgccgagcacgcaccggacatcgtggtgacggacgtccggatgccgccgggcttccaggacgaggggctgcacgcggcggtccggctgcgcgagaagcagcccgcgctgccggtcctggtcctgagccagtacgtgcagcgggcgtacgcgtccgaactgctggactccggcgacggttcgggcgtcggctatctgctgaaggaccgggtcggccaggtcgaggagttcgtggacgcgctgagcgaggtcgcggacggcggcaccgtcgtcgaccccgaggtggtgcgccagctgctgcgccgccgccgggacccactggcccgcctcaccccgcgcgagcgggaggtcctggcactgatcgcgcagggcaagtcgaacggcgcgatcgcccgtgaactggtggtctccgaggcggcggtcggcaagcacatcggcagcatcctcaccaagctggacctgcccccggcggacgagacccaccgcagggtcctggcggtactggcctttctgcgggcg

SEQ ID NO: 3618 - DNA, 1287 bp, Streptomyces avermitilis
  CDS (1)..(1287)
atgcaccctcggaatgtgtggcaggccatgtccaggccgggcttcctgctgtcgtcgtggccgtggcggtcggtcctgtatctgctcaccggggcggcggccgggatcgccgcgctggtggggatcgtgaccgtggccgtgatcggcggcgccctcgccgtcgtcctggtggggctgccgctgctggtctgtgtggcgctggccggaatcccggtcgcctccatggagcggcgcaggctggcgctgatcgacctggacccggcgacggaccagcaccgcacgccttccgcccccgggctgtgggcctggctgcggacccggctgcgggaacaggcgacctggcgggaactcggctacgcgctgctgttcgcggggctgctctggcccgtcgacgccctcgtggtcacggtgggcctgctgttccccgtgtcgatggtggccactccgctgctgatggccaccatcgggggcggcgacgaggcgaaggtgctcaagcagtggacggtcaccacctggccgggagcgttcggggtcgccgtgctcggcctggtcctgctggtgctctgcgcctacgcgctgggcctcgcgggcggcgcccgggcggaactgacgcggcttctgatcgcctccagagaagccgacctggacgccaaggtcaccgaactcgccagctcacgcgtccggttggtcgacgcgttcgaggccgagcggcgccgcatcgaacgagatctgcacgacggggcccagcagcggctcgtcgccctgacgatgacactcggcctggcccgcctggacgccccgccgggaccgctcgccgaccagctcgccaaggcgcacgaagaggccggcaaggccctggaggagctgcgggaactcatccacggcatccaccccaaggtcctcgcggactacggcctcgaggcggccgtcgccgacgccgccgaccgctccgtggtccccgtggacgtaggcctggagctgcccggccggctgcccgaagcggtggaggccgccgcctacttcgtggtctgcgaggccctcgccaacgtcgccaagcacagcggggcgagccgcgccgaggtgagcggcggacaccgggacggccgactggtcctcgaggtgcacgacgacggcggcggtggcgcgaacgcggcggacggcagcgggctgaccggactcgccgaccgggtgtcggtgctcgatggcagacttgcgctgtccagcccgccgggtggaccgaccctgctgcgtgtggagattccttgcgagcgaaccgacccctgcgcg

SEQ ID NO: 3619 - DNA, 1845 bp, Streptomyces avermitilis
  CDS (1)..(1845)
gtggaggccagagagggcgcgcgccgcgtcgccctgtccggctcgaaggtgcacacggttctcgctgtactgctgctcgcgcgaggccgcgtggtgggtgacagccggctgagttcgctgctgtgggggtgggacccgccggccacgatgaacgcccagatctacacgtacatatcaaggctcaggaagcatctgggctccgatgtcgagctcgtccgccggcagcccgggtaccagttgctcgccgagggctcccatgtcgacatggtggagttcgagcgtctggaccggctcgggcgcggggcgctggaggagcggcggttcccggaggccggggagctgctgcggcgcgcgctcgacctgtggcagggtcccgcgctctcgaatgtgacgccccatctcgccgaggccgagctgccgcgcctcgaggagtccaggatgagcgccctcgagcgtcgcatcgaggccgatctcgccctcgcccggcaccagcgcctggttcccgaactcaccggcctggtgggcgagttcccggtgcgggagcggctgcgcgcccagctgatgacggcgctgtaccggtgcggccggcaggccgaggcgctgcgcgccttccacgagggccgcgacgtgctcgccgaggagctgggggtggaccccggcaccgatctcacggacacctaccaggccgtgctgaccggcgagctgagccggttgccgcagcccgcgcggctgcccacgtccgccccgtacgcgtcgccgtactccgcgccgtacgcgtcgccgtccgcacccgtcatgctgccgcccgacaccgccgacttcaccggccgggagaaccagttcaccgagctgtgcgcccggctcgctccgcccccggccgaccggcgctccgcgttccgcccgcgccgactgctgatcaccggcatggccggtgtcggcaagacggcgctcgccgtccgcgtcgcacacgccgtcgccgccgagttccccgacggtctgctgtacgcccggctgcaccacgaggacggcaccgtcaaggactcctgcgcggtcctcgcccaactgctgcgcgcactcggcgatccgtccgccggcctgccggcccccgacgggtcgccgctccaactggacgagctgatccgccgctaccgcacccggacggcgggccgcaggctgctgatcctgctggacgacgcggcgaacgagcttcagctggacgcgctgcttccgggcacctcggacgccgccgtcctcgtcacgagccgcagcaggctgtccgcggtgcccggctcgcgcacggtcgccctggacccgatggaccggaaggagtcgctcgccctgctcgcggccatcgccgggaacgcgcgtctcgccgtggagccggaagccgcccggaccgtcaccgaggtgtgcgcggggctgccgctggcgctgcggatcgccgggacgcggctcgcctcccggccgctgtggccggcggcccggctcgcccggcggctcgccgacccggccacccgcctcggcgagctgcgggtcggtgaactcgacgtacggcgccgcctcgacgcggcactgcggcaactgcccgcgccggagctggagctgctgcgcacgctcgtccgccgcggtgccgagccgttcgcggcgacctcggccgcgctgctgctcggtctgcccgagacggcggccgaggagttcctggagcggctcgtcgaggtgtccctcctggagatgaccggcatcgactccgcgggcgagccccgctaccggctgcacgccctggtgcggctcgtcgtgcgggccggccgggaacagcgcacggaccggccgttcaccagggcgagc

SEQ ID NO: 3620 - DNA, 510 bp, Streptomyces avermitilis
  CDS (1)..(510)
atggcttggctggccgagcgcgtcctggcctacggaagcttcggcatcctcgccacggtgctgctgctgcccgcgctggaggcggccctgccgctggtcggcgcgctgctgccggggcagaccgcggtggtgatgggcggcctgctcgcctggcacgggcgcgttcccgtcgtggcggccctggtgaccgcggtcgtcggagcggtgctcggcaacgtcgccgggtacgccgtcgggcggcgcttcagcgcccggctcctcgcgcgggtaccggccgacgggcggcgccggcgctacaccgaccgcgccctcggcctgatcgaacggcgcggtggcagcgccgtgttcgtcggccgcttcaccgccgtcctgcggaccctcgtgcccaccctgtgcggagccacccggatgccgttgcgccgctacctcgcctggtcggtcgtcagcagcgtcgtatgggcgcccgccttcgtcctgatcgggtacgtcatggggccggccgggcccggg

SEQ ID NO: 3621 - DNA, 744 bp, Streptomyces avermitilis
  CDS (1)..(744)
gtgggacagatgagtaacgacgcgatccagttgcgttccgtgagcaggcgatacggtgcgggaggcggcgcggtgaccgccctcgaccaggtgtcgctcgccttccccaggggcaccttcaccgccgtcatggggccgtccggctccggcaagtccacccttctgcagtgcgcggccggactcgaccggcccacctccggctcggtcaccgtcggcgacaccgaactgacgaagctcagcgagacgaagctgaccctgctgcgccgtgaccgcatcggcttcgtgttccaggcgttcaacctgctgccgtcgctgaccgcggaacagaacgtggcgctgccgctgcgcctggccggacgccgcccccgcaagacggaggtccgcgaggtgctggcgcaggtcgggctcggcgaccgggccgggcaccggcccaccgagatgtccggcggccagcagcagcgcgtcgccctggcccgggccctgatcacccgccccgacgtcctcttcggcgacgagcccaccggcgcgctcgactcgcagaccagccgggaggtgctcaccctgctgcgcggcatggtcgacagcgagggccagacggtcatcatggtcacgcacgacccggtggccgcctcgtacgccgaccgggtcgtcttcctcgtcgacggacgggtcaacggcgagctgatcggggcgagcgccgaggacatcgccgcacgcatgaccaagctggaggccgcgccgtgc

SEQ ID NO: 3622 - DNA, 2454 bp, Streptomyces avermitilis
  CDS (1)..(2454)
gtgctgagcgtcgccctgcgcaccctgcgcgcccgctgggtcaccttcgtcggcagcttcgtcgcgctctccctgggcgtcggtctgctcgccgtcatgggcctggccctcgcgtcgtccctggacgcaccggaccgcgagcccgagcggttcgccgcggccccggtcgtggtgaagggaccggacaccctgcgcgtgccgacccccatcggggaccgggtccagaagctggcccagccgcgcgccgtaccggccgccctgaagaccgagctgaagaagctgggtcccgtggtcgaggaccgtgccttcgccgtacgcgcccggggcggccccggcgagctggtgggccacccctggtcgaccgccgccttcgccccgtacgagatcagtgccggaagcgcgccccgggccgccgaccaggtcgtcgtcagcggcgactgggccaccgtgggacagcggctgcggaccgaccgcggcaccgtgcgggtcgtcggcacggtggccgggctcggcttcgagaacgcggtcttcttcagcgacgcgcgggccgccgaactggcgcctgtcagcgttcagttggtggtggacgccgacgcggccgccgtgcgggacgcggcgcgggacagcaccggggtgagcgtgctcaccggtgacaggcgccggctcgccgacgccgatcccgaccgcgacagcgaggccctggtcgcgatgaacgccatgttcggcacggccggcggggtcaccgccttcgtgtcggtgttcgtggtggcgtcgaccttcgcgttcgccgtcgcccagcggcgccgcgagttcggtctgctgcgcaccgcgggcgcgacaccgggccagatccgccggatggtcatctccgaggcgttcctcgtcggtgtcctcgcgtccgccgcgggctgcgtgttcggcgcgtacggtgcgccgcgcctcgcccagtgggtggtcgacaacgagctggccccgtcctggttcaccatcggcgactacacgtggccgtactacatggccttctggacgggcctgctcgtggccctgtgcggcgcggtggccgcgtcctggcgggccggcaggaccgggccgaccgaggcgctgcgcgaggcgtccgtcgacaccaggacgatgacctggggccgctggctgtccggtctggccctgctgctgaccgccgtgggcacgctggtcttcgcgctggccaccgagccgggcgacctgctgcaccgcaagacgtacgtcagccggccgatgctgctgatcaccgcggtcgcgctgctcgcccccgtcctggtgcggcccatgacccggctgatcgcctggctgccggcccaactgccgggcgccaccgggatgctggtgcgggagaacgccgccgcgggcgtgcgccgtaccgccgccgtcgcggcgcccgtcctggtcacggtcgccctcgcgggctcgctgctcggcgccacggcgacgctcaacgaggcgaaggccaccgagacccgggcgcagaccgccgcgaacttcgtggtgtcgccggggagttccgagggcttcgacgcggccgctctcacccggctgcgtgaggtgccgggcgccaaggtctccgccacctccacgagcgccgtgtacgtcctcgaggacggcgtcgcgctgatcaagtccgaggcgcgggccgccgatcccgcgatgctcgccaccacgacgcggctgccgctggcggcgggccgggtgaccgacctcgacgacgactcgatcatcgtgaacgaggagtgggcgcggcacaccgtcgggcagagcgtggccgtctggctcggcgacggcacgaagaagaccctgaagatcgccgcggtgatgcacaccggcaccggcaacaacggcgtctacgtcaccccgggcaacgcccagggcgcgagcgtcgaccgggtcgacgtgtcggtcgcggacggcgccgacgcctcggccgtggccgccggtctgcgcgaggccgtgcggtccgagggcggacaggtcctcaccaaggacgcgtgggtgcgggcgagctaccccgagaccaaccggacgacccgcctcggcttcatcctggtcctcggtatcgccctcgtctacacggcgatcgccctggccaacacgctggtcatggcgacgtccgaccgggtgcgcgacctggcggtgctccgcctggccggggccaccaggtggcaggtgctgcgcctggtgggcgcggaggcgctgatggtggtcgcggtgggcggggtgctcgggctgctggccgcggggctcaacctggccgggatgtggggcgccctcgggctcctcgaggtgtggtcctcgatcgagctcccctggccggtgctcggcgcggcggtggccgtctgcgccgtcctggcggtcgtctcggcgatggccccggccggggtctccctgcggcgcagggccgtggaactggccggcatgcgggag

SEQ ID NO: 3623 - DNA, 933 bp, Streptomyces avermitilis
  CDS (1)..(933)
atgaccgcgatcgagtacacggcacagccgggaacgccggtgcacgactacatcgccgagaaccgggagaagctccggcgggtcctgggcgagcggggagcgctcctgctgcgcggtttcgaggtcggcggagtcgacggcttcgacggcgtggtccaggcgttctccgggagcaggccgctcagttacgccgagcggtcctcgccccgctccaccatcaagggccaggtctacacgtcgaccgactatccggccgacgaggagatcttcctgcacaacgagaactcctaccaggccgtctggccgcacacgctgtacttctactgcatcgagccggcccacacccggggcgcgaccccgctcgccgacatccgtgaggtgtaccgggccatcgacccggcggtgcgcgaggagttcgtgcggcgcggcggctggcaggtggtgcgcaacttccacgcggacttcggcgtgccctggcaggaggcgttcggcaccggcgacccggcggcggtcgaggagtactgccgcggcaagggcatcacggccgagtggcgcgcggacggggggctgcggacgacgacggtgcgggccgccgtgcacacgcacccgggctcgggggaggaggtgtggttcaaccacgccacgttctggcatgtcacctcgctggcgccggaggtccaggaggggctgcgggagatcttcccggacgaggacctgcccaccaacacgtacttcggcgacggcggacgcatcccggacgagacggtcgcgcatctgcgggccgcgtaccgctcggcgacgacgcgcttcgactggcagcgcgacgacgtgctgatcgtcgacaacatgctggccgcgcacggccgggagccgttcacgggcccccgcaagatcgcggtggcgatggccgaaccctcacgcccgcccgccgcc

SEQ ID NO: 3624 - DNA, 792 bp, Streptomyces avermitilis
  CDS (1)..(792)
atgaccgccgcatacgagaacctgagggaccgcgacgcggtccacatctggcagggccgggcccccgacgcgctcgcgccgggtgacaccgacctgctctcggaagaagaacggcacctggtcgaacgcctgccggacgcggccgcggtccgttacgcggccgcgcacgcggcgctgcgccgggtgctcgccgagtacctggacgtggcaccgggggacatcgtcctcggcaggcgcccgtgcccgcgctgcgcgcatccacggcacggcagaccccgtgtcgactggccgcccaccgacctcgacttcaacctctcgcggtccgggccgcgctggctgctcgcggtggtggtcggccggcaggtcggcatcgacgtggaggacggccgcagcctggacgtggagggcgcctcgaagctcgtgctgagcgcctccgaactcgcccacgtccggtcggcaccggacgaggccgcgcgttcgcacgccttcttccgctgctggacgcggaaggaggccgtggtcaaggcgagcggggtcggcatcatcacggacctcaaggcggtcgacgtacggcccgccctcgacggtccggtcgtggtcacccacaccgagccgacgggccccgacacctggctggtgcaggacctgtcggtggccgacggggtgttcgcggcgctggcccgggaggccggttccacgggcccggtggtgcggcgcggtgacgaggagcggcaggaacagcagcaggaacagcagcaggagcaggcgaaggcgacgggggttctggtccga

SEQ ID NO: 3625 - DNA, 933 bp, Streptomyces avermitilis
  CDS (1)..(933)
atgacggacacgcagacctggacgccgttggagatcgagaccgagtgcgagggcggggcggaggaactcgtcgagcgggtggccggcatgggggaggagttcggcaagctgctcgtggcggagaagggcctggtcttccgtggcttcggggtcacccccgaggacctcgaccgggcgctcgacgcgctgctgcccaaccggctcgcctacgtccacggcaactcgccgcgcaccaaggtcggcagcaacgtgtacacctccacggagtacccgcgggaattcaccatctccatgcacaacgagatgagttacgcgcacgcctggccgtcccggctggccttctactgccaggtgcagcccggcggcggcggcgcgacccccgtcgtcgacgcggccgtctggtacgggtccctggacgccgaggtgcgcgaggccttcgcgggcggggtgcgctacgtgcagaacctgcacgacggctacgggctcggcaagagctggcaggacaccttcgagaccacgagccgcgaggaggtggaggccttcctcggcccgaccggcgccacctgggagtggaaggccgacggcggcatccgggtctcctcggtgcgcccggccaccacccggcacccggtcaccggcgccgaggtgtggttcaaccagtccgaccagtggcacccggcgggcctcggcgacgacaccgcggcggcgctggcgcagatcctgcccgaggacgaactgccgcagagtgtgacgttcgccgacggcagccccatccccgcggagtacgtcgcccagatccgcgaccgcggcctcgcgaacgccgtcgacgtggactggcgcgccggcgacctgctgctcatcgacaacgtcctgctggcgcacggccgccgccccttcgtgggcgaccgccgggtgctggtcgcgatgtcggac

SEQ ID NO: 3626 - DNA, 747 bp, Streptomyces avermitilis
  CDS (1)..(747)
gtgcgcggcgagccgtggctcaggcgctacccggcccggtcgggaggccgcccccggctccggctcgtctgctttccgcacgccggcggcaacgcccagctctaccacggctggccggcgcgtctgccgtccgacctggagctgctcgccgtctgctaccccgggcgccaggagcggctcgccgaaccctgcgtcaccgacatggccacactggccgacgcggtcaccgacgcgctgctgccccacctcgacgtcccgctcgccctgttcgggcacagcatgggctcgacggtggcctacgagacggccctgcggcttcgggcccggcacggcgtcgtaccccggcggctgatggtctcggcccgctccgcaccgcaccgcgcccgcccctccgggctgtatctgcgcaccgacgacgaactcgtcgccggggtgcgccggctcggcgacctgggctcgcaggcgtacgacatccccgaactgcgcgagctgctgctgcccgcgctgcgcgccgactaccggctcatcgagagctaccggcccgcgacgcccccggagccggtggcgtcgccggtcaccgcgtatctcggccgcagcgatccgggctgcgaccgcgacagcgtcctcgcctggtcagagctgtcctcggccggggacttcgccctgcgcacctacccgggcgaccacttctatctcgcgcagcgggaagccgaactggtcgccgatgtcagtaaagatctggaggaa

SEQ ID NO: 3627 - DNA, 1350 bp, Streptomyces avermitilis
  CDS (1)..(1350)
gtgaccctcgtcgagggcgccggtccccggaccggcgccccacccgaaccgctgcgccgcaaccgggagttcctgctcctgtggtccggcgcgagcatgtcgttcctcgccacgcgggtgacggcggtggcctacccgttgatcgtgctgtggcacaccggctccccgctggcgatgtccgtggtgtccacggcggccctgctgccgctgctcctggtgcagctgccggccggcgccctggtggaccgctgggaccggcgccggctgatgctgggctgcgaggcgggccgggtcctcgcggtgggcagcgtggcgctggcgctcgcggcgggccgggtggacgtggcccacctggcggcggtggcgttcctcgaatcggccctggccgtgttctaccggctcgccgaacgcggcgccgtacgcaacctcgtccacccggcgcacctgcccgccgccctcgcgcagaacgaggcgcgcgggcgggcggccggtctgctcggccagccgggcggggtgctgctgcactcggcggcccggtggctgcccttcggcttcggcgtgctcggctacctcgtctcgctcgtcaccctgctgttcgtccgcaaggacttccaggcggagcgcaccgccccggcgcgtccgggacggctcaccggtgaggtcgccgaaggcatgcgctggctgtggcgccagcggttcctgcgcgcggcactcggctatgtcgccggcaccaacgtcctgttccagatgctggcactcgccctgatcctgcggatcaaggaggcgggactgccgtcggcgacgctcgcggtcgtcgtgggcatcggcggcgtcggcggcctgggcggggcgctcgccggcggccgcctccagcgcctgatgtcccagcgcaccctgctgatcgggggcgccgtcgcctggacgctgctgatcggcgccatggcactgaccgcccgccccgtgctcctcggcgcgctgtacgcgggcaccggattcgtcggcgccgtgttcaacgtcgccgccgccgtctaccaggtgcgcatcacccccgacgcgttccagggccgggtggccgccaccgcgggactgatcggctcgggcaccaacgcgctcggctcgttcgcgggcggcctgctgctcacggcgtggggcgcgctgcccacggtccgcgcgatcgccgccgccatggccgtactggccctgctcgcggcggtggcaccgggcctcaggggagaaacggcggcgacgccacggacagcggagccggtcgatccggtggagccgacggagaaaccggtggagccgacggagaaaccggtggagccgacggagaaaggagagggggaccga

SEQ ID NO: 3628 - DNA, 921 bp, Streptomyces avermitilis
  CDS (1)..(921)
gtggcacccgtacggcatctgatctccatcgacgacctctccgacaccgacctgtactccctcgtactccgtggcgccgccttctcggccggtaccgcgggccgccccgcgccgctggccggggacgtcgtcggcatctacttccgcaagacgtcgacccgcacccgcaccgccttctccagcggagctctgcgactgggggcgcagatcatcgcgtacggccccgacgacctccagctcaacaccggcgagaccagcgaggacaccggacgggtcatgtccggcatgctcgacgtcctggtcgcccggaccgccggcgaccccgccgagatgcgggcctgggccgcgcaggaccggatggcggtcgtcaacgcgatgagcgcggacgagcaccccacccaggcactgaccgacctgaccaccctgcaagggcacttcggcggcatcgaggggctgcgggtgctgtacgtgggcgagggcaacaacaccgcgtcggcgctggcgctcgcactgactcgctatccgggcgtctccctcgaactgcgcacgccgccgggctacgggctggccccgtactaccgcgaacgcgccgccgaccaggccggccgccacggcgccacgttccgcgagcggcacgacatggacgacctgcccgccgatcaggacgccgtctacacctcccgctggcagaccaccggcaccagcaagccggacccggactggcgggagatcttcgccccgttccaggtgtcggcggcactgtgggagaccagtcccaaggcggtcttcctgcacgacctgcccgcgcaccgcggtgacgaggtcaccgccgaggtgctggacggcccggcgagcatcgccttcgcgcaggcggagaacaagatgcacagcgcgatggcggtgctggagtggtgcaggccg

SEQ ID NO: 3629 - DNA, 11058 bp, Streptomyces avermitilis
  CDS (1)..(11058)
atggagaagcccgtcctctcgggcactgatgccgacgcgctccgcgccgaactgctgcgccgccgtctcgcgggccggcgcaccggcgccacccgccgcccggacatcccccgcgccgaccgggacggcccgctgccgctgtcgtacggccagcagcagatgtggttcctcagccgcctggagccggacagccccgaatacctggtcccgctggtgctgcggctgcgcggcgccctcgacaccgaggccctcgacaaggcctggcaccaactgctggagcggcacgagatcctgcgcacccgctacgccctggacggcgacgagcccgtccagatcatcgacgcgccgcgccccctgcccctggaccggtccggggccgcggacgacgacgcggtccgcgccctggtcgaggcggacctggcccgcccgttcgacctcggccgcgactggccggtgcgggcgcgcctgatccggctcgccgacgacgagcacgtcctcgcggtggtcttccaccacatcgcctgcgacgcctggtccaccggcgtcttcggacaggaactcagcgccctgtacacgggctcggccccggccccgctcaccgtgcagtacgcggactacgccgcctggcagcgcgccgagctgaccggcgaggtcgtcgaacgtcacctcgaccactggaagggccggctggcggacctcgcgccgctcgaactgcccaccgaccggccgcgccccgccgtgcgcgacggcgccggttccgccgtcgccttcgacgtgcccgccccgctgggcacccggctgcgcgagctggccgccgcgcacgacagcaccccgttcatgctgttcctcgccgcctaccagagcctgctggcccgccacaccggccgcgcggacatcgccgtcggcaccgtggtctccggccgcggccgccccgagctgcaacggctcatcggctacggcatcaacaccctggtgatgcgcggcgacctctccggcgaccccgccttcaccgacctgctggcccgcaccagggccacggtcctggacgcctacgaccaccaggacgtcgccttcgcccaggtcgtcgacgccctcggccccgagcgcgacctctcccgcaccccgctgttccaggtcgcgttcacgatgcacggcgaccgcagctccgcgttcgcgttccccggcgtcgaggtggcgccgttcgagggcgcgggccgggtcgccaagttcgacctggacctccagatacgtgagcgggcggacggctcgttcggcgggcacctggagtacgccacctcgctgttcgaccgggcgacggtcgagcggttcgccggccatctgctgcgcctgctcacggggatcgccgccacgcccggggcgcgcctgtccgcgtacgagatcgtgggcgagcgggagaaggccgtcctgctcggcgcccccgaggccgtggagcccgtgacgcgccgcgtgcacgaggtgttcgaggagcaggtggcgcggacccccgagggggtcgcggtctccttcgaggggacggatctgacgtacgcggagctgaacgcccgcgccaaccggatcgcccacgccctgatcgcgaagggggtcggcccggagacgctcgtcgggctgagcctggagcgcggcatcgaactgatcccggccctgctcggcatcctcaagtcgggtgccgcgtatctgccgctggacccggcgaacccggccgaccggatcgcgtacatcgtcggggacgcacaggccccggtggtggtgaccaccgccgagcacgcgcatctgttcgacgtggagctgctgctcctcgacacggacgcgccggacctggccgcgcggccggactccgacccgggcgtgcccggcagccccgagaacctgatctacacgatctacacctccggctcgacgggccggccgaagggcgtcgccctcacccacaccaacgtcgtacgcctcctggagcgcggcaacgagcactacgccttcaccgacaccgacgtctggcccctcttccacagctacgccttcgacgtctccgtctgggagatgtggggtgccctgctgcacggcggccggctgatcgtcgtcccctacgacgtcacccgctccccggaggagttcctcgacctgctggtgcgcgagcgcgtcaccgtgctcaaccagacgccctccgccttccgttcgctggtcgccgcggacgccgaactgtcgctgcgcgcggtggtcttcgcgggcgagaagctggagatctccgaactgcgcccctgggccgaccggttcgggctcgaccggatcgcgctcgtcaacatgtacgggatcaccgagaccaccgtccacaccacctaccaccggctgaccgagcgggacctggacccgcgggcgggcaacgcggtcggccatccgctggccgacctgcgggtgtacctcctggacgcggaccgacagctggtcccggtcggcgtgcccggtgagatccacgtcggcggccccggcgtggcacgcggctacctcaaccggccggagctgacggccgagcggttcgtcccggacccgtacggtccggcgggctcgcgtctctacaagagcggcgacctcgcgcgccggctgcccgacggcagcctggagttcctgggccggatcgacgaccaggtcaagatccgcggcttccggatcgagctgggcgagatcgagaccgcgctggccgcgcatccgcaggtccgtgacgccgtcgtcctggtccgcgaggacacccccggcgacaagcgcctcgtcgcctacacgacgccggccgccgaccaggccccggcccccggcgacctgcgctcccacctggcggcccggctgcccgagtacatggtcccggccgcgttcgtcgccctcgacgcgctgcccctgaccaccaacggcaagctcgacaagcgcgccctgcccgcccccggccaggacgccctcggcgccgccggccacgtcgccccgcgcaccgtcgccgaggagcggatcgccgaggtgtgggccgacgtcctcggcctcgaccgggtcggtgtcgaggacggcttcttcgagctcggcggtcactccatccgcgccgtcaccctggtgggccggctccgcgcgatcggctacgacctcgccgtgcgcgacgtcttcgagtaccgcacggtcgcccgcgtcgccgaactggtcaccgggcgcccggcaccggaggacgccgaccgcaggaccgagccgttctccctgctcaccgccgaggacgcggcccggctgcccgacgggctcgccgacgcctacccgctgtcccaggtgcagctcggcatggtcgtcgagatgctcacggacgacggcaagcacccgtaccacaacgtcacctcgttccgtatccgcgacgagcggcccttctcgctcgacgccctgcgcgccgccgccgcggccgtcgtcgcccgccacgaggcgctgcgcacctccgtcgacctcaccggctactccgtgcccctgcaactggtccacaccacggccgagatgccggtcggtgcccgcgacctgacctccctcaccgaggaggaactcctttcctccctgcgggagttcacggccaaggagcgctccgagctgttcgacctggcgaccccgcccctgctgcgcctgcacgcacacatggcgggcgacggcagctggtggatcaccaacaccgagtgccacgcgatcctcgacggctggagccaccactccctgctgatggaggtcctggaggagtacggccgcgtccgcgacggcggacagccgtccgaggcccccgtgccgggcgtccgcttcgccgacttcgtcgccgccgagctggacgtgctcgactccgccgggacccgcgcctactggcagtcggtcgtcgacggctacgcccggctcaccgtgccggccccctggcgcggcgacccggacgacaccggcgccccgtaccgggtgcccgtgcccttccacgacctggaggaccggctgcgcgccctggccacgaaggcgggcgcctccctcaagagcgtcctgcacgcggcccacctgaagacgctgagcatgctcaccgaggaggaccgcttcttcagcggtctggtgtgcaacgcccggcccgaggtgctcggcgccgaccgcgtctacggcatgcacctgaacacgctgccgttcgcgtacgaccgcacggccgccacctggcgcgacctggccgccgccgtgttcgcccgggagatcgagctgtggccccaccgcacctatcccatgccggtcatccagcgtgaactcgcgggcggcgagcggctgatcgacatgcggttcagctatcacgacttcgaccaggtcgaccgcgcccaggtcgactacctggccagcatcgacgacagccccaccgagttcccgctcggcgtctcggcccgcgtcggccacctcgtcctcaccgcgtccccgaaggccctgagccgcgccggcacggaccgcctcgcggccatgctgcgcggcgtcctggaggcgatggcggcggacccggagggcgacgcgcaggcgtcgttcctgccggcgggggagcgggagcggcagctcgtcgagtggaacgacacggcgtacgaggccgagaccgcctccgtgctccggcgcttcgaggagcaggcggcccgcaccccggacgcggtggccgtcggtcaccaggacggcacgctctcgtacggcgaactcgacgtgcgcgccaaccagttggcgcaccatctgcgaggcctgggcgtcggtgccgagtcgcgggtcctggtccggctcgaccggggcccggacctgctgacggcgctgctcgcggtgtggaaggccgggggcgcctacgtcccggtcgacccctcctacccggccgaccgcgtcaccgccatgcgggagctgtccggcgcccccgtgaccctcacggagatcccggtgcgggccctgatcagcctgcccaccggcgctcccgccaggaccgacgacctggaccggctcgcgtacgtcatcttcacctcgggttcgaccggcaccccgaagggcgtcgaggtcacccaccggggactggccaaccatgtcgcctgggcggcgcgggaactggcgtcccagggggacggcggagccccgctgttctcctcggtcgccttcgacctggtcgtcccgaacctgtgggcgccgctggtcaccggccaggccgtgcacaccgtgagccaggacgtcgacatggccgacctgggcgagcacctcgtcgcatcgggcccgtacagcttcatcaagctcaccccgggccatctggacgtgctcgcccagcagttggcacccgagcaggcggcggccctcgcgccggtgctggtggtggcgggcgaggcgttcacccgcgccaccctggagcgctggcgcgcgctcgccccggacacccggctgatcaacgagtacgggccgaccgaggcatccgtcggcacgacggtccacgaggtgccgcgggacgccgagaccgacgtactgcccatcgggcgcccgctgcccaacatgcgggtgtacgtcctcgacccggcgctccagccggtcccggtcggggtcacgggtgagctgtacgtcggcggcacgggcatcgcccgcggctacgcgggccgccccgacctgacggccgagcgcttcctgcccgacccgtacggcaccgagcccggcgcccgcgtctaccgcaccggcgacctcgtacgccaacgcccggacgggaacgtcgagttcctcggccgggtcgacgaccaggtcaagatccgcggctaccgcgtcgaactcggcgagatccaggcagtgctcaccgcccaccccggtatccgcgacgccttcgtgacgaccgtcgacggcgaactggccggctactacgcgcccgccggcgcggaaggggtccgcgagcacctcgccgaccggctgcccgactacatggtcccggcgaccctgaccgccctcgacgccctgcccctgaacgccaacggcaagatcgaccgcaaggcgctgcccgcacccgacgccgccgcggccgacgacgacgggtacgtcgccccgcgcaccgacaccgaggagcgcatcgccgccgtgtgggcgcaggtcctcggcctcgaacgcgtcggtgtcgaggacggcttcttcgagatcggcggccactccatccgcgccgtcgccctcgtcggggcactgcgctccgccgggttcgacatcggcgtacgcgacgtgttcgagcaccgcacggtcgccgccctcggcgagcacctgaccgggcgccccgcccggaccgaggtggacacccccgtggcgcggttcgcgctggtgccggccgaggaccgcgcgcggctgcccgaggacgcggtggacgcctatccgctgacgcaggtacagctcggcatggtcctggagatgctcgccgacgacaccaagcacgcctaccacaacgtgtcctcgttccggatcacggaggccgcgcccttctccgccgacgcgctgcgcggcgccgccgccgtggtcgccggccgccacgagatgctccgcacctccttccacctcgacggcttctcgcagccgctccaggtggtgcgtgcacacgcggcgatccccgtcgccgtgcacgatctgaccgcgctcgacgaggcggggcggcggcgcgccgtcgaggagttcatcgcccgggaacgcgccgacctgttcgacctggagcgggccccgctgctgcggatgaccgcacacgtcgaggaggacggcgcctggcgcctcggcctcacggtgtgccacgccatcacggagggctggagccaccgcgcgctgctgatggagctgctcgacgaataccggcggctgcgcgacggcggacagccgtccgaggcccccgcgcccgccgtccgctacgcggacttcgtcgccaccgaggtgcgctccctggagtcggagcacgaccgggcgtactggcgtgacgtcaccggcggcttcgcgcgcttcgcgctgccggcggcctgggcgggcgaccgctcggccccgcgggagaccttccgggtcgcggtggagctgcgccccttcgagcaggggctgcgcgccctggccgcgcgggcccgggtctccctcaagagcgtgctgctcgcggcgcacctgaaggcgctgagcgtgctgaccgaggaggaccgcttccactcgggtctcgtcttcagcgcccgccccgaggcgcccggcgccgaccgcgtctacggcatgtacctcaacaccctgccgttcgccttcgacgccgaccgcgaccgcacctgggaggagctggtccgcgaggtcttcgcccacgaggcgggcatgtgggagtaccggcgctacccgatgccggcgatccagcgcgacgccggggtggagcggctgctcgacgtgcgcttcagctaccaggacttcgaccacgtggacaccgagcgcgtcgacgtcggcgacagctcgggcgagggcgccacggagttctccctcgccgtgtccgctgtctccggctacctgctgatgaccacgcacacccacgccctgtcccgggcgaacgccgaccggctcaccgcgctgtacgcgggcgtgctcaccgccatgacacaggacccggcgggcgacgcccgggccgtgccgctgccggcggacgagctgcggcgccagctcgtcgaatggaacgacacggcgtacgaggccgagaccgcctccgtgctccggcgcttcgaggaacaggcggcccgcaccccgcgggcgcccgccgtgaccctgggcgagcggaccctgacctacgccgaactggacgagcacgccaaccggctggcccacgcgctgcgggcgcgcggtgtcggcgccgagtcccgggtggcggtccagctggaccgcggccccgtgctgatcgccgcgctcctcgcggtgtggaaggcgggcggcgcgtacgtgcccgtcgacccgtcctacccggccgagcgcgtcgcgtcgatcgtcgggacgtcgggcgccgcggtggcggtcacctcggcggcgtacgcggaccggttcggtgccgtgtcgctgctgctcgacgacgaggacgtcagcgccctgccgtcggccgcgcccgcccgcgccgacgacctcgaccagctcgcctacgtcatcttcacctccggttcgaccggccggcccaagggcgtcgaggtgccgcaccgcggcctcgcgggccatgtcggctgggcggcacgggagctggcctcgcgggggacgggcggcgcgcccctgttctcctcggtcgccttcgacctgatcgtcccgaacctgtgggcgccgctggtcaccgggcagcgggtgttcgccgtcccgcaggacaccgaacccgccgagctgggacaccggttgctggccggcgccccgtacagcttcgtcaagctcacccccggccacctcgacctgctcgccgagcagctcaccaccgaacaggcgcaggagctggccgaggtcatggtggtggcgggcgaggcgctgcccggcgccacggccgaccggtccctggacatcctcggtccgggccgcctcatcaacgagtacggcccgaccgaggcctccgtcgggaccacggtcttccccgtcctcgcgccggtcgggcgcgacgtcgtaccgatcgggcgtccgctgcccaacatgcgggtgtacgtgctggactcggcgctccagccggtgccggtgggagtcacgggggagctgtacgtcggcggcacgggtgtcgcccgcggctacgcgggccgccccgacctgaccgcggagcggttcctgcccgacccgtacgcggccgagcccggcgcccggctgtaccgcaccggtgacctcgtacgtcacctcccggacgggaacgtcgagttcctcggccgggtcgacgaccaggtcaagatccgcggctaccgggtcgaactcggcgaggtgcaggcggtgctcgccgaacacccggccgtgcgcgacgcgttcgtcaccgtccacgagcccgttcccggcgaccggcgtctggtcggctactggacgcccgccgcgggcgccggggcgcggccggaggagctcgcggcgcactgcgcggtgcggctgcccgactacatggtgccgtcggcgttcgtggccctggaggcgctgcccctgaacgccaacggcaaggtcgaccggggggtcctgcccgtccccggccggggggcgctgcgcagcggcaccgcgcatgtgccgccgcgcaccccgacggagaaggcgctgggcgccatctggtccgaggtcctcggcgtcgaggagatcggcgtccacgaccgcttcttcgacctcggcggccactcgctgctgatgatcaaggtgctggcggcggcccgcgcggcgggcctcgcggtctccgtctaccgcatgtaccagcacgacacgctgatcgacctggcggcggcggtggacgaggacacggcggcgggggcccgcgcgggcggttcgcagtcggccgacgcggagtcggccacgagcggcgccgccgccgaaacacaggcctcggccggcacggcaccggcctcttcggcggaggctggcgggtctccggcggaggctgccgggtctgctgtgggtgccgtctcggctgggggcgctcgtgcctccggtgctgcgggctcctccggggaggctgtcgcccccgctgcggttgctgcgggctcttccggggaggctgtggtcttcaccgctgccgctgccgctcccggcgtccccactcccgctcccggcgtggacgccgccgcccccaccgtcgccgtctccgccgagttgcttgccgctctgttggagcaggccgccgggggtgacccggggcgggcggggagcggggtggtgcccgaggccgccgcgttgctcggggccgcgcgccgggaggcgcccggggtgcggggcgaggaccgggatccgctcgccgaggggctcacggccgccatggccgagcgtcatgtgccgggcgtcgccctcgccgtcatccgcgacggcgcggtcgccgaactgcgcggccacggcaccctcgaggccggcggcagcgacccggtgaccgagcgcaccctcttccaggtcggctccatcagcaagcacctgaccgcgttcgcggtcctgcgtctcgtccacgagggcctcatcgacctggacgccgacatcgacggctacctcacctcctggcacctggccgacgacccggcagcgccgggcaccgtcaccgtgcgcacgctgctcggccaccgcgccggtctcgcccggcaccgcagcgtcgggttccgccccggcgaacagctgcccaccctcctggacctcctggagggcaggcccccggtgaccaccccgcgcgtacggcgggaactgccgcccggcgaggtgttccgcaagagcagcacgcactactgggtgctccagcaggtgctggaggacgtcacgggcgagcccttcgagacgctgatgcgccggctggtcctcgacccgctcggcctcgccgacaccagcttcgaccaggaacacccgcgcaccgcgggcctgcccgtcgcactcgggcacgacgcccacggcaccccgctgagcggcggctggcgcgagcgggcccacctggcggccgccggcctgtggaccacggcgggcgacgccgcccgcttcgtactcgccgtacgggacgccctcctgggcgcaccgggggccctcgtcccgcaggccctggcccgggaactgctcgcgggcgagaccggcaccttctacgggctcggcaccatcgtcgacgacaccggcgacgacctggagttcggccacggcggcgaaccctcgggctactggaacatggcgatcagccggatgcacggcggcaccgggttcgtcgcgctcaccaacgccgactccggcaaggccgtcgtcaagtacctcaccgccgaactcggccgcagggacgcgacgttcggcagcggccggctcgccgccgactggcgtcgcgaggacccggcaggcgcgctcccggcggtgctcgcccccgtcgtcacggacgaggagcgcgca

SEQ ID NO: 3630 - DNA, 5127 bp, Streptomyces avermitilis
  CDS (1)..(5127)
gtgaacgccgaactgctttcggaacgcttcgccgagcaggcgttccgtacgccgcacgcggccgccgtcgtcgacggagcccggacggtgacgtacgaggagctggaccgtgcgtccctgcgcatggcccgccacctgcgggacctgggtgcggggcccgagacgctcgtcggggtgagcctgccgcgcggcgtcgatctgatcgtcgcgctgctggccgtctggcgggccggcgcgggctatgtcccgctcgacccggcccagccgcccgcccgcctgtcggacctggcccgggaggccggggcgcgcctggtggtcgccggaccggccctggcgggccccgtgcgcgacgccggtgcccggcgcgtcggacccgaggagatcccggaccggtcctcggaccccgccggcccgctccccgccgccgaccccgccaacgcggcgtacgccgtcttcacctccggttcgaccggccggcccaaggccgtcgtggtcacccacgcgggcatcgcgaaccggatcggctggaccgtgcagcggcatgcgctcggggcggccgaccgggttctgcagaagaccaccatcgggttcgacgcggccggctgggagatcttcgcgccgctggtcggcggcggcaccgtggtgctcgccccggcgggcgccgagcgcgacccggccgcgctgctgcgcgcggtggccgaccacggcgtcaccgtgctccaggtcgtgccgtcggtgctgcggctgctcgtggaggagggtgactggagcggctgcggctcgctgcggctgctgttctcggcgggcgaggccctgcacgccgagctggtcgcgcggctgcgtgagcggacgggccaggacctggaggtctggaacacctacggtcccaccgagtgctccatcgacatcaccgcgcagctcgtcgaccccgcgctcaccgcgggtccggtgcccatcggccgcccgctgcccggcatgcgcgtcctcgtcctcggaccgaacggtgtccccgtgcccgtcggtgttcccggcgagctgtacgcgggcggcgtcggagtggcccgcggctatgccgggcgccccgatctgaccgccgaccgtttcgtgcccgacccctacgccaccgagcccggcgcccgcctctaccgcaccggtgaccaggtgcgctggcgctccgaccgcaccctcgagtacctgggccggctcgaccaccaggtgaaggtcaacggcgtccggatcgagcccgccgaggtcgaggccgcgctcgccgcgcacccggcggtcaccggcgcggtcgtcacgccgtacgaggccgacggcggcggcaagcggctcgccgcgtacctcaccgtcagcggcgaggcggacccggccgggctgcgcggtttcctggccgagcggctgccggacagccatgtcccctcattcctccacaccctcgacgcgttcccgctgacggccaacggcaaggtcgaccgggccgcgctgccctccccggccgagatcgccgccgccgggcagcccacgtacacggccccgcgcgacgcggcggaggaactcgtcgcgggggtctgggccgacctcctcggtctcgaccgggtcggcgcgctcgacgacttcttcgcgctgggcggcacgtcgctccagctgacccggctcgcggcccggctgcgcgccgcgtcgggcgagaaggtctccctgcgcggcctgttcgccgcgacgacggtccaggcccaggcccagctgatcggcacacccacgggggcggccgacggcgggacgagcggtgccgtgaccggcggcacgacagatgccgggcacgagggcacgggcggcacgggcggagccgtccacggcggcacgggcgccgacgtggacgacgggccccagatccgccccgtcccgcgcaccggcgacctccccctctcctccggtcagcgccgcctctggttcctggaccggatgcaccccggcagccccgagtgggtcgccccgctcttcctgcggctgccgggttccctggacgccgggaccgtgggccgggccctggacgcgctcgccgcccggcacgagccgctgcgcacccgctacgtcgaccagggcggcgagccgcgccagatcatcgacgcgccgggcgccggcaccgtcgagctgcgcgtcgaggacaccgcccgcgacggggtggccgcgctcttcggcgcacagttcgagcggggcttcgacctcgccgcgggcccgctgtggcgcgcgctgctggcccgggtggccggcgaggaccatgtcctccttctgacgatgcatcacatcacctgcgacggctggtcgacggtgatcctggaacgggagctgcgcgagctgtgcgccgccgaccgggccggccgcgcgccggacctgcccgaactgcccctccagtacgcggactacggctcctggcagggtgcccgcctcaccgacgccgtcgtcgagggcgagctgacccactggcgcgccgccctcgacggcatcgccccgctcgacctgcccgccgaccacccccgcccggcggtgcgtgatccgcgcggcgcggtcgtaccgttccgcgtcgcccccgaactcgccgtcaaactagccgagttgggccgagcccacggcgccaccccgttcatgacgctgctgacggcgtacgccacgctggtcgcccgccacaccggccagtgggacgtcccggtcggcaccccggtggccggccgcacccggcccgagaccgagaacatggtcgggttcttcctcaactccctcgtcgtacgctgcggcctcaccgcggacctgggcttcaccgaggccctgcgccgggtcagggacgcggcccgcgccgccctcgtccaccaggagctgcccttcgagcggctggtcgaggagcttcagcccgagcgcgacctgtcccgcaccccgctctaccaggtggccttcgacctgcacagcgagggcgtgaccagcgtcgtcacccatgacagtgacctggccgcgttcgccgaggcctggcaggtcgcgaagaccgatctgtcgctgttcatgcggcagacgcccgacggctccctcgacggggtcctcgaatacgccacctcgctgttcgagcggggcaccgccgagcgcatgaccggccacttcctcaccctcctcgaacaggtggccgagcagcccgagaccccgctcggcgctctggagctgctctccgccgacgaacgccaccgcctcctcgtcgagtggaacgacacggccgaggacaccgacgaccgtacggtcttcgaacgcttcgaggagcaggcccgcagcgcccccgagcgcaccgccctgaccttcggcaccgagaccgtgacgtacggcgaactggacgccgcggccaaccggctggcgcagcacctgcgcacccgctgcgtgggcgccgagtcacgcgtcgcggtcctgctcgaccggggtcccgaactggtcaccgcgctgctcgcggtgtggaaggcgggcggcgcctatgtgccggtcgacccgtcctacccggccgagcgcatcgcggcgatgtgcgacacggcgggcgtacgcacggcggtgaccacctccgcgtacgcggcccgcttcacctcctccggcacccgcctgctgctcctggacacggacgccgacgacatcgccgggcgcccggccgccgcgcccgcccggaccagggacccgcgacggctcgcgtacaccatcttcacctcgggctcgaccggcacacccaagggcgtcgaggtcacccaccagggtctcgccaaccacgtcgcctgggcggcccgcgaactcgccgggcaggactacggcggcggcgccctgttctcctcggccgccttcgacctcgtcgtccccaacctgtgggcgccgctggtcaccgggcagcggctgttcctgctgccgcaggacaccgacatgtccgagctgggcaagcggctcgcggaggcccagccgttcagcttcgtcaagctgaccccgggccacctcgacatcctcgccctccagctcaccccggcccaggcgggcgcgctcgcgccggtgctggtggtggcgggcgaggcgttcacccgcgccaccctggagcgctggcgcgcactcgccccggacacccggctgatcaacgagtacgggccgaccgaggcgtccgtcggcacgacggtgtacgagattcccgagcatgccgacgccgacgtactgcccatcggacgcccgctgcccaacatgcgggtgtacgtcctcgacccggcgctccagcccgtcccggtcggggtcgccggcgagctgtacgtcggcggcacgggtgtggcgcgcggctacgcgaaccgccccgacctgacggccgaccgcttcctgcccgacccgtacggcaccggccccggcgcccgcatgtaccgcaccggcgacctggtccgccacctcccggacgggaacgtcgcgttcctcggccgggtcgacgaccaggtcaagatccgcggctatcgcgtcgaactcggcgagatccaggccgtgctgacagcgcaccccgccgtccgcgacgccgtcgtcaccgtgcaccggcccgagaacggcgaaccgacgctggccgcccacgtggtgcccgccgacgccgccgcgccgctgcccgacctcgccgcccactgcgccgcacgcctgcccgagtacatgatcccggccaccttcaccgcgctcgacacgatcccggtcaacgccaacggcaaggtcgaccgcagcgccctgcccgcgccgggacggaccgccgacgacgagagccatgtcgcacccagcggccccgtcgaggagcgcgtcgccgagatctggaccgaactgctcggcgtccaggccggagcacacgacaacttcttccacatcggcggcaattcgatcctcgcgatccgcctgatctcccacctccagcaggagttcgagatcgacttcgcggtccgcacggtcttcgagggaccgacggtcgcccgtatcgcggccaccgtcgaggagcgcgtcaccgcccagatcgccgcgctctccgacgccgacctcctcgacgacgcggcccgcaccgacaccacacacctcacgaacaacccagcgctgaaggagcaccaggca

SEQ ID NO: 3631 - DNA, 264 bp, Streptomyces avermitilis
  CDS (1)..(264)
gtgaccgcagaacagaccgcacagcaggccgcggaccagcccgcacagcaggccgcacagcagtccgagggccccgtccagcgggtcgtgttcaacgacgaggagcagtactcgctgtggcccgccgggcgtgacctgccggccggctggcacgccgagggcaccgagggcagccgcgaggagtgcctggcccggatcgccgaggtgtggaccgacatgcgcccgctgagcctgcgccggcacatgcacgagtcctccgcggcc

SEQ ID NO: 3632 - DNA, 1002 bp, Streptomyces avermitilis
  CDS (1)..(1002)
atgctgattctccggcgcgccgatgtgacggacgtcctgtccggccgggagacggagatcatcgacctcgtcgccgagacctaccggctgcacgacgaggggcagacgtccctgccgcactcgacgttcctgcgtttccccgaggagcaccacagccgggaccggatcatcggcctgccggcctaccggggcggtgagcggcccgtcgccggaatgaagtggatctcctccttccccggcaacgtggccgccggcaccgaccgggccagcgccgccgtcgtcctcaactccctcggcaacgggcacccggtggcgttcgtcgagggtgcggtgatctccgcgaagcgcaccgccgcgagcgcggcgctcgccgcccgggaactcaccgcggacaacccgcccgccgccgcgctgctgatcggctgcggtgtgatcaacctggagatcctgcgcttcctggccgccgccctgccggacctgcgcgaggccgccctgtacgacacggacccggcccgcgccgaggccttcgccgcacggtgcgccgaggaggtccccggggtgaaggcccgtccggtgaccgacctggccgccgcgctcggcgagcaccgcctcgtctccctcgccaccaccgccgcgaccccgcacatggacctgtcggcgtgcggcccggacaccaccgtgctgcacatctccctgcgggacctgaccgccgaggccgtcctcggggcggtcaacgtcgtcgacgacgccgaccacgtgtgccgcgagcgcacctccctcgacctcgcccagcaggccaccggcaaccgtgacttcgtcgccgccccgatcggcgccctgctgcgcggcacggccacgctccgccgcaccgcggaccggcccgtcgtctactccccgttcggtctgggcgtgctcgacctggcgctcgccgagttcgtgcgcgaggaggccgaccggcgcggcctcggcgtacgcgtcgaggacttcctgcccgcctttgcc

SEQ ID NO: 3633 - DNA, 798 bp, Streptomyces avermitilis
  CDS (1)..(798)
atgaccggtacggagtccgcggcggccgggggaccggtacgccagcaactgcccgaaggacccaccgtctggtgcaccaacgggcccgccgcggtggcgatgtggcgcgagatgcagccgcccggcgcctaccaccgggcggccgggcggctgcgggccggcgacaccctcctcgacatcggcgccaacgtcggcctcatgtcggtgcactgcgcccgcgcctgccccggcgtccgcgtcgtcgccgccgagcccgcccccgacctgcacgcctgtctgcgccgcaacctggccgaccacgcggcgcccggctggcaggcggagtgcgcggccgtctccgaccgccccggactcctgcgtttcacctactaccccgacgcgccgggcaactccggtctctacgccgacccgcgcgccgacgacgagatcaccctggccttcctgcgcaacagcggagtcgacgccgaggacgccgaggaactcgtcgaggggctgcacgagggcgtcgagttcaccgtgccggccgtcaccgcctccgacctggtccgccggcacggcatcgaacgcgtcgacctgctgaaggtcgacgtcgagcgggccgaactcgacgtgctgctcggcctcgaggaagcgcactggtccctcgtgcgcgccgtcgtcgccgaggtgcacgacgaggacggccgcctggccgccgtactccggctgctgcacgcccacggcttcaccgtcgacgtacgccaggagccgctgctcaagggcaccgcgctgtacgacgtcgaggccgaacgggccgta

SEQ ID NO: 3634 - DNA, 1338 bp, Streptomyces avermitilis
  CDS (1)..(1338)
atgtccaccggccaggaaggtctctggctcacccatcagctggacccggacagccccgcgtacaacgtggtcctcgcggtgcgcctgcgggaccgggtgcgcaccgaggtgctccaggaggcgctcaccgcgctcgtccgccggcacgaactgctgcgttcccgcttccccggcaccgagcagggcccggtgcgtgtcaccggcccggccgaggccgtacggctcgacgtgcgggaggtgccggacgccgacgacgagcggctcttcctgctggcccagcgcgccggcgaggagccgttccggatcgccgacgagggcgccttccgggcggtgctgctgcgccgggcccccgacgacgccgtcctcgtcacggccacccaccacatcgtcagcgacgccacctcgcagtggctgctggtccgtgacctgttcgccgagtacggggcgcgcacgggagtggagacgcccgacccgttgcccgtcggtaccgactgggaccaacaagtgcgtgcggagcgggagttcatcggatccccgcgcggcgcgcgggccgccgcgtactggcggcaggtgtgcgcggggctgaccgccgccaccctgcccaccgaccggcagcgcccgccgcagcgcaccctgaacggcgccaccgtcgagctggcgctgcccgagcgcaccgccgcccggctgcgggacgccgccgcgcgccatgcgctgaccccgttcgcctggctgctcggcacgttccagacggcgctgcaccgctccggggcgggagacggcttcctcatcggctgcccggtcaccacccgcttcaccccgcgcagcagggaagcggtcggctactacgtcaacgcccttcccatggcggccgtgttcggcccgacgaccacgcttctggagaccgcgcaggccgcacagcgccggctgcgcaccggtctcgcccacgcccgtcatcccgtcgagctcctggacacgacggccgggcgcgggccgctcttccgtatctcctgcaccctcgtcgccgccgaccggctgcccgtgccgggcctctacgagggacccgtccggctgggcgggctgcgcgccgaactgtgcgacgtgccgcagcaggagggccagctcgacctgaccgtcgaagtcctccaggacagccagggcttcaaggcggtcctgcgctacaacaccgacctgttcgacgcggccaccgtggagcgcttccgcgacacctggcaccgcctgatcgacgtctccctcgacgcgcccggcacccggaccgccgacgtggagctcgtcgcccaggacgacctgctcttcctgctcgccctcggaggcgtgtca

SEQ ID NO: 3635 - DNA, 981 bp, Streptomyces avermitilis
  CDS (1)..(981)
gtgcccgacaaaacgttcccaggcattctgtcaaccgtaggaaacaccccacttgtggaattggaaaggctgctgccggatttcggctcccgggtattcgggaagatcgagaggttcaatccgggcggcagcatcaaggaccgttccgccctcggcatgctgctcgccggcatccgcagcggcgaggtgcagcccggccgtaccgtgatcatcgagtccagctcgggcaatctggccgtcggactggcccagatctgccgctacttcggactgcgcttcatctgcgtggtcgacggcaagaccaccgagcagaacctcgccatcctcagcgcgttccgggccgaggtcgaggtcgtcaccgaacgcgacgagctgaccggcgagttcctgcccgtgcggctgcgccgggtgcgcgagctggtggccgcgacgccggacgcgtactggcccaaccagtacgcgagcctgctcaaccccaaggcgcacgagaccacgatgcgggagatcgaggagtccctcgacggtgcggtcgacttcctcttctgctcggtcagcaccttcggcacgctgcgcggctgccgtgaccacatcagggcccgcggcctggacaccacgatcgtcgcggtggacgccctgggcagcgcgatcttcggcctcgagtccacccagcggctcataccggggcacggcgcctccgtggtgccgcccctgatggacgcctcggcggccgacgaggtggtgcacatatccgatctggaatgcgtcgtcgcctgccgccggctcatcggtcgtgaagcggtcctcgcgggcggctcgtccggggcgaccgtcgccgcgctgtggaagatccggcaccgcattccggagggctcgaactgcgtcctcatattccccgacggcggcgaccgctatctcgacaccatctattccgacgcctgggtgaaccagaacttcggagacgtcgcacacctgtggaaggac

SEQ ID NO: 3636 - DNA, 264 bp, Streptomyces avermitilis
  CDS (1)..(264)
atgaccgagaccaccaccgccgtcacctccccggaggcgatccgatcctggctcaccgagcgcgtcgcctcctacctggagcgccccgccgccgacatcgacgctggcgcgcagctcgccgagctcggcctcgactcggtgtacgccctgtccttgtgcggcgacgtcgaggaccacttcggtctggtcgtcgagccgaccatggcctgggaccacccgacggtcgacgccatcaccgcgttcctggcggccgaactggccgcg

SEQ ID NO: 3637 - DNA, 1827 bp, Streptomyces avermitilis
  CDS (1)..(1827)
atgaccgacctgctgaccgccggcgccgccgacgcccccctcgaccccgccggtcccgacccggacctcgcccgcgtcgaccgtctcgaagccctcctcggcgacccggacgacgcggccaacccgctcgggctgcatgccgtgctcgccgccgacgaacgcggcgaactgctgcccgaaggggagcgcgcgctacgggacttcggcctcggggccgagttcgtgcccgcggcgtacggggggcgcttcgtgcgggccgaccggttcgcgctgctcatgcggagcctgttccggcgggactgcgccctcggcatcggtcatggcgtcaccagtttcatcgccggcctgcccgtctgggcggacggcagcgacacgcagcggtaccgggccgcgggcctgctgctcggcggcggccggatcgtcgccgcgtacaccgaactcgaccacggcagcgacttctcccgtgtctcgctcgccgcgcgccccgcgcccggcggcggctatctcctcgacggcggaaagcaactcgtcaacaacgtgggccgggccgaggcggcggtcgtgttcgcccgcaccgacgaacgccccggcagccgcggccactcccacctcctggtggacctcgacgcgctgcccgccgaccgggtggaccgcaccgcccgctacgccacctcaggggtacggggctgtctgctcggcggcgtcgacttcgacgcctgcccggtccccgccgacgcgctgctcggcaccgagggcggtgccatggagaccgtgctcaaggtcttccaggtgacccgcagcgtgttgcccggcatggtcgtcggggtcggtgacacccagctgcgcgcggtgctcgacttcgccggacagcggctgctgtacgggcagcccatgcacgaactgcccgaggtgcgctccgcgctgaccggcgccttcctcgacctgctgatctgtgacgcgctgtccgtcgtcggcgcccggtcgctgcacctgctgcccgcggaggccagtgtgcggtcggcggccgtgaagtatctggtgccccggttcctccaggacagctcctaccggctcggcgtgctcctcggagcccgcagctacctccgcgaagggccgtacgccgtcttccagaaggccgctcgtgaccttccggtcgtcgccctcgcgcacgccagtggcgcggtgtgcctctccaccatcgtgccgcagctgccgcggctcgccgagcgcgcctggcagcccgcgctgcgcggggacgcctcgttccaggaggcgccgcggacgctgttccgcctccacgagccgctgcccgccctcgacttcggccgcctggagctgaccgcgcgcggcgccgacagcctcgccggccacctccccgtcctcgcccgtgagctggccgaagaggcccggtcccggccggagctcgccgaactcgccgacctggccggcctgttcgcgcgggaactggacgaactcgcccggcgctcggtcgccctgccgccgcgcgaccgcaccccggtcgcgggccgccgcgccttcctgctggcccagcggtacgccctgctgctcgcggccgccgcctgcctcggcgtctggcgtgcggcgacgccctccgacggcttcgtcgccgacccgctctgggccgcctcggcgctgcaccggctggccgagcggctcggcctgcgccgggggccgctgcccgagcccgccgtccggcagctgttcgcggagctcgccgagcggcacgagaccggccgcaccctcgatctgttccgcggccggctcgcccgccgggccgccccctcccatggagtccaaggagccatc

SEQ ID NO: 3638 - DNA, 3783 bp, Streptomyces avermitilis
  CDS (1)..(3783)
gtgccgcatagcggggggcggttgcctggggttccgtaccgctgctgggcgagcgcggctccgagaagccgcagagggtgggtagttggggtgtccggcttcgagagcttcgtcagcgcgctgcgccacagggtcgcggacacgccgacccgcagcgccgtccgcttcagcgcgggcgcggccgaggaggacgtgacgtacgcggccctggaccgtgccgtacgcgccgccgcgcacgcgctcggcgatcgcgtcacgcccggggaccgggtactggtctcctgcgggcccggcaccggctttctccgggccttcctggcctgcctctacgtgggcgccgtgcccgttccggtgcccgtgcccggggggttcgggcggcaggaggcccgtacgaccgcgatcgccggggacaccggggcccgcctggtcctcaccgacgaggcgagcgcgggcgcggtgcgccgctggctggacggcgagcgggacgcgctgcccgaactgaccgtcgccaccgtggagtcggcgcaggaggcgggcgacgcggacgcgtggcacgagtggcccgtcgggccggaggcactctgcttcctccagtacacgtccgggtcgaccagtgagccgaagggcgtgatggtgccgcacggcgccctcgtgcacaacctgcggctgatgcgcgactgccacggctggcacggcggcatgacctggtgcagctggctgcccgcgtaccacgacatgggcctgatcgcgatgatgctcgccccgctttatctgggcggcacggccgtgctgatgtcgtccaccgacttcctcaagcggcccgtctcctggctgcggctgatcgagcggcaccgcgccgagatcagctgcgccccgaacttcgcgtacgacctgtgcgcgcgccgtctgaccgaggagcagaccgccggcctcgacctgtcgagctggcggtacgcctgcaacggcgccgagcccgtcgacgccgcgaccctcacccggttcgcggagcgcttcgcgggcgcgggcttctcggcgcggtccctgctgccggggtacgggctcgccgaggccaccctctatgtctccggcacccgggccgaccggccgccggtcgtgcttcgcgccgacccctcggcactggccggcggcgaggtcgccgaggccgaaccgggctccaccgcacaggagttggtgagcagcggcatcgtgcgcggcctcgatgtgcgcgtcgtggaccccgggacgcgggccgaactgtccgaggggcgggtcggtgagatctggatccgcggcgggagtgtcgccctcgggtactggaaccgggccgaggagacccggcggaccttcggcgcggcgacggccgacggtgacacgggcttcctgcgcaccggtgacctcggagcgctgcgcgccggcgagctgtatgtgaccggccgcatcaaggaaatgatcatcgtgcacggccggaacctgtatccgcacgacatcgaacgcgaactgcgcgacctcgcaccggccttcgccgacctgcccgccgccgtcttcgcggtgcggcccgggggcgcccacgcgccggaggagatcgtcgccgtccaggaggtgcgcggccgggggctgtccggggaggaactggccgctctggcccgcaccgcgcgcgccgggctcgcccggcggctcggggtacgggtcgggggcgtcgccctcgtcaaggcgggccggatccggcgcaccacgagcggcaagatccaacgcaccctgatgcgcggcctcttcgagggcggcgaactccagcccctgcacgaggaactggcaccggaactcgcgacggcctttcggagcggcgggcggacgcgggagacgccatccacgtcatcgacaccatccacgccaacgacaccatccacgcgatcgacgccgtccgccgagcccgcagcgcccgccggcggccggagtgcgtacgagttggccgggtcggtcggtgggggtgtgggtgcggggggctgggatccgtatgcgctcagtcgggagctggaagtgcggctcggggatccccgggacgggagcgcggagttctccttccggcgcagcgcggaactcgaccgcgccgaggagttccccgccgcgatctgccgggagctggacgccctgggcgtgccgcgctggttcgcgcccgcccggtacggcggtgaactgcgcggcagtgaggagctgttgcagctgatccggacgctgggccggcgtgacttcaccgtcgccctcggccatgtcaagacctacctgggtgccgtctccgtctgggtcgcgggccggcccgagcaggccgcggcgctcgcggcgcgggtgacggccggtgccgtggtctcgctggcggcaaccgagcgcgcccacggcagcgacctgctcgcgggcgagctgcgggccgggcggacgccccgcggctggcggctcgacggcgagaagtggctgatcaacaacgcgacgcgggccgaactggtctgcgtcctcgcccgcaccgacgaggcgggcggcagccgcggcttcagtctcttcctcgtcgacaaggcacggctcgcgccggacagctggcgcccgctggccggcgtaccgacgcacggcgtgcgcggcgccgacatcagcggcatcgccttcaccggcgccgagctgcccgaggacgcgctgatcggcgccgagggcgagggactggagatcatcctcaagggcttccagatcacccgcacgctctgctcggcgatgtcgctcggcatgaccgaccacgcactgcgcatcgccctggacttcgcccgcacccacctcctctaccggcgcccgctcgccgaactcccgcacgccgcccggaccttggcggagagctacgccgacctgctcgccatggaggccgtcagcctcgtcgcgacccgctccctgcacaccctcaccgaggagcagagcgcggtctccgccgtggtcaagtacctggtgccgaccctcggcgacgaggtcgtcggagagctgcgcggactgctcggcgcccgggcgatgctcaccgaggacttcgccgacggagccttccagaaggtggagcgcgaccaccgcatcgtcggcatcttcgacgggagcacggcggtcaacctcaactccctgatcaaccagttccccgtgctcacccgcgggtaccgcaagggactcgccgaccgggacgcggtcgccgcggccgcccgcctcgacgggccgacgcccgagctcgaccacggccggctcacgctctacgcacgctccggctccagcgtcgtacagtccctgccggacgccgtggagcgcgcccgggccacggcgccgccggccgtcgtggcgcgcgccgagcagctcctcgccctcgccgacgaggtgcacggggaactcgccgcccaccggcacagcgcccgcgcggtaccggagacggccttcgcctcggcccgccgctacgccctggtgtacgcgggcgcggcgagcctgcacctgtggctggagaacgcgggcaccgcacgcgcgagggggccgttgtgggccgacgcggcgtggctggacgcggtgctggccaggctgctgcgccggctcaccggcacggccgacctcgacgacgccgacggccctgccctggaccggctgctgcccgcgctgcacgcgcagttcgaggagggggcgctgttctcgctgctgccgtgcccgctgggggagggccgcccggccgcggtgcccccggtccgcatccccaccgtcacgacggccacgaccaaggagccggta

SEQ ID NO: 3639 - DNA, 723 bp, Streptomyces avermitilis
  CDS (1)..(723)
gtgcgcgcggggcgccgtcgcaggcggcccccgcgcttctacttctccctgcgcagcccgtactcctggctcgcctaccgggacctgctcgaccggtatccggccacggccgcggccgtggagtgggtgccgttcttcgagccggacgagctgagccgcaagctgctcgccgaggcggggggagcgttcccgtacacgccgatgtccccggagaagcaccggtacatccttcaggacgtacggcggctggcgggcgagcgggggctggagttcacctggccggtggaccgcgagcccgtctgggaggtgccgcacctcggctacctggccgccgcccggcacggggtgggagcgcaatacatcgcgctggccgcgcgggcccgctgggagctgggcctggacatctgcgaccggaccgtgatcgccggcttcgccgcggaactcggtctggacgccgaggaactggccaccgcgtccgacgactcggggcttcgcgcggagggtgtgcgggtgcttctggagattcagcgcgacggggtgttcggcgtgccgttcttcgtcgaccacttcgacaagtactggggcgtcgaccgcctcccggccttcgccgcggcgctcgcggccaagaccgccgccgacctcacgggggtcccggacgactccggggacccccttcccgtacccgcggcgtccgtcgacgacggtcacgcgggcgggtgcggc

SEQ ID NO: 3640 - DNA, 939 bp, Streptomyces avermitilis
  CDS (1)..(939)
atgtccgaacagagcaggtccacgccgggtgacaaggtcgcgccgggtgacaaggtcgcgccgggcgaccaggccgcgccgggtgacaaggtcgcgccgggtgacaaggtcgcgccgggtgacaaggtcgcgccgggcgacaaggtcgcgccgggcgacaaggccgcgccgggcgacaaggtcgcgccgggcgaccaggccgcgccgggcgacaaggtcgcgctggtcaccggaggttcgcggggtatcggccgcgcggtcgtcgcgcggctggcgagcgacggctacgacatcggcttctgctaccgctccgacgaccaggcggcggccctggtggagaaggaggtgcgcgagctgggccgccgggtgctgtcccggcgcgtggacgtgacggaccgtacgcaggtacgggagttcgtcaccgcggccgaggaggaactcggccccgcctcggcggtggtcacctcggccggcatcacccgcgacagcccgctggtcctgatgccggacgaggactgggacgcggtgctgcgcaccaacctggacggcacctacaacctgtgccgtgcggtggccttcccgatgatcaagcggggcggcggggccgtggtcacgctctcctcggtggccggggtcgcgggcaacgcgggccagaccaactactccgcgtcgaagtccgggatcatcggcttcacccggtcgctcgccaaggagggcggccggcacgggatacgcgccaactcggtggccccgggcttcatcgacaccgacatgacctcggagctgccgccgaaggtggccaaggagatgctgggccggattccgctgaagcggttcgggcgaccggaggacgtggcggccctggtcgccttcctgctctcgtccgaggccgcgtacatcaccgggcaggtgttccaggtggacggcggtatcgcgctg

SEQ ID NO: 3641 - DNA, 495 bp, Streptomyces avermitilis
  CDS (1)..(495)
gtgcacggcatcgaccggatcaagaacaccattccgcaccgcggggagatcctgctggtggaccgggtcgcggacgtggtgcccggaacgcggctgaccgcgtacaaggcggtctccggcaacgagccctgctacgcgccgctcggccaggacgccgccccggccgactacgcgtatccgacctcgctcgtcatcgagtcgtgggcccagtccgcggtgctgctctcggtgtgggagaaccccaatccggacgtgctcgccgggaaggtcgagctggccggttccatcggagatgcggtcatcggagagcgcgcctatccgggggacgtcctcgagcaccgggtgcgcctggtgaagtccgtggacgagacggcgatcctcgccggcgagacgctcgccggcggccgtgaggtgctgcggatcggatcgttcgtggtggcgctgcgggacgtcaccgagctgcttccggcgcccgaccgtgccctgctgagtgtg

SEQ ID NO: 3642 - DNA, 462 bp, Streptomyces avermitilis
  CDS (1)..(462)
atgagcgccgcgacgccgctgggcgacctggagctgatccgtaccggtccctcgggcgccgtcaccgccttcgacgccccggtggacgggcccgtcatcgccgggcactatcccggcttccccgtgctgcccggcgtgttcctcatcgaggcggcggaccgcacggtgcgccagtgggccaaggacaacggccgcgcccaggacgacggcgccgaccccggcagcggtgcggacagcggtacggccggcaccgcggacagcggtacggagctggagctggccgccatggaccgctgccgcttccaccgtcccgtctaccccggcgaccgggtgctcgccgacgtgtccgtcgtggacaacgccgccgggctgctcttcaaggccgccgtggccaccaaccgcgggaaggtcgccgacatccggctgcgctaccgcgcgaagcaggaagaagaggaaaccccg

SEQ ID NO: 3643 - DNA, 261 bp, Streptomyces avermitilis
  CDS (1)..(261)
atgcccgagaccaccaccaccgcgctcgacaaggaacagctgcgcgaactggtcgccgatgtgctcgacctggatgtcgcggaggtcaccgacgacgccgacttcatggaggacctggacgtcgactcgctgatggccctggagatcaccgtgcggctggagaaggaatacggggtacggctcgccgaggccgagctgacctcgatcacctcgctgcagggcacgtacgaactgctgacgagcaagctcggggacacccga

SEQ ID NO: 3644 - DNA, 1116 bp, Streptomyces avermitilis
  CDS (1)..(1116)
atgagtgtcagtcttgccaccggggcggacccggacaccctggtcgtctccggctggtcggccgcgtcgccgtacggactcggcgccgaggccttcgccgcgggggtgctcggggacgtcgacgcggtgcgcggcgcggacgacgccacggacctcggaccctacgaacgggccggccgcgtaccggacttcgcggcgaaggcggtcctcggccgcaagggcacccgggccatggaccgggccaccgcgctcgccgtcgccaccgcgggactgctcctggaggaggccggtcccggtctggcccaggacgccccggaggccgtgggcatggtgctcggcaccggacacggcagcgtgcagagcatcatggacttcacccgggactccctgaccggcgacaagccgttccacgtcgacccggccctgttccccaacaccgtgatgaaccgcgcggccggccagagcgccatctggcacacgctccgcggccccaacaccacggtggcgggcggtgccgcgaccggtctgctggctctcaactacgcggcccggctgctgcggcagcggcactgcgaggccgtgctgtgcggcgcggtcgaggagttctcgaccgcgcgcgcctggctggagtaccgggcgcgcaccggcggcccgcaccggcagccggccgggccgctcggcgagggctgcgcgctgttcctgctcgaatcgctcggccgggcccgcgcccacggccgtacaccgctcgcttcactgctcgccgcccggttcatcgccttcaccgaccaggagcgggccaaggacgcggtcgcccggtcggtcaccgaggcgctcaagaacgccgaggtacggcccgaggaggtcgccctgctggtgccgtcggacagcggcggcgagctcggcgcccgcgaggacgcggcgctcgccgacctcttcggagaacaccggccgccgcggctgcggctgcgcaggctgaccggcgacctgggcgcggcctcggcgtcgatgcagctcgccgccgccgtcgcggccggcggcgagggcaccccggtgctcgtcacctccgtcgacccggacggccagaccggtgcggtcgtgctgcgtaccggtacgccg

SEQ ID NO: 3645 - DNA, 813 bp, Streptomyces avermitilis
  CDS (1)..(813)
atgctgaagtcgcttgaggggagctggtgcctggtcctcggggcgtccagcgggatcggccgggccatcgcgctcggtctggccagggaaggcgtgcacgtcgccggggtgcacttcgacacggcggcgcgcgccgaggaggtcgaggcgctcgtcgaggagatccggagcctcggcgtcgaggcccgcttcttcaacacgaacgccgcctccaaggccacccgtgccgaactcgtcccgcaactggccgagttgaccggcgccaacggtggcatccggatcctggtccactcgctggccttcggcaccctggtcccgttcacgccgagggagggctgggaccggccgatcagcgtacggcagctggagatgaccctcgatgtgatggcccacagcctcgtctactggacccaggacctgctcgccgcggggctgctgcgcagcggttcgaaggtctacgccatgaccagtgcgggcacctcccagcatctgcccagctacggtgccgtctccgccgccaagagtgccctggagtcccatgtccggcagctcgcggccgagttggcgaccagcggcatcgcggtgaacgcgctgcgcgccggcaccaccgtcactcccgccctgcaacgcatcccggagcacgccggctacatcgagcgcgccgccgagaacaacccgcacggccgcctcacccgccccgacgacgtcgcggacgccgtcgcgctgctctcccgcaccgagtcgtcctggctgaccggcaacaccatcggcatcgacgggggcgaactgcacgccgccgccggggcgtggggc

SEQ ID NO: 3646 - DNA, 1110 bp, Streptomyces avermitilis
  CDS (1)..(1110)
gtgaccggggtccggggtcgtctctccctggggggacacggccgaggtcgccgcggcggcgggcggggcggcgatgcccggcgccgagaggtggttcgaccaccgggagcggctggggcccgcgcggatacaaagtaccttccggccgccgcccagtacgccctggccgccgcgcgggccgcgctcgccgacggcggacggcccgacgcggtccccgccgaccgccgcgggctgctgctcgccaccggcgcggggctcgcctcgctcttcgacgccatggacgcgaccgtcgccgaggacggcggcgcggcacatctgtcgcccgccacggccccctacttcgcggtcaacgtcctcggcaaccggctcgccgccgaactcgaactgaagggcttcgccctcacggtcgccaccgcccgcacggccgccgcggacgcgctgtccacgggggcgctcgcgctggccgccggccgctgcgacacgcttgtgctggcggcggccgaggagccgctgccggcggtgcgcggcggcggtggtgagcagggcgccgccgcgttcacgctggagcccctcgcggcggcgcgggcccgcggcgcccgggtgcacggcacactgcgggcccgctccctgttcgtaccgccgggcgcgctgcgcgacagcgcgggccgggagcgggccgccgcctatctgtcggaggcgctcgcggacctgctcctcggcccggcgggcgggccgcccgtccccgtgagccgcgacctcgacctcgaccccgaccccgacctcgacctcgtcctcgtcctcgacgagtccgccgtcggcgaggcggtggcgctcgccgtcgccggtgcggcgcccggtgccggcctgcccgccaccggcccccggctccccatgccctcgggggcacccgagatcgcacaccccccgggcactccgcgggtcggctgtctcggtcccgcgttcgccctcgctcacgccgtcacctcgccggacggccccgaccggctcgtcgtctgcgccaccggcgccggacacgtcgccctcgtccgggtctcgcccgcccgtccgtcccgcctcaccacacaggagccatcgcatgctgaagtcgct

SEQ ID NO: 3647 - DNA, 1317 bp, Streptomyces avermitilis
  CDS (1)..(1317)
gtggtcaccgggatcggcgccgtcacctgccacggtgcgggcgccgacaccctgtggcgggccatgacggcggccgggacccggctgccggaccggccggcggacccgctcgcccggatggacctgccgctgatcagcctggtgcccgaccccgacctcagggccgagcgggcgacccgcttcgcctcgctcgccgccgccgaggcgctgtccgacgccggactcgacggaccgtcactcgccgccgcccgtacggccgtcgtgttcggcagctgcatgggcgagcccggcggcaacgagcgcgggcggggcgcggacgacggctggcagccgccgttccggctcgcctcggcgctcgccggtgaactcggtctgttcgccaccgtccacgacatcggcaacgcctgcgcggccggcggctacgccctcggcatcgcggcggacctggtgcgcgcgggcgaggcggacgtggtgatcgccggtggttccgacgcgtactcgcgggtcgcgctcggctgcttcaaccggctcggcgcggtcgaccccgagcgctgccggcccttcgaacgcgaccgggccggcacggtgttcggcgagggcgcgggcgtgttcgtcgtcgagtcggccgcgcacgcccgggcgcgcggcgtgctgtcctcgccggacggggcgccgcgactcaccggtgtggcatggagctgcgacgcggaccatccgacggctccgcaggccgacgcggagcaggtcgtacgggccatgcgcgaggccctgggcgcggcgccggacacggtcggctgcgtcgtaccgcacggcaccggcacccggctcaacgacgtcctcgagagccgtgcgctgcaccgggccctcgggccgcgcgcggcgcgggtgccgctgtacagcctcaaggcactgctcggccacacgggcggggcgtccgccgcgctcggcgcggtcgcggccgcgctgatcctgcggcacggcgaggtcccgccgaacgtgccgctcaaggagcaggaccccgagtgcgaggtgctgctgccgcagggcgacgcggtaccgctcgccgacggagcccgccgggtgctggtcaacgcgtacggcttcggcggcaacaacgcgtcgctggtgctggagagcgggacacccacggggccctccgggggctcggcggctggggagcgggcgggcgccgcgtccgggggcggggtgggttccgtgtccggcgggtcgggctcggcgggcggcggggcggtggtggggcccggtggtgggtcgggaggcgtggttcggcggacggtggagggtggtggggtgtcg

SEQ ID NO: 3648 - DNA, 981 bp, Streptomyces avermitilis
  CDS (1)..(981)
gtgaccacgaacaccgctgacacggctgacatcgaggccgcggtcctcgccctgaaggagcccagctccctggagatccgcccccgctacgagggctccaacatctgcacctggatcggcttcaagcacgtcaactacctcgtcgaggaagccgttctcaaccatctgcggcaggccgggatcgccccgggcacggtctacgagacctacggactgtgcacggacatcgtcgacatcgacacccgcatcctgcacgccttccacatcgacgacaccgcgatcgccgaggtgaagccgcaccgcaaggccaaggacggcgaactggtcctcgccgtcacgctccatgtgcggcgcgagaccctgctgaaggccgtcacctcgaccgtacgggtccagctgcgcctcgacccgcgcggcggcggcgaactgcccgtcccggccgcgctcgcgccgttcgcggtggaccggctcggcgcggtgcccggctggaccccggaacccgtcgaggtggacctcgcggccgacgacctggtcaaggagctgacggccgggcgcaacgcgtacgcctggaagttccgtatcccctactggtactgccacttcacggagcgccagcagatgtccggctatctgcggctcatggaggaggccaaggaccggctcgtcgccgaccggggcgtctccatcaagaccctgctcgacgagcagaactggatcccggtcgtgccgcactcgcgcatcacggtgctcgacgaggcgcgcatggaggaggacctgtatgtcgtcctcaccgtcgagagcgtcttcaagggcttcacgtacgactcgcgcatggacacgtacgtcgtacgcgacgggcagctggtgcagaccgcgaccgggcggatcacccacggctacgcggtgatcgagaaccgccgcgactggagcctggtctccttcgacgaccgcatgaacgcggccctggagggccgttcggca

SEQ ID NO: 3649 - DNA, 723 bp, Streptomyces avermitilis
  CDS (1)..(723)
gtgctgccctggagcgcggacggcgaccccgactggagtctgcgcgacgacccggcggaccatgtggagcacgccctggacagcgtgcccggcggtgccgacgtgatcgtcgtgcactccttcaccgcgggaccggccctggaggcactcgcccgccggggcgcgggacgcgggccgcgcgccgcggtggtggtggcccccttccaccggcgcacgcccggggagttcacctgggacgacgccacctactacctgagcggcttccaccgcatcctcgacgagggcctgcggatcagcgcgggggaccgcctcgccccgcagctgcgcgccgcgatggcgctgcgggtgcgggaccggatcgggccgtacggctggcagcagttcttcggcgcgtatctgcgcagccccttcctcgacgtcggcgcgctgcggctgccggtgctcgtcgtggcggggacgcaggacttcgcggcgccgccggacgacgcccgcgcgctggccgccgcgctgcccgacggcaggttccggctcttcgacggctgcggccacttcgccatggcggagcagccggaccgcttcgcggacgcggtgcacgggctgctgcacgaggtcttcgccggcacctccccgcacccttcggaccacccttccgaccagctttccgacgagctttccgagcacctttccgtccatccctacgccccctacgcaccggagttgacg

SEQ ID NO: 3650 - DNA, 1083 bp, Streptomyces avermitilis
  CDS (1)..(1083)
gtgagtaccgcgcgcacggcggacgtcgtgatcaccggaatcggtacggccgtacggggcctcgacggcccggcggccctgttcggacccctgcccgccgggcaccggtcggcggccgaccccgtctcccgcctcaccgggcgcggcctgcgctacaaggaccgggccaccaagctcgccatggccgcggccaaggacgcgctgcgcgcggccgaactggtcgacgcggccggtgagctgacggtgtcgggggaggccaccggggtcgtcgccagcaccaactacggcaacgccgacacggtctgcgagaccgtgcggacgatcgccgaatcgacctatctggcgaccagcccgatgctgctgcccgccacctccagcaacgtggtcgcctcctggctggccatcacccacgggttgcgcggggccaatctgaccctgtgcaacgggcccacctccggtctcgacgccgtcaactgggcccgcctgctgatcgcggcgggccgggtcgagcgggtgctcgtggccggcgtcgagccggacaacccggcggtgcgccatgtcacggacgccgcggaggcctcggaccatgaggcgtacggagagttcggcgcgccggtgctcttcgacggagcggtggcactggtcgtcgagtcgccctcctcggcacacgcgaggggagtgcggccgctggccgccatcggcccgtacgcccgccggggcgaccacgcggaggccgtcgccgaggtccgggcgctgcgtccggggccggtcggcctgtggtgcgtgcccgaacacccggagggcgtacgcgcccccgcgccggccctcggcgcggcggccggctccgcccccgtccacgacctgtccgcactgttcggtccctcgtccggtgcgctcggtgtgctccagtgcgccgcggccgccgtctggctggacaccggacccggggacggcgaggtggcgctggtcagcgcgggcaccggcgacgcgggcggcgacgacgcgggcgcggccctgatcctcaccgcacccggtgccgtcgcggcggtcgcggcggcaccccggccggcgggcggcgtgcga

SEQ ID NO: 3651 - DNA, 1161 bp, Streptomyces avermitilis
  CDS (1)..(1161)
atgggcgccgtcgccagcatcggcgacagcgtcgaggagatcttcggttcgctggtcgagggccgcagcgggctcgcaccgctgcggggctacgaccgcgacaacttccgtgcgcaggtcgcgtacgagatcgacgaccgtcctgcgccgggcgtcgacgagccgctgcgggccacccgctggctggagcgggccgtcgccgcggcggcggccgacgccgggctcggcgacgacctgtcgcgggtgccggtgctcgtcggcaccaccctgcgcgaactgcgctcggtggagctgtcctggcgggacggcatccccttcgacgccgccgatctgcacttcggcaccatgctgcggcgccgcttcggggccgtcgacacccacaccgtcgccaacgcctgctcggcctcgctctacgccctggccctcggcgccgacctgctcgacctcggcgcggcggacaccgtcgtcgtcgccggggtcgacaccatcaccgagagcacgtacgggctcctcgaccgctgctaccccgaagcccccgaccgcgtacggcccttcgaccgggcccggcgcggaatgctccagggcgagggcgcggtggccgtggtgctgcgcagggaggccgacggcccgggacccggtgcccgtgtccatacgcgggtgcggggagtcgccgtcaactgcgacgcccatcacccgtcggcacccgacgccaagaacatcgccgccgccgtccaggaggcgcatctgcgggccggcgtacggccggcggacatcgacctggtcatgctgcacgggaccgggaccccgctgaacgacgaggccgaatccaccgcgctcggcacggtgttcgggggcctcgacccctccccgtacatgaccgcgatcaagtcgatgaccgggcacaccgccggggcgtcggggctgcacagcctggtggcggccgtcgacgtgctgcggaccgggaccatcccgccgaccgtgtacctcgacgacccggtcgaggccgtcgcgggcttccgcctggtgcggggcaccgccgagcgggcttcggcgccgctgcggatcgcccagatcgactcgttcgggttcggcgggctcaacgcggtcgcggtcgtggagcgggtcgacggcccgccggcctccgaagaaggagcgggccag

SEQ ID NO: 3652 - DNA, 1284 bp, Streptomyces avermitilis
  CDS (1)..(1284)
atgaacgcttcgatcaacacagacgcgcgcggtcacggcggacccgaggacccgcgccccgaggccgccggacgccgggtggtcatcaccgggctcggcgtggtcaccagcatcggcatcggtgtcgaggccttcaccgccggcctccgtgcgggacgcagcggcgtcaagccgatcaccgcgttcgacacgaccgggttcgcccacgccaacggctgcgaggtcaccgacttcgagccggagcgctggctcgaccggcagcaccccgaggaactgggccgggcgagccagttcgcggtggccgccgccaggatggcggtcgcggacgccggtctgcacgaggaggacgtgcgggcccgccggtccctggtgtccgtcggcaccacggacggcgagtcccgcgacctcgaccaactcgtcgccgcgggcctggagaacgggcccgaagagtacgaaccggccgtcgcccggcgcatccccgccgggcgcctgtccgccggcatcgtccgcgagctggaactcgaggacgtggaggccgtcacgatcccgaccgcgtgcgcggcgggcaactacgcggtcggctacggctacgacgcgctgcgcagcggcgatgtcgacatcgccctgtgcggcggcgccgacgccgcctgccgcaagacgttcaccggtttctaccggctcggcaccatcgcccccgaggtgtgccggcccttcgacaaggaccgcgagggcatcctcaccggcgagggagcgggcatcctcctgatggagagtctcgactcggcgctcgcccgcggtgcccggatctacgccgaggtgctcgggtacgggctcgcctgcgacgcgctgcaccccgtcgcccccgaccgggacagcatcgcgcggaccatccggatcgcgcaccgcaacgcgggcatcaccccggaccaggtcgacttcgtctccgcgcacggcaccggcaccaaggccaacgacatcaccgaggcgggcgccatccgccaggtgttcggcgaggacgccatgccgcgcaccgtctccatcaagtcgatgatcggccacagcatgggcgcggccagcgcggtctccgcggcggcctgcgcgctggcgatcaccgagggcttcatcccgccgacggtcaaccaccgggagaccgaccccgagtgcggtgtcgactgcgtgcccaaccaggcggtcgagacggaactgtccgtcgtgcagaacaacgccctcgccttcggcggcaacaacgccgtactgatcctcggggcctaccggagcgcggca

SEQ ID NO: 3653 - DNA, 252 bp, Streptomyces avermitilis
  CDS (1)..(252)
gtgacgaccggacttgacgctgcccgcaagcaggagatcaaggagatcgtctgcgacattctcgagatcgacgaggacgaggtcaccgagaccagcctcttcaaggagcagcacgacgcggactcgctccgcgccatcgagatcctcgccgccctcgagcgcacccagaaggtcaccatcgaccaggccgagctcagccgcatggtcaacctggagggcgtctacgtcgtggtgtccgaagccgcacagaac

SEQ ID NO: 3654 - DNA, 1011 bp, Streptomyces avermitilis
  CDS (1)..(1011)
atgctggaaccgctggggctgggcgctcatgcggccgaggtctaccgggccatgctcaagcggccggatttcggcgtggaagatctggtcacctcgctgggctgggagcaggatctggtccgctccgcgctcgacgagtgtgtccgtctctcgctgatcaaaccttcgtgggacgcgcccggagggctgcgggcggtgagtccggagatcgggctgcaagcgcttctcgcgcggcaggaaagtgaattcctggagcgccagcagcgcatcgccgagtcgcggatagaagtggcccgcttcgtcgacgagtacaccgcggcccagcagaaactgcgcagcaccgtcgtcgaacgtctcgtgggaatagacgacatccgctcccgcatagaggaattcacgcaggaatgcggcacggagctgctgacctttgcgaccggaggcccgcagtccgaagccagccggcaggccagccgcccgctctgtgaggatctggccaagcggggcgtggtcatgcggagtatttatctggacagcgtccacaacgaccccgcgacggtggaacatctgcggtggctgcacctccacggcgaccaggtgagaaccaccgcctcgctgccgtcccggatgctgctgttcgaccgcacccacgccgtactgcccatcgaccccgacgcctcggcggccggggcgctcgtcctgcgcggcgcgggcgtcatcgccaccctcggcgatctcttcgaccgggtctgggagtccgccatcccgttcagcggcggccggccgcagccccgggaccgcggggaggaggagctgacgggacaggagcaggccgtactgcggctgctcggcgaaggactcacggacgaggtcgtcgcccgcaagctcggtgtctccgtgcgcaccgggcgccgtatcaccgccgaactcatgggccggctcggcgcccgcagccgcttccaggcggggctgcgggccgctcagctcggctggctgacgggatccgacaccgta

SEQ ID NO: 3655 - DNA, 1347 bp, Streptomyces avermitilis
  CDS (1)..(1347)
gtgagcagcagcggcctcatctacgcagtcatcgtcggggcctgggccgcctacttggtgccgatgtggctccgtaggcaggacgagctgaacgaggcccgtccgacggaacgcttcagcaccgccatccggctgctgtccggacgggcgggcatggagcgccgatacgccaaggacctgcaggcgcgctccgccgaggagggggagcccagcgccgacccggacgccgtcaccgactcggtggacgtccgggccttcgccatgccgccgaccaggccgcgggtgcagacccgggtcgatccggcggccccggcggagcccccgtcggcaggagcttccgtaccggctcccgcgtccggccacaggccggcgtcgaagtcggtcccgagtccccaggcgcacgcacaggcacaggcgcacgcacaggaacaggcacaggcccacgcacaggcgcaggcccggtcgggggcaggcgcgggagcgcagtcgccgtccgtgccgccctcccaggccgtgccgcaacagacggccaggtccgcgtcggccgcgcggcgggcggcctcggcggaggccgccgcgcgggcccggcgctcgaaggtgctggcgcgccggcggcgtacgaccatgatgctgttcctcgccttcacgctcggcgcgatcgtcgccgcggtcggcggcctcgcgttcctgtgggcgcccggggtgccggcggtgctgctgagcgggtacatcgcgtatctgcgggcgcaggagcgcaagcggttcacgtacacgatggaccggcggcgggcggagctggcggcgcagcggttgcgggagcggcagccgcgtcggcgggcgtccgtcgaggcggacggcgacgagccggaggacggaccagagccgcagagcgaccccggtctgtccgcgctcgcggcggaccgccgggcgctcgtcgagcagaccgaccacgcggagtgggtcgaccagcagcgcgagcggcagcgccggccgggccacggcgacagctgggacccggtgccggtgccgctgccgacgtatgtcaccgcgccggtcgctccgcgggccacgccgagcgtggatctcggggcgccggacgcgtggagttcggcacggtcgtccagtgcggtggagcccggggcggcggcgcgggagcgcgagccgggtccgggcaccgatgcggggtccgcgccaggtgatcccggcgcggaggaacaggcggacgccgcggacgacgggcgcagcgacgcccgccgtgcggcctccgcccgtcgggcccgggagcgtgggcgtacgccgctcttcgaccagtacgaggacggggaacggccgcgcgcggccaacgag

SEQ ID NO: 3656 - DNA, 468 bp, Streptomyces avermitilis
  CDS (1)..(468)
atggtccgccatctgcgcgcggaggccgccgcgggccggatgctgcccttcgtcatcgagtaccagggccggctcgtcgggcagttgacggtcgccgggatcacctggggctcgatgtgctcggggcacgtcggctactgggtggacgaagcggtcgcgggccgcggggtgatgccgacggccgtcgggctcgtggtcgaccactgcttccggaccgtgggcctgcaccgcatcgaggtctgcattcgcccggagaacgggcccagccgccgggtggtggagaaactcggattccgttcggaggggctgcgtccgcgttatctccacatcgacggcgcctggcgcgaccacctcgtcttcgcgctcaccgccgaggaagtgccggaggggctcctcgcccggtggcgaagggcgcgtgagcagcaggcacgccgacaggaccccagcaagccgggcaacgccagcaaa

SEQ ID NO: 3657 - DNA, 537 bp, Streptomyces avermitilis
  CDS (1)..(537)
atgacgcggcccgccgagccgtcgatcggcggtgcactgaccgcctcgtacagcgccctggtcgtcacggcctccaaccgtgcggcggcgggggtgtacgaggacaagggcgggcccctgatcgcggaggggctcgcgacgttcggcttcgcggtcgacgggccgtgggtggtgccggacggcgatccggtcgaggagacgctgcgcagcggcgtcgcggccgggtacgacgtcatcgtgaccaccggcggcaccgggatctcgcccaccgaccgcacgcccgaggcgacgcgcgcggtgctcgatcacgaggtgccgggcattcctgaggccatccgggcgttcggacgggagaaggtgccgaccgccgcgctgtcccggggactggccggagtggcgggaggcacgctgatcgtgaacctgccgggatccaccggcggagtgaaggacggactggccgtcctggaacccctgttggtccacgccgtcgaccagattcgcggcggtgaccaccccagacccagtgggggtgcgagc

SEQ ID NO: 3658 - DNA, 510 bp, Streptomyces avermitilis
  CDS (1)..(510)
atgactgttccatcccggggggagacccccggaccccctgcgcaggaccggctgacgcacatcgacgaggcgggcgccgcccgcatggtcgacgtgtccgggaaggacgtgaccgcgcgcaccgcccgcgccagcggccgcgtcctcgtctcaccgcgcgtcgtcgaactgctgcgcggcgagggagtccccaagggggacgccctcgccaccgcgcgcatcgcggggatcatgggcgccaagcgcaccccggacctcatcccgctgtgccacccgttgtcggtgtcgggtgtcaagcttgatctgtcggtcgcggacgacgccgtggagatcctggccaccgtgaagacgacggatcgcacgggcgtcgagatggaggccctgaccgcggtctccgtcgccgcgctcaccgtgatcgacatggtcaaggcggtcgacaagggggcggtcatcacggacgtacgcgtggaggagaagacgggcggcaagtcgggcgactggagcaggtca

SEQ ID NO: 3659 - DNA, 1272 bp, Streptomyces avermitilis
  CDS (1)..(1272)
gtgaccgaacacctggaggacatcctcgccaccgtccgtcccctcgaacccatcgagctgcaactcctcgacgcccagggctgcgtcctggtcgaggacgtcacggtgccggtctccctgccgccgttcgacaacagctcgatggacgggtacgcggtgcgggtggccgatgtcgcgggcgcgagcgaggggttcccggccgtcctgacggtcgtgggcgatgtcgcggcgggccaagccgacctgctccacgtgggccccggccaggccgccaggatcatgaccggcgccccgctgccgcccggcgccgaggccgtcgtccccgtggagtggaccgacggcgggctgggcgaaggcccggtctccgggatgcgcgcccacagcgcggcccccgagggcgcctcgggtcaggtgtccgtccaccgcccggccgaggcccgcgcacacgtgcgcgcgctgggcagcgacgtccgggccggcgaccgcgccctggccgccggtacggtcctcggcccgccgcagatcgccctgctcgccgccatcggccgcggcaccgtgcgtgtgcgcccgcgcccgcgcgtggtcgtcctgtccaccggcagcgaactcgtccagcccgacgagaaactgggcagcggccagatctacgactccaacagcttcgccctcaccgccgccgcgcgggacgccggagccatcgcctaccgggtgggagcggtcgccgacgacgccgagacgctccgctccaccatcgaggaccagctcgtccgcgccgacctcatggtcacgacgggcggggtgagcgtaggggcgtacgacgtcgtcaaggaggctctctccaccgtcggcgacgaggacgaggcgggcagcggcgtcgagttccgcacgctcgccatgcagccgggaaagccccagggcttcggctccgtcgggcccgaccacaccccgctgctcgcgctcccgggcaacccggtctcctcgtatgtctccttcgagctgttcgtccgccccgcgatccgcaccctgatgggcctggaggacgtgcaccggcccaccaccagggccgttctccgtacggacaaggcgctgacctcgcccgcgggccgccggcagttcctgagagggacgtacgcggacggcgaggtgaccccggtgggcggcgccggatcccatctgatcgcggccctcgcgcaggcggacgcgctgatcgtggtccccgaggacgacacctcggtcgagcccggcaccgaggtcgaggtggtcctgctcggc

SEQ ID NO: 3660 - DNA, 900 bp, Streptomyces avermitilis
  CDS (1)..(900)
atgactgagtcgcatcccaggatcaccaaggctgtcatccccgcagcgggcctcggcacacgcttcctgccggccaccaaagccactcccaaggagatgcttccggtcgtcgacaagccggcgatccagtatgtggtggaagaggccgtgtccgcgggtctcgacgacgtcctgatgatcaccggccgcaacaagcgccccctcgaggaccacttcgaccgcaactacgagctcgagtcggctctgcagaagaagggcgacgccagccggctcgccaaggtccaggagtccagcgacctcgcgaccatgcactacgtgcgccagggcgacccgaagggcctcggccacgccgtcctgtgtgccgcaccgcacgtcggccgcgagcccttcgccgtgctcctcggcgacgacctgatcgacccccgcgacccgttgctggcccgcatggtcgaggtccaggaacagcgcggcggcagcgtcatcgcgctcatggaggtcgcgcccgagcagatccacctctacggctgcgcggccgtggaggccaccgacgagggcgacctggtcaaggtgacggacctggtcgagaagccggacccggcggatgcccccagcaactacgcgatcatcggacgttacgtcctcgacccgcacatcttcgacatactgcgcaagaccgagccgggccgcgggggcgagatccagatcaccgacgccctccagcagctcgccgccgacgagaaggtcggcggcccggtgcacggcgtcgtcttcaagggccgccgctatgacaccggcgaccgcggcgactatctgcgtgccattgtcagactcgcatgcgaacgtgaagacctggggccggagttccggacctggcttcgcagttacgtagccgaggagatg

SEQ ID NO: 3661 - DNA, 621 bp, Streptomyces avermitilis
  CDS (1)..(621)
gtgagtcacctgaggcccggctctgatcctgacaagcgaatgttgcggcgagagttccttgtggtgagaagccggttgacggcggatgacgtgcgggaaacggcgtccgctctcgcggcccgggccctggaactgccggagctggcgcacgcgcgcacggtggcggcgtacgtctccgtggggagcgagccgggcaccctcgcgctcctggacgcgctgcacgcgcgcggggtgcgcgtgctgctgccggtcctcctggcggacaacgatctcgactggggtgcgtacgccggacagggctcactcgcccgcgtccggcacggcgggaagatggccctcctggagccggcgggcacccggctgggcccgtctgccgtgctcggcgccgacgccgtcctgctgcccggcctcgcggtggactcccgggggatgcgcctgggccgcggcgggggctcgtacgaccgggtactggcccgcctggagcgcgcgggcgtggatccggccctggtggtgctgctgtacgacacggaggtcgtggaccgcgtaccggaggagccgcacgaccggccggtgcacgcggcggtgacgccgtcgggggtgcgccgctttcgggccgcgtcc

SEQ ID NO: 3662 - DNA, 2808 bp, Streptomyces avermitilis
  CDS (1)..(2808)
atgccccccaacaccaccgcctcttccggtgagcagcccggcaagtccggcaggaagaaggggcgcaaagcccgtttgctcgtgatcgtcctggttctggccatcatcggaggcatcggcttcggtgcgtactggagcatcagtacggtccgcgcctcgttcccgcagaccaagggctcgatcaccctcgacggcctggccgggccggtcgacgtgaagcgcgacggctacggcatcccgcagatctacgcctcgtccgacgcggacctgttcatggcgcagggctacgtccaggcgcaggaccggttctacgagatggacgtgcgccgccacatgacctcggggcgcctgtcggagatgttcggcaaggggcaggtcaagaaggacgagttcctgcgcaccctgggctgggaccgggtggcgaagaaggagtacgacaccaagctgtcggccgccacgaagaagtacctccgggcgtacgccaagggagtcaatgcctacctcgagggcaaggacggcaaggacatctccctggagtacgccgcccttggtttcaccaacgactaccagccccagaagtggaccccggtcgactcggtctcctggctcaaggcgatggcctgggacctgcgcggcaacatgcaggaagagatcgaccgctccctgatgaccagccgcctgggccccaagcagatcgctgacctgtacccggactacccgtacagccgtaacaagacgatcgtccaggagggccagtacaacgagctcaccaaggcgttcgagcagggtggctccacgggcacgcagtccacgaccggggggacgtcgaccgggacctcggggacctcggggacctcggggaccacgggctcgacctcggcctcggggacttccacgtcggcctcggacccctcggccctggagagccagctgacgggcctctacaagctcctggacgacgtccccaccgccgtcggcgtgaacggcaacggcatcggctccaactcctgggtcgtctccggcgaccacaccatcaccggcaagccgctgctggccaacgacccgcacctgtcggcctcgctgccgtcggtctggtaccagatgggcctgcactgccgcagcgtctccagcaagtgccagtacgacgtctccggctacaccttcgcgggcatgcccggcgtggtcatcggccacaaccaggccatcgcctggggcatgaccaactccggggtcgacgtcaccgacctctacctggagaagctcagcggcgacggctacctgtacgacgacaaggtgctgccgttcacgtcccacgacgagaccatcaaggtcgcgggcggcaggagcaagacgatcgtcgtccgcgagaccaacaacggacccctgctgtccgaccgcaacgacgaactcgtcaaggtcggcaagaaggccaccgtcgacacggcggcgcccgaccgcggcgacggctacggcatcgcgctgaagtggaccgccctggcgccgggcaactccatggacgccgttttcgagctggacaaggcggcgaactggtcggagttccgcaaggcggccgcgtccttcgacgtgccctcgcagaacctggtctacgccgacaaggacaacatcggctaccagctgcccggcaagatccccacgcgcgcgaagggtgacgacggctcgctcccggtgcccggctgggactccaagtaccagtggaccggctacatcgagcaggacgagctgccctacgagtacaacccggaccgcggctacatcgtcaccgccaaccaggccgtcgtcgacaaggacaagtacccctacacgctcaccacggactggggctacggctcccgcagccagcggatcgccgatctcatcgagtcgaagatcaagggcggcggcaagatctcgaccgacgacatgcgccagatgcagctcgacaacagcagcgagatcgccaagctcctggtgcccaagctgctcaagctcgatgtcgccgacaagcatgtgcgtgaggcgcagaagctcctcgagggctgggactacacccaggacgccgactcggcggcggccgcgtacttcaacgcggtgtggcgcaacgtcctcaagctcgccttcggcaacaagctgcccaaggagctgcgggtccagggccagtgcctgtacgtcgatccggccgaaagcaccggtcccgcggaccaggaccagaaggtgcgcgagtgcggccagcgcgacgcggaccaggcacagccggacggcggagaccgctggttcgaggtggtccgctccctcatggacgacgagaacaacgactggtggacgtcgcccaagtcgcgcaccgacgaggcgaccgacacgcgtgacgagctgttcgcacgggcgatgaaggacgcccgctgggagctgaccgccaagctcggcaagaacatggacacctggagctggggccggctgcaccgcctgttcctgaagaaccagaccctcggcaccgaaggtccggacgtcgtgaagtacgtgctcaaccgcggcccctggaagctcagcggcggcgaggcgacggtcaacgcgtccggctggaacgcggcgggcggctacggcgtcgtctgggtgccgtccatgcgcatggtggtcaacctcggggacctcgacaagtccaagtggatcaacctgtccggcgcctcgggacacgccttcagcgcccactacaccgaccagacggacaagtgggccaagggcgagctgctgccgtgggccttctccgagaaggcggtcgacgggagcacgagcgactcgctggtactgaagccg

SEQ ID NO: 3663 - DNA, 1569 bp, Streptomyces avermitilis
  CDS (1)..(1569)
atgctcggatcgaagcgttcacatcgcagcgctcgattggcgagaagggaacagccgctgactgtccaccacctcaaccagctcctgctcgtctgctcgctcgtcctgctcatcgcggtggcggcggttcggatctcgtcacgcagcgggctccccagcctgctcgtctacctgggcatcggcatcgccatgggccaggacggggtcggcgacatccacttcaacaacgccgagctgacccaggtcatcgggtacgcggccctggtcgtgatcctgaccgagggcggtctcggcacgaagtggaaggagatcagaccggcgctcccggccgcctcctccatggcgttggccggcgtcgccgtgagcgtcggtgtcacggccgcgggcgcgcactggctgatcggtctggagtggcggcaggcgctcatcatcggggcggtggtgtcctcgacggacgcggcggcggtcttctcggtcctgcggaaaatccccctccccgcgcgcgtgacgggtgtcctggaggccgagtccggcttcaacgacgctccggtggtcatcctcgtcgtcgccttctccacggccgggccggtcgagcactggtacgcgctgctcggcgagatagccctggagctggccatcggcgcggccatcggcatcgcggtgggctggctcggctcctggggcctgcggcacgtggcgctgcccgcctccggcctctaccccatcgccgtgatggccatcgcggtcaccgcgtacgcggccggagcgctcgcacacggcagcggcttcctcgccgtgtatctggcctccatggtgctcggcaacgccaagctgccccactggcccgccacgcgcggcttcgccgacggactcggctggatcgcccagatcggcatgttcgtcctgctcggtctgctggtcaccccgcacgacctgggggacgacatctggcccgcgctcctcatcggcctggtgctgaccatggtcgcgcggccgctgagcgtcgtgatcagcctggcgccgttccgggtgccatggcaggagcaggtcctgatgtcctgggccgggctgcgcggcgccgtgcccatcatcctggcgacgatccccatggtgaacggtgtcgaggacagccgccgcatcttcaacatcgtcttcgtcctggtcatcgcgtacaccctcgtccaggggccgacgctgccctggctggcccggaagctgcacctggacacgtcggccggccaggccgccgacctgggcatcgagtcggcacccctggagcggctgcgcggccatctgctgtccgtcgcgatccccgaggggtcgaagatgcacggcgtcgagaccaacgaactgaggctgcccgcgggggccgcggtcaccctcgtcgtccgggaggggaagtcgttcgttccgctgccgacgacggtgctgcgccgcggcgacgaactcctggtcgtgaccaccgaccccgtccgggacgcggcggaggcacggctgcgggccgtgggccagggcggcaagctggccggatggctgggcaccggggcaccggacgaccggccggggcgt

SEQ ID NO: 3664 - DNA, 1296 bp, Streptomyces avermitilis
  CDS (1)..(1296)
gtggcatccacggtcacctccgggacgtcgaagacctcgccgcccccggactcctcccgcccgggatacggccggctgctgcgcacccgcggcgcctggacgttcctgctccccggcttcgccgcacgccagccgttcgcgatgctgaccatctccatcgtgctcctcgtccagcacaccaccggctcgtacggggccgccggcgccgtggcggccgccaccggcgtctccatggccctgttcgccccctacagcggccgtctcgccgaccgccacgggcagcgcgcgatcctgctccccggtgtcctggtgcacaccctggcgggcctctccctgacggcgctggcgctgaccggcgcccccttgtgggcactgttcgccgccgccgtcccgaccggcgcctcggtgccgcaggtcgggcccatggtgcgtgcccggtggggcgtgaagctccaggactcgcccctgatgaccaccgcggccgccttcgagtccgtcaccgacgagctgaccttcgtcctcggcccgctgctggccaccgccctgtgcaccgccgtgaacccggccgcgggcctgctcaccgaggccaccctgaccctcgtcggcggtctgctgttcgcggcgcagaagagcacccagcccgctgtcgcccccgaccggcacgcgcgcgtggagcacgcctccgccctgcgcgtccccggagtgcgcgttctgatcgtgacgttcctgggcatcggctcggtcttcggcggcatgcaggtgtcgctcgccgcgttctccgagtcgatcggcgagccaggcctgaacggcgtcctgtacgggaccttcgcggccggcaacatgctctccggcatcgtctgcggcgccatcgcctggaagatcgccccgcagcgccgcctggtcatcgggtacgcggccctcgccctggccgcctccggcctgtggaccgcccactccgtggtcgtactcgccggaatcggcctcctcgtgggcatgtgcatcgcgcccgccctgatcaccggctacacgctggtcgaggacctggtcccggcgaccgcgcgcaccgaggccttcacctggctgaccggcgcggtcgcgctcggccaggcggcggccgtcacggtcgccggccagctggaggaccggctgtgggacggcgccggattcctggtcccgatggccggtacggtgctggcgctcgcgaccctcgtgtgcttgcgttcacggctcgcgcaccggcccgcgggccgcacggtcgcacgtggcgtcggtcaccgagtgccggtgacggtggac

SEQ ID NO: 3665 - DNA, 339 bp, Streptomyces avermitilis
  CDS (1)..(339)
gtgccgacctaccagtaccagtgcaccgcgtgcggcgagggcctcgaggcggtgcagaagttcactgacgatgccctgaccgagtgccccagctgcgccggccgcctgaagaaggtgttctccgcggtcggcatcgtcttcaagggctccggtttctaccgcaacgacagccgcggctcgtcctcgagcagcagcccggcctcgtccgcgaagtcgtcgggttcttcgtcgtcgtccgactcgaaggcgtcgtcggactcgaagtcgtcgagctctacgtcctcgtcggactcgaaggcgtcgtcgacgggatcctcgtcggcgggcagcaccgccgcc

SEQ ID NO: 3666 - DNA, 831 bp, Streptomyces avermitilis
  CDS (1)..(831)
atggcgaacgcagagatcggtgtcatcggcggctcgggcttctactccttcctcgacgatgtgaccgaggtccagatcgacaccccgtacgggccgcccagcgactccctcttcctcggcgagatcgccggccggcgggtcgccttcctcccccgccacggccgcggccaccatctgccgccgcaccgcatcaactaccgcgccaacctgtgggcgctgcgctccgtcggcgcgcgccaggtgctcggaccgtgcgcggtgggcggcctgcgcgcccagtacgggcccggcacactcctcgtgccggaccagatggtggaccgtacgaaggcccgtgcccagacgtacttcgacgggctgccgctgcccgacgggagcgtgccgaacgtcgtgcacgtctcgctcgccgacccgtactgccccgtcggccgcaaggccgcgctggcggcggcgcgcggccgcgactgggaaccggtggacggcggcacgctggtcgtggtcgagggaccgcggttctccacccgcgccgaatcactgtggcatcaggcgcagggctggtccgtggtgggcatgaccgggcatcccgaggccgcgctcgcccgtgaactggagctgtgctacacgtcgctgacgctggtcaccgacctcgacgcgggtgccgagaccggtcagggcgtctcgcacgaggacgtcctgaaggtgttcgcctcgaacgtggaccggctgcgggatgtgctgttcgacgcggtggcggccctgccggcgaacgacgcgcgggactgcctgtgcacgacggcgctcggcggcatggatccggggttcgagctgccg

SEQ ID NO: 3667 - DNA, 492 bp, Streptomyces avermitilis
  CDS (1)..(492)
gtgccgcacttcgctcccctgcgggtgcgcggcgggcggtaccgactgcgccgtctcgcgcggcaccggcagcgcgccgtggccgcgggactggcggtcacggcggccgcgctggtggcggcgggcccgcaggacccgggacggtcgcgcggacacccggacccgggcccgcccgctcacgcggcctcggaggcggaccccgtacggcgggggcgcacggtccggacggtcacggcaccggtgcggatcgcggacgcggccaccgtgcggctcctgcggcccggcgaccggatcgacgtggtcgcggcggacagcggcggtgagacccgggtggtggcgaccgcggcccgcgtgaccgaggtgccggacaccggcgagggcatggccgagagcggcgccctggtcgtcctctccgtaccccgggcaacggcggcgcgactggccggagcgagcacgacctcacggctggcggtgaccctgtgccgaacctgc

SEQ ID NO: 3668 - DNA, 474 bp, Streptomyces avermitilis
  CDS (1)..(474)
gtgagcgagaagaaggagacgggcgtcctggcgggcttcaaggccttcctgatgcgcggaaacgtcgtcgacctggcagtggcggtggtcatcggcgccgccttcaccaacatcgtcaactcggtggtgaaggggatcatcaaccccctggtgggcgcgttcggcacgaaggacctcgacaagtacagctcgtgcttcagggccccctgccaggtggcgaaggacggcacggtcaccaagggcataccgatcatgtggggcacggtgctcagctcgacgctcagcttcgtgatcaccgcggccgtcgtctacttcctgatggtcctgccgatgtccaagtacctggcccgcatggaggcccgtcgcaaggcgaaggcgggcatgcaggaggtgatcgaggtgaccgagctgcaagtactcaaggagatacgcgacgccctggtggcccagcgcgggcccggacacagccaggac

SEQ ID NO: 3669 - DNA, 174 bp, Streptomyces avermitilis
  CDS (1)..(174)
atgactaccgcccccgaacccagtgtccccaaggccgcgctgatcttcgacgacccgctgagccagcagtcctcggacgacacggaccgtgggtggggcgagcggcccggcgtcgacagcgacagcgcggccgacctgaagcgcttcctcgacgagaagccgccccaccacatc

SEQ ID NO: 3670 - DNA, 1254 bp, Streptomyces avermitilis
  CDS (1)..(1254)
gtgcttggccccatgacctcgtcccctcctcccccgtcggccgcggaacccactcccccggcccgaccgaccccgctcagcccgctgcgccccatgaccgcccgcggacgcggcgaggcccaccgcgtcgcatcaccgctggagctgttcttcgacctgtgtttcgtcgtggcgatcgcccaggcgggcgtccagctcgtccacgccgtcgccgcggggcactcgggccagggcatcctcaactacgcgatgatcttcttcgccatctggtgggcgtggatgaacttcagctggttcgcctccgcctacgacaacgacgacgcgctctaccggatcgtcaccctggtgcagatcgccggggtcctggtactcgcggcaggggtgtcgaaggcgttcgaggagcacgacttcctggtcgtctggctcggctacgcgatcatgcggttcgccatgatcgcgcagtggctgcgcgcggcgcgggccggccggggagccgagagaaccatggcactgcggtacgcgggcggcgtgttcctgtgccaggtcggctggctgggcctgctggtcctgccggagcacgcgcgcccgtgggtcttcctggtgatggcgctgctcgagctgagcgttccggtgtacgcggagaaggacttcacgacgtcctggcacccgcatcacatcgccgagcgcttcggcctgttcacgatcatcgtgctgggcgagacgatcgccgcggccacggtcgccgtgaagtcggccgtggacgagcacaacgcgctgggcgagctgctgcccatcgcgatcggcgggctgttgatcgtcttcgccgcgtggtggatctacttcgtggtaccgatccacggccatctgcggtccaacagggagagcttcctgtggggatacgggcactacctgatcttcggctcggcggcggcgatcggcgcgggactggaggtcgccgtcgaggaggcggtcggcaaggcgcacgtctcgacactgaccgcgtccgccgcggtgaccctgccgacggcgctctacctcctcaccgtatgggtgctgcactcccgttacttcaaggtgggtatcgcccagcaactcgtgctgccgacggccgcgctgctggtgatcgtgtgcacgttcctgggcgagtgggcggtcctcggcgcggggatcgtgtccgcgggggcggtggcgagcggggtgatgctgacggtacgcatggccgcgcggcagaagggcagagcggcgacaacggca

SEQ ID NO: 3671 - DNA, 1026 bp, Streptomyces avermitilis
  CDS (1)..(1026)
atgacagttgacgctctgacagatgtcgcgggcctgcgcgtggggcacgccacgcggaccggcggcggttggctcaccgggaccacggtcgtactcgcccccgagggcggcgccgtcgcggccgtggacgtacgcggtggcggacccggcaccaaggagaccgatgcgctggacccgcgcaatctggtgcagcgggtcgaggcggtcgtactgaccggcggcagcgcatacgggctggactcggcgtcgggcgtgatggcctggctggaggagcagcggcgcggagtgcgcgtcggcccggacccggcgcatgtcgtgccggtcgtgccggcggcctgtgtgttcgacctgggccgtggcggagacttccgggcgcggccggacgcggccaccgggcgggccgcggtggaggccgccgccgcgagcgagccgggcgcccccgtgccggagggatgcgtgggcgccggtacgggagcggtggtcgggcaggtcaagggcggggtaggcacggcgagcacggtgctcggctcgggaatcacggtggccgcgctggtggtggccaacgcggcgggttcgacggtggatccggaaacgggggtgctgtacggggagttgttccagggacgtgtcgtgtatccggcggacggggtccacgaggccgcccggcggcggctggccgagacggccgcgaagaacgcgccgcctccgctgaacaccaccctcgcggtggtggccaccgacgccgagctcaccaaggcgcaggcgcagaagctcgcgggcacggcacacgacgggatcgcgcgggccgtgcggccggtgcatctgctcagcgacggcgacacggtgttcacgctggcgaccggcgcccacccgctgccctccgacagccccctggcgctcaacgaggtgctggcggcgggcgcggacgtggtgacgcgggcgatcgtccgagcagtacgggcggccgagtcggcggacggtccgggcgggacgtggccttcgtacggggagctgtacgggagccgg

SEQ ID NO: 3672 - DNA, 1224 bp, Streptomyces avermitilis
  CDS (1)..(1224)
gtggcaacgccgaacatcgcagcacggcgcgcagtggtggcctgtgccgccctcgtggtcggcgctctcagtctcaccgcctgcggtggcagcgccgacgccaacgtcggtaagggggacggcaagagcggcagcggctcgggcaacacgtccaccgcgaagatcaccatttcggcgaaggacggctcgacgggcgcgtcgatcaacgcgaccggtgtgaaggtcagtgacgggaagctgaccgatgtgaagatgacggtggcgggcgccggtacggccgtgtcgggggcgatatccgcggacgggaagagctggaagcccgccaagcagttggaccgcggggtgaagtaccagatctccgccaccgccaaggacgcgagcaaccgcaccgcggccgccaactcgatcttcaccacggtcaattcggccaacagtttcatcggcacgtacacacccgacaacgggagcacggtcggtgtcgggatgccggtctccttcaacttcgacaaggtgatcggcgacaagaaggccgtgcagtcgcacatcaccgtcagttcgagcagcgggcagcgggtggtcgggcactggttcggggcgcagcggctcgacttccggcccgaggcgtactggaaggccggttccaaggtcacgatgaagatcgacctggacggggtcgagggcgcgaacggcgtcttcggggtgcagaagaagacggtcaccttcaccgtcgggcgttcccaggtgtcgacggtcgatgtcagtacgcagaccatgacagtggtgcgggacggcaagaccgtcaagtcggtcccgatctcggcgggcagcccgcagcacaccacgtacaacgggcagatggtgatctccgagaggttcgcgcagacgcggatgaacggctcgacggtcggttacggcggcgagtacgacatcccggacgtgccgcacgcgatgcgtctgacgagctccggaaccttcatccacggcaactactggtacaaccgcggcaacccgcccttcggcaggcagggcaccagccacggctgtgtcggtctcgccgatgtgcagggggcgcagggcgacacggtcgcgaagtggttctacgacaactcgctcgtcggggacgtcgtgacggtgaagaactcccccgacaagacggtcgcgccggacaacggtctgaacggctggaatatgtcgtggagcgcgtggaccgccggaagtgccgtc

SEQ ID NO: 3673 - DNA, 747 bp, Streptomyces avermitilis
  CDS (1)..(747)
ttgagcgttccgtacgagacagcagcgtacgaaccacccgagtcgcccgagtctccggaggagcatctcgcgcgactcctcggccgtgcgctgaactcgttcgagctgcccgacgagacgatatggcggctcgactgcgcgctggcgcacgacagttcgctgcactccgcgcaccacagcgcggggctgcaccgggagacgtaccggcacacctggctgctcgccgacggctcggcggtcacgctgtgggagctggtgcacaacacggcgcccggcagccatccgcagcacgaggtgtacgtggacgaggaggagttgctggcggccacggcccggctgccgctgccgccggacgccccggacttcgaactgccggtgctggtgcagttgtcgccgatccccgagccgcgccacgcctacctgcccgagaactccgcggaccacgcgcgtcggctgctgcgccgtgcggagaacccggatccgccggacgcggacctcgcctcgctgctgctcggctcggcgttcgcgcaccagatcacccaggccttcgggcgcccgtgccgggccggccagatgaggctgtgcttctcgctctacgagcacgcgttcctgctccgtgacggacgtgagctgtccctgtgggaggtcgagcacacggcgacgccggacgggcggcacatgtgcgaggtgtacgcgtcggaggaggcggcacgcgaggcgatggagcggcgggcggcgacgctgggc

SEQ ID NO: 3674 - DNA, 288 bp, Streptomyces avermitilis
  CDS (1)..(288)
atgcccgagcacgcgtcgatcctccaactgaccggtgtgaccgtcctcgccctggccatgggcgtctggatcgccggcctgatacgcctgttgcgtgccccacgcgccccccgtgccccacgcggcgggcacggagtacggcaccgcggcgcccaccgccgccgcgacgtgctgcgggcactgccccgccagcgccaggcgggccccgcgctggaatccgtcgacctgaccccggccgaacgcgacgccttcgccggtctggtacgccagttcagcgacggccgctct

SEQ ID NO: 3675 - DNA, 2112 bp, Streptomyces avermitilis
  CDS (1)..(2112)
atgagcgagatgatcaccgcggacctggtcgacctcgacctgtccgcccagaccaaagaggcggcggcacgtgccctcgccgagcggatggtggcgaagggccgggtgaccgacctggacggcttcctcgccgacgtcgccgcccgcgaggcgcagatgccgaccggcctcgacggcggcatcggcatcccgcactgccgcagcgaacacgtcaccgagcccacgctggccttcggacgcagcgcggccgggatcgacttcggcgcgccggacggccccgccgacctgatcttcctgatcgccgccccggcaggcgcggacgacgcccacctcaccatcctctcctccctcgcccggcagctgatgaacgccgagttcacctccgcactgcgggccgtggacgacgcggccgccgccgccgcactcatccgcggcgacgagaccccggccgccggcacctccgagaactccgtggcggagccgattgcggcggcctccgccggcaccgccacggagggcacggccccggtgccgggcgcgaccgtcgacgacggttccgccccggcgccgggcgccgccgccaccgacggcgcaccgagcgacaacgacgcgcgtcccttccgtgtcgtcgccgtcacctcctgccccaccggcatcgcgcacacctacatggcggccgagtcgctggagaacgcgggccgcgaggcgggcatcgacatcgtcgtcgagacacagggctcggccggcttcacccgcctcgacccggccgtcatcgcggcggcggacggcgtgatcttcgcgcacgacgtacccgtacgggacaaggaccggttcgccggaaagcccaccgtcgacgtcggagtgaaggccggaatcaaccgtcccgccgcactcctcaccgaggtccgcggcaaggccgagcgcggcgaggtgacctccgggtcggccgccgccacaccggtcgagcgcggcggcgagtcgggcgagggctacggcaccaagctgcgcaagtggctgatgagcggcgtgagctacatggttccgttcgtcgcggccggcggtctgctgatcgccctcggcttcgcgatcggcggctacaagatcaacaaggcgccgtcggtcatggaccacttcctgtggacccaggcggacagctggggcgcgctgttcttccagatcggcgtcgtgtccttcggcttcctcgtcccggtcctggccggctacatcgcgtacggcatggcggaccggccgggtctcgtgcccggcttcgtcggcggcgcgatctccctcaccatcaacgcgggcttcctcggcggcctggccgccggtctcatcgccggtggtgtggtgatcgggatccagaaggtcaagatccccgcggccctgcgcggcgtcatgccggtggtggtgatcccgctgatctccgcggcgatcgtcggattcctgatgttcgtcgtgatcggcaaacccatcgcctcggcccagaagggcatgaccgactggctgaacggcctcaccggcaccaacgccgtcctgctcggcgcgctgctcggcctgatgatgtgcttcgacctcggcggcccggtcaacaaggtcgcgtacaccttcgccaccgccggtatcgcggtcgccggccccagcgactcggcgatgaagatcatggccgcggtgatggcggccggcatggttccgccgctggccatggccctggcaacgaccgtacgcggcaagctcttcacccagaccgagcgcgagaacggcaaggccgcctgggtcctcggcgcctccttcatcaccgaaggcgcgatcccgttcgcggcggcggacccgctgcgcgtcatcccctcggccatggcgggcggtgcggtcaccggcgccctgtccatgacgttcggcgccacgctgcgcgccccgcacggcggcatcttcgtggtcccgctgatcggcaacccgctgctgtacctggtcgccatcgcggcaggtgtctgcgtctccaccgccctggtggtcgccctgaagggcatgcgcaagcagagccccgacgacgtcaccaaggaggccgcacaggcgccgataccggccaagaccgactccaagcagccggtcgcggcc

SEQ ID NO: 3676 - DNA, 951 bp, Streptomyces avermitilis
  CDS (1)..(951)
atgatcctcaccgtcaccccgaacccctccctcgaccgtacgtacgaggtcccgtcgctcgaccgcggcgaggtcatccgggccaccggcgaacgcatggacccgggcggcaagggtgtgaacgtgtcccgggccgtcgccgcggccggacagcggaccgtcgccgtgctcccgctcggcggcgcgcccggcgccttcgtcgccgcactgctcgacgcccagggcatcgacgtggcgccggtcccggtcgccggagccacccgctccaacatctccgtcgccgaacccgacggcacactcacgaagatcaacgcccccgggccggaactcacgcccgccgaggccgagttgctcctggagacggtccgtgagcagtaccgggccggcgacaccacctggatcacctgctgcggcagcctcccgcgcggcctcgccccctcctggtacgccgacctggtcgcccgggcccacgcggccggcgcccggatcgcgctggacacctcaggacccgccctgctggaagccctccgcgagcggcccgacgtcgtcaagcccaacgcggaagaactcgccgaggcggtcggccgccccctcgccaccgtcggcgacgccgtcaaggccgccgaagaactgcgcggtctcggcgccggcgccgtactggccagcctcggcgcggacgggcaactgctcgtcgacgcctcgggcacctggttcggcagcgcacgcgtcgacgccgtacgcagcgacgtgggcgccggcgactcctccctcgccggcttcctcatcgccggcggcagcggagccgacgccctcgcctccgccgtcgcccatggcgccgccgccgtacagctgcccggcagcgtgatgccgaagccggccgacctcgacccctccgccgtgaccgtcacggcagaggtgcccgtggaccgcgtactgacggagccggtgtca

SEQ ID NO: 3677 - DNA, 759 bp, Streptomyces avermitilis
  CDS (1)..(759)
atgtacgcaccggagcggcagcaggagattctccggctcgcccgtgacggcgggcgggtggatgtcgtatccctggcggaggagttccaggtcaccgcggagaccatccgccgcgatctgaagaccctcgaccgcgccggcctcctccgtcgcgtgcatggcggtgccataccggccgggcgcctcgacttcgagcccgacctcgccgagcgcgagagcacggccgccgacgagaaggaccgcatcgccgaagccgccctcgccgagctgccggccgacggcacgatgatcctcgacgccggatcgaccgtcgcccgcctggccggggcgctgcccctggacgcgacgctcaccgtcgtcacccacagcctgcccatcgccgcccgcctcgcggaccaccccggcatccagctccacctggtcggcgggcgcgtccggcaccgtacgcgggccgccgtggacgcctgggccctgcgcgcgtacagcgagatccgcgccgacgtcctgttcgtcgcggccaacggcttctccgccgagcacggactgaccacccccgacctcgccgaggccgccgtcaagcgcgcggccgtccgtgccgcacgccgcgtggtgctgctcgccgactcctccaagcacggccaggagcacttcgcccgcttcggcgacctcggtgatgtggacctgctgatcaccgacagcgggttgagccccgaagacgccaccgccatggagcgcggcggcacggaagtagtgcgcgca

SEQ ID NO: 3678 - DNA, 1512 bp, Streptomyces avermitilis
  CDS (1)..(1512)
atgacctccaccgagacccctctcaacagcccggccgccgcggccgaccggcgccgctggttcgcgctcgcgatcgtgatgacagcggccttcatggacctggtcgacgtcacgatcgtcaacatcgcgatcccgtcgatccagcgggacgcaggcgcctcgtggggccagatccagtggatcacggcgggatacgcgctggccttcgccgccgggctcatcaccggcgggcggctcggcgacattcacggccgcaagcggctcttcctcatcggcataggcggcttcacgctcgcctcggcgctgtgcggcttcgccgcgaacccggagatgctcgtcgcctcgcgcatcctccagggcggaatggccgcgatgatggtgccgcaggtgctgtcgatcgtgcacgcgaccttcccggcacacgagcggggcaaggtcttcggtctcttcggcgcgatcgtggggctcggcgccgtctccggtccactgctcggcgcgctgctcaccgagtggaacctcttcggccttgaatggcggccgatcttcctcatcaacctgccggtgggcgtggccggactgatcctgggccgtcggttcatcaccgagtccaaggccccgcgcgccctcaagctcgacctcgtcggcgtcgccctcgtcacgctcggcctgctgatgctgctctacccgctgacccgcggccgtgagctgggctggccgctgtgggggcatgtgtcgatggcgggcgcgctggtcgtcttcgcggcgctggtggcgtacgagaggcggaagacggcgcgggacgggtcgccgctggtcgagctgtcgctgttcaaggtgaagagcttcgcggcgggcatcgccgtacagaccgtcttcggtatcgccctcggcatcttcttcctggtctggacgctctacatgcagatggggctggggtggagcgcgctgcgggcgggcctgaccggggtgcccttctcgatcgcggtgtccgcggcggcgggcatgtcggtgcagctgctggtcccgcgcttcgggcgcaaggtgctgcaggcgggcgcgctgctcatggccctcggcgtgctgctctacatctgggagtccgaccgttacgggatggccatcgcctcctggcagatggctcttccgctggtggtcatgggcgcgggcatgggcttcatcgtggccccgctgacggacgcggtgctgtcggaggtcccgcgcgagcactccggctcggcctcgggcctgatcaacacggtccagcagatgggcaacgcgctggggctcggtctggtctcggtggtcttcttcggcgagatcggcgaccgtcttacccgggcccaggtggggccggccttcgcacacgccttccagcacgcgctcgggtgggtggcggtggtgctggcggtcatcttcctgctgatgttcgcgctgccgaagcggccggcgcagcacgtggagggggccggggccgcggacaccctgggggagaaggagccggtgctcgtcccc

SEQ ID NO: 3679 - DNA, 990 bp, Streptomyces avermitilis
  CDS (1)..(990)
atgacgacggacaccccggccaggctgctccagctcctctccctcctccagacgccccgcgagtggccgggcggtgagctctccgaccggctcggggtgtcccggcgtaccgtccggcgtgacatcgaccggctgcgggagctgggctatccggtgcaggcgaccaaggggtccgacggcggataccggctggtggcgggcaaggccatgccgccgctcgtcctcgacgacgaggaggccgtggcgatcgcggtggggctgcgggccggggcggggcacgcggtcgagggcgtggacgaggcgtccgtacgggccctcgccaagctggagcaggtgctgccgtcgcggctgcggcaccgcgtgtccacgctccaggccgccaccaccccgctcaccagcggcgacggcgcgagcatcgcacccgagacgctgaccgtgatggcttcgtcgatcgccggccgagaacgtctgcggttcgcctaccgctccggggacggaacgccgtcccgccgccagaccgagccgtaccggctggtctcgaccgggcgtcgctggtacctcgtcgcatacgacctggaccgcgaggactggcgtacgttccgggtcgaccgggtcagtgagccgttcgcgaccggcgcgcggttcacgccgcgggagctgcctacggggaacgcggcggagtttctgcggcagtcgatgttccggcggcaggagacgtacgagttcgaggtgacgttcgccgcgcccgcggagttcgtcgcggcccgcctgcccaactggctcggcgcgcccgagccgatcgacgagcacagctgccggctgcgcgcttccgccggcgactccgtggagtggctggcggtgcggatcgccatggtcgactgtgagttcacggtgcaagagccgccggaactggtggggtgcgtaagggagttggggggacgactgacccgggcggtgggcgcggacgacgggtgggcgacggacagccgg

SEQ ID NO: 3680 - DNA, 705 bp, Streptomyces avermitilis
  CDS (1)..(705)
gtgccacagcggcataacctgccgtccgtgaccggtaccaaccgtgcgaccggcccttccgccggccgcacgtcgaaagcttccgcaggcgcgtccctgatcgagcggcgcaaggcggcgacccggatggagatcgcccgggccgccgcgggactcttcatggcggacgggctgcgtgccacccgcgccgaggacatcgcccgcgccgccggggtcgcgccccgcaccttctaccgttatttcgccaccaaggaggagtcgctcgcccccctcttctcggcgggcgcccacaagtgggcggaggcggtgcgcgaagcccccgccgcactctccgtcccggacgccctgcaccacgccgtggtccgcaccctgacccccggcgtcggcgtgtcccacacctccctggagtgggtccgctccctcctgcgcctcaccggcaccaacccggcgctcgcgaaggtgtgggcggagatctgccaggccgcggacggggaactggcggaggtgctggcggcccggcccggggtggtggccgccccggactccccggccgtccgcttcgccgccgccgtggccggcgccgccgtccgggtggcggtggagagctgggcggcggacgacgcaccggccgtcggtccccaggggcccgcggatctcgccgtacgcaacctcgagaccctgcggaacttcccgtgggacgaactc

SEQ ID NO: 3681 - DNA, 993 bp, Streptomyces avermitilis
  CDS (1)..(993)
atggcaacccgtgccgtcgcccgtcgtaagtccgccgccggcgggaccgacgcggcaagcagcgttcgcgccgtaggcggcgaaatcgccgaccgcgacctggtcggcatgtacctcgacgagatagcccgtacgccactgctcgatgccgccaaggaagtcgaactgtcccagatcatcgaggcaggtgtcttcgcgcggcagatcctcgacggcgaggaggagcccagggcggaggccactcgcgaggaactcgaatcgctcgtcgccgacagcgagcgggccaaggacgtcttcatcaagtccaacctgaggctcgtcgtggccgtggcgcgccgctacccccgtagcgggctcccgctgctcgacctgatccaggagggcaacgcgggcctggtgcgcgcggtcgagaagttcgactaccgcaagggcttcaagttctcgacgtacgcgacctggtggatccggcaggccatcacccgctcgatcgccgaccagtcgcggacgatccgtctgcccgtccacctggtggaggagctgggccggatccggcgagtgcagcgcgagttcaaccgggagcatggccgtgagccggagcccgcggagatcgcggccgagctggactcgaacccggcgcgggtcacggacgtcctggactgggcgcgcgacccggtctcactgaacatgcatgtcgacgacgagggcgagacgcagttcggcgacctcctggaggacacgtcggcggtatcgccggagcagtcggtgctgacgctgctgcgcagcgaggagctcgacgacctcatcggccgcctcgaccagcgcacggcctcgatcatcaagatgcggtacggcatcgacgacggccgggagcgcacgctgacggaggtcggcaaggagcacggcctcacacgcgagcgcatccgccagatcgagaagcacgccctgctggaactgaagaagctggcccggagcaccgggttcgacgcggcggcg

SEQ ID NO: 3682 - DNA, 516 bp, Streptomyces avermitilis
  CDS (1)..(516)
atgccgtcggaacgtacagaggtgcaggtcaggtcgggagtcgaggccgacctcaaagccctcaccgacatctacaaccactatgtacgtgagacgcccatcacattcgataccgccgccttcacgccggaagagcgccgcccttggctgctctcccaccctgaagacggaccgcaccggctgatggttgccacgggcgcggactcacaggagattcttgggtacgccaccagcagtcctttccgcgccaagcccgcctacaccacctccgtcgaggtgaccgtctacgtcgccccggacgcggctggccgtggcatcggcacgctcctctacggcgccctcttcgaggcgctggcgggcgaggatctccaccgcgcctacgcgggcatcgcccagcccaacgaagcgtccacgcggctgcatgaacgcttcgggttccggcatgtcggcacctaccgggaggtgggccgcaagttcggacggtactgggacgtggcctggtacgagagggagctg

SEQ ID NO: 3683 - DNA, 759 bp, Streptomyces avermitilis
  CDS (1)..(759)
atgcccgcgctctatctcagccacggtgctccgccgctcgcggacgacccgatctggcccggcgaactcgccgcctggtcggcggacctgccacgtcccagagcgatcctcgtggtctccgctcactgggaggaggccccgctcgccctagccgccaccgagagggtccctctcgtccacgacttctggggcttcccggagcattactaccaggtgcggtacgacgctcccggcgcccccgcgctcgccgagtcggtccgcaagctgctgcgcgcccccggcacccccgtccaggacgtcccggaccgcggcctcgaccacggcgcgtacgtcccgctggtggagatgttcccggacgccgacatcccggttctgcagatctcgatgccgacgctcgacccggtgaagctgatggagatcggccgcaagctggcgccgctgcgcgacgagggcgtgctgatcgtcggctccggcttcttcacgcacaacctggcggccctgcgccagggcggcatcccctcctggtcggtcgagttcgacgactggggacaccgggctctggacacccgtgactgggacgcactgctcgacttcacccgcaagtccccggccggcctgctggcccacccgcgtaccgagcacttcgctccgctcttcgtgacgatgggcgcggcggacgcgacgggagaactcgacgaccagaagtccgtgatcgacggcttctggctggggctggcgaagcggtcggtgcagttcggc

SEQ ID NO: 3684 - DNA, 552 bp, Streptomyces avermitilis
  CDS (1)..(552)
gtggggtacatgaacacggcatccgcacccgcacccgcgtcaacgtcgacgtccgcgaccgcgtccgcagaggagccacgctggctcaccgaggacgaacagcacacctggcgctcctacatgcacgcggtcaccctcctggaggatcacctcgaccgccagctccagcgcgacgcgggcatgccgcacatctactacggcctgctcgtccagctcgccgaggcaccacggcggcggctgcggatgaccgagctggccataagcgcgaagatcacgcgctcccgcctctcgcatgccatcgcacggctggagaagagcggctgggtgcggcgcgaggactgtccctcggacaagcggggccagttcgccgtcctcaccgacgaggggtacgaggtactgcggaagaccgcgccgggacacgtcgcggccgtccgccaggccctcttcgaccgcctctcccccgaacagcagaagtccctcggcgagatcatgcagatcatctccgagggactccagccgaaggaggcgggcgcggacctgccctggctccgc

SEQ ID NO: 3685 - DNA, 1548 bp, Streptomyces avermitilis
  CDS (1)..(1548)
atgtctgaaacagccacggcaaaggcggcgcaggcctccgaggccgaagcccattccaaccgctggaaagcgctcgtcttcatcgcgctcgcccagctgatggtcgtcctcgacgccaccatcgtgaacatcgcgcttccgtccgcccagcaggacctggggatatcggacggcaaccgccagtgggtcatcacggcctacgcgctcgccttcggcggtctgctgctgttcggtggccgcatcgccgacctgtggggccgcaagcggaccttcgtcaccggtctgatcggcttcgccgccgcgtccgccctcggcggcgccgcgcagggcgaggcgacgatgctcggggcccgtgccctccagggcgcgttcggcgcgctgctcgcgcccgccgcgctctccctcctggccgtgatgttcaccgatgccaaggagcgcgccaaggcgttcggcatctacggtgcgatcgccggtggcggtggcgccgtcggcctgatcctcggcggcttcctcaccgagtacctcaactggcgctggacgttcttcgtgaacatcccgttcgcgatcatcgcggcggccggtgcgtacttcgtcatccgtgagccggccggcggccgcaaccgttcgccgctcgacatcccgggcgtcgtcctgtccaccctcggtctggtctccctggtctacggcttcacccgcgccgagtccaacggctggagcgactccacgacgatcggcatgttcgtcgcttcggcggtcctgctcgcggccttcgtgttcgtcgagtccaaggtcaaggccccgctgctgccgctgcgcgtgatcaccgaccgcaaccgcggcggcgtgtacctctcgctcggtctcgcgatcatcgcgatgttcggcctgttcctcttcctgacctactacctccagatcgtgaagggctactcgccggtcaagaccggcttcgccttcctgccgatgatcgtgggcatgatcacgggctccacgcagatcggcgcccgcctgatgacccgcgttccggcgcggctgctgatgggccccggcttcctggccgccgcggtcggcatgctgctgctgacccagctggagatcggctcctcgtacgcggggctgctcctgccggcccagctgctgctcggcctcggcatgggtacggcgttcatgccggccatgtccctggccacgctgggcgtcgagccccgtgacgccggtgtcgcctccgcgatggtcaacacctcgcagcaggtgggtggcgcgatcggtacggcgctgctgaacacgatcgccgcctcggccaccacctcgtacatcaaggaccacatcgccggtgcggccgccaagccgcagcagcagctggtccagctggagggcatggtgcacggctacaccagcgcgatctggttcgccgtgggcatcctcgtggccgccgcgacgatcgccgcgaccttcgtcaacgccggccgcccggacacctcctcggtctccggctcgggtgagggcgacggcgtcgaggacgagttcaaggtgccggtgatcgcccac

SEQ ID NO: 3686 - DNA, 642 bp, Streptomyces avermitilis
  CDS (1)..(642)
gtggagaccgccgcccccgtgcagcgccgagtgccccggccgcgcgccgatgccgtgcgcaaccgggagcggatcgtcaccgccgcccgcgagatgttcgtcgagttcggcccggacgtgccgctcgacgagatcgcccgccgggccggcgtcggcaacgccacggtgtaccgcaacttcccggaccgcgatgccttggtgcgggaagtcgtctgctcggtcatggaccgtacgtcggaggaggccgagcgcgcgctcgccgagaccggcgacgccttcgaggcgctgtcccgcttcgtgcacgccgccgccgatgaacgcatcagcgcgttgtgcccgatggtctccagcacgttcgaccagcaccaccccgatctggaagcggcaggtgaacggatcgagcagctggtcgcctcgctgatggagcgcgcccgcacggccggacagctccgccccgatgtggccgtcggcgatctgatgatcggcgtggcccagctcagccgcccgcccgccggaaccgggtgcatgagcctcgaccgcttcgtccaccgccacctgcagctgttcctggacgggctgcgggccccggcccgctccaccctgcccggcacggccgcgaccatggaggatcttcgacaggcc

SEQ ID NO: 3687 - DNA, 1317 bp, Streptomyces avermitilis
  CDS (1)..(1317)
gtgcagtcggagaccggcggctgccgcggagcgaagggcccccgtatgcagtcgtcccgccgccggatacgcccgcgccgtgtcgccgcgctcgcctcggtcaccgttctgacgctggcggtctccacctccgccggtaccggacatctgacggcgggctccacgacggcgggccccatcgcaccggcccgctccacggcgctcggctcctgcatgatccgcggcggaatgggcgtacagatggcggagggcatcccgaccccggccggttactcccgctccaccggcacggtccgcgccctgaccctgatggtcgacttctccgacgcgcccggccagggcagcgcgctcgagcgcctcgcggagttcttcccgcagacccagaactggttcaaggtcagctcgtacggccgcctcgactaccggccggaggccccggtcacccactggctccggatgcccaagcccttcggggcgtacgggatcgaacgcggcgcacccttcgaccccggctaccgcggtctggtccaggacatagtggcggaggccgatcccgaggtggacttccgccagtacgacctgctgaacgtgctgatcaccccgaacgcgggcccctccgccctggacaccgtgctgtcggtgaccttcgcgggcaacaccgaggcgccggtcgccgacggggtgcccgtggccaacgcgtcgttcgtctacagccgccaggacgacggctccggctcctacgcggagaccggctaccgggtgctcccccacgagaacggccacaccttcgggctgcccgacctctacacccaggacggcggcggcgcggtcgggcactgggacatcatgagcgaggactggggggcggacaacgatctgctcgcctggcacaaatggaagctcggctggctggacgactcccaggtccgctgcgcctcggcacccggcaccgcggagtacaccctcaccccgctggcccggcccggcggcgtcaagctcgtcgtcgtgcccctcagcaccaccacggcgtacgcgctggaactgcgcacccccgagggcaacgacgcggacgtgtgccgccccggcatcctcatctacaaggtcgacgcggacatagacaccggcaacgggcccatcaacgtgttcgactccacgcgcgacagcggcggctgcacccgcagccccaacgtccacgccgaactgtcggacgcccccttcatagccgacgagtccttcaaggacccggccagaggaatcaccatcacggtcatcgcggcggacccctccggggactaccgggtccaggtgtcgcggcgt

SEQ ID NO: 3688 - DNA, 1716 bp, Streptomyces avermitilis
  CDS (1)..(1716)
atgtccccgaacgtcaccgcggcccccgacagcaccgccgtacccgccgaggccgtcgctccgctcacccgcggcatcaccgtcctgcggcggctcacggaggccgacgggagggccagcctcagcggcctggagcgggccagcgggctcgcccggtccaccgtcgaccggatcacggcgacgctggcgcgcatggggtacgtacgactggacggccgggacgccgtactcgcaccacggctgatggagctgggcaacgcgtatctggccgcgctgcggctgccgaagctgctgcacgcccaggcggacgcgctcgccgacgagctggacgagtccgtgtccctcgccgtcggcgaccgggacgggatccgcttcatccaccaggcgacccggcgccgcgccatgtccctgagcttccgcatcggcgacctgctgcccgccgaacgcaccgcgccgggcccgctgttcgccaccgaatgggatgcggccgagtggcagcggtggcgcgagcggcgggcggcggaccccgaggaccgcggctttccggcggttccggcccgcagccgcccgctggaggacgacgacaggggcgaaaggtcctcgggacggcgccgaggcggcaccctgggcgacgacttcgaggagcgtacggcggcggcccgaaagcagggctgggcactggacgaccagctgatcgagccgggtcttgtggccctcgccgtgcccgtacgggacccggacggccgtatcgcctgtgtcgtcagcgtggtgagccacaccagtcggcacaccgcggccggcctgcgggacgccctgctgccgcggctgcgcacgtcggtcgacgcgatggagcgggagctgcgcgaggcaccgcccgccgagcctgccgcgcccgccgacccgtccgggctcgccgcctggaccggcgcctccaagcaggaactgggccgggagttcgtcgagtcgctggcccgcggtctcacggtgatcacctcgttcggggagggacgctccgcgctgacgctcacggaggtcgcccgggccacggggctggcccgggcgaccgcccggcgcgcgctgatcaccctggagcacctcgggtacgtcaccgcacagagcggggtcttccggctcaccccgcgcgtcctcggcctcggcttcccggcactgtcccggacgacactgccggacgtcgccgccccgcacctggcggcgctgtcgcggcgggtgcacgagtcggcgtcgctcgcggtccttgcgggcgacgagatccgctacaccgcccggttcaccaccagccgcgtcatgagcgtcaacatcacggtcggtacgcgactgcccgcctacgcgacctcgctgggccgggtgatgctggcggacctgcccgaaccgcacctccccgacccgtccgacctggtcgcgcccacgccccgtacggtcacggacccggaagaactgcgggccgtgctggatcgcgtacggcgggacggatacgccctggtcgacggggagctggaggaggggctgcggtcgatcgcggtgccggtgcgggagcgcggggggcgggtggtggcggcggtgaacgtcgccctgcacagcagccgtcgtacgcccgaggaatgtgtcgaggaggtcctgccggaactgctcgcgacggcctcgcggatcgaggcggatctgcatatcgcgggccggttcagggaggtgccgggggcc

SEQ ID NO: 3689 - DNA, 654 bp, Streptomyces avermitilis
  CDS (1)..(654)
gtgacgaaacaggaacgcgccgcccgcacccgccacgccctcatccgctccgccgcccacgccttcgaacggcagggctacacacaggcgaggctggccgacatcagcgcctgcgccggtgtcagccccggcgcactgcacttccacttcgagagcaaggcagaggtggccagggcggtggaggcggcggcgggggtgagcctgcgccgggcggcctggctggcccagccgccgggcacgaacgcgctgcaacggctgacgaacacgtcgcacgccctggccgagcgactgcgcggggacgtcgtcgcccgcgcgggcttccggctgaactgcgaatcggcgggcggcggcgcgctgaatctgctccgggaatggcagacctgcgtggagcagctgctcgcggaggccgccgaggaggggctgctggcccggcgcctcgtccgcgccgacacggtcagcgcggtggtggccgcgaccaccggtttcgaactgctcggccgccgggaccccgagtggctctccggccagtcgctggccgcgttctggcgggtactgctgccgcgcgcggccacggcggcggccctgaccgcggtggacccggacgggacgtgccccagccgggcggagacgcggaccccggcgaccaccgccgga

SEQ ID NO: 3690 - DNA, 861 bp, Streptomyces avermitilis
  CDS (1)..(861)
atggtcaagcaggtcagacaggaacgcgcgatccgcacgcgcaacgccttgatcgagtccgccgccgcgctcttcgcccggcacggctacgaagtggtctcgctgtcgacgatcagcgccagggcgggggtcagcaacggtgcgctgcacttccatttccccagcaaggccgccctggccgaggcggtcggggtggcggcggcgcagcgattcgggcggatcatcgccggcgaggcgctgccggctcagcgcggtggtgtgccggagcgcggtggtgtgccggagcgtggcgggtttgcggagcgtggcgggtttgcgcgtcatgagggggcgtcggcgtacggggggtcgtcccgttacgagggggcgccggagcgcggggcttcgcttcggcgcatcgaagcgcctcgtcgctgggatgtgccccggcgtgacgaggcggcgtcgaagcagggtgcggcgtctcggcagaacagtgcgctgcagacgctgatcgacacgagtcatgccctcctgcgcggcctcggtcacgatgccgtgctgcgggcggggttcgcgctgggggacggtgcggaggccgtcggccgcggcgaggacctgtaccgcagatggcaggagtgggtgacggaggtgctcgcccgggccgagcgggagggcctgctcgcccgcgacctggccgtccgggacgcggtgaccgcggtggtcggcgcgacgatcggcttcgccgtcctcggcggccatgaggggcagtggctctcccgtaccaccctcacccgcttctggacgctgctgctgccacggctcgcgacgccgacggcgctggaggggctgatggcgtcgggcaggccgccggagacgcgc

SEQ ID NO: 3691 - DNA, 1422 bp, Streptomyces avermitilis
  CDS (1)..(1422)
atggcggagacggccgaggcgcccgggacggccgaggcgcccgggacggctgaggcgcccgggacggccgaggcgcccgagaccgctgaggtgtccgggacggccgaggcgcccaggacagcggagacggccgaggcgcccgagacgaacggaaccaacagggtggcagagggagtcggagcagccggcgtcaccgggatgaaccagtgcccctacgccctggacgtgaccgggcgcgatctggcgggcgagaccgcgcagctgcggacgcgggggcccgccgtggaggtggagctgccgggcggtgtggccgcctgggccgtcgtacggcagaagtacgtgaagcaactcctcatggacgcacgggtgtcgaaggacgcgcgacagcactggcccgcgttcgtctcggggcagatagacgaggcgtggccgctgtatccctgggtggcgaacgagaacatgctcttcgcccacggggaccggcacgcccggctgcgccggctgaacgcggccgccttcaccgcccgccgcaccgaagccctgcgcccccgcgtcgaggagatcaccgccgccctgctcgacgggctggcggaccgacccgccggtgaacaggtcgacctgcgcgccgagttcgccaagctgctgcccatgcgcgtcatctgcgagctgttcggcatcgccgaggcgaaccgtgaacctctgtgcacggcactggagctggtgttcggtacggcggtcccggccgacgagatggccgcggcccaggtgaaggtcttcgggatgctggcggaactggtcgccgagaagcgggagcgccccggcggcgatctgacctccgcgctgatcgaggccagggacggcgacgacagccgcctgaccgagcaggaactcctcggcaccctctatctgatgatcgccgcgggccaggagaccacctgcacgctcatcaccaacgccgtcgccgccctgtgcgcccaccccgaccagctctcgcacgtgcgggaggggcgcgccgactgggcggacgtggtcggcgagaccctgcgcacgcacggtcccgccgcgtactcgccgatgcggttcgccatcgacgacatcgagctggacggcgtgcacatcaagaagggcgatccgatcctggtctccttcgccgccgccgcggcggaccccgagccgtacggggcggacgcggccgtcttcgacgtactgcggcccggccgccgcgacgacctggccttcggatacggggtgcaccgctgcctgggcgctccgctggcacgcctggaggcgaccaccgcgctgtcggcgctcttcacgcgcttcccggacctgacgtccgttcagccgacggaagagctcgagcccgtacggtccttcatcgtcaacgggtacggctccctgccggtcgtcctgcggccgcac

SEQ ID NO: 3692 - DNA, 702 bp, Streptomyces avermitilis
  CDS (1)..(702)
gtggcgcggcaggagcgagccattcggacgcggcagacgattctggtcgccgcggccgaggtgttcgacgaggtgggatacgaggcggcaaccatctccgacgtgctgaagcgctcgggggtcaccaagggggccctctacttccacttcacgtcgaagcaggagctggcccaggccgtgctggccgagcaggtcgcctcccttccgcgcgtccccgagcaggagctgaagctccagcagtcgctggacgaggcgctgctgctcgcccatctgctcagggaaggcaccggcgatccgatcgtccagggcagtgtgcggctgaccgtggaccagggctcgcccagggaccatctcaaccggcgggtcccgatgcaggcctggaccgagcacacgcagtccctcttcgaagaggccagggccaagggcgagatcctgccccacgccgatgtggaagcgctcgccaagctgttcgtgggcgcgttcaccggcgtgcaggtcctctcgaggatcatgaccgggcgcgcggacctggcggagcgggtggccgacctctaccgccatctgatgccgtccttcgccatgccggggatcctggtccgcctggacttctccccggagcggggctcgcgggtgtacgaagccgccatgaagcagcgggagtcggcggcagcgagtacgacggacgcggcacggacgttggag

SEQ ID NO: 3693 - DNA, 2019 bp, Streptomyces avermitilis
  CDS (1)..(2019)
atgatcgctacgacgttcgaggccggcccggtcgccacgggacacccggtcgccgaccacctggcacacctgctcttcgaggggaccggccgcgagcggacgcacggcacctggcgcaggctgatctccggccgggagttctcgtaccggcccggcctggcccccgccgagcgcaccgcactctcgtacgaccggctgcggctgctcaacgacaccgtcgacgacccggtgcggctcgccgccgacccgcaccggctggccgcgctgcacgagtggatcgggccggtcgacgggggcctgaccacgttggcgagcatccactacaacctgttcctcggcagcctcgtggaccacgacgacaacgggcgcgacctgtccgccttcaccaccctccagcaggtcggaacgtttctctgcaccgaactggagcacggcaacgacgtggcggccatggagaccgtggcggtcttcgaccgcgcgagcggcggcttccatctgcacacaccgacgccgggcgcgcagaagttcatgcccaacacgagcacgacgggcggccccaagagcgcggtggtcgccgcccggctcgtcgtcgacggccgggacgagggcgtcttcctcttcctgaccccgctcggcgaccggtccggcctcctgccgggcgtacgggtccgcccgctgccggagcgcacgggcaccccggtggaccacgccctcaccgccttcgaccacaagtggctgccgcgcgaggcgcttctggaggccgcccacggacgactcgcccccgacggcaccctgaccagcaccctcggcaacaggcgcaaacgcctcctgcgctccatcaaccgcgtcaccatgggaaagctgtgcatgagcgccggcaccctgggcatggcgcgcgccgcgctgaccatcgcggtccgctacgcccacagccgcctcgtgacgggcccgcgggccggggagcggataccggtcgccgcccaccgcagccaccatggccggctgctcgacgcgctggcgacggcgtacgcgatgaccttcctgcaccgcacggtggtggaccgtttcgcggcacgcaccgaggaggaccgggaggaggtcgagcggctgacggcggtcgccaaggggtggatcacctggcaggcgcgggcgatcaccaccgagtgccgcgaacgctgcggcgcccagggcctgttcccggccaacggcatctccgacctggcgtcgaacatcgagggcggcatcaccgccgagggcgacaacctggtgatctgggtgaaggcggcggcggagatggtcttcggccacgacacgacggcccgcacccgggccggggcccccgccgcacccaacagctccgccgcactctccgcgcccaaccgccccgccgcgcccgccactccctccgcacccggcgcacccgccactcccggcgctcccggcgctcccggcgctcccggcgctcccggcgctcccggcgctcccggcgctcccggcgctcccggcgccacgctcgccgacccggccttcctgcgcggtctgctcgccgaggcggaggcgatctggcaggcacgggcccgcgccgacctgcgtgacggcccggcgggcgatccggtcggccggtggaacggcacgtcgaccgccgccctcgaaatggtctccgcgcacgcccgtctccaggccgccgacgcgctcatcgccgcggccgagcgggcgacggaccccacggcgcgcttcctgctgcgctccctgtgccggctgttcctgctccgccggctccgcgaccacaccggtgacctgctcgccgagggccatctgacggcggaccacgtacgggcgctgccgagggccctcgacagcgtgtacgacgacctggccccgcacctgatgacgctggtcgacgcgttcgacttcccggccgagatgctctccgcgatccccatcgccagcggcggcacgatcgtccgcacgctggagcagtcggcggaggaatggccactggtctcgccggcctccccc

SEQ ID NO: 3694 - DNA, 1032 bp, Streptomyces avermitilis
  CDS (1)..(1032)
atgcgagcaacactgatttacggtgccggggacgtgcgcgtggaagacgtgccggacccgaagatccagcagcccaccgacgccgtcgtacgcgtactgcgttcctgcatctgcggcagcgacctgtggccctacaagtcgcggccggccaccgagcagggcgagcgcatcggccacgagttcctcggcgtcgtcgaggacgtcggctctgacgtgtccggactgaagaacggggacctggtggtcgcgccgttcgtctggtcggacaacacctgcgacttctgcgccgagggcctgcacaccagctgccggcacggtggctggtgggccgccgacggtgtggacggcggccagggcgaggccgtacgggtcccgcaggcgcagggcacgctggtcaagttgcccgtcgccgaggactccgccctgctgccctcattgctcaccctgtcggacgtgttctgcaccggccaccacagcgccgtgacggccggagtcgacccccgcaccaccgtgacggtggtcggtgacggcgcggtcggcctgtcggcggtactggccgccagacggctcggcgccgagcggatcatcctcatgggccggcacaaggaccgcaccgacctgggccgggacttcggtgccaccgatgtcgtaccggaacgcggcgaagaaggcatcgagcgcgtccgcgaactgaccggcggcgacggcacccacaccgtgctggagtgcgtcggcacgctgcccgcccttcagatgtcgctcggcgtggtccgcgcgggcggcacggtcagccgggtcggcgcaccgcagtacgacgacgttccgctgggcttccaggagttcatgaacaacatcaccctcacgggcggcgtggcaccggcccgcgcctacatcgacgaactcctgcccgacgtcctcgagggaaaggtcgagccgggccgggtcttcgaccgcaccgtcggcctcgacgacgtcccggccggctaccgcgccatggacgaccgcgaggcactcaaggtactcatccgcccc

SEQ ID NO: 3695 - DNA, 1179 bp, Streptomyces avermitilis
  CDS (1)..(1179)
atggccccccgcaagagaaaccccaacggctccggcagcatctggcagcgcaaggacgggcgttacgaggcgcgcgtctacgtcccccagcctgacggcacccgcaagcgcaagactgtctacggcaccacgtgggaagagtgcgacaccaagcgccaggaactggtcctgcgcgatcgccagggcattccgacgcccacaaggtccgccaagctctccgagtggcttccgtattggctgaagcactacgtcgaaccgcgccgcaagctcagcacgtacgacaagtatgaggtgcaggtccggctctacctggtgcccctgctgggcacgaggcggctggagtcgttgagcgtggcagacgtgcgccgcttcatcacccgcgtgcagaacgcacacacggccgcgaccgcgaaggagtcgcatcgagtgctgcgtacggcgctcacggcggctgtgcgcgaggaactgatcacgcggaacgttgcgtcgctggtcgagccgccgcgcgtcaagcagcgggagatccgcccctggtcgctggaggagacgctgagcttccttgaagccgcgcggagcgatccgctgtacgcggcattcgtgctggccattgccatggggcttcggcgcggcgagctggggggcctgcgctggtcggatgtggacctggacaaccgcgtcgtgcacgtccgtcaacagacgcagcgtcgcaggggaacgctgtacgacgacgatcccaagagccgccgcatccgcgtcgtgccgatgcccgcgctgtgcatcgcaccgctgcggtggcaccggctgcgacagcgggagacgttcgcgcgcacgggcgttgcctggtgcgaggccggctacgtcttcgccacgcggaacggccggccggtcgagccgcggaacgtgtaccggtctttcacgcgggtcgcggctgacgcagggctgagggtggtccggctgcacgacgcgcggcacggctgcgccacgctactgaccgcggccggcgtcgcgccgcgggtcatcatggaaatcctcgggcacagccagatcagcatcacgatggacgtgtacacgcacgtcgtgcatgacacccagcgggaggcgatcagtcacatggaccggttgctcaagcgtcgtctgcccaccagcctgagcggcggagctggatcaatagagtttcct

SEQ ID NO: 3696 - DNA, 198 bp, Streptomyces avermitilis
  CDS (1)..(198)
gtgctgaccgtcgtcacgagcgaaccccaagccctcaccgttccggaggtcatgaccgctctgaggcttagccgcagcaaggtctacgacctgatccgctccaagcagctcccgagctacacctccggccgtgcccgccgcgtcccggtcgacgccgtacgccactacatgcaggaccgacttgaggagaacgcagcc

SEQ ID NO: 3697 - DNA, 165 bp, Streptomyces avermitilis
  CDS (1)..(165)
atggaggccggaaaacggcacctgaactgcgaaaacgtccatgacgcagacggcggagtctgcgtcatctgcgtcatctgcgtcatgggatgcgtcgcgggtgacgtgccgatgacgcacctccgagccgctgcgtcacacaaaaccgcagctcagaagcctgaa

SEQ ID NO: 3698 - DNA, 1473 bp, Streptomyces avermitilis
  CDS (1)..(1473)
atggccgacgacgagacgaaccccgcccgcaaggtcatcaccgactacgcgcaagcgcacttccggtacttccgcaccgctgacggcaccgtgtacgcgcagcggaacggccaccccgtggcccgcccgatccgctcccagggcaccacgggcagccaccggcaggaactcatggtcggcctgttcagggacgggcgcggcgtgttcaacggatccgccctcaaggaggcgttggacctgatcgaagcactggccctgtacgaggacgtccaacccgtccacatccgtgtcgcccctggattcgacggggcgacgtggctggacctgggccgcgacgatgggcaatccgtccgcatccaccctaccggctgggacatcctcacccccgacccgcgagaagtctgctggcggcgcacgcaactcaccggggaactgcccctgccggccaaggacacgggcggcaagggcatcgacctcttgatgcggttgtgcaacttcgccaacgctgagaccgagtgcctggccattgtgtggctgatcggctgtctcgggccatcggtgcccgtgcccgcgccgttcctcaccggcccgcagggtgcgggcaagtcgaccggtgggcggatgctcgtgcggatcgttgaggggatgagcggtgacctgcgccgggctccgaaggacgaggagaacctgatcgcagcggtcgccgcagggtgggtcaccgcgctggacaacctctcccacatgacgccggatctgtctgacgccatgtgctgcatcgtgactggcgccgagagcgtcaagcgtgcgctgttcaccgacggggacgtgttccgcgtcggttaccgccggcccctgctcctgaccggtatcgacgtgggcgtcatccggcccgaccttgctgaaaggctcctgccgctgcggttggagcggccccgcgtccggcgcaccgaggccgaactgtggtcggagtatgcggaagttctgcccgtcgtcctcggctcgctgctggatctcaccgtgaaggtccgcgcggtcgcagcggagaccccgaccgatctgcggatggcggatttcgcgcacctgtgcgcgcagttcgatgcggcaaccggcctgggagcgctcgccgcgtaccgggccagtctggacgacctgaacgacgacgtgatcgagggagatctcctcgcacagaccgttcttcggcatgccgacaccatcgagccgggcggggcgcagcggatgacgtccacggagtggctgcactgtctcagtcgcctctacagcggcgaagatcttcgtgccttgcccaaggggtggccgacgacgggcaaggtcctctccgaccgtctcaaacgcctccaaccgaccctggccgcccggggcgtcctcatcgacacgggccgcaccagcgagggccgctacctcgaaatgacccggacggcccccgtacccccacatcagcagcagcggatgcac

SEQ ID NO: 3699 - DNA, 858 bp, Streptomyces avermitilis
  CDS (1)..(858)
atgacccaacccaccgacattcggacagagcacctggctactgctctctccctggcagcctccggcatcccggtcctgccgctgcgagcagggaaggtgcccttcggcaactgccaccgctgcacagacaacgcatgcgggggccggcccaacatgaagaacgccgggccgtgcgcctgccccggcccctgccacgcatgggcggccgcgaccacggacccggacgtcatccagtccggcgtctggcggcgcgcatggatgcgggcgagcgcggtcgcctaccaccccggcggagcctggctgacagtcgtggacctcgacaacgccgaggccgtgacgtgggcacgcgaaaccctgccagccacacagaccgtgcccaccacccgcggtgagcactggatctacctcgggccgatgcagtccaccaacgcggtccggcccggcgtcgacatcaaatccacgatggcctacgcccgctacctcggccccggcaccggccgcatggcggccctgccggacgccgtacgcgcgctgaccgtgaagaaccccaccacggcccggcccgcgccccaggccatcaccgtgcccgccctggccgggggtggggagtgccggcaccgcacgcccacctacctcgagcgtggcatcgccatggcagagcagcgcatcaccgcggcttccagtgcggtgcacgccaccgtctaccggacgttcctcgccgtgctgtccacgcacggtcgatgcggctgcctcaccgacacccacatggcgcggctgttcgccgccgctcaggcaaagggcgaatcggcccggcattgcaccgacgcatggaccaacgcccgtaccaggttgggactg

SEQ ID NO: 3700 - DNA, 1029 bp, Streptomyces avermitilis
  CDS (1)..(1029)
atgacgacgaccgttgatcttgtgccgggttgggtgacgacgcgcgatgtgatcgctgcgacctacggctgtgggacgttccaggggatcgagccggccgatgctgcgggcaaggtgttcgtgtactccgacccgtccgcgggtgaggagtacgggtacaccttcgatggccgtgcggaagacgacgagttcgggccgctgtacctgtacacgggtgccggcgccaacggtgaccagaagccttccggccgcaacggctcgctgctcagccacgtcgaaaagggccgtgaggtgcatctgttcgtcgcgcacggccggctgccgggcagtggagcgatgcggcagcgctacatcggtcagatggtgttggacccggtgaagccgtacgacgttcggcgcgggccgggcaaggacggcgtgatgcgcgatgtgctggtgttccggttccggccggctgagggaacgacgccggcgtggacggaggcggaccggatgccggccgccgcgcagactgcgttcgagatcgttgatcccgcggtagcggtggcgcagccggtggtgctgccggagcagagcggcgcgaaggtcaagaagaccgagcagcacagcactgttgagacgatggcggacattcctgccgggcagcgcaaggtgctgcgccgcgagggcgagttggtgaaggcgttcgtggcgcatctggccgcggcgggccacgagacccacagttttcagatcaccatcaagggcgagcccggggcgctgactcccgacctgtacgacgcgacggatcacgcgctgtatgaggcgaaggggcagacgacgcgggccaatgtgcggatggcgatcgggcagttggctgactaccgccggcacatcccgggccgcaaggacctgcttcgggtggttgttctgctgcccagcgagcccaccgaggacgtgaaggatcttctcggtgaggagtacgtggagttggtctggcagaccgaggacggcggtttcgccggctggccgctcgcctacaaccagccc

SEQ ID NO: 3701 - DNA, 453 bp, Streptomyces avermitilis
  CDS (1)..(453)
atgacgcacacccaccggccggccgccctcgaggtgcaccacccgcagccgctcgccgtccacccgaccgtcgcacccctcgtgaccgtccagccgggcccgacgccggccgtgcagagcatcgtgttgcccgacggccgcgtcgtcaccggctacaccctcacccccgcacccgccctggcccccgtcgacgcgcggccggccgtctcgcgcacagcggtcaacgtcgccctcgggggcgtcgggttcgccgcagtgtgcggcgggctggtcctgctcaccacgttcatcgcagccctgaccacgttcatcagccagctcatcaccctcgccgcggtcatcttcggcggatggatcgccgtacagatcctcggcggcacccggcacaccggccggggcggaaccacgatcaacatccgtaaggccgtgatcaagcgcagtcacttccacggc

SEQ ID NO: 3702 - DNA, 2076 bp, Streptomyces avermitilis
  CDS (1)..(2076)
atgaccaggaacaatcgccgcaacgtcaccgattatctggacgacgggcggaccatggccacctacaccgtccccgacatgcacggttcgtcgggcgggggcgtgggtgcgtacctgctgcaccgggccaagccccaccttcccccgtggatcggcctcgccggcaccggtatcgccggcgcgctggggaactggcggtgggagggcagcgccggcgccggcgtcggcctcaccctcgcctccgtcgccctcaccggggcaacgtggtgggcggggaagtcgaccagccaacagcgccggctgcactccgccgtcaccgtcgccgccggctccgcatgggtcaccgccgcctgcctggccggccccacggccggctctatcgacgacatgttcctgatgggcgggccggtcgtggccctgtcgtggaacgtgcgcatgatgctgcgccacaaccccgagggcgccgtgaacgggagctctgacggcgggctgctggagaaggtgggcctggcccgggcgcagatcggtgcggcgaaggtggagccgaaccgggtcaccgcgccactcgccgtggtggccggtgagcagaccaacgacgacgtcaccaaggcactggcccggatcgcctccgcgctggacctgccgacctccgccgtccgctacacccccgacgccggatcctcccgccgcggcgaactcgtcatcgtccccgaagacatgctggccgacgtcgtggagtgggaagggccgtcgaacctcgggggttcgatcgccgaaccgctggtcatcggccgctacgacgacggcgccccactcgtcgtgtggctgccgggcgaccccgacgcggaacgcaactccacccacgtcctggtcgccggcggcaccggatccggcaagggcgacgccgccttgaacctgctgaccgaggttctctcgcggcgggacgtgatcgtgtggttctccgacccgaaagccttccaggacttcgccccgctccgccccggcctggactgggcagccgagggcggcaccgacaccgaggtcatggtcgaggcggtcaaggccgtcatccccgcccgcacccgctggctgggcgcccacggctaccgccagtgggtaccggccgcagcccagcagcagaacgaccccgcccactcctgccagagcgctagggcgtgcggctgcgccgggatgccgttcctggtcgcctggttcgaggaggccgccaacaccctgcgcgccctcggagacgacgcgttcaccggcatcgcacaggaagcccgatcggcaggaatctcgctgatcgtgtcgcttcagcgtccctcctacgaccagatgtccaccagcacgcgggcatcgctgccgtccgtgatcgccctcggctgcgacccccgcgacgaagggttctgcctccccgacaccgtgctggacgccggcgcccaccccggagcatggggaaaccggcgccccggatactgctacaccgtctccccgggcatccccgaggaccgctacccctccccgggccgcacccgccgcttcacgctgcgcgccgtacctgtcatgcagcagctcgccacgtgggcgcagcacaacggcgcgcacgccgacccgatcaccgccggcgccgccgctggcgtggccgggcaggcatacgccggccgctcgagcgactcgccgaccgcgcagccagccgcgctgcgggccgtccaggaaggggatgacatgaccgagtacggcggcgggctgctggtcgacctcgaagacgccggcatcgacgcggacgccgaactccccgaggccgaggacggcgacgacgccccgatcttcgggcaggagaccgggcgtaagccgtccccggaggaggcacggcggttcttcgccgaggcgctcgccgacttcgaggcggccgggcagatggtcgtcgggccgaaggacttcatggactggtgcgaccgtcacaacctctcgcgcccgtgggtctccgagcggttgaaggaggccgccatggacggccgtctggaggcgacgaacaccaccggccggtggcgcatcgtccccgtcctgacggccgcc

SEQ ID NO: 3703 - DNA, 567 bp, Streptomyces avermitilis
  CDS (1)..(567)
atggcagaccaggcttccgcccaccggcgggcacagaccaccagccgaccgcgcaacaccaacggtgacggcaagggcaacaagttcgccaacgccggcgccgccgccggcgggttcgtcggcgccctcggtggctcgttcgtcccgccgatcaacgtcaccgtcaacaacagcaagcagaccgcccgcaccgggggcggcagccggccgcactccgagtcgctgctgccgtcgccggagttcggttcgccggcgcaggtgcggcagtactgcaacaccctgcgcgccgccgccgtgacgctctcgatcgaggtggccatgggcgccgaaatcatgaaaggcgtcctggccgcggttcccgacccgcagggccgcaccttcggctcccgtgtccgggccgcgaaggtggcgcgcaagatgcagcgctccgccgacgccctgcgtgacgcggcgaagaacgccgcggcctgctactcgacctttcagcaggagttcgaggaggagatcaaccgcgtccgtcaccgtgcccgcaagccgcagcagccggtcatgaactggcaccagcag

SEQ ID NO: 3704 - DNA, 498 bp, Streptomyces avermitilis
  CDS (1)..(498)
gtgtcaagtcgtacccgtgcccgcggctccaagagggctgccggcgtccacacagtttcgatcccgcgtcagcgcgggcgccgccgggcccagccgttcgtgatcgtcttccctgagtcgccctcgctgactcgcgaggcactcggcttcatcggccgcgcgctgtggaagggccgccgcgcgctcgccccgaccgcgctcgccctgctcgcgttcgccgtgaccggcctgctgcacgtcatggcctggtggtcgtccctgatcctcgcgcccctggccgcgggcccgctggtgtggctggcggtcatgcaggtacgccggcccggccgcggcgcggtcgtgctgtggcgggccggcctggccctgctcgccacgttcaccgccgcatgggccgcgctcgcagccggctttgggccgctcgccggcccgctggatctggtctggctgctgatgtggatcgccgctcagaccgcgtggctcttcgtccgccgctcgcac

SEQ ID NO: 3705 - DNA, 1080 bp, Streptomyces avermitilis
  CDS (1)..(1080)
gtgagcgcccggagcaagcggcgtcagccggccggggacatgttccccggcatggccgaccgcatcaccggccgcccaccgaaagccgagagcgagccggaagcgatgacgctggatgaagccatcgcccgctcgttcgccatctatgaccgcgtgcttgccgtcttcccggtggtggccacggtcggtttgttctccggtggcaacgactccgtggtcgtcaaccacctcttccgccaccgcgtggacgcgatcgcgcacgtcaacacggggaccggaatcccggagaccactcagcacgtgcgggacgtggtcgccgcatggggcctgcgcctgcatgagctgcacccccgacactcctaccgggatctcgtgctcggcaacgtgctcgccacccgcggcaagaacatcggccgacccgtctggaagggcttccccggcccggccggccactccgtgatgtaccgccgcctcaaagacgaaccgctgcaacgcctgcgcgggcagatcatcggcaagcgcgggcggtcccgcaacgtggtctacctgggcggcatgcgctgggcagaaaccgaccgcaggttccgcaacgccgaagaagtcgaccgggaaggcgccctgatctgggtgtctcccatcgtgcactggaccgatgcgcacatgcgcgaataccgggcccggcaccgctgcaccctcccgcacgagcacgccgaacaccacctgtgcacgccggatgcgctgccgctgaacgaggtcaccgttcacctgcacatgtccggcgagtgcctgtgcggagcattcgccaggcccggcgaactcgatgagatcgagtacttctacccccaggccaccaagccccaccgggagctggagcgcgaggcggaagccgctgggttgcccgcgtgcaagtgggggcagcgcccgcccggcccgcgctcgcgtcgctcggccgggcggctgtgcaccaaatgcgacggcatcgagggacaagccgacctgctcgccgaatggcgtgagtccggcctgatcaccgacgcccagttcgccaccttcaccagcaccgacgaacagcgcgccgcc

SEQ ID NO: 3706 - DNA, 975 bp, Streptomyces avermitilis
  CDS (1)..(975)
gtgaacggtgttcatatccgttcagcggagcgcgcgctgaacgtggggacgtggctgatcgtgtgcggcgccatgctgtattcgatcctcacggtcacccccctgatgtccgctcacacccccgccaagtgggggtggacggcgccgatcctgccgctcgtcgtggacgccgcggtggtcatcgtggtccgtctcgactccgtccttgcccgcctgggcgggcacggcggacgctggcccatcgtgctgcggtggatgaccggcaccatgaccctcgccctcaacaccgccgactccgccttacagaaagacctggtcggagtcgcggtccattccgtggcgccgctgctgctgatcgtcacggcggagaccggacttgcctaccgccgcgccatcaccgccgccgtcacggcgctggaggcgcggcagcgggccgaacgcgaagcagcccagcgggccgcccgcgagcggcaggaagccgcccggcgggaggcgcgcgaggagcgcgagcacgccgcgatgctggcgcgtgaacagcgtgaacacgaagcccgcctcgccgcagaagcagcggagcgcgaggaacgccggcggcgggaggagcgcgaggaccgcgccgcccgcgaggctgccgaacgcgaagggcgtgaacgccgtgaacgcgagcgtgaacagcgcgagcgcgatcgtgaacacgctgaacgcgaggccgccgaacgggtagcgaaggaggccggggagcgtgcggaagccgcccgccgtgaacacgccgcgctgctggatggtccgcccgtgaacagcaagctgcccgaggaccacgcgcggcggatcgtcgccgctgccgtggccgagggcgtatcggtgcggcgcgcggccgatctgtgcggctggtcggtcggctgggtgtccgcccgctacgccgagtaccgcgaccccggtgacggtggcgcgcaactcgcgatcgtgagccaagcg

SEQ ID NO: 3707 - DNA, 288 bp, Streptomyces avermitilis
  CDS (1)..(288)
gtgatggcgcgggagctgcgggcgcagctgtccgcgagtcggggcggctggcggctctacgtggtggtgcgcggctcggtcgagccgtggcttgagcactgcttcggcccgggtgatcggttgctgacgttcacggagcgggcgcgggcgctcacggcgctggggttcgttcaggcgccggctgctgagtgggagtggacggagttcagcacggatcccgccgaccccgcctcgccggtgtggctgctcgcctccgtgctggtgcgttcacggcaggaggctgcggcg

SEQ ID NO: 3708 - DNA, 1362 bp, Streptomyces avermitilis
  CDS (1)..(1362)
gtgcccccggccactctctggctgactcctagtaggactccgtcaggtctttcggtcgggcctgttccggagcatgttgggtgtgtggacgcacacgaagtgaaccgcgtacgggcgacgttggcgttatacgtggccgatgtgttcgcctcggtgccgcggaaggaccagcgggccaagggcgactgctatctgcggggtctgatgctggacggccgccgcaagtccatccaggccatggccgcccggctgccggacggcaacgagcagaacctgcagcagttcgtgaaccagtccacctgggatccggtgccggtgcagcggcggatctgcgaacgcatgctgcccctgatcgccccggtggcctgggtgatcgacgatgtgtcggtgcccaaggacggccggatgtcggccggggtggctccgcagtactgcggagcgctgggcaaacgggccaactgccaggtcgcggtcagcgtccacgccgcgagtgataccgcctcctgcccgctgcaatggagcctgttcctgcccgaagagtgggcgtccgacaccgaccgccggaccatcacccggatcccacccgaggtcacgcaccgcgagaagtggcgcctcgcgctggacatgctcgacaccctcgccgcctggggcatgacgccgccagtcatcgtggccgacgccgcctacggcaccaacgcacacctgcgggccgcactggccgaccgccacatcgcctacatgccggccgtccgctcggatgtcaccgcccacccattcgacgcgaagcccgtggcgccggcccgcaacgggccggtcggctgctggccccagccccgctaccggcaccccgcgccgtcgctgtcagcacttgctgccggcctccggcaagacgcattcaccctgctcacctggcggcaggactcgcgcgggcagttacgctcctgcttcgccgccgtgcgcatccggcccgccggcaaggccgtcgaacgtccggtcaaagccgccgcttcggcggaacagggctggtgggacggcgtcctgcccgactgctggctgctgatcgaatggccctccgatgctgaggcgcccaccgattactggctgtccaacctgccctcggacacccccatcatcgacctggtccgcctggccaaggtccgctggcgcatcgagcacgactaccgcgaactcaaacacggcctgggcctggaccacttcgaaggccgttcctggccaggctggcaccaccacgtcaccctcgtgaccgccgcccacgccttcctcaccgaacagcgcctggccccaaaagtccccgcgccggactcaccctctaccaagtcctcgacaccctccaggacatcc

SEQ ID NO: 3709 - DNA, 1008 bp, Streptomyces avermitilis
  CDS (1)..(1008)
gtggcatttcgctacgaacaccaggagcctggctcgcgcgtgatcagcggtggacgggaccacagcaaccgcctgttggagcgcctgggcttcaccgtgatcgacggacgccccaccacggtcgagggtgagcgtgcctggcgtctcgcagtgtggtcgcacctacagctcaccgaagaccttagccaggttccgccgggcgtcctgcgcgcattcggtgtctacggcggaggccagggcatctggatggataaagccaggacggacgccgtccacgagggcggaatcactatgggagtccttcacaccggtgcgcactacccagacgagatcagcgacaacgacgtgatctaccactacccaactaccgggcggggcccgggccgcgacgagtcggaggtcgctgcaaccaaggcagcagcaaccctgaagctccccatcttcgtcatcgcgaagccaactccccgatccagtgtccgcatcgtgcgcctggcgtgggtggaggggtgggaagagcgctccaggatcttcctgatcagcttcggagacagcagacctgaacacctcctgaccgaggaccactcagacaaccagcctttttccctgacgggcaaccgcagccggagcagccggcgcaacgttcgtgagcgccccggccagcgtcgattcaaactgcgagtcttccagcgctacggacctcgctgtcccctctcgggaatcgcagtgcccgagatgattgaggcagctcacctaaggcccgacgccgaggacggcacagacgatcctcgcaacggcttgcccctcaacgcggcactgcaccgcgcctacgatgcctacctgttcgctatcgagcccgagaccctcagcgtggtgacgcgcccccagggcccaaccatcgaagagcttggcatcttcacgccacaccttcgtgagctgcctcggcgcccacacacggaagcgctgcgctggcgctacagggaatggcagttgcgtattggcacacagggg

SEQ ID NO: 3710 - DNA, 393 bp, Streptomyces avermitilis
  CDS (1)..(393)
gtgggcaatctgggggggtaccagatgatgacgacgctggcgaagaaggtgggcggccccgtggcgctggccgtcgtcactgccgtgagcgggtgggccatcggccggggtgctgaagccggcgggaaggacatattcaaggccgccaaggctgcggccaaaaaacggaacgccccgtgctcgacgaagggccaggtcttcgacgttgtgtccgacggcgaggacggcaagggcctcgtgctccgggcaggtgaccagtaccgagtcatggagtgcgacggggaggcgatcctcatcgaggtgctcggtggcacgaacaatccctacttcacgtcatcgcagttcctggcgtcagtgtcgggcttctccacgggagagaagaccaaagccaag

SEQ ID NO: 3711 - DNA, 1101 bp, Streptomyces avermitilis
  CDS (1)..(1101)
atggccacgttagaggcggagttatcgaagctcggtgtcatgtttgatttacgttcatatacagggggattcgtgccgctcgttgttatccagccctcctacggcaaccctgccgcccgccgccactggagggacaccctcgacgcccacgtcgacttcaccacccatccccgggccagcctcctcaccccagaccagcgcaagcaactcaatgagtttcaccccagcggtgccgcccgcttttggggagcgaccagcgtgcaggacacgaagatggaccgcctccacgccggagacatcgtcctcttcaccggcaaaaaccacgtacgcggcattggcgagatcggtgcgctcttccgtaatgcccagttcgccaacagcatgtggaccgaagaccccaccaaaggcagctggcacaacgtctacagcctgctctcctttgcccccaccgagatcccctacgaggagatatgggccctgcccggcttcaacgtcggcgacaacttcataggcttgcgtatcctggatcccgagaaggccaccaccatcctcgatggcctcggcatcgaagcacaagtggatgccgaacttggcaggcaactacacgagccggttgcacgcgcgctgcgcacccacacagacatcgtggacggcgaagcccttcgcacgcagaccacgcgatacacgctcacagaacgcgaactcgtcgtccaccgcaccgaggcgctcctcctccaggagtacaccgactcgctcgggatcgatcagcctcagcgactccgcacgccggctggcatcaccgacttgcacttgacgcggccggacggtagcgaagtcgtagaagccaagcgcgccagcacccgccggttcgtacgagaagccctggcacagctcctggactacgcccctcacacacccgagccagccacacgtctcacggccttgttccctacacgcccggctgaccaggagctggccctgctccaccgctacggcatcgactgcgtctaccgcacccatccccgcgccttcgagcgtgcgcccgcggaccaggaggtccgagccggcatgacgccgttctggcaaggacggccgtcgaac

SEQ ID NO: 3712 - DNA, 1746 bp, Streptomyces avermitilis
  CDS (1)..(1746)
atgagcgtgaatcccaccttccagagccctgacgacggtgacccgcaggccagccccacatcgcaggcggccatcatccagatcgacaccgccctggagtccatgcgcgactccggcttcgatctcaccgccgcggccggcgagccgatcgacaactccatcgaagccggcgcaacccacataaagatcgcgaccaccttcggccctcagaagcgatctatcgaggagatcgccttcgccgacaacggccggggcatcaagaccgaaatccttgctctcgcactgtccatgggcttcagcacacgctacggccaacggggcagcctgggccgcttcggcgtcggcctcaaactcgccggcctcagcctcggccgccgcatcgacgtgtacaccaagctgcccggcgacgacgtgatccgccacgcctacctggacctgcaggagatcagcaagaagcagcagacccacatccaggcccgcgaggtgccagcatggccggccgcctacgagcacttgatgcgcaaccaggacgggacccccgtcgactccggcaccctggtgatctacggcaggatcgacaagctcgacggcggcggcccctacggcaccagtctcgacgagaagctcgccgacctgcgcaacttcatcgcccgggcctaccgcaagttcctggaccaaggggtgatcatccagctcaacgacacgaagatcaccctcttcgacccgctgttcctgctcgacaacccgcggatcctcaagcggtaccccaaggaggacatgcacggcacggtgatcgacgcggacgacatcccgatcgctgacggccactccatccacgtcaccgtcaccatcgtgcccgccatcttccggtggaggtcaggcgagggtggcctcagggaccgggacggccgggatatccgcgagttccagattgcggacggcgtcggaaagatcagcatggtgcgcaacggccgcgagatcaactacgacatcgtgcccaagctgctgcccgccggcgtcgacaaggtcgaccgctacatcggcatcgaggtcaccttccctgccgaactggactccttcttccaggtccgcaacgtcaagcgcggcgctgtccccgtcgacaagctccgctcggagctgcgccagtggctcgaccggccggtgcgatccgctcgccgtgccatccgtagccactggggcgagatcgagacgcaggaacgcgccgccgcgcaggcccacgccgaagcgacggcagccgctgcccgcgcggagaagaccgcgcccatgggacaggcaggcaaggacctcacggatcaggagagcgaggagatcctgcaggagctccttgaggatctgggagtcgctgacgaccaggagaaggccgaggaggtccgcgagcaggtcaagcagaaccccttcaccctcgtcgacggggcgtggcgcggcaaggaaatgttcgagatcgaccacctcaacggcaaggcgatcatccacctgaaccaccgccaccccttcatccgcgacatctacgaccggctcaaggccgtcgctgacgacggtgccaacggcgtcgaacccgaagagctgctcgccctcatccgcaagacccagaccgctctcgacaccctcttcctcgcctacgccaaggccgagaacatgcatcccaagcccagccagttcgacgatctgcgcagctactgggggcagttcacccagtcctacctgcaggaactccgcaacgaggag

SEQ ID NO: 3713 - DNA, 468 bp, Streptomyces avermitilis
  CDS (1)..(468)
atgctcactgagcaggcgcagcatgcgctgaaactgctgtaccgtcgcgccgacaagacgggcgacgccttcgacctcgagcgcatcgaccgcgccctcgacgaggtcatccgcctcaacgcgaacgcccccgccgcgtttcagatccgcagcgccttggcgcatgccggcacggttctgcgcgaccggcgagtcctcgcgcccgcgatctccctcgatgagaccgactcgtaccgcgagcccggcgccctcgacgagcacttcgcggtcaccgacatccgtgcgtggctcgacactacggaggcgctgacggcatcgcagcgcagtctgctgcagcagctgagcgctgatcgggatccctctgatctggccgtggagcgcggactgagcgtcgcgcggatgcgcgagcaggtttcccgggctcgccgtcgtgcacggatcgcgtacgccgcggaggtggtgcgggca

SEQ ID NO: 3714 - DNA, 1137 bp, Streptomyces avermitilis
  CDS (1)..(1137)
atggccaacaagaaggggaggcgcagaagcttcgggtcctgccgtcagctcgcctccggccggtggcaggtgcgctaccgcgatccgcagactggcctcctgcgcccggctgagaagacgtacgagaccaagaccgatgcgcaggtcgcgctgactcacattgaggcggacatcacccgtgggcagtgggcggaccccgatgctggggatgtgaacttcgccgactacgccacggcgtggctgagggatcggaaactggccgaccggactcgtgagcggaatgagtcggtgatgcggctgcatgtcgttcccgttttcggtgcgggctccatcgctgacgtcacgaccgctcgggtgcgaagctggcgcggcaagctgctcgctgctggggtgggggagcccacggtggtcaaggcgtaccaactgctgcgggccctgatgaacaccgcggtagatgacgagctgatccgccgcaacccgtgccggatcaaaggcgcggacagttacgacgtgcctgagcggcctgttttgtcggtggcggaagtctttggcgtcgcctatgccattgcaccgcgctaccggctgctcgtcctcctggctgcgttcacgactctccgcttcggcgagctggccgcgctgcgtcgcaaggacatcgatctgaacggtcgcttggttgtggtccgccgggcacaggccgagttgcagaacgggcggctcttcgacaaggcgcccaagtcggccgcgggccttcgaaccgtttccttccccgctgagctggtcgacgagatcagccaccacctgaagcactacgccgccgatggtcaggagggccacctgttcgttggtccacagggtgggcagcttcggcggagcaacttccgggatgactggatcaaggccaggaaggcagcgggcgtctcgcccaagctgcactttcacgacctgaggcatacgggcaacacgttggcttcgaccgccggcgccagcactcgggagctgatgacgcgcatgggccacagcagctcgcgcgcggcgttgatctatcagcacatgacaagtgaccgtgatcggacgatcgcggaccgccttggggccatgatccggaacggcgagggcgatctgacggccgcgggcgac

SEQ ID NO: 3715 - DNA, 1311 bp, Streptomyces avermitilis
  CDS (1)..(1311)
ctggcccagcacggcaccctgcccggtatcctccgccagctctccggactcggcggctgcaccaacccgatccgcctcgacggccaccgcaccgagtacgacgtcgacacccgcaccggcgagatcggcaacgtcctccaccgcctcgactcctccagcctcccggccggtcacctcctggtccgctgcaacaaccgccgcaccacccgctgtgcggcctgcgcggaggtctatcgccgcgacaccttccacctgatcacctccggactgcggggcggcaagggcatcccggaacgcgtcgccgcccacccccgcgtcttcgccaccttcaccgcccccagcttcggtcccgttcacaaccgcccctccggtccggccggttcggtccgccgttgccgctgcggcgtccaccacgaccaggacgacgctgcgctcggcaccccgctcgacccagaaacgtacgactacgaagcggccgtcctctggaacgcgcacgccggcccgctctggcgacgcttctccacctacctgcgccgcgaggtcgccaagcgcgccggattctcacagcgcgcgttccgccagtacgcccgggtctccttcgccaaggtcgccgagtaccagaagcgcggcgccgtccacttccacgccgtcatccgcatcgacggccccgagggcggcgacaccccgcctccggcctgggccaccgctgaactgctcaccgacgccatcggcgccgctgctgctcacgtccgcgtggacggcccggtcatcgacggacgcgcgcccaccttcaccttcggccgtcagctcgacgtccgcacgatccgctccgccgacttcgacagcggccaggaactgaccgagcgggctgtcgcctcctacatcgccaagtacgccaccaagggcgccgagaccgcgaccggagctctggaccgcccgttgaaattcctcgccgaactcgcccaactcgacatcagcgaccacgcccgccggctgatccgaacggcctgggccctcggcgcgcgcaaggagttagaagacctccgcctccgggcctgggcccacatgctcggcttccgcggccacttctccaccaagtcccgccgctactccaccaccctcggcgcccttcgcgccgcccgcgccgaatggcgccgcgcccaagccgcagcagccaccgaaggcgacaccggcacgaccctcgtcgtctcgcactgggtcttcgccggaaccggtctgtcctccgccgaagcctggcttgccgcatccctcgaacccgcccccggaacagaaggagaaccgatccgtggc

SEQ ID NO: 3716 - DNA, 243 bp, Streptomyces avermitilis
  CDS (1)..(243)
gtgttcctgcccaagtaccccgacaactcgaccccgccgcccgcacacacccacaccccggccgacccggcacccgtacgacgcacgctcctgcagatctccatcagccccggagcagtcgcggccgtcctcgtcggcggagtcgtcctgaccgcgctcctggccgccgtcgccgtcacggccatctccgtggccatcgccgccgtggtcctgcgctcgatgctccgcgaccaccaccggcgc

SEQ ID NO: 3717 - DNA, 192 bp, Streptomyces avermitilis
  CDS (1)..(192)
gtgaccgtcagcctcccgctcgtcgtcgtcctcggcttcatcgcctggggagcggtcaagttcctcggcgtccgtacctggatcgtcgtcgtgatcgccctgttcggcttcctcctctcgcacaccttcatggctcccgccatcgactccggcacgcgttccggcgtgggcattgtcaacggctcacatgac

SEQ ID NO: 3718 - DNA, 189 bp, Streptomyces avermitilis
  CDS (1)..(189)
gtgaccgccaaccgccgcttccggtccgtcacccgcataggccccgttcaggtcggcacgtcctacgacgaccggggccacgagaagcacaccgccgcctgcaccgccccgcgctgcggcttctccgccgactacgacagccgcgccgccgccgaactcgctgcccgtacccaccgctgccccgtccgc

SEQ ID NO: 3719 - DNA, 624 bp, Streptomyces avermitilis
  CDS (1)..(624)
atgcgcgcccaactggcccgtatcgacgcggtactcgtacaagcgctcatcgccgcagcactgtccttcgcccacctgcacgacgtcgcctcggccgccggtcaggacggatggaaggcctgggcgtatcccatctccgtcgacctgctgctcgtcgccgcctggcgccggttgcggaccggcgacgcgaaagcggctgggtggtgctggttcgtcatcgcgctcaccgcgtccctcggagccaacgttgccaccgccgggctcctcgacctggaccaggtgccggcatggctccgcatcctcgtcgcaggctggcccgcggtcgccttcctcggcgggaccctcctcgcccactcggccccgggtccggtcccgcacgaggacaccgaggacgagcaggaccaggaggacgcgcccgatcccgccccggagctccccacgcaaccggctcccgaaccgacccccgctccgcctgccgtagccgtcccggccgccctggtcgagcacgcccgcaaggtcgccgccgaacaccacacccgtaccggaacggccatcgacaccccgaccctccgcgcccggctcggcgtccccgcgcccatggccgacgccatcgccgcccacctc

SEQ ID NO: 3720 - DNA, 1377 bp, Streptomyces avermitilis
  CDS (1)..(1377)
atgaccgatctggcaacgcttctggaggtgggtggtcccgtcgccgcgctcggcggcggggctgcctacacccgggccaagcaccccggcgtctactggtccacggtcggtctcctgatatccacggcccggctgctcagctcctacagctccgtcatggaggcctgcggcctgaccgtcgctccctcccggctgcgggtcctggcggtcaaggccaccacccgacgggagatacgccccgtaccgccgcgtcggggaatcatccggcccacttcgaccgggttacggcttcgtctgcggctcgctcccgggcaggaacccgccgacgtcgccgcctcggccgaacggcttcggcatgcctggggcgttcacgccgtgtacgtcacgaccgtcaagcccggtgtggtcgaactgcggctcgtcggcttcgatgtcttgcggcgggtacggatgccgcgcaaggtcgatggcgggttcctcaaggtgcctgtggcgctgcgggaggacgcgactcccttcgtacgggactaccgcaccgtgcctcaccaactgaccctcggcgcaaccctgtccggcaagtccatgtacctgcggcatctcgtcgccggactcgccccgcaacccgtcgccctggtcggcatcgactgcaagcgcggtgtggagctggcgccgttcgccgcccggctctcggcactggccaccgaccccgaacaggcggccgagctgctgccggtgctcgtcaaggaaatggaggaccgatacgacctgatcaaggcccggcaggggatcgccccggacgcccccgacgaggagatcacctccgacatctggggcctgtccgagcacgaacgccccgtccccatcgtcctgttcgtggacgaggtagccgaactcttcctcgtcgctacccgcaaggacgaggaccgacgcgacgaaatggtcacgcaactcatccgcctcgcccagctcggccgcgccgccggtatctacctggaggtctgcgggcagcgcttcggcgccgaactgggcaagggagcgaccatgctccgggcccagttgaccggccgtgtctgccaccgcgtcaacgacgaagcctccgccaagatggcgctcggagacatcgcccccgaagccgtctccgccgcgtgcgccatcgctcccgaacggcccggcctggccgtggccggtgacacctccggcggctggtcccgcatccgcaccccgtacctctccctcggcgacgccgccgagatctgccgccaggcggcccacctggtgcccgacctccccgcgctcaagcgcttccggtccgacgtgcccgtacggcccgtcgacacgacgagggccccggtactccagccgcgccccgtgaccgac

SEQ ID NO: 3721 - DNA, 354 bp, Streptomyces avermitilis
  CDS (1)..(354)
ttgcgcaccatccgtgtggagacctcggccgcgacgatcctgctgaccgaggcgcccgagcccaaggtccgcgaccggcagaccggcgagatcgccaaggacatcaacagcggtgaggcactgatgacgatcggcgtcgtctacatcgaggaaggagagtcctccctcatcaaggtcaccgttcctgagagcggtgtctccgaggggctcgcgctcggcgctccggtctcgctgccggggctcgtggcccggccgtgggaaagcgtgttcaacggccagcagcggcacggcatcgcctaccgctccgccgccgtcactccggccgcgttcccggccgccatgggggccacggcc

SEQ ID NO: 3722 - DNA, 786 bp, Streptomyces avermitilis
  CDS (1)..(786)
gtgacctcactcccgaccagtctgcttggcgacctggaccccacgagcgatcgtgcggtgttccggcagatcgccgaccagctgcgcgaggccatcgaccgtgggcgattcaaggagggcgaaaagctcccctcggaagctgagctcgtcgagcactacggagtgtcccggatgaccgtccggaactccttctccatcctccagggcgaggggctcgtccatgccgagcacggaaaaggcgtcttcgtacgaccacggccacccgtgcggcgactagcctccgaccggttcgcccggcgccaccgcgaacaagggaagtccgcgttcatcgtcgaggccgacgccgccggaagtcacccgcaggtggacagcctggaggtgaaggaggagaaggccagccaggacatctccacccggctcggctccgtacggcgcgtgctcgcccgccggcgccggtatctgctcgacgggcgtccggtcgagttcgccacctcgtaccttccgctcgacatcgcccgggacaccccgatcgccgagcccaatcccggtcccggcggcatctacgcccgtcttgaggaactgggccaccggctcgaccacttcgaggaggagatccgggcccggatgccctcgccgtccgaggtcaagacgctccggctggcctccggcgtgcccgtgatccacctgatccgcaccgcgtacgacaccgaggggcgggccgtggaggtctgcgacacggtcatggcagcggacgcgtacgtcctgtcctaccagctcccggcgacg

SEQ ID NO: 3723 - DNA, 486 bp, Streptomyces avermitilis
  CDS (1)..(486)
gtgggcgagtgttgttgctacggtggagagcctagccatccgagaaggccgaggaacgtgaccactgaccgcccgcactccgtgagcgttgccggagtcattgtcgacgaccagggccgagccctgctgatcaagcgtcgcgacaacggtcactgggaacctccgggtggcatcgtcgagcgggaggaaaccctccccgaggcccttcagcgcgaagtcctcgaagaaaccggcatcaagatcgcgctccccgcgaccctcacaggcgtctacaagaacatgacgggcctgatcgtctcgctggtcttccgatgcgaagccgccgacggcacacccaccaccggggacgagacctacgcactgcgctgggccacccgcgaagaagtcaccgaactcgccgacgaggcgtacgcgatccgcgtccttgacgcactcgacgcggcatccccgccggccatccgcgcccacgacggcgtgaaactcgtc

SEQ ID NO: 3724 - DNA, 426 bp, Streptomyces avermitilis
  CDS (1)..(426)
atgcacgagtatacgagcactgcgcgggtctggggactcacttgcccaggtttcccagaagaggtcagcagggcccgccgctggacgcgggacatcctgcgcggctcaccgttagccgaggacgccgaactgatcgtgagcgaactaagcgcgaacgcgatcctccacaccgccagcggacagcagtcaggcagcttccatctggccctcgcggtctcctcccaggtcgtcgccctgtcagtcacagacgacggcggcaccgggacggcaccgaagaccgagcacgccgaccagaacgccacacacgggcgaggcctcggcatggtcagcgcgatcgcccaccgagtcgtgatccacgacagccaggccggccacacagtcaccgcagaactcttcacgagcgcccgcccgggaggccacccgtgc

SEQ ID NO: 3725 - DNA, 345 bp, Streptomyces avermitilis
  CDS (1)..(345)
gtgctgacctcgaccactcccgaggacttagccgcggcggggcaggacggcacgtaccgctgctgggccacggcctacccgctgcacgagaccagctccatccccctgggagctcacgatgcgacgagcccccgcctggcactgcggtggctccgcgaacgcacgaggaacgtcacggaccaactcgacatggcatacgcccagccgggccgctactggctgagggacgagacggaacacgaacgagccctcgcctacctgaccacaagcacggcctaccaactcaccctgcacgacgagaacacgcgctacgtcctcgtggcctacccgcccggggtgacctcg

SEQ ID NO: 3726 - DNA, 387 bp, Streptomyces avermitilis
  CDS (1)..(387)
gtgaacggatacacccgcggcttctggtgcgaatgctggaccgaagacctcaccaaggcagacagtccggcctttcacagctccttcgacgcccactccgccggacaggcagaccgctggatagcgatcgcactgcgcaccatcacgccagcactggactccagagcctccgacgaagcctgggagtggctgtacgagggccgcatcgagacgaggagagctctcctgtgctcggagccctgcactgtcacgatcaaccagggcggcacacgcatcacttggactgcccgaccagcgctcttcctacccctggcccaccggcgaggccttgaacttccgtgctgcgcatatgacttcaagccccacgtgaccgtgtcgagtctcagt

SEQ ID NO: 3727 - DNA, 1767 bp, Streptomyces avermitilis
  CDS (1)..(1767)
gtggtcgagcagcggtatcacgcggtgatggaggttgctgcgggagttccggtcactcaagtcgcggcccggtatggggtgtcgaggcagtcggtgcactcctgggtgcgcaagtacgagcagtcgggtcttgcgggactgacggaccggtcgcaccggccggcctcgtgtccgcaccggatcgcgtcggaggtggaggcggtggtctgtgaactgcggcgccggcatcccacctggggtccgcgcaggctggtgcacgagttggagcgcaggggcctcgcaccggtgccctccagggcgacggtctatcgggttctgatccgcaacagtctgatcgagccgggggtccgcaggcgtcgccggtcggattaccgcaggtgggagcggtcggcggcgatggaactgtggcagatggacatcgtcggcggactgctgctggcagatggcggcgaatgcaagatggtcaccgggatcgacgatcactcccggttcatggtgatcgcgaaggtggtccagcgggccacggcccgcgcggtctgttcggccttcggggaagcgctggtgcggttcggagtgcccgaggaggtactgaccgacaacggcaagcagttcaccgcccgcttctctcccggcaagccgggagaggcgatgttcgaccggatctgccgggagaacggcatcacccatcggctcacgaagccgcggtccccgaccaccaccgggaagatcgaacgcttccaccagaccctgcggcgtgaactcctcgaccagcaggacccgttcaccgacctggccaccgcgcaggcgaccgtggatgcctggctggaggagtacaaccggatgcggcctcatcagggactggacatggccgtcccggccagccgcttcgtcccccggccgcgggccgagcaggatgccctgccggtgaggctgcccgcccgcctcgacccggtccccgcgccggcatcggcggagccggaaccagcgacggtgccgcgggcctggccgatgaccgaaggcgaggtcggcgcgatcgaggtggaccgggtggttcccgcgtcggggaacctgagcctgcgcgggcagcagatctggttcggcccggccctggccggcaccacggtgaccctgcggatcgacgtgaaccggctgcacgtcctgatcggcggcggccggcacaagacgctgccctcgaagctgtccggccgtgacctcaaagccctgctggccggcggagacgcccggcccgccggaccctgggccgaggagcccggaccggccagggacacgaaggggacggtggaggtggaccgcaccgtgaacgcggtcggctacgtcggcctgggcggcgacaaggtcctgatcggctggccgttcgccggacaacgggtcaccctgcggctggacggacgggtcctgcaggtcctcgacgagcagcgcgtcctcaaggccaccctgcccagcccgctgccggcctcggcctgcgggcgcctgcaaggaagccgtccggccggaccgcctcccctgctgccgccgcccgccgagcagatcgccgagcggaccgtcagcagcgtcggcggcttcatggtcgccggacagcgcatccagctcggtcgcggctatgcccaccaggtcgtcaccgcccacctggccgaggacgtcatccgcgtcttccacggccccgagctgatcaccaccgtcccgcgcgtgaccaggaaggaggtggtcgtccgcaagtccggcgaacacaaccgccggaagatcgtc

SEQ ID NO: 3728 - DNA, 399 bp, Streptomyces avermitilis
  CDS (1)..(399)
atgtacggccgaagcgacgaggcatgggagcagttgaccgatgccggattgaagttcctcgttgaacgggcacagctccacaaggtcacgacctatacggagatgaactctgtgctggcccggcggacagggcttcccggcttcgacttcgagcaggcggacgaacgtgccgccatgggctacctgcttggcctgatagtggaacaggactacccaaagagcgggctcatgatctctgcactggttcactacctcggtgcgaacgacgccgggccggggttctacacgctcgcgcagcggctcgacctgctccccaaggactcctccgcaacggcgagactcgagttctggattgggcaggtcaactcgctccaccaacttcactcggcccctggccga

SEQ ID NO: 3729 - DNA, 441 bp, Streptomyces avermitilis
  CDS (1)..(441)
atggctgacacaggcattgacgacctgtccaagtacgagtccgggaccgacccgttcaccgcgtccgagctggaggcgattgcccgcttccgcgaaaacctgtccggcatccccgacattgccttcaagggcttcgacgccgacgagatccgccacctcgcgtccgaacacggcatgggcgaagcccgcaagatgctgcactcattcgctaccgacctcctcaacggccggtggctggcgatcctctcgttgaagaacgacctgccgaccggcaccgacgagcctccccggtacagcacgcccgccgcccggtacgtcgcccacctcaccgcccagcacctcaacgcctgcgcgaagttcgaacacgccgtcaccatgtggttcctggacctggacacgcacctctcctccccgctgtacctgaacagggatggggaggag

SEQ ID NO: 3730 - DNA, 1545 bp, Streptomyces avermitilis
  CDS (1)..(1545)
atgttgcggagccggccgcctgcgaggccgcgccgccccatggacagaggagaaacggtgcccagtgacggagtcatcctgcacggccccatcggggacttcgcgcgtcagctgagcccatcagacgacctgcaggccgaagagatgtatgcggcagccatctcagtgtggtcgaccgcgatcgcgcccaccgtgaaggttcgctcgtacctgccgggagtgcgtccgacgctagtgtggactgcgtttgtcggagacagctcgaatccgtccgatgggctggcacagagcgtggtacgtgcactgcgcgtgcgggactacttcacatcgctggcggggcgccacccagtcaccagcgaggcccacctcctcagcgcagtggaatcagcccgccgctacccctccctgcacactcccgcaccgcggagcacgttgcttgaaagttctccgtttcaacggaccccggccggtaggcagcgactccagggggagctcaactacgcgttgcgtcaggcgtgggatggaagcaactttttgtggatcggcgcaaagaagcggacccctgcccagcaggagctggaccgtataccgcccacggtgggagtcctctggggactctcggatatgagctgggagcagcgcccgtacgggcctggcgatgacgccttctactcccgcttcctgccgttcaagctccgcggtcagcccagccacggccgcactgtgcagaccgggccctctcccgagctggtcgccgcgtatgaatgggcgatcggaagtcagcgggaagtgaagctgagtcgagccgcagcagagatgtggggcgagatcagaagtctggaagactcgacactgctgaacagcccggccccaagggatgccgccttcacgatcagggtgggggagcacacccttcgggtggcagcggcactcgccgccgcagagatgtcaccagccatcgagccgaacgtgatcgaggcagcttggtccctggtgtggcgctccattcgcgatgtcgctgacctggctaatggggctagcgtcctgctcgagaaccccctcgccaagaccagctcggccgtgcccaccgaagcagatccggccggcatttgcgtggaaccttcgtggcccgcagagagcgccaccctggacttccccgatacacccgtccggcgcagagctgcaatagtgcaggcccaggaccgggattcccaggtcagacgccaggtcaaggtgtggtacgacaacacctgccagttctgcaggaccaagatcgaatttccggcacagcccttctcatacagcgaaggtgcgcacatacaagcgctcggagcgccccataacggtcccgaccgagttgaaaacatgctctgtctctgcccgaattgtcacatccgctttgacatgggtggccgattcctcacggacgaactgcgcatcattgactcggccacaggcgaagatctcggacctctgaaggttcatgcgcagcaccggatccgccttgcgtacgtccgacagcaccgctcccgctgggctaatacg

SEQ ID NO: 3731 - DNA, 426 bp, Streptomyces avermitilis
  CDS (1)..(426)
atgacggagacagcaaaggccagacgagcgccaaggcagctgggcgagctgcacgacgtgtacgccttcctggaggaagtgcgactgcgccctggcatgtgggtgcgcggcagctccttgcagcatttgcactccatgctgctcggctatcgggttgccctgggcgtccacggcatcgaggagccctttgacttctggtcccccggaaaccagtgctcattctccgagtggctatggggccggccaggtatgcccaacgccagctccttgggctgggcgacagagattgagcgcgcggccgagaaggccgacaggtccgccatggagatgttcttcgagctgttggaccagttccgcaccacacaccacgatgttcaaccgccacatcgagcagcacctgagacccaacagcccaccgtcaccgcc

SEQ ID NO: 3732 - DNA, 966 bp, Streptomyces avermitilis
  CDS (1)..(966)
ttggaaggccctgctgttgtcagtacacggcttactcttgactgccatgtactttgcatcgcaaagttggttctcggcgggcgatcatgcggcggtccgctcatgagcgctgccagagcgccggcacaagggggagatatgggaacatccgcaccgagcagcgcgggatcggaaccgagagcggccgcggccgctttgttggctgcgacggaaggccttcgggcgaggactcgcaggcagaccaacggagcgtggactcccctccttggcttcgggctccttgcactggcggccattccggtcgcccggtacgccttcaacttcggagcccacgggcgctacgtcgggtcctatccggcctttgcctacgccgagttgaccggcctgtgcgtcgtccacgaaccagggaccccctgcctgaaaggcgagttcgacggagccgtcctgcgcttcgtggcatggggcgtgtggttcgcgctcctccccctcgcgtggttcgtcttcgcccgctggtatcgcctgcgcggggaggcccggggcgtcgtcccccggcgcggcatgtgggtcagcgtgaccgccgtatccaccactgtgatcacgacagctctggtggcgctgctgttcggcaggaaccagtcctgggaggccgtgctgctggagaacagctacgcctccccgtggtacctggccggcatcggacttctcgccctcggaatcgccgaacgcagctggatcgccgcggcggcaggcaccgctcacgccctgctgctcacggggtacctgggagcctcctggggcagtggatggcttccctggcagcaccccgcccatcccggctgggccgacggaccgcagttcaaggcctttctgctcgctgccatcctgctcctcgccggtctgggcgagcggacagcggtccgccgccggggcgcgcccggtgtcgcggttgcgggtacggtcgtccca

SEQ ID NO: 3733 - DNA, 507 bp, Streptomyces avermitilis
  CDS (1)..(507)
gtgacgatcaaacgaggtacccccctcatcgcggcactggctgccaccctcttgctttccgcgtgctccagcccggacacggacgatcgccgcgtgaccgacgggcgcacctcgcagtgggacaagaacgccggcgcgcccgaggcgtcggcgttcatgaacgtgacggcgcccaaggccgcgaccgaggtcaagggggccgtgcagatcaaccctcaggaggacatccacctcctctcgttcgtcaccagcgagaagaacgccgaaggcatcgcgagggaccttcgttccgaagaaccgctgaaggcgaacaaggccgacttcgccccggacggcgagctcttcaagcacctcgggctggccgagccgcagacgctgaagggagcccgctcggccggggtctgccccccgtgcgtgaaggacgatcgccgcaagaaggtgcagtggatcgacatctacgtccaggcgctcaaggacgatcaggccagggtctacctgaaggcgttc

SEQ ID NO: 3734 - DNA, 330 bp, Streptomyces avermitilis
  CDS (1)..(330)
gtgaccggatcaaggtcgcgccaccactccgcgaccgccttcgcgcccttggggacgtgctgcgccttcgccacctcctcaagcgacgggtgcggatcggactccgcttcccggacactgtgcgcaccgtccgacggcacgcccaccaccggcgacgagacgccgacgggcgagtacccgacgcgcgacccgagggcccacacgccgtggagcgggcatcgttccactttgtcggccgggcggcctgcaccggaccgggtgctcaactcaccgctcattcccggaggtcaggactgttcatctcgtcgcgcgagccgctgctgtaggacc

SEQ ID NO: 3735 - DNA, 276 bp, Streptomyces avermitilis
  CDS (1)..(276)
gtgtggcgttcctgtcgtacgcgtcctggtggcgtcggacctcggtgccgcgagggcactcccgagaacgtacggcggtcggtcgagggctcgctgcgacgcctgaacaccgactacatcgacctctactaccagcaccggatagacccggggacgccgatcgaggacacggcggggacgctttccgagctgatcgaggaaggcaagatccgccactacgggctgtcggaggcggcgcccgccaccatcaccatgccgggtatcgcgtatcgccgc

SEQ ID NO: 3736 - DNA, 1650 bp, Streptomyces avermitilis
  CDS (1)..(1650)
ttgcacccccgggcaggattcgaacctgctttcggcggtgtggtcggagatcaggccgacgacggctcggcaggtgccccgatcgttaacgtgcgccacgttgtcagcaccacaactcccctttcccgtacaacccttcaggctcaccagaggtcatctctgagctcgcacgtatgtcctggaggggaactcatgtcccggtcccatcacaagcgctctcggcgtcccgccgtcctgggcgccaccgccgtcgcggccgtcctggccggtggcctgctcatcaccctgcccggcggcgcgagtgccgccgggtcgggcctggccgacgacttcaacggtgacggctaccgcgatctggcgaccggcgccccgggcgctgtcgcgggcgggaaggcgaaggcgggcgccgtggtcgtcaactacggctcgtcgagcggtatcagcgccgcgcgccacaagatcacatcgcagagttcctccggcgtgccgggcgcctcggagacctccgaccgcttcggcaccgaactcgcgcacggcgacctcaacaacgacggctacggcgatctcgtcgtgggcgcaccggtggaggacgtcggcggcgatgccgacggcggttcggtcacgatcctgtggggcggctcgtccggcctgtcgggcggcacgacgatcagcgacccgaacgcgtcgggccacgaccggttcggccagtccttggcggtcggcgacttcaccggtgacgggaaggccgatctggcggtcggttccaccggcaaggacgtgtggatcttcaagggcggcttcaccaagtccggcggcgcggccggaaagctgcgcttcgacgcgcagatcgagtccggcgcgtaccccaggggcgccgtccagttggccgccggggactttgacgacgacggggcggccgacgtggtggtggggtccgccgcgggcaacttcgtctaccgcggcgcctcgaccgggcccacgctgcagaccgaggtgggcacggggtacgcgggcgcgctcaccgtggccgacttcgaccgcgacgggcacgacgacctggtcgtcggcaccgacttcgtcgacgtcatctcggaccggacggcgaagggcggctacgtcaccgtgttctacggcggtgcggcgggcgtcgacaccacgcgcagcgccgtcttcagccaggacaccgcgggtgtgccgggagcggacgagtccgacgactcgttcggaggcgcgctcgcagcgggcgacgtcaacggtgacggttacccggacctcgccgtcggcgcggacttcgagaccatcggctccgcggaccaagcaggcagcgtctgggtgctgcgcggcggcgcctccggcctgacggggaccggcgcccagtccttcgaccagggcacctcgggtgtaccgggcgccaacgagtcgtcggacttgttcggcgacgccatccatctcgccgaccacaacaaggacggccgcgccgatctgtcggtgggcgcgggcggcgagaacagcgacgacggcgccgtgtgggtcctgcgcggctccaccggaggtctcaaggccaccggcgcggtgagcttcggtgcgtcctccgtgggcatcgggaactcgggggaggaccccatgttcggggacgccatgtcgggctcc

SEQ ID NO: 3737 - DNA, 531 bp, Streptomyces avermitilis
  CDS (1)..(531)
gtgcgaccgcgcactgctgcattggcatcaccgatgtcaccaggtcggggggctgtgccgtcggctgccgggcggtacatcccggatcggtgtgaccatcacaccaaggtgacatggcgactccgagccgtcaccacacctggcaggagggaccgatcgatgaacctcatgaacctcactctgaagcgactgctcggcgttaccgcggtggtggccacgggcgcggcggccctgctcggcaccggagccggcaccgccggcgccgccgacagggcgcactgcgaccgtgccgaacaggacgtgtggagcggcgatcccagccgcaacctgaccggccatcggtgcagcatcccgacccacaagagccgctggtacaccgtcgagatcgacaccctcgtacagacccgctacaagggggacaccgtggacggaggggtcgaccgggccaagaccctgcacaacagaaccatcaggtgcatgggctatacctccgacaacggcacggtgaactggttcggatgcccacccgcc

SEQ ID NO: 3738 - DNA, 1491 bp, Streptomyces avermitilis
  CDS (1)..(1491)
atgcacgacttttctcgtcgcggactgctcagggcgacggcggccgccggcgccggtgcggtcgttctcccgggcatcacggccgcggaagccccgggcgcgagcgccgcgaccggcacggccgaaagcgtgaaatgcaagccggcgaagctgaccggccgcatcgtccgtcccgacgaccccgggtacgcggatgcgagcctcggctgggacgagctcttcgttcactatccgctggtcatcgtctacgcccaggagacccaggacgtggtcaacgccctcacgtgggcgcggcagcatgacgtcgcgctgcgggtgcggagcggtggccacagccttgagggctggtcgaacgtggacaacggcatcgtgatcgacgtcagcgagttgaagtgggcccacatcgacaccgcctcgcgcatcgcgacggtcggcgccgggctgagccagttggaagcggtgaccgcgctggcggagaaggacctcgcggtgacgaccggaacggagggcaccgtcggcctgtccggtgcgacactcggcggcggtttcggcttcctcacccgctacctcggtatggcctgcgacagcctgatcggggctgaggtcgtcgtcgcgtcgggtgccgagtgcgccaaggtgatcaaggcggacgggaagaacaacgcggacctgctctgggcgctccgcggggcgggaaacggcaacttcgggatcgtcacgtcactcacctataaagtggctccgctgaagagcgtcgcttatctgcaagcgacatgggacggcctcggggacctgcaaggggtcttcgacacatggcagcgtacggcgccggtcgccgacaaccgcctcggcacccagctcgagatccacaggggcgagatcctgctgttcggggttctcgcagaagggtcggaggcagaggcggaggagctgctggccccgattctgtcggtcggcaatccccaggtctcggtacaggtcggcaactggggtgacgtatacgcgggattccagattccgacagcggacgagcctgcgaactggaagttcttctcgcagttcaccaccgagccgttcccggagaaagcgatcagtctgatcgcctcattcatgcaggacgccccctcggacgacagcaacttcttcactcaggctttcggcggagcggtccggaggagcccccgcggcggtacggcgttcccgcatcgcgacgcgctcttctactccgagcccggcgccggctgggggactcgtggacaagcgggcagcggcgacgagatcaccccgcaggcccaggcctggatcgccgagttcagccaggcactgcggccgtacgtgaacggcgcctacgtcaacgtgccgaacatcggcatgcaggattgggaaaccgcctactggggatccaacttcgaccggctgcgcaagatcaaggcgaagtacgacccgcgcaacgtcttccagtacgagcagagcatcccgcccgcgtcatgc

SEQ ID NO: 3739 - DNA, 270 bp, Streptomyces avermitilis
  CDS (1)..(270)
atgtcaggcatgagcgggatcttcctggggtgcggggagggcgggggtggtgaagtagcggcgggcgtgcagggcgacgtggacgaggccgatcagtacgggggcttcgaggagcgggccgacgacgcctgcgagggcctggccggcgcgacaggctggcagatccgacaggaagaaccatgccagggcgaacatgagcgccgcgccgacgagcctgggcggcccaggcccagcccggcagccatcgcggcgaggatccagcgggccagg

SEQ ID NO: 3740 - DNA, 420 bp, Streptomyces avermitilis
  CDS (1)..(420)
atgcctgacatcaccgccgccccctccgtgctgttcgtctgcgtccacaacgccggacgctcgcagatggccgccgccttcctgacccacctcgcgggcgaccgcgtcgaggtccgctcggccggctccgcccccgccgacaccgtcaaccccgccgtcgtggcagccatggcggaggcgggcgtcgacatctccgccgaggtccccaaggtgctcaccgtcgaagccgtccaggcctccgacgtcgtcgtcaccatgggctgcggcgacacctgccccgtcttccccggcaagcgctacctcgactggcgccttcccgaccccgccggacaaggagtcgacgccgtccgccccatccgcgacgagatcgaaaagcgcgtccgtggcctcatcgaggagatcgccccggaaacgcaaccg

SEQ ID NO: 3741 - DNA, 402 bp, Streptomyces avermitilis
  CDS (1)..(402)
atgtcgaatcaagagcttgtcgtgctgggccggagtgacgaagccggcgtctgctgccccgggctgctgaccgccccgctggacgagggccgggccggggagctggcgaaggtgttcaaggcgctgggtgatccggtgcgtctgcggctgctgtcgatgatcgcctcacgggcgggcggtgaggtctgcgtatgcgacctgacccccgacttcgacctgtcccagccgacgatctcgcaccacctcaagctgctgcggcaggcgggtctgatcgactgcgaacggcgcggcacctgggtctactactggctggtcccggagatgaccgatcgcctcgcgagcatcctgacccggcctgcgggtgagccgctgccgggccgtgccgccgccgcggccgctccg

SEQ ID NO: 3742 - DNA, 468 bp, Streptomyces avermitilis
  CDS (1)..(468)
atgtctcgcgctcagctcgccctgcgtgtcagcgacctggaggcgtcgatcaccttctactcgaagctgttcggcaccgaaccggccaagcggcgcgagggctacgccaacttcgccatcaccgagcccccgctcaagctcgtcctgatcgagggcgagcccggccaggacacccgcctcgaccacctcggcgtcgaagtcgactccaccggccaggtcaacgccgccaccacccggctcagggacgccggcctggccaccttcgaggagaacgacacttcctgctgctacgccctccaggacaaggtctgggtgcacgggcccggccaggagccgtgggaggtctacgtcgtgaaggccgacgccgacgccctcggcaagagcgccgcccccaacgccaccggcgacggctgccacaccacccaggcccccgaaccggcctcggcgtccgcaggctgcggctgcggc

SEQ ID NO: 3743 - DNA, 645 bp, Streptomyces avermitilis
  CDS (1)..(645)
gtgcggcacccggatcacccgggaggttggcaccgaagcagggcgcggcggagcggtcggggcatcgggtgcggacgggacggaaccttgaacaggaattcgggcagtgcccgccgacaggcgctgcttgccgctgtacggtcgctgatgatcgtgggggccctcgtggccggctactacctgctgccgctgggttcggccttcaccgccggcaccgtactcgtgcttgtcggtggtctcgcggccggggcactgcttctggcatggcagatcctcaggatcacgcagtccccgtggcccgggctgcgggccatggaagcgctggcggcgaccgtcccactcttcatcttgctgttcgcgacggcctactggctgatggagcgcagcgcgccgaacaccttcagcgagtcgctgtcccggaccgacgcgctgtatttcgccatgaccgtgttcagtacggtcggattcggagacatcaccccgcgcagcgaatcggcccggctgctcaccacggggcagatgacagtgaatctcctgctgatcggcgtggcggcccggttcctggtgaacgcggtccaggaaggcagacgacagcgggaccgttcgacaaccggcagccaggacggcaccacccccgacgctcga

SEQ ID NO: 3744 - DNA, 594 bp, Streptomyces avermitilis
  CDS (1)..(594)
atgccacgcccgcccgatcccgccaaacgacgcgacctgctggaccgggtccgtgagtacatgatccgcaacggcttggccgacctgtcccttcgcccgctggcccggtccctgggcaccagcgaccgcatgctcttgtactacttcgggagtaaggagcgcatggtcgccgaggcactcgccctggacgagaggcgaccgctcctgcgcgcccggatcctgctcggccccaccgactcccccaggaacccggcgtggctccgccgcttcatggaggaaacctggcggcagctcagtgcccccgacctgcgcgccgcgctccccctctacctcgaggtcatgaccgtcagcgtgctccaccccgaccggtacgggcccttcatgcgcgacgtgctgaccgagtggaggggcctgctcgtctccgtcttccgcgacctgggcatggccgaagcccgagcccgaacggaggccgacctcctggtcgacgcgttcttcggcctgctcatcgcacccctggccgacggcggatgggaccggtccgacgccgccgtccacgccctcctcgaccgcctcgaacccggctggcacgacacc

SEQ ID NO: 3745 - DNA, 726 bp, Streptomyces avermitilis
  CDS (1)..(726)
atgtacatttatagatgtagcgagtgctacgcgaacgcaagacgtggcacctcggcagccatggtcgccagcagctcagaaaggagtggttccatggcctcccaggtgatcggcctcaccacgacctccctcggggagcgcttggcccggatctgccgccgccacggggaatcggggcagaagggcgcttcggaccaccacgctcagaggaagggccggcccctgaaggacacacccacgacatgggtgcaccggaacctggctctctggtcccgcgtcctggcacccctgcaaccgctcgacgcgccccgcgcccgcgccaccgcctgggacgcttcctggcctctgcagcgggagctgacctcggcccgtctggcccggcggacggtgaccgcgcaactgggcgactggaatctggaggacctggccgacaccgccgagctcctggtcagcgaagtggtcaccaacgccctgcgccacacccgcggcccactgcggctcaacttgcaggtgcgcggctcccgtctgcggtgcgaggtcgaggacacggaccccgccggccccgtacgccgcgtcgtcgacaccgacgcggaaggcggacgcggcaccgaactgctcgatctgctcagcgaggcctggggcagtacccgtaccgccaccggcaaaaccacgtggttcgaactgctgacgcggacacctgagcccgagggatcgcccgcctccgac

SEQ ID NO: 3746 - DNA, 558 bp, Streptomyces avermitilis
  CDS (1)..(558)
atgtcgacgcacgaggcgaccagtgaattccgccgtccaccccgcggccgggccgcatggtcacgatccgcggcacacggtcaagaggctgatggtccgattgccttcttcggagggccgcgagaccatcgccggatgtggggagagttgatcacgcggcacaccagcgaggtcgagttcggtgctccggtctcggacgacgcgctgacttgggctgcgggggtcctgggctccccgctgccggacgaactgatctcggtgctgcgcgagagcaacggcatcgtcggcgagtacggcaaccacttggtgtcgccgatcgagacgatcgtccagcggaacgtggagcttcgcagctccttctccgagctctacatggccttcgaccaactgctcttcttctcggacatcccgggcaacggcgatctgttcgggatggttctcgtgccggggcagtacgaccaggtgttcgtctgggatcacgagaccgacagccggaactgggtcgcctcgtccctcgccgatttcctggagcggtggcttaccggggcgatcgacgaa

SEQ ID NO: 3747 - DNA, 615 bp, Streptomyces avermitilis
  CDS (1)..(615)
atggacgcgggcacagtggcggccttcctggcgattgatcttctgctggtgttcacgcccggggcggactgggcctacgcgatcgcggcgggactgcgggaccgttcggtcgtcccggcggtggccgggctggtggcgggatacgccgggtacaccctgctcgccgtggccggcctggtggtgatcgtcgccggctccgcgagcctgctcaccgctctgaccgtcctgggggccgcctacctgatatggctcggctggagcgttctggcgcggccggccactccccaggcctccgcggaggccgtggccgcttccaggtggcggatcgtgctgaggggcgcggggatcagcggtctgaaccccaaggcgctgctgctgtacttctctctgttcccgcagttcatccaccccggtgaggggtggcccgtagcggctcagaccggtctgttcggcacgctccacatggccagctgcgccgtcgtctacctggccgtgggcgtcttggcccgcaccgtactgaaggcccggccgacggcggctcgcgccgtggcccgagtcagcggaaccatgatgatcgtcatcggcgggttcctcctcgtggaacgcctggccgga

SEQ ID NO: 3748 - DNA, 456 bp, Streptomyces avermitilis
  CDS (1)..(456)
atggatgcgcttgatcggaaaattcttaccgagctacagatggacggccgcctgacagtgaccgagctggccgcccgcgtacagctcagcgtctcgccgtgccaccggcgactgcgcgatctggagcgcacgggcgcgatccgcggctaccgcgccgtcgtggacccggccgcggtcggcctgaacttcgaggccctggtgttcgtcacgctgcgctgggaggaccgcgacaccgtctccaccttcgagcaggccgtggccgccgtcccgcaggtcatccaggcccagcggctgttcggcgaccccgactacatcctgcgcgtcgccaccgccgacctggccgccttccaggagctctacgaccgccacctggccaccctgccaggcgtacagcgcctgacctccaccctggtcatgaagcacgtcgtcaacgatcgcccgctgcccgagcagccg

SEQ ID NO: 3749 - DNA, 1245 bp, Streptomyces avermitilis
  CDS (1)..(1245)
gtgacgatgccgtacggatcgcggctcgccgcgatgatgacacggcgactcggacgcgaatgcgtctacacgccctcggcacggctggccctgtatctggcgctgcggcactggtgccggcccggcgcacgggtgctgatgtcaccggtgaacgacgacgtgatcctcttcgtggtcctcgcggccgggctgcgcccggtccttgcccccgtgtccgtgggggacggcaacatcgacccggccgccgtaccggagtcgacctggcggagcgtggacgccgtcctgaccacgaatctgtacgggatgccggaccgggtcgtggaactgcggcgccgctgcgagcagttggggatccccctgttcgaggacgcggcgcacgcgatcggcacgcacgtggacgggcagccgatcgggacgttcgggaaggcggcggcattcagcctgtccaagcacgtggcggcgtcggccggcggcttcctcgccgtcgaggacgcgcgcacccggcgggagttggagctgctgcgcgacgccctcctggtgccgcgccgcctccatgacgacctggccgcgacgctccggccgctggcgcggtcggccgtacgcaccctccatctggtgcgtcccgtatggcggacgatgcagcgtctcggggtgctggaacgcgatgacttccgtatggccctgcacgcggagcggctctccggctgcgcgcgcgaggcgccgagcctggccgcgtacgagccctgggtgcgcgtcgacctgcacggcttccggtcccgccacggggccctggtccgcgggcagttgacactgcggatggaccggctcgacgacgacctcgcccggcgtgcggtcggtgtctcgctgctgtccggcaccgcctgggcctccccggcactccgcgaccggacggcgcacaacggccatctccccctcttccgtgttccgctcctggtccacgaccgcaacgccctcatagaacgcctggtgagccacggcgtggtcaccgggtatgtctacgaccccccgctcgacgactacgcgggcgcggagttcgtcgaaccgtcccccgacccgtcggccgcccgctggttcgcctcacacgtgcttccggccgacccgctcctggcccgcgggatcaccaacgccctgacggcagaacaggcggcaacggcacacccctcgaccccggccgcggccccggcccccatcccggacaccaccccgccgacccccttgggccag

SEQ ID NO: 3750 - DNA, 1113 bp, Streptomyces avermitilis
  CDS (1)..(1113)
gtggacatcacgatccacagacccgcggagctgaacacctcgcttcgccgggcctggcaccaggcgatggacgagtcgcccgactacgccaaccctttcctggcaccggagttcgcggcggggatcggcacgtaccgcggcggggcgcaggtggcggtcctgcgtgagggcggggaacccgtggggttcttcccgtacgagcgcaactccttcggcgtcggccgggccatcggtctcggcctctccgactgccaggccctcgtgcaccgccccggggtcacctgggacccgcaggaactgctgcgggcctgcgggctgtccgtcttcgagttcgaccacctcgtcgaggagcagaagcccttcggcagatacgtcacggggaccttcgcctcaccggtgatcgacctgaaggacggcggcggcagctacgcggagtggctgcgcggcgcgtacccggggctggccaagacgacactgaagaaggaacgccgcctggggcgcgacctgggcgagatgcggttcgtctacgacgagcgcgacccgcgggcgctgcgcaccctcatggagtggaagtccgcccagtaccgcaggacgggacggatggaccggttctcgcggccgtggatcgtcgacctggtgaaccacctgttccacgtccgcgacgagcacttcaccggtgtgctgtccgtggtgtacgccggcgaccggccggtggccgcgcacttcggaccgagatcgcgcacggtgttcgcggcctggttcacggcgtacgaccccgagctccgctactactcgcccgggctgatcatgcaccttcggatggccgaggcggcgggccgggacggtgtacggctcatggacatggggcgcggcgacaaggagtacaaggactggctcaagacccgcgagctgcgcgtgggcgaggggttcgcgacccgtccccacccggtggcggcggcgcaccggctgtggcgcagaccggtgcgcggcctgcggaacacggtcctggcccatcccacgctgcgggagccggccgaccggctgctgaggacggtcggcacgctgcgcacgtcgggccgggcggactcgggcggagcgggaccccgtgcacgc

SEQ ID NO: 3751 - DNA, 324 bp, Streptomyces avermitilis
  CDS (1)..(324)
gtgctgatcatcaccaccttggccgccatcgccatcggggcggccgccagcatgacctacatgcggtacgtctcggcacgcagccaaggacggccgatatcctttgcctccctccggcatgaatgcgttccgccatgggtcgacctgattttcatcccggcctggctcgcaagttcatgcgtactctgcttcacgctcccgctctgggcgggcttgtccctttactgcggagccgcactgctccccggggagctgatgcgccgccgccacaaccgccaggtcaagaaccgtcccccgatttcggccggcgctctcacctctctg

SEQ ID NO: 3752 - DNA, 843 bp, Streptomyces avermitilis
  CDS (1)..(843)
gtgaatgacgactatccggatctctccttcccccggcgcgaacggtatctcggtgcctaccccaccacgtcgggtaccggccggcaccggggtcctgtcgacgccctgcactcggcggttcccttggaaggctccgacccgggctgggacccggtcgaggaactcacctacctccttcaggacgccgcggcggagcaggcggcggccatggtgccgccacctcgcagcgagccgccgtccggcgacggcttcagtggcgacccgatggagaacctggcgcagatcaccgctgagttgccgcccatccggcgccctgccgccgggcatcggaaggtgcgagtccgcaaactccgctttacgtggttgcagaccgtcagcttcgtgatggccgcgttcgccgccgtcatcgtgtcgatggtgagcgtcttcggcggcatggtggcctacgctccgctccagcggatcgcgtccggcacgcagagcgggacggtcccctggtggcccctcctggtctacggcccctggatggtggcctcgctctccatcctgcggaccgccctgcaccaacgccgggccgtgcactcgtggttcgtcgttctgctgttctcctccgtcgcgatgatgctctgcgtggccgaggccgacaggaccttcaccggtatcgccgcggccgccctgcccgccctcgcgtccctggcctgcttccagcaactggtccggcagatcaccctgacccggccaccgcgccagcgcacgtcccgccaccggcagcgcctcatccccgcacctcaggagtcgaccgaagccatgccggaccccgtccttcgggaaacgcctcgcgcc

SEQ ID NO: 3753 - DNA, 2487 bp, Streptomyces avermitilis
  CDS (1)..(2487)
atggacatccggagcctgagccaggccgaagccgaacggcgggccgcgctgctcacggtcgagaggtacgacgtggcggtcgacctcaccgctctgccggacgggccggacgtgcgatgcgtgtccaccgtgaccttcggctgtcgtgaaccgggcgcggagacgttcgtggactgcgcggcccaggtgctgagcgccacgctcaacggcgtcgaactcaccccggccgccgacggacgcatcccgctgcccgccctggacgcgcacaacgtgctgcgggtagagagcgtgcagtcgaacaccgccgagggcgagggcgtgcacaaggcggtcgaccccgcggacggcgaggtctacgtctggatgtcgttcgagcccgacgaggccaggttcgtgtgggcgtgcttcgaccagcccgacctcaaggccccgcacgcgttcacggtgacggcgccgtacgactggaccgtcacgagcaactccggcgacccgcggatcgaggaactcggggaacgcgacgaacccagccggccggcagcgcgccgctggacgttcccggacaccccgcccctggcgacgtacaacacggtcgtcaacgcgggcccgttccacgagatccgccgcgaggccgacggctacgacctgggcatctacgcccgccgctccctcgcccagatcctcgaacgggacgccgacgacgtcttcacggtcacccgccagggtctggccttcttcgcccgggtcttcggaatgccgttcccgcagcgcaagtacgaccaggtcttcgtacccgagttcggcggggcgatggagaactacggctgcgtcacctgggcggacggcttcctgtgccgcgccgagccgacgcccgccgagcgcgaactgctcgcgaaggtcctgctccacgagatggcgcacatgtggttcggcaacatcgtcaccatgcgctggtgggacgacctctggctgaacgaggcgttcgccgagttcgcctgcaactgggccgccgccgacgccacttcgcacaccgacgcctgggccggacacctggcgaacggcaagctccgcgcctatctcgccgaccagggcccgatctcccacccgatccgccagcccgtccgcgatgtcgccgaggcggcgtcgatcttcgacgcgatcacctaccccaagggcgcctcggtcctgcgccagctgatgacctacgtcggcgagtcggccttctcggccggcatgaccgcgtacttcgcccgccacgcctggggcaacaccacgctccaggacctgatcgacgccctcgccgaagcgagcggccgcgacctggacgcctggcgcgcgggctggctggagacggcggggacggaccgcctcacgctggagcgggagggcgacggctacgtactggtggcccacggcccggacagcggtccccggccgcatgtgctggcggtcggcgcgtaccgcgcgtcgcgggacggctcgctggaacgtacggcgctggtgacggcggaggtgacgggggagcgcacgcccgtcgccctgccgccggccgcggacggcgcccccgccctcgtcctcgtgaacgacgaagacctgaccttcgccacgacccggcccgagcccaccgccgcgtccgcgtacctctccgcggctgcccggctgcccaccgccatctcccggggcgtggccgtggcgacggtgtgggacatgctggtcacgggggaggtgacggcggcggaggcgggccgctgcgtcacagcggtggtcgagtccgagacatcggacgcggtgatcgagccgtacctcacgctggccggggacatcgcggaactgtgggcgcccgacgccgaacgccccgcgctgacggcgctggtggccgcggcctgccgccgcctcgcggaggacccccgccgccgccaggtgagcctgcgcggcctggcccgcaccgccaccgctcccgacgacctggcctggctggagtcgcagacggcccaggacatcgacctgcgctggcgccttctggcccgccgggcggaactgggcgacaagaccgccgatgacgtggccctcctgctggaccaggaccccgaccccgacgcctgggtgcgtgcgctcacggtccgggccgccactcccgacgccgaggccaaggaggaggtctggcagaagctggtggtggaacgagcggtcccgctcagctcggtcagccaggtcaccacggcgttctggcgcccgtcccaggacctgctgctggcaccgtacgccgagcgctacctcgccctgatcccccagttggagcgcggcggcatgattccggcgatggtgttcacgagccggctgctcccgccgtacgcgatcgacgccgagttcctcacgacagcggagaacgcctcccgggacacggtcccggtggtccggaagaccttgctggaacgctcggacatcgtgcggcggatgctgggagcgcgggagtacgggggcgcgggggcc

SEQ ID NO: 3754 - DNA, 1407 bp, Streptomyces avermitilis
  CDS (1)..(1407)
atgtggtcgacggtgacggcgacgacggcgacgacagcgacatcggagtctcggaggcgaaccttggcgactgacgcaccggtccgcccggccgactgggcaccgttccccgacgacccgaggcccttccgcccggcgcgctccgaccggagcccggcggtacggctgcgcggggtgatcggcgtcgacgaggacgtactggactgggtgccggaggagcgagcccgctacacccgctacggcgcgatagtcgtcaacaccgcgttgctgggcggcgtctccatggccctggccatgggcaccttccgttccgacctcccgctcgcggtggtgatcctggtcgccgtggtctggttctgggtggtcctcgccctggacagctggctggtgtcgagcacccacggcgtgccggccagaaacccgctgcgggtgctgctgccgcgcctcgtgctctccgtgctcctcggtctcttcatcgccgagccgctgctgttccagatcttcgacaaggagatccaccagcagatcgcggtgggcaacgaggagaaggtgagcacctacaagggcatgctggtgtcctgcaaccccgccgacggctcggacaccagcggccgggccgcatgcgggaagtaccagctgaaggtggagggttccacggcccagctccgtgacgacatccagcgcaacaccgcccgaaccaaggcgatgcgggcccaggtcgacggcatcaacaagaccctgaacgccaagatggccaccgagcagcgcgaatgcgcccgggacaagtggatctggtacggcgatgtcgccgacgtcagccagacctgcgagcgcgcccgcgcggactcctcgtcctaccgcacgaccagcaagatcaagaggtacgagggcgaactcgagaacctcgtcgcgaagggccggaccctgaccgcgcgcatggagaaggccggcgacgcctaccagcccgctctccagcggagtatcgacgccaagacgcggcagcgggcggccgaactcgacgacgacgggatcctcacgcgggcccacgcgctcgaagcggtcgcctggtccgactggtacgccgggttcgtgttcgtcgtactgcacctgctgatcctggccgtcgacgccatgcccgtcctggcgaagctgatgagcggctgcacgacgtacgacactctgctcaccgcccgcctcgacacgagccgccgtctgcactccgacgaccttcaggtgcagcacgcctgcgccaccatggagtacgaggtgcggcggcaccgcatcgagcaggacacgtcggagcggatgcggcggctggagcacgaccacggcctggcgcaggcggaacgggccgccctcttccgcgcggaactcgacgcgcgggcggcacggatcctgcggggggac

SEQ ID NO: 3755 - DNA, 1521 bp, Streptomyces avermitilis
  CDS (1)..(1521)
atggcacagagatatccgctggtcgaacagcgggagtacgggcttgcgcagcagcgcggcggctggctgcgcaagcgcacgagcaggggagacggggagctgccgccgctggccgcacaccaggtccgggtcttcagggtcggtgaggagtacgtcgaggaccacggccggctgcggcccgacgacggtgtggtggtcgccgccagctcggtcacggtcgtcgaccggagggcgagcgttcccgtcgtcgtcgagatgcgcatcccgtccgccgaggtgggcgacttcaccctgcggacgaccttccactgcaccgtcacggacgcgcgtgccgtcgtacgggacggggtcaccgatgtggaggcgctgctcttcggctacctccggggcatcccgggcctcgccgaggagggcggcgatctgcggatcgtcgactcggccaccgtgcgccgccgggtcgacgcccggctggccgcgtatctggacatgcggccgccggtcgtctccggcctgaaggccgtgccgtccgcggtcgacgtcctcaccccggaggaactcgccgcgcacctgaaggaggtcgaggaggccaggctcgcccgggagaaggagcgcctgcgggacgagatggaacaggagcgggtccgcgccgaggccgacaaggagcggctgcgcgaggagatccggcgcgaggaggccctcatgaaggagctgaaccgccaggagcgggagcggatgcgcacgacgtacgagcgcaccgacagcgccgaggggcaggagcacgcgctcgggctcgaggcccagcgcaacgggttcgtccggaaccagataaccgaggacctccgggtcatcggcaacgatccgatcgccgccgacttctacgccaaccgcagcggggacctgaccgccggcgcgttcgccgagcggcgtcgcgaggacgagtccggtcgcctcgaacgcgaggacgcgctgcacaagctcgaacaggagtacctggagcgccgggccaccctggagcgcgaggaccaggagcggcgggccgccctcgaccgggacgagcggcgctaccggctcgaccggggcgaccggatcagggagttgacccgccaggaccggaacgaggaggccgccgccaagcgcgaggaacaggctcgcagccgggcggaggcgcgcgaggacaggctgcgcgaacggctggagggccggcaggacgcccagctgctgcgcgaggagcagcgcaagtgggcggagcggcgcatcgacctcggcaagcacctcgtcaaccgggggctcgtcgacaacgcggcggtcgacatgggcgccttcatcaacagcgtgagcgagatccccccgtacggctcggcccaggcgctgggccagggccgggacgaggaggtgcagaaggcctcggcggaacgcctcgacaagcagaccaggaggccggcccccaccgatgtggtcgacggtgacggcgacgacggcgacgacagcgacatcggagtctcggaggcgaaccttggcgac

SEQ ID NO: 3756 - DNA, 2364 bp, Streptomyces avermitilis
  CDS (1)..(2364)
atgaacgaggaacagcagcacgaacagcagcaggagaggccggggacgcctgccggggagcaatggacggcgcccgcctccgcgcccccgcccgcagcggccggtgccggcgcggatcccggcgcggatcccggcgcggatcccggcgcggatcccgacgccgcaggagccgaggcgaaggacaccgccgcacccgagaacaccgtgaaccccgagaaggacacggcggcggcgaagaaggacccggcggcgaagaaggacacggcggcgaagaaggacacggctgccaggaaggacgagacggccgcagagaaggacgcctcggccgcgtcggccgccgagaaggcggagcgcgccgcccaggtccagcacaacaacgtcaaccagcacttctacggctccctcgacgcccgccacgcccacttcggcatcggcgggatcggcggcacggacacgccgaacacccgccgccgggccatcgggcggctcgacgccggagaggcggacgcggtcctggagtcgtacgtcgcaccgccctgcttcgaggaggcggtgcgcgcgctgcggcaggacggtgtggtggtgctggtcgggccgcccggcacgggcaagcgctcgggggcggtggccctcctcgacgcggtcgccgacggcgcggagtacgtggtgctctccccgggccggagcctggaggagctcgccaccgggcggccggccttcgagaagggcaacggctatgtgctgctcgaccggatgaacgagggctcgtcgtccgggacggcggacttcgactggcggcgggtccgggacgcggtgcgcgagcagggtgcgcacctggtggtgaccaccgtgcacacggtcgacggggagccccccgagtccgtacgccatctgacctggcaggtccccgccctggcggacgtgctgcgagtgcggctgcggaaggcgggatgcgccgagagcaccgtcgagcaggccgtcgggctgctgcccgccggatgccggatcgcggaggccgtcgcggccgccgaccggatcgcccggggcgccgacccggccggggtctggcaggagtacggcagcagcgccgcgcaccccgtgcgcgactggttcgccgccgaacgctcgctccaggaggccgccgaggtcacgacgctcgccttcgtcatcggtgccgggcgccgcgacttcgagctgtgccaggaaggtcttgagccgtatctggccccggccttcccccagacgccgaccggtcccgggacggccacggcggacggcgccccggcggccgcgccccggcggaccgtcgaccgacggcgctccctggcccgtaacgacctggtcgccaccgaggcgcagaagcacggcgcgctcagccggaccgtgctggtcttccgcagcccgcagtaccggcagtgggtcctggaggaactgtgggcgaaccactcgacggactactgggacggcgtacgggactggctgaccgacatggtccgcaccgtgcccgaccccgacctccagatgtccgtcgcctccggcctcgccctgctcgcccggcccgccttcgacgaggtcgccgagtcctatctgcacccctgggcgcggggcacggcgggccccctcgggcagtccacggccacgatggtgctgtggtggatgtgcctcctggacgagaacctcggcgccaccgcgctggccgtcgcccgcggctgggcccagtcccgcgacccggggctgcgctcgacggcgatggcggcgttcggcggggagcttggcgtccgcttcccctccgacgccgtgaagtggctgtggcatctgatcagccgggccggtgacgagtccgcggaggcggtctccgccctcgccgccctcgtcgccgtgcaggtcgcgtcccgggagaacgccggcgtcgtcttcgtcttcgcggccctcgcgcaccggatgggcgtccaggggagaacgggcgccgcgacccatctgaaggaagccaccttcgacgccgtccaggccgtcctgacggtacgcgacctgggcagcaaacgccccgtctgcgccgtactggccggacggcgcccccaactgatcgacaggttcggacagttgtgggccggactgctgtgcaaccggccgcggcgcgcctcggcgctgcgggacctgcacgacaccctgcgcgccctgccggccacgtgcgagaagcccgaggccatagccggacgcttcggccgggcggtcggcgccgccctgccggcggacgaacgccccctgctggacagggcgttgcgggcgatggcggcccgctccgacgacacggtcgccgccgccctcaccgagaccttcctgaccgccgtactgagcacggaggac

SEQ ID NO: 3757 - DNA, 780 bp, Streptomyces avermitilis
  CDS (1)..(780)
gtgcattcacgagagcacgaaagtcggggagtggggaacatgagcacgttcgggcgcagactgctgctggcggtcgacgcgaaggggtacggcggcgtcgacgtactgacacagacgcagttgcaggaggccatccagcggctgctcgggcaggcggcggacgcggccggtctggagcgggagcggtgggcgacgcaggaggccggcgactcggtgctcgcggtcctgcccgagggggcgtccgaaccggacctcgtcgacacgttcatgcgcagcctggacgcgggactgcgggccttcaaccacgggcggctgccccaggcgtggctgcgactcagggcggccgtgcacttcggtacggcgtccccggcggccaacggattcgtcggcagggctccggtcgagatcggccggatccgcgacagcgcggtcctgcgctccgccctggccgccgcaccggacgccgctctggccgtcgcggtctcgtcgaccgtcttcaacgacgtgatccgcgaggcgtacacgacgatccgggcgcaggagttccgcgaggtgcggatcgaggagaaggagtacaccgggcgggcgtggatctgggtgcccgggtacgacgtacgcgggctcgaactggacggcgcgggcgcggacggcccacgccctgggggtggtgaaacgcccgccgcgcgccccccgaatgcgccaactgctcctgtggacacggtcgttcagcagttctacggaaccgtcaacgccgagggcgccgtcttcggaatctccaag

SEQ ID NO: 3758 - DNA, 516 bp, Streptomyces avermitilis
  CDS (1)..(516)
atgccgtccgccggtgccgatccggacaaccgccccgcgcagtacatgttcaccgccctgcagaccacccatcagcacgcggacaccaaggccgggatcctggcggccgcgcaggcggcgctggtcggcacggccgacacctggagccggcaggccctgcacaccgtggagcggggtggagcggcgggcgtgctcgccgggacgctgctcaccctgttcctgggcggcctgttcgtcggcgccggctgtctggcggcgacgctgcggccccgggtgctgcactccgcgcacgccaacagatacagcttcgtccacctcgcctcgggccccgacatcctgcccgccgaggctcccggcgccgacgaggcgaccgatcggcgggagctgtcccacacggtcaggtttctcgcgcgggtggcgctgcggaagtaccggtgtctgaccggtgccgtggtgtgcacggcggtgatggggaccagcgcggggctgttcgtggtgctgcgtcccgtactggcc

SEQ ID NO: 3759 - DNA, 738 bp, Streptomyces avermitilis
  CDS (1)..(738)
gtgttcacgccgtacgactccgaggagtggcctgcccgcagtctgctgggggtgctgtcgccgcccgcgcggcgggaactgctcggcctgggtgtcgagacgcggttcgagccgggtgaggtgctgctgaccgagggcgcgcacgaccggcatgtcctgttgctgctgtccggcttcgccaaggtgaccgcgaccgtggagaacggcgagacgtcgctgctcgccgtccgggtcggcggcgactcgatcggggagatggcggccatggacggggcgccgcgctcggccacggtgaccgcgtgcgggccgatgacggcccgggtgctgcaacccggggtgctgcacggtctgctgatgcggcgcccggaggtgtccatggccctggccggcatcgtcgcggaccggctgcgctgggcgaaccggcggcgcctggacttccgcggctatccggccaaggtgcggctggcccggctcctggtggagctcgccacctcctacgggcgcccgacggacggcggcgtcgtcgtcggctgccggctgacgcagccggagatggccgcgctcaccggggccgccgagacgacgatccacaaggggctgcgcgaactgcgtgagggcggtctgctggagaccggctaccgctcgacggtcgtccgggacctgccccggctgaggcagctggcgaacctggcgcccgaaggccgcgaaggccacgaaggccacgaaccccaagggtcc

SEQ ID NO: 3760 - DNA, 1230 bp, Streptomyces avermitilis
  CDS (1)..(1230)
atgcgcagctactccgacctcttccgcacgcgggagttcaccccgctgttcgtgtcctcctgcttccgcaccgcggccgccacggtgagcggtctggccctcggcacgctggtgtaccgggcgacggactcgccgctgctctccgccctgagcatgttcggcccgtcgctggcgcaggtcgtgggcgcgacgaccctcctgtcggcggcggaccggctgccgccgcgggcgaccgtggcgggcatcgcgctcgccttcgcgctcggtacggcggtgatggcggcacccggtctcccggtctggacgatcttcgtcctgctgctgctcctcggcctggtccagtcgctcggcggcggagttctgtggggcctgctgaacgagatcctcgccaaggagggctatctgctgggccgttcggtgttcaacatgatgagcggggtcgcacagatcacggggtacgcgacgggcggcgtcctggtggcgctgctgtccccacgggtcacgctcctcgcggcggcggcgctctacctggcgtcggccctcaccgcccgcctgggcctgaccggccgcgccccgcgcgcctccggccgcccgtccgtcgtacagacctggcgcacgaacgcgcgcctgttctcctcgcccgagcgccgcaccctctacctcctcctctggatccccaacggcctgatcgtcggctgcgagtcgctgttcgtgtcgtacgcgccgagccgggcgggcgcgctgttcgccttcgcggcgttcggcatgttcgtgggggacgtgacgacgggccgtttccttgcgccccgggtgcgggcccgcctgggcatcccgttcctgctgctgctcgcggcgccgtacctgctgttcgcgctccggccgggggtggccctggcgacggcgtgcgtggccgtcgcctcgatcggcttcggttcgagcctgatccagcaggagcggctggtgtccctgatcccggacgaactgagcggccacggcctcggactgcacacctcgggcatgctgaccatgcagggcgtgagcgccgcactggcgggcggcgtcgcccaactcacctcacccggcccggcgatgacgatcatggccgtcgcctcgatcaccgtgaccctgacactggcaccgtccctcctccgtcgcggcgccgcgtcccgggaccgccgacacccggaggtgtccgcgccgaaggaaaggcgatccggagtgaactcctcc

SEQ ID NO: 3761 - DNA, 981 bp, Streptomyces avermitilis
  CDS (1)..(981)
atgggctggtggcaggtcaacgccgacactctcgccggctgccgcttcgtactgtcaccgctcgccgagaccttcgcgagcctgaagctgctgcacgcgggggtcgcctcgcaccccggtgagcgcggctggctcgacgcccacctgcccgcgtaccgggagctgctggcggccgatccggtcgccgcgcagctggtgcgctccgggctcgggcgggactggatcgccgacttcttcacccccgccccgcgggagagggagaccttcgaggaggaggtcgcccgggtccgttcggcttcccccgaagcggcccgcggccacctcaccgtctccctgcgcggcccgctccccgcccgcctgcaccgcgacgacctccctgaacgcgccgccgacctcctcacctggctctggaccgaggccgtacgcccgtactgggcccggcggcggcgcgtcctcgaggccgatgtcgtcgcgcggaccgcgcagttgggccggggcggctgggcggccgtgctggacgagctgcggccggggacgcgctggctcggcgagaaccggttccaggtcaatccgcacgcgtacccgccgcgcgagatctccggcgcccagctgttcttcgtaccggtcaccccgcagcggatcggctgggtgagctgggaggagccccaccggtacgccgtcgtctacccgtgcgcgggcgtcctggccggcggcgggtccgaggccgtgcccgcgagcctcggcgcgctgctcgggcccgcgcgggccgccgtgctcgtcctcctcggctctcccctgtccacctcccagctggtcgccgtgaccgggcagcggctggggtcggtcgggcggcatctgcgcgtgctgctggacgcgcggctggtggagcggcggcgggcgggccggtcggtgctctactcgcggacaccggccggtgaggtcctggtcaaggcccagagcggggacgacaccgagcggagt

SEQ ID NO: 3762 - DNA, 507 bp, Streptomyces avermitilis
  CDS (1)..(507)
atgactacagacaacgctgccacctctgtcctcgacaccgagatcgacgcgctccagggcggttccgccgacctttcgcagtacgccggcaaggccgtcctcattgtgaacgtggcctccaagtgcgggctgaccccgcagtacgccggtctcgagcggctccaggagcggtacgcggcccagggcttcaccgtgctcggcgtgccgtgcaaccagttcctcgggcaggagccggggacctccgaggagatcgcggagttctgctcggcgacgtacggcgtgaccttcccgctgaccgagaaggtcgaggtgaacggggacgcgcggcacgcgctgtacgagagcctcgtgggcttcgccgacggcgaggggcacaccggcgacatccgctggaacttcgagaagttcctcatcgggcgggacgggaaggtcgtcgcccgcttctctccgcagaccgagccggagtcggccgaggtcgtgacggcggtggagcggcagctcgccggt

SEQ ID NO: 3763 - DNA, 897 bp, Streptomyces avermitilis
  CDS (1)..(897)
gtggaccgggaactcgtggaactcgtggaccaggaacgtgtgcgctcgggtgagctgctcaccatcggcgcgttcgccgcgcgctcgcggctctcgccgaaggcgctgcggctgtacgaccggctcggtctgctgcccccggcacacgtcgacgcgacgaccggctaccgctactaccgcgccgaccaggccgagcgcgcccgcatggtcgcgctgctgcggcggctggacatgccgctcgcgcggatcgccgaggtggtggaaccggccgggctcgacggcccgtcggcggccgaccggctggcctgctactgggcggaagccgaagcgcggttcgcctcgcagcggacgctcgccgagtacctccgtggacgactgtcggggaggagctccgagatgtacgggaagttcgtggtcgagacggtggacgtgcccgagcaggtgctgatcacacagacacggcacatcctgccggacgagctgccgacgtggatcggggcggcgctggggcgtctggaggacgcggcgcaggcgtgcggggggacgaccggggcgccgttcgtcgcgtaccacgcggaggtgtcgcaggagagcgacgggccggcggaggcctgcgtgccggtcgccgacgaggccgccgcgcgggcgtgggccgaggaacacgggcgggcctgggacaccggggtccgcgtcgagccggcccggcgtctcgcctacacccgcatcacgaaggcccaggtggcaaacccgcagatccacgcggccttcgaggcggtggaggagtggatcgcggagcgggggctgaaccacgcggggccgtgccgggaggtgtacttcgccgactgggacgcggcggggcctcaggacgcggtgtgcgatgtggcgttcccggtgagg

SEQ ID NO: 3764 - DNA, 1971 bp, Streptomyces avermitilis
  CDS (1)..(1971)
gtggccgcagtggagccgacacacgccgatgactcccgtccagggagcagttccaccccccgaataacgccgcccgcgcacctgcacggcacgaacggcgccgcgcgtccgcccggttccgccgacaccctcggcgcccacgacgcccccgacaccctcggcgcccacgacgcccccgaaaccctcggcggtcccgacaccccggagaccccggacgcccccggcacccccggcaatgagcacgagcccgccggacggttcgcgcgcctccgtcgtctgatccaccgccaccccgtcctctccgtcacggccctcgccggtgtcctgcatctcgcctggttcttcacgttcgcgaacagcggtggtgacctcgcggcgcaggacgcgtgggcggagttcgtcggacggcacccggactcggcgtacaacctggcctggtacggcgggatgcacccggtgtcgtacagcgtggtgtcgccgtatctgatgtccgtgctcggggtgcggaccacgatgatgatcgcggggaccatctcggcggggctgctgacgatgatcctgatacgcagccgggcggtgcgtgagccgttgtggcccgcactggccggggtgttcgcgctgctgtgcaacgccgtgtcgggccgggtgacgtacggcctgggcatggcgttcgggctgggtgcgaccgccgtcgtgttctgctggccctaccgctggcgctacaaacgctgggcgaaggccctgtgcgcggcgccgctcgccgcgctctccaccgccgcgtcgccggtcgccggactcttcgtcggtctgatcgcggtggccctcttcttccagaagcgccgtcctggcgcgtgggcgctgggtatcgcgccgaccgtcgtggtcgccgtctcggcgtggctgttcccgttctccggcacccagccgatgggcatcggttcgacgatcctgccgttcctgttctccgtggtggtctacctgttggtgccgcgggagtggaagacggtacggatcacggcggcggtgtacgggctcgccgtgttcggcgtctgggcggtcagctcccagatcggctccaacatcacccggctcgcgatgctcttcgcgggggtcgtcctgctggcggccctccccttcgccgtgccgcgcacccgcaagtggtacgcgatcgtggtcgccctcgccggattcacgggctggatcggcttcaagacggtcgacgacatcatgcatacgactccggcggcgtcctgggcgcgcgagctggcgccgctggtcaaccagctccaggtgatcggtgccgagaagggccgtgtcgaggtggtcccggcgcgctcgcaccgggaggcctcggcgctcgccccgtacgtgaacctggcccggggctggaaccggcaggccgacatggagcgcaacccgctcttctacgacgacacactcaactccgcgaactaccacgagtggctccagcgctgggccgttcactacgtcgtcctgccgaagggcgagccggacggcgacggggggcagcgggagcggcagctggtgcagcgcgggatgccgtacctgaagcagatctggggcgacgcgaactggcagctgttctcggtgaccgacccgacgccgctggcggacccgccggccgtcgtggaccgggcgaagcagggggagctgacgatcgaggtgcagaaggcggggcgcgtcctcatccgcatcccgtactccccgtggctgggtctggtcgacgccgagggcaagagcgtgaagccaccgcaggagacggcggagtccaagcaccgcgaggagggcacgccgaagacgtacgacaacgtcaacggctgcctgatggaggaggagcaggacgagtccggagacaactggacggtcctgctggctccgggcaagggcacctaccggctggcggcgccgtaccagctcccgcgggggacgccgtgccctgaagagctgcgg

SEQ ID NO: 3765 - DNA, 2664 bp, Streptomyces avermitilis
  CDS (1)..(2664)
gtggcgggcgagtcccccgacaggtcgaagcagcatgagtcgtcggcagaaccgacgtcggggagccccgcggcggtcccggggccgacgcagccaccggtgagcgcggcgaaggtttccggtgacccccgcctggcggtggcccgggagacggtccgggtcgaccaggcgacggcggtgttctcgacgcgggcgctgaaggaggcggaggtcgccgcgacggcgcctgcgggtacgggtggtgcctccgagggtgcctcgacgacgtcggcgtcctcggagaccgccgggaccgttgagaccgcggacgccgcggacgccgcggacgccgcggacaccggtgagaccgaggggatcggcgggaagggcgacgcccggctgcgggcggcggtggcggcctgggtgcgcggggccgacgacgagggtggcgacaagggcggcgccaagggcgaggaggcctccgaggaggccgacgtcgagcctggggacgagcctggggacgagcctggggacgagcctggggacgagcctggggatgagcttcagggcgaatccgcggctgagggagcctcagaggaggccgccgacgagcctgaggagaagcccgaggagaagcccgaggcggagaagcccgcggcggagaagtccgcggcggagaagtccgcggcggagaaggcggacggcgagcccaagggggagcccgacgccgcggaagcgcgcgggaaggccgacaaggccgcggagaaggccgcggcggcgactgccaaggccgggagcgacgcgtccgagaaggcgtccgagaaggccgggagcggcgcgtccgcgaaggtcgggagcggcgcctccgataaggccgggagcgacgcgtccgggaaggccgagggcggcgcgtccgcggaggacgctgtcgaggagcagtcccccgtcgaccagcccaccgccatcttcaaggccgtacggcggccggcggtggaccagcccacgaccatgctgaagctgggctccaccaagcccgccggcgacaagtcgggcgcggacaaggccactgaaaagccgtcgggcaagccggccaccgccaagtccgccgacaagccctcgggcaagtccacggacaagccggccgacaagccctcgggcaagtccgccgccgagacccccgccgagcgcaccagcaaattcgtcgccctcaagccgctggacgagcccgggtcggcgaagccgaaggccacccccgccccgggagcggccgcctccggtgccaccgccacgggcgccgcgggcatcaccgcccccaagccggccccgtcgcccgccgaggcgaccgccgcgatcccgcaggtcggtcccgagcgcaccacgcagcagccgctgccgccgaagcccccgctggacctgctggccgagctgacgaacactccgccgcccccgcagaccccggtgcgcacgatggtccggcgggtcaagatctggaccccgctgctcatcctgctggtcgtcgtgtttgcggtcgcacaggccgtacgtccgttgcccacccccaccctggggctgaccgccgacgagacgtacaccttcgagggcggcaagctcgacctgccctggccgggtcaggggcagtccgccgtcgaggtcgagggcgtcggcaccgtcggcacggcgggcaagcaggcgcccaagccgatcgcgagcgtcgccaagatcatgacggcgtacgtcatcctcgaggagcacccgctcaaggggaccgcggccggcgacaagatcaccgtcgaccagcaggccgaggacgagtccaagaacgaggacgagtcgacggcggccatgaccaagggccagaagttcaccgagcggcagatgctccagatgctgatgatcccgtccgggaacaacgcggcacgactgctggcccgttgggactccgacagcgagaccttcgtcggcaagatgaacgccgccgcgaagaagctcggcatgacgaactccacgtacaccgacccgagcggtctggagaagaccacggtgagcacggccaccgaccagctgaagctggcgaaggcggtcatgcagaaagaggtgttccgcagcatcgtcggcatggccaaggcggacatccccggcctcaagggaacgatctacaacaacaacgacctgctggtgaagcaggtcggcgtgatcggcctgaagaccggttcgtcgacgcccgcgggcggcaacctcgtgtgggcggcgaccaagaccgtgaacggcaaggtgcggacgatctacggcgcggtgctgaaccaggacgccggcaccggccgggtctgggacagcctccagctggcgctcaccaacagccagaagctgatcgacaaggtccagcagggcctgatctccgcgccggtggtgaagaaggggcaggtcgtcgggtacgtggacgaccagctcggcggccggaccccggtcgtcgccaccgagaacatgacggcggtcggctggccgggcctgaagacgaagatctcgatcggtgcgggcgacacgacggttccgcacgaggcgaaggcgggcaaggtcgtcggcgagctgacggtcggcgacggttcgagccacgcggtgacgatcccggtcgcgctccagtccgacctcgctgaaccgggctacggagcgaagttcacccgagtgagc

SEQ ID NO: 3766 - DNA, 753 bp, Streptomyces avermitilis
  CDS (1)..(753)
atgggcaggagccgcagaacaattccggaggagcttctgctgctggcgttggacccgaccacgggtaccaccgcacagccgcagtcgctcgacctcggtctggccggagcacagctagtggagctggcgctggccggacggatagccccagacggggatcgtatcgccgtggtggcgccacggccgacaggagatccaacactggactgtgcgttggaactgcttcgccgacgcggagcacccgtacgcgcggtgaactggattggcggaccccggctggggttgcgccagacctatctctcgcatctggagaggtgcggcatggtgcatgccgtggccggccagatgtgcggggtgctgccgacgactcgctaccaggcgacggacacggcgatcagccgggagatcaaggcccggctggacaacgcgatccgcaccggcgtcccgccggacccgcggaccgcggcgctcgccgcgctggcccatgcggtcggtctcggcaagcacctgtatccgggcaatgagggacgctcgtcccgctcccggctacgggacctgatcaggcatgaccccatgggcggcctggtggcccacgcggtcatggacgttcagaacggtgtggccgctcagccacgccgcagcccggcaccggccggccgccaggccgcccccggagccaggcccgcaccggaacccgccaggggaatgccgatgcaaccgcgccacggatccatggcgcgcgccgtggcccac

SEQ ID NO: 3767 - DNA, 855 bp, Streptomyces avermitilis
  CDS (1)..(855)
gtggcgtccaatgtcgatcccaccgtccggcgacgccgactgggtcaggaactgcgccggctccgtgaactcaagggcatgacggccgaagaggtcgccgagcggctgctggtctcccagtcgaagatcagccggctggagaacggacggcgcagtatcagccagcgcgacgtccgcgatctgtgcggagtctacgaggtcgaggaccaccggatcgtcgattcgctgatgcagatggccaaggactcgcgccagcagggctggtggcactccttcggcgacatcccgtacagcgtgtacatcggcctggagaccgacgcggcgtccctgcgcgtctacgacccccaggtcgtccccggtctgctccagacccgcccctacgcggaggcgctcatcgcgggcgcgctgccggagacggccccgggcgacatcgacaagcgcgtccaggtgcgcctgcgcaggcaggaacgaatctccgcaccggacaaccccctgcgcctgtggaccgtcctcgacgaggccgcgctgcgccgggtcgtcggcaaccggtcgctgatgcgcgagcagttggagcatctcgtcgagcagtcgcagctgccgcacgtcacggtgcaggtcatcccgttcgatatgggcgcgcaccccgggctgaacgggcagtacgcgatcctggagttccccgacgcggccgattcgagcgtcgtctacatcgagggcgtcaccagcgatctgtacctggagaaagcggccgacgtccagaagtacagcgtcatgtacgagcacttgcgggcgcaggccctgaacgtggagcaatcccgtcagttcatcgcggacatcgcgaaagagtacgcccgc

SEQ ID NO: 3768 - DNA, 207 bp, Streptomyces avermitilis
  CDS (1)..(207)
atggcaattcagcaaggcgccacggacacctggaccaagtcctcgtactccacgggaaatggcgcgtgcgtcgaggtcaagtccccggtcgtcgcggcgatggccgtacgggactccaaggtcccggccggccccacgctggccttccccgccgactcgtggaacgccttcgtggtcgaggtgagccggggagccttcgacctcggc

SEQ ID NO: 3769 - DNA, 852 bp, Streptomyces avermitilis
  CDS (1)..(852)
atgagcgaggacacccgtggtgaggacacccgtagtgaggtgtacgcggagttggcggccgtgggtccgtacggcgtccgcccgggccatgccctgatcaccatggtcgagccgcatccggggcacgagtacgcgtacaaccgctggtacgaggacgaccactactacgccggcgcgatggcgatgccctggatgtacgccgggcgccgctgggtggccacccgcgacctccagctgctgcgctacccggagaagtcggcggtcgcccagcccgtctcggcgggctgctacctctccacgtactgggtcaccgacggccgctacgacgaccacatgaagtggacggtgggcatcaacaagcggctcaatcgcgacaggcgggtgtatcaggaccgtacgcacgtcttcaccgcgttccaggaccacgaggcgaccgtgtaccgggacggggccgtggggccccgcgacttccacgcgctcgaccacccgtacgcgggccttgtggtggaggtcgtcgatgccgacgggccggccgggcgtgccgagctgctggagtggctgcgctcgcgtcacctgcccgggcgcctcgcgggctctccgtccgcgatggtgacggtgttccgcccgacaccgctgcccggcgaccgtatgacgtatgtgaagcaggtcgagggcgtggacacccggctgacgctgctgtggttcctggaggcggatccacgggagtgctgggaggcgtacttcaccgggctggacacggatgtgcacgaagccggcctggggagagtcgaattggtggcgccgttcataccgacggtcccggggacggacacgtacgtggaccggctgcgc

SEQ ID NO: 3770 - DNA, 783 bp, Streptomyces avermitilis
  CDS (1)..(783)
atgtcactgcttcagggcaagaccgtcgtcgtctcgggggtcggcgccgggctcggccaccaggtcgcggcggccgtggtgcgcgacggcggcaacgccgtgctcggggcgcgcacggagacgaacctcgccaaagccgcggccgcctgcgacccggacggcgcgcacacggcgtaccgggccaccgacatcaccgacgagggccagtgcgacgccctcgcggcactggcccgggagcggttcgggcggatcgacgccgtggtccatgtggccgcctgggacagctacttcggcggcctggaggacgcggacttcaccacctggcagtcggtgatcgacgtgaacctgctcggcacgctgcggatgacccgcgcctgcctgccatcgctgaagccgtgcggcggctcggtcgtcatcatcggcacacagtcgtcggtggccgcaccgtcgcaggtccggcaggccgcgtacgcggcgtcgaagggcgcgctgacgagcgcgatgtactccctggcgcgcgagctgggcccgtaccggatccgcgtgaacacggtcctgccgggctggatgtggggcccgccggtggaggcgtacgtccagttcacggcgcacacggagggcgtaccggaggcggaggtgcggcagcggctcgccgaccggatggcgcttcccgacctggcgaccgacggcgacgtggcggacgccgccgtcttcctggcctccgaccgggcgcgggccatcaccggacagtccctgctcgtgaacgcgggggagctgatgcgg

SEQ ID NO: 3771 - DNA, 1566 bp, Streptomyces avermitilis
  CDS (1)..(1566)
atgaacggtctcgactgggccgtcctggtcgcgtacttcggtgtgatgaccgcgatcggcgtctggtcccacaagcgtgtggacgacgtgagcgacttcttcaccgcgggcggcaagatgccctggtggctgtcgggcatctcccaccacatgtcgggctacagcgcggtgatgttcaccggatacgcgggcatcgcgtacacgtacggcgtcacgtcctacgtcacctgggcgctgcccatcgccatcggcgtcgcgatcggcgccaaggcgttcgcgccacggctcaaccggctgcggtcacggctgcacgtcgcctcgccgctggagtatctgaaggaccgctacaacgtgcccacgcagcaggcgctggcctggtccggcatcctgctgaagatcgtggacgtcggcgcgaagtgggcggccatcgcgaccctgctcagcgtcttcaccggcgtcacgctcacccagggcatcctcatcaccggcggcatcaccgccgtgtactgcacgatcggcggcctgtgggcggacgcgctgaccgaactcggccagttcgtcatccagttgctggccggactcgccatgctgatcatcgccctgaacaagatctccgaccagggcggcctctccaaggcgctggactcgcccaagctggacggtcacgcgaacggcttcgccggcccgtacctcacggtcttcttcatcgcgtacctgttcatcaagctgttcgagtacaacggcggcatgtggaaccaggcccagcgctacatggcgacgggcagcgccaagcaggccacgcggtcggcgttcctgtcggcgggactgtggttcgtctggcccctcgtcctcttcatccccatgtggctgtcgccgctgctggtcaccgccaagaagccggacgggtccgacgcgtacggcctgatgaccgaacagctgctcccccacggtctgttgggactggtcgtcgtcgggttcttctcgcacacgatggccatgtgctcctccgacgcgaacgcgatcgccgcggtcttcacccgggacatcgtgccggtgctgaacaaggcggcgcgggcgtgggacacccggacgggcctgatggccgggcgggtgacgacggtcgcgttcctgggcctgtcgatggcggtggcgacacaggtcaactcccccacgttcaaggacatcatcaccgtggtgatcaagtgggtggccggtctgatgggcccgatcgcgatcccgttcatcctgggcctgctgcggccgttccgtaagtcgggcccgacggcggcgctgaccagttgggcgtgcggtctgctcgcgttcttcttcatcaactacaacctggacttctcccagcgcacggatgtgaagctggagtaccaggtggcgctgccgatggtgatctcgctggtcctgtacatcctgatcggcctggtgaagccggaggacacaccggagcgggacgcgatcatcgagaagatcaacacggacgacgacggttcgacggcggccgcggtgccggcgcaggcgcagacggacggcacgtccaccagcccgacgggcgtg

SEQ ID NO: 3772 - DNA, 1113 bp, Streptomyces avermitilis
  CDS (1)..(1113)
gtgggtgcgacagccggtgccgtctggggccgtgccgaacagcaggacttccgcagccgggtgcgcggaacgctgctgggcacggcggtcggcgacgcgctcggcgctccgctggacgcgctctccctggacgagatccgcgaggcgcacggcccgctggggctcgtcgacctgaccttcgggcacggcaggcgcggcgcggtcacccagctgacccagctcacgctcttcagcctcgacgggctgatacgcgcccaggtccgccgggacacgggcgcctggcatccgccgacggatctgcaccgggcgtatctgcggtgggcggcgacccagcacgactgggggcccgacgagcgccgcaaggaggacggctggctggcgcgcgaggagtggctgtacgcccgccgctcgccgtcccgggcctgtctgctgggcttggccgacgagaccatgggcacgccgggcgcgcccaagaacccgggcgagacggggccggaggcggcggcccgctcggcgccgttcgggctgctcgtcggctgggagccgcagctggtgctgcaactcgccgtcgagtgcgcggcgcagacgcacggacaccccacggcgtacctggcggcgggggcgtacgccgtcgtcgtgcatgccctggcgcgcggcgagagcctggacgcgggcgtgcagcgggcgttgcagctgctgtcggcgcggccggggcagcagccggtcgcggacgcgttgcagcacgcgctgggtgcggtgcggcaggggatgccgacgccggcgcgggtggaggagctggccggggacggtacggcggaggggttgctggcggtcgccgtgtactgcgcgctggtgggggaggacgtccggcacgggctgtgtctcgcggtgaaccacgggggcccgtcgggggtggccggggcgctgaccggggggctgctgggtgccctgcacggcgagacggccctcccgccggcctggctggccgagctggagggccgtcccacgatgctggtcctggcggacgacttcgcgatggagatgacccagggcccggccctgcacgggccgggcgggtcctcgccggggtggctggcccgctatccgcgggcg

SEQ ID NO: 3773 - DNA, 1404 bp, Streptomyces avermitilis
  CDS (1)..(1404)
gtgacccaccgcatccgccgtcgttccgtactgggctgtgccgcgctcgccgcgctgctgaccgcccccgtggccctggccgcaccggccttcgccgcgcccacgacgacgccgccggtgatcgacttcaacggcgacgggttcgccgacctggcgatcagcgcgccgaacgccacggtgtcgggcgtcggcgaggcgggctacctctcggtcgtgtacggctcctccgccggcgccgacagcgcgcacccgaagctgatcacgcgcgccaccgagggcgtgcccggggacgtcacggagtacgacgacttcggcagctggacggcggcccgcgacctcgacgaggacggctacaccgacctggtcgtcggcggctaccgcacgcccgtggtgctctggggctccgcgcagggcctgggcggcggcaccgcgctcgccgggacgacgtaccaggtgagcggcggcgacatcgacggcgacgggcacgccgacctcgtcgccaacgtcggcggctcgctggaggtgcgcttcggtcccttcacccgcgccggggtgcccgcgcggaccgacacgctcgccttcgacgacgaggacgggccgcagggcttcaccgtcggcgacgtcaccggggacggcaaggacgacgtcgtcacccagcacggcttcgaggagatgcagtacaagtcccgcctgtggaagggcacgtccaccggactgagcaagaccttccagtcctccggccactacacggtcggcggggtcatcgccgacgtgaacaaggacggctacggcgacttcatcgcccgccaggtcgaccaggtctccgagatgatggagtacgacgccggcgacatccgcgtcgtctacggctccgcgtccggcttctccacccgtaccgcgaagatcaaccaggacacgacgggcgtcccgggcgtcggcgaggcgggcgacaacaacgcgaactacggcgaccagttcggctactcgctcgccgccggtgacgtgaccggcgacggctacccggacatcgcggtgggcgtgcccggcgaggacatcgactcgatccgcgaggcgggctcggtggtcctgctcaagggcggcccgtccggcctcaccggcaccggggcgcaggccttcacccagtccacgtccggcgtccccggcgcctccgagaagggcgacttcttcggcgcctcggtgctgctcgcggacgtcaacgccaacaaccgcgcggacctcgcggtgggcgcgccccaggaggacggtacgtaccagaactcgggcgcggcctggctcctgcgcggctcgaagaccggcctgacgaccaccaacatcacctccttcggccccagcacgctgaacgccccggagaaagctgcccgattcggggcgaacttcgcacgc

SEQ ID NO: 3774 - DNA, 1176 bp, Streptomyces avermitilis
  CDS (1)..(1176)
atgaccacggcgaccggagcaacccggacgccgcccgccaccgcgcccacggccgagaccggccgcacgccggcgccctcgctgccgtccctcaccggcctgcggtggatggccgcgctgctggtcttcggactgcatgtgcgcaacttcggctacttcgacggcaccggtgcccgcatcgcgacgtgggcgttcggggccggcgccagtggggtgtcgttcttcttcatcctctccggcttcgtgctgatgtggtcggcacggccgggggaccgcgcgctcgccttctggcggcggcgcatcgcccggatctatccggtccacctggtcaccgccgggatcgcgctgctcatggggttcaccctggcccatcagccgaggcccaccctgcaccaggcggtggccaatgtgctgctggtgcactcctggtggcgcctgtggtggcagacgctggacccggtcagctggtcgctggcctgcgaggcgttcttctacgccgctttcccgctgctggcggtcctgctgcgccgcctcggcgcccgggggtcgacggcgttggccgggctgtcggtgctggcggtcgtggtcctcgcccgggcggacgagcaccactggctgagccagccgctcaactccttccccgcggcccgcctccccgagttcgtcctcggcgcggccgtcgcccggctggtgatcctcggccgctggcgcgggccgggtcttgaggcctcgctcgccctgacgatcatcggctacttcttcgttccccaggtcaccgccgggtacccggcgacgccgtgcacggtcgtcgggttcgcgctgctcatcccggcggccgccgtcgccgacctgcgcggtctgccgtcgatgtggcggcacccgtggctggtgcggctgggtgaactctcgttcgccttctacatggtgcacctgctggtgctgcgggccggcaccaatctgctggggaagtacccgcactacggcatgctgctcggactggcggccaccgccgccgcgttcgccgtggcactgggcctgtcctgggtcctgtacgagggcgtggaacgcccggcgagacgcctcctgctccgccaccgccgctccgcgccaccccgaccgacaccgcggcccacacccccgaagccccacccggagtcgaccacggcccgggccgac

SEQ ID NO: 3775 - DNA, 384 bp, Streptomyces avermitilis
  CDS (1)..(384)
gtgatcactggtgggggtgtgcagaggttcttcgagcaggtcgccggccacgccacgtcgatccactcacacggcccggacagcagaccggtcagccgacgcggccggcagatggacctgggcgagcgtctggtgcgcccgcaccaggtcgtcgccaagaccgaggtaacgcgtcagatcggccagcgcttcgtccggacggcccacggccaacagggtgacggcccgccgcatcagataccgggcgccatccgggtcgagggcgacggccggctccaccgcccggtccagaccgaccgccgggccccaggcggtcagccggtcatgacgggctcacgcaccgcacccaggacaacgtcggccttcacgaccacaaccaggtcg

SEQ ID NO: 3776 - DNA, 2064 bp, Streptomyces avermitilis
  CDS (1)..(2064)
gtggccgccacggtcctggcggcaccgggaacggccgcggcggcgggcaacacaccgcccgcgcgaccgctcgtgaaggacctccagaccgggagcaaggcgtgcgcggcgggggaggacgcgcggccgtacgtggcggaaccgccgaaactgagcgcggtgctgtacgaccccgaccgcacccaggtcagcggtgagttcgaggtctggtggacggacaccgagggcgccgagcagcgcaggacctacacgaccacggcgaagctctcgggcaccccgttcaccctgcaactcccgtccgacatcccgccgaccaccgtcgtctcctggcgggtgcgcgccaacgacggcaccaccacgtcgccttggagctccgcgggcgaggacggctcggcctgcgagttcgtgtacgacgacgtgaatccggagaaggcggcgctctcctcccccgaatacccgcagccacaggacgtgttctgggtggacggagtgggcgtgtacggccacttcaccatggactcgccctcggacgacgtcgtggcctacacatacggcttcatcggcggcccctacggaaccgtccgcgcccagcaggccggcggggccgtcaccattccctttctgccgctcgcctcgggtcctcagcggctgacggtccgcgcgatcgaccgggccggacgcagcagcggccagtcggcgtacgaattcaacgtgaagtccggccacgcccccgtctcccagtggaagctcgccgacccggccggcaccaccagcgcggccgccgaaaccggaaccgccgcgcgcgccggctccggggtgaccttcgcgggagccgcgccggacggcaccggcctcaccagcaccgcccacctcgacggcggcgaccaggcgttcctgacccccgacgccccggccgtggacacgcacgggaccttcgcggtcagcgcgtgggtgcgcccggagcgcaccgaccgggacatggcggtggtgagccagggcgccggctccacgggagccgggctcggactgcgcaggggcgacgagggcccggtgtggtccttcaccgtcgccggccaggaggtctcgggcggcgctccggagaccggcgagtgggcccacgtcctcggcctgtacgacgccgagaccggcctggcgcagctctacgtcaacggccacgaggccggtacgaagacgaaggccgagcccacgcggaccaccgacgccttccggatcggccagggctccggtctgtcggcctggcagggcgacatcggtgacgtccgcgcctacgaccgggtcgtcgtacccgccgaggccaccgaactcggctaccgcaagccgaagtcgctcggccactggtccctggagacggcgtcggacggtgccagccccgagcagagcggcagggcgccgctgaagctgggcgcgggcgcgacggtctaccgggtcccggacagctcctgcctgccggagctcgacccggactgccccgtcgtgcccctcccgctggtcggtgacggccacctccagctggacggcgagacgggctacgcggccacggagcagccggtcgcggacacctcgggcagcttcaccatcggcgccgtcgtacggctggcggacgccgaacccgcccacccgatgaccgtgctgtcgcaggccggcgagcacacggacgccttcaaggtgcgctaccagccgtcggagcacgcctggcagctggtcatgccggtcaaggacgagcggggcgcggccgagaccgtggtgtcccagatcgaatcggcggacggcggcgaggggcagggccaccgtctcgcggtcgtgtacgacgacgccaccgaccaggtcaagctctacctggacggcgtcgccggcacctccgcgaccgcggacttcccggacggctggcacagctcgggcccgttgcaggtgggccgcggccacacggccgacggctggggcgagtacctgcacggcgacgtcgacgaggtacaggcgtacgcgggggcgctgcgggaccgcgacatcaccggcctgggctggggcaccgacccttgcctgtgc

SEQ ID NO: 3777 - DNA, 351 bp, Streptomyces avermitilis
  CDS (1)..(351)
atggacatctcccgccgcagccgtgccctgctcgccccggccggggacaactggctctcgcgcgtctatctggccgtggtcgtcgccgcgaccgggttcgtcctctacgacgccgcgttcgtctcccaccccgacgcctcgctggcggccgtggtgccgtggctgctgaccgccccgctgagcctgctctacacgctgctgcccgacgacgtgctcagcggtgcgcccaccggtgttgccacggccctctatgtggccggaatcgcggtcgccgcgacggccaacgccgtgttcatgggcgtggccctgcgcaggatccgcccgtcggccccgcgcaccgccgccagcgcc

SEQ ID NO: 3778 - DNA, 2583 bp, Streptomyces avermitilis
  CDS (1)..(2583)
atgacgacctccgcgacctccggaaccgggcccacggcgaactccatgcggcgcgcgctgaaacgggcgcgggacggtgtcgcactcgacgtcaccgaggcggccgtgctcctccaggcccgcggcgaggacctcgacgacctcaccgcctccgccgcccgggtgcgtgacgcgggcctggaagcggccggccgcgccggagtcatcacctactcgaagagcgtcttcatccccctcacccgcctgtgccgggacaagtgccactactgcacgttcgtcacggtccccggcaagctgcgccgcgccgggcacgggatgttcatgtccccggacgaggtcctggacatcgcccgcaagggcgccgccctcggctgcaaggaagccctgatcacgctgggcgacaagcccgaggaccgctggcccgaggcgcgcgagtggctggacgcgcacgggtacgacgacacgatcgcgtacgtacgggccatctcgatccgcatcctggaggagacggggctgctgccccacctcaacccgggcgtgatgtcgtggacggacttccagcggctcaagccggtcgcgccgagcatgggcatgatgctggagaccacggccacccgcctctggtcggagcccggcggcccgcaccacggctccccggacaaggagccggccgtacgcctgcgcgtcctggaggacgccggccgctcctccgtccccttcaccagcggcatcctcatcgggatcggcgagacgtacgaggagcgcgccgagtcgctgttcgcgctgcggaagatctcgcgggcgtaccacggcatccaggagctgatcatccagaacttccgcgccaagccggacacggcgatgcgcgggatgccggacgcggagctggacgaactgatcgccacggtggcggtggcccggcacatcatgggaccgcgcgcctgcctccaggcgccgccgaacctcgtcgacagcgagtacgggcggctgatcggcgccgggatcgacgactggggcggggtgtccccgctgaccatcgaccatgtgaacccggagcgtccgtggccgcagatcgacctcctgcgtgagcagtccgctcaggcgggcttcgaactgcgtgaacgcctgtgcgtctacccggagttcgtgcagcggggcgagccgtggctggacccgcggctgctgccgcacgtacgggccctcgcggaccccgcctccggtctcgcgcacgcggacgcgacggtcgagggccacccgtggcaggagccggaggaggcgttcgtcgcccagggccgcaccgacctgcatcacagcatcgacaccgagggccgtacgggcgaccgccgggacgacttcgacgtcgtgtacggcgactgggaggcgctgcgggaggcggcggcgcccggcatggtgcccgagcgcatcgacaccgacgtccgccaggccctggcgacggcggcgaacgaccccacccggctcaccgacgccgaggcgctggccctgctgcacgcggacggcccggcgctggacgcgctcacccgcatcgccgacgacgtccgcaaggcggcggtcggcgacgacgtcacctacatcgtcaccaggaacatcaacttcaccaacgtctgctacacgggctgccgcttctgcgcgttcgcccagcgccgcacggacgcggacgcgtacaccctctccctggagcaggtcgccgaccgtgcccagcaggcgtgggacgtgggcgcggtcgaggtgtgcatgcagggcgggatccaccccgacctgcccgggacggcgtacttcgacatcgcgaaggcggtgaaggaacgcgtccccggcatgcacgtgcacgccttctccccgatggaggtggtgaacggcgcgacccgcaccggcctgtccatccgcgagtggctgacggcggcgaaggaggcgggcctggactcgatccccggcacggcggcggagatcctggacgacgaggtccgctgggtcctgacgaagggcaagctgccgacggccacctggatcgaggtgatcacgacggcccacgagctgggcatccgctcgtcctcgacgatgatgtacggccatgtggaccagccccgccactggctcggccacttccgcacgctcgcgcggatccagcagcagacgggcggcttcacggagttcgtgacgctccccttcatccacaccaacgccccggtgtatctggcgggcatcgcccgccccggcccgacgacccgcgacaaccgcgcggtgatggcgatggcccggctcctcctgcacccccacatccccaacatccagaccagctgggtgaagctgggcacggagggcgctgcggagatgctccgttccggcgccaacgacctgggcggcacactgatggaggagaccatctcccgtatggcgggctccagttacggctcgtacaagtccgtcaaggacctgatcgcggtggcggaggcggcggggcgtccggcgaagccgcgtacgaccttgtacggggaggtgccgcaggagcggcagcgggcggccgcggcttccgacgggcatctgccggagctgctgccggtgctggac

SEQ ID NO: 3779 - DNA, 1506 bp, Streptomyces avermitilis
  CDS (1)..(1506)
atgtgtgaggacgaccacggaatcggcagacgggcgttgttcgtgacgggagcggccgccgcgcttacgttgggaagcgtgagcttcgcgagcggtgccccggcggccggccaggagacgcggacggtgcgcggcaccctgcccaccggctcgccggacttcgtgtacgtgcccgtcgaagtcccctcgggcgtacaggaactccacgtcgcctacacctacgagaagccggccgtgcccgccggcaccccgggcaacgccctcgacatcggcctcttcgacgaacgcggcacggaactgggcggcaagggcttccgcggctggtcggggggcgcccgcacggagttcttcgtccgtgcggacgacgcgacccccgggtacgtcccggggcccgtccgccccggcacctggcacatcgccctcggcccgtacacggtggcgccggggggtctgccgtacgagatcacggtcacgctgacctacggggagcagggccggaccccgcggcccggctacccgcccgcgcgcgccaagggccgcggccgggcctggtaccggggcgactgccatctgcactcctggcactcggacggccgccgcacccccgcggagatcgccgccctggcccgcgccgcgggcctggacttcatcaactcgtccgatcacaacacccactccgcgcacccgcactgggcggaccaggcgggcgacgacctcctgatcatgctgggcgaggaggtcacgacgaggaacggccatgtggtggcgctggggaccgaccccggcacgttcgtggactggcgctaccgggcccgcgacaaccgcttcggccggtacgcccgggagatccggcgcgccggtggcctggtcgtcccggcgcatccgcacgccacctgcgtcggctgcaactggaagttcggcttcggcgaggccgacgcgatcgaggtgtggaacggcgcgtacacgccggacgacgaggtggcgctggccgactgggacagcatgctggtcgcgtccgtgcgcggggacgcgcggtcgtggatcccggcgatgggcaacagtgacgcccatcgcgaccccgacccggtcggcaccccgcagacggtcgtcctcgccgacgacctcacccgcgaggccgtccaggagggcatccgcgcgggccgctcgtacgtggccgagtcgaagtcggtgtcgctgtcgttctcggcggcggggccgaaaggtgagcacgcggggatcggcggccggctgcgggtggccggcgacgccccggtcacggtccgtctggaggtcacgggggcgccccgctgctcggcccgcttcgtgacggaccagggtgtcctcttcacgagcgccgtcctcccggtgtccggcagcggaacggtggagtggcggacgacggcgcagtacgcggcgtacgtacgggcggagctccggcacgaggcggcgctgggtccgctgccggggccgctggcggcgttcaccaacccgatctttctgggggcg

SEQ ID NO: 3780 - DNA, 405 bp, Streptomyces avermitilis
  CDS (1)..(405)
atggcacgctacgacgaggtcaagttccgggcgatcacggcattccagcggagggtcggcaatccggtgctgcgccgactgccgttccagacggtcctggagaccacgggccgcacgtcggggctgccccgtcggaccccggtgggcggccgccgcgtcggtgactccttctggctcgtctccgagtacggcgagaagtcgcagtacatccgcaacatcaaggcgaacccgaccgtacgcgtccgcatccggggccactggcacccgggtacggcccacctcctgcccgacgacgacccccgagcccgcctgaagaccctgccgcgcctgaacagcacggcggtgcgggccttcgggacgggtctgctgacggtgcgggtggacctgacggacacccgcgtgacc

SEQ ID NO: 3781 - DNA, 1386 bp, Streptomyces avermitilis
  CDS (1)..(1386)
atggccgcctcacaggtttcccccaccggcgctttatctccgtcgtggagcttggggcgcatggacggacacacaccccgcactcccgaagccgagcgcagtcgccggtggttcatgaacaaggcgctgctcgccggcggtgtcgccgcggtggcgaccatgaccggctgttccgcgggctcctccggcgcgtcgagctccgcctcggcctccggggcgccgggcggcatgccgtccggcgccccctcgggcgccccctccggggggcccggcggaggcgccggcgggatgggccccggcgccagtgaggtcaagtacgacgacttcacgggcgtcaccaccgacggcaaggccgccgacggcctgtactccgtccacgccaccgacgtctccaccgacgcggtggtcaaggcggcgcaggccttcctggacgggctctcccagaaggaacgcaaggccaccctgttcgatgtgcaggccgacgaatggctggcctggagcaacgtcgacggataccagcgcgagggcgtccgcatgggcgacatcacggccaagaagcgcgacctcggctacgcgctgctcggcgcggccctgtccgccgacgggctcacccagacccgcaacatcatgaagctcaacgcgttcctgggcgagtacagcggtggcggcaaggagaccctcaccgagggcgcctacttcttcacgatcatgggcaccccgtcgaccacgaaaccctggggcttccagtacgagggccaccacgtggccatcaactacttcgtcctgggcgaccaggtcgtcatgacgccgaccttcatgggctccgagccgacgtccgcaacgtacaagggcgagaagatcgtcaccttcaggacggagacgaaggccggtctgacgatgctgcgctccctgaccgacgcgcagcgcaagaaggtcgtctcctcggagaccaaggccggcgacaacatgaaggccggcgcgggccaggacaacctcaagctcgcctaccagggcctggccggctcccagctcaccgacgcgcagcgggacaagctgctcgacctggtgcgcgtctacgtcggctacatggacgacgggcacgccgaggtgaagatgacggaggtggagaagcacctggacgacacgtacttctactggatcggcgcgaccaaggacacctccccgttctactaccgcgtccacagcccggtcgtgctcatcgagtacgacgcccagtccccgatcgcgtacggcaccaagtccggcggcggcatgggcggccccggcggcaagccgacgcagcagcacatccacaccatcatccgcaccccgaacggcggcgactacggcgtggacctgctcaagctccacctggcccacgaccac

SEQ ID NO: 3782 - DNA, 1497 bp, Streptomyces avermitilis
  CDS (1)..(1497)
atgactccggggactccagggaatccagcggctccagtgacgcctggggcgagcgacgcgcagcggctgttcatcggcggtgagtgggtcgcccccgacggcggccactacgaggtgatcgacccggcgaccgaggcagtcgtcgggtgggcgccggaggcctcgcgggaccaggtgcacgcggccgccgccgcggcccgtgaggccttcgcggcgtggtcgcgcacgccggccgaggagcgtgcggcggtcctcggccgcgccgcggaggtgatgcggcgcaacctcgtgccgtacgccgaactggcccaggccgagagcggcgccacgaccggcacggcgcgcggcatgcaggtcggggtcggggcggcccggttcaggcggtacgcgcgtgtggagccggccgaggagcccatcgccccgcagatcaacgaggcgggcccgttcggcagggccgccgtcatgggcgccctcgcggtacggcaaccggtgggcgtcgtcacctgcatcacgtcgtacaacaacccgtgggcgaacccggcgggcaagatcgcgcccgcgctggccatgggcaacacggtggtggtgaagccggccccgcaggacccgctgtccgtgtaccggatggccgaggcgcttcaggcggcgggtgtgccgccgggtgtggtcaacgtggtcagcggttcgggggcgcaggcaggcgaggcggccgtggactgcccggacgtcgacatggtgagcttcaccggctccaccgccgtcggacagcgcatcgccgaggtgtgcggccgcggcatgaaacggcagttgatggagctgggcgggaagggcgcggcgctcgtcttcgaggacgcggacctggcgtcggcggtctcggggatcggcacgacgttctcgttctacagcggccagatctgcacggcgccgacgcgggtgctggcgcagcggggcgtgtacgaccgcgtggtcgaccaactcgccgcgtacgcccgccgtctgccggtcggggacccgcgcgccccgggcacggtcgtgggcccggtgatctcggcggcccaccgggaccgggtggagtcgtatgtcgagctgggccgcaaggagggggcgagggtggtgacgggcggcgaacggcccccgtgcgccacggggttctacgtcgccccgacgctcctcgcggactgcaccaccgacatgagggtggtccgcgaggagatcttcggtccggtcgtggccgtcctccccttcgacgacgaggaggaggggatcgagctggccaacagcagcgactacggcctgatcgactacgtctggtccgccgacgtggcccgcgccttccgcgtcgcccgccgcctcagggccggcggagtcggcgtcaacacggtcggccggaacatggaggcccccttcggcggcttcaagaggagcggggtcggccgggacgtgggctcgtacgcgctgcacgcgtacagcgagctgcaggcgatcgtgtggccgggg

SEQ ID NO: 3783 - DNA, 1728 bp, Streptomyces avermitilis
  CDS (1)..(1728)
atgctcgaccacgtcatcaggggcgcgaccgtcgtggacgggacgggcgcgcccgcgtacaccgccgacgtggggatacgggacggccgtatcgccgccgtcggcacggtcaccgagccggccagggccggcgaggacgcggccggcctcgtcctcgcccccggcttcgtcgacccgcacacccactacgacgcccagctgttctgggacccctacgcgaccccgtccctcaaccacggggtgacgacggtcgcgggcggcaactgcggcttcaccctcgcgccgctgaacccggaccggccccaggacgcggactacacccgccggatgatgtccaaggtggagggcatgtccctggtcgccctggaggagggcgccccctggagctggcacaccttcggcgactacctggacgcgctggagggccggatcgccgtcaacgcgggtttcatggtggggcattgcgccctgcgccggtacgttatgggcccggacgcggtcggcggccggcccacgcgggagcagctggagcggatgctggcgctcttccacgaggcgatggacgcgggtgcgtggggcctgtccaccacccagtcgtccacccactcggacggcgacggacagccggtcgcctcccggcacgcgcggccggcggagctgctggcgctggcgcgggcggtgggcgagcacgagggaacccagatcgaggcgatcgtcgccggctgcctggaccagttcagcgacgcggagatcgacctcttcgtggagatgagcgcggcggcgggccggccgctcaactggaacgtcctcaccatcgacgcggcggttcccgagcgcgtaccgcggcagctgaccgcgagcgagcgggcccggaaggcggggggacgggtggtggccctgacgatgccgatcctcacccccatgaacatgtccctgggcaccttctgcgccctgaacctgatccccgggtggggcgaggtgctcggtctgccggtgcccgagcggatcgcgcggctccgcgatccggacgtccgcgcggagctgctgcgacgggcggacagcaaggaggcgggcgtcttccgccgcctcgcgaacttcggccggtacgtcatcggggacacctacagcacggcgaacgagggcctgaccgggcgcgtggtgaacgacatcgcggccgaacgcgggcaggaccccttccactgcctggtggagatctgcgcggccgacgaactgcggacggtcctgtggcccatgcccaccgacaacgaccccgactcctgggccctgcgcgccgagacctggcggcacaaggacgtcctgctcggcggctcggacgcgggcgcccatctggaccgcatgtgcggagccccgtacacgacccggttcctcggcgactgtctgcgcggccggaagctggtgccgctggagcaggcggtgaagatgctgacggacgacccggcgcggctcttcggcctccgggaccgcggccggatccgggagggcttccacgcggacctcgtgctcttcgatccggcgcggatcgacgcgggcaaggccaccctggtgcacgacctgccgggagacagcccacggctcgactcgaaggcgatcggcgtcacggccgtgtgggtcaacggggtcgaggcgatcagggacgacgtggtgaccggcgccgtaccgggaaaggtgctgcggtcgggccgggacacgcggacggtgagcaccaga

SEQ ID NO: 3784 - DNA, 1038 bp, Streptomyces avermitilis
  CDS (1)..(1038)
atggaggagaccgagtacgtcatccaggcggacacgtccggcttcaagtacgcctgggcgtccgagcaccacttcctggacgagtactcgcacctctccgccaacgacgtcttcctcggctatctcgcgcacgccaccgagcgcatccacctcggctccggcatcttcaacccgctcgcccaggtcaaccaccccgtgaaggtcgccgagaaggtcgccatgctcgaccacctcagcgagggccgcttcgagttcggcagcggacggggggcgggcagccacgagatcctcggtttcataccgggcgtcaccgacatgaactacaccaaggagatctgggaagagaccatcgccgagttcccgaagatgtggctccaggaggagtaccccgggttccagggcaagcactggcagctcccgccgcgcaaggtgctgcccaagccgtacgggaagtcgcaccccgcgatgtggtacgccgccgggtcgccgccctcgtacgccatggccgcccgcaagggcctcggcgtgctcggcttcagcgtgcagaaggtctccgacatggagtgggtcctcgagcagtacaagacggcggtcgtcgaggcgcggccggtcggggacttcgtcaacgacaacgtgatggtgacgaccaccgccatctgcgcgccgacgcacgaggaggcggtacggatcgcggtcggcggccagctgcactacctgccgtccctcgtcttccgctaccacgacaccttcccgcgccccgagggcttccccgtctggcccgagacgctccccgagtacaacgaggagttcatcgagctgctcatcgccgaggagctgctgatctgcggcgatccgggcgaggtgctgacccagtgcaagcgctgggagcaggcgggcgccgaccagctgagcttcggtctgccggtgggtgtccccaaggaggagacgctccagacgatccggctgatcggcgagcacgtgatcccgaagatcgacacggatccggtgcaccgcacgacccgtttccggcagtccgtc

SEQ ID NO: 3785 - DNA, 774 bp, Streptomyces avermitilis
  CDS (1)..(774)
atgggcaagctggacggacgcgtcgtcctcatcagcggggcggcgcgcgggcagggtgagcaggaggcgcggctcttcgtcgaggagggcgccaaggtcgtcgtcgcggatgtgctcgacgaccagggggaggccctggccaaggagatcggggcccggtacgtccacctcgacgtcggtcgggaggacgactggcaggcggccgtcacggtcgcgaaggacgcgtacgggcacatcgacggcctcgtcaacaacgccggcatcctgcgcttcaacgacctggtcggcacgccactcgccgagttccagcagatcgtgcaggtcaaccaggtcggcgtcttcctcggcatcaagaccgtcgcgcccgagatcgaggcggcgggcggcggcaccatcgtgaacacggcctcgtacgcgggcctgacgggcatggcgtacgtgggcgcgtacacggcgaccaagcacgccatcgtcggcctcacccgcgtcgccgccctggaactggccgccaagaagatacgggtcaacgccgtctgcccgggtgccatcgacaccgccatgagcaacccgtcccagctcgaccccggcgcggaccccgaggagacggcgcgggccctcagcgagctgtacggcaggctcgtgccgctgggccggatcggcaggcccgaggaggtcgcccggctggccctcttcctctccggtgaggactcctcgtacatcaccgggcagccgttcgtgatcgacggaggatggctggcgggagtgagcgtcatc

SEQ ID NO: 3786 - DNA, 927 bp, Streptomyces avermitilis
  CDS (1)..(927)
ttgaacggctccttcgcctacgggatccagctccccgtccagtcccagagcaccctctacacggagggctgggaggcgggcgccgggccggacgacctcgtggagatcgcccgcaccgccgaccgctccggtttcgcctacctcgcgggctgcgaccacgtcgcgatcccccggcgtctcgcgagcgcgatgagcaccgtctggtacgaccccgtcgccaccctgtccttcctggccggtgtcaccgagcgcgtccggctgctcagccatgtagcggtcgtcgggctgcggcatccgctcgtcacggccaagcagtacgcgaccctcgaccacctctccggcggccgtctgatcctcggggtcggcgccgggcacgtacgggaggagttcgaggcgctgggggtggacttcgagcggcgggggttcgtgctcgacgagtgcgtcgacgcgctgagggccgcgctggggcccgacgaattccccgtccaccacggcaaggtgtacgacttcgaggggctcgggcagcggccccgccccgcccagccgcgggtgcccctgtgggtcggcggctcctcgcccgccgccgtgcgccgggccgcggtccggggcgacgggtggctgccgcagggggacccgcgcgaccggctgccggagcagatcgcgaagctgcggcgactgcgggagggcgcgggcatctccgacccgatcaccgtcggcgccatcaccgagcccctgtacgtgggcgggcccggctgggacgtcggccgccgcaccctcgccgggcgccccgaagccctcgccgagtcgctgcgggcgtaccgggcgatgggcgtggaccagatccaggtgcggttccgcagccggagccgcagcgaactcaccgaccagatggccgcgttcggcgccgaggtggcgccgcacctcacc

SEQ ID NO: 3787 - DNA, 1257 bp, Streptomyces avermitilis
  CDS (1)..(1257)
gtgagccgtatggagacctcccggaccctttcggccttcccgaagatcatctcggtggacgaccacacggtggagccccctgacgtctggcgggaccggctcccgaagaagtaccaggacacaggccctcgcatagtccgcgcgcctctgaaggaaatgaccttcctgggcggcaagttcgccccggtcatgggcggtcccggcgacgacggccccctcggcgactggtgggtctacgaggacctgcaccggccgctcacccgtctcgacaccgccgtcgggtactcccgcgacgagatcaagctcgaagtcatcacgtacgagcagatgcgtccggggtcgtacgacgtcccgcggcggctcgccgacatggacgtcaaccacgtccagtccgccctctgtttccccaccttcccccgcttctgcggccagacgttcaccgaggccaaggaccgtgaactgggccttctcggggtcagggcctacaacgactggatggtggaggagtggtgcggcccggacgcccacggccggctcatccccctcaccctggtgcccctctgggacgcgcggctcgcggcggcggaggtgcgccgcaacgccgcccgcggcgtacgcgccgtggccttctccgagataccgccgcacctgggcctgccgtcggtccacacggacgactgggacccgttcctggccgcctgcgacgagaccggcaccgtcatcgccatgcacatcggctccagcagccgcatgccgtcgacgtcggccgacgccccgccggccgtcggctccaccatcaccttcgccaactgctgcttctcgatggtggactggctgatgagcggcaagttcgagcgcttcccgaacctcagggtcatgtacgcggaaggccagatcggctggatcccctacatcctggagcgcgcggacgtggtgtgggaggagaaccgcggctggggcggcgtcgcggacaaggtgcaccgtccgccgtccgaactcttcgccggccacgtcttcggctgcttcttcgacgacgccttcgggctgcggaacctcgacgccatcgggatcggaaacgtcctgtacgagaccgactacccgcactccgactcgacctggcccaagtcccgcgaggtcggcgaggcgcagatggggcacctggaggcggaggtggtggagcggatcgtgcgggggaacgcgatcgagctcctcgggctcacggacgacgggttgtgggccggtcccggcggtgcccgt

SEQ ID NO: 3788 - DNA, 2940 bp, Streptomyces avermitilis
  CDS (1)..(2940)
atggacggtgtgccgcgagtaccggagcagtggcgtcccgaggaatcggcggcgctgcgcttcggcgtgctcggcccggtccgcgcctggcacggggagaaagcgctgtccaccggttccccgcagcaacgcgccctgctggccgcgctgttgctgcgcgagggccgcaccgcgacggccggtgagctcatcgacgccctgtggggcgacgagccgccgtcgcaggccctggccgccgtacggacctacgcctcccggctgcgcaaggtactgccggccggagtcatggtcagcgagtcgggcgggtacgcgatccgcggcctgcccgaggaggcgctggacgtgtccctggcccaggcgctcgccgccgacgcggagaaggcgaaggccgcgggcgacctgtgccgggcccgcgccctgctcaacgaggcgctggccctgtgggacggggagccgctggcgagcctgccgggaccgtacgccgagacccagcgggcccgcctcgacgaatggcggctccagctcctggagtcccggctcgacatggacctggaacagggctgccacgcggaggccgtctcggagctgaccgccctgacggccgcgcaccccctgcgggagcggctgcgcgagctgctgatgctcgcgctgtaccgcagcggccggcaggcggaggccctcgcggtctacgcggacacccggcacctgctggccgaggaactcggcgtcgacccccgctccggcctgaaggaactccagcagcgcatcctccaggcggacccgggcctggcggagccctccggcccggccgccgaacccccgccggcgcccgtacgccccgcccagctccccgccacggtgcccgacttcaccggccgggacgccttcgtcgccgaactgagcgacgtgctcgcgtccgccgagggccgggtgatggcggtctcggcactggccgggatcggcggcgtcggcaagacgaccctcgccgtgcacgtggcccaccaggcgcgggccgccttccccgacggccagctgtacgtggacctccagggcgccggacagcgggcggcggagccggagaccgtcctgggcgcgttcctgcgggccctcggcaccgcggactcggcgatccccgactccctggaggaacgctccgccctgtaccgctcggtcctcgacggccgccgcgtgctggtcctgctggacaacgcccgcgacgccgcccaggtgcgtccgctgctgcccggcatggagggctgcgcggccctggtcacctcccgggtacggatggtgggcctggccggggcgcacctcgtggacctcgacgtgatgtcgccggaggaggccctccagctcttcacgaagatcgtgggcgaggagcgggtggcatcggagcgcgaggcggcccttgacgtggtggcggcgtgcggtttccttcccctggcgatccgcatcgccgcgtcccggctggcggcccggcgcacctggaccgtctccgtactggcggcgaagctcgccgacgaacgccggcgcctcgacgagctccaggccggcgacctggccgtgaaggccaccttcgagctgggctacggccagctggacccgccccaggcccgcgccttccgcctgctgggcctcgcggacggcccggacatgtccctggccgcggccgcggcggtcctcgacctcccggccgaggagaccgaggacctgctggagtccctcgtcgacacgtccctgctggagtcggcggctcccggccggtaccggtaccacgacctggtccgcctctacgcccgcgcgtgcgcggagcgcgacgagcacccgccgagcgagcgggacgcggccatggcgcggttgctggacttctatctggccacggccgcggaggtcttcgccatcgagcggcccggggaccggctggtggatcacctggagcagacccggaccccgggactggtcttcccggaccgccgcgccgcccaggactggctctactccgaggccgtgccgctcctggcctgcgtacggcagtcgtcgggcggtgcgacgctcaggcgtgccgtcgacctgttgtgggccgctgtcgacctggcggaatcgggggcgaacgccaaggagtacgaggcggccgcgacggcgctgcgggacgcggcgcgggtcgcttcggaccgccgggcggaggggcgggccatcctcgtcctggccaacgcacgccactggtccggcctgttcgaccaggccgatcaggaggcacggcaggcgctcgcgctctccgaggcggccgcggatccgttgccctgctgctgggcggcgaacatcctgggcgccttcgcgttctaccagagccgctacgcggaggccgaggagtacctggagcgggccatccgggagttccgcgcctgcggggaccgctccggcgcggcggccgccctgtgcaatctctcccggctgcacctggagacggatcgcgcccacagcgccgtcgatctcgcccagcagggcaccgagatgtacgaggagctcgggcattccctcaaggtcgccaacggccgctacgcgctggggatggccctcagcaagagcggccggccggccgacgccacccatcgtctccgggaggcgctccaggtcttccgcgcgagccgtcagcggttgtgggaggggatgaccctcttccggctggccgaggtcgatctcctggcccagcgcccggcgcaggcggcggccaactccgagatggcgctggcgttgctgcgggggatcggcggcgagtggcgtcgcggcaacgtgctcacggtgctcggcaagtccctgaacgggatcggccagcccggcagggctcaggtctgctggcgcgaggccctcgaaatctacgtgaaactgaactctcccgaggccgccgaggtgcaggcactgctggctccggccgccgctgcc

SEQ ID NO: 3789 - DNA, 261 bp, Streptomyces avermitilis
  CDS (1)..(261)
atgagcgacatcacgaaggacgagacggtcgtcaagccggacaacacccacatcaccgacgccgaggccggcacggagatcaagccgctcaacacgcacatcaccgatgctgcggccggcacgacgatcaagccgctcaacacgcacatcacggacgccgaggcgggcacggagatcaagccgctcaacacccacatcaccgatgtcgaggacgacggcgagaccactccggacaacacgcacatcacgtccaaccccacc

SEQ ID NO: 3790 - DNA, 1581 bp, Streptomyces avermitilis
  CDS (1)..(1581)
gtgcgcggagacgtggagtggggcagcatcccgggcctggtgcggtcgtccgcggagcggtacgcggataccgaggcggtggtggagggccgtacgaggatctcgtacgccgagttgggcgcccgggtggagcgtgcggcggcggcgtgtatcgccagcggggtgggtgtcggcgaccgggtgggcatctgggcgccgaattcgctggactggatcgtctcggcgctgggcgcggtgtcggcgggcgcggtactggtgccgctgaacacgcgcttcaaggggagcgaggcggcttatgttctgcggcggagcggggcgcggttgctgttcgtgaccgggacgtttctgggcacgtcgtacgtggcttcgctgcggcgggcggcgggggagggcgaggggctccgtggtcccctgcccgggcttcccgccctggagcaggtggtggtgctggcggacgacgcgccggccgacttccgtacgtggaaggacttcctggcgagcggggagggggtgggcgaggcggagacgcgggagcgagcgcgggggctggacggctcgacggtctcggacatcatcttcacgtcgggtacgacgggccgcccgaagggcgcggtgatcacgcacgcgcagacgttgcgggcgtacgaggtgtggagcgacctggcgggcctgcgccggggtgaccgctacctgatcgcgaaccccttcttccacaccttcggctacaaggcgggagtgatcgcctgcttgatgcgaggcgcgacgatgatcccgcagccggtgttcaacgtggacacggtgctggcgaacatcgccgcggaacgggtctccgtactaccgggcccgcctaccctgcaccagtccctgctggaccatccggcccgggacgcgtacgacctgtcggcgctgcggctggtggtgaccggggcggcggtggtgccgttgcggctggtggagcggttgcggggggagttgggggtgggaaccgtgctcacggcgtacggcctctcggaggccagcggcatcgtcacgatgtgccgtcggggcgacgatccgtccgtgatcgcgtcgacgtcggggcgcgcgattcccggtacggaggtccgtgtggaggcgccgctcggctcccccggggaggtcctggtccgcggcttcaacgtgatgcggggctacttcgaggacgagcgggccacggcggcggcgctgacggaggacggctggctcaggacgggcgacgtgggcgtcctggacgcgtccggcaatctccggatcacggaccggatcaaggacatgttcatcgtcggcggcttcaacgcctaccccgccgagatagagcaactgctcggcctgcacccggatgtggcggacgtggcggtgatcggcgtaccggacgcacgcctcggcgaggtgggcaaggcgtacgtggtccgccgcccgggttccgtcctgacgggggacgacctgatcgcctggtcccggcgcgagatggcgaactacaaggtgccgcgggcggtggagttcgtgggggagctgccgcggaacgctggcgggaaggtggtgaagggggagttgcgggggcgg

SEQ ID NO: 3791 - DNA, 1146 bp, Streptomyces avermitilis
  CDS (1)..(1146)
atggccggactcaaggacgccaccgcgatcgtcggtatcggtcagacacccttcgccaagcacctccccgaggacgagcggaccttggcctgccgggccgtgctcgccgccctcgacgacgcgggaatcgccccgggcgaggtcgacgcccttgcctcctacacgatggaggagaccgacgaggtccagctggcgaaggcggtcgggttcggggacctgaccttcttcagcaaggtcgggtacggcggcggcggttcctgtgccaccgtcgcccatctcgccgccgccatcgccaccgggcaggccacggtcggcgtcgcctggcggtcgcgcaagcggggcagcgggccgcggccgtggaagaacaccagcgcccaactccccacccccgcccagtggacccgtcccttcggcctcctcagaccggccgacgagatcgggatgctgacccgccgctacatgcacgagtacggggcgacccgggaccacctcttcaatgtcgccctcgcctgccggaaccgcgccaaccagaacccggcggcgatcatgtacgaccgcccgctcacccgcgagatgtacatgacctcccggtggatcagtgagcccctctgcctcttcgacaactgcctggagacggacggggcgttggcgtgcgtggtcgtctccgccgcgcgggcgcgggactgtccgcaacggcccgcctacatccactccgccgcccagggcctgcccgcccagcaccacggcatggtcaactactggaacgacgatccgctcaccggccccgcctggacggccgcccggcacctgtggaagcacgccgacctctccccgcaggacgtggatgtcgcgcagatctacgacgcgttcaccccgctgataccgctgtccctggagggctacggcttctgcgggcggggggagggcggggccttcacggagggcggtgcgctggagatcggcggccggctgcccctgaacacggggggcgggggcctgtccgaggcgtatgtgcatgggttcaacctcatcaacgagggcgtgagacagctgcgggggacgagcaccgcccaggtcccgggcgccgccacctgcctggtcacggccggcgaaggcgtaccgacgtccgcacttctcctgaggagt

SEQ ID NO: 3792 - DNA, 414 bp, Streptomyces avermitilis
  CDS (1)..(414)
atgctcacaccggtcgtggacgacgacggcgcccccttctgggagtacgccgcccggggcgagctgagggtccaggcgtgcgccgactgcggcgagccgcgcttcccgccccgtccctgctgcccgcactgccggtccttcgcgagcgagtggcggctgatgagcgggaaggggcgcgtctggtcgtacgtcgtcccccacccgccgctcctgccggagtacgcggcgcaggccccgtacaacgtgatcgtcgtcgagctcgccgaagcaccccggatacgcctggtcggcaacctggtcagcgaggccgacgcgccgctcgacggtgtcgcgccggaacgcgtgcggatcggcgccagggtgcaggccgtcttcagcagcgccggactgccccagtgggtactggagcggcca

SEQ ID NO: 3793 - DNA, 786 bp, Streptomyces avermitilis
  CDS (1)..(786)
gtgggtactggagcggccatgaccctgcgcgtcgtcgcggacaaggacaccggcgtcgccgtcgtcaccctcgaccggcccgagcggctcaacgcgatcgatctggagacggccgccgaactcgccgccgtgtggagcgcgttgcggcgcgacgactcggtgcgggccgtcgtcctgaccggagccggcgggcgggcgttctgcaccggcatcgaccggggcgtcgacgttccgcagcccacctcgccctacatggccgacgatccgctcctcaccgtcgggcccaagtccaacgacctgtggaaacccgtcgtctgtgccgtgaacgggatggcctgcggcggcgccttctatctgctcggcgagagcgagttcgtcgtcgccgactcgaccgcgaccttcttcgacccgcatacgacgtacggcatggtcagcgcgtacgagtcggtcctcatggcgcagcggatgccgtacggggaggcggcgcggatggcgttgatggggacggcggagcggatctcggcgcggcgggcgtacgaggtggggctggtgtccgaggtgacggcacccggggaggcgttggcggctgcaacgcggtgcgcggccgtcatcgccggctgcccgaccgaggccgtacaggggaccgtgcgggcgctgtgggccgccaaggaggcggcccgtaccgcgggatacgcacaggcgccgcacctgatcgcgctcggaaatctgccgggtgagcgacaggcggagctgttcggggaacgaagccgcgagcacaggttgcgc

SEQ ID NO: 3794 - DNA, 999 bp, Streptomyces avermitilis
  CDS (1)..(999)
atggcacacccgtatgctcgaatcatggtcaaccatcgcatgatcgacgtgaacggcatccggctgcacatcgcggagcagggcgagggaccgctggtcgtgctgctgcacggcttccccgagtcctcgtactcatggcgccatcagttcgggccactggcggccgccggcttccgcgtggtcgccccggaccagcgcggatacgggcgcagcgaccgtcccgagagcgtggacgcgtacaccatcctgcacctcgtcggcgatgtgatcggcctgatccacgccctcggggaggagacggcgtacgtcgtcgggcacgactggggcgcgccggtggcctggcacaccgcgctgctgcggcccgatgtcgtgcgcggggtcgcggggctgagcgtgccgccgccgttccggggcgagcggccgccactggatgcgatggacgagatgttcgacggacagttctactggaactacttcgcccagccaggtgtcgccgacgccgagttcgggcgggacgcacgtggctcgctgcggaagttcctgtactcggcctccggtgacgccccgggcgcgggcagcggacggcagccgctggtcgcaccggggcggggcttcctcgacgggatgcccgaccccgaggtgctgccggggtggatcacggaggcggacctcgacgtgttcgcggaggagttcgcgcccggattcaccggggcgctcaactggtaccgcaatctcgaccgcaactgggagctgacggcggcctggcagggcgcggtcgtcagcccgccggcgctgtacatgtacggcgaccgggatgccgtccccgcgttccccggcacggccgaactgatcgagaagctccccgcgttgatgcccaacctgcgccgcgagccgctggtgctgccgggctgcggacactggacacagcaggagcgaccgaacgaggtgaacgcggcgctggtcgacttcctgaccgggctgcggggcgagcagaggatc

SEQ ID NO: 3795 - DNA, 597 bp, Streptomyces avermitilis
  CDS (1)..(597)
ttgcgctgttcgcgcaccccaatccagcgattttcaacgggggttgaaaacgtgcaacttcgtcatgtccgcgccatcgccgtcttcggtatcgccgtggtcgccctcaccggagcccggggctcccacggcggcggctgccacagcgacagcggcggttccggcagttcgtcctcgagcggcggcggatccaccggctccaccggcggcggcgcctacaaggacgacaacgactccacgacgaccggcggttcgagcggcagcggctccaccaccggctccaccaccggcggcggcaaggccaccgaccccgcgaaggacgtgaagatcgagacctgcgtgttcgacgacgcgcgcggcatcgtcgcccacgtcagcgccaccaactccagtgcgagcacgacgtacacgtacaagttcagcgtcaccttcaagggcccggacggctcggtcgtgcgcaccagcaactccaccatcccctacgtctccgcgaactccacggacacgctggacgtggcggcgtcttacgtccccgccgccgggcagagcgcgagcggcagcacctgcaagctgagcgctgtgacgcgtacggcggag

SEQ ID NO: 3796 - DNA, 645 bp, Streptomyces avermitilis
  CDS (1)..(645)
atgtacacacgggggcgtactctcaagttcgcagcggtattgaccatggtggttctcgcgctgaccgggttctccaggggacgcggtcacggcggccacggcggccacagcggtggtggcggttgcagcagctccagccagaaccacgacagttcgtcgtcatcgacatcgggtggcggctcgtacagctccggatcgacgacatcgggtgcggggagcgacgactcctacgacgattcctacggcgactcggacgacgactcttacagcagcggcagcagcagtagtggcagcagtggcggcagtacctacaaccgccgccccacccaccgttccaaccccacctcctccagcggcgacggcgatgacgaaccgctgaaggacggcacggcgagggtggtgagctgtgcgaccaagaaggcgccctacgcgaccgtcgaggtcaagaaccccaatgcacgtaagggcaccttctggatcacggtcaccttcaaggacaaggacggccttgagatagtcgaccactacgccgatgtccgggtgccggcgaaggggaaggcgaccgtcgacgtggaggtgggcggcgcgggtctcgtcgactacgtcgaccactgcgacgtcgatccggtcgccgaatcgtcgagc

SEQ ID NO: 3797 - DNA, 609 bp, Streptomyces avermitilis
  CDS (1)..(609)
atgatgtcgacggtactgtcaggccacccggcgtccggcgcacttcacgcggacgaccggccactcatcgtcgggctcgggggaacggcacgccgcggtttctcgtccgaggtctgcctgcgcacggcactcgaagcggccgagcaggccggcgcgcgcgtcgagctcttcagcgccgacgccctcgacctgccgatgtaccagcccgcgagcagccatcgcaccgagcgcgccgtcgcgctggtcgaagccgtcagggcgtgcgacgggctcatcctcgcttcgcccagctaccacggcaacctctcgggactcgtcaagaacgccctcgactacttcgaggacctgcgcgacgacgcgcggccctacctcgaagggcgcgccgtcggctgcatcacgtgcgcggccggctggcaggggacggtggccacgctcaccagcctgcgcgggatcgtccacgccctgcgcggctggccgaccccgctcggggtgacggtcaactccgcgacaccggtggtggtcgacggggcgatcgaggacgccgggcctcggcagcgcctgggcctgctcggcgagcaggtcgtcggcttcgctcacgcgcgccgcggc

SEQ ID NO: 3798 - DNA, 315 bp, Streptomyces avermitilis
  CDS (1)..(315)
gtgggcctgctcgaccgagtgcagtacgccagcgatccggaccgctacgagtaccgcctgacggccgccggccgggagttgttcggagcgatcgtggtgctcatgcgctggggcgacacccacctcgccgggccggagggcccgccgatcgtgctcacgcaccggacctgcggcgaggtcactcatccgaggctcacctgcgatgtgtgcggtgaggaaatcaccatccacagcgtcacgcccagccgcgggcccgggttcctggaagccgatcccgcgccgcccgaggacccggcacgctccgagaggaactca

SEQ ID NO: 3799 - DNA, 561 bp, Streptomyces avermitilis
  CDS (1)..(561)
gtggtgtccggcgccgccggagcggtcggcagcgtcgtcgggcagatcgcgaggatccacggctgccgggtcatcggcgtcgcgggcggacccgagaagtgccggacgatcgtcgacgagttcggctgcgacgtggcgatcgactacaagtccgagaaccttcgcgacgcgctgcgcaagcacgcgccggacggagtcgacgtgtacttcgacaacgtcggcggaaagactctggactcggtgctgacccgcctggcccgcggcgcccgcatcgtcatctgcggctcgatgtcccagtacaacgccacggagcggccgcccggtccggcgaactacatggccctgctggcggcgagggcgtcgatgacgggaatggtcgtcttcgactacgaggaccgctacccgcaggcgagcgccgagctggcccgatggctgaaggacggccgcctgcgctcgcgggagcacatcgtcgaaggcggcgtccgcgcgttcccggagaccctgctcaagctgttctcaggtgagaacaccggcaagctgatcctcgcgctcggcaacgga

SEQ ID NO: 3800 - DNA, 2346 bp, Streptomyces avermitilis
  CDS (1)..(2346)
gtggtggatcagctgacgcagcacgatccgcggcggatcgggccgttcgaggtgctgggacggctgggtgcgggcggcatggggctggtctatctcgcgcgctcggcctccggccgacgtgtggcgatcaagacggtcaggacggagctcgccgaggaccagctgttccgggtccgcttcacgcgtgaggtcgaggcggcccgcgcggtctccggcttctacacggcgaccgtggtcgacgccgacccgcgcgcggcggtgccgtggctggcgaccgcgtacgttcccgcgccctccctcgaggagatagtgaccgagtgcgggccgcttccggcccaggcggtgcgctggctggccgcgggcgtcgcggaggcgctccagtcgatccacggtgccggactcgtgcaccgcgacctcaagccgtcgaatgtgctggtggtcgaggacgggccgcgcgtcatcgacttcggtatcgcgtcgggcgtttcgaacacgcgtctgaccatgacgaacgtcgccgtcggcacgcccgcctacatgtcgcccgagcaggcgaaggactcgcgcagcgtcaccggcgcgagcgacgtcttctcgctcggctccatgctcgtcttcgccgccaccgggcacgcccccttccacggcgccaacccggtcgagacggtcttcatgctgctgcgggagggccccgacctcgaaggtcttcccgacgagctgcggcccctcatcgagtcctgcatgcagatggaggccaccggccgccccaaccccgccgacctccaggcccagctggccccccacctcttcggctccggttccgacgacagcggtacggcgtccgcgtggctgcccgagcgggcggtcggcctgatcgaggcccgccgcggcggccgtccggccatcaagccgccggccggcggaagccagggcggtgccggaggccgcagcggagcgcggcccgtcgtaccgcccccgccctcgcacgaccccgttccggtgggcgtcggcgcgcccgacgccggccccgtgcggctggccggtgccccggtgcccatcgggccgggaccgcgcgtcgccgacgcccgcgccgccgccgtcaaggcgcctcctcccgaggcgggcctcgccgcgtcctggtcccggccgcgccccggcgtcaacggcgccgagccggtccccgcggtcgccccgccggtcgctcccgcggagtccgcgtccggctggcgcccctggcgttttcgcatgtcgaacgatgtctggggcacgcccgccgtcgccgacgacctggtctacgtcacctccttcgaggtgcacgccctggacgtggcgaccggccgccgccggttcaagacgcgcgacgtcgcctggtcgatgtcggtcgcggacggccgggtccacgcctccgacgggccgacgctcttcgccctggacgcccgcgagggcgccgacctgtggcggctgtccacggacgcctgggtgtacgcgctgaaggccgaccggggaacggtggtcaccggcacgcgcggcggcggcgtacaggcctgggaggcagccaacgggcagaagctctgggagatcaccggggcccagcaggacttcgagtccccggaggccggccccgtcgtccacgacggcacggtgttcgtctggaaggacgcccggctgcgcgccctggaggcccgtaccggcgaggagcgctggtcgtacccgatcggtgacgcggcgtcctgcggcggcgtacccgtgcggctcaccccggcccccgacggatacgtgtacgtgtccgccggcacccgggtcctggccgtcgacatcgcgggcggccatgtccgctggcacttcgaggcaccggcggtgttcctgtccccgcccacgttcgtgccgggccccgcggtggcgggcggcggcatctacctcgccgactacctcggcacggtgtacgccctggacgcgaccgacgggcgtgaccgctggcgcatcgccacggagtcgcgcgcctcgctcgaccccgtcctggtcgccgccggtcacgtccacgtcggcagcggcaagggcctctacaccctggacgccgtcacgggcaccccgaagtggcgcttccaggcgggcggcgacatcgtgggcgcccccgcggtcgccgagggccgtatccacttcggctccacggaccacctcctgtacacgctgaaggcggacgacggccggctgcgctggaagctggcgacgggcggcgagatcaccggcgccccggtggtcaaggacggcgtggtgtacgcgtgcagcaaggaccgctgcgtgtacgcactggacgcggagaaggggacggggacggcgcggaccgcc

SEQ ID NO: 3801 - DNA, 792 bp, Streptomyces avermitilis
  CDS (1)..(792)
atggccgaaaccccgccatccaccgcgtccgaccggaacggtgccgccttccccgagggcgtcccctgctgggtcgacgcccagctgcccgacgtcgaggcgggcaagcgcttctacggtgagctcttcgggtggaccttcgagccggcggccggggcggaacacggcccggcggacggcccggcacccggctcctccgtgtgggcgtacctggacggcgcccccgtcgccgcactcgcgcccaaggcggacggccggatgcccaccgtctggaccgtgtacttcgcgacgcccgacgccgctgccctcgtgggccgcatccgcacggccggcggccaggtgatcaacccgccgaccccgctggcccccttcggcaccttcgccctggccgccgacccggaggacgccgtcttcggtctctggcaggccggtgcgcaccccggattcggccgccgtcacgagcccggctccttcggctggaccgagttgtacgcccgcgacaccgccgccgccgactccttctacgccgacctcttccacgacgccctcttcgggcccggcgcccgccccgatttcggccgtgcttccgtcaccgacgtctttccggccgagatgccgccccacttcctcgtccacttcggtgtccgggagggtgacgacgccttggaggacgccatccgggcggtgaaccggctcggcgggcgcgtacaggtgccgtccttcgacgcgtcgtacggacgtgtggccgtggtcacggacaatcaaggggcgtcgttcgcactgctccagcgg

SEQ ID NO: 3802 - DNA, 633 bp, Streptomyces avermitilis
  CDS (1)..(633)
gtgcgtaccgtcgacggccgtgtggcgggtcggcgtgggcaggcgacccggcagaagctgctcgactgcctcagcgagatgctcagctcatcgccctaccgggacgtcaaagtcattgatgtcgcccggaaggcgggcacttcacccgcgaccttctaccagtacttcccggacgtcgaaggcgccgtcctggagatcgccgagcaaatggccgcggaaggcgccgggttgaccgagctgctcgaagggcgctcatgggtcggcaaggccggctggcagacatcacaggaactcgtcgacggattcctggagttctggcgcaagaacgacgcgatcctcagggtcgtcgatctgggtgccgccgagggcgacaaacgcttctacaagatccgcatgaagattctcaactcggtgaacaactccctttcggactccatcgccgaactccagtccaagggcaggatcgacaaggacgtgaacccggcggcgatcgccggttcactggtcgcgatgctcgcggcggtcgcctcgcaccagaagggcttccagagctggggcgtcaagcaggccgaactcaagccgaacctcgccctgttggtgcacctcggcgtcacgggcaagaagccgacgaag

SEQ ID NO: 3803 - DNA, 735 bp, Streptomyces avermitilis
  CDS (1)..(735)
atgacgatcaccgacaagaaccgcctcaccggggaagccgacccgcgccgtacgtcgctctacgggcctccgtccatggacgccctcaccgagcgggccctgcacctggcccgggccgggcgggcactgctcggcatcgtcggagaaccgggcgccggcaagtccacgttcgccgagcagctgcgggcgcggctggagaaagagcggccgggactggccgtgaccgtgtccatggacggattccacctcgcccagaaggtcatcgaggcccgggggcaggcggccgacaagggcacgatcgacaccttcgacgccgacggcttcgtcgccctcctgcgccgtacgcgtgccgagaccggagacaccgaaaacaccgaaagcaccgtctggtggccggagttcgaccgcgacctcgaggaccccgtggccgggtcgatcgaggtcgcgccgcaccaccggctggtcatcgtcgacggcaacttcctgctgtccgcgcaggagccctggcggcaggtgaagggcctgctggacgagacctggttcctggacgccctcccggagccgaggcgcgagcggctcacccgccgctacatcagctacggcttcaccccggaggccgcgcgcgcgaagaccctgggagtcgacgaggacaccagtgccctcatccgcagcaccgtctcacgggccgatctcgtcatcggcgaggccagggagagcggcggggtcagcgactgc

SEQ ID NO: 3804 - DNA, 471 bp, Streptomyces avermitilis
  CDS (1)..(471)
atgcccccaggcctgcggctgttgcacaggatgtcctcgtcccccgccttcgccagatacgcgccgcgcatcatccccgccgtggacctcaccgtgcaccggctgacccgggggagggtgcagctcagcgcgcagatgctgcccggccttgtcctcacggtccgcggcgcgaggagcggactgccgcgtcgtacgccgctggcgtgcatgccgcaggagcccgacgcctggttcgtggtcggctccaacttcggtcgtccggcccatccggcgtggacggcgaacctgctggcccaccccgaagaggcccggatcagctggcgcgggcgagacattccggtgacggcacgcctgctggagggggcggagcgggcggaggcgtggaagcggctgctcacgttctggccgccgtacgcgacgtatcaggcgcgcatcacccgcgagatccgggtcttccgcctcagcagtcgc

SEQ ID NO: 3805 - DNA, 1239 bp, Streptomyces avermitilis
  CDS (1)..(1239)
atggacgcccgtttcaccgccgaacaggacgagatccgccgcacggtgagggagttgctgctcaaacgctggggcccggaggaggtccgggcggcggtgggggccggcgccgggtacgaccccgcactgtggtccgccctcgccgaacagctcggcctgcccggcctcgccctccccgaggcctacggcggtgtcgggtgcgccgtcaccgaagtcgccctcgcctgcgaggagtcggggcgggcgctggccccctcgccgctgctcgccaccgccgtcctcgccgccccgctcctcctcgccctcggtaccgagacgcagcgcgccgaactgctgccccggatcgcggcgggcgcgctgaccgcggccctcgccgtgccgggcacggcactctccctcgccctcgggctcgtcggcgacaaccgggggaactgggccggtggcggacgtgcgggaggagtgcaggcgcggcgcgccgaggacgggtggcggctgtacgggcaggtggagcaggtgctggacgggcacagcgccgggctgctcgtggtggccgcgcacgccggggggttcgcccgcccgaggaccctgctgttcctcgtgcgggagggggccgcgggcctggtgcgcgcacggcagacctccctggacgtgagccggccgcaggcgcgggtccaactgcgggacgtgccagccgagttgctcggcgacgagcacgtcgatgtggccgacgcgctcatggcgacgggcgacgcggccgccgccgtactcgccacggaggccgcgggagccgccgaccgggccctggaacggaccgtcgaccatgtgcggcagcgggagcagttcgggcgggcgatcggctccttccaggcggtgaagcaccggctcgcggacgtgtacgtgcaggtgcaggcggcgaggtcggccgcgtactacgccgcgtgggcggccgggaccggccccgagcgggccggacaggtgggacaggtgggacggaccgagcggaccgagcgggtcggtgggctcgccctcgcccaggccctggaagcgctgcggaccgccgcggccgagggcatccagctgcacggcggcatcgggttcacctgggagcacgaggcgcatctgtacttcaagcgggcgacgggggacgagctgctgttcggcccggtgcaccggctacgggcatacgcggccgagcgctcgggcatcttctccctggccggatccgaggaggtggccgtc

SEQ ID NO: 3806 - DNA, 1167 bp, Streptomyces avermitilis
  CDS (1)..(1167)
atgactccggggaagcgcaaggtcgccgtcgtgggtgtctccctctcggactgcggtcgcgtggacgacgcgacgccctacgccctgcacgcccaggccgccaggcgcgcgctggcggacgcggggatggaccgctcgctggtcgacgggttcgcgtcggccggcctcggcaccctgccaccggtcgaggtggccgagtacctgggcctgcgccccacctgggtcgactccaccgccgtcggcggcgccacctgggaggtcatggcggcgcacgcgacggacgcgatcgcggcgggtcacgcgaacgcggtcctgctggtctacggttccacggcccgcgcggacatcagggcgggccggcgtaccgggaccctctccttcggcgcccggggtcccctccagttcgaggtcccctacggccacacgctcatcgccaagtacgcgatggccgcgcgccgccacatgcacgcgtacggcacgacactcgaacagctcgcctcggtggccgtccaggcgcgggcgaacgcggcgctgaacccggaggcgatgttccgcgacccgatcacggtggacgacgtcctgtccggcccgatgatcgccgaccccttcaccaagctgcactgctgcatccgctccgacggcggcgcggcggtcctgctggcggccgaggagtacgtacgggactgccgtacgccaccggtgtgggtgctcggcacgggcgagcacgtctcgcacacgacgatgtccgagtggccggacttcaccgtctcccctgcggcggtgagcggacgcctcgccttcggccgggcggggattcggccggaggagatcgatgtggccgagatctacgacgccttcacctacatgaccctcgtgaccctggaggatctcggtttctgcgagaagggcgagggcggggcgttcgtggagaaggggcggctgctggtgcggggcggggaactgccggtgaacacggacgggggcggcctttcggcccagcaccccgggatgcgcggactgtttctgctggtggaggcggtgcggcagctgcgcggcgaggcggcgggccgtcaggcgcggcgcccggacggcgagctgccatgcctggcggtcgcgtccggcaccggcggctggttctgctcgtcggggacggtggtgctggggcgg

SEQ ID NO: 3807 - DNA, 1185 bp, Streptomyces avermitilis
  CDS (1)..(1185)
atgccgttccatctgcaggccgaggacgtcaaggcgaccagccgctacggcacgcaggatcaccggctgaccgtcgacgtgcgcgggtccgagggcgtcgtacggctgaaggcggtcggcctgcgcaagagcgggacccggtgcgtcaacgacaccgtgcgtgccgtctgcgacgtcagcggtgcctacaacagctggtcggacctggaccgcgtccacccggtcgccgccgagggcagcaaacccggcgacaccggcatcgtgcgtttcaccttcaccacgaagggcgggaagacgctcaccacccgcacccgggtcgtggtcggcgaacccgaggtgaaggtgcgcactctcaaggtcatcaaggacgtgcgccccggcgccgacgtgaccgtaccggtcgtcgtccgcaatgacggcgaggtgccggtgcaggggctcgccctcgaactcggttccggggagctggacttccggcagcggtacgccaactgccgttacccgcctcagcgtcacggccacacggccgtctgccggtttcccggcctgcgtgtcccgccgggcgggaccgtcgtcctgcacccggccctgcgcctgcgcgcgtcgacgaagcggatgtacggctccttcagccaggaggcctggccgctggactcggggcccggacagtacaccgtggtgccgccgggtggcgaccacggtgacggtccgcccctgaccgccgaggccttgcagggcgccgacgacaccgacggcacgttcgccgagggagacgtctccaccgacgtgcgtctggacacccacgccgactacgaggtcttcggcgtcgaactgcggggcagccccggcacgaagcgctcgctgcggctcaaggtccgcaacaacgggcccggcatccccggcgccggtacgaagctgctgttcacgccgccgcccggcaccgtgctggaagaacccatggaggccatcgacgaggacgcgtacgagccgtactgcgactccgacggccccgcgtacagctgcctcgtgggccaactcgaccccggcgagacccgtgacttcgagttcaccctgagcctcgacgggccggggcagggcagcgcggccctccaggacacccagccgtccaccggccgccgcgacccgaacccggccaacgacaccgctcctgtcaccgttctgccg

SEQ ID NO: 3808 - DNA, 654 bp, Streptomyces avermitilis
  CDS (1)..(654)
atgggaacggatcttcacgagctgctcaggtcactgcgggtgtgggacgtagagctaccctccttcgacccggcatccgcacccgccgaaccactcccgctgttcgtggagtggttcgcggaggcggtcgcggcgggccagaccgagccgcacacgatgacgctcgcgacgtcggacgaggacggcctgcccgacgtccgcatcgtgatgctgcacggcgcggacgcggacggctgggccttcgcgacccatgccaccagccgcaagggccgccagctggccgcccgcccgtacgcggctctgagtttctactggcccactcagggccgtcagatccggctgcggggcccggtcgaggtcgccccggcccaggaggggcaggcggatctgcacgcccgctccacgggggcgctggccgccgcgctcgtcggcaggcagagtgaagtgctcggttcgatggaggagctggggcgggcctcggacggcgcctgggaccgcgctcagagcgaccccgacgcccctgccccgacctggaccctctaccgcctccggccggaagaggtggagttcttccagggagacgcgaggcgtcggcacgtacggctcgtctaccgacgcacggaggagggctggctcaaggaactgctgtggccg

SEQ ID NO: 3809 - DNA, 405 bp, Streptomyces avermitilis
  CDS (1)..(405)
gtgagcgggcggcggttcgacgagccggagaccgacgcgttcacccgcccgtactgggacgccgccgccgagggcgtcctgctgctccgccgctgcgccggctgcggccgcacccaccactaccctcgcgagttctgcccgcactgctggagcgacgacgtcacctgggagcgtgcgagcggccgcgccacgctctacacctggtccgtcgtccaccgcaacgacctgccccccttcggggagcgcaccccgtacgtcgccgctgtcgtcgacctcgccgaggggccgcggatgatgaccgaggtggtggagtgcgcggcggccgagctacgggtgggcatggaactggaggcggcgttccggccggcgggggaggtcacggtgccggtgttccggccccggggg

SEQ ID NO: 3810 - DNA, 411 bp, Streptomyces avermitilis
  CDS (1)..(411)
gtgctgcgtatcgggctcgggctgtggtggctggagagttggcggcacaaggacaagaaggcgtggttcgagcgcgggaccgggatcgcgtgggcggcggacgtcgcggccaagcaccggtggagcgtcgtacgcggcggcttcgacgcggtggtcgcgccccggccgcgcacgatggcgtacgtcgtcgtgtacgcagagctcgccctcgggctggggctgatcgtcggcctgctgacgccgctcgcgctggtcggcggcctgctgctcaatctcttctacctcgtcctcatgatccacgactgggcggagcaggggcagaactcgatgatggcgctgatctcggtcgtcgggctgttcgggatgtcgtggcagacgtggtcgctggacagcgcgttcgggctgttccag

SEQ ID NO: 3811 - DNA, 1203 bp, Streptomyces avermitilis
  CDS (1)..(1203)
atggccgactcgactgctacttcgacgccccgtgcggtgccgtcccacgaggaccgccccgtctacgtcatcggcggcggaccgggcggcctcgccgcggcgcacgcactgcgcgcccagggcgtacgggccgtcgtactggagaagtccgaccgcgtcggcgcgtcctggcgccgccactacgaccggctgcacctgcacaccacccggcgcctgtcggccctgcccggcctgcccatgccgcgctccttcgggcgctgggtgtcgcgggacaacgtggtgcgctacctggagaagtacgtcgaacaccaccagctggagatcgtgacgggggtcgaggtctcgcgcgtcgaacccgcgcccgacggcaccggctggctgctgcacgccaccggcggccgtgaactcaccggcagcgcggtcgtcgtcgccaccggccacaaccacaccccgcacctgcccgactggcccggccgcgacgcctacaccggcgagctgctgcacgccggcgactaccgcaacgccacgccccacgccggccgtgacgtccttgtcgtcggcgtcggcaacaccggcgccgagatcgccgtcgatctggtggagggcggcgcctcgcgggtgcggctcgcggtgcgcacggcgccgcacatcgtgcgccggtcgaccgcgggctgggcggcccagttcacggggatcgtcgtacgacggctgccggtgcgtctcgtcgacctcctcgccgggccgatggccaggctcagcgtgccggacctgtcggcccaggggctgccgcgccctgacaccggtctgtactcccgcgtgcgcgaggggtcgatccccgtgcaggacgtcgggctcatcgacgccgtgcgcaaggggcgggtcgagatcgtcgccgccgtcgacgggttcgaggacgggaaggtcgtcctcgccgacggcaaccgcatcggtccggacgtcgtcatcgccgcgaccggttacgcccgcgccctggaggacctcgtcggccacctcgacgtcctcgacggccgcggccgcccgaccgtccacggcgcccgcaccccacgcacggcccccggcctgtacttcaccgggttcaccaaccccatcagcggcatgttccgcgaactcgcgatcgacgcggagaagatcgcgaaggcggtcgccaaggcgctcgcgaggacgaccgcaagaacgcccgcg

SEQ ID NO: 3812 - DNA, 2139 bp, Streptomyces avermitilis
  CDS (1)..(2139)
gtgcacggcaggcccgccgaggccgacgacctggatgtcagcggccgcccgctgtacgccggcgtgcccgacctcgaccgcttcttccgccccgggtccgtcgccgtgatcggcgcctcggacaccgagggccggccgaacaccggcatcacccggcagctgctcacctgggccgaacgggtcggcgcccggctgcacccggtgcaccccacccgtcagtccgtcttcggcatcccctgctccccttccgtcgcggacctgcccgaaccggtcgatctggccgtgctgctggtcgccgacccccttcccgtgatcgagcaactcgccggtgccaaggtgaagttcgccgtcgccttcgcctccgggttcgccgagaccggcgaggcgggcgccgccgcacaggcccggctcgccgccgccgtgggacgctccgggctgcggctgctcggcccgaacaccaacctcaacgccttcgaggagttccgcgaggacctggacggaccggcgatcgcgctgatcacccaatccggacaccagggccgcccggtcttcacgatgcaggagctgggcgtccgactctcacactgggcgcccaccggcaacgaggccgacctggagaccgccgacttcatctcctacttctccgaacggcccgaggtgggcgccatcgcctgctacatcgaggggctgaaggacggccgctcctttctgctcgccgccgaccgggccgcccggcgcggcgtgccggtggtcgcggtcaaggtcggccgcaccgagaccggcgcccggacggccgcctcccacaccggcaagctgaccggcgcggacgcggtggtggacgcggcgatgcggcagtacggcgtgatccgcgtcgacgggctcgacgaactccaggacaccgccgccctgttggcgcgggcccgcgcaccgcaggccgacggggtcgtcgtctatgcgatctcgggcggcacgggcgcgcacttcgcggacctggcgagcgaggccgggctgcgcctgcccgtgctgtcggacgccaagcaggccgagctgcacgagtggataccggagtacctgaacgtcaccaaccccgtcgacaacggcgggcacccggtcggcgactggcgcggccggaagatcatcgacgcgatcctcgccgacccggccgtcggggtgctgatctgccccatcaccgggcccttcccgccgatgagcgacaagctcgcgcaggatctggtggacgcggcggaggcgacggacaagctggtgtgcgtggtgtgggggtcgccggtcggcaccgaggccgcgtaccgcgagacgctcctcggctcgtcgcgggtcgccaccttccgtaccttcgcgaactgcatcaccgccgtccgcgcccatctcgaccacgcgcggttcaccgcctcgtaccgctcgcccttcgacgaggcgccgcgcaccccctcgccctccttccgcaaggcccaggccctgatgcgcccggggcagcagctgagcgagcacgcggcgaaacagctgctgcgcgcctacggcatccgcgtgccgcgcgagcagttggtgaccagcgcggcggcggccgtgcgggcggcctcgcaggtcggctacccggtcgtcatgaaggcgtccggcgcgcagatcgcccacaagaccgaactcggcctggtgaagatcggactgacctccgccagccaggtcagggacgcctaccgcgagctgaccgacatcgcgcgctacgaggggatctcgctcgacggggtgctggtgtgccagatggtggagcggggcgtcgagctggtcgtgggcgtcacgcacgaccagctcttcggaccgacggtgaccgtcgggctcggcggggtgctcgtcgaggtgctgcgggacgtcgccgtgcgcgtgccgccgttcggcgaggaccaggcgcgggccatgctcggcgagctgcgcggacgggccctgctggacggggtgcgcggcgggccgcccgtggatgtggacgcgctggtggaggtcgtcatccgggtgcagcggatggccctcgaactcggggacgacctcgcggagctggacatcaatccgctcatggtgctgccgcgggggcagggagcggtggcactggacgcgctggcggtgtgccgc

SEQ ID NO: 3813 - DNA, 837 bp, Streptomyces avermitilis
  CDS (1)..(837)
atgacagcctcccccgaggaatccgttgattcagtcgatccagtcgatccagtcgattcattggtactgcacgccactgacaatcacgtctcgcggatcaccctcaaccggcccgacgccctcaacgccatcacccctgaccagcgtgaacgcctcatccgactcctcggcgacgcctccgccgacccggccgtacgagccgtcgtcatcacggggacgggccgcggtttctgcgcgggcgcggacctgcgcggcgggccaccggccggggagcggaccgcgggggacgtggcccgcgtgatccgctccggcgcgcagcgcctgatctgcgccgtactcgactgcgagaagccggtgatcgccgccgtgaacggcacggcagccggcatcggcgcgcacctcgccttcgcctgcgacctcgtactggccgcggattcggccaggttcatcgaggtgttcgtacgccgcggcctcgtccccgacggcggcggcgcctatctcctcccccggctgatcggtccgcagcgcgccaaggagctgatgttcttcggcgacgcgctgacggcggcggacgcgggacggctcgggctcgtcaaccgtgtcgtaccggcggacgacctggagaagacggcacgcgagtggtccgcgcgcctggccgccggccccacccgcgccctcgcgctcaccaaacagctggtcaacgcctccctcgacaccgaccgcggcagcgccttcgccgccgaggcggccgcacaggagatcaacatgacgacggcggacgcggccgagggcgtgacgagtttcgtggagcgccgaagtcctcgcttcgaagggcgc

SEQ ID NO: 3814 - DNA, 597 bp, Streptomyces avermitilis
  CDS (1)..(597)
gtgatgggacacgcagggatggcggcagccgccgtccgttacctcaggtcggccggggcccccaccgtcgcggagcccgtcgggacgccgccccgcccccagctgcgggcggtccgggacgacgagcgggcgccgctcgacccgaccgagttccggcgcgtcctcggcaccttcgcgaccggcgtcacggtgatcacggcacccggggagcagggcccggcgggcttcgcctgccagtccttctcgtccctctccctggacccgccgctggtcgcgttcatggtcggccggacgtcgacgacctggccccggatcgcccgcgcgggcgtgttctgcgtgaacgtactgggagcccaccaggccgatctgtgccgcggcttcgcggtgagcggcgcggacaagttcgccggggtcgggtacgacgcggcgcccttctccggttccccgcggctgagcggctccctcgcctggatcgactgcgcggtccacgcggtccacctgggcggcgaccatctgatcgtggtgggcagggtccagtccctggggacgagcgacacccatcaggagccgctcctcttccaccgcggccggttcctc

SEQ ID NO: 3815 - DNA, 1308 bp, Streptomyces avermitilis
  CDS (1)..(1308)
gtgacccagacaacggacgccatcgccgcttcgcaggagccccccgccccacgacgaacccgtatccaccgcgcctggttcgtcgcggccgtcacctttgtgacgatcatcggcgcggctgccttccgttcgctgccggggctgctgatcgacccgctgcaccaggagttccactggtcgcgcggcacgatcagcgcggcggtctcgatcaacctcgcgctgtacgggctcacggcgcccttcgcggccgcgctgatggaccgcttcggcatccggcgcgtggtcgcggtcgccctggtcgtgatcgcgggcggctcgggcctgacggtgtggatgacggcggcctggcaactgcttctgtgctggggtctgttggtggggctgggctccggctcgatggccctcgccttcgcggcgacggtcacgaaccgctggttcaccgagcgcaagggcctggtgacgggcatcctgacggcggcctctgcgtcgggccagctgatcttcctcccgctcctgtcctggatcgtcaccgagcacgactggcgtccggccgcggtgacggtctccctcgcggccctcgcggtcgtccccttcgtctggctgctgctgcgggaccacccggcggacgtgggcgtgaagccgtacggggcgacggagttcgtggagaagcccgcgccgatgccgggggccgcccggcgcgcggtgaccgtcctgctctccgcggtccgcaccggacccttctggctgctggccgggtccttcgcgatctgcggcgcctcgacgaacggcctgatccagacgcacttcgtgcccgcggcccacgaccaccacatgccgatcacggcggcggcctcgctgctcgcggtcatcggcgtgttcgacgtggtcggcacgatcgcctccggctggttcaccgaccgcttcgagccgcgccgtctgctggcggtctactacgcgctgcgcggcatctccctcctcttcctccccatgctcctgcaccccaccgtgcaccctccgatgatcttcttcatcgtcttctacggcctcgactgggtcgccacggtcccgcccaccctggccctgtgccgtgagcagtacggcgaggacagcgccatcgtcttcggctgggtcctcgcctcccaccaggtcggcgccgccctcgtcgccttcctcggcggcctcgcccgggacctgctcggctcgtacgacgtggtctggtacgcgtccggcgccctgtgcgcggcggcggccctgatggccctggtgatcaggcggcggccggtgcggggggtggtggctgcggcggcc

SEQ ID NO: 3816 - DNA, 1011 bp, Streptomyces avermitilis
  CDS (1)..(1011)
atggccgatccgaaggcatccccgctgcaccgcgtcgtcgtcctcgccctcgacgggctgatccccttcgagctgggcatcccgcagcgcatcttcggcaaggcgcgggacgcggacgggcggccgctgtacgaggtcgtcacctgctcggtgcggccgccgggcccggtcgacacggacgccgacttcgccgtcctcgtcgcgcacggccccgagaccctggccaccgccgacaccgtcgtcgtccccgcctcctacgaactcggacccgtccacgaggaaggcgtactgacccccgaactcgccgccgccctcgcccacatccgccccggcacccggctcgtctccatctgcaccggcgggtacgtcctcgccgccgccggctacctcgacggccgcccggccaccacgcactggtaccacgccgaacacttccaggggctcttcccgaagatccgggtcgacgccgatgtgctcttcgtggacgacggcgacgtcctgacctcggccggcgtcgcgtccggcatcgacctgtgcctgcatctcgtacgccgcgaccacggcgccgccgtcgccaacgaggtggcccgccgtaccgtcgtacccccgcaccgcgacggcgggcaggcgcagtacatccggcgtcccgtgcccgagccgcaggtcgcgacgacgaccgccgcccgcgcctgggcgctcggccggctgcacgaaccgatccagctgcgcgacatggccgagcaggaggccatgtcggtccgcaccttcacgcgccgcttccgtgaggaggtcggcgtcagccccgggcagtggctcacccagcagcgcgtcgaacacgcccgccacctgctggagtccagcgacctctccatcgaccaggtggcccgcgacgccggcttcggcacggcccagtcgatgcgccagcacctccaggccgcgctcggggtcaccccgaccgcgtaccggcgtacgttccgaacggggagcggcaccagccccgccggcctcgcc

SEQ ID NO: 3817 - DNA, 1047 bp, Streptomyces avermitilis
  CDS (1)..(1047)
atgcgcggagtggtcttcgacggaaagcagacccaggtcgtggacgatctggagatacgggagccgggacccggcgaggtggcggtggcgatctccgcggccgggctctgccacagcgatctgtccgtggtggacgggaccataccgttcccggttcctgtggtgctgggccatgagggcgcgggggtggtggaggccgtgggcagtggcgtcacccatgtccggcccggagaccatgtggcgctgtccacgctcgcgaactgcggtgcgtgcgcggagtgcgaccgggggcggccgacgatgtgccgcaaggcgatcgggcggccgcagcagccgttcgcgcgcggcggccggccgctgtaccagttcgcggccaactcggccttcgcggaacggaccgtggtgaaggcggtgcaggccgtccggatcccgaaggacattcccctgccctccgcggcgctgatcggctgcggggtgctgacgggcgtgggcgccgtgctcaaccgcgcgcgcgtggagcacggcgacagcgtgctggtcatcggcacgggcgggatcggcctcaatgtcctccagggcgcgcggatcgcgggtgccctgacgatcgtcgcggtggacgcgaacccggcgaaggaggcggtggcccgccagttcggcgcgacgcacttcctgacctcgacggagggggtgagggacatcctgcccacgggcgcggaccacgccttcgagtgcgtgggccgggccgcactcatccgtcaggccgtcgacctgctggaccgccacggccaggcggtgctcctcggcgtaccgcccgcgacggccgaggcgtccttcctcgtctcctcgctgttcctggacaagtcgatcctcggctgccgctacgggtcctcgcggccgcagcgggacatcgcgctctacgcggacctctaccgggagggccggctgctgctggacgagttggtcacggcgacgtaccccgtggaggacttcgagaaggcggcggccgacgcgcatgaggggagggtggcgcgggcggtgctgacgttc

SEQ ID NO: 3818 - DNA, 1149 bp, Streptomyces avermitilis
  CDS (1)..(1149)
gtggagttcggattcgacgccgaggacgaggtcttccgtaccgaggtgcgtggctggctgtcggcgcagctcaccggtgacatgggccggcgcgactgggaacggcggctcggcggtgccggctggatcgggctcggctggcccgaggacggctacggcaaccgtcgcgtgagcctgacgcggcaggtcgtctgggccgaggagtacgcccgttcgggcgcccccgcccgctccggtcacatcggcgagaacctcctcgcgcccaccctcatcgcccacggcacccccgagcagaaggaccgcttcctgcccccggtggcccgcggcgaggaactctggtgccagggctacagcgaacccggcgcgggctcggacctggccggcgtgcgcaccgcggccgcacgggacggggacgcgtaccgtgtgaccggccagaagatctggacctccctcgcccacgaggccgactggtgcttcgtcctcgcccgcaccgaacccggctcgcgccgtcaccacgggctgaccttcctcctcgtgccgatggatcagccaggccgtatcgaggtccggccgattcgccagctgaccggcaccagcgagttcaacgaggtcttcttcgacggcgcggtggcgcgggccgcgcatgtcgtcggcggcgagggcaacggctggcgcgtcgccatgggcctgctcggcttcgagcggggcgtgtcgacgctcgcccagcagatcggcttcgccgcggaactggggcgcgtggtgcgcacggcggtggcgaacggcgccgcggacgaccccgtcgtacgcgaccggctcgtacggcagtgggcgctgctgcgcacgatgcgctggaacgcgctgcgcaccctcggcaacgcggcggatgccggcgcccccagcgtggccaagctgctgtggggccgctggcatcagcagctgggcgaactcgccatgcaggtgcggggcgcggcgggggcggtcggtccggcggactggtcgccgtcggcaccgtacgaactggacgcgtaccagcagctgttcctcttcagcagggccgacaccatctacggcggctcggacgagatccagcgcaccatcatcgccgagcgcgtgctcggcctgccgaaggaacccaggggacccgaggga

SEQ ID NO: 3819 - DNA, 903 bp, Streptomyces avermitilis
  CDS (1)..(903)
gtggggaacttcttggcaggcaaggtcgtcgccgtgaccggcgcgggccggggaatcggacgggcggtggcgctggccgcggcggccggcggggcgcgcgtcgtcgtcaacgaccacggggtgtccgtcgagggcgccgagccgacgagcgccgtcgccgaaggcgtggccaaggagatcgtggcggcgggcggcgaggcggtcgcggtggccgacgacatctcgacgatggcgggcggacagcgggtggtggacgccgcggtgacgtcgtacggccgtatcgacggtgtggtgtgcgtggcgggcatcctgcgcgaacggatgctgttcaacatgaccgaggaggagtgggacccggtcgtcgccacccatctgaagggcacgttcaccgtcttccgcgcggcctcggcggtgatgcgccggcagggctcgggcacgctcatcggcttcaccagcggcaaccaccagggctcggtctcccaggccaactacagcgccgcgaagggcgggatcatctcgctggtgcgcagcgccgcgctcggcctgcacaagtacggggtgaccgccaacgccgtcgcccccgtggcccgtacgcgcatgtcggcgaaggtaccgatggagctgaaggagatcggcgaaccggaggacgtcgccgcgctggtggtgtacctgctctcggagcgggcgcggcaggagcggatcaccgggcaggtctacacgatcgccggtcccaagatcgccgtctgggcccagccgcgcgagctgcgcgccgggtacgcggagggctcctggacgccggagaagatcgcggactttctgcccgggacggtcgggacggatccgatgccgctgctccagcaggtggaggcgatggcgcgggcggccgcgaaacgctccgccggg

SEQ ID NO: 3820 - DNA, 933 bp, Streptomyces avermitilis
  CDS (1)..(933)
atgtcacggccggcacttcatcccgcgttccacgacatcgccaaacgcgtgaacaactgggggcgttggggcgccgacgacgagatcggcaccctgaacctgatcaccgacgaggtggtacgggaggccgcggccaccgtccgcaccgggcgccgcgtccccctcgccctcccgctccgcgaggacggcgtccagaccggtctgattccggggcgggtcaatccactgcatgtgatggtgcagatcaaccaggagatcttcggtcccggcacggtcgcgtgcagcgacgacgccgtgaccatgggactccaggcggccacccactgggacgcgctcacccatgtctcgcactccgggaagatctacaacggccgcccggcggacaccatcaccccgcacggcggcgccgagttcagcgggatcgacaagccgcggcacatcgtctcgcgcggggtgctgctcgacgtggcacgcgcgcgtggcgtggaccggctggcgggcggacacgccgtcaccccggaggacctggacgccgccgaggaactcgccgggacgcgcgtacggcccggcgacatcgcgctcgtgcggaccgggcagatccagacgtacctcgcgggcgccaaggacgcgtacggatatccgtcgccggggctgtccgtgcgcactccggagtggttccacgcacgcgatgtggccgccgtcgcgaacgacacgctcacctttgagatatttccgcccgagatcgatgatttgtggctgcccgtacacgcgctcgatctggtcgaaatggggatgttgcagggtcagaactggaatctcgaagagttgtccacagcctgtggacaagaagagcgttactgcttcctgctgtcggcgatgcccgaaccgttcgtcggcggcacggggaccccggtggcaccggtcgcgatcctg

SEQ ID NO: 3821 - DNA, 531 bp, Streptomyces avermitilis
  CDS (1)..(531)
gtgcaggtgcttcaagtgcagctggagatccggcccgaccccgcagaggtggggcgggcccgcagatgggctcgttcgcggctcgtcgggtccgggatagaggccgacgagccgctgtcggagacgctgatcctgctggtctccgaactggtcaccaacgccgtggtgcacaccggctgcccggccgtgctgcggctgctgctgacgggcgtgcgcgacgactcctccggggccccgtcgggcacggtccgcctggaggtggccgacttgagcgcctgcccgccggccccccggcatgcggagggtgacgagacgggcggccgcggcctggaactggtcgacggcctcgccgaccgctggggctggacccccgagggcgcgggcaagcgcatctggtgcgagctggaccgctgcgctgcggcgacggagggcgcggccgtgtcctacagcggggacgcgtcgtgcggtgtggacgcgtcgtgcgccggggaagtggcgacgtcgtacaagggtttcgcctacgaggccgtg

SEQ ID NO: 3822 - DNA, 870 bp, Streptomyces avermitilis
  CDS (1)..(870)
gtgcggttccaactcaccgaggatcagaaggcgttgcgggacggggtgcgcgggctgctggcggggcgcttcggccgtgcggcgctgcgggccgccgtcgaggcgccggggctcgaccggacgctgtggcgggagctgggcgcggcggggttcttcgcgctgcggctgccggaggcggagggcggggtcgggctcggcctgcccgaggcggtgctggcgttcgaggaggccggacggttcctgctgcccgggccgctggtggccacgcatctcgcggcgggggaggtggccggggcggccaccggcgagaccgtggtgacggccgtgcacggggggctcgtggagtggctgacgcaggcggacgtcgtacggggggacacggcgggagccgagcccctgcggtcggtggacccgctcactccgctgcaccgggtaccggggaccgctgagccggcccccctggtgatgcttctgacggcagccgaacagctcggcaccgccgcgcgcacctgcgaactcgccgtgcaacacgcacggacccgtgagcagttcgggcagccgatcggggccttccaggcggtcaagcacctgtgcgcggagatgctggtgcgggtcgagacggcgcgtgtcgcggtgtacgcggcggccgtcaccgccgacccgctcgacatcgccgcggcccggctgctcgccgacgaggccgccgtgcgcggcacccgcgactgcctccaggtgcacgggggcatggggttcacctgggagtccgacgtacatctgtacctgaaacgggcatgggtgcggacgcaacgtggagaatcagtcacggagagtgaggagaggttggcgagggagttgctgtccgggacgggc

SEQ ID NO: 3823 - DNA, 1152 bp, Streptomyces avermitilis
  CDS (1)..(1152)
gtggacctgacccgcacgcccgaagaggaggagttccgggccgggctgaggacatggctggcgaaggcgctgccctcgctgccgccgaagccgtcccccgacgactggccggccagacgggcgtacgacctcggctggcagcggatgctgtacgacgccggatacgcggggctgcactggccgctcgacgcgggcggccggggcgccaccccgacccagcacctgatcttcctggaggagacggaaaaggcgggcgcaccctacgtaggggccaatttcgtcgggctgctgcacgccggacccacgatcgccgccgagggcacccccgaacagcgggcgcgatggctgccgcccgtgctgcgcggcgaggaggtgtggtgccaggggttcagcgaaccggacgccggctcggacctcgcggcgctgcgcacgcgcgcgtggcgggacggcgacgactacgtggtgagcggatccaagatctggacctcccacgcggaggtcgcggactggtgcgagctgctggtccggacggatccggcggcgccgaagcaccgcggcatctcctggctcgccctgcgcatggacgcgccgggggtcacggtccggccgctgcgtacgctcgcgggctcgaccgagttcgcggaggtcttcctggacgacgtccgcgtacccgtcgcccatcgcgtcggcgccgagaacgacggctggcgcgtgaccatggtgaccctctccttcgaacgcggcacggcgttcgtcggcgaggtcgtcgcctgccggcgggtactcggcgaactcgcccgcgaggcgcacaggaacggccgctgggacgatccggtgctgcgccggcacctcgggaggctgaacgccgagttccgcgcactgtggcggctcacgcagtggaacgtgagcgaggcgcagagcaccgggggagtgccgggcgtcggcgggtccgtcttcaagctgcggtactcgcacgcacggcaggagctgtacgacgcggccgccgaggtgctcggcccggacgcggcggacctggggcgggagtggaccctcgaccggctgtcgtcgctgtcgtacaccatcgcggccggcacctcccagatccagcggaacatcgtggccgagcgcatcctgggtctgccgaaggggcgg

SEQ ID NO: 3824 - DNA, 1266 bp, Streptomyces avermitilis
  CDS (1)..(1266)
atgaccgaactgccccgcatcatcagcgtcgacgaccatgtgatcgagcccgcgcacctcttcgagacctggctgccgaagaagtaccgggaccgcggtcccaagccgctgaccgccggaatcggcgaactcgcctacgtcggcggcaagtaccagatcaccatggacccaaaggggccacccaccgactggtggatctacgaggacctgaagttcccgtacaaacgcaacatcgccgccgtcggcttcgaccgcgacgagatgacgctggagggcatcacgcgcgcggagatgcgccgcggctgctgggaccccgtcgagcgcctcaaggacatggacgccaaccacgtcgagggctccctctgcttccccaccttcccgcgcttttgcggtcagaccttcgccgaggcgcacgacaaggaagtggccctggcctgcgtacgcgcctacaacgactggatggtcgaggagtggtgcggcgacagcggcggccggctgatcccgctctgtctgatcccgctgtgggacatcggcctggcggtcgccgagatcaggcgcaacgcggcccgcggagtgaaggccgtgaccttctccgagatccccacccacctgggcctgccgtccatccactccggctactgggacccgttcttcgcggtctgccaggagaccgggacggtcgtgaacatgcacatcgggagcagttcccagatgccggcggcctccccggacgcaccccccgccgtacaggccgcgctgtccttcaacaacgcgatggcctcgatgatggacttcctgttcagtggcgtcctggtgaagttcccgcgcctcaaactcgcctactccgaaggccagatgggctggatcccgtacgccctggaacgcgccgacgacgtgtgggaggaacaccgcgcctggggaggggtcagggacctgatccccgagcctccctcgacgtactactaccggcagatcttctgctgcttcttccgcgacaagcacggcgtcgcgtcgatcgatgtcgtcggccgcgacaacgccaccttcgagaccgactacccgcatgtcgactcgaccttcccgcacaccaaggaagtcgccctcgaccacgtcgagggcctcgacgacgagacggtctacaagctgatgcgcggcaacgcgatccgcatgctggacctggacctggaccgcgacctcgaccacctcggcaaccgcgaccacctcggcgcccgcgacaccctcagcagccgcgacaaagcggaccgg

SEQ ID NO: 3825 - DNA, 1497 bp, Streptomyces avermitilis
  CDS (1)..(1497)
gtgaacgacaccgcacacgcgctcagcacctccggcacgctctgggaactcgtcgtccgccgcgccggcctcacccccgaccggaccgtcctcctccaggacgaccggtccctgagcttcggcgaactccgcgaccgcgccgaacgggtggccgccggcctgtacgacatgggcgtacgccccggcacggtggtcgcctggcagctgcccacccgcatcgagaccgcgctgctgtccttcgcgctggcccggctgggcgccgtccagtcgccggtcatccccttctaccgggaccgcgaggtcggcttcgcgctgcgggagtcgaaggccgagttcttcgccgtgccgggcacctggcgggggttcgaccacacggcgatggcacggcggctgggcgcgaaggggatcttcgaggcctacgacgccctgcccgacggcgaccccgcgctgctgcccgccccgcccgcccagggcaccgacgtccgctggatctactggacctcggggacgacctccgaccccaagggcgtactgcacacggaccgttcactgatcgcgggcggatcctgtctcgcccacgccctgcgcctgacggcggacgacgtgggctcgatggccttcccgtacgcgcacatcgccgggcccgactacacggtgatgctgctgctgtacggcttccccgcggtgatgttcgagcagttcgcgctgccggacgcgctggcgggctaccgggggcacggggtgacggtggcgggcgggtcgacggccttctactcgatcttcctggccgagcagcggcgacagccggacacgccggtcgtcccgacgctgcggctgctggcgggtggcggggcgcccaagccgcccgaggtctaccaccgtgtcgtacgcgagatgggcgtgcagctcacccacggatacggcatgaccgaggtgccgatgatcacgatgggctccccggacgacacggccgagaacctggcgacgacggagggacggccgccggagggcatggagatacggatcgtggacggagaggtacggctgcgcggggaggcggtgtgccagggctatctggatccgcggcagacggcggaggccttcgacgaggacgggttcctgcgtaccggcgacctgggccatctcaccggcagcgggcatctggtgctgaccggccgcctcaaggacgtcatcatccgcaagggcgagaacatctcggcgaaggagatcgaggatctgctgcaccggcatccggccgtcggggacgtcgccgtgatcggtctgccggacgcggagcgcggggagcgggtctgcgcggtggtcgaacagccgccgggagcgggggcgttgacgctggacgcgatgacctcgtatctgcgggcggaagggctgtccgtccacaagctgccggagcagctggaggtggtggacgcccttccgcgcaacgagaccctgcggaaggtgctcaagtaccggctgagggagcgctatgcgcgg

SEQ ID NO: 3826 - DNA, 510 bp, Streptomyces avermitilis
  CDS (1)..(510)
atggtcagcaccgagtacgagcgcaagatcgctgcccggttcgccggcttcgaccaggacggcaacggctacatcgaccgtgaggacttcaacgccgcgaccaaggcggtcctcgccgagttcggtaccccggcccggtcggacaagggtcagtccctgtatatcggcgccgaggccttctggcagggcatggcggggatagcggaccgggacggtgaccagcgcatcacccgggaggagttcgtgggcggcgcggtcaagcggctgcgcgacaaccccgagcggttcgcggagatcgcccgccccttcctgcacgcggccctcgccgtcgcggacaccgacggggacggcgcggccacggtcgacgaggccgtacgggtgctcaaggcgctgggcgttcccgaggagatcgcggccgcggcggccggcaccctcgacgcggacgccgacggccggatcggggaggcggaggtcgtctccgcgttcgcgcgctacttcacggtgccggag

SEQ ID NO: 3827 - DNA, 378 bp, Streptomyces avermitilis
  CDS (1)..(378)
gtggcggtggtgttcaaggtgaccgagggcaagcgaggtgactgggccgtcctccaggtggcgggcgagatggacctgatgacctcgccggtcatgcgccagcgggtgcacgacgcggtggcggacggccaccgcagtctggtcctcgatctctccgaggtgctgttctgcgactccagcggcgtcggcgtactgatcgcgacccgccgtctgatccgctcctgccagggccggctgcgcctcatcctgcccgcgcagggcgccgaggacggatcgcacgtcaaccgcgttctcgccgccctgggcgtccgccgtctcttcgacgtccacccggacctcgcctcggccgtggacgaggaagcccgccccctgtccgcg

SEQ ID NO: 3828 - DNA, 579 bp, Streptomyces avermitilis
  CDS (1)..(579)
atggcggcgaagaacgcaccgccccgctgggaccgcaagatgcagcagcggctcgcacgcggcgaggcggcggcgctcggtgaactgtatgaccggttcgcttcgctcgtgcacggcctcgcccaccgggtgctcggggacgagcgggccgccgaccgcatcacccgcgaggtgttcgcccatgtctgggagcacccggacgcatatgaccccaagcagggtccgctgcgctcctgggtcgccgggctgacgcaccggctggcggtgcagcggctgcgcgccacggagacggccgcgctcgcccggggcggccggggcaccacggaggacctggagcgcagggtgcggcgcgcctcggtggccgcccgcgcggactacatcgtcacgtccatgccgacgccgttgcgggccgcgctggagcgcgcgtacttccagcgccgtgactaccgccagaccgcggtcgacctcggcatcacggaggacgaggcccgccgccgcctgcgcctcggcctccaactcctgtccacggccaacgaccccggcacgtccgggctaccgcccgaggacgggaggccacgg

SEQ ID NO: 3829 - DNA, 1482 bp, Streptomyces avermitilis
  CDS (1)..(1482)
gtgagcggggcggaggggttcgaggaagccgaagggtccgaggaagccgagaggcacgacgggcaggacggagccgaagagggcaacggaacggagcggcacgacggacccaaggggacccccgggaccgaggggactaccgggaccgaggggactgccgaggccaagggggtcactgggaccggcagggccgagggcgctgacggagccgagggtgccgacggagccgacgggctcaagggcgtcgggggcgccggcggcagcggcggcagcggtgtcggtggttccgggcggctgcctcgcgtaccgccaccgcgggtgtccgtcgaggacagcgggcggccgttgcccgacctcgggcccctgccgctcgtgctcgagcaccgggtgctgaagtcgttgctcggcgcgtgggcgctgaccgcctgctcgccggaggagaccgcggccgtcgaggagcacctcggcgactgcggcccctgcgcggaggaggcgctgcggctgcgcgacgccgtcggcctgctgcaccccgccgagagcctcgacctcgatcccgccctgcgcacccgcgtcctggagggctgcctcgaccggcgtccgccgcgcatcccggtgccgaagtgggcggccgcgtacgacgcggagaccgcgcggctcgacgcgctgctccaggacatcggcgacgccgagtggcacgctccggtgcggctgcgctggttcgacggacagcggcccgcgagccggcgtacgaccgtggccggagtgatcgcccacctgctgaccgtcgacggactggtcgccgtcgccctgggcctcgacgaccccctcgccgggacaccggcgggcaacggcacgcccacggcccgcaccgaggcgtactggcgggccgcccacttcccgcccacccgttccgtacgcggcccatggcgggagcagagccacagcctcgtccgcacggtgtcgttcgcgggcggcggctccggaaaactgcccgtgccctacggcggcttcgagctgtcgctgcgcgactccatgctggaccgggccttcgagtgctgggtgcacgcggacgacatcgcggacgcggtggactacccgtacgacccgcccgccccgcgccatctgcacacgatgatcgacctggcggcccgggtgctgcccgtctccctggccgagcgccgccgggccgggctcgcggccccgccccgccggacccgccacctcgtcccggcgggcgcgcccggccgcagtctgcgcctggagatcgagggtctgggcggcggcgagtggctgatcccgctcgactctccggccgcgaccggctccgccgcgcacgaggtcgctcatgtcgcgctcgacggggtggagttctgccggctcgccgcggggcacgtgtcaccggaggaggcggccgccgggcaggacggcgaccgggaggcgatcagggacgtactgctcgcggcggcctcgctcagccggatg

SEQ ID NO: 3830 - DNA, 879 bp, Streptomyces avermitilis
  CDS (1)..(879)
atgaacgagcagtccgtccgcgccgccgcgcccgctgagcagtatgtcctcaccctctcctgcccggacaagcagggaatcgtgcacgccgtgtcgagctatctcttcatgaccggctgcaacatcgaggacagtcagcagttcggcgaccacgacaccggtctgttcttcatgcgggtccacttctcggcggaggcgccggtgacggtggagaagctgcgcgcgagcttcacggcgatcggcgacgccttccacatggactggcagatccaccgggccgaggaccggatgcgggtcgtcctcatggtcagcaagttcggccactgtctgaacgacctgctcttccgcgcccggaccggcgcgctgccggtcgagatcgcggccgtggtgtccaatcacacggacttcgcggagcttgtggcgtcgtacgacatccccttccaccacattccggtgacgagggacaacaaggcggaggccgaggcgcagctgctggagctggtccgcagcgagaacatcgagctggtcgtcctcgcccgctatatgcaggtcctctcggacgacctgtgcaagcagctcagcggccggatcatcaacatccaccactccttcctgccgagcttcaagggtgcgaagccgtaccaccaggcgcacgcccgcggtgtgaagctcatcggtgccaccgcgcactacgtgaccgcggacctcgacgagggcccgatcatcgagcaggaggtcgagcgggtgggccacgacgtgacgccggaccagctggtcgcgatcgggcgtgacgtggagtgccaggcgctggcgcgtgcggtgaagtggcacgcggagcgccgcatcctgctgaacggccgccgcacggtcgtcttcgcg

SEQ ID NO: 3831 - DNA, 498 bp, Streptomyces avermitilis
  CDS (1)..(498)
gtgaccgtgcaaggttcggagaactcttcccgtcgcggccgtcgctcctccaccatgggcggcatgccactgaacgacatgccgtggtggcgctggcgcagcaatgtgcgctccgcgctgcacatgctttccgaccccgcgttccagcgtgatgtctggctggcgggcgtcgacgggtacggggacgtcaccgacgccgtgtaccggctggtcgaggacacctggctggacaactggtcggccgagaaatacgtcggcacgatattccgggattcgcaggaggcggcgctcgtcgacacggccgtgctgcgcgtgctgcgcatcatgcaccaggtcggcccggacgcgcccgtctccgcctacctcgaccaccatgcgtggccggaggccgtccgggccgcccgcgacgcgcatgtgcggttggccgtgagcgacgaggaggacccggacgtgccgccgcggacgctcgaggtgctgcggatcctgacgcggaccgcg

SEQ ID NO: 3832 - DNA, 1284 bp, Streptomyces avermitilis
  CDS (1)..(1284)
atgaccggcaggcgacgcacctcctttctccctcgtcccgtcaagaccgcggcgctgtccgcgggggccctggcggcgtgtgcggcgctcgccgtcggttgcggtgtcgtccccggtgtcacggggggctcgggggacgacaccgtcaccgtcatgacctgggcaccggagaagaccacggcgaccaacgagcccggcatgccggcgatggcgaaggcgtacgcacgctgggtcaacgccgagggtggcctgaacggccgcaagctcagggtcctgacctgcaacgaccacaacgacaccgtggatgcggcgaagtgcgcccggcgcgccgtcaacgagggagccgtcgcggtcgtcggctcctacagccagcacgccagctccttcctctccccgctggagtcggcgggcatcccgtacatcggcggctacggcgtcaccgacgacgagttcaagagcgtcctgtcctacccggtcaacggcggccagcccgcgctgctggccggcctcggcgaggaactgggcaagagctgcggccccgtcgccctcatccgccccgacaccttcgccggcgaccagctcccggtgctgttcggctccggcctgaaggcgggcggccactcggccgccgccgatctgcgggcggacgaggacgccagcgagttcgcgggacaggcccggcaggcgctgcggcgggcgagcgccgacccgctgaacaagggctgtgtggtgcccgcgctcgacgaacgcaccaacacgttcatggactccttccggcgtcagcgcgacgactacccgacggtgcgcaccgcgtccgtgctcggcagcgtcgaccagtcggtgatcgacgcgacgggcggcgcgtcggggccgtacgaaggggcgtacgtcaccggctggtacccggtcgcgagcgacgcgcgctgggggccgatgaagaaggtgatccgcgagcacgccttcggcgacaaccggatcgacccggcggacgcgggcgtgcagacgacctggatcgcgtacaccgtgctcaagaaggtcgtcgagtcgctcgacggcgaggtgagcgcccgtaccgtccggcgggccctggacgacggcgtcaaggtggagacaggcggcctcacaccgaggctcagctggcgcttcgaggacatgacggcggtcgtcgacttcccccgcgtggtcaacgccgacgtcaccttccaggtcgtacgcgagggccggctggtggcggcccggcgcggcttcgtcgatgtgtcgaaggtcctggagagcaacgcgtac

SEQ ID NO: 3833 - DNA, 1677 bp, Streptomyces avermitilis
  CDS (1)..(1677)
gtgctgccctcggacggtggcgcgcccctcctgccgggcacgaccggcgatcagcggcccgccccggcgggcggtcaggcctggggtcagccctggggcccggacggcccggggcagaccccgcccgcgccgggctggggcgcgcccacggacgcgggacagccctggacggcgcccgagcccccgcagtccgcgcccgcgcccgactggggcacctcgggggcgcagccgtcctgggaggcctcccaggacctgcgatcgggctgggacggcccgcaggggcagcccagcgactccgggtacccggttcaacagcagcagcagcagccgcatcagcagcaaccgcatcagcagcagccgcagcaggcggccggctccgcgttccccgcgcagccgcagccgcagccgcagccgcagccgcagtacgcgcccgactccggcttccagccgcagtcgcagcaggcgcccgcgcccgggttctccgcgccgcacggcaccggcggtgccggcccgctgccccccgagggcgcgcaggccttcccgcccgtcccgggaggcgccccgctgccgcccgtcgacgagggggccacgcagtacctcccgcccgtgcccgcggccccggacgagggggcgacccagtacctcccgcccgtcccggccgtcgacgagggtgccacccagtacattccgccggtcgcccccggagcgctgccgcccgaggtgtccgccgacgcgacgcagttcctcggccacggcccgcaggccggctcccggccggccgccgaccccgacgcgcaggccacgcagtacctcccgcccgtgcccgcggagcccgacgccgggtcctacgggatacggccgggcgcgcccgacgagcggcagccgccggccgagttcgacaacctcttccgcagcgactcggcgggcgcgtcgtccacccagcagctgccgcagttccagccgccggccgcgggagcgccgggagcgccgggtggtcgcgcggccgcccggcgcgccgcgggtgacgaggggggcggccgcggtggccgcaccggttcgcgtgtgccgctcatcgccgccgtcggcgtgggcatcgccgtgctcggcatcggcgcgggcgcgctgctgagcagcggtggcggcagcgagagcaagggcgacgacagcaagcccgtgtcggcgagcgccccggccaaggaatcgtcggcgtcggcgtccgccgacccggcgaaggaacaggccgtcgcgctggaccagctcctggcggacagcggcaacagccgcgactccgtgatcaaggcggtcggcaacgtgcggacctgcaacaacctcgaccaggcggccggcgatctgcgggacgcggccaagcagcgcggtgacctggtgacccgcctgtccggcctctccgtcgacaagctcccgaaccacgccgcgctgaccgccgcgctgaccagcgcctggcaggcctccgcctccgccgacacccactacgcggcctgggccgaccaggtcaacggcaagaagggctgcaagaagggccaggcccgcaccaccggccagaccgtggccggcaaccgggcgagcaccacggccagcgcccagaaggtcaaggccgcggggctgtggaacacgatcgcgtccacgtacggcctgacccagcggcagcccacccagctc

SEQ ID NO: 3834 - DNA, 1383 bp, Streptomyces avermitilis
  CDS (1)..(1383)
atggccgcaaggcctctcgtagccaggcagccgaacgaacggctccaggcgctcatccaggaagcgggctgctcgaacgccgggctggcccgccgggtcaacatgtgcggcgcggaacacggtctcgatctgcgctacgacaagacgtccgtggcccgctggctgcgtggacagcagccacggggccgggctccggcgatcatcgccgaggcgctcggccgcaagctggggcgcacggtcacgatcgacgagatcggcatggccaacggcaagaacctggcgtccggcgtgggcctgcagttctcgccgaccgtcctcggcgccatcgagcaggtgtgtgagctgtggcgcagcgacgtcggccgccgggacttcctctccggctcctcggtcgccgcctcggcgctggtcgagcccagccgcgactggctgatctccgtgccggactcgcaggtggcgcggtcggccggcccccgggtcgggatctcggacgtggcggcggtgcgcgcgatgacccaggccctcgtggacctggaccacacgtacggcagcgggcatgtgcgcccggtcgtcgtgcactacctcaacagcgtcgtctcggggctgctcgcggggtcgtaccgcgaggcggtcgggcgtgaactgttcgcggcggtcgcacggttgaccgagctcgccgggtacatggcgatcgacaccgggcagccgggcctcgcccagcggtactacatccaggcgctgcggctcgcgcaggcggccggggaccgcgggtacggcggatatgtgctggccgcgtccatgagccacctggccgctcagctcggcaacccgcgggagatcgcgcagttggcgcgggcggcgcaggagggggcacgcgggcgcgtgacaccccgtgcggaggcgatgttctacgcggcggaagcgcgcgggcacgcgttgatgggcgacgcgcgggcggcccaggtggcgtccgggcgggcggtcacggcgctggagtcggcggacccctcgtccggggacgacccggcgtggatcgcccacttcgacgaggcgtatctggccgacgagttggcgcactgtcaccgggacctgggacaggcggaggcggcggcgcggcgcgcggaggagtccctggccgggcaccccgagtcgcgggcgcgccgccgtgccatcggatatgtgctcctcgccacagcgcaggtgcagcagcgcgaggtggagcaggcgtgccacacggggctgcgggcggtcgaactcctcggcaccctgcggtcgaaccgcggcgcggagtacctggacgacctccagcagcgcctggagccgtaccgggacgagccggtggtacgggagttcggggcgcgcatggagttgcaggcggcggcg

SEQ ID NO: 3835 - DNA, 651 bp, Streptomyces avermitilis
  CDS (1)..(651)
gtggaagagaccatcgcggggcctcaggccgcccaaatcccgaagcagcgcggcgaatcgctgcaggacaccgccgtccgctacgccgaggaacgccactgggacgtgttcgccgggacctggctggaagccgtcgagggggtgccgcgctgctcgtgcggggacgccgcgtgcgccgtgcccggcgcgcacccggcgcgcgaggactgggccacgcaggcgacgggcagcgcgaccgtcgcgcgccgtatgtgggcgaagcagccgaccgcgtcgatcctgctgcccaccgggcgcacgttcgacgcgatcgacgtgccggagaccgccggcttcctcgcgctcgcgcgcatggaacgcatggagctgacgctcggcccggtcacctgcacaccggaccggcgcatgcagttcttcgtgctccccggggccgccgtgaagatccccgacctggtccgcaggctgggctggccgcccgcctccctcgacctcgtcgcgctcggcgagggcatgtacgtggccgccccgcccacccgttacggctcccggggtgccgtccagtgggcctgccgaccgacgcccgcgaaccgctggctgccggatgcggaggagttgatctcgcccctcgcgtacgcgtgcggacgggaacga

SEQ ID NO: 3836 - DNA, 789 bp, Streptomyces avermitilis
  CDS (1)..(789)
atggctgagggagcagtggtggatgtgcccgccgtacgcgtgcgggggctctggaagcggttcggggagcagatcgccgtcgcgggagtcgatctggaactgcccgcgggccggttcgtcggcctcgtcgggccgaacggggccgggaagaccaccaccctgtccatggtcaccgggctgctccgccccgaccagggcgccgtcgaggtcgtcggccacgacgtgtggcaggacccggtggcggtgaaggcccggatcggcgtactgcccgagggactccggctcttcgagcggctctccggacgtgaactcctcggctacacgggcagactgcgcggcctgcccggcgtcgaggtcgacaaacgggccgcccagctcctcgacgtcctcgacctcgcgggcgcccagcacaaactcgtcgtcgactactcgaccggtatgcgcaagaagatcggactggccgcggccctcctccacaaccccgaagtcctcttcctcgacgagccgttcgaaggcgtcgacccggtctccgcgcagaccatccgcggcgtcctcgagcgctacaccgcctccggcgccacggtcgtcttctcctcccacgtcatggagctggtcgaatcgctgtgtgactgggtggccgtcatggccgcggggcgcatccgcgcacacggcccgctcgcggaagtccgcggcagcgccccctcgctccagcaggcgttcctggaactggtcggcgcgaacggccgcgccgccgccaccgacctcgactggctgggcggcggcgcccgg

SEQ ID NO: 3837 - DNA, 1632 bp, Streptomyces avermitilis
  CDS (1)..(1632)
gtgagcgcggccgacccgacgagtacggccgacccgacgagtacgccctccctgacctcggtcgtcgtacggctgaagctgtcgctcctcaggaacgggctgcggcagtccgccgggcggcgggccgcgtacgtcacctccctcgtcctcgtcctgcccttcgccggcctccagctgctcggcctgatcgcgctgcgcggcaccacacacgcccccgccgtcgccgtactgctcgtggcggtcctggcgctcggctgggccgtgatgccgctgttcttcccgagcggcgacgagacgctcgaccccacccgcctggtgatgctgcccctgcgcccccggccgttgatcagggcgctcctcgcggcctcgctggtcggcatcgggccgctgttcacgctgtgtctgctggccggttccgcggtctcggtggcgcacggcacggccgcatgcgtcaccgcggtcgtcggcgtggcgctggccctgctgggctccgtggcgctggcccgggccgtcgccgccgccaacatccgtctgctgagcagccgcaagggccgcgatctggcggtgctgagcggactggtggtcgcgatcggcgcgcagctcgtcaacttcggggcgcagcgactggggtcggccggcgggctgtcacagctcgacccggcggcggacgtactgcgctgggtgccgccggcggcggcgatcggcgcggtcgactcggtgagccggggctggtacggggccggtgtcgcccaactcgtgctgagcgccctggcgctggtgggcctgctcgcgctctggtcgcgcagtctgaccaggctgatgacctcgccggacgggtcgacactccaggccgccgaacccgggcgggacagggcggggcggtcctcggggctcggccggctgctgcccgcgggccgcaccgggaccgtcatggagcgcagcctgcgctatgtctggcgcgatcccaagaccaaggcggcctgggcgacgtcgctggccatcgggctgatcgtgccggtgttcaacgcgctccagggcaccggctcgatctacttcgcgtgcttcgcggccggaatgctcggcatccagatgtacaaccagttcgggcaggacacctccgcgttctggatggtcgcgatgacgatctcgtccacccgggacgcctacgccgagctgcgcgggcgtgcgctcgccctgctggtgatcaccctgccgtacgcgacgctcgtgtgcgtcctgacgaccgcgatgctcggcgactggccccggctgcccgaggtgctcgggctgtccttcgcgctgctcggggcgatgctggcgaccggggcgtggtcgtcggcgcgcttcccgtactccatcccgcaggagggctacaagaacgtcgcgcccgggcaggcggggctcgcctggatctcgatcttcggcggcatggtgtcggcggcactgctgagcgcccccgtcatcatcctgaccatctggctgaacgtggccgcgggcgggggcgagtggacctggctgctgctgccggtgggcgccgcgtacggcgccctgctcacgctgctcggactccggctcgccgcaccacggacggcacggcggctgccggagatcctggcggcggtcagcaaagga

SEQ ID NO: 3838 - DNA, 921 bp, Streptomyces avermitilis
  CDS (1)..(921)
gtggaccggtcggctcgacgcgggagcgagcggtccgagcggagccaggggggtgccaggactatggtgcggcgcatcgatgtgaccggtgcgggcggcgtacgcctcgcggcctgggagttcgccgatcctcccaagaacggggagagcgagcgaacgccgggcgtgctgttactgcacggcctgatgggccgagcatcacactgggcgtcgaccgcccgctggctctccgagcggcaccgggccgtcgccctcgaccagcgaggccacggccagagcgggaagccgccagaggcggcctacacccgtgaggcctacgtcgaggacgcggaggccgccctggaacagctgggtctcgccccgaccgtcctcatcggtcacgccatgggcgccctgaccgcctggcagctcgccgccaagcgccccgacctggtctgcggtctgatcatctgcgacatgcgggcgtccgcgctcggtgccgcctcccagcgcgagtgggaggactggttcaaggcctggcccgtccccttcgccacgctggccgacgtacgcaagtggttcggcgaggacgacccctgggtggagcgtccgaacccgtcgcgcggcgagttctacgccgaggtgatgcacgagtccgacgacggctggcgtcccgtcttcgaaccggagcagatgctgaagtcccgccagacctgggtgtacgacgcgcactgggaggagctggcacaggtccgctgcccggcgctggtggtccggggcctggacggcgagctgggccgggccgagtcccaggagatggtgcgggtgctgccgtacgggcagtacgcggaggtggccgaggcgggccacctcgtgcactacgaccagccggaggcgtggcgcgcagcgatcgagccgttcctggacggagtcctggcgcct

SEQ ID NO: 3839 - DNA, 690 bp, Streptomyces avermitilis
  CDS (1)..(690)
atgtccggactgatcgacaccacggagatgtatctccgcaccatcctcgagctggaggaggaaggcgtggtccccatgcgcgcccgcatcgccgagcggctcgaccagagcgggccgacggtgagccagaccgtggcgcggatggagcgcgacggcctggtggcggtggccagcgaccgccacctggagctcacggaggagggcaggcggctcgccacgcgcgtgatgcgcaagcaccgcctcgcggagtgtctcctcgtcgacgtgatcggtctggagtgggagcaggtgcacgccgaggcgtgtcgctgggagcacgtgatgagcgaggcggtcgagcgccgcgtcctggagctgctgcgccacccgaccgagtcgccgtacgggaacccgatcccgggcctggaggagctgggcgagaaggacggcgcggacccgttcctcgacgagggcatggtgtcgctggccgagctggacccgggcgcggacggcaagaccgtggtcgtgcggcgcatcggcgagccgatccagacggacgcgcagctgatgtacacgctgcggcgggcgggcgtgcagcccggctccgtggtcagcgtgacggagtcgccgggcggcgtcctcgtgggcagcggcggcgaggcggccgagctggaggcggacgtggcctcccacgtcttcgtcgcgaagcgc

SEQ ID NO: 3840 - DNA, 753 bp, Streptomyces avermitilis
  CDS (1)..(753)
atgagcgagagcaagctggccgagcagttcctcgacgccgcgatcggcctgctccagcgcgtgcgggacgaggacgccgagcccatcgcggccgccggcaccctcatcgccgacacggtcgccgacgggggccgcctgttcgccttcggcgccgggcactcctccctcgccgcgcaggacctcgtctaccgcgcgggcggcctggccctgatgaaccttctcgccgtccccggcgtcgtcggcgtcgatgtcatgccggccaccctgggctccgccctggagcgcgtcgacggcctcgcgagcgccgtcctcgactcgagcccggtccgctccggcgacgtactggtgatcatctcgctctccggccgcaacgccctccctgtggaaatgtcgatgaacgcccgtgcgctcggggtcaaggtcatcggcgtgacctccgtggcctacgcctcgcagaccaggtcacgccacgtctccggcacgtatctgaaggaccactgcgacatcgtcctcgactcgaggatcgcggtgggcgacgcggagctcaccctggacacgatcgaggcccccttcgcccccgcgtcgacggtcgtcacgacggctctgctccaggcggtcatggccacggccgcgggcacgctggccgaccgcggcatcgaacccccgctcctgcggtcgggcaacgtggacggcggccacgactggaacgaccgggtgatgcgcgagtacggcgacaggatcttctaccgccgc

SEQ ID NO: 3841 - DNA, 1428 bp, Streptomyces avermitilis
  CDS (1)..(1428)
gtgagtgcttcccggcgtagtgggaccaccgacgagctggggcccgacgggcccgatcccgagcgggacgggcccgacggggcggacctgcttgccgcgctcctggacgggatggacgcggcgttgtgcgcgttcgatgccgacggcgtcgtgacgcactggaaccgggaggccgagcggatcctcggctggaccgccgccgaggccgtggggcgccgggggttcgccggctgggccgtacggaccgccgacgccgaggacgtcgaggcgcggctgatgaccgccatgcaggcccccggccgtcaggtgcacgagttcgcgctgctcaccaaggacggcggccgggtgctcgtacggacccagtccgcggccgtgcacgggcccgacgggaagccggccggggtgtactgcgccttcagtgaggtgcacacccagatcgacctcgagcggtccatcgccctgagtgaggcgctgttcgaggacgcgagctggggtgtcgtgctcgtcgacgccgacctgcggcccgcggtggtcaacgcgcatgccgcgcgggcgctgggcaccgggcgcacgacggtgctcgggcggccgctgggcgacctgctctcccagggggtcgaggagctggagagcgccctgacccatgtgctcgccgaaggggcgccgcccgcgcccgccgagatgtgggtgagcgtgcggaccgccgagggcgagaagcggcggtgctggcgcagcgggttcctgcggctcgcctcgccgctcgccgaggagcccgtacccctgggtgtcggctggctcttccaggacatcaccgaggccaagcagaccgagcaggaggcggcgctgctgcgcttccgcaccaaccagctgcaccgggccgcgcgggccgccgccgagtgcgaggacccgggggaggcggccaccgtccatctggacttctcgctcgccgggttcgcggaccacgcgttgatcgaccgggtggccgggggcccggtggcggacggcgacagggacggggacggaccgccggtgcggctcgtacgggccgccgacacgccctcgggggcgcccggaccgagcctgctcgtcgggaaggcggagctgcccgtgtggtacgcggaggggcatccggcgttgcagtgcgtggagcgggccgggtccgtgcgggccagcgcgggggtgtccgacgcggagcgggcgcgggagtgggccatctcgcggcagtggcccggggacgcggtgcacgcgctgtgcgcggtgctgcgcagccgggggcggacgctcggggtggtgacgtttctgcggggggccgggcggagccagttcgagcgggccgacgcggtgtacgcggaggacgtggcggtacggatcgccgccgcgttggacctggccgggctggccgggctggccgggccggcgggggagcgg

SEQ ID NO: 3842 - DNA, 672 bp, Streptomyces avermitilis
  CDS (1)..(672)
gtgaccgaccgtgaccctatccacgaccccgcggcgatgcgtgagcactaccggctggagggactcgacgagaccgagctggccgcgcacccgatggatcagttcacccgctggttcgcgcaggccgcgcaggccgccgcacagggggtggtgtacgagccgaacgcgatggtcgtctccaccgcggacgccgacggccggcccagttcgcgcacggtgctgatgaagcagtacgacgagcagggcttcgtcttctacaccaactacgactcacgcaaggcgcgcgacctggccgccaacccgtacgtctcgctgctcttcccctggcatccgatggcccgccaggtggtcgtcacgggcctcgcgcgccggaccgggcgcgacgagacggccgcctacttccgcacccggccgcacggctcccagctcggcgcctgggccagcgcccagtcctcggtgatcttctcccgcgccgagctcgacgcggcgtacgagcagttgggcgtccgctaccccgagggcgagcaggtcccggtcccgccgaactggggcggcttccgcatcgccccgcagacggtcgagttctggcagggccgctggaaccgcctccacgaccgcctgcgctacgtggccgagccggacggatcctggcgggtggagcgactcagcccc

SEQ ID NO: 3843 - DNA, 1098 bp, Streptomyces avermitilis
  CDS (1)..(1098)
atgtccgacttcgtacccggactcgaaggagtcatcgcgttcgagacggagatcgccgaaccggacaaggagggcggcgcactccggtaccggggcgtcgacatcgaggatctggtcggccacgtctccttcggcaacgtctgggggctgctcgtcgacggcgccttcaaccccggcctgccgcccgccgaaccgttccccatccccgtgcactccggcgacatccgtgtcgacgtccagtccgcgctcgccatgctcgcccccgtctggggcctgaaaccgctgctcgacatcgacgccgagcaggcccgccacgacctcgcccgcgccgccgtcatggccctgtcctacgtcgcccagtccgcccgcggccagggcctgcccatggtcccgcagagcgagatcgacaaggcgcactccgtcgtcgaacggttcatgatccgctggcggggcgagccggaccccaagcacgtggcggccgtcgacgcgtactggacgtcggccgccgagcacggcatgaacgcctccaccttcaccgcgcgtgtgatcgcctcgacgggcgcggacgtcgccgccgccctctccggggccgtcggcgccatgtccggaccgctgcacggcggtgcgccctcccgggtcctcggcatgatcgaggagatcgaacggacgggagacgccgaggcgtatgtgaagaaggctctggacaagggcgaacgcctcatgggtttcggccaccgcgtctaccgcgccgaggacccgcgtgcgcgggtgctccgccgcaccgcccgcgagctgggcgccccgcgcttcgagatcgccgaggcgctggagaaggcggccctggaggagctccacaaccgccgccccgaccgcgtcctcgccaccaacgtggagttctgggcggcgatcatgctcgacttcgccgaggtgccggcgcacatgttcacctcgatgttcacctgcgcccgcacggccggctggtcggcgcacatcctggagcagaagcgcacgggccggctcgtacgcccgtccgcacgctatgtgggccccggttcgcgcggcccccaggagatcgagggctacgaggacatcgcgcgc

SEQ ID NO: 3844 - DNA, 1035 bp, Streptomyces avermitilis
  CDS (1)..(1035)
atgacgaacacggcgacaaccccgtcgtaccagcgctaccagcagctcccgatcatcgacctctccgcggccgaccgaggcccgcaggcccgcgcgctgctccacgcgcagctgcacagcgccgcccatgacgtgggcttcttccagctcgtcgggcacggggtcacccaggccgagaccgacgagctgctgcgcgccatgcacgcattcttcgcgctgcccgaagccgaccggctggcgatcgacaacgtcaactcgccccacttccgcggctacacgcgcaccggcgacgagcgcaccggcggcagccgcgactggcgcgaccagctcgacataggcgccgagcggcccgtacggacacccggccccggcgagcccgcgtactggtggctggagggcccgaaccagtggcccgccgccctgcccgagctgcgcacggcggccctggcctggatcgacaagctgagcgccgtcgcccagcggctcctgcacgagctgctcaccgccatcggcgcgcccgccggcttctacgacccggtcttcggcgagcacgcccacccgcatctgaagctggtgcggtatccgggcagcgcgggcgacggcgccgaccagggcgtcggcgcgcacaaggactacggcttcctgaccctgctgctccaggaccaggtcggcgggctccaggtgcagcgcgaggacgggctgttccacgaggtgccgccgctgccgggggccttcgtggtcaacctgggcgagctgctggaggtcgccaccaacggctatctgctcgcgacgaaccaccgggtcgtgagcccgcccggcgccaccgagcggttctccgtgcccttcttctacaacccccggctggacgcgcgggtcgagccgctgcccttcccgcacgcctccaccgcgcccggagtcaccgacgaccccgccaacccgctgttcgcggagtacgggctcaacgaactgaagggcaagctgcgcgcccacccgctggtcgccgcccgccatcacgcggagctgctcacccccgca

SEQ ID NO: 3845 - DNA, 645 bp, Streptomyces avermitilis
  CDS (1)..(645)
atgggggaccacttccagacgatcgtcgacctggacgcgagcgccggggaggcaccggagctcgccgcgcgcgtgatcgagtggctcgtgaccgagggcatcgtcctggccgagcggaccgactgcgtcctcggccgcccgctcggtcatccgccggggccgaactggcggcgggcggtgggggagaaccccgacctggacccgtccgacggtctcgccgtccacaccaggcgtacggctttcgacgccggccagggcggcccggagtcggtgacctgcccgcgctgcggagcgacgacggagctggccggcgaggactacgcggacggcgcggacggcgcggactacgaggacgcggccggggccgaagaccggtcggagtcggacgagggcgcggccgacggtgtctgggaccgcttcgccgccgcgatcgaggtctggcacgcgaccggcgccgccacggtcgcctgccccgcctgcgcgcacccggtccccctcgccgactggacgtggaacgacgactgcttcgccttcggccacctcggattcgagttctggaactggccggagttcacgtccgggttccgcgccgacatagcccgcctcctcgacggccaccgcacggcgtacgtgtggggcaagttc

SEQ ID NO: 3846 - DNA, 597 bp, Streptomyces avermitilis
  CDS (1)..(597)
atgggcgctgtgaacacggccgaccgtgttcccaagcaggaccgcagccgggccacccggcagcgcctcctcgaagccgccgtggcctgcctcgccgaacacggctgggcgggctccacggtctccgtcgtggccgagcgcgcgggcgtgtcacggggcgccgcccagcaccacttcccgacccgcgaggacctcttcacggcggcggtcgagtacgtcgccgaagagcgctccacggcgctccgggtgctcttcccggagggcgccgccgaccgccgcgccgtggtctccgcgctcgtcgacctgtacacggggcccctgttccgagccgccctgcacctgtgggtggccgcgtcgaacgaggaccagctccggccccgggtcaccgagctggaggcccgcgtcggccgcgagacccatcgcatcgccgtcgacctgctgggcgccgacgaatcccggccgggcgtacgggagacggtgcagggcctgctggacatggcccgcggcctcggcctcgccaacctcctcacggacgacgcgagccgccgggaccgggtggtgacgcagtgggcggcactgctggaggagacgctcggc

SEQ ID NO: 3847 - DNA, 732 bp, Streptomyces avermitilis
  CDS (1)..(732)
atgactctgatcggcatcacgcgcgcgcggggcatcgcgaccctcgccctggactcgcccggcaaccgcaacgcgctctcggccgacctggtcaccgaactcgccgacgccctcaccgcgtgcggcaaggaccccgacgtacgcgccgtcgtcctcacgcactccgggaacaccttcagcgcgggcgcggacctcaggcagccgcccgacccggcggccttcgtggggctgctgcgggggatcgtggagctgccgaagccggtcgtcgcgcgcgtgacgggccatgtacgggcgggcgggctcggcctgctgggcgcctgcgacatcgcggccggcgggcccgggacgtccttcgcgttcacggaggtccgcatcggggtcgcgcccgccgtcatctccatgccgctgctgccgcgcctcgagccgggggccgcccgccgctactacctcacgggggagcgcttcggcgcggcggaggccgtacgcatcgggctgctgacggcgtccggcgacgacgtggacgagaccctggcaccgatcctggacgggctgcgggcggccgccccgggagccctggccgagacgaaggcactggtcacggctagggtgctggaatccttcgaccgggacaccgcggcactgaccgcgctctccgcacggctgttcgccactgccgaggcccgcgaggggatgacggccttcctcgaacgacgggaccccgcatgggcgctg

SEQ ID NO: 3848 - DNA, 1572 bp, Streptomyces avermitilis
  CDS (1)..(1572)
gtgttccgcagcgagtacgcagacgtcccgcccgtcgaactccccatccacgaggcggtgctgggccgggccgcggagttcggggaggcacccgccctcgtcgacgcagtggacggcaccaccctcacgtacgaacaactggaccggttccaccggcggatcgccgcggcgctggccgaggcgggcgtccgcaagggcgacgtcctcgccctgcacagcccgaacaccatcgccttcccgacggcgttctacgccgccacgcgcgcgggcgcgtcggtcaccaccgtgcacccgctcgccacggcggaggagttcgccaagcagctgagcgactgctccgcccgctggatcgtcaccgtgtcgccgctcctggacaccgcccgcagggcggccgaactcgcgggcggcgtccgggagatcttcgtctgcgacagcgcgcccgggcaccgctcactgatcgacatgctggccaccgccgcccccgagccgcgggtcgacatcgaccccgcggaggacgtcgcggccctcccgtactcctcgggcacgaccggcacacccaagggcgtgatgctcacccaccggtccatcgccaccaacctcgcccagctcgaaccggccgtgccgacggggccgggcgagcgcatcctcgccgtcctgcccttcttccacatctacggcctgaccgccctcatgaacgcgcccctcaggctcggcgccacggtcgtcgtactgccccgcttcgacctcgacacgttcctcgcggccatcgagaaacaccggatcacccacctgtacgtcgccccgccgatcgtcctcgcgctggccaagcacccggccgtcgcgcagtacgacctgtcgtccctgaagtacgtcatcagcgccgccgcgcccctggacgccgacaccgccgcggcctgctcgcgacgcctgggggtgcccccggtcggacaggcgtacggcatgacggagctgtcacccggcacccacgtggtcccgctgaacgccgtgaacccgcccccggggaccgtcggcaagctcgtcgcgggcacggagatgcgcatcctctccctcgacgacccggaccaggacctgcccgtcggcgaggccggtgagatcgccatccgcggcccccaggtcatgaagggctacctggggcgcccggaagccaccgccgcgatgatcgacgaggacggctggctgcacaccggggacgtcgggcgcgtggacgccgacggctggctgttcgtcgtcgaccgcgtcaaggaactcatcaagtacaagggcttccaggtcgcccccgccgagctggaggcgctcctgctgacccacccgaagatcgcggacgccgccgtcatcggcgtctacaacgacgacaacaacgaggtcccgcacgcccacgtggtgcgccagccgtccgcggccgacctctccgcgggcgaggtgatgatgtacgtcgccgaacgcgtcgccccctacaaacggatccggcacgtcaccttcctcgacgaggtgccccgggccgcctccgggaagatcctccgacgacagctgcgagacctgcgggagcactca

SEQ ID NO: 3849 - DNA, 1158 bp, Streptomyces avermitilis
  CDS (1)..(1158)
atgacccgagtcatcgagaccgaagagcaccaggccctccgatccgccgtagccgccctcggcaagcgctacggacgcgagtacctcacccgcgtggtcgccgaaggcgattaccccgacgaactctggtccgagaccgccaagctcggctatctcggagtcaacctgccagaggcgtacgggggcggaggcggcggcatcgcggaactctccatcgtcctcgaagagctcggcgccgccggctgtccgctgctcatgctcgtcgtctcgcccgcgatctgcggcacggtcatcgcccgcttcggcaccgaggcccagaaacagcagtggctgcccgggttcgccgacggcagccgcagcatggccttcggcatcaccgaacccgacgcgggctcgaactcccaccgcatcaccaccaccgcccgccgggacggcaccgactggatcctgagcggccgcaaggtcttcatctccggtgtcgacatcgccgacgccaccctcgtcgtgggccgcacggaggacgcccgcacgggccggctcaagccctgcctgttcatcgtcccgcgcgacacggacggcttcgggcggcggccgatcgacatggaactccacggcgcggagaagcagttcgaactgaccctcgacgatgtgcggctgcccgcggacgcgctcgtcggcgacgaggacgccggtctgctccagctgttcgccggcctcaacccggagcgcgtgatgacggccgcgttcgccatcggcatgggccgcttcgcgctctccagggccgtcgagtacgcccgcgaccgcagcgtctggaagcagcccatcggcgcccaccaggccatagcccacccgctggcccaggcccacatcgacctcgaactggcccgcctgatgatgcagaaggccgcccacctgtacgactccggggacgacgtcgccgccggggaggccgccaacatggccaagtacgcggccggcgaggcctgtgtgaaggccgtcgaccaggccgtgcacaccctcggcggcaacgggctcacccgcgagttcgggctcgcctcgctcatcacggcctcgcgcgtggcacggatcgccccggtcagccgggagatgatcctcaactacgtttcccaccagaccctgggcctgccgaagtcctac

SEQ ID NO: 3850 - DNA, 1848 bp, Streptomyces avermitilis
  CDS (1)..(1848)
gtgattgcatctgtcctcgtcgccaaccgcggcgagatcgcctgccgggtcttccgtacctgccgcgcgtccggaatccggacggtcgccgtgtactcggacgccgacgagaacgccctccacgcgcgcgtggccgacgcggcggtacggctgccgggtgcggcgcccgctcagacgtatctgcgcggcgacctgatcgtgaaggcggccctcgcggcgggcgccgacgccgtccacccggggtacgggttcctgtccgagaacgccggcttcgcgcgcgccgtgcgggacgcggggctcgtctggatcgggccgccgccggaggcgatcgaggcgatggcgtccaagacgcgcgccaagaagctgatggggctcgagcccctgacggaggtcacgccgccggacctgcccgtgctggtcaaggcggccgcgggcggcggcggccgcggcatgcgcgtcgtgcgggacctcgccgagctggacgccgagttggcggcggcccgcgccgaggcgctgagcgccttcggggacggggaggtgttcgtcgagccctatgtggagggcggacgccatgtcgaggtccaggtgctcgccgacacgcacggcacggtgtgggcgctcggcacgcgcgactgctccctgcaaaggcgccaccagaaggtgatcgaggagtcaccggcccccggtgtggacgccgaactcacggcggaactccacgagctggcgatacgcgccgcgcgcgccgtcggctacacgggcgccggcaccgtcgagttcctggtcgcggacgggcgggcgcacttcctggagatgaacacccgcctccaggtggaacacccggtcacggaggcggtcttcggtatcgacctggtcgcccagcagatacgcgtcgccgagggcgcggcgctggagagcgacccgccacgcgcgcgtgggcacgcgatcgaggcccgcctgtacgcggaggacccgtcccgggactgggccccgcagacgggcacgctgcaccggctcgccctgccgcgggaagcggacgtccgcctggacacgggctacaccgacggcgaccccgtcggcgtccactacgacccgatgctcgccaaggccgtcgcccacgcccccacgcgcgcggaggcggtgcgcacgctggcggacgccctggaacgggccgagatccacgggccggtcaccaaccgcgacctcctcgtacggtcactgcggcacccggagttcacggcggcccgcatggacaccgggttctacgaccggcacctgaccgaactgacggcgcccgccccggacccgtacgcccccttggccgccgccctcgcggacgcccacggccgctcccggttcggcggctggcggaacctgccctcccagccgcagaccaggcgctacctgatggcgggcgacgagcacgaggcccgctaccaccacacccggcacggcctgaccgccgaaggggtgcgcgtcgtgcacgcggacgccggcctcgtcgtcctcgaaatcggcggcgtacagcggaagttccgggtcagccgctacggcgaccaggtccatgtgaacgcgacggccctcacggaactgccccgcttccccgaccccgccgcccgccaggaaccgggttccctgctcgctcccatgccgggcaccgtcgtccgcgtcgccgaggggctcgccgaaggagcccgggtggaggccggacagcccctgctgtggctggaggcgatgaagatggaacacaagatctccgcgccgacggcgggcaccctcggcgccctgcacgccaccccgggccaacaggtcgaggtaggcactctgctcgcggtagtacagcgcgccctt

SEQ ID NO: 3851 - DNA, 1596 bp, Streptomyces avermitilis
  CDS (1)..(1596)
gtgacggtcctcgcatccgcgctcgacaccacgggccccgagtacgcggcgaaccgtgaagccatgctcggcaaactcgcccaactgaccgccgagcacgccaaggcgctggccggcggcggtgagaagtacgtcgcccggcaccacaagcgcggcaaactgctcgcccgtgagcgcatcgagctgctgctcgaccccgacacgcccttcctcgagctgtcgccgctcgccgcctgggggagcgagtacgcggtcggtgcctcgctcgtcaccgggatcggtgtcgtcgagggcgtcgagtgcctgatcaccgcgaacgacccgaccgtgcgcggcggcgccagcaacccctggagcctgaagaaggccctgcgcgccaacgacatcgcgtacgccaaccgcctgccctgcatcagcctcgtggagtcgggcggcgccgatctgccgtcccagaaggagatcttcatccccggcggcgcgatcttccgcgacctcacccggctgtcggcggccgggattccgacggtcgccgtcgtcttcgggaactcgaccgcgggcggcgcgtacatccccgggatgtccgaccacgtgatcatggtcaaggaacgggcgaaggtgttcctcggcgggccgcccctggtgaagatggccaccggcgaggagagcgacgacgagtccctgggcggcgccgagatgcacgcgcgcgtgtcgggtctcgccgactaccacgccgtcgacgagcaggacgccctgcggcaggcccgtcgggtcgtggcccggctcaaccaccgcaaggcgtacggcgatccgggccccgccgtccccccgaagtacgacgaagacgaactcctggggatcgtgcccggcgacctgaaggtgccgttcgacccgcgtgaggtcatcgcgcgcgtggtcgacggctccgacttcgacgagttcaagcccctctacgggacgagcctcaccaccggctgggcgaccctccacggctatcccatagggatactcgccaacgcccagggcgtgctcttcagccaggagtcccagaaggccgcccagttcatccagctcgccaaccagcgcgacatcccgctcctcttcctgcacaacaccaccggctacatggtcggcaaggagtacgagcagggcggcatcatcaagcacggcgccatgatgatcaacgcggtgtccaactcgaaggtcccgcacctctccgtcctcatgggagcctcgtacggggccggtcactacggcatgtgcgggcgcgcctacgacccccgcttcctgttcgcctggcccggcgccaagtccgccgtcatgggcccccagcagctcgccggcgtcctctcgatcgtcgcccggcagtcggccgccgcgaaggggcagccctacgacgaggacgccgacgccgcgctgcgcgccatggtggagcagcagatcgagtccgagtccctgccgatgttcctgtccgggcggctgtacgacgacggggtcatcgacccgcgcgacacccgcaccgtcctcggcctgtgcctgtccgcgatccacacggccccctacgagggcgtgcgcggcggcttcggcgtcttccggatg

SEQ ID NO: 3852 - DNA, 1686 bp, Streptomyces avermitilis
  CDS (1)..(1686)
gtgaccgagccgaccgccccgctgcgcataggcaacttctccggcttctacggcgaccgtttcgacgccctccacgagatgctcaccggcggcgaactggacgtcctgaccggcgactacctcgccgagctgaccatgctcatcctcggccgcgaccgcctgaaggaccccaccgccggttacgcccgcaccttcctccgccagctcgagggctgcctcggcctcgcccacgagcggggcgtgcggatcgtcaccaacgcgggcggcctcaaccccgccggactcgccgacgccatccggaacctggccggacgcctcggcatccccacccgcgtcgcccacgtggagggcgacgacctcaccgccgcgcacccgggcagcctcgccgcccacgcctacctcggcggcttcggcatcgccgcgtgtctgcgcgagggcgccgacatcgtggtcaccgggcgggtgaccgacgcggccctggtcaccgggcccgccgccgcccacttcggctggcagccgggggagtacgaccggctggcgggcgccgtcgtcgccgggcacgtgctggagtgcggggcgcaggccaccggcgggaactacgccttcttccgcgacgcggacgtccgccgccccgggttcccgctcgcggagatccacgcggacggcaccggcgtcatcaccaagcaccccggcaccggcggcctcgtcgacgtcggtacggtcaccgcccagttcctgtacgagacggcgggcgcccggtacgcgggccccgacgtcaccgcccgcctcgacaccgtacggctcacccaggacggccccgaccgcgtccgcgtcgagggcgtacgcggcgaggccccgcccccggccctcaaggtcggccgcaaccggctcggcggcttccgcaacgaggtcgtcttcgtcctgaccggtctcgacatcgaggccaaggccgcgctcgtacaggcgcagctgaccgacgcgctcgccaagtccccgcccggcgaggtgcggtgggacctcgtgcgcaccgaccggcccgacgccgacacggaggagacggccagcgccctcctccgcctcgtcgtccgcgacccggaccaggaggccgtcggccgcgccctgagcggggctgccattgagctggcgctggccagttaccccggtttccatgtgctggcacccccggggaagggcgctccctatggcgtcttcgaggatgtgtacgtcccccatggcgccgtcgaccatgtggccgtcctctacgacggacgccgtatccctgtgtccccggcccaggacaccctcgtactccacgacgtggcggagccgccgctgcccgaggccccgccgccgggaccgacgcgccgcgccccgctgggactggtcgccggagcccgcagcggggacaagggcgggaacgccaacgccggtgtctgggtgcgcacggaggacgcctggcggtggctcgtccacgagctgaccgtcgaccgcttccgggacctgctccccgagtgccgcccgctgcccgtcgtgcgccacgtcctgccgaacctccgcgccctcaacttcaccgtcgagggcatcctcggcgaaggcgtcgccgcccagcaccgcttcgacccgcaggccaagggcctcggcgaatggctccgctcccgccacctggacataccggaggcactcctg

SEQ ID NO: 3853 - DNA, 801 bp, Streptomyces avermitilis
  CDS (1)..(801)
atgtccgatccgacacgcgtgctcgacgacctgcgtgcggagagcgaggaactcgaccggctggtagccgagttgagcccagagcaatgggccctcgcgacccccgccccgcgctggaccatcgcccatcagatcgcccacctggcctggacggaccactccgccctgctcgcggtcacggacgaggacgccttccgcgcgctggtcgacaaggccctcaccgcaccggagtcgttcgtggacgagggggcggaccaaggctcccgactcccgtgcgccgaactggtgaagcgatggcgcgagagccgcgccgccctcgaccgcgccctgcgcgaggcgccgcccggcgcccgcttcccctggtacggaccgcccatgtccgccgcctccatggcgacgggccggctcatggagacctgggcccacggccaggacgtagccgatgcgctgggtgtggtccgcacccccaccgaccggctgaagcatgtggcccgcatcggtgtgcgcgcacgggacttcgccttcggtatccatgggctccccgtccccgccgccgacgccatccgggtcgaactcaccgcgcccaccggcgagggcgagttgtggacgtacggccccgaagacgccccccagcgcgtcaccggccccgccctcgacttctgcctcctggtcacccagcgagcccatcgcgccgacctcgccgtacgggcgaccggccccgacgccgaccgctggctcgacatcgcccaggccttcgcggggccacccggcaccggccgccccgggaagggaacggcagag

SEQ ID NO: 3854 - DNA, 1719 bp, Streptomyces avermitilis
  CDS (1)..(1719)
atgacgaccgaccggaacaagacggccgagcgggacaccacccacaagcccttgagggtcacggcccggggaagggccgtcctggccgacccccggctcaaccggggaaccgcgttcaccgatgaggagcgccgggccctgggcctggtcggcctcgtgccgccgcgcgtgctcacccaggacgagcaggccgaccgcgcctatgcccagttccgggagcagcccggcgacctggccaagaacgtctacctgacggccctccacgaccgcaacgaggtgctgttctaccggctggtcggcgaccacctcgaggagatgctgcccatcgtctacacccccaccgtgggcacggccatcaagcgctacagctacgagtaccggcgcccccgtgggatctacctgtccgtgaacgcccccgacgacatcgaacgctccctgcgcgccgccggcctcggcgccgacgacgtcgacctgatcgtcgccaccgacggcgagggcatcctcggcatcggcgactggggcgtgggcggcatcgacatcgccgtcggcaagctcgccgtctacaccgccgccgccggcgtcgacccgcgccgcaccctgcccgtcatgctcgacgtcggcaccaaccgccaggagctcctcgacagccccctctacctcggcaaccggcacccccgcgtcgaccgcgacacctacgacgccttcatcgacgcctacgtcaccgccgcgacgaagctgttcccccgcgctctgctgcactgggaggacttcggacccgccaacgcccgccgcatcttcaaccactaccgcgacgacgtcttcaccttcaacgacgacatccagggcaccggcgcagtcaacctcgccgccgtcctctccggcgccaaggccggtgacctgcccctgcgcgaccaccggatcgtcgtcctcggcgcgggcagcgccggtatcggcgtcgccgaccagctccgggacgccctcgtcgccgaagggctctcgtccgacgaggccaccgcccgcttctggtgcgtcgaccgctacggcctgctcaccgccgaccagggcgacaaactccgcgacttccaggtgccgtacgcccgtcccgccgacgaggtgtccgactggcagcgcgacgacgacctgcccggcatcccgctcgacgaggtggtccgccgggtccatccgaccatcctcatcggcacctccggccagggcggcgccttcaccgagaccgtcgtccgcgagatggccgcacacaccccgcgcccgatcatcctgcccatgtccaaccccaccgacctcgccgaggccaagcccgccgacctgctcgcctggaccgacggcaaggcgctcgtcgccacgggcagccccttcgacccggtggaactcaacggcacgacctaccggatcggccaggccaacaacgccctgatcttcccgggcctggggctgggcgccatcgtcgcccgagccacccgggtcaccgaccgcatgctccgcgcggcggccgacgcggtcgcgaaccagacggacgtgacggacccgggcgcgcccgtgctgccacccgtccgcgacctccgcgagacctctttcgccgtggccgtggcggtggcccgagcggcggcggaggacgacgtcgcccgagccggcaccgacgacatcgaggcggcggtacgggcggtgacgtgggagccggtctatccgccggtccaggcggtg

SEQ ID NO: 3855 - DNA, 951 bp, Streptomyces avermitilis
  CDS (1)..(951)
gtgaacaaccccagcgccgtcccgtccccggcggctcctcccgtcgttcccgcgacggaccacgtacccacggcgggcggcggccccggtcgccggggcgccctcgggcccgtcggactggtcctcgccggaggcatctccgtgcagttcggcggcgcgctcgcggtgaccctgatgccgcgggccggggcgctcggcgtcgtcaccctgaggctggtcgtggccgcgatcgtgctgctggtggtgtgccggcccaggctgcgcgggcactcgcgcgccgactggggcaccgtcgtcgtcttcggcatcacgatggccgcgatgaacggcctcttctaccagtcggtcgcccgcatccccctgggccccgccgtcacgctcgaggtgctcggcccgctcgcgctctccgtcatcgtctcccgccgcgccctgaacctcgtctgggcgggcctcgccctcggcggcgtcttcctgctcggcggcggcggcttcagcgacctcgaccccgtcggcgtcgccttcgccgtgtccgcgggcgccatgtgggcggcgtacatcgtcttcagcgcgcgcacgggccgccgcttcccgcaggccgacgggctggcgctcgcgatggtggtcgcggcggtgctgttcgtgccgctggggatcgccgagtccggtacgaagctgctggcgccgaccacgctcgggctgggcgccgccgtggccgtactgtcctcggtcctcccctacaccctcgaactgctcgccctgcgccgcctgcccgcctccaccttcgccatcctgatgagcctggagccggccgtcgcggcgaccgcgggcttcctcgtcctgcaccagtcgctgtccgtcctggagtccctcgcgatcgcgctcgtcatcgcggcgagcatgggggcggtacggacgcaggtgggccggggcaaggcgctgccgccggacgcc

SEQ ID NO: 3856 - DNA, 2373 bp, Streptomyces avermitilis
  CDS (1)..(2373)
atgcacccgcagcaaagcgaacacggcgcgtacgcggactatgaagacggcgacggtcacggcgacggcggccgcgacggcgacggcgacggtgacttcgaggggagccaggaccccgacaccccgtccatccccgcccgcgtcgccttccggcgcttctggcccatgaccaaggggcttcggggctttctgctgatcgtctggctgtgcacggtgctgaacgcgctcaccgagaccgtcgccatcctgctcttcagcgacctcaccgaccacgccctgcaacagggttcgctggacgcgttctggagcccggccgcccagtggctgggcgtcgccgtggccggcgcggccgtcggcttcgcgggcaactccctcgccgcatgggccacggaacgcttcgtgatgcggctgcgcgagcacgttttcgaccacgtccagcaactgccgccgcacttcttccaacgccaccggcagggcgatctgctgtccaggctgaccgccgacgtcgaggcgatcgaacagatggtcgtgtccgcgatggtgggcgcggcgtccgcggccttcagcgcgctcttctacgcggcggcggcgttctggctgcgctgggacctggcggcggcgaccttcgtcctcgcaccgctgttctggctggcggcccgacgcttctccggcagcatcaagtccgtctcgcgcgagggccgggtcgccgacggcgcgatcacctcggtcgtggaggagtccctcggcaacatcgtcctcacccaggcctatgaccgccgggacgccgaacgccggcggctgaaccaggaggcgggcgcctggttccgggccgcggtccgctcgacccgcctcaacgagctgtacgagcaactcgtccaggtcatcgagacggtgtgcgtgctggcggtgatcggcctcggcgtgtgggagatctccaccggccgtatgacgctcggtcagctcctcgcgttcgccgccttcctcggctatctctacccgcccgtccgcggcctggcccagctcggcctcacggtcacggcggccacggcgggggccgagcgtctgatcgagatcctcgacgtccggcccgcggtggcggaccccgcgcgcacgtcggagagcatcggccgccccgacggctcggtggaggtgcgggacgtctccttccgctacccgggcgcggacaaggcggccctggaagggctgtccttcgcggtccgccccggcgagctggtgatcatcaccggcccgagcggtgcgggcaagtccacggtctccaaactcctcctgcgcttctacgacccggacgcgggctccgtcctcctggacggcgtaccgctgaacgcgttcccgctggcccgactgcgcgagtacgtcacgctgctgccgcaggagaccctggtcctgcacgacaccgttcgcgcgaacatcgcctgcggccgccccggcgccagcgagcacgcgatcgtcgaggcggcgaaggcggccgacgcgcacgcgttcatcaccgggctgcccgacggatacgacacccgggtcgaccccaactccgcccggctgtccggcggccagctccagcgcctcgccatcgcccgggccatcctgcgtgacgcgccggtcctggtcctggacgaaccgacgacgggcctggacgcgatggccgcccgccgtgtggtcaggccgctgcgccgcctgatggcgggccgtacgacgatcatgatcacgcacgatctgaacctggcccccgacgcggaccgcatcctggtcgtcgaccacggccgcatcgtggaaacgggccgccacgacgacctcctgtcccgcgcgggcgcctacgcccgcctgcaccgctcccagaacaacgccctcatggacacgggcgagctacgactgccgctgttcacgggcccggaggggcgcgccgagcagttcgcgtacgggaccgcgcacggcgccacgcccggggcggttcccggtaccgcacccggcgccgttcccggtaccgcgtacggcgccgggcacgggaccgcgtacgcagccgttcccggcaccgtgtaccaagcggcacccggcaccgcgtacgcagccgtccccggcaccgcgcaccatgccgcaaacgggaacgcgtacggaacctcggaccaagtcgcgtacggaacctcggaccaagtcgcgtacggaacctcgaaccaagccgcgttcggaacctcctacggagccgcaggcggaatcccgacggaccccccgtacagcgccccgtacaactccccgcacagccccccgtacggattcaccgccgacgttccgtccgacttccccgtcacactccccggcggtcgccccctcttccgcgacgaggtgccctggcacggcgtc

SEQ ID NO: 3857 - DNA, 183 bp, Streptomyces avermitilis
  CDS (1)..(183)
atgcgaagagggccgatggtgcaccatcggccctctttctcaccgctggatcacttgccgtcgaccctgggcggcttcggcgcgtgcttcggcttcggcttgggcttcggcgggggcgggagcagcttcgacttgggcttcgggggcagcggggccagcttcttgaagctcattccgactcct

SEQ ID NO: 3858 - DNA, 564 bp, Streptomyces avermitilis
  CDS (1)..(564)
gtggacgacctccaccgcggcctcaaccagcagtggcgccgcaacatcaagaaggccgagaaggccggcgtgaaggtggtgcagggcggctaccacgacctgccggccttctacaccctctacaccgagaccgcggcacgcgaccgcttcatcccgcgccccctcccgtacttccagcgcatgtggaccgcgctgaccgccgaggacccccaccggatgcggctctacctcgcccaccacgggggcgaagtgctgtccgccgcgacgatgctgacggtcgggacccacgtctggtactcctacggggcctccacgagccgtcgccgcgaggcccagcccaacaacgccgtccagtggcgcatgctgaccgacgcccatgcgcgcggcgccgaggtctacgacctgcggggcatcacggacaccctggaggactccaaccacctcctcggcctgctccgcttcaaggtcggtacgggcggcgaggcggcggagtacctgggcgaatgggacttcccgctgaaccgcctgctgcacaaggcgctcgacctctacatggcgcgccgc

SEQ ID NO: 3859 - DNA, 540 bp, Streptomyces avermitilis
  CDS (1)..(540)
atgagcctgcgtgtccagcccatcacccgtgaagaacatctggcgttcgtcgcgtcccgcccgtccgccagccatatgcaggtgccttcctggggtgatgtgaagccggactggcgggcggagagcctcggttggtacgacgagggcgacggcggcgcacggggcggtcggctggtcggggcggggctcgtgctgttccggcccctgccgaagctgaagcggtacctcgcgtacctccccgagggcccggtcatcgactggtacgtgccggacctcgaccgctggctggacccgatgctggcgtacctcaaggcgcgcggggcgttctcggtgaagatgggcccgcccgtggtcgtacggcgatggagcgcggacgcggtcaagacggcgatcgccgacccgggcgcgcaccgcctgcgggacgtgaccgcgaccgcccacgagccgcgcgccttcgacgtcgcggaccggctgcgccggatgggctggcagcagaccgagccggccggcgaggacgggttcgcggccggacagccgcgc

SEQ ID NO: 3860 - DNA, 2946 bp, Streptomyces avermitilis
  CDS (1)..(2946)
gtgcgcggcgaggtcgccttcgacgcgacggcgcgggcgctcaccaccatggacgcgtccaactaccgccgggtgcccctcggggtggtggccccccgtgacgccgacgacgtggcggcggcgctctccgtgtgccgcgcgcacggggtgccggtcgtgccgcgcggcgggggcacgtcgatcgccggccaggcgacgggcacgggcgtggtgctcgacttcacccggcacatgaaccggatcgtgtcgctggacccggcggcgcgcacggcggtggtgcagccgggggtggtcctcgaccggctccaggaggcggcggccccgcacggcctgcgcttcggcccggacccctccacccacggccgctgcacgctcggcgggatgatcggcaacaactcgtgcggttcgcactcggtggcctggggcacgacggcggacagcgtgcgcgagctgaaggtgatcaccggccgcgggcagcggctgaccctgggccgggactgggcaggcgcccccgaggggctgcgtcccctggtggacggcgagttggcgcgcctgcggaccggattcccggcgctcccgcgccgtatctccgggtacgcgctggacgcgctgctccccgagaagggcgcggacgtcgcccgttcgttctgcggctccgagggcacgctgggcgtgctgacggaggcggtcgtccggctcgtcgaggccccccgcgcgcgtgcgctggccgtgctggcgtacgcggacgagggcgcggcggccgacgcggcggccggactgctgccgtacgggccgctgacggtggagggcatggcggcggatctggtgccctccccggccgatctgccgaggggcggtgcctggctgttcgtggagacgggcggcgcgacggaggcggaggcacgcgcgcgtgcgcaggcgatcgtgcgggcggcggacgtcatggacgccctcgtggtcaccgatccggccggccagcacgcgctgtggcgcatccgggaggacgcgagcggtacggcgacccggatgccggacggcacggaggcctggcccggctgggaggactgcgcggtgcagccggcccggctgggcgcgtatctgcgggacttcagaggcctgatgtcggcacacggcctgcgcggcacgccgtacggccacttcggcgacggctgcatccacgtccgcatcgacttcgacctgctgaccgaggtcgggatcggccgcttccggcgcttctcgcaggagctggccgacctggtcgtctcccacgggggatcgctgtcgggcgagcacggcgacgggcaggcgcgggcggagctgctgccgaggatgtacgggccggagctggtcgccctcttcgagcggacgaaggacatctgggacccggacggtctgctcaacccggggatgctcgtgcggcccgcccgcctcgacgagaacctgcggttcgcggtgctgccgaggaagccggtggacgtggagttcggctacccggccgacggcggggacttctcggcggcggtgcgcagatgcgtgggcgtggcgaagtgccgtacgacgtcggtgtccggggcgggcgtcatgtgcccgtcgttccgggcgacgggcgaggaggagcactccacgcgcggccgggcgcggttgctgcacgagatgctggccggcgaggtgatcacggacggctggcggtccgctgaggtgcgggacgcgctcgacctctgtctctcctgcaagggctgccggacggactgcccggtcggggtcgacatggccacgtacaaggccgagttcctgcaccaccactacgagggccggcggcgccccgcggcccactacgcgatggggtggctgccggtgtggctgtcggcggtctcccggacgcgggcgggggccgtggtcaacgccctcgcctccgtagggccgttggcggccgtggccaagcggctgggcgggatcgcgcccgagcgggggattccgcgggtggcgcgggagacgttcagccggtggtggtcgcgcaggttccgggaccgggtgcgggcgttcgtgcgggaggcgaagcggggggagcgcacgcgggtcccgggcgccggacgggagagcgtcgtgctgtggcccgacaccttcaccgagcacctctcacccgctgtgggccgcgcggccgtacgggtcctggaggcggcggggctggcggtcctgctgccgcccacgttccgcatgaagtcgcccgcggtcatggacggggtgtcgaaggcgccggccggcttcaacgtgttcatgccgcaccgccgccggcgcgtctgctgcggcctcacctacgtctccacggggcaactggaccgcgcccgcaccgtgctgcgccgcacgctggacctgatggagccggtcctggacgccggcctgcccgtcgtcgtcctggagccgagctgtgcggccgccctgcgcaccgacctcccggagctgctgcacgacgacccgcgcgcggcccggctcgcggcggcggtggtgacgttcgcggaggcactggagcgccacgcccccgcctggaccccgccccgactggaccgcccggtgaccggtcagacccactgccaccagcacgcggtcctgggcgacgcggcggaccgccgcctgcgcgaggcggcgggcctcaccggtgaactgaccggcggctgctgcggcctggcgggcaacttcggcttcgagaagggccactacgacatctcgacggcctgcgcggaggaccaactgcttccggcggtacgggcgtccacggccgacacgatcgtgctggcggacggcttctcctgccgcacccagctggagcaactgggcggcgtacggggacggcatgtggcggaggtgctggcggagggactgggagaggcaccgggggacgtgctggggaagggaccggggggcgggccggggggcgggccgggggagaga

SEQ ID NO: 3861 - DNA, 2238 bp, Streptomyces avermitilis
  CDS (1)..(2238)
atgaccgcgcccctccccccaggcgaacggcccaccctcggctccatcgcacccttcccgctggtcaccgccgtcgcggcggggatcgcggtggccggcgcggtcttcgcggctccggactcggtacgcgcccccctcgcctggggcggcggcgcggccgtgctgctgctgtgcacggcggtcgccctcgccgcccacggcatgcgggcggcgaagctggcgcgcggacggctggacgccgtgacgcgggacgcggggcggctgttgcaggaacgggcccggctggccgaggacttcagccaggagcggggccggctgacggacgggttcatcgaggaacgcgcacggctgaccgaggacttcgcccgcgaacgcgtccgcctcaccgacgagttcgcacaggagcgggcccggctcaccggcgagttcgaccaggaacgcacccgccgtaccgaggagttcgaccgcgaacgcgacgaactcaccacggactacacccgggaacgcgaccgtctcaccgccgacttcacccgggaacgcgacaagctcaccgccgacttcaccggcgaacgcgaccggctcaccgccgacgtcacgcgactcaccgccgacgtcgcccggctcaccgaggagaacgcccgcctcgccgagcgcgcccgtcacgccgccggcgcccgtgcggccgccgtctccgtgaccggcaacgtggcgggccgtatgcaggccctcgccaccgggatgctcgccgacctgcgcggcatggaggagcggcacgccgacgaggaggtcctcaccgacctgctgtacctcgaccaccgcaccgcgcaggcgggccgcctcgccgactccgtggccgtgctcgccggcgcccgctcgggccgccgctgggcacgccccatcgtcatggagtcgatcctgcgcggcgcgatgggccgcatcggcggctaccagcgcgtgcgcgtccactcctccagcgaggccgccgtcgccggacacgccgccgagggcgtgatgcacgcactcgccgaactcctcgacaacgccgcgaacttctcgccgccgaccgccgaggtccacgtgtacgtcgaggaagtgccggccggtgtcatcgtctccgtcgaggacagcggcctggtcatgagcgacgtgcagctgcgccgcgccgaacgcgccgtgtccggcgagagctccgacctcggcggcctcaccggcacccggctcggcctcgccgtcgtgggccgcctggcccgcaagcacggcctgaaggtgtccttccgcccgtccgcgcgcggcggcacgggcgtcctggtcctcatcccccaggacatcctgtcgacggtgccggcggtccccccggcgcccgcgcccgcgcagcccgtcaccgcggccgccgctgcgaccaccacggctgcgaccgccgtcgaaccggctgccacggatccggccgtcgcgacctcgacggacgcgacctcgacggacgcgaccacgccggacgcgtctcccgcgaccgctccgcccgccgccgctccgcccgccgccgctccctcgcgccccctcccgtcgtacgccgccgcccgctcccccgaggacctcgaccccgacccggtccccacccacgagtcggccgagcgcggcggcggcgacacgggcggcctccccaagcgccgccggggccgcgccctcgccgaggccgaacgcggccgcccccacgccaccggccggaccgagcgcgagccccgcaccgccgacgacgccaaggcgagggtcgcccgcttcagcagcttccgccaggcggtacgcggcacaatgcccgaccaggccgcagtccagggcacgacaaccgatccgacgcccgaggcccaggaccgggaccgcgcccgggccgaggaccgagaccggaaccgggccaaggccgagggccgaaaccaggaccaggccgagggcggggaccgggccgagggcagggaccgggccaaggccgaggaccaggcccaggaccgggaccgggaccgggaccgggaccaagtgcaggtgcaggtgcaggaccggcaccccgccaagctcaccaagcccaccaagcccgcaccccccacgacacccccggcccccgtacgagccacagcacccgccacccccgtacaggacccgccgcccgccaccccctcgcagtcccagccgcacccccagccacagccgcacccccactcgcacgcgcacccggaaggcgacaccacttca

SEQ ID NO: 3862 - DNA, 405 bp, Streptomyces avermitilis
  CDS (1)..(405)
atgaccggcaccaccacggccgacgagaaactcacctggctcatcgagggtctgatcgagcgcaccccgggcacccggcacgcgctcgtgccctcccgcgacggcctgaagctgtgccgtacgccggaactgtccgtcgaccaggccgatcagctcgccgcgatcgcggccggcatccagtcgctgtcccacggggcgtccgtggagttcggcgacggcagcgggggcgtgcgctcggccatggccgagttctacggcggggtcctgttcatcgtggaggcgggcgagggcgcacatctcgccgtggtcaccaccgaggacgcggacgcgggtctggtcgggcacaacatgagcgaactcgtggagcagctcggcgaacacctgagcgcgccgcctcgtacgtca

SEQ ID NO: 3863 - DNA, 345 bp, Streptomyces avermitilis
  CDS (1)..(345)
atgagccgcccgggcagagacgacgcgcccgaccggctgtacaccctcacgggaggacgcagccggtccggcgacgactcccgcttcgacctcgtgaccctcgtggtggccgagtgcgatccggtgccgggcatgcagtcggagcacgccgcgatcctgcggctgtgcgaccggccgacggcggtcgtggagatcgccgccgaactgcggctgcccgtgagcatcacccggatcctgctcgccgacctgctggccgcgggccgcatcagcgcccgccatccgcgcaaggccgcgcttcccgaccccgacatcctggagcaggtgctcgttggactccgcaacctc

SEQ ID NO: 3864 - DNA, 540 bp, Streptomyces avermitilis
  CDS (1)..(540)
gtggtcgtcggcggcttcggcgtcggcaagacgaccctcgtgcgctccgtgagcgagatacgcccgctcagcaccgaggagacgatgacccgggccggcgagacggtcgacgacatcagcgaggtgcgcggcaagtccgcgaccaccgtcgccttcgacttcggccgtatctcgctcgacacccgcaacatcctctacctcttcggggcgcccggccaggaacgcttctggttcctgtgggaccgcctcttcgccggcacgctcggcgcggtcgtcctggtcgacacccgccgcatcgacgactcctggtacgccatcgaccgtctggagcggcacggcacgccgttcatcgtcgcctgcaacgacttcggcggccccgcgcacacccccgaacagatccgcgaggccctcgacctcgacccgcacgtcccgctgatcgactgcgacgcccgctcgcgggagtccagcaagcgggtgctgatcaccctggtcgagcacctcaagagcctgtacgtcccccgagccccggagttggccctg

SEQ ID NO: 3865 - DNA, 1233 bp, Streptomyces avermitilis
  CDS (1)..(1233)
gtgacccccgccccggcccccgcccccgttccgctgagcggcccccggttccagaccgaccccgccgccctgtaccgggagatgcggcgcgaacacggttccgtggcaccggtgctgctcgacggcgacataccggcgtggctggtgctcggctaccgcgagctgcaccaggtcaccggcgaccccgtgctgttcagccgcgactccgagctgtggaaccagtggccgaacattcccgccgactggccgctgctgccgatgatcggccacaagcagccgtcgatcctctacacggtcggcgagcgccaccgcgagcgcgccgcgatgatcagcgacgccctggaggccgtcgaccccttcgaactgcggtccctcaccgagaagttcgccgacgagctgatcgacgcggtgtgcgccaagggcgagacggacctcgtcgccgactacgcggccctgctgcccgtacgggtcctcgccctcctctacggcttcgccgaggaacagggccctggtctggtcaccgcgctgaacgacatgatcgacggccgtgaccgggcgatcgccggacagacccatctggccacgtccatggcgcagttgctcgccgaccgcaaggccgagcccgcgaacgacgtggtcagccggatgctggcggattcgggtggcttcacggacgaggagatcgcccaggacctgatggtcatgatggccgcgggccaccagccgaccgccgactggatcggcaactcgctgcgtctgatgctgacggacgagcggttcgccgcctcgctgttcggcgggcgcaacagtgtcgccgaggccatgaacgaggtcctgtgggaggacacccccacccagaacgtggccggccgctgggcctcccgcgacacccagctcggcgggcgccgcgtccgcgccggcgatctgctgctgctcggcctccagggcgccaacaacgacccgcaggtacggatcgacggcgccgccctgaccggcggcaacaacgcgcacttctccttcgggcacggcgagcaccgctgcccgttcccggcgcaggagatcgcggaggtcatcgcccgcaccggtatcgaggtcgtactggaccggctgccggacatcgacctcgcgctgccggccggctccctggcccggcggccctccccctggctgcggggactgacggaactgcccgtgaagttcacgcccatccccgcccttggaggttcccccgca

SEQ ID NO: 3866 - DNA, 1200 bp, Streptomyces avermitilis
  CDS (1)..(1200)
atgacgactcgtatcgccctggacccgttcgtctccgacctggaggctgagagcgccgccctgcgcgccgcgggtccgctcgccgccgtcgaactgcccggcggggtgcccgtgtgggcggtgacgcaccacgccgaggccaagaagctcctcacggatccccggctggtgaaggacatcaacgtctggggcgcctggcagcgcggtgagatagccccggactggccgctgatcggcctggccaaccccggccgctccatgctcacggtggacggcgcggaccaccgccggatgcgcaccctggtcgcgcaggcgctcacgccccggcgtgtggagcagatgcgggagcggatcaccaagctgacggaggagctcctcgaccggctcaccggcgaggtcgtcgacctgaaggccgacttcgcctaccccctgcccatgtacgtcgtcgccgacctcatgggcatcgacgaggcgagactcccccggctgggggagctgttcgagaagttcttctcgacccagaccccgccggccgaggtcatcgccaccctcaccgagctcgccgggatcatggcggagacggtggccgccaagcgggcggcaccgggcgacgacctgaccagcgcgctgatcctggcctccgaggacggcgaccacctcaccgacgcggagatcgtctccacgctccagctgatggtcgcggccggccacgagacgacgatctccctcatcgtcaacgcggtcgtcaacctctccacgcaccccgagcagcgcgccctcgtcctgtccggcgaggcggactggtcgtcggtggtcgaggagacgctgcgctactcgacgccgacctcccacgtcctgatccgcttcgcgaccgaggacgtcccggtcggggacaaggtgctcccggcgggtgacgcgctgatcgtgtcgtacggcgccctcggccgcgacgaggcggcgcacgggccgacggcgggcgagttcgacatcacgcgctccacggagaaccggcacatctccttcggccacggcccgcacgtgtgcccgggcgcggcgctgtcccgtctggaggcgggcgtcgcactgccggccctctacgcccgcttcccgaagctggacctggcggtcccggcggcggaactccgcaacaagccggtggtgacccagaacgacctgttcgagctgccggtgcggctgggc

SEQ ID NO: 3867 - DNA, 1116 bp, Streptomyces avermitilis
  CDS (1)..(1116)
gtggctgagatccagattccttccgacatcaagcccgctgacggacgtttcggcgcgggtccctccaaggtgcggacagaggcgctggacgccctggccgccacgggcagctccctgctcggcacctcccaccgacaggcgccggtcaagaacctggtcggcaaggtccgcgagggcgtcagcgagctgttctcgctgcccgagggctacgaggtgatcctcggcaacggcggctccacagcgttctgggacgtcgcgacccacgggctgatcgacaacaagtcccagcacctcagcttcggcgagttctcgttgaagttcgcgaaggccgcgaagctcgccccctggctcgccgagcccacggtcatctcctccgacccgggcacccaccccgagccggccgccgaggcgggcgtggacgtctacgccttcacgcacaacgagacctccaccggtgtcgccgccccgatcaagcgcgtcgcgggcgccgacgagggctccctggtcctcgtggacgccacctccggcgcgggcggcctgccggtcgacatcaccgagaccgacgtctactacttcgccccgcagaagtccttcgccgccgacggcggcctgtggctcgcggtgttctccccggccgcgatcgagcgcgccgagcgtatccacgcctccggccgccacgtcccggagttcttctcgatcccgacggcgatcgacaactcccgcaagaaccagacgtacaacaccccggccctcgccaccctcttcctcctcaacgagcagctggagtggatcaacggccagggcggcctggactgggcggtgggccgcacggcggcctcgtcgagcgcgctgtacggctgggccgaggacgtgaagtacgcgaccccgttcgtcaccgacccggccaagcgctcgcaggtcatcggcacgatcgacttcgcggacgaggtcgacgccgccgccgtcgccaaggccctgcgcgccaacggcatcgtcgacaccgagccctaccgcaagctcggccgcaaccagctccgcgtcgcgatgttcccggcgatcgacccggcggacgtcgaggcgctgacgaagtgcatcgactacgtgatcgagaagctg

SEQ ID NO: 3868 - DNA, 984 bp, Streptomyces avermitilis
  CDS (1)..(984)
atgcgcatgcgccgatcgtttccgttcctcgccgggtccgccctgctcgtcgtgctgtcggcacccgccgtcgccgccgacggggacgaggggttcaccatcggggactcccggatcaccgagtccagcggcctcgccgcctcgcgcctgcaccccggtgtctactggacgcacaacgacagcgacgacggcccgtacctctacgccgtggacagccggaccgggaagaccgtcgccaccgtcaccctgagcggcgtcggctcgccgcgcgacgtcgaggccatctccataggcccgggcaacgagatctatgtcggcgacatcggcgacaacctcggcggccagtgggaccacgtgtggatctacgaactgcccgagcccaaggtgctcgaggaccagacgatccgtgccacgcagtacgtcgtgaagtacgcggacggagcccgcgacgcggagtcgctgatggtgcatccgaagaccgggcgggtctacatcgtcgacaagaaggaggacggcgggcacctgtacgagggcccggcacggctctccgcctccgggacgaacgtcttcgagcccctcggcgccgtcggcctgtgggccaccgacgccgccttctcgcccgacgggaagcagctcgccgtacgcggctacttcggcgggatcgcgtacacgtggaacggcgggaagatcaaacggcaggggcagctcagcgtgccgttgcagcggcagggcgagtccgtcacgtacaccgccgacggctcggagctgatgtacgggagcgagggggcggacagcgcggtgaagccggggagcgtgccgggctacagcggttccggcgccaagtcgccctccgggggcggcggttcggcctccgcgcaggacggcgacagcgacggctcacacgcgaactacaaggtcggcgccctcgccctcgcggtcgccctggccctgggcctcggcgtcaagcggctgttgcgcaggggc

SEQ ID NO: 3869 - DNA, 684 bp, Streptomyces avermitilis
  CDS (1)..(684)
atgctcaggttcatgcccgtaggcgactcccagacgatcggaagcgcgggcgaacacacatggcgttaccggatgtggcagcatctgcgcgccgcgtacggcggaccgttccggatcgtcggcccgcgcgagacgctctacgacaaggccacggacgcccccgactcgtacgagtacgcggacccggacttcccccgcgcccacctggccggctggggcgagggctggctgcacatggccccgctgatcggcgaggcggtccgcacctgccgggccgatgtactgctggtggcgctgggcctgatcgacctgggcttctacacgaacgcgccccagacggcggagaacgtccggtccttcgtggccgaggcccgtacggcgaacccgcggatccggatgatcgtgcttccggtgataccgaacgtacgcgcggagtcggacaccgccttcgccgccgaggtcgcgtcgttcaacgaactcctggccaaggcggtcgccgacctggacgaaccccagtcgcccctgctgctggcctcgccgccgccgtcgtacgacaccgacttcgacacctacgacggaacgcacccgaacgcgagcggcgagcacaagatcgcggaggccttcgcggaggcgatgtaccaggcctgggacgtcggcgagccctacgccgccgccgacttcgcc

SEQ ID NO: 3870 - DNA, 792 bp, Streptomyces avermitilis
  CDS (1)..(792)
gtgaccgctctcgacgcactcgtacgcccggaccgctacccccgctcctccgcctacgaccccggctggctgctcggcctcgacatgggccccaaccccctgtggctgctggaggacctcgcgcgggacctggacctgagaccgggcatgcgggtcctcgacctcggttccgggaagggggcgacgtcggtgttcctcgcgcgggagtacggcgtcgacgtcgtcgccgccgactggtggatcggggcggacgaggcgacggccgtcttcgaggcggcgggcgtcggcgggcaggtggcggccgtacgggccgaggcgcatcaactgcccttcgaggaggggagtttcgacgcgatcgtgagcatcgacgcgttcgagtacttcggtacggcggacagctacctgccgtacctggtgaagttcctgcgtccgggtggccaactgggcatcgccacgcccgcgttgacccgcgagatccgcgaactcggcgcgatacccccgcacatcaaggccctggtcggctgggaggccatcgcctggcacaccgccgagtggtggcggttccagtgggagatcaccgagctggtgacggtgacgtccgcgcggctccaggaggacgcctggcgggactggctgctgtggagccgtgcgggtgcggagcacctgccggaggggcgggcggcccaccagccggtcatcgacatgctgaccgccgacgccggggagttcctctccttcgcgctggtgaccgcccggacccagggcccgtccggcggaccggcccggagcact

SEQ ID NO: 3871 - DNA, 1533 bp, Streptomyces avermitilis
  CDS (1)..(1533)
atgtctgctgacagcacggctgtcgtcgcccccgcggggccggacacatccggcgccggttccccgtccgccggccggcatctcggactcgccctggtcgtgatcgccgcggcccagctgatggtggttctcgacgccacgatcaccaacatcgccctgcccgccattcagacggacctgggtgtgtccgacgcgaacctggcgtggatcgtcaactcgtatgcgctggctttcggcggactcctcctgctcggcggaaaagcgggggatctcttcgggcggcggaagatgttccaggtgggcatcgccgtcttcacactggcgtccctgctgggcgggctcgcgccgaatgagggattgctgatcgccgcccgtattctccagggcgtcggagccgcgctcgccgcgcccagtgcgctggcgctcatcaccaccacgttccccgtgggaaagccgcgtaatacggcgatgggtgtgtacgcggccatgggcggcgtcggcgcgacggtcgggctgctgctgggcggcacgctcaccgacgtactggactggcgctgggtgttcttcgtcaacattcccatcgggctcgcggtgctggccgggacgcggacgctcgtcgaggccgagcgtcaccccggtcgtctggacgtgcccggcgccatcgccggcacaggtgggctgatcgccctggtccacggcatcacgcgcggcggcgaacacgggtggacgggcgggctcacgctggcctccttcgcggcggcggccgtgctgctggcggcgttcctgtggcttcaggcgcggaccgcgcacccgatgatgccgctgcggctgttcaagaaccgtagccgctccggcagttacgccacgatgctgttcatcggcgcggggatgttcgcgaccttctacttcctgacgctgtacgcgcagctgatcctgggctacagcccggtcaggaccggcttcgcgtttctgccgttcagtttcgggatggcggccgccgcgggagtcagctccaagctggtcgcccggttcgcgccgcgggtgatcgccgggccggggctgctggtcgcggccgtgggcatgttctggttcgcgacgctggagccggactcctcgtatgccgggcatctgatgcccgccatgttcgtcaccgccctcggcctgggcatgagcttcgtcccgatgaccctcggcgcggtcagcggcgtctcccacgaggacaccggagtggcctcggcgctgctgaacaccgcccagcagatcggcggcgcactcggcctcgccgtcctgtcgaccgtctccacctccgcggccgacgacaagctgccggaggcggccggagccctctaccggggcctggcggccaaggactccgccctggtcgccgaggcgggcgacgcgctcacccacgggtacaccatggccttcgccgcggccgccggcatgttcctcgccggtctggccgtcaccgccctggccgtcaacgccggcaagcagcggcacgtcgagggcgcggccccggtccacatgggc

SEQ ID NO: 3872 - DNA, 696 bp, Streptomyces avermitilis
  CDS (1)..(696)
gtgagcattcctttgcgtacccgggtgcgggccgggaattcgagcgcgttcgcggagctgtacgacagctacgcccgcgcggtctacaaccatgccttccggctcaccgccgactggtcgacggccgaggacgtgatggccacgaccttcctggaggcctggcggctgcgtgaacgggtcgaccccgagggcggctccctacggccctggctgctgggcatcgccaccaacaccgcgcgcaaccagtaccgcagcaaccgtcgctaccgtgccgccgccaacgccgccgccgctgcccagctgtcggtccccgaccacgccgacgaggtcgccggccggatcgacgaccggcaccgcctcgcgaccgccctcaccgcgctcgccgccctgcgccgacccgaacgcgaggtcatcgcgctctgcctgggcgagggcctggactacgaggccgcggcggaggccctgggcatccccgtcggcaccgtcgcctcccggctctcccgcgcccgcaagaagctgcgcgcgctcgccggggccgaagcggacgcccgcccggcagccaagtcggcgtcggcatcggcgtcggcgtcggcgtcggcgaagaaagttcgcgggaagcgggaaggcgcccgccccggccgacagacaagaggcgatcacgcacacgcgatccggcccgcacaggaaggaaaccga

SEQ ID NO: 3873 - DNA, 1107 bp, Streptomyces avermitilis
  CDS (1)..(1107)
atgaacgcgaacacgtcccggcagcacccggccgagtgggaagagggcgcacagctctttacccggacggcgcgcgacctgccgacgggccgtcaccagttccacaaggagcgtctgatggcccagatccagcaggagcagcaggagcagcggggcgagcacacgggcaggtccgcggtcccggcgaagacgcggcggctgcggctgccgcgcccggcgatcgtcctgcccgcgatggccgccaccgtcgccgcggcggtcgtcgccggggtggcgatgtccgacggcggcggggtcagggacggcggtgtcgccaccggaccggccctgaccgccgaggtgggcgccgcgaccagcaagggcctaccccagctgctcgaccagatctcgctggtcgccgccaaggagtcccacccggtcgtcaagcccggccagtacgtctacatcgagtccaagacggccgacaccttcctgaagaccgtcgacgacaagaccagcctggccagccacgcgctgcaccgccgccaggtgtggaactcccccgacggcaccaagggttggctcatcgaccccgccgtcaacacggactccgcgggggagaccctgagcctgcccgacgagcagggcaacacccccaagggcagcctcaactacccgacgtacgactacctcgccaagctgaccaccgaccccgaccagctcctcgccctgatctacaaggagaccaagggccagggcaacacccccgaccagcaggccttcaccaccatcggcgacctgctcggcgagagctacccgccggcggagctgtactcggccctgttcaagaccgccgcgaagattcccggcgtcgtcgtggtgccggaagcggtggacgcggtcggcaggaccgggatcgcggtggcccgcctggacgagaccagcggtcagcgcgaggagtggatcttcgacaggaagacccacgtcttcctcggcgagcgctccgtccaggtgaagaagaacaccggcacggaggccctgatgaagcccggcacggtgaccttcaccagcgcgatcctccaccgggccgtcgtcgacggcatgaagcaggcaccgtcacaggcgggc

SEQ ID NO: 3874 - DNA, 990 bp, Streptomyces avermitilis
  CDS (1)..(990)
atggagtacacgcagctcggacgcacaggactcaaggtcagccgactcgtcctcggcaccatgaacttcggtccgcagaccgacgaagccgacagccacgcgatcatggacgcggcgctggacgcgggcatcaactacttcgacaccgccaacgtgtacggctggggcgagaacaagggccgtacggaatcgatcatcgggaactggttcgcgcagggcggcgaccgtcgcgacaaggtggtcctggccaccaaggtgtacgggaacatggccgccggcggcgacccctggcccaaccacgacaagctctccgccctgaacatccggcgggcggtggacgccagtctgaagcgcctccagaccgactacatcgacatctaccagttccaccacgtcgaccgctcgactcccttcgaggagatctggcaggccgtcgacgtgctggtgcagcaggggaagatcctgtacgtggggtcctccaacttccccggctacaagatcgcccaggccaacgagatcgccgcgcgccgccacggcaccatcgggctcgtcagcgagcagtgcctgtacaacctcgccgagcgccgcgccgagatggaggtcatcccggccgcgcaggagtacgggctcggtgtcatcccgtggtcgccgctgcacggcggactgctcggcggtgtcatcaagaaggaggccgagggcggccgacgcgcctccggccgggccgccgactccctggccaacaccgccatccgcgcgcagatccagtcgtacgaggatctgctcgacaagcacggggtcgagcccggcgaggccgcactggcctggcttctgacccgccccggagtcaccggacccatcgtcggcccccgcaccgccgaacagctcgactccgccctgcgcgccgtcgagctggagctgtcggaggaactgctgtccggcctggacgagatcttcccgggcccggggccgtcacctgaagcgttcgcctgg

SEQ ID NO: 3875 - DNA, 1050 bp, Streptomyces avermitilis
  CDS (1)..(1050)
atgaaggcgatcgcgttcagggagaccggcggacccgaggtgctgcgcctcgtcgaactccccgaccctcagcccggtcccggcgaggtcctgatccgcgtcgcctacgccggcgtcaactacggcgaggtccagcaccgcctgggcgacttcggcgcgcccgagggcgagacggtcaccggtctggaggcggccggtcacatcgccgcgctcggcgacggcgtgacgggcccggcggtcggtgacggcacgggggtgagcggccggtccttcggtgacggcgacggggcgcgcggcctgtccgtcggcgatgccgtggccgcgtatctccccgacggcggcgggtacgccgagtacgtcgtcgccccggccgccttcgtcttccccctcggtggcctcgacctgcgcaccggcgggggcgcggcgctcgtcctgaccacggcgtacggtgtcctcgccggcgcggctcgcatcgcccccggcgagacggtactgatccacgcggcggccggaggcgtcggctcggcggcggcacagatcgcccgcgccctgggagccacggctgtgtacggcacggtcggcacccccgaaaaggccgcgtacgcgaagcgcttcggctacgacgcggtcttcgtgcgcgacggtttcggggacgcggtccgcgcggccaccggtggccggggcgtcgacatcgtcctcgacccggtcggcggcccgacccgcctggccggcttcgaggtgctcgcccccttcggccgccttgcggtgtacggagaagcgggccgccaccccgacctgcggctccccgtcctccccctctggaagaacaaccgcaccctgaccggctacaacatcggcgacctcgcccgccgtgacccggccctcgtccgcacccacgccctcgcggccctcgccctggccgcagcgggcgacctccacatcgacatcacggacgagtacgccctgcccgacgcaccgcaggcccaccgggtactccagtcgggggcgaaccgggggaaggcggtgctcgcggtggcgccgccgcgaccc

SEQ ID NO: 3876 - DNA, 570 bp, Streptomyces avermitilis
  CDS (1)..(570)
atgagactcttcgccgcggtgctgccacccgatgacgtggtccgggaactcgcctctgccgtcgacgagttgcaccggctgccgggagcggacgggctgcgctggacgggccgccccggctggcacttcacgctcgccttctacggagaggtcgacgacgaactcgtaccggagctctcggtacggctggagcgcgccgcccggcggaccgcgccctttccgctggcggtgcggggcggaggacagttcggccatgggcgggcgctgtgggcgggcgcggagggcgacctgggcaccctgcggctgctggccgagcgggcggaggcggcggccgggagggcgggcgtgccgatgggggagcaccgccgctaccgcccgcatctgacggtggcgcgcagccgcgacgcggtcgacgcgcggccctacgtcgaggccctcgacaccttcgcgagccgcacgtggacggtgggcgagctgtgtctcgtacgcagccggctgccgaagtcgggggtgccgggtgagcagccccggtacgagacggtcgccggatggccgctcggggcgggcgcc

SEQ ID NO: 3877 - DNA, 510 bp, Streptomyces avermitilis
  CDS (1)..(510)
atgaagatcaggaagggcaccaccgacgacatccccgccatactcggcctgctcgacggcgcggtcgcctggctcgtctcgcaggggcgcacccggcagtggggtacccggccgtggaccgagcggcccggggcggtggagatggtgcacacgtacgtggccgccggcactccgtggatcgcggaggtcgacggcgtccccgcgggcacgctcaccctcagcgagggccccggcggctacgtcgccccggcgggcgaacccgagcggtacgtgcatctgctcgccgccgaccaccggttcgccggccacggcgtcggcggggccctgctcgcgcacgccgccgaggagacacggcgggcgggggtctccctgctgcgggtcgactgctacgcgggggacgacggcaagctcgtcgcgtactacgagggcaacggcttcgtccggacggagcccttcaccgtgaccgtcgacggcgccgactggccggggcaggtgctggcacggcgggtg

SEQ ID NO: 3878 - DNA, 1344 bp, Streptomyces avermitilis
  CDS (1)..(1344)
ttgagtacgggatccggagcagactccgcccccgcacctgccgcccacgactccccgtccgcacccaggcgttcctccatgttcagctcgctgaggatcaggaactaccgcctcttcttcaccggccaggtcgtctccaacaccggcacctggatgcagcgcatcgcccaggactggctggtgctgagcctcaccggctcgtccaccgccgtcggtgtgaccaccgcgctccagttcctgccgatgctgctcttcgggctgtacggcggcgtcctcgtcgaccgcctccccaagcgccccacgctgctcgccacccagtcggcgatgggcgtcaccggtctcgccctcgccttcctgaccctctccggccacgtccaggtctggcacgtctacctggcggccttcgccgtcggcctcgccacggtcgtcgacaacccggcccggcagtccttcgtctccgaaatggtcggccccggccagttgcagaacgcggtcagcctgaactcggcgaacttccagtcggcccgcctgatcggccccgcggtggccggtgtcctgatcacgggcgtcggcacgggctgggcgttcctgctcaacggcctgtccttcatcgccccgatcgcgggcctgctcctcatgagctcccgcgagctgcatgtcgtcgagcgggccccgcgcggcaagggccagctgcgcgaaggcctccgctatgtcgccggccgcccggagctgatctggccgatcgtcctcgtcggcttcatcggcaccttcggcttcaacttcccggtctggctgtcggcgtacgcggacgacgtcttccacgcgggcgccggtgcctacagcctgttcaacacgctgatggcggtgggctcggtggcgggcgcgctgctggccgcccggcgcggcacggcccggctgcgggtcctgatcgcgtcggcggtggccttcggcgcgctggagatcgtggcggccgtcgccccgtcgctgtggctcttctcgctcctcatggtcccgatcggcatgttcggtctgacggtgaacgtcaccgcgaacacggccgtccagatgggcaccgacccggccatgcgcggccgcgtcatggccctgttcatgatggtcttcatgggcggtacgccgctgggcgcgcccgtggtcggctggatcacggacgcgtacggagccagggtcggcttcgccgccggcggtctcgtctcggccctcgcggccgtcacgatcggcctggtgctggcccgcgtcggcggtctgcgcctgtcggtcggctggcaccacgggcatccgcaggttcgcttcgtcccgcgcgagcgcgagctggcgacggcggcg

SEQ ID NO: 3879 - DNA, 435 bp, Streptomyces avermitilis
  CDS (1)..(435)
atggttgacctgacccatggcgacgacgctgccgccgtgaacgcccttcgctccgctgtgatgcgtctctcgcgccgactcaagcaccagcgggtcgacgagtcgctgagccccaccgagatgtcggtgctcggcaccctcgcccgctgcggctccgccacgcccggcgaactcgcccgcaaggagcacgtccagccgccctcgatgacccgcatcgtggccctgctggagagcaaggggctggtcaggctggagccgcatcccgaggaccggcgccagaaggtcgtcacgcagaccgagcgggccgaggcgatgctcgaagagagccgccgcagacgcaacgtgtggctggccggtctggtcgaggggctcgacgacgacgagtgggcgaaactccgcgccgccgcccccgtactggagaagctcgcccatctg

SEQ ID NO: 3880 - DNA, 180 bp, Streptomyces avermitilis
  CDS (1)..(180)
atggggaccagcgtgctcagcctgcggatagacggggagctgctcgagcggctccggcaccatgccgccaaaaggggaatgagcgtccaggactatgtcgtccggacgctcattcgggatgacttcgacgagcggtttcaggccgccgtcgacgagacggagaagttctacggggtcacg

SEQ ID NO: 3881 - DNA, 1449 bp, Streptomyces avermitilis
  CDS (1)..(1449)
atgtccacctcggcccccgccaaggttcccgcgcccgagcagccgggcgaccggcccgcatacggcgccctcgaccgctacttcaagatctccgagcggggcagcacgctgtcccgcgagatccgcggcggtttcgccaccttcttcgcgatggcgtacatcatcgtgctgaacccgatcattctcagcagcgccaaggacatgtacggccaccagctggactacggccagctggtcaccgcgaccgccgtcaccgccgccttcaccacgctcctcatgggtgtcatcggcaacgtcccgatcgcgctggccgcgggcctgggtgtgaacacggtggtcgcgctccagctcgcgccccggatgtcctggccggacgcgatgggcatggtcgtactcgccggcctggtggtgatgctcctggtcgccaccggtctgcgcgagcgcgtcatgaacgccgtgccgctcgggctgcgcaagggcatctcgatcggtatcggcctgttcatcatgctgatcgggctcgtcgactccggcttcgtctcccgcatcccggacgccgcccacaccacggtcccgctccagctcggcaccgacggccacctcaacggctggcccatcctggtcttcgtcctcggcgcgctgctcaccctcgcgctgatcgtccgcaaggtgccgggcgcgatcctgatctcgatcgtcgcgatgacggtcctcgcgatgatcatcaacgccgtcgcccatgtcccgtcctggggcctgaccaccccgaagtggccgggcaacccggtcgccagccccgacttcggcctgatcggcaaggtcagtctcttcggcggcttcagcgaggtcggcgcgctgaccggcatcctcttcgtcttcaccgtgctgctgtcgtgcttcttcgacgcgatgggcacgatcatgggcgtcagcgacgaggccaagctcaccgacgccgagggcaacatgcccggcatcaacaaggtcctgttcgtcgacggcatcgcggtcgcggcgggcggcgccagctcctcctccgccaccacctgcttcgtggagtccacggcgggcgtcggcgagggcgcgcgtacgggcttcgcgaacatcatcacgggcggcctcttcgcggtggccctcttcctcaccccggtcgccacgatggtcccgtcccaggcggccaccccggcgctgctcgcggtcggcttcctgatcctgtccaactcggtcaaggagatcgactgggcggactacacgatcgccatcccggccttcgtgacgatgatgatgatgccgttcacctactcgatcacgaacggcatcggcatgggtttcatcaccttcgtggtgctgcgcctggccgccggccggggccgcgagatcccggtcgcgatgtacgtcgtggcggcggtcttcggcttctactacctgatgccggcgctgggtctcaca

SEQ ID NO: 3882 - DNA, 264 bp, Streptomyces avermitilis
  CDS (1)..(264)
atggcgaaatggacccccacgcacgaggcgccggagcccctggagggccccgtggtcgccaccatcaccggcggcacgatcctgtggttcgtcctcttcctggtccagctcccgttctacggctggttcgacgaccacgggcacacctggtgggtgtggacctgcctggccggcgccggtctcggcctcatcggcatctggtacgtgcggggacgggacgcggcgatcaagcgggacgccgcggagaagcaaccgcaggtgaag

SEQ ID NO: 3883 - DNA, 2391 bp, Streptomyces avermitilis
  CDS (1)..(2391)
atgacccacatcgacgcgggcgccgaactcgatcctgtgcaccccatgcccctccccgggcgggcgcgaggactgagcaccgcccaggtggccgagcgggttgcccgtggcgaggtcaacgacgtccccgtgcgcagcagccgctccctcggcgagatcgtccgcgccaacgtcttcacccgcttcaacgcgatcatcggcgtgctctggctggtcatgctgttcgtggcgccgttccaggacagcctcttcggatacgtgatcatcgccaacaccgggatcggcatcatccaggagtggcgggcgaagaagaccctggactcgctcgcgctgatcggcgaggcgaagccgaccgtgcgccgggacggggtcgcctccgaggtcagcacctccgagatcgtgctggacgacgtgatcgagaccgcgcccggcgacaagatcgtggtcgacggggtgtgcgtcgagaccgacggcctggagatcgacgagtcgctgctgacgggcgaggccgatcccgtcgtcaagcacgccggcgactcggtcatgtccggcagtttcgtggtcgcgggcggcggcgcgttcaaggcgacgaaggtgggccgggaggcgtacgcggcacagctcgccgaggaggcgtcccggttcacgctggtccactccgagctgcgtacgggcatctccacgatcctcaagtacgtgacgtggatgatggtcccgaccgcgatcggcctcgtcatcagccagctggtggtcaagcagaacgacttcaaaaactccgtcgcccgcacggtcggcggcatcgtgccgatggtccccgaggggctcgtgctcctcacgtccgtcgccttcgcgatcggcgtcatccgcctcggccgccgcaacgtcctggtgcaggaactgcccgcgatcgaggggctcgcccgcgtcgacaccgtctgcctggacaagacgggcacgctcaccgagggcggcatggacgtcacggagctgcggccgctcggtggcgccgacgaggcgtacgtacggaaggtcctcggcgcgctcggcgagtccgacccgcggccgaacgcgtccctccaggcgatcatcaacgcctaccaggacagcgacgactggcgctgcacggagtcgctgcccttttcgtcggcccgcaagtacagcggggcgtccttcagtgagggcaacggcgagtccagtacgtggctcctgggcgcccccgacgtgctgctgcccgccgacgacccggcgctcgccgagaccgagcagctcaacgagcaggggctgcgggtgctgctcctcacccgcgccgtacgggacctggacgaccgcgaggtgaagacggaggcgcggcccaccgccctggtcgtcctggagcagcggctgcggccggacgccgccgacaccctgcgctacttcgccgagcagaacgtccacgccaaggtgatctccggcgacaacgcggtgtccgtgggcgcggtggcaggaaagctcgggttgaccggcggcgtggtggacgcgcgcgcacttcccgcggagcgggcggagatggcgaaggggttggacaagggcacggtgttcgggcgggtcaccccgcagcagaagcgggacatggtgggcgcgctccagtcacgcgggcacacggtggcgatgaccggcgacggcgtgaacgacgtactggccctcaaggacgccgacatcggcgtgtcgatgggctcgggctccgaggcgacccgggcggtcgcgcagatcgtgctgctcgacaacagcttcgcgacgctgccgtcggtggtcggggagggccgccgggtcatcggcaacatcacccgcgtggcgaccctcttcctcgtgaagacggtctactcggtgctgctggccgtgctggtggtgtgctggcaggtggagtacccgttcctgccacggcacctgacgcttctgtccaccctgacgatcggcgtcccggcgttcttcctggccctcgcccccaacaaggagcgggcgaaaccccacttcgtacgccgggtcatgcggtactcgatcccgggcggggtcctggcggcggtggcgaccttcgtctgctatctgctcgcccgccaccactacaccgggccgggcgcgctggacgcggagaccagcgccgcgacgctgacgctgttcctgatctccatgtgggtgctggcgatcatcgcccggccgtacacctggtggcggatctgcctcgtcgccgcgatgggcggggcgttcctgctggtgctggtcgtgccgtcgctccagcagttcttcgcgctgaagctggtcggcgtgacgatgccgtggctcgcggtggccatcgcggcggtggcggcggccaccctggagttcctgtggaagtgggtggaccgccgctttcccgcg

SEQ ID NO: 3884 - DNA, 909 bp, Streptomyces avermitilis
  CDS (1)..(909)
gtgggcccctctccacttggggaatgcatgcgcatacgtgccactgtggccgccgccaccggcgccctggccctctccgctttcgccgtaccggccgcgcaggccgccgactcggtgtcccgcgctgacatcgcccacgcctgggggctgtccaccgccgcctccggcaagtccggcttccggcccgccacggcgggcaccgccgccgacctcgacgtcaccttctccgacatgaaggtgaacaagagcaagaacatcgtcgtgggcacgacgaaggaggtcgcgatccccgtcacgtacaccctgacgcacgccgccgacctcgacatgagcgaggacaacttcgccaacggcccgctcatctaccgcggctcctcggtcgacgagccgacgaacgtcttcatcagcgacgagccggcgacctgcaccgccacgtcgacgaccgtcgccagctgcgtgggcaccatctacctccgcccgggcgacggcgacctggtgaacgccgacgccgccacgtggaaggcgggcggtctcgccatcacggccgacggggacgagacggtgcagggcgacctcggcaccaccaaggtccagcgctactcgaagctcaccgtcaacgcctccccggagccggtcaagaagggccggaccatcacggtcaccggcgccctgacccgcgccaactgggacaccggcaagtacgcgggctacaccagccagtccgtgaagctgcagttcaagaagaagggcagcagcaccttcaccaccctcaagacgatcaagtccgacagcaagggcaacctgaagacgaccgtcacggcctccgccgacggcaccttccgctactccttcgcgggcacgtccacgaccccggcggtcgactccgcgggcgacgccatcgacgtgcag

SEQ ID NO: 3885 - DNA, 3282 bp, Streptomyces avermitilis
  CDS (1)..(3282)
gtgagcaagttcgtgcggccggcagccgagggcgcggacccgttcgggacggcgcgtctgcggcgcggagtgctggacgcctgggccatcagcccggcccggttccgcgaggacgccaacgccgaggaggacctcgtcctcggcggctaccgcgaccggctcgtcgtggaactcgcccagaacgccgccgacgccgccgcccggtccggtgtcccgggccgcctgcggctcaccctccgcgacggcgtcctggccgccgccaacaccggcgccccgctcgacgccgccggcgtcgagtccctgtccacgctccgcgcctccgccaagcgggaggggcacgaaagcgccgtcgggcggttcggcgtcggcttcgccgccgtgctctccgtgaccgacgaacccgccgtactcggccggcacggcggcgtccgctggttcctcgccgaggcccgcgaactggccgcggacaccgcccggcacagccccggcctgggcgacgaggtccgccgccgggacggccatgtgccgctgctgaggctgccgttcgccgccgagggcaccgccccggagacgtacgacaccgtcgtcgtcctgccgctgcgcgacaccgccgcggaggatctggccgagcgcctgctgaccggcatcgacgatgccctcctgctcgccctgccgggcctggaggaggtcgtggtggaggtgggcgagggggacgcgaggaccctgcggcgcctgaccgagggcacggaacacggcgccgccgcggaccgtacgggtacggacgccgggcaggtcgcgcccgacccctccggcgccgaccggaccaccaccgcgcaccgcaccgtccgcatcgaggacacccgagacggcaccacccgctggcgcaccgtctcccagcacggccccctggcccccgaactgctggccggccgctcggtcgaggagcggctgcgtccgcactggtccgtgacctgggccgtccccctcgactccgagggtgtcccggccttcccgcgcaccgcgccggtcgtgcacgcgcccacccccagcgacgagcccctcggcgttcccgccctgctcatcgcctccctgccgctggacaccagccgccggcacgccgccccgggcccgctcaccgacttcctcgtcgagcgggcggccgacgcgtacgccggacttctcgccgcctggcggccggtgacccccggcatcatcggtctcgtccccggcccgctcggcaagggcgtcctcgacggcgccctgcgccaggcgatcctggaccggctgccgcgcaccgcgttcctgccgcccgccgccgagggcgccgaccggcaggccgccgaccggcaggccgccgcagagggcccggcggagagtcccgccgaggaccccgccgactgggacgccgtagcccccgtcgccctgcgcccccgtgacgccgaggtggtggagggggcgggcgcggacaccgtacgcgtcctcgccgaggtgctgcccagcctgctgcccgccgggctcgagcgccgggtggagctgcgcaccctcggtgtggcccgggtgccgctcacggaggccgtggaccggctggccgggctggagaaggaccccggctggtggcggcggctgtacgacagcctcgcgggcgtcgacccggaccggctgtccgggctgcccgtgccgctcgccgacgggcgtacgaccatcgggccccgccaggtcctcctgcccaccgccgacgggccgcaggccgctcccgaggccctggcccggctgggcctgaaggtggcgcacccggaggccgcccatcccctgttggagaagctcggcgccctccccgccaccccccgcgccgtcctcaccacccctcaggtgcgcgccgccgtcgccgcctccctggacgacgaggcccctgcctgggaccaggaggggccggacgccgaggagttggccgacaccgtcctcgccctcgtccgcgacgcgggcctcgaacccggcgacgagccctggctcggcgccctcgccctccccgacgaggagggggagccggcgcccgcgggcgaactcgtcctgcccggcagcccgttcgcccgcgtcatgcgggacggcgagctcgccttcgtcgacgccgagctggccgaccgctggggcgagcagcccctggcggcctgcggtgtgctcgccgacttcgccctcgtccgcaccacggacgtcgtcctcgacccggacgaactggagccccgcgactccgacttcgcggaacccgatgacgccggactcctcgacgccgtcgacgtgtggtgcgaggacgtcctggaccggctgcccgacacgccggtgccgccggtcgccacggagatcgtcgcggtacgcgacctggacctcgtcgacgacgactgctggccccaggccctcgccctgctgtcgcggccgccgctgcgggacgcgctgatccagccggtacggatcctgctcccggacggtacgcacgaggtcgtacggccgtacaccgcctggtggctgcgcggacaccccgtgctcgacggccgccgccccgccggtctgcgcgccgcgggcggcgatccgctgctgcgcggcctgtacgacgaggccgacgccaccgggttcgacgacgagcaggtactgcgggcgctgggcgtccgtacctccgtcgccgccctcctcgacgagccgggcggcgccgccgagctgctcgaccggctcgccgatccggagcgggaggtctcgggcgcccagctgcacgccctctacggcttcctggccgacctcgacccggagcgggtgaccctgccggacgagctgcgggccgtcgtcgacggcgaggtcgtcgtggtggacgcggccgacgccgtggtcgtcgactcgcccgacctgctgcccttcaccgccgggacgccgctgctccccgtacccccgtccagggccgccggtctcgccgagctgttccaggtgcggcggctgagcgagtcggtgacgggggaggtggactccgagggcgtcgaacacgacgtaccggagtcggtgcgggtgctgctcggcccgtcgaccccggcgtcgtacgtggagcacgaggagctggtcgtcgacggcaccgaactcgactggcgccgcacccgggacggcgtgctgcacgcgtccaccctggagggcgtcgcagccggcctcgcctgggcggcgggtcagtggccgcggcggttcgaggtggccgcgctcatcgaggacccgtcccgcacggaggagctggcgcgggaccgctggttcgac

SEQ ID NO: 3886 - DNA, 924 bp, Streptomyces avermitilis
  CDS (1)..(924)
gtgagcgcagcgacaacgcgaagccgcacccccgaccgcctgtgcaccgaggccgtcgacctcgcgcgcgccgccgccgaggaggccgccgcccccggcgtcgtcggcgagcacgtgggagtcgtctccgagggtgaccgcgttgtcacgcactttttcgagtgcaaggaattcgggtaccggggctggcgctgggcggtgacggtcgcccgggcctcccgcgcgaaggtcgtgaccctcgacgagacggtgctgctgcccggcgacgacgcgctgctcgcaccggagtgggtgccgtggagcgagcggctgcgccccggtgacatgggccccggcgatcttctgcccaccgaggcggacgacctccggctggagcccggctacacgggcgaggacgagccactgccgaactccgcggtctccgaggagatggccgagctggtggaagccgaggacgcggaggtcgcgggcggggctccggcgaagctgccgatcccgccgacgcgcggctcgatcgcggcggtggcggaggaactgggcatgcgccgggcgcgggtcctctcgcgctacgggctgcacatcgccgcggaccgctgggaagaggcgttcggccccaagacgccgatggcgcaggccgcgcccgcggcgtgcgtcagctgcggcttcctgaaccggatcgggggatcgctcggacaggcgttcggtgtctgtgcgaatgagttctcgccggcggacgggcgcgtggtgtcgctggcgtacgggtgcggggggcactcggaggcggcggtcatgccgaagccgccgcgtccggccgagccggtcatcgacgagacgaaggtggacccgttcccgctgcgtccgtcccccgactcgggttcggtcccggagacgacggacgagtcctcggcggaactggggcactcg

SEQ ID NO: 3887 - DNA, 1422 bp, Streptomyces avermitilis
  CDS (1)..(1422)
gtggcagccgcgaagtcgccccagggagccgccgggatcggtggggtcaaggggagcagcgggagtggcggatcgggccgggtgcgtggcgccgtccgctcggtcggccgcgccctgcacttcccggtcaccggaacggcccgcggcatccgcagggccacacacgcgcacggcgcaggcgagtccggcctcggcaaactgatcgagctgcacgcggtgaacggcgccggtgacgtcatgatcaccgtcgctctcgcctccaccgtcttcttctcggtgcccaccgacgaggcccgcggccgcgtcgccctctacctcgccatcaccatggcgcccttcaccctgctcgccccggtgatcggcccgctcctcgaccgcctgccgcacggccgccgcgccgcgatggccggcgcgatgctcgcccgcgccctgctcgcgctgatcatctccggcgccgtcgccagcggcagcctccagctgtacccggccgccctcggcgtactggtcgcctccaaggcctacggagtcgtacgcagcgccgtggtcccccgtctgctcccaccccgcttctccctggtgaaggcgaactcccgcgtcaccctcggcgggctgctcgccaccggcgtggccgcccccatcggcgcgggcctccaggccctcggctcccgctggccgctctacggcgccttcgtgatcttcgtggccggaacgttcctgtcgttctccctgccgccgaaggtcgactcggccaagggcgaggacacggcactgctcgcggcggacccggagcacctgcacggcccgcaccgggggcagctcaagcgccccggactgcgcaccgtgggaacggccgtcacccacgccctcgccgccaacgcggccctgcgctgtctgtccggcttcctgatcttcttcctcgccttcctgctgcgcgagcacccgctcaccggcgagagcgcggcggtgtcgctggggatagtgggcgtggcggcgggcacgggcaacgcgctgggcacggcggtcggcgcctggctgaagtcacgcgcgccggaggtgatcatcgtgacggtggtggccttcgtactggccgcggcgatcacggcggccctcttcttcggcgcgttcctggtcacgtgcctcgcggcggtggccggcttcgcgcaggccctcgcgaagctgtcgctggacgcgttgatccagcgggacgtgccggagctggtccgtacgtccgcgttcgcgcgctccgagaccctgctccaggtggcgtgggtgctgggcggcgcgatcggcatcgccctgccgctcaacggctcgctcggcctctccgtggccgccgggatcgtcgccgtcgggtggctgacgacggtgcgcgggctgctcggcgcggcccggcacggcggccccgcgcgcccacgcgtcgac

SEQ ID NO: 3888 - DNA, 456 bp, Streptomyces avermitilis
  CDS (1)..(456)
gtgcgccgccgccgcgccgtcgccgccgccggtgccgtttccgccggactgctcgtcctgtccgcctgcgacaagccgacgccgctgtcgacgatcaccgtcggccagagctcggtgagctcggaagcctcctgctacaacgacggcaagccgctcgcgaccgcggacctggcgaagtgcctgaaggacacggacatcaagtccatcaaggtcgaccccgacgagacggtccgcttcggcgtggacccggacgtcgcgaaaaagggctggacgatcctgatgaacggccaggcgctgaccgaggccagcaagaagacgtaccgcacgatcccgggcagcgtgttcttcaacgcgcagtacggcgcgagcggcaactccacgctggtctccatccaggagggcgagaaggcgccgttcaccggcctgtggtccttcaagctcaagaaggacgcgggc

SEQ ID NO: 3889 - DNA, 669 bp, Streptomyces avermitilis
  CDS (1)..(669)
gtggcacgggcgttcacgcccgcgccgcacgaggtcccgctcccgggggcgaccctccaccggatcctccacgggagcggcggtcacgacctgctggccgccggcgtcggccccgccctcgccgccgcctccaccgcgaccgcgctcaccgcggccgccctcgccggcaccccgtacgacctcgtcgtctccgccgggatcgcgggcggtttccagccggacgccccggtcggctccctcgtcgtcgccgacacgatcaccgtggcggatctcggcgcggacaccgccaccggcttcctgccggtcaccgagctgggcttcggaaccgtcacccaccatccaccggaaacactcgtacgagcggtcgcggactccaccggggcgcgcgccggagtcgtgctcaccgtctccacggtgaccggcaccgccgagcgcgccgcggaactccgtgcccgtcaccctcgtgcgctggccgaggccatggagggcttcggggtggccgaggcggccgccgcgcacggcacgcccgtgctggagatacgcgccgtctcgaaccccgtcggcccgcgcgaccgtgccgcctggcgcatcggcgacgctctcgcggccctcacggagggcttcgggaagctggcgcccgccctggagagttggaacccgcatgagctc

SEQ ID NO: 3890 - DNA, 852 bp, Streptomyces avermitilis
  CDS (1)..(852)
atgagctctgaaagccgaccgctgcagatcgcgtactccccctgcccgaacgacaccttcgtcttcgacgcctgggcccacgaccgggtcccggacgcgcccgccctcgacgtcaccttcgcggacatcgacatcaccaacggcatggccgagcgcggcgagttcgacgtgctgaaggtgtcgtacgccgtgctgccgtacgtcctcgacgagtacgcgctgctgccgtgcggcggtgcgctgggccggggctgcggcccgctggtgctcacccgcgaggcggacgccgacctgacgggccgaacggtcgccgtgccgagcgagaagtcgaccgcgtacctcctgttccgcctctgggcggcggacacggtccccggcggggtcggcgagatcgtggtcatgccgttccacgagatcatgccggcggtacgggacggcaaggtcgacgcgggcctggtcatccacgaggcccgtttcacgtaccagaactacggcctgcacaagctggccgacatgggcgagcactgggagcgcacgacgggcctgccgatccccctcggcgcgatcatcgccaagcgctcactgggtgtggagacgctcacccggctcgcctccgccacccgcgcctccgtccgagccgcctgggccgaccccgcggcctcccgcccgtacgtcctggaacacgcccaggagatggacccggcggtggcggaccagcacatcggcctgtacgtcaacgagttcaccgccgacctcggcgaggacggctacgcggccgtccgcgggctcctcacgcgtgcggcggccgaggggctggtgccgcccctcggccctgacgcgctgaacttcccg

SEQ ID NO: 3891 - DNA, 381 bp, Streptomyces avermitilis
  CDS (1)..(381)
gtgcctaccggcaaggtcaagtggttcaacagcgagaagggcttcggctttctctcccgcgacgacggcggtgacgtcttcgttcattcctcggtcctccccgccggagtcgaagccctcaagccgggccagcgcgtggagttcggcgtagtcgccgggcagcgcggtgaccaggcactgtcggtggtcctgctggacccgaccccgtcggttgcggctgcacagcgtcgcaagcccgatgaactggcgtccatcgtccaggatttgacgaccctcctcgagaacatcacgccgatgctggagaagggccgctatcccgagaagacctcgggcaagaagatcgcgggcctgctgcgggcggtcgccgaccagttggacgtc

SEQ ID NO: 3892 - DNA, 627 bp, Streptomyces avermitilis
  CDS (1)..(627)
atggcccatatgacctctcgcgcactgaccgtcggcttcgacctcgacatgaccctgatcgactcccggcccggtatccacgcctgctaccaggcgctttccgcgcggacgggcacgtacatcgacgccgacctggccgtcacccggctcggcccgcccctggcggacgaactcgtcaactggttcccggcggagcaggtcgcggccatggccgacgtctaccgtgagatgtaccccacgcacgccatcgcgccgacccccgcgatgcccggcgcccgtgcggcgatagcggccgtgcaggcggccggcggacgcgcgatcgtcgtcaccgccaagtacgagcccaacgccaagctccacctggagcacctcggcatcgagcccgacgcggtcatcggcgacctgtgggccgagggcaaggcggaggcgctgctcgagcacgcggcgggcgtctacgtcggcgaccacaccggagacgtacgcggagcacgtaccgccgacgcgtacgccgttgcggtcgccaccgggccgtgcgacgcggccgaactgcgggcggcgggcgcggatgtcgtactggccgacctcacggagttccccggctggctggagagccaccgctcgcgctcg

SEQ ID NO: 3893 - DNA, 537 bp, Streptomyces avermitilis
  CDS (1)..(537)
gtgcccgggttcaccgggggcgtggagatccccgagatactcaagccgccgcaggaggacagcgcgcgggaggaccggccgcacggggccgggcaggggccgggagccgaaccggtcgtcgacgcctcgccggccggcgctcccgcgggcgaggaggccgccgccgcgcctccgcgccggatgctgctcaggccccggctcagcggctggagcaacccgctgctcctgctggccgccgggcttctcgtcgccggtgccgtcctcggcaactggttcgcgctcgggctcggctggctcatcgcctacgcctcccgccggctgacgcccgtcgagtcgaagtgggcggtcctgggcctgcccggggcggccgcggccgcggggatcgtctggctgtggggccgtacggagcgccggtggggggatccgatcgccacgggacacatgaacgacgcggtcacggagacctggccgtgggtggtgcggggggcggctgtcgcctcggcactgttcctggtgtggcggtcccagcggcgacgc

SEQ ID NO: 3894 - DNA, 141 bp, Streptomyces avermitilis
  CDS (1)..(141)
atgcgacggacgacggccggactgtcgaccggggtcttcgcccggcgccggtcgatctcgttgcgcagctcggagacgagccgcatccgcgtccccgacggcagctgccgctgctgggccaggtctccgacccggctcaga

SEQ ID NO: 3895 - DNA, 2580 bp, Streptomyces avermitilis
  CDS (1)..(2580)
atgagcaacgaggacaagccggcggcagccccccgttccctcgcggaagcgctccgcgcgcgggacgacgcgtccctgtccgccctcctccgcgcccgcccggacctcatcacccccgtccccaccgacctcacccagctcgcgacccgcgccggcacccgcgccagcgtcgtacgcgccctggagcggctcgaccggttcacgctccagacggcggaggccctcgccgtggcccccgacccggcgacgtacgacgaactcctcgccctgatggcgggcgacgacgccgaccgggccgtcacgaacgccctcccgcgggccctcgccgccctgcgggaccaggccctcgtctggggctccgacgaccggctccgcctcgtccgcacggcccgcgaactgctcgcgccctccccccagcacccgtccccgaccggcctcggccccacggtcgcggaggccacggcgggcatgtccccgggccgggtgcaggagatcctgacggccgccgggctgccgaccacgcacgacgcggtgtcggccgtggcgtcgctcggcgccctcttctcggaccgcacccgcatgtccgcgctcctggacgaggcccccgccgactcgctcgacgtgctgtcccgcctggtctggggtccgccgtacgggcaggtcaccgcggaccccgcgacgcggctgcgctggctcctcgaccgcgggctgctgctgccgacggcgcccggcacggtcgtactgccccgggaggtggccctccatctgcgggcgggccgcgcgcaccgttccaccgagccgctgccgccccaggtcgagatcgccgcgacccaccgtccgccgctggtggacgcgacggcggccggccaggcgtacaccgcgctcgcgacggtcgaggagctgctgaaggactggcacgagggcggtccggccgtgctgcgggccgggggcctgagcgtgcgggacctcaagcggaccgcggtggccctcgacgtgcccgagccgacggccgccttctgggtcgaactcacttacgcggcaggcctgttggcgtcggacggcgaggcggaggagcggtacgcggcgacccccgcgtacgacgagtggctggagctgcccgccgccgagcgctggagccggctcgccaccgcgtggctggcggcgacccgcacggcgggcctggtcggcggccgggacgccaaggagcgcaccctgtcggccctcggccccggcctggaccgctcggccgcgtccgaggtccgccgccgggtcctggcgctgctcgccgatctgcccgagggcgcctcggccgcacccgcttccgtactggcccgactgcgctgggaacgcccgctgcgcggcacccacccgtccccgtccccgtcctcggcgccctcctcctcggacgatctgcgcacccgcctcgccgagtggacgctgtccgaggcggagcagctggggttcacgggccggggcgcactgtcctcgcacggccgcgcactgctgggcgcgccgcccgcgcccgcgaaacccccggccccctccggcccgggcgacaagctccccgtccaccacaggcaccacgacatgcccgccgagccccaagccgccccgctctcccccgccgaacaggcggcggccgccgccgaggccacccgtctcctcgccccgctcctgccctcccccctggaccacgtcctgctccaggcggacctgaccgcggtggcgcccggcccgctggagcgtccgctggccgacacgctcggcgtgctcgcggacgtggagtcgaagggcggggcgacggtctaccgcttcacgcccgcctccgtgcggcgcgccctggacgcgggccgtgcggcgtcggacctgcacgcgttcctcgcggcccactcgcggacgccggtcccgcagcccctcgcctatctgatcgacgacgtggcccgcaagcacggccacctccgcatcggcgcggcctcggcctatgtgcgctgcgacgacgacaccctgctgaacgagatcctcgccgacaagcgctccgccggactccggctgcgccggctggcccccacggtgctggcggcccaggccgacccggcgacgctgctcgaaggcctgcgcgcgatgggcttcgcgccggccgccgagtccgccgagggcgatgtcctgatcacccgcgcccacgcccaccgcaccccgccgcgcgcggccccggagccggtccccgacggccccccggtgcccgacacgacgctcctgaccgccgcggtccgcgccatccgcgcgggcgatctggcctccactgccccgcgcaagccgaccgccgacccggccggcgcggacggcggcctcccgcgcaccagctccgccgagaccctcgccaccatgcaggccgccgtcctcaccggcgaggcggtctggatcggctacgtcaacgcggaaggcaccgcgagccagcgcgtgatcgccccgatccgcgtggagggcggcttcgtcactgcctacgaccacacggcggacgaggtccgcacgtacccgctgcaccgggtcaccggagtggcggaactggccgacgaccaggcg

SEQ ID NO: 3896 - DNA, 1641 bp, Streptomyces avermitilis
  CDS (1)..(1641)
gtgaatggtccactcatcgtccagagcgacaagacactcctgctcgaagtcgaccacgagcaggcgaacgagtgccgacgggccatcgcgccgttcgccgagctggagcgggcgcccgagcacatccacacctaccgggtgaccccgctcgggctgtggaacgcgcgggccgccgggcacgacgccgagcaggtcgtggacgcgctcgtgcagtacagccggtaccccgtgccgcatgccctgctcgtggacatcgccgagacgatggaccgctacgggcggctgacgctctccaagcacccggcccacgggctggtgctcacgacgacggaccggcccgtgctcgaggagatcctccggtccaagcgggtcgccccgctcgtcggcgcccgcctcgaccccgacaccgtcgccgtgcacccctccgagcgcgggcagatcaagcagacgctgctgaagctgggctggcccgccgaggacctcgccggttacgtcgacggggaggcgcacccgatcgagctggccgaggacggctgggcgctgcggccgtaccagaagcaggccgtggagaacttctggcacggcggctccggcgtggtcgtgctgccctgtggcgcgggcaagacgctcgtcggtgccgggtccatggcgcaggccaaggccaccacgctcatcctcgtcaccaacaccgtctccgcccgccagtggaagcacgagctggtgaagcggacgagtctcaccgaggacgagatcggtgagtacagcggtacgaagaaggagatccggccggtcaccatcgccacgtaccaggtgctgacgaccaggcggaagggcgtctacccgcacctggagctgttcgactcccgtgactggggactcatcgtctacgacgaggtgcatctgctgccggcgcccgtcttcaagttcaccgccgatctccaggcgcggcggcggctggggctgacggcgaccctcgtgcgggaggacgggcgcgagtcggacgtcttctcgctcatcgggcccaagcggttcgacgctccgtggaaggagatcgaggcgcaggggtacatcgcgcccgccgactgcgtggaggtgcgggtcaatctgacggagaccgagcggctcgcgtacgcgaccgccgagaccgaggagaagtatcgcttctgcgccaccacggcgacgaagcggaaggtgacggaggcgctggtccggaagttcgccgggcagcagatcctcgtcatcggccagtacatcgaccagctcgacgagctgggcgagcacctgaacgcgcccgtcatcaagggcgagaccagcaacgcgcagcgcgagaagctcttcgacgccttccgggagggcgagatcagcgtcctcgtcgtctccaaggtcgcgaacttctccatcgacctgccggaggcgaccgtcgccatccaggtgtcgggcacgttcggctcgcgccaggaggaggcgcagcggctgggccgcgtcctgcggcccaaggcggacggccaccaggcccacttctactcggtcgtcgcccgcgacaccatcgaccaggacttcgccgcgcaccgccagcgcttcctggcggagcagggctacgcctaccggatcatggacgcggacgagctcctgacggagagc

SEQ ID NO: 3897 - DNA, 1194 bp, Streptomyces avermitilis
  CDS (1)..(1194)
gtggcacgtgcgcgccgcttcgtggcaacggcccgtgcgacggcgcctgcgccggcccccgccctgtcccgcctcgcccgtctccggcaccccgccaccgcgagcgtcgtccttctcgcctgttcgctcggctccttcggggcgctctgtctcctccagggcgtgcccatggccgacgccctggtctaccgggccgcgggcgccgccgtgctgagcggtgcggatctgtacgggttcacggtcaccgagtgggggttgccggccacgtatccgcccttcgcggcgctcctgttcgtaccgacaacctggcttgccccgggcgccctcaaggtggccttcgtcgccgggaacgtggccctgctggccgcgctcgtccggctctccggccggctcgcgggccgcccggcgccgctccccgccgtctgcgccgccacggccctcgccctctggctcgaacccgtcttccagaccgtcctcttcgggcagatcaacctcgccctcgcctgcctggtcctgtgggacctcacccgccccggcgcccggtgcaggggagccgcgctcggcatcgcggccggggtgaaactgacgcccgccgtcttcatcgtgtacctgctgctcaggggccggcgacgagaagcggccaccgccgcggccgccttcgccgggaccgtactgctgggcgcgctcctactccccgccgccagcgtcgacttctggacccggcggatcttcgagaccggccgggtcggcaaggcgtggatcgtcgacaaccagtcgcttcaggggctggtcgcccgcgtgctgggagagccgtcgcccggcctcgcctgggcgctgcccaccgcggtcgtcgcgggcgccggcctctggctcgcccggcgcgccaccagcgagcgccggggcatcctgctcgccgccttcaccgccctgctcgtctccccgatcagctggtcgcaccactgggtgtggtgcctgccgctgatcgccgtgctgtacgccgaaggccacccgcgccaggccgcggccaccgccgcggtcttcacggcgcgcacgctgtggctgctcccgcaccagggcgacctggacctccagctctcctggtggcagcagccgccggcctcgccctaccccctgctcgcgctgctcgtcctggttcagctctccgtcaggagctcgtccgcgtccatgatccgg

SEQ ID NO: 3898 - DNA, 249 bp, Streptomyces avermitilis
  CDS (1)..(249)
gtgcgggttacgtcctgggaccgacgcattcgccgcggccggatccatgatggatgtatgagcgcagcgaccttctctccgggccctgcccggcacagccccgcgtccggcgccaccgccctcagggccgacgtccaccaccgccacctcctcggcgacgccctgcgcgccgtcaaggtcttcgcccgcgcggcgatggacgtggtgctcctcggcgagtacggcgaagaagcgggcgtccaccgccgg

SEQ ID NO: 3899 - DNA, 2046 bp, Streptomyces avermitilis
  CDS (1)..(2046)
gtgtccagcctgtccgagagtcccgccgaccccctctcccgcgagcgcgcccacctcgccggctcccgtgcggccctgcgtgcgatgcgcgaggacgtggagaacctcgacatccgcgacgtcaccgccaactgggtcaacgccgaagtcctcgcccgccagatcgacgaccgcatcaaggcgctcgcggacctcagccacacccccctcttcttcggccgcctcgactacctgcacgccccgggcgccgaccgggcggagggcgccgagggcgagcgtttctacatcgggcgccggcatgtgcacgacgccgagggcgacccgatggtcatcgactggcgcgcgcccgtgtcgcagccgttctaccgggcctcgaagaaggacccgctggacgtcgggctgcgccgccgcttcggctacacggcgggcgacctcactgcgtacgaggacgagcacctctccgacccggccgaggcggccaccaccagcaagctgctccagcaggagatcgagcgcccgcgcgtcggcccgatgcgcgacatcgtggcgaccatccagcccgagcaggacgagatcgtacggtcgggactgtccggctccgtctgtgtccagggcgggcccggcaccgggaagaccgccgtcggcctccaccgggtcgcgtatctgctgtacgcccaccgtgagcgactcgcccgcaccggcaccctggtcatcggaccgaacaggtcgttcctgcactacatcgagcaagtgctgcccgccctgggcgagttggaggtcaagcaggccacggtcgacgacctggtcgcacatgtcgagatccgggggaccgacgacgcggccgccgccgtcatcaagggcgacgcccggatggccgaggtgctgcggcgggccgtccgctcgcacgtcaccctgcccaccgagccggtcgtggtggtgcgcggctcccgtcgctggcgcgtacccgcctacgaactcgagcagatcgtccgggagttgatggaccgtgacatccgctacggggccgcccgcgaggcgctgccgcagcggatcgcgcacgccgtcctggtccagatggagcggtccggcgaggcgcccgacgaccgggtgcaggacgccgtcgcccgcaacgccgccgtgaaggcggccgtcaaggcgatctggccgcccgtcgaccccgccaagctcgtcctgcgtctgctcaccgacgcggacttcctcgccgtgcacgcggacggagtcctcgaggaggacgagcggaaggagatcctctgggcgcggcccgtacgcagcacgaagaccgccaagtggtcggccgccgatgccgtactgatcgacgaggcgaccgacctcgtccagcggacgcattcgctcgggcacgtcgtgctcgacgaggcacaggacctgtcccccatgcagtaccgggccgtcggccgtcgctgtacgaccggttcggcgaccgtgctcggcgacctggcgcagggcacgaccccgtgggcgacgcggagctgggacgaggcgctggcgcacctcggcaagggcgacgcggtgatcgaggagctgacggccggtttccgcgtgcccaccgatgtcatcacgtacgcgtcccggctgctgccgcacatcgcgcccggactgacgccggtggcgtcggtgcgtgagaacccgggcttcttcgaggtgcgtacgacggccaccgacgccgcggtgatcgacgcctgcgcggaactgctccgcaacgagggctcgatcggcctgatcgccgccgacgcacgtgtcccggcgctggccgaggcgctcacggcggccgggatcggccatctcggtccgggcgaggagacgacgcacgacacccggctcaccctcgtaccggcgtcgctggccaagggcctggagtacgactacgtggtcctggacgagccgcgggccgtcgtcgacggcgaaccggacgagcggacgggcctgcgccgcctgtacgtggccctcacccgtgcggtctccggcctgatcgtgacgcacacggcgcccctgccgagccagctcggc

SEQ ID NO: 3900 - DNA, 1227 bp, Streptomyces avermitilis
  CDS (1)..(1227)
atgccatccatacgccgccgcggcgtcacggccgcaaccgccgtgatcgccgcggtgctggtcaccgcaacggcttgcgacagcgagaagaccgacgacgcgaaggcatcgccgtcgtcgtcggcccaggcggaccagaagatcgacaccggtcaggacgacggggacaccaccatcgggggctacaagctcccggccggcgtccccaccgacctcaccggtgaagcgttgcggcagtggaagaacggcggctggaaggactacagcaactgggcttccaaggcggaggatttcgccaacccgtacatcgagaacttctggaccccggagaaaatggccgaggcgaaggcgaacgcacccgcggtcgtcgacgcgggcagcgcaagctccggctccagcggcaccaccaagacgtacctgcccgacggcacggtgaagaagaagtcggccacgcgggtggcggcgagctaccaccactccgcgccgcccgtcggcaagctgttcttcagcagcccccagggatccatggtgtgctccgccgccgtggtcaccgacccggcgcaccccggcaagtccaacctcgtgtggaccgccggccactgcgtgcacgcgggcaagggcggcggctggtaccgcaacatcgccttcgtgccgtcgtacaacaacgacgcccggctgaacatccagcaggcctcccagaacgcacgctccaagagcgtctccccgtacggcatctggtggtccgactgggcgaccacgtccggggcgtggatcaagggcggcgcccaccaggccacgacggcctacgcgtacgactacgccgtgctgcacgtgaagcccgagaagggcggcaagtcccttcaggagcagatcggttcggccctgccggtgtggttcaacgccccgtcggcgaagaagatcaagacgatgaaggcgcgcggctaccccgccgagtcgccgtacgacggctcgaagatgtacgactgccgcggcgccaccaagcgcctggtgctcggctaccgctacccgagcgactacccggcccagtacatgctcggctgcacgttgaacggcggggcgtcgggcggaccctggttcctggcgcacaacgggcgtacgtatctggtgtccaacaactcgctgagcgaccgccggaccttcgtgtccggaccgcgcctgggcaagaacgccaagcaggtctatctggcgaccagcaacaagttcaag

SEQ ID NO: 3901 - DNA, 696 bp, Streptomyces avermitilis
  CDS (1)..(696)
atgagcacgcgtgcagtcctggaggtgatcgccctcgacgccgaggacgcggtcgccgcccaggccggaggcgcggaccgcctcgaactggtcgcggacatgtccgccgacgggctgaccccgccggtggagaccttcgcccggatccgggccgccgtcgacatcgcgctgcgcgtgatgctgcggccggcggacgggttcgcggcgggggacgccgaccggttcgccgcgctcgtccgcgccgccggggagctgcgggccgcgggcgccgacgagttcgtgttcgggttcctcggtgaggacggcggtgccgacctcgacgccgtggagcggctggtcgccgacctggacggctgccactggaccttccaccgcgcgatcgaccgcgccgccgaccgcgacgccctgcgcaagcagctcgcggatctgccggggctcgacgcgtacctcacggcggggtcggccgacggcgtggacgacggtctgcccaccctgctcgccgaggccgcccgcagcggcgagcccggctacacccagcggctcctcgtcggcggcggcctgcgtctcgaccacgtcccgcggctgcgcgccgccggcatcgacgccttccacatcggcggcgcggcccgcccggccggctggtccgggccggtctcggcacaggccgtacaggagtggcggaccgccgtcgacgcg

SEQ ID NO: 3902 - DNA, 675 bp, Streptomyces avermitilis
  CDS (1)..(675)
atgacgatcgcagaccggtatgacgacgtacgagaccccgagcttcccggccgcctcctgagcaccgagcgcgacgccctgattcccctcctgcgggcccgtcccgacggcgacttcgcgctgcggaccgcctgtcccgggtggacggtgcggcatgtgctcgcgcactgttcggccgcgctgacgcgggtggtggagagccgtttcgaggagggcgtgttcagtcccgaggcgaacgagcgggacatcgccgagcgcggtgactggacgaacacgcaggtcgtcgacgagctggaacgcggcatgaccgaggcgggggccgtgatcgccaaggcgggcggcgccctcgacatggtcgcgctcggcgagtgggtgcacgcgggcgacgtgcgcgaggcgttcggggagccgggggcgtacgggggcggcgggctggcgcacgcgctcctgctgctcgcccacgtcagccgcgagaagcggcacgtcccgctgcacgccgacctcgacgacctcgacgagccgctgctgctgggcgacgcggccggggaccggaccccggcgcgctacatcggcgacgccccgaccctcgtacggctgtacgcgggccgcccgctcgtcggcacgcggtacgaactcgcgggggcgggggagcgggagctgaacatcttcggacgc

SEQ ID NO: 3903 - DNA, 675 bp, Streptomyces avermitilis
  CDS (1)..(675)
atgaggcgcatggtcgatcacgacgcactgcaccgccgctggctcggcgccctggtcggggcgcggggcggcgccgcccaacccgatccggcgccgtacggcgagaacctgctgcgtcgctggtcggagccgcagcggcgctaccacacggtcgagcacctcgcggcggtcctcgatcgcgtcgacctgctggcggagtacgcggacgaccccgacgtggtgcgtctggccgcctggttccacgacgcggtctacttccccgaccgctcggagaacgaggagcgttccgcccgcctcgccgagcgcgcgctccccgaggccggggtgtccggggcgaggaccgcggaggtcgcccgcctcgtccgcctcaccgtcacccacgacccggccgacgacgaccgcgacggccgggtgctgtgcgatgccgacctggcgatcctggcggcaccgccgaagacgtacgcggcgtacgcggccgcggtccgcgaggagtacgcgttcgttccggacgactcgttccgggcgggccgcgcggcggtactgcgccaactcctggacctgcccaggctgttcaggacgccgtacggggagcgggagtgggaggagcgggcccgggagaacctgcgggaggaactggcgcggctcgacgaccgcgggaccagcggagcggcacag

SEQ ID NO: 3904 - DNA, 984 bp, Streptomyces avermitilis
  CDS (1)..(984)
gtgcggacaccctggcagcgcgccctggactcggccgggatcacgacagccaaactgcgccgcgactacaccaccgccgcccggcggctcctgacccgcgagaccgccggctacgcggccgtccgcgccctgctgcccgcccggttgcagccgcacctggtggccgccaccgcgttctcctgcgccaccgacgacatcgtggacgccgagcgccccgtcgccgtgcgcaccgctgcgttcgggcgatggcgtgaggcgacccgcacggcgctggacaccggccggtcccgcttcccggtactgcgggcctacgcccacaccgcggccgtgtgcgagcagtccccgggcggcgtcctggagtatctcgaagggacggcgggcgacctggagttcaccggcttcgagaccgaggcggcctaccaggcgtacgtggaccgcctcacgctgccgttcctgatgatcagtacggggctccagtacccggggggcggcgacccggccgtccgcgcgcgctggcgccccttcgccgacgccagccagcgcctggacttcctgaccgatctgcacaccgacctgcgtgcggggcggctgtgcctgccgcgcgaggacctgacgcggcacggggtcacggtgaccgatctggcgggggcgcgggacacgtacggggtacggcggctgatcgccgagacctgcgccaggacgcgtgcggcgctgaccgaggcgcacggcgtcctggagatcgccacccccgactaccagcccctggtccgggccggactgtccctctgggaacaccgtctgaacgaggtggagcgccggggtgcggccgtcctgcgccgcccggtgtcgacgggaatccgcgaaccgctctcgatcctgctgcgcgagacgcgggagcgggggcgggaacgggagcgggggcagagacagggacagggacagggacagggtcgcgcgtcggcctcggacggggtattcagcgac

SEQ ID NO: 3905 - DNA, 282 bp, Streptomyces avermitilis
  CDS (1)..(282)
gtgacgctgtacatcgatccacccacctggccggggcacggacacctgtggtcccacctggtcagcgacgtctcgttcgacgaactgcgcctgttcgccgacgggctgggcgtcccccggcgggccttcgagcgcgaccactacgaccttccctcccaccggtacgcggacgcggtgcgggcgggggcgctggaggtcagcagccgcgaggtcgtacgactgctgcacgcgtccgggctgcgcaggccgaagcaccggggtcccgcgggcccggtcagtcgc

SEQ ID NO: 3906 - DNA, 381 bp, Streptomyces avermitilis
  CDS (1)..(381)
atggaccccatcagccccctggagcaggcgttgcacgcggctcgcgccctggtgctcgccgatctggtcgcgggccaggtcgccgaggcggacgtcgtctccctcgtcgaggagtccgtcgtggagcgccgctggtggctcgagcagtggccggacggcgcggactacgtggccgggctggtcgcgcaggacgtgcaggacgcgctgctggagcggtacggccgctggccgctgtgcccggtgtgcggcgccggcgacccgcacgcgctcgacgtcgagccggagctcggccccgacccgcactgggtgtgccacaaggcgggcgtgaaggtcgcgtcggtggggacgctggggtcggcgacaggcgggaagtcgtcctcg

SEQ ID NO: 3907 - DNA, 924 bp, Streptomyces avermitilis
  CDS (1)..(924)
gtgacccatgacgtgaaggaaattttcgcgggcacgaccggcggggcgccgcccgcccccgccgcgctcgcggccaaggtgcgcacgctcgcgccgtcgatgacccgctccatgcagcgggtcgccgaagccgtcgccggcgacccggccggctgcgccgccctcaccgtcaccggcctcgccgagctcaccggcaccagcgaggccacggtggtacgcaccgcccgcgtcctcggctaccccggctaccgcgacctgcgcctcgcgctcgccggtctcgccgcccagcagcagtcgggccgcgcgcccgccgtcacggcggacatagcggtcgacgaccccatcgcggacgtggtcgccaagctcgcgtacgacgagcagcagaccctcgccgacaccgcggccgcgctcgacaccgtccagctcggcgcggccgttaccgccctcgcggccgcccgccgcgtcgacgtgtacggcgtgggggcctccggtctcgtcgcccaggacctcacgcagaagctgctgcgcataggcctgatagcccacgcgcacagcgatccgcacctcgccgtcaccaacgccgtgcagttgcgcgccaaggacgtggcgatcgcgatcacgcactccggctcgaccggcgacgtcatcgaacccctccgggtcgccttcgagcgcggggcgacgacggtcgcggtcaccggccgtccggacgggcccgtcacgcagtacgcggaccacatcctgaccacgtcgacggcgcgcgagagcgagctgcgcccggccgcgatgtcgtcccgcaccagtcaactgctcgtcgtggactgcctgttcgtgggagtggcgcagcggacgtacgagacggcggcgccggccctgtccgcctcgtacgaggcgctggcgcaccggcaccgcaacactccgcgg

SEQ ID NO: 3908 - DNA, 933 bp, Streptomyces avermitilis
  CDS (1)..(933)
atgacatccatgtcccaccaccgcagtcttcaggccgagttggagacgctgacgaccgaggcgttccggcccgaactcgccgagatcgaccagttgcccaccctggagatcgcgcggctgatgaacggcgaggacgcgaccgtccccgccgcggtcgccgcccgcctcccgcagatcgccgccgcgatcgacgccgtcgccgaccggatggcccggggcggccgcctggtctacgcgggcgcgggcacggccggccggctcggcgtgctggacgcgtccgagtgcccgccgaccttcaacacggacccgtccgaggtcgtgggcctgatcgcgggcggcccgagcgccatggtgacgtcgatcgagggcgccgaggactcgaaggagctggcggccggggacctggccgggctcgggctgacggcggacgacacggtggtcggtgtctccgcctccggccgcacgccgtacgcgatcggcgccgtcgagtacgcgcgggcccggggcgccctcaccgtcggcctgtcctgcaacgcggacagcgcgctcgcggcggccgcggaccacggcatcgagatcgtggccggccccgagctgctcaccggctccacccggctgaaggcgggcacggcccagaagctcgtcctcaacatgctgtcgacgatcacgatgatccgcctcggcaagacgtacgggaacctgatggtcgacgtacgcgcctcgaacgagaagctgcgggcccgctcccgccgcatcgtggccctggcgacgggcgcggcggacgaggaggtcgagcgggccctcgcggccacggacggcgaggtgaagaacgcgatcctcacgatcctgggcggggtcgacggaccgaccgccgcccgccttctggaggagagcgacggccatttgcgcgcggcgctcgcggcggcgccccgc

SEQ ID NO: 3909 - DNA, 1635 bp, Streptomyces avermitilis
  CDS (1)..(1635)
gtgcgtaccactcctcactcagccacggccgccgcgatcctccccctggtcggcggcgccgcgaacgtcacctccgtcgcccactgcatgacccgcctgcgcctgggcctggccgaccgctccctggtggacgaggaatccctcagggcgctgccggccgtgctgggggtggtggacgacgacacgtaccagatcgtcctcggcccgggaacggtcgcgaaggtgaccccggaattcgagaaactgctggcatcggaaaccaccgaggcaccggcgaacgcgctgccggtgaccgccggggccccgacgcccgcagcaccgacggccgccgagggaccggcgacctccgagactccggtagccgccgagccccccgctcgcggtagcgctcccggtaccgaggccgcccggctcgcggcgcgcggcgccgccttgaaggcggctcagcggcagcgtcacgcgacccccgtacgccttctcctgcgccggatcgccaacatcttcgtcccgctgatcccggccctgatcggctgcggcgtcatcgcgggcgtgaacggcctgctcctgaacctggggtggctgccctccctcacccccgccctcgccgccgtcgcctccggcttcatggccctgatcgcggtcttcgtcggtcaccacacggcgaaggagttcggcggcaccccgatcctcggcggcgcggtggcggcggtgatcgtgtacgcgggggtggcgaaggtgacggtgttcggtacgacgctgtccccgggccagggcggtgtcctcggcgcgctggcggccgcgctcctgggaacgtacgtcgagaagtggtgccgcacctgggtcccggacaccctggacgtcctcgtcacccccacgctcacggtcctgctgaccggcctggtgaccctgtacggcctgatgtacgcggccggagcggccacgtcggccatcggcacggcggcgacctggctcctgtccacgacgggcgtcttcgccggcctgatcctgggcggcctgttcctccccctggtgatgctgggcctgcaccaggccctcatccccctccacaccaccctcatcgaacagcagggctacacggtcctcctccccgtgctggcgatggcgggcgcgggccaggtcggcgcggccctcgcggtgtacgtccggctgcgccacgaccactccctgcgtacgacgatccggtcggcgctcccggcgggcctgctcggcgtgggcgaacccctgatctacggcgtctcgctccccctcggccgcccgttcctcacggcctgcgcgggcggcgcggcgggcggcgccttcgtgggcctcttctcgatgctgggcgaccggatcggctcgacggcgatcggcccgtcgggctgggccctgtttccgctgctggcggggagcgggggcctgctccccagcgccgcgatctacgccggcggcctgctgacggggtacgcggtggggttcggggcgacgtacttcttcggctcgttcggcgttgtcggtggcgtgtgcgaggctgaacgcactgatatcgccgcaccgaccggcaccgccgcaccggccatgaccaccaccccgaccgacaccgccgccccgcacgacccggaagggaaccgcaccctg

SEQ ID NO: 3910 - DNA, 585 bp, Streptomyces avermitilis
  CDS (1)..(585)
gtgaaccacgcgcaactgaccgctctgggccgcgccctgcgactcgtcggggagcacggcgaggcactgagctcacagacgcccgacgcgcgcctgcacgaggtcaaggccgacctgaagcgggccctcgacctgctggaggacagcgtcagcgcggcggcgcccagcacccgctgcgccgagcatccgaacggcccggtcgacgaggacgcgcccgacctgtgtctgctgtgcgagacgcgccgccgcgccgcccgccgctcccaggtgaacgacacgtacccgcacggcaggccgcccggcgcggacggcaccgccgagcgcgcccagtcccgctacggggtgcgcggcgaccgcccccagccccagcagcgctggctcccggagctgtggaacggccaggtctggcagctgtgcggcaccccgcgccgggacaagcgcgaggcggagcagtacctcgcggcgcagcgcagaggcccgcgcccggcgatggcctaccgcctggtgcacgagttcaccgactacgaggtcctgcgcatctggggcgagcccctgaaggtggacatcgagccgatgggaaacctg

SEQ ID NO: 3911 - DNA, 375 bp, Streptomyces avermitilis
  CDS (1)..(375)
gtgttggttccgatgtccagcgtgcgacggtccgaggaccgcgggaaatgggcagtggtggtcctcaccggcgaggtggactgcgacctgacgccggcgctgcgtgaggcggtggactccttgaccgccgaggatcacggactgatcgtgctggatctgggacaggtgtcgttcatggactccgcgggcctcggcgtggtggtgtacgggatgcggcgtgccggggcactgggcggcaggctgcggctggcgggccccggcgagcaggtccgcgagctgctgaggctgaccgggctggacgccgccgtcgaggtgttcggtgacgtcccggcggcgtgcgcgtacggcccgacgcccaagggcctggaaagaatc

SEQ ID NO: 3912 - DNA, 1722 bp, Streptomyces avermitilis
  CDS (1)..(1722)
atgggctgcgtggagagttccccgggcggggacgaggacttcgacgcgaacgaggcgttgacgtcggcgctgttcgaagccgtgggcgcgggcatgtacgccgtggacgggcagggaaaggtgatcgcctgcaacccgtgggcggagcggctgctgggctatgcgccgggcacgctgctcggcgtcgacgcccaccacacgctgcacccgatggaaggcgacgagaacggtctgcctgcccagcggccggtcctggccgacatcgtgctcggcaagcggatcagcggcgaccgggccgtgctcttgcgcgccgatggcacccccgtgcaggtgtggtggtccgcggctccgctgccggaggagatgggatacgacaagggcgcggtggtcgtcttccacgacgcctccgccagacgtgcgcgggacggacgccgcgcccggcgctacgcgcacagcgagaccatgcgcgaacaggccgagtacgacctgtcggagatcacctggctcagcgagctgacgctggccatggtcagcaccctggacgcggacgaggcactgggccggctggtacggcaactggtgccccgcctggcggacaccgccctgatcgacctgaccgccggcctcacgcgccggcgcgccgccgccacccaccacctgcccggcgtcctgccctccggaccgcacgacatcggcgagccgttgccgggccatcccgcccacgacgcggcactgtcccgggtgttcggcggcgccggcacgcagcacctgaccgctccgctgccggccggacccgcatatccgggaagagacctgttcgcgctggtggacgcccacgaggccctcgtggtcccgttgcggctgcgcgccagcacgttcggggccctgacgctggtccgcgcgccggccagcccgccgttcaacgaagccgaccggatcctggccgaggaagtggcccgccgcgcggcactcgggctggacaacacccgcctgcacgccgcccaggccgacatcgccgccaccttgcagcgcgccctgctcaccgacctgcccaccgtgccgcgcctggagctggccgcccactaccagcccgcccagcgggcagcggaagtcggcggggactggtacgacgccttcctcctggaggacggcgacctggccatggccatcggcgacgtcaccggacacgacatccaggccgcctcccgcatgagcgaactgcgcaacatgctccgcgccctggtcgtcgaccgccccgaggaaaaccccggccagatcctgcgccgcctggacaccgcccaggcccgtctgaccctcgccgactccgccaccgccatcctcacccgcctgcaccccaccgcggacggaacctgggacctggcctggtcggtcgccggccaccccccacccctgctgatcaccgccgacggcacggccacctacctcaccggcccccgcgccatgctgctgggagtcaggcccaccgcggagcgccccaccgcccacacccgtctgcccggcggagccaccctcctgctctacaccgacggcctggtcgaatcccgcgcgcagccgttcgacgtcggcatgacccgcctgcgccagtacgccaccacccaccgccagctgcctctgcaccggctctgcgcccagctcgcgcacgacctcggcgacacccgcgacgacatcaccctcatcgccgcccgcacgccccccaccgcc

SEQ ID NO: 3913 - DNA, 1125 bp, Streptomyces avermitilis
  CDS (1)..(1125)
gtgaccgtcaccaccgatgccaccgaccgcgccgcacagatcctgtcccggccggtcaccctcaacggcctgaccgtcccgaaccggatcgtgatggcgccgatgacccggcagttctcccccggcggcatccccggtgaggacgtggcctcgtactacgcccgccgcgccgccgcgggtgtcggcctgatcgtcaccgagggcacgtacgtggggcacgagtcggccgggcagagcgacagcattccgcgcttccacggcgaggagcagctggccggctggtcgaaggtcgccgacgccgtgcacgccgccggcggcacgatcgtgccgcagctgtggcacatcggcatggtgcgcggcgcgggcgagccgccgttcgcggacgccccgccggtcggcccgtccggcataggcaccgagggcgccgaggtcaccggcaaggccatgacccagcaggacctggacgacgtcatcgaggcgttcgcgaaggcggcggccgacgccgagcgcatcggcttcgacggcgtggaactgcacggcgcgcacggctatctgatcgaccagttcctgtgggcgggcaccaaccgccgcaccgacgcctacggtggcgacccggtggcccggacgaagttcgcggcggagatcgtggccgcggtccggtcggcggtctccccctccttccccgtgctcttccgctactcgcagtggaagcagcaggcgtacgacgcccgcctcgccgagaccccggaggagctggaggcgatcctggccccgctggcggcggcgggagtggacgccttccacgcctccacgcgccgctactggcagcccgagttcgacggctccgacctcaacctggccggctggaccaagaagatcaccgggaagcccgccatctcggtcggctcggtcggcctgaacggcgaattcctcaaggccttccagggcgagggttccaccgtgcggggcatcgacgacctcctggaccgtctggagtccggggagttcgacctggtcgccatcggccgcgccctgctccaggacccggagtgggcggcgaaggtactggccggacggttctccgagctggccgcgtacgacgcgtcctcgctgaagacgctgcac

SEQ ID NO: 3914 - DNA, 2565 bp, Streptomyces avermitilis
  CDS (1)..(2565)
gtgaagagcggttcacgcctgtctataaggtgtgatcgcttcgaacaccgtgcgaacaaaaggaccctgatgggcagacacataagacggatggcggccctcgccgcgcccctggcgctcggcgcgacactgctcgctccggccaccgcccaggcggagaccgtggtctccgggaactacacatcggtcttcaactaccccaagcccacgacctacgactcctcgatcaacacctcggtcggcgacctgatcgacctcgcggctcccagctcgaccctgtacatgggcatgtactggttcaacagctcggacctgcgggcgaagctcaccgccgcccagacccgcggcgtcacgctgcgcatcatctcggagtcggcgaaccggcccagcagcgacctggacagcctcgcgctgaccggcaactccaccctcacctggtgctcccgcggctgcctgggcaacggctcgggtgacacgaacgcgatcgaccacgacaagtacctcgtgctcgactcgctcaccgacggacgcaagaacgtcgtctggcaggcctcgcagaacctcgcgggcggccaggacggcgagatcaacaacgcggtcgtcgtgtccggcaacgcgaccctcgcgtcccggtaccgcgcgcacttcaacgaccaggtgaagcacgccggcgacagcctgcacacgacgtacgactactccaccggcgacccgagctccccggtcgaggcgtacttctccccgcgcgacaccgcctcggacgccgcccactacggcaacgccgacatcctcgcctcgttcatcgaccaggtcgactgctcgaacgacggaaagatcaggatctcggccgccgaactcgaccagcggaccacccgcccggccgtctacgacgccctggcgacgaagcggtcccagggatgcagcgtcgacgcgaacgcccgcgacctcagtgacggcggcggcaacgacggcatcaacgacctgaccgccctcgacatcgcggcctacggcaaccgccccggcggctgccgctacaagacctccgcaggggcctcctgcaaccacggcaccacccactccaagtacctgctgacggagtggaagaagagcgacggcacccaggtccagcacgtgtacacgggctcccacaactggaccgcgggctcgctgaagacgaacgacgagacgattctgcgcatcgacgacgcgggcacctaccaggcctacgtcgccaacttcaacaaggtgcgcgcgagcgcggtcgacctcgacgccgcgaagtacggctcgacgtcgcagcactactcccgggtcaacgtgaacgcgaacggcgaccagcactacagcgccgtcgcctccggcggcacctcgtccgtctacaccgcggtggcctacgagcagggcgaccggcacgactcctcggacagcgagctgggcaccgacgtgtacctgcgcctgtacaaggacggtgcgccgctgtgggacgagaagctgctgagcaacggcaacaccggtaccggcacgacctggtcgcaccagaagcccgacgtcggcgtggacgaccagggcaacgcgatcgtcgtgtgggccaaggacgacgacggcaacaagtacgccgacatcgcggtgcgcaaggtgaccccggacggcacggtcaccaccctgccgcgtccgcacgcctccggtgacggggaccagctgcggccgacggtcgcggtggccggcgacggctcctacagcgtcgcctgggagaacacggccgacggctcgaccctcaaccaggtgtacgcgagcagttggtccgcgaccggcgcgctgcgctaccaggacgtccaggtcagcacgatcaactccggtgcggccggatcgaaccggcggcccgacgcggcgatcgacaacgccgggaacaccgtgatcgcctgggaggaggacgcggacggcaacggcggcctcaacatcggtgtcgccaagctcaacacctcgggcggcttcaccgtggcccgcaaggtgggcaactccctcaccgacggacagcagaccaagcccgcggtggcctccgccggtgacggccggttcgtcgtggcctggacggacgagtacaccacgggcgcgggcaccctggtccggccgcagcggatcaaccagcgcttcttctcggcggccggcagccccgcggcggcggaccagcggaccaccgaggacggcacgagcagcggtccctacgtcgacggcaagcggccgatctccgaccagacggacgccgatgtcacggtcgccgacgacggcaccttcgtcgtcgcgtggaaggaggccttcgacgtgctcgtcggcaacccggccaccctgtacgcgggcaaggacgacgtgtgggcccgcggcttcaacgccgacggcacgacgaccggcaggttccccgccacccggatgaacgtggtgaccggcggcggccagggcggcccggccgtggccgtcgcttcgaacggccggctcgcgctgacgtactcggacgactacgacggcaacggccacaacgagatgcggctgcgcgacgcgttcagcaactcc

SEQ ID NO: 3915 - DNA, 1623 bp, Streptomyces avermitilis
  CDS (1)..(1623)
atggccaagatcatcgcgttcgacgaggaggcacggcgcggtctcgagcgcgggatgaaccagctcgccgacgccgtcaaggtcacccttggccccaagggccgcaacgtcgtcctcgagaagaagtggggcgcccccacgatcaccaacgatggtgtttccatcgccaaggagatcgagctcgaggacccgtacgagaagatcggcgccgagctggtcaaggaagtcgccaagaagacggacgacgtcgccggtgacggtacgaccaccgcgaccgtcctcgcccaggcgctcgtccgcgagggcctgcgcaacgtagccgccggcgccaacccgatggctctcaagcgcggtatcgagaaggccgtcgaggccgtctccggtgccctgctcgagcaggcgaaggatgtcgagaccaaggagcagatcgcttcgacggcctccatctccgccgccgacacccagatcggcgagctcatcgccgaggcgatggacaaggtcggcaaggaaggcgtcatcaccgtcgaggagtcccagaccttcggtctggagctcgagctcaccgagggtatgcgcttcgacaagggctacatctcggcgtacttcgccaccgacatggagcgtatggaggcgtcgctcgacgacccgtacatcctgatcgccaactccaagatcagttccgtcaaggacctgctcccgctcctcgagaaggtcatgcagtcgggcaagccgctgctgatcatcgccgaggacgtcgagggcgaggccctgtcgaccctggtcgtcaacaagatccgtggcaccttcaagtccgtcgccgtcaaggctccgggcttcggtgaccgccgcaaggccatgctcggcgacatcgccatcctcacgggcggcgaggtcatctccgaggaggtcggcctcaagctggagaacgcgagcatcgacctgctcggtcgcgcccgcaaggtcgtcatcaccaaggacgagaccacgatcgtcgacggcgccggctcggccgaccaggtcgccggccgggtcaaccagatccgtgccgagatcgagaactccgactcggactacgaccgcgagaagctccaggagcgtctggcgaagctggccggcggcgtggccgtcatcaaggccggtgccgccaccgaggtcgagctcaaggagcgcaagcaccgcatcgaggacgccgttcgcaacgcgaaggcggccgtcgaggagggcatcgtcgccggtggtggcgtggccctcatccaggcttcctcggtcttcgagaagctggagctcacgggtgacgaggcgaccggcgccaacgccgtgcggctcgccctggaggccccgctcaagcagatcgccgtcaacggtggtctcgagggtggcgtcatcgtcgagaaggtgcgcaacctgcccgtcggccacggcctgaacgccgcgaccggtgagtacgtcgacatgatcgccgaaggcatcatcgacccggcgaaggtcacgcgctctgccctgcagaacgccgcctccatcgccgcgctgttcctgaccaccgaggccgtcatcgccgacaagccggagaaggccgccgcgggcggcgctccgggcggcatgccgggcggtgacatggacttc

SEQ ID NO: 3916 - DNA, 204 bp, Streptomyces avermitilis
  CDS (1)..(204)
atggctcagggcaccgtcaagtggttcaacgcggagaaggggtacggcttcatcgcggtcgacggtggtgcggatgtattcgtccactacagcgcgattcagatggacggctaccgcaccctggaagagggtcagcgggtcgatttcgagatctcgcaaggccagaaggggccgcaggcggacatggtccgactggcgaccggc

SEQ ID NO: 3917 - DNA, 273 bp, Streptomyces avermitilis
  CDS (1)..(273)
atgagcgtcaacgtccgcatcccgaccatcctgcgcacctacacgggcggcaaggccgaggtcccggcccagggcgcgaccctcgccgaggtcatcgccgacctggagaagaaccacacgggcatcgcggcccgcgtcctggacgaccagggcaagctgcgccgcttcgtcaacgtgtacgtgaacgacgacgacgtgcgcttcgagcagggcctcgagacggtgacgccggacggcgccggagtctcgatcatcccggccgtcgccggcggc

SEQ ID NO: 3918 - DNA, 1296 bp, Streptomyces avermitilis
  CDS (1)..(1296)
atggctgcgcagactgtcgcaagtacctccgtcacctcccccgcgaactccgtcgacctcggtccggccgccgcgctttcctgccgcgagtgcggccaccgcgtgcccctcggtccggtcttcgcctgcgacgagtgtttcggcccgctggagatcgcgtacgacttctcgggctacgacaccgaggaactccgcaagcagatcgaggcgggccccgcgaacatctggcgctatgcgccgctcctgccggtcccggcggacgtcgccgagaagcccaacatcaacccgggctggaccaagctcgtccaggccgacaacctggcgcgtgagctcggtgtcgacgccggcaagctcttcgtgaaggacgactccggcaacccgacgcactccttcaaggaccgcgtcgtcgcccaggccatcgaggccgcccgcgccttcgacttcaccaccctctcctgctcctccaccggcaacctggccggcgcggtgggcgccgccgccgcccgcgccggcttccgttcctgcgtgttcatcccgcacgacctggagcagggcaaggtcgtcatggccgcggtctacggcggcgagctcgtcggcatcgagggcaactacgacgacgtgaaccgcttctgctccgagctgatcggcgacccggccggcgagggctggggcttcgtcaacgtcaacctgcggccgtactacgccgagggctccaagacgctggcgtacgagatctgcgagcagctcggctggcggctgccggaccagctggtggtgcccatcgcctccggctcccagctcacgaagatcgacaaggggctccaggagctgatcaagctcgggctggtcgaggacaagccgtacaagatcttcggcgcgcaggccgagggctgctcgccggtgtccgtcgcctacaaggccggccaggacgtcgtgcggccgcagaagccgaacaccatcgccaagtcgctggccatcggcaacccggccgacggcccgtacgtcctcgacatcgcgcgccgcacgggcggtgcggtggaggacgtgaacgacgagcagatcgtcgacgcgatcaagctgctcgcacggaccgagggcatcttcgcggagaccgcgggtggcgtgacggtgggtgtggccaagaaactgatcgagagcggtctgctcgaccccaccctcacgacggtcgtcctcaacaccggtgacggcctcaagaccctggacgcggtggccgggaccgggctgaccgcgaccattcgtcccagcctggactccttccgggaagccggcctcgcg

SEQ ID NO: 3919 - DNA, 942 bp, Streptomyces avermitilis
  CDS (1)..(942)
gtgctgaacgaagtcgagcgctggctgagcacccgctcctggtccctgaccgatcgcccgctccacaagatcatggccgcgaaacgctcctcgggctcctcggtcagcgtcgtgctgcccgcgctgaacgaggaggagacggtcggcgagatcgtcgccgtcatccggcacgacctgatgcaccaggtcccgctcgtcgacgagatcgtcgtgatcgactcgggctcgacggaccgcacctccgaggtggccgcggccgcgggcgcccgggtcgtgcaccgcgacgagatactcccgcggctgccggccgtgcccggcaagggggaggtcctgtggcgctccctcctggtcaccagcggtgacatcgtctgtttcatcgacgcggacctgaaggagttctcgtcggacttcgtctccggcatcgtgggcccgctgctcaccgacccgggcgtcgacctcgtgaaggcgatgtacgaccggccgctgggcggcgcggcgggccagggcggccgggtgaccgagctgatggcccggccgctcctcaacatgcactggccgcagctggccggcttcgtccagccgctcggcggcgagtacgcggcccgccgctcgctgctcgaacagctcccgttccccgtcgggtacggcgtggagctggggatgctcgtcgacgccctccacctcgtgggcctcgacgcgctcgcccaggtcgacgtcggcgtgcgcaagcaccgccaccaggacggccaggcgctcggccgcatggccgcggcgatctaccgcaccgcccagctgcgcctggcccggggtcacctgatccgccccgcgctcacccagttcgagcgcggcgaggacggtttcgagccgcgcacgtactcggtggacacggaggaacggccgccgatggcggaaatcgccgagtacgcgcggcggaaggccgcg

SEQ ID NO: 3920 - DNA, 1389 bp, Streptomyces avermitilis
  CDS (1)..(1389)
atggcttccacccgaggtgcccagatcctcgtcgcgtccaaccgcggcccggtctcgtacacgctggacgagaccggcacgctgaccagcaagcgcggcggcggcgggctggtgtccggactgtcggccatcggccccgacgcgggcgccctctgggtgtgctcggcgctcggcgaaggcgaccgcgaggcggtgcggcgcggagtcggcgagcccggcgtacggatgctggacgtcgacgcagaggtccacgcggacgcgtacaacggcatcgcgaactcggtcctgtggttcgtccaccacatgctgtaccagacgccgctggagccggtcttcgacgcggagttccggcgccagtgggcggcctacgagacgtacaaccacgccttcgccgcggcgctggccgaggaggcggccgagggcgccgcggtcctcgtccaggactaccacctgacgctggtcccgcggatgctccgcgaactgcgccccgacctgcggatcggccacttctcgcacacgccgtgggccccgtcggagtacttccggatgctgcccgacgacatcgcggcgcaggtgctgggcgggattctgggcgccgaccgggccgcgttcctcacccagcgctgggcggacgcgttcacggactgctgtcacgccgtgctgggccccgggattccctccggtacccggatcggcgtgcacggcctgggcgcggacgcggacttcctgcgggagcgggcgcaccggccggacgtcgaggagcggatggcggcgctgcgcgaggaggtcggcgagggccggaagacgatcgtgcgggtggaccgtacggagctgtcgaagaacatcgtgcggggtctgctcgcctaccgggagctgctggcgtcgcggccggactggcgcgagcgggtcgtccacgtcgccttcgcctacccgtcccgccaggacctggcggtctaccgggactacacggccgccgtgcagcgcctcgcggacgagatcaacgcggagtacgggacgccgggctggaccccggtcgtgctgcacgtcaaggacgacttcgcgcgctccctcgccgcgtaccggctggcggacgtggccctcgtgaaccccatccgcgacggcatgaacctggtcgccaaggaggtcccggtcgtctccgacgagggctgcgcgctggtgctgtcccgggaggcgggcgcgtacgaggagctgggcgaggacgcgatcacggtgaacccgtacgacgtcgtgggtacggccgtggccctccacgaggccctctcgatgccggccggcgagcgcgccgaacgcacgaagcggctggccggggcggcgacggcactgcccccggcccgctggttcctggatcagctgcacgcactggacacc

SEQ ID NO: 3921 - DNA, 861 bp, Streptomyces avermitilis
  CDS (1)..(861)
atgggcagccatacggactccacggactccagggactctttgccgacgcccgcgaccccggccgggcgcgacggtctcgacgccatcctcgcccggcccggccgggccgttctcgccttcgacttcgacgggacgctcgccccgatcgtccccgaccccgatcaggcccgcgcgcaccccgacgcggtccccgctctcgcggccctcgccccgaaggtcgcctccgtcgcggtgatcaccggccgcccggcgggtgtcgccgtccgctacggcggcttcgcgggcgtccccggcctggagcacctcgtcgtcctcggccactacggcgccgaacgctgggacgccgtcagcggcaccgtcaaggcccccgccccgcaccccggcgtcgccgccgtccgcgcggaactccccggcttcctcgatcggatcggcgcctggcagggcacgtggatcgaggagaagggccgggccgtcgccgtgcacacccgccgcgccaccgacccccaggccgccttcgaggccctgcgcgaacccctcaccgacctcgccacccgccacggtctgatcgtcgaacccggccgcatggtcctggagctgcgcccgcccggcatggacaagggcgtcgccctcctggagtacgcgcgggagaccggcgcggaggccgtcatgtacgccggcgacgacctcggcgacctccccgccttcgccgccgtcgacaaactccgctcggacggcgtaccggggctgctggtgtgcagcggcagctccgaggtcaccgaactggccgaacgggccgacctggtcgtcgacggcccgcccggagtcgtgagcctgctctacgcgctggcggcccgcctcggc

SEQ ID NO: 3922 - DNA, 243 bp, Streptomyces avermitilis
  CDS (1)..(243)
ttggcagtcatgtcgtccatggaagagctcagcccgcgggaacaggccgtcctcgcccttgagcgccggagcttcggcggccccggcgccaaggagcgggcgatacgcgagcagctgggcctggtaccggtcaggtactaccagctgctcaacgccctcctggacgacccccgcgccctcgcccacgacccggtgacggtcaaccgcctgcgccgcgtccgcgagaaccgccgcgcggagcgc

SEQ ID NO: 3923 - DNA, 1275 bp, Streptomyces avermitilis
  CDS (1)..(1275)
gtgcagcggcgtacgacaggtttgatcgcggtgttgtcggcactgggtatgacagcgacactcgcgggctgcggcagctcggaggactccggcgacgtgaccctgaagctggtggccgcggattacggcgactcgtcggcgaacagctcccagaagtactgggacacgctggtcaaggagtacgaggcgaagcaccccggcatcaaggtcgaggtcagcgtctactcgtggaacgacgtcgaccgcaaggtcaaggagatggtcgcggccggcaaggcgcccgacatggcgcagatcggggcgtacgcggactacgcggccgccggcaagctgtacaccgccgacgacgtgctctccatccccgtccaggccgacttcgtctcggaactgagcaccgccgggcagctgaaccgggtgcagtacggcatgccgttcgcggcgtccacgcgcctgctcttctacaacaagaagctcttcgcccaggcgggcatcaccggcgcgccgaagacctgggacgagctggccgccgacgcgaaggcgctcaaggcggccggcgtcaagaccccgtacgcgctgccgctcgggccggaagaggcgcaggccgagacgatgcagtggctgctgagcggcggcgacggctatctgagcagtgtcggcacctacaacctcgactccgcgcagaacgtcgccacgttcgcctggctgaaggacgagctggtggggaagggcctcaccggcccgaccgcgccggcgaagctgaaccgggcggccgcgttcgccgcgttcacgcggggcgaggtcggcatgctgagcggccatccgacgctgatgaagatggccgcgaagaagggcgtgaagttcggcatggtgccgatgcccggggtcgacagcgggcccaaggccacgatgggcgtcgccgactggatgacggcgttccgcaagaacggccacaagcagcagatcggcgacttcctcgacttcgtctacaacgagaagaacgtgctcgccttctcccacgagtacgacctgctgccggtcaccaactcggcgtcggaggcgatggccgcggacaaggacgacgccgacatgggtcccttcctggaggaactcccgacctcccagctgtacccggtcggcaagacgtcctgggcgagcgtcagtgccgacatcaagaagcagatcggcaaggccgtgagcccgagcggcaacccggcggcgatcctggggcagctccagcgcacggcggacgcggcggacacgtcggacatcgcggag

SEQ ID NO: 3924 - DNA, 903 bp, Streptomyces avermitilis
  CDS (1)..(903)
atgaaggccgccctggtcggggcctcgggcgagctgctgcaccaggcccgccgggcgaccgggcgggagcgcggtccggacgccgtggtcgacaccgtcctcggcttcgcggccgaactgcgcgcgtacggcgagcgtcatctcggcgaacccgcggccgccgccggcgtcgccgtccccggcatcgtcgacgccggccgcggcctcgccgtctacgcggcgaacctcggctggagcgacgtacccatgcgcaagctcctcggcgaacggctgcacggcgtcccggtcgccctcggccacgacgtgcgcaccggcggtctcgccgagggccggatcggcgcgggccggggcaccgaccgcttcctgttcgtggcgctgggcaccggcatcgcgggcgccatcggcatcgacggcacggtggaggcgggcgcgcacggcttcgcgggcgagatcggccacatcgtcgtacgccccggggggactccctgtccgtgcgggcagtacggctgcctggagcggtacgcctccgccgcggcggtcagccaggcctgggcacaggcctccgggaacccggacgcggacgcggcgagctgcgcgcaggccgtggagtcgggcgacgagcgcgccgtacgggtctggcgccgggccgtggacgcgctcgccgacgggctggtcaccgcgctcaccctcctggacccgcgcaccctgatcatcggtggcgggctcgccgaggcgggggaaaccttgttcacaccgctgcgcgcggccatggaacgccgcgtcaccttccagaagctgccggccctcgtccccgcggccctcggggacacggccggatgtctcggcgccgggctgctcgcctgggacctgctctcgacccatgactctccggaggtaaccgcc

SEQ ID NO: 3925 - DNA, 1143 bp, Streptomyces avermitilis
  CDS (1)..(1143)
atggccactagcaacgtgctcgccggtgcccgggtggtgctgcccacggggatcgtggacggcggccgggtgatcgtcgagggaacgcgcatcgcgggcgcctcctccgaggacgccccggtcgtggacctgtccggccactggctggtcccgggcttcgtcgatctgcacaaccacggcggcggcggcgcgtccttcacctcgggcaccgccgaggaggttctccggggcgtccacacccaccgcctgcacggcaccaccaccgtcgtcgcctccaccgtcaccggcgagatggacgtgctggcccagcgcgcggggctgctctccgagctggccgagcagggcgacatcgccggcatccacttcgagggcccgttcatctcgccgtgccgcaagggcgcccactccgaggaactgctgcgcgacccggacccggccgaggtccgcaagctgatcgacgcggcgcgcggcagggcgaagatggtcacgctggccaccgaactgccgggcggcatcgactccgtacgcctgctggccgagcacggggtgatcgccgcgatcgggcacacggacgcgacgtacgagcagacggtggaggccatcgacgcgggtgcgacggtcgccacgcacctgttcaacgcgatgcccgcgctcggccaccgcacgccgggcccgatcgccgccctcctggaggacgagcggatcacggtcgagctgatcaacgacggtacgcatctgcacccggccgccctccagctggcgttccatcacgcgggcgccggccgggtcgcgttcatcacggacgcgatggacgcggcgggcttcggcgacggccgctatctgctcggcccgctggaggtcgaggtcagtgagggcgtggcgcggctgatggagggcggttcgatcgcgggctcgacgctcacgctggaccgcgccctcaagcgggcggtcaccgtcgacgggctgccggtcgaggacgcggtggcggccctgtccgccaacccggccaggctgctcggcgtgtacgaccaggtgggctcgctggagcccggcaaggacgccgacctggtggttcttgacgcggagttcacgctcaagggcgtgatgcgcaagggcgaatgggtggtcgatccccaactgggg

SEQ ID NO: 3926 - DNA, 927 bp, Streptomyces avermitilis
  CDS (1)..(927)
gtgatcctcacggtcacgctgaacaccgctctcgacatcacctatcgcgtacgggcgttgacgccgcacgcctcgcaccgggtgaccgagatggccgaacggcccggcggcaagggcctgaacgtggcccgcgtgctggccgccctcggccacgaggtgacggtgacgggtttcacgggcggggcgacgggccgcgccctgcgggagcagctcgcgcacacgccgggggtggtggacgcgctcgtgccggtcggcggcgcgacccggcgcacgatagcggtggtcgacgagacgaccggtgacacgactcagctcaacgagccggggccgaccgtgacgcccgccgagtgggccgccttccaggaggcgtacggggaactgctgcggtccgcctcggcggtggccctgtgcggcagtctgccgccgggggtgccggtgggggcgtacgccggtctggtccgcgccgcacgcgcgcaggcggtgcccgtactcctggacaccagcggcgaaccgctgcggcgcggggtggcggcgcggcccgacatcgtcaaaccgaacgccgaggagctggccgaactcaccggctcgcacgagccgtggcaggccacgcgcgacgcccgacgtcgcggggcgaacacggtggtggcttcgctgggtgccgagggcctgctggccgtgaacgcggagggccactggcgggccaccccgccgcaccgggtccggggcaatccgacgggggcgggcgactcggtggtcgcgggcctgctgtcgggcctggtggaccagctgccgtggccccggcgcctggcccgggcggtggccctgtccgcggcgacggtgctgtccccggtggcgggcgagttcgaccgccggacgtacgaggagctcctggaccgggtcgcggtgacgggggacgccaccgcggcg

SEQ ID NO: 3927 - DNA, 948 bp, Streptomyces avermitilis
  CDS (1)..(948)
atgacgcccggcaacaacggcgcgagcacgcccgaggacgacgacccgttcggctatctctacgccgatggtcaggccaacggagccaccccgcccagcggtggtggcggttacggctacccgggttcggtgaaccgggtgcgggcggtgggtgagcggcagtacggccagcagaacgccaccgccgcgtacggccaggtcccgcagcaggggacctacgggcagcagcagccggggtacggccagcccaacgcgcactacgcggcgcccgagaccgtgcccggcggcgcggtcacctcccggcaggcgccggtgggcggcgggcggggccggggccccaacaccaaggggctgctgatcggcgcgatcgccgtggtcgccgccgtggtgatcggcatcaccgtcgtcatggtcggcggcgactcggacgacgacaagaacggcagcgaggcgggctcgacccccacggccgcccagagcgcggagccgagcaagtcggccggccagaagtcgccggaggccggcaagctgcccaccatcgacgccaaggcgctgaagctggacggcggcgcgacgaccgcgtcggacgtcgagggcgccaaggccgacggcgggatctacgtgtcgggtctcagcaccgtcggcgcccaggtcacctggaccgtcaacggcatccccaaggacggcctctacaccgtcttcgcgcgttacaacgtcgtcggcgagaaccagtcgatgaccgtcacggtcaacaacaagacgttcggcagcaagctgaacctgggcaacttcacgggcgccaccgaccccgcgaagggctggatgaagacctacgcgtggcccacgctcaccaagggcaccaacacgatctcgatctcctgccaggacggcgacaagtgcaacatcctcctggaccagctgtggctgaaggcaggcaaggtcaaggac

SEQ ID NO: 3928 - DNA, 1704 bp, Streptomyces avermitilis
  CDS (1)..(1704)
atggagaccgagtcggagccgtacgtccgccttacgaccctgcggcagctgcatcaggtcatggcggacatgaacaccgcgcggagcctggcggacacgctgcagaccgtcgccgacggcgtggtcaacggcctcggctacgagctggcctgtgtcaacctcgtacgcccggacggcgacctcgtggtcgccgccttcgccggcaactccgccgccgaggcactgatcaccggccgcgtcggctcccgcgtctcctgggaccgccgcctcgacatgggtgaggcctggggcgacctgcggttcataccgcataccgagggctgggtcctcgacgaggacgacgtaccgcagtggtacaccgacggccccgagccccgcttcgaggacgagtggcacccctccgaccggctcttcgcgccgatgtacacccccggcgtccagggcgcctcgtgcggcgagctgatcggcgtgctctccgtcgaccggccgcgcaacggccgcaagcccggcgcgtgggggcgcgaggctctccagatgtacgcgttccaggccgcgatcgcgatcagcaacgcccgtctcagagcgaacatgcagcgcgccctggtccggctggagcgcgagcagcaggccctgcgcgccagcgaggagtcgttccggcaggccttcgagtacgcgccctccggcatggccatcgccgagatgggcggcgaccagcacgggcgaatactgcgcaccaacgacgccctgtgccgcctcctgggccgccccgcctcggcgatgcgccgctactcgttctccgacctcgtccaccccgaggacatcggcaccctgctgcgcacctccgccgagggcggccgggccgagctgcggctcgggcggcgcgacggcacctacgtctgggtgtccctgcgcaactcggtcgtcgcggacgccgccgacggtccgcgcttcctgctcacgcacgtcgaggacatcgaggagcgcaagcgccgcgagctccagctcgcccaccgcgcctcccacgactccctcaccgggctgccgaactccgccgagctgcgctcccgcctctccgcccgcctgtgccggcgcccgcagtccgcggagctgggcgccgtcgagtccctcgacgcggcctacgcgcacggccagtacacgacggagcacccggcggcgtacgacacgagcggacacggagagcagccggggcacggacacgggttcgacttcacccaggggccggggccgtacgacgccttcgaccaccacgtccacaccgtcgcccccgaggggcagaccgacgacgggaccaaggggctcgcggtcctcttctgcgacctcgacggcttcaagtcgatcaacgaccgcttcgggcacaacgccggcgacgccgtgctgatcgaggtcgccagacggctgagcggggcggtacgggacggggacacggtcgcccggctcggcggcgacgagttcgtagtcctcgccgacgggctcggccgggccgatgcccaggacctcgcggtgcggctgcgcaacgagatcatccagccggtccgggtcgacggccgcacgatgcgcgtcggcgccagcttcggcatcggatgggcacactgcggcatgacggcggacgaggtattgaaatccgctgacgagcggatgtacgtggagaaacggtctcgtcccaaacagcatcgacgtgcgggg

SEQ ID NO: 3929 - DNA, 576 bp, Streptomyces avermitilis
  CDS (1)..(576)
gtgctgaacactccccctgccctacctcccgccgccgtacccgccgcccctcccgtgcatgctgagggggtgagcaacgacgagttccgcgccgccatgtcccggctggccgcgggtgtggtcctggtgaccgcgcacgagcccgcgctggatccggacggcccgggcggcgaggacatcggcatgacggcgaccgcgttcgtgtccgtgtccttggacccgccgctggtcatggtcagcctgcgcgagggctcccgcatggacgacctgctcgccgaacagcccctgtgggccgtctccgtgctctccgacaaccagcggcacatcgcgggccgcttcgcgatgaagggccgcatcagcgaccgtctgctgttccaggacatcccgtacgtccgcggggaggccgccggggcactcctggtgggcggcgccctggcgaccctggagtgccgcacggaacagcgggtggcggccggcgaccacacgctcgtcatcggccgcgttctgacggcggacgtaccgggcgcggacggcggaccgctggtgcatttccggggacggtaccggcacttggag

SEQ ID NO: 3930 - DNA, 426 bp, Streptomyces avermitilis
  CDS (1)..(426)
atgtccggtccctacgtcatccgcggctccgtctccctgcccgaggccgagctcatgtggcgtttctcgcggtcttccgggcccggtgggcagcacgtcaacaccagcgactcgcaggtcgagctgcgcttcgacctcgcgaagaccgaggcgctcccgccggtgtggaaggagcgggccctcgccaagctggccgggcggctcgtcgacggagtcatcagcgtccgcgcctccgaacaccggtcgcagtggcgcaaccgggagacggcggccgtacggctcgcctccctgctggccgaggcgtccgcgccgccgccgaagccccggcgggcgacccgcattccgcgcggcatcaatgagcggcgtttgcgcgagaaaaagcagcgctccgacaccaagcgcggacgcacgggtcgcgactgggga

SEQ ID NO: 3931 - DNA, 573 bp, Streptomyces avermitilis
  CDS (1)..(573)
atggctgtaagcctgtccaagggtggcaacgtctcgctcaccaaggaggctccgggcctgaccgccgtcaccgtgggcctcggctgggacgtccgcaccaccacgggtaccgacttcgacctcgacgcctcggccatcgcggtcaaccccacgggcaaggtctactcggacgcccacttcgtcttcttcaacaacaagcagaccccggaccagaccatcgttcacaccggcgacaaccgcacgggcgagggcgcgggcgacgacgaggcgatcaacgtcaacctggcgggcctccccgccgacgtcgacaagatcgtcttcccggtctccatctacgacgccgagaaccgctcgcagaacttcggccaggtccgcaacgcgtacatccgcatcgtcaaccaggccggcggcgcggagatcgcccgctacgacctgtcggaggacgcggcgacggagacggcgatggtcttcggcgagctgtaccgcaacggcgcggagtggaagttccgcgcggtcggccagggctacgcctcgggcctggtgggcatcgcccaggacttcggcgtcaacgtc

SEQ ID NO: 3932 - DNA, 852 bp, Streptomyces avermitilis
  CDS (1)..(852)
atgccgccaagagacattccaaccgcccgacaggcccgattgggcgctgagctgcggaagttgcgtgagctcgcagggaagacggcccgtgaggcggccggcctgctctcgaccgaccaggccaagatcagccacatagaggcgggccgcatcggcatcagcgaggaacggatccggcggctggcggtgttctacgcctgcgacgaccgggatctgatcgaggcgctgtgcgccatcgctcgcgagtcacgcggccagggctggtgggacgagtaccgaggagtgctcgcgcccgggttcctggacatcggtgaactggagaaccacgcaacgtacttgcgcacagtcgcggtgatgaccgtgcccggcatcctccagaccgaggactacattcgggcgatccaccgaagcgctacgccaccacttccggccgaggaagtggacgcacgtgtggagtttcggttgaaacgccggagcatcttcgatcgggatactccgcccccgttccgagtcatcgttcacgaagcggcgctgcgtatgcgcttcggcggccgcaaggtcgccaaggggcagcttgaatatctgctcgaagcatctgagtggccgacagtgacagtgcgagtcatcccgttcacctgcgaggatttcgtcgaggcgacgtatccgctgctgtacgcggggggagttgtgccgcaactcgacacggttcagatggacagtcctgtgggtggcgtcttcatcactgcggccgcccaactcaagaggtacgtggggatgctcgacaccgccgagcggtcgtcgctgagcgagttggagtccgcgcagctcatccaccggatcgcaagagaacta

SEQ ID NO: 3933 - DNA, 414 bp, Streptomyces avermitilis
  CDS (1)..(414)
atgaacgccaccctcatcaccccggggacctaccacctcaccacccccaactcccccctcacccccaagatctgccgcgacaccgtcgccatactcctcgccacgaacggccacgcccccggtctcgccgacaccgctcgcaccctcgtctccgagctcgtcaccaacgccgtactccacaccgcctcgcccaccatcgacatggagacggccgtgctgagcgacggcgtacgggtcgcggtgtacgacgacagtccggccgcgcacctggagccgctcgcccccgcctgggacggggagggcgggagaggattactcctcgtgcaggccctggcgcaggcgtggggtgtcgccacggcgcgcccctacggccgtaagcacgtctggttcgagctgcggagcggtagcggcggc

SEQ ID NO: 3934 - DNA, 954 bp, Streptomyces avermitilis
  CDS (1)..(954)
atgcgcctcgatgccctccctctcaccccggaccacgacatcccggcccccctcctcaccgaactcaccgccctctacgccgcccaccgcgagttccacgccctgagcggcgacttccccgatccggacgacatccggcccgagcaggtcgcggcagcgctcgccgacgagctggcgaacccggacgtggaggtgctgctcgcgcgcagtgccgggcggctcgtcggggtggtgatcaccctcgcgcaccaccccgaccccgccgacccggacccctggatcggcctgctgctcgtggctgtggaggagcagcgcagggggtacgggcgggagctggcggcccgcgtcgaggagcggtttcgggccgccggccggaccgccgtacgcctcgccgtccacgacgacaacccgggcggcctcgccttctggaccgcccttggctacgaggtcgtcgaccaccgcacggaccgccaacggggccggccgtgcgccgtgctgcgcaagccgctgccgagcgcgacgccacgcaccccgcgccgggcggcacgcgtcgccgtgctcgatccgggcggcgcggtcttcctcttccggtacgacaacgaagaggtgggcgtccactgggccctgcccggcggcggactcgacccaggggagagcgcacgtgagggcgctctgcgggagctgcgcgaggagaccgggtggaccgacctggagccggggcccccgctgtgcacgtgggaacacgacttcacccgggccggggttcccgtgcgccagctcgagcacgtctacgtggcgcgcgggccgcgccgggacccggtcggcgaccaggtcggtgccgcgcacgccgaggacggaatcctcggctggcgctggtggaccccgcaggagctggccgactcgcccgaggccctctggccgccccatctcccgcggctgctggccgagttggac

SEQ ID NO: 3935 - DNA, 1047 bp, Streptomyces avermitilis
  CDS (1)..(1047)
atgccgagcggcggatgttgcagggatgggcccggcgccggacgactgctcagggcctggcgttacgggcacggattgtgctggcctgcgcggacggcggcagtaacaccgcgggtggccgcgcggatgggcgtcaaccggggcacggtgaccaagtggcgggcgagattcctgcgcgaccggttggacgggctggccgacgagccgcgcccgggggtgccgcgcaccatcaccgatgcccaggtggaggaggtggtggtgcgcacgctggaggagacccccgagggcgcgacgcactggtcgaagcgggagctggccaggaccgtggggatctccccggcgagcgtgctgcggatctggcacgccttcggcttgcagccatggcggaccgagaccttcaagatctctccggacccgcttctgatcgacaagatccgtgatgtcgtcggcctctacctcgccccgccggccaacgctgcggtgttcgcggtggacgagaagccgcagatccaggctctggaacggacggcaccggtgctgccgatgctgcccggagtgcccgagcggcgcagcttcgactacgtccggcatggcacggtcgatctgttcgccgccctgaacaccgcgacgggcagggtgatcacgaagctgtccgcgcagcaccgggccgtggacttccgggacttcctcgacgagatcgaccgccagaccgagcccggcctggcggtccacgtgatctgcgacaacctctccgcccacaaggcaccggtggtgcacaagtggctgctcgcgcatccccggttccgcctgcatttcacccccacgtactcgtcgtggatcaatcaggtcgagcggtggttcgccgaattagagcggcgctgcctggagcgcggagtgttctgctcgctggacagccttaaggccgcgcttgaggaatggatcaaggtctggaacgaggaggcccggccgttcaagtggaccaagaccgccgaccagatcctcgaccggatctgccgttactgctcacgcatctccgaaccagctcac

SEQ ID NO: 3936 - DNA, 1407 bp, Streptomyces avermitilis
  CDS (1)..(1407)
gtgccccgatctgccgccgccgtgccctctgccctggccctttccctggtcctggccctcaccgcctgcgacggcggggtgcagggcacccccggcggctccgggctgcgcgacccgtacttcgcgaagatgggcaacggcggctatgacgtcacccactacgacctgaccctcgcctacgaccccgggcgccgccacctcaccggaacggccgtgatcacggcgcgggcgaagcaggacctgaccgcgttcgccctcgacctcgacgggctggacgtcggcggcgtcaccgtcgagggccgcccggcgcgctggaaccgcaccgggcaggaactgaccgtgcgcccgcacgacgacctcgacaagggcgagacgttccgcacgacggtccgttactcgggcactccggtgacgatcaccgacccggacggctcgaaggagggctggctgaagacggccgacggcgcgctcgggctcggtgagccgaccggttcgatggcgtggttccccggcaaccaccacccctccgacaaggcgtcgtacgacatcgaggtcaccgtcccgaagggcctgcgggccgtctccaacggtgagctgacgcgcgagacgacgagcggggaccgtacgacgttcgcgtggcatacgcccgaaccgatggcgagttacgtcgccacggtcgcgatcggccactacgacgtccggcgttcgacgacgaagagcgggctgccggtgtacgtggcggtcgacccgacgcaggcgaaggcgagcgcgaaggtgctggcgaagctcccggagatcatggagtgggaggagaacaacttcggcccgtaccccttctcctccaccggcgcgatcgtggaccgcgagaacgacgcgggctatgcgctggagacacagaaccggccggtcttcccgggcgcgcccgacaccgggaccctggtgcatgagctggcgcaccagtggtacggcgactcggtgacgccgaagtcgtggcgggacatgtggctcaacgagggcttcgcgacgtacgcggagtggctgtggcaggaggaccacggtggtgaaacggcccaggagaccttcgacgcgctctaccggggcgacgggggcggggacggggccgccgacaaggcgcgctgggcgtttccgccgggcaagccccccggtgccgcccacatctccgacaggccggtgtatgagcggggcgcgatggtcattcacaagatccgcgagacggtcggcgacgacacgttctacgacatcatccagggctgggccgccacccaccgccacggcaacgcggacacggccgacttcacgacgtacgtggagaagaaggcacccggcaaggacttcagcgcgatctgggacgaatggctgtacggggagggcaagccggcgaagccc

SEQ ID NO: 3937 - DNA, 498 bp, Streptomyces avermitilis
  CDS (1)..(498)
gtgctcgacatcggttacgccctctccaaccgcttccccgaccccccgcagaccgactaccgccgcgcggacgtccacgcgctgcggcacgacctcttctgcggtgacgtctacctcgccgacaccaagtcggaccgggagctgtccacagcctggggatgggtgccggtgctcgacttcgcgtgggcgctgtgcgacatcgtcgagcagctcgaccgggatccgcgcggcagccgggcctcccgcccccagcacgccgaactcgacttcaccgagtccaccgaccgcatgctcttcgagcgccgcttcggctgggtggacatcgaggccgactggatgcccggcgacgagcccccgctcaccttctcccacgccgaactgcgccgcgaggcccgcgacttcctgcacgacctgctcgccgacctcaccgacctgcacgaggcgctccgcgagaacccggcgatctgggccctcgaggcccgctttccgagagtgagc

SEQ ID NO: 3938 - DNA, 792 bp, Streptomyces avermitilis
  CDS (1)..(792)
gtgaacacgcaggtcggggcgattgtcagtgggggcgtgcaggatgagggcatggtgcggaaagcggcgggcgccgcggtgaggggcacggcggtgaggggcacggcggcgacgggcaaggcggtcaggggcaaggtggtcaagggcgcgcggcggccggaggtgcggttgccggtgctcgagtcgtacgcgggcggcgagttggagcccgacggggactacgacgggctggagttcagggacgcggacttcgccgggcaggacggcgggggcgcgcggttcatggactgcgcgctgacggggtgcgccgtggacgagacgcggctgcctcacgcgcgcgtactggactccgtgctgacggggctgcgcggtgtgggcaccgacctcgcggaggcgacgctgcgtgacgtggagctggtggacgcccggttgggcggcgttcagctgcacggtgccgtgctggagcgggtcctggtgcgcggcggcaagatcgactacctgaatctccgcacggcacggctcaaggacgtcgtgttcgagggctgtgtcctggtggagccggacttcgggggcgcccggctggaccgggtggagttcgtggactgcgtgctgaagggagccgatttccacgcggcgacactgaccgacgtggacctgcgccgggcggccgagctggggatcgcgcgcggggtggaccggctggcgggggcggtgatcagtccgacgcagctgatggacctggcgccggtgctggcggcggagctgggggtgaaggtggccgcggcgggggcg

SEQ ID NO: 3939 - DNA, 1167 bp, Streptomyces avermitilis
  CDS (1)..(1167)
atgcagcgcatcaccctcaccgtcgtcggcggcggcctcgccggactcaccgcggcggtcaccgccgccgaggccggcgccaaggtcaccgtgtacgaggcccaccacaccctcggcggccgggcccgcaccgcgcagggcccgtaccggaccaacgagggcccgcacgccctctacagctgcggcccgcactggacctggctcaggcagcgcgacctgatcggcccgctcgcccccgttccgcccctggaggcggcccgcctcaggctccgccacaagggcgtcctgcgccgcaccccgcccttcgcgatgctcaagctcctgcgccgtaccgcccgacaggcgccggccgacgtcgacttcatgacctgggccaccgaacaggcgggcgaggaaggcgcccgcgccgccgcgaaccacgccgccatctccctcttccaccacgaccccggctccctctccgccgccttcgtccaggaacgcctgcgccgcaccgccaagctgccgccggaggcgcaccacccgcgcggcggctgggcgagcgtcatcgaccggatggcggcgcgggcctggaacctcggcgtccggatggagaccctcgcccgcgtcgacacgatcccggagaaccggggcccggtcgtcgtcgcgacctcgctcgacgccgcccggcgcctcctgggggacgactcactggcctgggacagcggccgtaccgccctcgtcgacctggccgtacgcacccggcgcggcgacgcgttcgccgtctccgacctggacgcgcccggctggatcgagcgccgcacggcccaggaccgctccctcgcacccgccggtgaacagctcctccaggggcagatcccgatcgcgccccacgagtcccgcgccgatggcgtcgcgcgcgccgagcagttgctggacctcgccttcgccggctggcgcgagcgcgtgacctggcggcgggaggcggtcgcgcagggccgtacgggagccgtggacctgcccggcaccagctggcgcgaccggcccgccgtcgaccgcggcgacggcgtctatctggcgggcgaccaggtcgcggcccccggcgtgctctcggaggtctccttcaacagcgccctcaccgccgtgtccctggcgctgggccggcacacacttgacctcaagcaagct

SEQ ID NO: 3940 - DNA, 987 bp, Streptomyces avermitilis
  CDS (1)..(987)
atgcacgccgtccgcctccacgccttcggcccggccgagaacctcgcgtacgagaaggtcgaggaccccgagccgggccccggccaggtccgtatcgccgtcgccgccgccggcgtacacctcctggacgcggccctgcgcgaaggcgtacggggcccggcccccgagcccaccccgctgcccacgattcccggccgcgaggtcgccggcaccgtcgagtccctcggcgcgggcgtcccgggcgaccggctcggcaagcgcgtcgtcgcccacctcggcttcgcccccggcggctacgccgaactcgccgtcaccgatgccgaccgcctccacgagatcccgcggaacctcgacttcgcccaggccgtcgccatgatcggaacgggccgtacggcgctcgggatcctccagttcgccgagctgggcccggactccgtggccgtcgtcccggccgccgccggcggtatcggcacccttctcgtgcagtacgccaagtccgcgggcgccacggtgatcggcctggccggcggcccgcagaaggtggcgcgggtacgcgacaacggtgccgacctcgccgtcgactaccgggaccccgactggccggagcggctcgcgcagtaccgcggcagggccaccgtcgtcttcgacggcgtgggcggggacacggcccgcacggccgtcgggctcctcggccccggcggcaggcacctcgtcttcggatggtccggcgaaggcatccagaacgggcagccgctgctcgtcgacgacaaggaccgggggatcgtctccgaacaggtcctcggccccgtgatgctgcgccgggcgggcggcccccaccccctgcgcgccctggaactgcgcgccctcgccgaggccgcggcgggccggctgaccccggccgtccagcgcttcccgctcgccgaggcggcagccgcgcaccgggccctggagagccggcggaccgtcggaaaagtggtgctcgagcca

SEQ ID NO: 3941 - DNA, 1497 bp, Streptomyces avermitilis
  CDS (1)..(1497)
gtgaatgtcacccgaacaggtgaatccacctacgtcctggaccccgacccccgccgctggtggagcctggtggtcatcgccctcgcacagctgatggtggtcctggacgcgacgatcgtgaacatcgcgctcccctccgcccagcgcgcgctgggcatgtccgacggcaaccggcagtgggtcatcaccgcctacacactggccttcggcggactgcttctgctcggcggccgcatcgccgacctggtgggccgcaagcgcacgttcatcatcgggctgatcggcttcgccgccgcctccgcgctgggcggcgcggccaccacatccgggatgctgttcggcgcccgcgccctccagggcgccttcgccgccgtactcgccccctcggccctctcgctcctcaccaccaccttcaccgacccgaaggagcgcggaaaggccttcggcatctacagcgcactggccggcagcggcagcgcgatcggcttcatcgcgggcggactgctcaccgagtacctgaactggcgctggtgcctgtacgtcaacatccccatcgcagtcatcgccgtctgcggcgcgttcgccctcctgcacgaacagccgcggcacgcgggcgcccgtctcgacgtccccggtgcgctgctcggctgcggcgggctcgtcgcgatcgtctacgggttcagcgaggcggagccgcgcggctggacggacccccgggtgctggccctgttcgccgtgggcatcgtccttctcgccgtgttcgtgtggtggcagaccagggcgccgcagccgctgctgccgctgcacatcgtcaaggaccgcaaccgcgcgggctgcttcctgaccatggccctcgccgtcatcggcttgttcggcatgttcctgttcctgacctactacctccaggtcgtcctcggctactcccccctgaagacgggcctggccttcctgcccctgacggtcgcgatcatcatcggctcgacccagatctcggcccgcctgatgagccacgtggccccgcgcctgctcatggtccccggcacggtcctggccgcgggcggcatgctggtcctgacccggatcaccgtgcactcgccgtacgcgagcgaactcctgcccgctctgatcctgatcggcctgggcatgggcctcaccttcatgccggtcttcgccaccgccaccgcaggcgtcgccccgcaggactcgggtgtgacctccgcgaccgtgaacacggcccagcaggtgggcggttcgatcggtacggccctgctgaacaccatcgccaccaccaccagcaccgcctacatcgcggcccatctgcgcgaccccgcccgcaaggaactggtcatacgcgaaggcatcgtccacggctacacggtggccatctggtgcgcggcgggcgtcatgctcctggcgggcctggcggccggcctgatggtcacgacgaagcccccgcggcacaccccgtccgacacccccgtacccgagtcggtgggg

SEQ ID NO: 3942 - DNA, 471 bp, Streptomyces avermitilis
  CDS (1)..(471)
atgattcgcgccgccacttccgccgacatccccgtcattcacgccatgatccgcgagctggccgagtacgagaaggtgccggacgaggcgcgggcggacgaaccgcagctcgcggaggcgctgttcggggagcggccggccgcgttcgcgcacatcgccgaggaccgggggctgccggtcggcttcgcgctgtggttcctgaacttctccacctggcgcggggtgcacgggatctacctggaggacctgtacgtacggcccgaggcccgcggcggcggccacggcaaggcgctgctgaccgaactggcccggatctgcgtcgagcgcgggtacgagcgcctggagtgggccgttctgaactggaacaagccgtcgatcgacttctacgaggcgctgggtgcgcgtgcgcaggacgagtggacggtgtaccggctgacggacggggcgctgaccgccctgggggcacgcgcc

SEQ ID NO: 3943 - DNA, 1413 bp, Streptomyces avermitilis
  CDS (1)..(1413)
atgagcagctcggcaagcagcctcggccgtgtcgtgaacggcggcatctccttctggtacgcggacgacggattccccgccccgcgtgagccgctgcccggcgacgcgaccgccgacgtcgtcatcgtcggcggcggctacacgggcctgtggaccgcgtactacctgaagaaggcggccccctacctgcgcatcacggtgctggagcagaagttctgcggctacggcgcctccggccgcaacggcggctggctctacaacggcatcgcgggccgcgaccgctacgcccggctgcacggccatgaggcggccgcccggctccagcgggccatgaacgacacggtcggcgaagtcgtccggatcgcggctcaggagaacatcgacgccgacatccaccagggcggcgtactggaagtggcgtacacgcccgcccagctggcccgcctcaaggagttccacgcccacgagctcgcgtacggcgagaaggaccgcgagctgtacggcgcccgcgagacggccgagcgcgtccgggtcgccgacgcggtcggctccacctggaccccgcacggtgcgcggctgcacccggtgaagctggtcaagggcctcgcggcggccgtcgaggcgatcggtgtcaccgtgcacgaacagaccccggtcacggagatccgtccccagcacgcggtgacgccgtacgggaccgtccgcgcgccctacgtcctgcgctgcacggagggtttcaccgcgaacctcaagggccagcggcgtacctggctccccatgaactcctccatgatcacgacggcgccgctcaccgccgagcagtgggacgcgatcggctgggcggggcgcgagacgctcggcgacatggcccacgcgtacatgtacgcccagcgcaccgccgacgaccgcatcgcgctcggcgggcgcggagtgccgtaccgattcggctcgcggacggacaacgacgggcgtacgcaggccgcgacggtcgaggcgctgtacgagatcctgatccgcttcttcccgtccctcaccggcgtccgggtggaccatgcctggtcgggcgtcctcggggtgccgcgcgactggtgcgcgacggtgacgctggaccggtcgacgggcctgggctgggccggcggttacgtcggctccggcgtggcgaccgccaacctggccgcccgcaccctgcgcgacctggtccggcaggactcggggcaggccggggcgacggagctgaccgcgctgccgtgggtgaaccaccaggtgcgcaagtgggagccggaaccgctgcgctggatcggcgtgcacggcatgtacgccacgtaccgcacggcggaccgccgcgaactgaccacccacagcgtccagtcgtcccggctggcccggatggcggaccgggtggcgggacgtcac

SEQ ID NO: 3944 - DNA, 588 bp, Streptomyces avermitilis
  CDS (1)..(588)
gtgtggctggcgatcctcttcgtcaccaccgtcgccctgcaccacatgtcgccggatttcgaagaggacttcctgcgccagcggtcgaccaacatccacgagctgtcgcgggatccggtgcgcgtgctgatcaccagcgccatgtggatcgacggcggccactggctgccgtacgcggtcctgttcaccgtcttccacgcgcaggcggagcgctggctcggcacgccgcgctggctggccgtgtgcgtcgccgcgcacgtgctggccaccctcgccagtgagggggcgctgctggaggcgatccgtgacggggtcgccccgcgctcggcggtcaacaccctggacatcggcgtgagttacgcgctcgcgggggtgatcgcggtgctcacgtaccggatcgcggagccgtggcggtacgggtatctggtggtcgtcctggcggtgtacgggggctcgctcgcggccagccccaccttcaccgatttcgggcatttcctggcgctgctgatcggtctcgcctgctgtccgctggccagaggccgcggaaaagcatggaatccgaaggagacactggccgctctcaggggt

SEQ ID NO: 3945 - DNA, 891 bp, Streptomyces avermitilis
  CDS (1)..(891)
atggtcggcagggtgatcgacgtgcccgaagagctggccgcctcccagcagaagttcaacggagcggcgggccgggccttcatcgccgggctgccgcgccgggcggcggacttcctggagcgctgggagctgcgggtcgacgggccctcgatgtacggcgtctgcgcgctggtcctcccggtactccgggccgacgggacgccggccgcgctcaagctccagcccctcgacgaggagagcgccggcgaaccgctcgccctgcgccggtgggacggcgcgggggccgtacgccttctggagcacgacgaggccacctgcaccctcctcctcgaacgcctggacgaggcgcggtcgctggcggagacaccggacacgcgcgaggccgttctggtcgtcgcgcggctgctggcccggctgaccgcgctgcccgccccggaggggatgcggcggctcggcgacatcgcggccgcgatgctggaacaggtgccgtgggccgtgcggcagctcgcggaccccggggaccgccgcctcgtcgaggactgcgcggccgccgtgcgcgaggtcgccgccgaaccgggcgaccggctgctccactgggacctgcacttcgacaacgtcctcgcctcacaccgcgcgccctggctcgccatcgacccgaagccgctcgccggcgaccccggcttcgacctgctccccgcgatccgcaaccggttcgagcccgccgagatccgctggcggttcgacgccatgacggagatcctcggcctggaccgggagcgggcccgcgcctggagcctggcccgcgtcctgcagaacacgctgtgggacctcgcggacggacggcccctggaggccgcgcaacgggagatcgggcgacagctgcgcgagcgc

SEQ ID NO: 3946 - DNA, 1134 bp, Streptomyces avermitilis
  CDS (1)..(1134)
atggccacagtctcgttcgacaaggcgacccgcatctacccgggttccgagaagcccgccgtcgatgccctggagatcgacatcgaggacggcgagttcctcgtcctcgtcggtccctccggttgcggcaagtccacctcgctccgcatgctcgcggggctcgaggacgtgaacgccggcgccatccgcatcggtgaccgcgacgtcacgcacctgccgccgaaggaccgggacatcgccatggtgttccagaactacgcgctctacccgcacatgaccgtcgccgacaacatgggcttcgcgctcaagatcgccggcgtcaacaaggcggagatccgccagaaggtcgaggacgcggcgaagatcctcgacctcaccgagtacctcggccgcaagccgaaggccctctccggcggtcagcgccagcgtgtcgccatgggccgcgccatcgtgcgtgagccccaggtgttcctcatggacgagccgctgtccaacctcgacgccaagctccgcgtgtcgacgcgtacgcagatcgcctcgctccagcgccgcctcggcatcaccaccgtgtacgtcacccacgaccaggtcgaggccatgaccatgggcgaccgcgtggccgtgctcaaggacggtctgctccagcaggtcgactcgccgcgcaacatgtacgaccgcccggcgaacctcttcgtcgccggcttcatcggctcccccgcgatgaacctcgtcgaggtcccgatcaccgacggcggcgtgaagttcggcaacagcgtcgtgccggtcaaccgcgaggcgctgaaggccgcctccgacaagggtgaccgcacggtcacggtcggtgtccgccccgagcacttcgacatcgtcgagcagggcggcgccgccgccaaggccctgaccaaggagagcgaggacgccccggcgggcctcgccgtgtcggtgaacgtcgtcgaggagctcggcgccgacggctacgtctacggcagcgccaaggtcgacgacaagctcacggacctggtcgtccgcgtgagcggccgcgcggtcccggacaagggcgccacgctgcacgtcgtgccgcggccgggcgagacccacgtgttctcgacctccacgggcgagcgcctctccgac

SEQ ID NO: 3947 - DNA, 456 bp, Streptomyces avermitilis
  CDS (1)..(456)
gtgaagcactccaccactaaccaacggacccggcatggccgtggccccgcccgccggatcggtcgcaccctcgccctcgttctgcctgtcgtcctggtgttctccgggaccctcgcggtcacccgagtcaactggtcggggaactcctcgcactcggtgctcaccgcatccgaagcctcctcgtcggacgtctccacacgagcgtcctcccgggccgcgcaggacgtcctgcgggacaagctcctggtggaactccaggagaagaacccgggcgtggccctcacccacctccaggaggcggtgcacgaccgtccgtcgctggcgaagcactgcgtgtccatcgcccgtgcgctgggccgggccgcggtccgcgtgtacgggccgccgcgggcccagtcgttcgcccgccccgtctgcgacacgtccttcgcgtcgggtgtggccgcccagcacacc

SEQ ID NO: 3948 - DNA, 729 bp, Streptomyces avermitilis
  CDS (1)..(729)
atgaccgatccgaacgccgcgtcgcgtcccgttcaagccgttgtcctggccggtgggcagggctcccgactgcgcccgtacaccgacgaccggcccaagccgatggtcgagatcccgggcaccgggaccccgatcatcggccatcagctcacctggctcgccgaagagggcgtgaccgacgtggtggtcagctgcgggcatctcgccgacgtcctccagaagtggctggacgcggccgacctgcccctgaacgtcacgacggtcgtcgaaacggaaccgctcggccgcggcggcggcctcaagtacgccgccgcgcatctcccgcacccggacaagccgtggttcgcgacgaacggtgacatctggacccgtttctcgctgcgcgacatggcggacttccacaccgagcgcgacgcggtggcgaccctcgcgctggcccgcccccgcatcccgtggggcgccgtcaagacggacggcttcggccgcgtgacggacttcatcgaggccccgccgacgacgtacgagatcaacgcgggcgtctacgtcttctccgccgagttcgccggcatgctcccggagcgcggcgaccacgagcgcaccacgttcccccgcctggcccgcgaacgcctgctggccggcttcccgatcccgcagggcgcgtactggcgcgccatcgacacggcgaaggacctgacggaggcggcaaaggaactggcgtccctgggccgc

SEQ ID NO: 3949 - DNA, 1695 bp, Streptomyces avermitilis
  CDS (1)..(1695)
gtggacaccagaacaccccgcacacccacgggggaccgatcgtcgggattcgacgacactcccgcgctgagcatggtgaaggtgccgagcgatccggcgcaggtcatcgtcaatcatgcgagcttccgtgtgcagctcaacgcctccgcgtggacgacccgatccccgcgcatcgcgcgccacttgagcgccaccgaagacaccgcacgcgtccccgtcgtcggtacggcgggcagagcgggcgcggcaggccaggccgccggcgcccgccgccgcgcgcccgtcgtctggagcgggaagtccgcccccgacgacaccggcgcccaccgtctgctgcaagccgtgcgcagtacgagcgtgggccacggtgaggcccccgccggggacgccggcgcgacccaggtcattccccgcatcgacgtcggcaacctccccggggagacggtcgcgacgcccggcgccggcagccggcgcacccacggagcgcgtcactccggcgagacccggctcctgcccggtatgcgcaccgccggcagcgcgtacgacgaacccgcctacgcggaccaggagttcgcggacgacgacctcgcggacgacggcttcgaggacgacggcttcggggacgacggcctcgacgacgaggagaccacctccaagcgccacggcaacgagccggtccggcacgcctattaccccggccgccggatgaacctcggggtggtgctgctgcccctgcgggtcttcctcggcttcatctccatctacgcgggcatgggcaagctctgcgacgccgtctacttcgacggcggcaagcgcggctcgatggtcacctggctcaacacactgcacccctgggaagtcgccgagcccctgcggcagttcgcgctccagcaccccgtcggcgccgggctcgtcatcgccttcctccaggtcatcgtcggtgtcctcacggttctcggcctctggcagcgggtcgccgccgtcgtcggcgcgatgctgtcggccgcgctcatcgtcaccgtcagctggaagacggtgcccgcctacgacgcgcccgacatcatctacctcgccgcctggtcgccgctgatcatcgccggtgcgcccgtgtactccgtggacggccggctcgcgggcggcgcctggcgcaggctcgggccgcgcgccgacatctgggagctgcgctggtacgtcctgcgccgcggcgccctcgtgacggccatcaccgtcgggctcaccctgctcctcggctcgctgctcggcggggcggtgcgggacgcggaccgggtcgtcgtacccggtccgggggaggcgccgcgcaacgaactgccgggctccccgctgcccgaggagcccgtcaagcgtcaccaccgggcgagcccctcggcctccgagacaccgacccagggcgcgacgtcgtcgccctcgggcgctgccacgacgccgggcgcgatccgggagagcggtccggccacgggcggccagcccagccagacgcagggcaccggtcaggcaccgccccagcagtcggcgccggtgcagcaggcgccgagcacgagcgcgggcccgtcgtcctccggcggctcgggcagcacgggcggcagcgcggccggcggttcgagcagcacgggcggcagcagctcgggcggcggctcgggcggcggctcggaccgactggtcggcgggctcctcgga

SEQ ID NO: 3950 - DNA, 939 bp, Streptomyces avermitilis
  CDS (1)..(939)
atggctgctaacaaccgccgcatgtccggcaagaagggcgcgcaggtcggcagtggcggccagcggcgccggggcctggagggcaagggccccaccccgcccgccgagatgcgcaagggacacaagaagaaccgcatcgccaccgccaagaccaagcaggtccagcggcggcccgccccccggggccgcggcggcaagtccgcctccgagatggtcgtcggccgcaacccggtcgtcgaggcgctgcgcgagggcgtgcccgcgaccatgctctacgtccagcagttcatcgacaacgacgagcgggttcgcgaggcgctccagctcgccggggagcgcggcggcatccacctgatggaggccccgcgtcccgagctggaccggatgaccaacgggctcaaccaccagggcctcgtcctccaggtcccgccgtacgagtacgcgcacccggaggacctctctgccgccgcgtacgacgtcggggaggacccgctggtcgtcgcgctcgacggcgtcaccgacccgcggaacctgggcgcggtcgtccgctccgtctccgccttcggcgggcacggggtcgtcgtgcccgagcggcgcgcggccggcatgaccgccggtgcctggaagacgtccgccggcaccgccgcccgtacgcccgtcgcccgcgccaccaacctgacgcggaccctggagtcgtacaagaaggaaggcctcgtcgtggtcggactcaccgccgacggtgaggtcgaactcggcgacctggaggccctcgcggggcccgtggtcatcgtcgtcggcagcgagggcaagggcctgtcgcgactggtcggcgagacctgtgacttccgggtgcggattccgatgccgggtggcgcggagtctctgaacgccggtgtggcggcgggagttgtgctgtacgaggcggctcggcgccggggc

SEQ ID NO: 3951 - DNA, 1398 bp, Streptomyces avermitilis
  CDS (1)..(1398)
gtgaccattcgcctgtacgacaccagcgcccggcagattcgtgacttcaccccgcttctgccgggttgtgtctcgatctacctgtgtggcgccaccgtgcaggccgcaccgcacatcgggcacatccgctccggcctcaacttcgacatcatgcgccgctggttcgagtaccgcggctatgacgtgacgttcatccggaacgtcacggacatcgacgacaagatcatcgccaagtcggccgaccacggccgcccctggtgggccatcggctacgagaacgagcgcgccttcaacgacggctacgacgttctcggctgcctgccgccgacctacgagccgcgcgccaccggccacatcaccgagatggtcgagatgatgcgcacgctcatcgagcgcggacacgcgtacgaggccgacggcaacgtgtacttcgacgtgcgctccttcccggagtacctccagctgtccaaccaggagctcgacaacctcctccagccctccggcgagggcgagaccggtaagcgcgacccccgcgacttcgccatgtggaaggcggccaagcccggcgagccgacctgggagacgccgtgggggcggggccggcccggctggcacctggagtgctccgccatggcccacaagtacctgggcagcgcgttcgacatccacggcggcgggctcgacctgatcttcccgcaccacgagaacgagatcgcgcaggccaaggccttcggcgacgagttcgccaggtactgggtgcacaacgcctgggtcaccatgagcggcgagaagatgtcgaagtccctcgggaactcggtgctcgtcagcgagatggtcaagcagtggcggccgatcgtgctgcgctactacctgggcaccccgcactaccgctcgatgatcgagtacagcgaagaggccctgcgcgaggccgagtcggcgttcgcgcgcatcgagggcttcgtgcagcgcgtcgtcgagaaggccgggggagtcgtcgagccttcgcccgaggtgccgcccgccttcgccgaggcgatggacgacgacctgggcgtcccgcaggcgctcgccatcgtgcacacgacggtccggcaggggaactccgccctcgccgccgacgacaaggaagccgccgtcgcccgcctcgccgaggtccgggccatgctcggcgtcctcggtctcgaccccctcgacccgcaatgggccggtgagggcgaccggggcgaggacctccacggcgtcgtcgacaccctcgtacgcatggtcctcgaccagcgcgaggccgcccgcgcccgcaaggactgggccaccgcggacgccatccgcgaccagctcaaccagtcgggcctggtcatcgaggacagcccgcagggaccgcgctggacgctcggtccgcgc

SEQ ID NO: 3952 - DNA, 522 bp, Streptomyces avermitilis
  CDS (1)..(522)
atggcttctgaggcctctgacgtccggctgccgccgggtggccccgtggtgcttcccctggtgggcatcggcaccgacatccacgcgttcgaggacggccgcgagctgtggtgcgcgggactgaagtgggagggcgagggcccggggctggccggccactccgacgcggacgtcgtcgcgcacgccgcgtgcaacgcgctgttctcggcggcgggcctgggtgacctcgggcagcacttcggcaccgggcggcccgagtggtccggtgcgtcgggcgtcacgctgctcacggaggccgcgcggatcgtacgcgccgcgggcttcaccatcggcaacgtcgccgtgcaggtcgtcggaccgcgcccgaagatcggcaagcggcgggacgaggcgcagaagatcctctcggacgcggtcggcgcgcccgtctcggtgtcgggtgccacgaccgacgggctcggcttcccggggcgggacgagggactgatggcggtcgccacggcgctggtggtccgggcgggc

SEQ ID NO: 3953 - DNA, 750 bp, Streptomyces avermitilis
  CDS (1)..(750)
atgtctgacgattcgcgcccctcgccgtcgggtgcacgtaccgcggccgtgattccggccgccggacggggcgtacgcctcggtcccggcgcccccaaagcgctccgcgcgctgaacggcacgcccatgctcatccacgcggtacgcgcgatggccgcgtcccgtgccgtctccctcgtggtcgtcgtggccccgcccgacggcaccgccgaggtcaagtcgctgctcgacgcgcacgcactgcccgagcgcacggatttcgtcgtcgtcccgggcggtgagtcccgccaggagtccgtgaagctcggcctcgacgcgctgccgcccggcatcgacatcgtgctcgtgcacgacgcggcccgcccgctggtccccgtcgacacggtagacgcagtgatcgaggcggtacgggacggcgcgcccgcggtcgtcccggcgctgccgctcgccgacaccgtcaagcaggtcgagcccgcggccgtgcccggggagcccgagcccgtcgtcgccacgcccgagcgggcccggctgcgtgccgtccagaccccgcagggcttcgaccgcgacacgctggtccgcgcccacgagaccgtcaccgacaacgtcaccgacgacgcgagcatggtcgagcagctcggtgcccgggtcgtggtcgtgcccggtcacgaggaggcgttcaaggtgacacgccccctggatctcgtgctcgccgaggcggttctcgcccgcaggaggctgaacgatggcttc

SEQ ID NO: 3954 - DNA, 480 bp, Streptomyces avermitilis
  CDS (1)..(480)
atgacgttcaaggttggcgacaccgtggtctatccccatcacggggccgcgctgatcgaggctatcgaaactcgccagatcaaaggcgtggacaagacctacttggtgctgaaggtcgcccagggcgacctgacggtgcgtgtgccagcggacaatgcggagttcgtcggcgtgcgtgatgtggtcggtcaggacgggctggaccgggtcttcgaggtgctgcgcgcgccgtatgccgaggagcccacgaactggtcgcgtcgttacaaggcaaatctggagaagctcgcctccggcgacgtcatcaaggtcgcggaagtcgtgcgtgacctgtggcgccgggagcgcgagcgcggactctccgcaggtgagaagcgcatgctcgccaaggcgcggcagatcctggtgagcgagctcgccctcgcggagaacacgaacgaggacaaggccgaggccctgctcgacgaggttctcgcgtcc

SEQ ID NO: 3955 - DNA, 660 bp, Streptomyces avermitilis
  CDS (1)..(660)
gtgagcagcagccttcgacgcggcgccctcgccgccgccgccatcgcgttctcgatcgcctcgctcgccgcgtgcggtgccggcaacaacgcccagaccctggaagtcaagccggacaacgcggccaccagtgtcggcgacatcatggtccagaacgcgctcgtgatcacccagcccgacccgaaggccacgggtccggccgtgatctccgcgaccctcttcaacaacggccgcaccgcccagaccctggactcgatcagcgtcgagggcgacggcaccgccgagctctcgcccgccaagggcaagggcaaggtgaccgtcccggccggcggctccgtcgtcctgggcggcaagggcaacgcctccgccgtgctggccagccccggtgcggacgtcaagaccggcaacgcccagaaggtcacgttctccttcagcaagaccggtgacgtgagcctgcgcgcgttcgtcgtcccggccgagagctacttcagcaagtggggcccgagccagatcccggcggcgccgggcgccacggcgtcggccacggccaccgcgaccaccagcccgtccgggtcggcgtcgggcacccccacggacaaggcgtcgagctccacggcgaccgccacggcgacggcgaccgcgtcgaactccgccggtcac

SEQ ID NO: 3956 - DNA, 669 bp, Streptomyces avermitilis
  CDS (1)..(669)
gtgctcgtcgtcgaggacgaggagtccttcagcgacgccctgtcctacatgcttcgcaaggagggcttcgaggtcgccatcgcgaccaccggccccgacggtctggacgagttcgagcgcaacggcgccgacctcgtgctgctcgacctgatgctgcccggtctgccgggcacggaggtctgccgtcagctgcgtggccgctccaacgtgccggtgatcatggtcaccgccaaggacagcgagatcgacaaggtcgtcgggctggagataggagccgacgactacgtcaccaagcccttctcctcccgcgaactggtcgcccgcatccgggccgtcctgcgccgccgcggggagcccgaggaggtcaccccggccgccctggaggcaggtccggtgcgcatggacgtcgaccgccacgtggtcaccgtctccggctccaaggtcgaccttcccctgaaggagttcgacctcctggagatgctgctgcgcaacgcgggccgcgtcctgacccgcatgcagctcatcgaccgggtgtggggcgccgactacgtcggtgacaccaagaccctggacgtccacgtgaagcgcctgcgcgcgaagatcgagccggacccgggcgcgccgcggtacctggtgacggtgcgtggtctcggctacaagttcgagccg

SEQ ID NO: 3957 - DNA, 1275 bp, Streptomyces avermitilis
  CDS (1)..(1275)
atggacgtgaacgcggcggtcgccgcagcggcagcgatcgccggagtacttaccggtgtcatcgccatgctggcgttccgctggagcgagcgcgaccagaagcgccccactcgcacctccctgcacacggaccccgtgcttccgccgggcgtcgacaccgtgctgtccgtgctgcggtcctcggccgtcgtactcgacgaggccgacgccgtcgtcaaggccagctccgccgcgtacgccctcgggctggtgcggggcgggaaactcgccatcgaacccatgatcaagatgacccgcgacacgcggcgtgacggggaaatacgccaggtcgagctcgacctgccccggcgcgggaccggccgcggcgaggccctcgccgtgtccgcgcgtgtggcgcccctcgggtcccggctggtgctcctgctcgtcgaggacctcaccgaggcccgccgcatcgaggccgtacgccgcgacttcgtcgcgaacgtcagccatgagctcaagacccccgtcggcgcgctctccctcctgtcggaggccgtcatggacgcctccgacgatccggaagcggtggagcgtttcgccggacgcatgcagatagaggccacccggctgacgaatctcgtgcaggagctcatcgacctgtcccgggtccagaacgacgatcccctcgaggacgcggagcccgtacgcgtcgacgaactcgtcgccgaggccatcgaccgctgccggcaccaggccggtacgaagcagatcacgatggccgccggcggcaccgccgagctgcacgtctgggggaaccgcggccagctggccgccgccctcggaaacctcgtggagaacgccgtcaactactcgcccgcccgcacccgcgtgggcatagccgcccgccgggtgaccgcgcccggcggagacctgatcgagctcgccgtgaccgaccagggcatcggtatctccgagaaggaccgggagcgcgtgttcgagcgcttctaccgcgtcgacccggcccgctcccgtgccaccggcggtacgggcctcggactcgcgatcgtcaagcacgtggccgcctcgcacggcggggaggtcacggtgtggagctccgagggacagggctccacgttcaccctgcggctgccggaggcgggcacggcccgcgaccgtgaacgcgcactcctgacgcccggcctcgacgaggacgacgaggacgggcagcctgacgggacgaccaccgtctcatccacgtatgaaccgctccctgccccggaggtccttccg

SEQ ID NO: 3958 - DNA, 687 bp, Streptomyces avermitilis
  CDS (1)..(687)
atgcgggacgcgtaccacgaggaacttgactcgatcggcgagggcctggtcgagatggcccggctggtcgggtcggcgatcggacgcgccacgacctcgatcctcgactccgacctgaagctggccgagagcgtgatcgcggccgaccagaaggtcgacgacctccagcacgacctggaggcgcgcgccatagccctgctggcccgccagcagccggtggcgacggaccttcgtatcgtcgtgacgtcgctgcgcatgtcggcggacctggagcgctccggcgacctggcccagcacgtcgcgaagctggcccggctgcgcttcccggagcgcgcgatcccgcacgacctgcacgcgaccatcctggagatgggccagctggcgcagcgcctgatggcgaaggcggcggaggtcatcatcacgaaggacgtcgacctggcgctccagctggagcaggacgacgacgagatggacctgctgcaccgcacgctcttccagcacctgatggacgaccgctggaagcacggcatcgagacggccgtcgacgtcaccctcctcggccgctactacgagcgcttcgcggaccacgcggtgtcggtcgcgaagcgggtggtgtacctggtgacgggcgagcacgcggacgagcttcaggcggacatccagccggtcaccggggtggagggggcg

SEQ ID NO: 3959 - DNA, 150 bp, Streptomyces avermitilis
  CDS (1)..(150)
atggctgagacccccagcacgcccgatccgacacaggagcgcgagacgcaacaccccgccgagatcaagagcctgcccctgttcggcgcctgcggctgcggctccggctgcgggtgcgggtgtcagtcgggcaatccttgccagtgcggc

SEQ ID NO: 3960 - DNA, 1020 bp, Streptomyces avermitilis
  CDS (1)..(1020)
atgacacagcaggacaacacccttccgaagcgcaccctcccgaagcgcacactcggcacccaggggctcgaggcgggcgcgatcggcctcggcacgatgggcatgaccatggcgtacggggccggcgacgagcccggcggcatcgccaccatccaccgggcgtacgagctgggcgtcaccctcttcgacaccgccgagctgtacggcatgggcaccggcagcaacgagcaactgctcggccgggcggtcaagggcttccgggacgaggtcgtcctcgcgaccaagttcggcttcgacctcagtgacccggccaacgtcggagtcgcgctggacagccgccccggacacatccgtgaggtcaccgagaacagcctgcgccacctcggcaccgaccacatcgacgtcctctaccagcaccgcgtcgaccccgatgtaccgatcgaggacgtggcgggcaccgtcggcgaactgatcgccgagggcaaggtgcggtacttcgggctcagcgaggccggtcccgagatcatccggcgcgcccacgccgtccacccggtgtccgtactacagaccgagtactcggtgttcgagcgtgccgtggaggccgacgtgctgccggtggtgcgcgagctgggcatcggcttcgtgccgtactcgccgctgggccggggtttcctcaccggcgcggtgcggcccgccagcgcataccccgcggacgacatgcgcagctgggacgaccgctggcagcccggcaactacgagaagaacgtggccgccgtcagcgaactgaccacgctcgcggcggccaagggcatctccgtcacgcaactggcgctggcctggctgctggcccagggcgacgacatcgtgccgatcccggggacccggagcccgcagcgcctggccgagaacgtcgcggcggcgcacgtcacgctcacgccggcggatctcgtccgggtccaggagatcctgccgaaaggcgcggcggggtcccgctaccccgaggtgatgatgccgtcctgg

SEQ ID NO: 3961 - DNA, 924 bp, Streptomyces avermitilis
  CDS (1)..(924)
gtgcctgagcacctgccggaccgactcggcgggctcgattcgctcgcggcggccatcgcccgccacaacgagggtctgtggtccgacagtgcggtgccccgtctgacgctggtcgcgctcgacgagctcatcgcacccgtcgatctgctctacgcgccgatgatctgcttcatcgccgacggcgcgaagcgcaccctcgcgggtgaccggagctgggtgaccgggcggggcgacatgttcctcaactcactcgtactgcccgtcacctgtacgttcgagcaggcgccgtaccgctcggcggtgctgcatctcgacggccgtctgctcgccgatctgctgctggaactggacggcacggatccgcttccgctcccccggcccggtgctcccggcgcgcaggtcaccgcctccatgacgccggcgctcctcgacgcggtcacgaggtgggtacggctgctcgacaccccggacgacatccgcccgctggcctcccgcatcgaggccgaaatcctctaccggctgctcgccggcccgctcgggccgatcctgcgccagtacacgctggccgactccggcgcggccagggtgcgcgtggcggccgcgtacatctccacccactacgccgagccgctcagcatcgccacgatcgcggcgacggcgcatatgagcccagccacgctgcaccggcacttcaaggccgccaccggcatgagcccgctcaggttccagaagctcctgcgcctccaggaggcgcgacgtcagttggtcgccggcaacaccacggcggccgtggtcgccgaggcggtcgggtacgcgagcgcgacccagttcaaccgcgagtaccgccgcacctacggcctgccgccgggccaggacgcgtcgctcctgcggggccggctgacggaggcgcgggggcgggctgac

SEQ ID NO: 3962 - DNA, 1305 bp, Streptomyces avermitilis
  CDS (1)..(1305)
atgtcacccgtctccctgagacgcgctgcccgcgagaccgtctcagggctcccgcgcgagttctggtggctgtggacaagcaccctcgtcaaccggctcggcgccttcgtcgccacgttcatggcgctgtacctgacgctggaccgcgggtactccgcctcgtacgccgggctggtggcgtcactccacggcctcggcggggtcgtctcctcgctcggcgcgggggtgatggccgaccggctcgggcggcggcccacgctgctcatcgcgcagtcgtccaccgccgtctccgtcgcgctgctcggcttcatgcacgacccggtcgcgatcgcggccgtggccttcctcgtcggtatgacgagcaatgcctcgcggcccgccgtgcaggcgatgatggcggacatcgtccggcccgaggaccgcgtccgggcgttctcgctcaactactgggccatcaacctcgggttcgcgatctcctccatggccgccggtttcatcgccgagttcagctacctcgccgggtttctgatcgaggcgggcatgacgctgatctgcgcgctcgtcgtcttcgccaagcttccggagtcccggcccgcccccacgggcaaggcgtccgccgagcccgaggtcggcctccggaccgtcctgcgcgacggtcgcttcatgagtgtcgtcggcctgtccttcctggtcgcgctcgtgttccagcagggttcggtggggcttccggtcgcgatgggcgaggccggcttcacacccgcggactacggcatggcgatcgcggtcaacggcgtactgatcgtcgcgttgcagatcccggtcacccgtttcatcgaacaccgggatcccaggcggctgctcgtgctctcgtccctgctggccgggtacggcttcggactcacggccttcgcgggctcggtcggcgtcttcgcgctgacggtgtgcgtgtggaccctcgcggagatcgtcaacgcgcccacgcagacaggcctggtcgtcggcctctccccgacccacggccggggccgctaccagggcatgtacaccctgtcctggtcggtcgcggctctggtggccccgttgctggccgggttcgtcatcgaccggttcggggctgagtggctgtgggggctgtgtgcggtggtggggacgggagcgggggtggggtacgcggcactgatgcggcggctgccggtccaggagcccgccgttgcggctccggtccaggaacccgccgtggtggctccggtccaggaacccgccgccccgtccccggccggggggaagcccgaggtcagcgcgaca

SEQ ID NO: 3963 - DNA, 759 bp, Streptomyces avermitilis
  CDS (1)..(759)
atggccgacgcaccgtacaagctgatcctcctccgccacggcgagagcgaatggaacgcgaagaacctgttcaccggctgggtggacgtcaacctcaacgagaagggcgagaaggaggctgtccgcggcggtgagctgctgaaggacgccggcctgctgcccgacgtggtccacacgtcgctccagaagcgcgcgatccgcaccgcccagctcgcgctggagtccgcggaccgccactggatcccggtccaccgctcgtggcgcctgaacgagcgtcactacggcgccctccagggcaaggacaaggcgcagacgctcgccgagttcggcgaggagcagttcatgctctggcgccgctcgtacgacaccccgcccccgcccctcgcggacggctccgagttctcccagtcggacgacccgcgctacgcctccatccccccggagctgcgccccaagacggagtgcctcaaggacgtcgtcaaccggatgctcccgtactggtacgacggcatcgtcccggacctgctgaccggccgcacggtcctggtcgcggcccacggcaacagcctccgcgccctggtcaagcacctcgacggcatctccgacgaggacatcgcgggcctgaacatcccgacgggcatcccgctgtcctacgaactcgacacggacttcaagccgctcaacccgggcggcacctacctcgacccggacgcggcggcggcggcgatcgaggcggtcaagaaccagggcaagaagaag

SEQ ID NO: 3964 - DNA, 1314 bp, Streptomyces avermitilis
  CDS (1)..(1314)
atggccggacacatccaagaccgctggtacaagaccgaggtcggtccggacggcaagacccgcagagtgaagagcgaccgctatggctcgggtgcgcgctaccgcgcgcggtacgtcggcccggacggtacggagaagtccaagagcttccccgacaggcagaagcggcttgcggatcagtggctcgcccacaccgaggcggacatggcacgcgggcagtacatcgacccgcgtgccgctcgggtcaccttccagcagtacgccgagacgtgggtatccacccagggagccgacccgaacacccaggcttcgatggagtcgcagcttcggctgcacgccttcccgtacttgggatcacgcccgctcggctccttccagcctgcgcacatccgtgactgggtgcggcagctgagcgagaacggcatccggggctcgtacgcccgcaccatctactccaacgtgcgtgccgccctcagcgcggccgtggacgacgggcacctttcccggaatccatgtgcggctcgatcggtccggccgccgaccgtcgatgacaggcgcgttgctcggacaccggaacgggtctttgccgtccgggccggcatgcccgagcggttccgggccatggtcgacctgggtggcggctgcgggttacgccagggcgagatcctcggcatcgccgtcgacgcgatcgacttcgagtcggacacgttgcacgtggtccagcaactcaagctgagccgaagcaaggccgtcttcgccccgcccaagggtggcaagctccgggacgtgccgcttcccgggccggtcgctgatgccctgcgggcccacatgaagcggttcccgccggtcgacatcaccttgccgtggaaggtggcagacgggcctctgatcaccaagcggctgatcttcaccgggccgcgcggtggtcacgtctggcggacgtcgctcaacgaggaggcgtggaagcgggcgctggcctcggccggggttatccccgaccggaagccgggcaagtcgtacgccgagtcccgcgaaaacggcatgcacgccctccgccacttctacgcctcggtgctactggacgccggggagaacatcaaggccctcgccgagtacctcggccactcggacccaggcctcacgctgcgtgtgtacgcacacctcatgccttccagccaggaacgcactcgtaaggccatcgccaccacctacgaaaactcaatccttcttagaactcccgcaaggatcaaactgcgagagagcgaatccgatatccctcaccaagagccaggaatatcgccccaccaaacgaag

SEQ ID NO: 3965 - DNA, 237 bp, Streptomyces avermitilis
  CDS (1)..(237)
gtggctagccgacgcctcgccctggccgacgtggccaccgaaccgcgcaccctgccctcgcggtacctgacgcctgacgacctggtggagatgttcgagttgcccagcgtcgagacggtctaccagtggcgacgcaagcgcaccgggccccgtgggttccgcgtcggccggcacctccgcttcgacccggccgacgtgcgcgcctgggtggactcccggcgtgagggggcggcggcc

SEQ ID NO: 3966 - DNA, 1365 bp, Streptomyces avermitilis
  CDS (1)..(1365)
gtgcccgtcagaaggagaaccgtcatcttcgcccgcgccaccccgccccctcttccggaactcagcaacctcgccgcaggcggcaccctgcccggtatcctccggcaactctccggcctcggcggctgtacccacccgatccgcctcgacggccaccgcaccgaatacgacgtcgacaccgccaccggcgagatcggccgcgtcctccaccacctcgactcgggcgacctcccggccggccaactcctcgtccgctgcaacaaccgccgcacgacccgctgcccggcctgctccgaggtctaccgccgcgacacctttcaactgatcaccgccggactgcgcggcggcaagggcacccccgaacacgtcgccacccaccctcgcgtcttcgccaccttcaccgcccccggcttcggcccggtccacaaccgccgtaccgacggacgcccctgccgttgcggcacccagcacgaccaggaggacgggcaactcggcaccccgctcaacccggccacctacgactacgaggccgccgtcctctggaacgcgcacgctggtcccctctggcgccgcttctccatctacctgcgccgagaggtcagcaagcgtgcgggcctgtcacagcgggagctccgcgaccatgcacgtgtctccttcgccaaggtcgccgagtaccagaagcgcggcgcggtccacttccacgcggtcatacgcatcgacggccccggcggcggcgagactccgcctccgtcatgggccaccgccgagctgctgaccgatgccatcggcgctgccgcgtccaaggtccgtgtcgacggcccgaccatcgacggccgcgcccacgtgttcgccttcggccgccaactcgacgtccgcaccatccgatccgccgacttcaacgacggccaggagctcaccgaacgcgccgtcgccgcctacatcgccaagtacgccaccaagggctcggagacagccacgggagctctcgaccgcccgctgaagttcgtcgccgaactcgcccagctcgacatcagcgagcacgcgcgccgcctgatccgaaccgcctgggcgctcggcgcacgcaaggacctcgaacacctccgcctgcgcgcctgggcgcacatgctcggcttccgcggccacttctccaccaagtcccgccgctactccaccaccctcggcgcactccgcgacgcccgcgccgaatggcgacgagcacaggcagcagcgaacgcacccgcccccgagacgacgtacgtcctcgcgcactgggtcttcgccgggaccggcctctccgacgccgaagcctggctggccgcgtccatcgaacccgcccccggaaccgaaggagaactcacccgtggc

SEQ ID NO: 3967 - DNA, 279 bp, Streptomyces avermitilis
  CDS (1)..(279)
atgactagacgagtagataaggagtccgccgtgttcctgcccaagtacccggaaaaccccaccccgccgcccgcacacacccacgccccgaccgacccggcccccgtcccggtccggcgctcgctcccgtcggtctccatcgatcagaagaccgtcgcggccgtcctcgtcggcggagtcgtcctcaccgcgcttttggccgccgtcgccgtcacggccatctcggtcgctgtcgccgccgtggtcctgcgctccctgctccgcgaccaccaccgccgc

SEQ ID NO: 3968 - DNA, 192 bp, Streptomyces avermitilis
  CDS (1)..(192)
gtgaccgtcagcctgccgctcgtcgtcgtcctcggcttcttcgcctgggcggccgtcaagtacctcggtgtccgcatctggatcgtcgtcctgatcaccctcttcggcttctggctctcgcgcaccttcctcgcccccgccatcgagtccggcacgcgctccggcgtggacgtcgtaaacggctcacatgac

SEQ ID NO: 3969 - DNA, 189 bp, Streptomyces avermitilis
  CDS (1)..(189)
atgaccgccaaccgccgcttccgcaacgtcacccgtatcggcccggtacaggtgggcaccgcctacgaccaccgcggccgcgagaagcacaccgccgcctgcaccgccccgcgctgcaacttctccgccgactacgacagccgagccgccgccgagctggccgcccgcacccaccgctgccccgtccgc

SEQ ID NO: 3970 - DNA, 627 bp, Streptomyces avermitilis
  CDS (1)..(627)
atgcgcgcccaactggcccgcgtcgacgcggtgctcgtacaggcgctcatcgccgccgctctgtccttcgcccacattcacgacgtcgccgtggcggccggacaggacggctggaaggcctgggcctatcccgtctccgtcgacctgctgctcgtcgccgcctggcgtcgactgcgctccggctcggccaagggtgcggcctggtgctggttcgtcatcgcgctcgccgcatccctcggcgcgaacgtcgccacgggacggcctgctcgacctcggcgacgtcccgggctggctgcgcatcctcgtcgcgggctggcccgccctcgccttcctcggcggaaccctcctcgcccactcggcaccaaaggcggccgacgacagccgaggtcatccgaggacgaggagcacgagcccgaatccgatcccgagccgcccaccccggcaccacccgccatcgaggccccgccgcaccgccccgccgtcccagtcccggccgccctcatcgaccacgcccgcaaggtcgctgccgaacaccacacccggaccggcactcccatggacgtcgcgaccctgcgcgcccggctcggcgtcccggcacccatggccgaagccatcgccgcccacctc

SEQ ID NO: 3971 - DNA, 1293 bp, Streptomyces avermitilis
  CDS (1)..(1293)
atgtccgacctgacaacgctcctggaggtgggtggtcctgtcgccgcgctcggtggcggggctgcctacacccgggccaaccacccgggtctctactggtcggcggtcggcgggcctatatccaccttccggctcctcagttcgtacgcctcggtcatggaagcctgcggcctgaccgtcgccccctcccgactgcggattctcgccgtcaaagccaccacccgccgtgaggtgcggcccgtgccgccccgccggggcatcatccggcccacggccaccggcttacggctccggctccgcctcgctccggggcaggaacccgccgacgtcgccgcctcggccgaacggctgcggcacgcctggggcgttcacgccgtgtacgtctccaccgtcaagcccggtgtcgttgaactacggctcgtcggcttcgatgtcctgcgcaaggtgcggatgccccgcaaggtcaaggtcgagggcggcttcctcaaagtgccggtcgcgctgcgggaggacgccatgcccttcgtacgcgactaccgggccgtgccgcaccaactcaccctcggcgcgacgctgtcgggcaagtccatgtacctccgacacctggtcgccggactcgcccggcaggacgtcgccctggtcggcatcgactgcaagcgcggggtcgagctggccccgttcgccccgcgtctgtcggccctcgccaccgatccggatgaagccgccgagctgctgcccgtcctgatcaaggagatggaggaccgatacgacctgatcaaggccaggcaaggcatcgcccccaatctccccgacgaagagatcacctccgacatctggggcctgcccgaaagcgaacggcccgttcccatcgtcctgttcgtcgacgaggtggccgaactcttcctgaccgccacccgcaaggacgaggaacggcgagacgagatggtcacccagctcatccgcctcgcccagctcggccgcgcggccggcatctacctcgaagtctgcgggcagcgcttcggcgctgagctgggcaagggcgcgaccatgctccgtgcccagttgaccggccgcgtctgccaccgcgtcaatgacgaagcctccgcgaagatggccctcggcgacatcgcgccggaagcggcgctggccgcctgcgccatcgcccctgagcgtcctggcctcgccgtcgcgggcgacacctccggcggctggtcgcgtatccgcaccccgtacctctccctcggcgacgccgccgacgtctgccgggagacggctcacctggtccccaggatc

SEQ ID NO: 3972 - DNA, 354 bp, Streptomyces avermitilis
  CDS (1)..(354)
gtgcgcaccatccgtgttgagacctccgccgcgaccgtcctcctgacggaagcccctgagccgaaggtccgcgaccgtcagacaggcgagatcgccaaggacgccgtcagcggtgaagcgctgatgaccatcggcgtcgtctacatcgaggacggggagtcctcgctgatcaaggtcaccgtcccggaaggcggtgtctccgaggggctgaacctcggggctcccgtctcgctgccggggctcgtcgcccggccgtgggagtccgtgttcaacgggcagcagcgtcacggcatcgcctaccgcgccgccgccgtcactccggccgccttcccggcctccatgggggcctcggcc

SEQ ID NO: 3973 - DNA, 786 bp, Streptomyces avermitilis
  CDS (1)..(786)
gtgagccctctgtcttcgggcctgctcggtgatctcgaccccacgagcgatcgtgcggtctttcgccagatcgccgaccagctgcgtgaggccatcgaccgtgggcgattccgggagggggagaagctcccctctgaggccgagctcgtcgaccactacggggtctcccgcatgacggtcagaaactccttctccatcctccagggcgagggcctggtgcacgccgagcacggcaagggcgtcttcgttcggccgcgtccgcccgtgcggcgactcgcctccgaccggttcgcccggcggcaccgagagcaggggaagtccgcgttcatcgtcgaggccgatgccgtcggtagccaccccaaggtcgacagcctcgaggtcaaggaggagaaagccagtcaggacatctccacgcggctcgggtccgtgcggcgggtccttgcacgtcggcgccgctacctcctcgacgggcgtccggtcgagttcgccacctcctacctgccgctggacatcgcccgcggtacgcagatcgccgaacccaaccccggtcccggcggcatctacgcccgcctcgaagagctgggccaccgcctcgaccacttcgaggaggagatccgcgctcggatgccctctcccgcagaggtgaagacgctccacctggcggccggcgtccccgtgatccacctgatccggaccgccttcgacaccgaggggcgagcggtcgaggtctgcgacacggtcatggcggcggacgcctacgtcctgtcgtaccagctcccggccacg

SEQ ID NO: 3974 - DNA, 486 bp, Streptomyces avermitilis
  CDS (1)..(486)
gtgggcgagtgttgttgctacggtggagagcctagccatccgagagggccgaggaacgtgagcacagaacgcccgcactccgtgagcgtggccggggtcgtcgtcgacgaccagggccgggccctcctgatccagcgccgcgacaacggtcactgggaaccgccgggcggcatcctcgaacgcgaggagaccattcccgaagcccttcagcgcgaggtcctcgaagagaccggcgtcaaaatcgcgctccccgcgactctcaccggcgtctacaagaacatgacgggactgatcgtctcgctggtcttccgctgcgaagcggccgacgggacacccacgaccggcgacgagacccgcgccctgcgctgggcaacccgtgaagaagtctccgaactcgccgacgaggcgtacgcgatccgcgtcatcgacgcattggacgcggcggtcccgccggccatccgcgcccacgacggcgtgaaactcgtc

SEQ ID NO: 3975 - DNA, 462 bp, Streptomyces avermitilis
  CDS (1)..(462)
atggcggcctaccagcatgaaggaacttgtatgcacgagtatacgagtactgcccgggtctggggactgtcttgcccaggttttccggaagaggtcagccgggcccgccgatggacgcgcgacgtcctgcgcggctccccttttgcggaggacgccgagctgatcgtgagcgagctcagcgcgaacgcgatcctccacacggcgagcggcctggagtccggaagctttcacctggccgtcgccgtctcggcgcaggtggtcgcggtctcggtgacggacgacggaggcacgggcacggcccccaaggtcggccaccaggcccaggagcaggacgccgaacacggccggggtctcggcatggtcagcgcgatcgctcaccgggtcgtgatccacgacagcgacggcggccacacggtcaccgcggagctcttcacggacgtacgccgaggaggccacccatgc

SEQ ID NO: 3976 - DNA, 390 bp, Streptomyces avermitilis
  CDS (1)..(390)
atgctgaggacgacgaccagccccggcttctggtgcgagtgctggacggaaaggctcggcgggcagcagccgccggcgctcttcggatccttcgacgcctactcggcggtcgaggcgaacaactgggtggcgacgatcctgcgcaccatctcacccgcgctcggcacggctgcttctcaagaagcgtggacacggctccacgacgaccgcatcgacacgagacgagccctcctgcgccgagagccctggacggtatccgtcacccacgtcagtacacgcatcacatggacggtccgaccagcactcttcctaccgatggcacaccgtcagcgcaagcaactgccttcgtgcgcgtacgacttcaagcctcacaggtcccacacgacggac

SEQ ID NO: 3977 - DNA, 432 bp, Streptomyces avermitilis
  CDS (1)..(432)
gtgggatgcgaagcgaggaagaagttagacgagtggccctatagccagtgccaccccgctcccatcccgtacgccgtcgacccacacaccgtggagcaggcgtggttcatggcgtccaggtggagcgcgccactgtacgaacgacctggacgccatgggccgcgtctgctcggctctgcctgggtcgatggtgtgcgggatgggagccaccccactcacgcccctacggatccgcagccgggaacggcgccccctctatcccggtgccggccgatcccccgccggaggcatcgttctgaccgtggccgctctcatgcggcagtagtttcgtggccttcggctcgctgctgtgcgcgcggcacgggcgccggccgggctggagcggggcggagacaggagcgcaggcccggccgggggccgggccgcgcgcgg

SEQ ID NO: 3978 - DNA, 1122 bp, Streptomyces avermitilis
  CDS (1)..(1122)
atggaagtctcgaacgcattcctgcgtctctacgagagtgacgctcgcttcggtcgcgctttcgctagcatccacgagcgactaaataagcatttcgaatccataaatgacagggcggagacgaccggccattactgggccgagcagagcagagaaatgctcgcactcctcaaggaactgaatgacttcctccggtcccttaagcatgctggcgtggttgtgcacctcgcagagtcctacatggccgcaatgaagagctgccagtcgtggctggtgcgcagcggcggcagcgctgttccagatgattttgaacagattgagataatcaagtacgcgcccgttctgtcccgcccggacgccgagatcaaactgaagaaatccacggtgcgtcatcagttgcagttgatcggcgaggggtcatacgcgaaggtgttttcattcacagatcccgactatggaataaaattcgcagtcaagcgcgccaataaagacctggacgaccgcgacctatatcgattccggcaagagttcgacatcctcaagcgtttgagcttcccttatattgtcgaggtttatcaatacgatgaaactcgaaacgaatacaagatggagttctgtgaatccactctgcgaaactacatcaagaagcgcaatagcgagttgcaattttcatcgcggaagagaatcgccctgcagtttttgtacggcatcaattacatccaccatgaaggtctacttcatcgtgatgtaagccttcagaatgttctagtgaaaaccttcagcggtggggctgtgctcgttaagctctcggacttcggtctcgccaaagataggaactccgaatacaccagaacgaagacggagatgcgaggaacaattcgagaccccctcctggctagcttcaaagaatatgacgtatgcaatgaaatatatgcgatcggatgggtgctttcttatatatttagcggtagggaagccctgatgtctcaaacagacgccccaagtcagatcgtgcgaaaatgcacagcgcatgatgttggcaagaggtaccagagtgtgcgtgaactaattggtgatgttgagaagctggaagcgactccggcgcctacggacgcgcccgct

SEQ ID NO: 3979 - DNA, 894 bp, Streptomyces avermitilis
  CDS (1)..(894)
atgcatcgcaagccgtccgccagaatagctagcatcggcgtgacgcggacacaactcgcagtcgaggccggcctaggttggctatttcgtgagcagccgacagaggattacggcatcgacgcgcatgccgaagtcgttgacgcggaactagtcagaggccgactacttgccttacagattaagagcggctctagctggttcagggaacaaggtcaaggcggttggtggttccgaccaaacgctgaacacgtgcagtattggacgaatcattccttgcccgtcgcagtagtgctttaccacccagagagagatcactgctattggcagcttgtcaaccacaacacgctcatcgaaactacacgtggcggctggaaattgctggttcctgacacccaggtgctcgacgagagagccagggatgcgctcagccgggccgccgagggtgacccctacacactccgcattcgcgaactacagcttgcacgaccgtggatgagaatgttgatcgagggaaagcggctagtgatcgacatcgaggagtgggtcaacaagacttcggggcgaggcacaattactctcggcgtagacaacgaagatggtaatgaccccgagcaacttgccagttggactgtgtttctggggctatctagctacgtcgaagtagttccgaagcttttcgcttgggcaaatgtaagcctacacgccgaaacctacgatgacgtcgaatacgatgactatccatacgaacgtgatgattggggcgccttgcacccctacatgaacccctccggcgaggttgatttctaccggctagagctgacgctgaatgaactgggtcgagccttcccgctggtggatctattcgccacggaaggaacaaggcagttgactgta

SEQ ID NO: 3980 - DNA, 480 bp, Streptomyces avermitilis
  CDS (1)..(480)
atgttcgtcaccgcgcctcgcgctctcttgggccggcgtgtgttggcaccgtggcgcgtgccctgttgctgtgagaggtggcgcacccaagaaggtaagggtgcgccggctcttggtcggaccaggtcttaccgccggacgcgcggcaagctcccgcggagcagcttgacgatctcaatggctcggcgggccttgccgtcgtcagaggtgaatgctgcgaagagagcgcagatggcgacgaccgtcgtgatcagcaacggcgaaagagcgaacaggcacaggaaggacacggggcgacaactccatgatgaatggatatgtcccgccgcctacggctcgccggtccgatccggcttcgtagtgctgggaatgagtggcttcagcgtccctgggctgtgtgaggtgcgcttgaggctcggacccgacctcgtaccgcgcgcttcatcgagaagtttacgcgatcccttgaaacggggggcc

SEQ ID NO: 3981 - DNA, 432 bp, Streptomyces avermitilis
  CDS (1)..(432)
atgtcgacagccggggcaccaagcaacacagcgacgctcaaccgctttcactccgccgtgaacagcggcgacctggacatcatctcgaaggccatcgacgagttcgtcgcaccggacgtgctcttccacgcgccggtaccgatgggcgcgacgggagcggaggccctgaagcgggtgtgggagatgctcctgcgcgcgttccccgacatccacgtcgccgtcgaggagatgatcacggagggcgacaaggtcgtctccaggaacacggtgaccgggacccaccggggcgagtaccagggcttggcgcccaccgggaagaccgtcacctacggcgagatcttcatcctccgcttcgccgacgggcggatcgccgagatccggggcatcgtcgatgtcctcacacaactgcgccagctcggcgccgtcccgtcc

SEQ ID NO: 3982 - DNA, 522 bp, Streptomyces avermitilis
  CDS (1)..(522)
atggaggccatcgatgtcatcaagtccgtccggtggcaccggaaaatgccgtggcaggtcaaaccggacaccatcgacccgccccaccgcagcccggatgtgagacctggggaagaacaactgccggcgccgggctgggtagcgtattgcatcgccggactgcttcggctgttcgtgagtggggctctgaccggtgtcatcgccagcagccacccacaggtggcagaccctctcgtttccttcctcatcggcttgggtgcgctgtcgggtgtcgaaaaggtggcaacgctggtgccgctggcagtcaagagcatcggacgggccgccctgggaagcaccgtggacgcggtgcaggagcagcggcagattccacagcagccaccgcaaccaccgcagcagggtcacgtcgggtcggccggtccacagcagggacccggaacggccggttcgctcggacaggggccgcagccgaactcggacatccccgcgcaacaggacccgacgggcaccggaggtgcgctg

SEQ ID NO: 3983 - DNA, 1005 bp, Streptomyces avermitilis
  CDS (1)..(1005)
gtgaccgtcactgccgagtccttcgtcgggcgcgtcatcgccgtgttctcgcgccgttcgccgggcttccgcccaccctcgcccggcactcccggctctcccggcgaggcacaccggactgcggccgggcttcgttcgggtgtggccgcgacggccgacagcaccgcgcctggcgagggcccgggcggggggcaggacgaaggcggatcgcagggatcgcaggggttgcggctggcccgggcgaccagtccgtggaaatcgacgtcctcccacacgcggctgtggcaacgccgtgtcctcctggaactgttcgcgtacgtcagggccgctcaccgacacgcggccggttgcaacctgcgacaagaactcgacttcgtccgcagccttgccggcgacctggccctcgtacacgacgctgccgtcgtccgtacgctcgataccgcagtggtgcagaggctcgaatccctccgcggcacggtccgtgacctcgtccaggatctcgggcaggctcgcgaacttgctcacgagctggtccgcaatcttcggtccgctccgagcccgtccaacgaccggaacctcgcgcaggtactcgcccgcaccctcgacgagatcgtcgaggacaccctggcgcgcgacgtggtgctggtccgcggccgcgcttccgtcctccctgccgaccgcgacctgatcctcgtccgtaacctcgtcttcgacctcgtccgcgtcctcgacctcgtcctcgatctggcgctggtaagtgatctggcggaggcacgtgacaacctgagcgacgcggccaacaacttcatgggcgccgatgtcaccgatgtggatcccgcggccatgaatctggcctggatccgctggaatcgagagacacggtggccgacgcgcgaatgggctgaccgtatccgcagggcctcagtggaatccccgccgggttcgggcattttcacggtcctgcccgagcaggaatacggccccgcagaagtagcgctggtccac

SEQ ID NO: 3984 - DNA, 507 bp, Streptomyces avermitilis
  CDS (1)..(507)
atggggagacggatgacccgactgcgcgtgctcgtctgtgtgtccgccctgctcgcggccgggtccgcctgcgcgtcgccccaggtgtgcgctggggtcggcgtcgagtcgggcgtgggcgtgatgtttctgcgggagggatacggcgacctcgccgacgcctcctacgagctgtgcgcgcggggcgagtgcgcgaagggcgagctgcggcaggaggacttgacgcgtgtgcgcctcgggctgccggacgacgtggacccggacggcggcacggtgcgtttccgggtcacccgcaagggcggcaccagccccgtcatcgacgcgtccgccgacgtgaggctcacccgccagtccgacgagtgcggcggcggcgcctacaaccgggggctcgcgttcaccaagaagggcggcctgaccacgaagatcccgccgagcgtgacggcggcgtggcgcgagcaggtgagggagctccgctcaccgtccaccggagcgacgaccgagtctccc

SEQ ID NO: 3985 - DNA, 579 bp, Streptomyces avermitilis
  CDS (1)..(579)
atgacccgctctgtggagcggcccgtccttttcctcgacgtcgacggacccctcatcccgttcgggccgtcgtcccggcggctccagccccgtgccgccggctccgtggcgttctccgacgaggggaacccgctgctggggcggctcgaccaggccgtcggaccgcgtctgatggcactggggtgtgagctggtgtgggcctcgacctggatgaatgacgccaacgagtccgtcgccccacggatcggactgcccaggctgcctgtggtggagtggccggaagcctccacccacgagggcccgcgcggcctgcactggaagacccgccatctcgtcgagtgggccggccaccgcccgttcatctgggtcgacgacgagatcggcgccatggaccgcctctgggtcgccgcgcagcaccaaggaccctcgctgctgcaccgtgtcgacccggcccaaggcctcaccgacggcgacttctccgtgcttgctgattggctccgtaccgccgtgccaggtctcgccgtgcccacccgggtcgaggggggctcagggagactcggtcgtcgctccggtggacgg

SEQ ID NO: 3986 - DNA, 342 bp, Streptomyces avermitilis
  CDS (1)..(342)
gtgaccgcgttcctggtcagcggcctgggcacccaggtcccggaagtgatcggcgacccgtacgaggacgcggacggggtgcgctacctcccgatgttccggcagccggtcctggtcttcgagggctcgaaggaaaccctgacggccgcccacacccgagccctcacccgcgccctccctcgcgccctgttcacgtccgacctgttcggaacgggcaacgatcacgacaacagggcggcggtacgcgcggtaaggacgacggaactggatgtggtgggcctcgcggtgtacgggccgcgcaatgcggtggacaaggtgctgaagggggcccggatgcatccg

SEQ ID NO: 3987 - DNA, 810 bp, Streptomyces avermitilis
  CDS (1)..(810)
ttgtacgttgtttgcatggtggaccggcgtgagatctccgcctggcgcccgcgggtgccgggtgtcgtggaggtctttcacgcccactacaccgagtacgcctatccgatgcacgtgcacgatgcgtggacgctgctgatcgtcgacgacggtgccgtgcggtacgacctcgaccggcatgagcacggcaccccggacgacaccgtttccctcctcccgccgcacgttccccacaacgggtccccggtcagtgagcacggctttcgcaaacgcgttctctatctcgacctcagccggctcgacgcgagcttgatcgggcccgccgtggacgcgcccgatgtcgtcgatcccctgctgcggctgcgcgtgggacagctgcacaccgctctcgcccacgccggggacgagctggaggccgagagccggctggcgttcatcggggagcggttgcgggggcatctgcggccccgggccgcacagcggcagcgtcccccggaccgcggcgtcgcgccccggctgcgtgagctgctcgacgcgcggctcgtcgacggggtctccctcgacgaggccgcgcggctcgtgcacgcgcatcccgcccatctcgtacgggcgttcagcggggccttcgggatcgcgccgcaccagtacctgatgtcacggcgggtcgagcgggccaggcggctgctgctggaggggatgcgaccggccgaggtcgcctccgccaccgggttctacgaccaggcccatctcaaccgccacttcaagcggttggtgggggtggctcccggccgctaccggaacagctcgcgc

SEQ ID NO: 3988 - DNA, 1764 bp, Streptomyces avermitilis
  CDS (1)..(1764)
atggaagggtgggcgggtatgagccagggaagccgggaaaaccagggacacgcgggcgtcagcagacggggcctgctcggcagcgccatagccgtggcggccgtcgccgcgaccggcaccacggccaccgccgccgcgcgaaccgccgccgcgcgaaccggctccgcgcgaaccgccgccgcccgatccggctccgggccgtccggcgaagtcccgtccctctggcacgaattcacccgcgccccctacacccacccgcagatcccgtacgtgggcaggtccggccaccgccgtggggcggcgcgcttcccccgccgccccgtcgtggccgacgtccgcgatcacggcgccgtggcggacggcacgaccgactccgcccccgcgatcaaccgtgccatcgccgccgccggaagggccggcggtggcacggttctcctgccgcccggaaccttccgcatcgacgacctgatccgcatcgggtacgacaacgtggtgctgcgcggcgccggaagctcccgtaccaagctgtacgcgacgaagaacctcaccgagctgatcggcgtgtacggctcccgctacggcggcgacaagtcctcgtggtcctgggcgggcgggctgatctggctggcgcccagggcccgttgggactccctggtcgcagcgatcagggcgaaggcgtggccgttcgagggctggacgggcaacgggcgggacgagtgggagacgctgacgacggtctccccggcgcggcgcggctcctggtcggtgacggtcgccgacgcacggctgctgagaccgggacagctggtgctcctgcgcctcgcggacgacgccggtcataccctcctggagcacatgtcgggtggcggcccgggcccggaggcgtactcctgggacgacaagatcaagctgacgtcgtacgtcccctacgagtggcccgtacgcatcgcgcgcgtgcggggccggaaggtcacgttcgagcgacccctcccgctggacgtacgcccggagtgggacccgcgcctcaccacccacgtcgaggcgctgacgggcgcgggcgtcgaaggtctcacgctcgaagccgtcgagaccccgcagtccccgcatctcctcgacaagggctacaacggggtcgcgttccagtgcgcgtacgactgctgggcggacgacgtcgtcgtccgtcatgtggacaacggcttcggcctggtcgccgcctcctcctgcaccctgcgccggacgacggtggccggccggggctcgcaccacccgtacttctgccgcgagggctcgcacgacaacctggtcgaggacttcacgatcgaacagcgcacggtcccggcgccggccggcacccagctccacggcatcaacgtcgagggcctgtcctcgtacaacgtctggtcacggggcgagatgcggatgggcacgttcgactcccaccgcggcctgccgttcgcgaacgtccgcacggacatcacggtgaacaacaacggccgccacggcggagacgcgtcggccggcccgctcttcggcgcccgcttcgcccattggaacatccgcgtcaccaacggccgggcgggcctgatgaagatcgacgggctggccccgtacagcgccaccgtcggcctcaacgaggtcaccgagttcgaccagaccgacgtaccggacttcaccggcgacctccacgcgcgcgtggagctgtacggcacgacggacgtcgtacgcccgcgcaacctgtacgaggctcagcgcgagctgttccgg

SEQ ID NO: 3989 - DNA, 489 bp, Streptomyces avermitilis
  CDS (1)..(489)
atggctgacgcagcgtcgatcatcgagcaggtcctcggcgaggccgagctggagtgggagagccccgagccgggctcgtacgtggtgaagctccccggcacccgcaagctgtcgaccacggtctcgctgatcgtcggcaagcactcgctgtcgctgaacgcgttcgtgatccgccaccccgacgagaacgacgcgggcgtccaccgctggctcctggagcgcaacctcaagctgtacggcgtcagttacgcggtcgaccggctcggcgacatctatctggtcgggaagctgccgctggccgcggtcacgcccgacgagatcgaccgtctcctcggctcggtcctggaggcggcggacggctccttcaacaccctcctcgagctcggtttcgccgcctcgatccgcaaggagtacgcgtggcgggtggcccgcggcgagtcgacgcgcaatctggacgcgttcagtcacctgacccagcgcccggccaac

SEQ ID NO: 3990 - DNA, 1392 bp, Streptomyces avermitilis
  CDS (1)..(1392)
ttggagggcgctccacgccgtcccgaccggcatgcccgcagcgaggaggaacgccacgtgagccagtacgccagcaggctcgggcgtcgctccccggcggcccccacgcggcgcaggatgctccgcaagccccggcgcgtcgccatgctctccgtgcacacgtcgccgttgcaccagcccggcacgggcgacgccggcggcatgaacgtctacatagtggagctcgcccagcgcctcgccgcgatcaacatcgaggtcgagatcttcacgcgcgcgacgaccgccgccctccggcccacggtcgaactcagccccggcgtcctcgtgcggcacgtcgacgcgggcccctacgaaggcctcgccaaggaggacctccccgcccagctgtgcgccttcacccacggcgtcatgcaggcgtgggccggtcaccgccccggctactacgacctcgtgcactcccactactggctctccggccatgtcggctggctcgccgcccagcgctggggcacccccctggtgcacgccatgcacaccatggccaaggtcaagaacgcggccctcgccgaaggggacaccccggagccggccgcgcgtgtcatcggcgagatgcagatcgtggccgccgcggaccggctcatcgccaacacctccgaagaggccgacgaactcgtacgtcactacgaggccgaacgcggcaaggtcgccgtcgtccacccgggcgtcaacctggaccgcttccgccccgccgacggccgcgccgccgcccgggcccggctgggcctcccacaggacgccctcatcccgctcttcgcgggccgcatccagcccctcaaggcccccgacgtgctgttgcgcgcggtcgccgtgctgctcgacgagcgccccgagctgcggtcgaacctcgtcgtcccggtggtgggcggccccagcggcagcggtctcgccaagcccgaaggacttcagaaactcgccgcccggctcggcatcgccgatgtcgtgcgcttccggccgccggtcggccaggagcagctcgcggactggttccgcgccgcgtccgtcctggtcatgccctcctacaacgagtcgttcgggctggtcgccatagaggcgcaggcggccggtacgccggtgctggcggcctccgtgggcgggcttccggtcgcggtcgccgacgggcggaccggattcctcgtccaggggcacgatcccgccgcctacgcgcgcgtactgcgcgatttcgcggacgacccggcgctgtcggcccggatgggccgggccgcggcccggcacgccgagtgcttcggctgggacacggcggcctccgcgacggcggacgtgtacacggcggcgatgcaggcgcaccggcgtcgcgtacgctcccaccatggc

SEQ ID NO: 3991 - DNA, 816 bp, Streptomyces avermitilis
  CDS (1)..(816)
atgacagcccgcgcagcctcccgccccgtgggaacggtgacgcgcgggaccacgaacccgaaccgcctgcgccgcatggaccgctggatcgcggcggcacacggcgccgaactgcgccgcgccgccgacccggtggctgtcgacctgggctacggggccgccccctggaccgcggtcgaactgctgctgcggctgcgcaccgtcgcgccccacgcgcgcgtggtcggcgtcgagatcgaaccggccagggtcgcggccgcccggccctacgagcgcgaggggctcgtcttccggcacgggggcttcgaggttccggtgccgggccggccgacgctgatccgcgcggcgaacgtgctgcggcagtacgacgaggaccaggtcgccgcggtctgggagcggctgtgcgcccggctcgcgcccgccgacccggcgaccggctcccgcggcggcctgctggtcgagggcacgtgcgacgagatcggccgccgccatgtctgggtcgcgctcggccccgagggcccgcgcacggtcaccttcgccacccgcctcggctccctggaccgcccgtccgatctggccgaacgactgccgaaggcactcatccaccgcaatgttccgggcgaaccggtgcacgcgttcctgcgtgacttcgaccgcgcctgggcggccgcggctccctacgcctcgtacggcgcacgccagcgctggatccgtgcggtccgcgcgctgacggcggactggccggtgacggacgacgccgggcggtggcgccagggcgaagtcacggtgacgtgggagtcgttggctccgcggggc

SEQ ID NO: 3992 - DNA, 1089 bp, Streptomyces avermitilis
  CDS (1)..(1089)
atgggaaccggcaagcggaccctgaccatggcagccatcgccctggtctgcgcggtcaccgtgctcggcgcacccggcgcggcccacgcgagcccgtcgaaaccgaccccgactccggcccccaccccctccggcagcccaaccccggctgccgacaaggaacttgaagaggtccgcggaaagctggagaagctctaccacgacgcggcggtggccacggacgcgtacaacgcggccgaggaggacacccagaagcagtcggggcagatcgtcgagctggcccgggagatcgtcaagggtcaggcgaagctggccgacctgaaggaccgcgcgggcgccgcggcccgggcccagtaccgcggcggcggcctgccgcccgaggcccggctgtggctgagcgagaacccgcaggcgtacctggacggggcgggccgggtgcggcagggcgagcacgcgaccaagggcctgctcgccgagatgacgcgcacgcaggaggacttgcagcagtacgcgcgcgacgcctccgcccagtggaagcggctggaggccaaccgcaaggacaaggccgcggccaagaagaaggtcaagaagcagatcgccgccgccgagaagctggagtcccagctcgagaaggaagagaaggagcggctggcgaagctggaggcggcggccgcggccaaggcgcagacggcctggctcgactccggcgtcctcgacgagatcaacaccaaggcgtccgagcagggcaggaaggccgtgcggttcgcgaccgcccagatcggcaagccgtacgaatggggggccgagggcccgaagacgtacgactgctcggggctgacgtcacaggcctgggcggccgcgggcaacgggattccgcgcacctcgcaggagcagtggaagcagctccggcacatcgacgtgaaggacatgcgccccggtgacctggtcatctacttcgacgacgccagccatgtcgggatgtacgtgggcgacggcgcgatcgtgcacgccccgcgccccggccggacggtgacgatcacaggagcgggaacgatgccgattctgggggtcgtacgcccggacgcgggc

SEQ ID NO: 3993 - DNA, 1446 bp, Streptomyces avermitilis
  CDS (1)..(1446)
ttgccgtaccgcaccccgccgagcattccgctgcggcggctgctaccgctatggtccccgtcggtgggtcgaggtccctcgccccgccatgccctcggggggagggaaggaacccagacgatgcccgtacccgtaccgcggcagagagcgatcccggccgcggagtgtggtcaggctcagaccgtgccgcaggccggccgcccgttcccggaaggaccggccggccacgccaaggccccggtcgaccgcgccggctcccccgtcggcaccacacccgccaatctcactctgctcgtcatcgaggacgacccgggtggttcgccgatcgtgcccgagatgctcgactcggcgggccagcccatccgtatccgtaccgcccgcaacctcaccgaggccggacggctgctcaccgacgacgtccactgcatcctgctggacctcgcgctgccggcccccggccggtccgccgacagtgacgacgagctggccacgctcaagcacgtgctgaagatcgcgccccggcacgccgtactcgcgctcaccgcgtccggggacaccgagcgcggcaccgaggcggtgcgcgtcggcgcccaggactacctcttccgcgacgagctggacgggcggctgctgagccgcgcgatccggtacgcggtggagcgcaagcggtcggacacggccgagcgacggctgaccgagtccaggctgcgggcgcaggagaaccggcgcctcgagcgcggtctgctgcccaccccgctcctggacggctccccgctgcggttcgccgcgcgctaccgtcccgggcgctcccgggcgctgctcggcggcgacttctacgacaccgtccggacgccggacggcacggtgcacgccatgatcggcgacgtctgcgggcacggccccgacgaggccgcgctcggcgtggagctgcgcatagcctggcgggcgctgacgctggccggcctgtgcggcgacgagctgctctccacgctccagcaggtgctggagcacgagcggtcggacgacgagatcttcgcgacgctgtgcacggtggacatcgcaccggacggccgccgcgcgggcctgtgcctggccggccacccgtccccgctgatcgcccgcccgggccggcccgcccagctgctgccgtacgagaacaacggcccggcgctggggctgctcccgcatgcccgctggccgcgtatgcaggtggagctgggcgccgcctggagcctgatgctctacaccgacggcctgatcgagggtcacatcggccagggcaaggagcggctgggccaggacggcatggtggaactggtccgccgccggctggccgagggcctgacgggcgaggaactgctgcgggccacggtgaacgaggtccgcgacctcaacggcggagagctgacggacgacgtcgcggtcctgctgctggaccgcgtcggc

SEQ ID NO: 3994 - DNA, 339 bp, Streptomyces avermitilis
  CDS (1)..(339)
atgctgatgttgggcttcgctgggttcatgggagtgctgaagatcgtcctgatggccctcgccgcgttcgggctgttcgacgcggcgttccggcgcgaggacgcgttccgtgccgccgacaagcagaacaagtggttctggctgctgatcctcgcgctcgccctcgtggtgagctggctgttctcgatcctgtcgttcctgccgatcatcggcgtcatcgccagcatcgtctacatcgtggacgtccggcccgcgctccggcaggtctccggcggcggccggggcggtcgccgcggctccagcagcgacggcccgtacggcccgtacaacggcggccgc

SEQ ID NO: 3995 - DNA, 600 bp, Streptomyces avermitilis
  CDS (1)..(600)
atggccatcaccgaagacctgcgtaagaccctcagcgacccgaccccgctctacttcgcggccggcaccgccgacctggccatccagcaggccaagaaggtgccgggcatcgtcgagcagctcgccgccgaggcgccggcccgcttcgaggccgtgcgcagcaccgacccgaaggccgtgcaggagaaggccaccgcccgcgccaaggaggcgcaggagaccctgcagagcaaggtcacggggttcatcagcacgctcgacaccgatctgaagaagatcggtgagtcggcccaggacttcgccctgcgcggtgtcggcgtcgccgccgagtacgcggtcaaggcccgtgagacgtacgagaaggtcgccgagcacggcgagcaggccgtgcggacctggcgcggcgaggccgccgaggagatcgaggaactggccatcgccgtcgagccgaaggcggagccggtcgaggtgaaggacgacaagcccgccacggccgcggccgagcccgccgccaagaaggcctcggtcccggccccggccgagccgaagaaggccccggtgcgcaagcccacggcgaagaagaccacgccgcccgcgaag

SEQ ID NO: 3996 - DNA, 474 bp, Streptomyces avermitilis
  CDS (1)..(474)
atggcatcgctcaacgtcggcaatctcggtgagtatctgcgcgagcagcggcgcagcgcgcaactgtcgctgcggcagctcgccgacgccgccggggtgtccaatccgtatctgagccagatcgagcgcgggctgcgcaagccgagcgcggaggtgttgcagcaggtcgccaaggcgctgcggatctccgccgagacgctgtacgtgcgggccggcattctcgacgccgagcgggaccgggacgaggtggagacacgcgccgtcctcctcgccgatccgacgctgaacgagcggcagaagcaggtgctgctccagatctacgagtccttccgcaaggagaacggattcgagatcggcacggcggacgaggacgctccgacgaacgctcagggcagagcggacgcccaggacacccccgtacgcggcccccgcacggccggcggcagcgatgccgatccgcagcaggccgccggc

SEQ ID NO: 3997 - DNA, 411 bp, Streptomyces avermitilis
  CDS (1)..(411)
gtgacgaactcaccgcagccgaccggggcgagccccgccggatgccgtccgacgaggagcattccgatgtccatcgcacacgttgtcgtcactcttcttgccgctgccatggcgggctattcggcctacgccgtccttttccgcgccaagtgggtcgtggaagcgctgaccgactacagcgttcccgcggcgtggtggccctggctcggcgcggccaaggcggcgggggccgcgggcctgctggccggcctcttcgtgccggtcgtcggcgtcctggccgggatcgggctggtgctgtacttcaccggtgccgtcgtcaccgtggcgcgggcgcgctggtacgcgcacatcccgttcccgctggtctacgcggcaccggtgatcggatcgctggcgctcggcttcgccgcc

SEQ ID NO: 3998 - DNA, 1008 bp, Streptomyces avermitilis
  CDS (1)..(1008)
atgacccgcaaccgcgcctcggccgacggcgtaccgcagcccctcatggccacgtactacgcccagcgcgcctcggccggtctgatcatcgccgaggccgcgaccccgaacgccgtcgggcagacgtacccgaacatcaccgcgatccacgacgcgacgcatgtggccggctggcggggtgtcacggacgccgtgcacgcggccggcggccggatgttcctgcaactccagcacggcggccgggtcggacaccccgcgaccagcggactgaccccggtggccccctcgcccgtccccctgcccgaaacgatcttcaccccgtccgggcaccgcccctccgtcgtcccgcgcgagatgacggcggccgacatccgtacgaccgtcgccgacttcgcagccgccgcccgcaacgcgatcgacgcgggcttcgccggggtggaggtgcactccgccaacggccatctgctccaccagttcctggcgaccaacaccaaccgccgcacggacgcgtacggcggttcggtcgccgcccgcatccgcttcgcggtcgaggtgaccgaggccgtcgccgacgcgatcggggccgaacgggtgggcgtacgcatctcgcccgggaccaccgtcaacggcgtcgaggaggacgacaccgagctcctctatccggccttcgtggaggcgctggccgctctcggcccggcgtacctgcacctcgtccacgccgacccggaccagccgctgttccggcacatccgggagaactggccgacgacgctgatggccaaccccgttctcggccccgaactccccgccgacggcggcgcccacgcggccggccgcctgctgaccgcgggcgccgacctgatcgcgctcgggcgccccttcctggccaaccccgacctggtgacgcggctgcgcaccggcgccccggtcaatcccgtacgggaccggttcatgatgtacgtgggcggggagcggggttacacggactatccgacgctcaccgtcgcg

SEQ ID NO: 3999 - DNA, 375 bp, Streptomyces avermitilis
  CDS (1)..(375)
atgcggatcgggcaactggccgagcggaccggcgtgagcgagcggtcgctccgctactacgagaagcagggcctgctggcggccgaccgcacccccggcggccatcgcgacttccccgaccgggcggtcgaccgggtcatcctcatccaggaactcttcgccgcgggcctgcacagcaagaagatcgccgagctgctgccctgcatgcgggacacggacggcggaccgtccgaggtcgccacaccgcggctggtcgcggacctcagcggggaacgcgaccgcatcgaccgcatgatcaacgatctgatccggtcccggaccgtcctggacgaggtgatcgaagcggcttcggccggcctccgccggccgcacgtc

SEQ ID NO: 4000 - DNA, 2043 bp, Streptomyces avermitilis
  CDS (1)..(2043)
atgacgtcacccgaccccgccctccaccacgccctcacccgcgaacgcgcctaccacgacacgtgccgcaccgccctcgccgccatggtcgaaggcgccgacgagcacgtgatcaccggcgaggacgtctccgcctccggtgccgacgccgaagtcctcggccaccggctccgcagccgcgccaagcacatgcgtgaactccccgaaggccccctgttcttcggccggctcgacttcgccccggacagcggcgaccgggaacacgccgggcagagctaccacctcggccgcctccgcatcaccgagcaccccgccgcaccgcccctcgtcgtggactggcgcgcccccgtctcccgcgccttctaccaggcgagcgcccgcgccccccagggcgtcgccgtccgccgccgcttcggctgggcgcccggcagccgcggtgacaccgccgatctcaccggcctggaggacgagcacatcggcgccgaacagcacgcccccagccgcatcctcacccacgagatcgaacgccccaggctcggccccatgcgtgacatcgccgccaccatccagcccgaacaggacgacctcgtacgcgccgacctcgccacctccgtctgtgtgcagggcgccccgggcaccggcaagaccgccgtcggactgcaccgggccgcgtacctcctctacacccacccccagcgcatccggcgtggcggactgctgatcctcggccccaaccgcaccttcctctcctacatcgcggaggtgctccccgccctcggtgagaccggcgtacgccagtccaccgtcgccgacgagatcggcgcccgccaccgcgtcaccgccgtcgacgacgaacgcaccgccgtcgtcaagcacgacccgcggatggcggaggtgctgcgccgcgccctgtacggccggatcggcacggccgccgactccctgaccgtgcccgacggttcgtaccgctggcgggtcccggccgacgcgctggcgcggatcgtcgaggacgtacggaccgaacagccgccgtacgccgtcggacgggagcgggtgcgtacgcgggtcgtcggccggatccaggcgcaggccgaacggcgcgccgggccgcgtacgcacgcatgggtgcggaagatcgaacgggcccggccggtcagcgcgtacgtcgacgccgtctggcccagggtgcgggccgaggaggtggtcgccggactgctcgccgacccggacgcgctcgccgcggcggcggagggggtcctcgacgcggacgagcagcgggcgctgctgtggaccgggccgccgcgctcgtaccggtcggcgcgctggtcggccgccgatctcgtgctcctcgacgaggtcgcggggctcatcgaacacccggagggatacgggcacctggtcgtcgacgaggcgcaggacctctcgccgatggagtgccgggcgatcgcccggcgggcggtcttcggatcgctgacggtgctcggggacctcgcccagggcacgactccgtgggcggcccgcgactggtccgaactcctcccgcacctgggcaggcccgacgcgcacgtggtcccgctgaccaccggtttccgggtaccggaggccgtcgtggggctggcgaaccggctgttggagcgactcgatgtggcggtgcccgccgcccgttcactgcgccgggacggcgagttgaggatgcggcgggtcggggaggcggcggaggtggcggcagccgtggccgaggccgtgcgcgaggccctcgcccatgagggctccgtcggggtcatcgcggccgacgcggacgtcgcggccgtacgggaggcgctgtcctgcgccgggctcgagccggccgggcccgaccggctcggcgcacgggtcacggtggtgcccgccaccgtcgccaagggactcgagtacgaccatgtggtcgccgtcgagccggccgcgatcgcggaggccgagtcgcgcgggctgcaccggctgtacgtggtgctgaccagggcggtctcacggctggacgtcgtgcacgcgcgcccgctgccgtgg

SEQ ID NO: 4001 - DNA, 612 bp, Streptomyces avermitilis
  CDS (1)..(612)
atgggtgagatcgggctgcgtgagcgcaagaaacagcggatgtaccaggccgtgtcggacatcgccatcgggctgttcctcgagaaggggttcgacgccgtgtccgtggccgaggtcgccgccgccgccgagatctccaagcccactctcttccggtacttcccggccaaggaggacctcgtcctgtaccggttcgccgatcacgagaccgaggccgcaggggtggtcggcagccggggcgaagggcagtcgcccgtcgccgcgctacgggcgcacttcctggacggactcgcccggcaggatcccgtcaccgggctcaacgaccgtccgggcgtcctcgccttccaccggctgctctacgggacgccggccctcgccgcccgcctccacggttacctggagcggtcggagggcgcgctcgccgcggccctcggcggcgacctcgacgcccggctcgccgccggccagatcgtcgccgtgcagcgcgtcctcgcgctggagaactggcgccgggtggcgggcggggagcgggcggcggacgtccacgccgacgccgtcgccgcggccgagcgcgcgttcgggcggctggcggacgggcttccctcgtacgcc

SEQ ID NO: 4002 - DNA, 966 bp, Streptomyces avermitilis
  CDS (1)..(966)
atgcgtgcggcacaggtgaaggagttcggcggcccggaggtgctggtcccggtggacctgcccgacccggtacccggcccgggcgaggtggtgatcgaggtcgcgtacacggacacgatcttcgtggagacccagctgaggtccggctggggccgggagttcttcccggccgaaccgccgtacgtgccgggcggcggtgtgtccggggtggtgggcgcgctcggtccggacgtcccggccgagtggctgggccggcgggtgacgtcgttcgtgacggggagctacgcggaacgggcggtggcggcggtctcgtccctgacgccggtccccgacgccctggacctgctgaccgccgcggccctggtccatgacggcgtgacggcgacgggcctgctggaactgaccaccgtcaccgagacggaccgcgtcctgatcctgggcgcgtcgggcggcatgggcacgctgctggtccagctggcgcacgcgcggggcgcccgggtggtgggagtggcccggggcgaggcgaaggtggcgctggtgcggaagctgggggcggacgaggtggtggacgcgacgctcgcggactggccctcgcgggcgcgccacgcgctgggcggggacggggcggcggacgtggtgctggacggagtggggggcgagctgggggccgcggcgttcacgctgacggccgacggcgggcggttctcggcacacggggcgccgtccgggggcttcgccgccctcgatcccgacgaggcggggcggcgcggcatcaccctcttcggcatcggggacgtgcagttcggtccggccgacctgtcgcgcctgacggccggcgcgctggccgaagccgcggcggggcggctgcggccggtggtcggggaggtgttcgcgctggagaaggccgccgaggcgcacgccgccatcgaggggcggcagtccgcggggaaggtgctgctgcgcagg

SEQ ID NO: 4003 - DNA, 2235 bp, Streptomyces avermitilis
  CDS (1)..(2235)
gtgggcgcaccccccgttccccgtcctccggtccgggaacgagccgccgacgttcttcccgacagcgcgttcgacgcgttcgtgcgcgtggcggccgagcggggggtaccgagcagcggacagcaccaccagaacttcgtgactccgctcgccgagccggtcgcgcgtctcctggggcgtgcggccgggacgccggtggtggtgcggattccccgcgccgaggcgctgcccgtggtgatcaggacctggcgggacgaggcggagatcctcggcgccctccacggcgtcctgccccatgtgcccgaatgcctcgtcaagcgcgagaacgccgtgatccacagctatgtgccgggcgtgccgctgtcgagcctctgcggcaacggcaaaccggtcgacggcctcatgctcaaggcgctggcggggctgttggcccggatggcgcaggtgcgcagggaggccctgccgccgctgcccgccgactggccccgcaacgacaaggacggccaggcgttcctgcgtaccctcgcgcacctcgccgaccgccagatccgtcagcccaactgggccgcctacggtggactgttcgcggctctgggcgtccccggagacgccctcacccggctggccgggcgggttcccgcgatggcgcgtcgcccgtacagccttctgcacacggacctccaccgggacaacgtgatcgtcccctacagcggcgacccgccactggtctgcgtcgactgggaactggcgacgtacggcgatcccctgcacgacctggccacgcacctcgtacggatgcggtacccggccttccagcgggacgaggtgatccacgcctgggccgacgcgatgggggcgacccggccggcggcggtgaacggactcgcgaccgacttgcgccactacgtcgccttcgaacaggcgcagtcggtgtttcccgacgtcatccgggcggcgcggtcgctgacggactcgcgcgacgagaagagcctggacgccgccacggccgaggtgcacagggctctttggacagccgcggaaccactcgggctggcgcaggtcccgggtaccgccgagatccggggggccctctaccggtggcaggcgtcgtcgcctcagcggagccccggcgcccggcgcgccacgatcggctgggtaccggacagacgcgtcccggaacaccccgaattcccccaccccgcggtgctctccgccctgatggcggaaggggcggcgccggcggcccgtgtgttcaagggcaccgcgcacctgaactcggtggtccgggtgccgggggtcggctttcccgtggtggtacggcgcaggctcgcgtcggtctgccggcgcgagcccagcttcctcagcgagcacgcggtgctgcgggccatcgagtcgtcccgggtcgcggtgacggcgccgcgggtcctggcgctgggcgagagcgctgagcgggatcctttcgccatccacacgtatgtcggtccgcccgacggtgaccagccccccaaccatccggtgcacggtctgctgccgcacgaggcggacggactcgtcgaccagctctgcgccctgacggacgtcgaccacggcgccctggacccgatggcgggcgagcccgacttctacacgtggctgagcgggcaactggtcgggctggtccgcgggctgccgagggagtcgcagcaactggcgcgtctgctgggccttccggacgcggctcggctggggcagatcctcgcccggcacgaggtgacgcccaggtcaccgtccttgctgcacggagacctgaacccctggaatctcgtacgccggcccgaccggttcgcgctcaccatcatcgactgggagatggcgatggtcggcgacccgctgtacgacctggtccggcacctgcacctcaccccgacccggccggagatccgcgaccgcatgttccgccgctgggaacgcggactcgcccccacccacacgaaggactggcagcgggactggcgggtctaccggtggatcgagatcgtccgctccgcctatgtggacctcgaccggctcgtcaccggcgcgggcctcgacgcccccaacgtgcgcagggcggtcagctcgtacgcgatgaccctgcgggccgcgacagcctcgctgggactgcccctcggccggctgtcgcaaccctgcctcgcccgcgccctgccggacggcggccggggcggcaccggaccggccgggctgcccgtgggcggg

SEQ ID NO: 4004 - DNA, 801 bp, Streptomyces avermitilis
  CDS (1)..(801)
gtggttcaacgccctctgggaaaccatcacgacggacctgacactctcttagtgacttctgatgcgacgcagactgaactggtgacagcagagaccgagaaactgcgagaactgatcacgcgggcccgtttcgtcctcttcgacttcgatgggccgatctgtcggctgttcgcggggcacaaggcggagcgggtggcggtcgagctcgtggagtggctcgaaggccggggcctgcacgccctgttgtcggagacggaacgcgaggctctggacccgcacatagtcctgcgcgcggtggaccgcagacaccccggcagcgacctggtggccgagctggaggaacgtctcaccaagcaggaactccgcgcggcgtcctcggccatgcccacggcgtacgcggaccccctgatccgcacctggacggcggtcggcgcccgactcgccatcgccacgaacaactctccgcgggtggcccgcaagtacgtggcgagccgtggcctcagcgcgtgcttcgccccgcacatctacggccgcacccaggacctgcaccttctgaagccggatccgcactgcctcaaccgcgcgctgaacgcgatgggcgccgctccgtccgcgtccttgatgatcggcgacaccccttcggactacttcgccgcacagcgggcgggcgttcccttcctgggctacgcgcgcaacgaccgcaaggagaagctcctgaaggaggccggcgccgaggagatcgtggggtcgctggagctggtgctgcgcgtcctcagggagcagtccgcttccgcccggccg

SEQ ID NO: 4005 - DNA, 876 bp, Streptomyces avermitilis
  CDS (1)..(876)
ttggtcgtgactcaggagaacgttgcagtgaacggcagcagaaggctctcgccccaggagatcgccgacaccctgcgggaccgcatccgcgccggcgacctgaaggcgggcgaccgcctgccgacccaggccgaactggcggaggagttcggcgtggaacgcggcacggtccgccaggccctgcgcgcactccaggaggacggcctgctgagcaacgtcagcaaggggagcccgccgcggatcgcggaggtcacgcccacccgtgacgaacctcagccgacgatggtgggcctggccccccggctcacggcggcgttcggggtcccgcacgtccatgtggacgcggcctgcctgaccgccgagacgctgatgctggcgctcggcgaaccggtccgccagatccatgagggccggctccgcccggagtcgatcgacgtccgcatcctgctcccgtcccgcgacatcaacctcgcgttcccgatccaggtcgacggccgcaccgagggcgaccccgtccacaagcgctggctggagcagcgcaacgcccaggggcatgtcctgcgccacaacctccaggccctgcgctcctcgcacggcatcgacgtccgggtgaccttccgcgccctgccgttcaccccgccggtgaagctgtacctgctcaacgaggaagaggcgctgatcgcctactacatgctgacgaagcgggaggaggaggtggagagccggaccctggagatgtacgacgccctcggctccaagtccctgctcttctccttcgagagccgggtgggccagcgggacgccgcgttcgtggaccaatcccagaagtggttcaacgccctctgggaaaccatcacgacggacctgacactctct

SEQ ID NO: 4006 - DNA, 186 bp, Streptomyces avermitilis
  CDS (1)..(186)
atgcccgtcatcgccctcctcaccgccgtcttcgtcgtcggattcgagcagatcgtccagtggcgctacggtgcgagcggtgtcgtcggcctgctgctgctcagcatcggcgtcaaggccaagaaccccacgtgcagctccatcggcgccgtcgtcctcgcgctgacggtcgccggccccgcgctg

SEQ ID NO: 4007 - DNA, 915 bp, Streptomyces avermitilis
  CDS (1)..(915)
ttgtactgttttgtcgtggacccggaacatgcctccgtcaaggggcggaagaggtcacgacagccacaggcgtcacatcgcgaggtggccgacgagctgcgcagccggatcaggtccggagtgctgcggccgggacagcgcatgcccacgcaggccaggctggcggacgagttcggggtggagcgtggggctgtacgggaggcgctgcgcatccttcaggcggagcggctgctttccaatgtttcgaagggcagcccggcgaccgtcgctcagaacataggcggtgtgccgaccgggcccgaaactccgccgcagcccacgatggtggcgctcgccccgcgggtgtcggcggccttcgcggtcccgcacgtggagatagacgccctgtgcctgacctcggtctcgctgacgctcgcgatgagcgagccgttgcgcgagattcacgcgggacgtataaaaccggccaaggtcgatgtccgggtgctgctgccgagccgcgagatcgacctggcgttcccggcacccgtggacgcgtcgcacaacggccggctccagcgccgctggctgacccagcgcaacgcccaggggcaggtgctccggcacaacctgctggcgctgcgggccacgcacggcgtggacgtccacgtgtccttccgggccctccccttcaccccgcccgtgaagctctacctgctgggcgagtcggaggcgctgttcgcgtactacacgctgacgcggcgcggcgaggagatcgaccacgagtacctggagatgtacgacgccgaaggcacgcagtccatgctgttcgccttcgcgcagggggcgagcctgcgggacacgacgttcgtggagcagtcgcacctgtggttcaacgcgctgtgggagacgatcagttcggaactggagttcacgaac

SEQ ID NO: 4008 - DNA, 1254 bp, Streptomyces avermitilis
  CDS (1)..(1254)
atgagccgccccgacgacatcgacgtacgcccgatcgccgaggccgagacagccgactggatccgcgccctcaacaccggtttcctgcgctccccggaggtctcggaacgcgaggtcgcggaccggagctcgtacctcgtcccggcccgcaccctgggtgccttcgacaacggccgctgcgtcgcgacgttcagatcgttcccgcaggagctcaccgcggtgggcggcgcctccgtccccgccgacgcgatctccaacgtcaccgtcaccgccacgcaccgccgccgcggcctgctcacccgcatgatggcccaggacctcgcggccgcgaaggagcgcggggacgtcgtcgccaccctcatcgccgccgagtacccgatctacgggcgctacggcttcggcgccgccacccactccaccgagtggacgatcgacgtgccgaggaccggtctcgacccccgctggtcgggccccggggacggcggccgcatcgacctcgtcgacggcgaggacgtccgcaaggccggcccggagctgcacgagcggctcaggcgtacccagcccggcgcggtcagccgcgacgagcgctggtggcaggtccacacgggcgtcgtgcgcctggaccgctcaccgtggacggagcccttctacgccgtgtaccgctcggcgtccggcgaggtcgagggcctggtgtcgtacgagtgcgacgaccactggggcgacgccaagcagccccagaacacggcgaaggtgaactggctgatcgcgacgaccccggccgcggagcgcgccctgtggcactacctgtgctccatcgactggatcacgaaggtcaggacgggctggcgggcccccgacgacctgctgccgcacttcctgcccgatccccgcgccgcccgcgtcaccacgcacgcggactggctgtgggtgcggatcctggatgtcgtacgggcgctggaggcgcgtacgtacgacgggtcggggacgctcgtactggacgtcgtggaccggcacggactggccggcgggcggtaccggctgacggtggggccggacggggcggtctgcgagccgaccacgcgggatgccggactcacgctggacgtgggcgagttggcggcgctgtggctgggcgacgcgtcggcggtgcggctggccgcgctcggccgggtgcgggaacagcaagagggcgccgcctccgttgccgacgccctgctgcgaacgtccgggcgaccgtggtgcccggacatgttc

SEQ ID NO: 4009 - DNA, 987 bp, Streptomyces avermitilis
  CDS (1)..(987)
atgtccgcccctgccacgcccgcgatacccgccgctcccgccgtgtccgccgtaccgcccgtcctcgcggaggtcgtgcgttccggcttcgtcgaggggcggcaccgggggagcctggtgctgctggccgcggacggctccgtggagctggcgctcggcgatgtgacggctcccgtcttcccccgctcgtccaacaagccgatgcaggccgcgggcatcctgcgggccggcctggaactggacggggagcgcctcgcgatcgcggccgcgagccactcgggcgagaccttccaccgggacctggtccagaagatgctggccgagcacgggctgagcgcggcgcagctccagtgcccgccggacctgccgctggacggggtggagaccgaggcgtacctggccgcgggcgccgtccgcgaccgcgtcaccatgaactgctccggcaagcacacggcgatgctcgcggtgtccgcgctgcggggctggccgctggactcgtacctggacccggcccaccccttgcagcagctgatccacaccgtggtggaggaggcggcgggcgagccggtcgcggcggtgggcaccgacggctgcggcgcccccctcatggcgatcaccctgacgggcctggcgcgcgccttccgctccttcgtgctggcggccgacggcaccgccgaacgccgcgtcgccgacgcgatgcgcgcccaccccgagtacgtcgcgggcacgcgccgccccgacacctggctgatgcgtgagctgccgggcgccctgtccaagatgggcgcggaggcggtccaggcggtggccctgccggacggccgggcgctggcgttcaaggtggacgacggggcgacgcgcgcgctggggccggttctggcgcgggcgctcgctctcatgggcgtggccgcgccggtggtggcccggatcggggcggcgccgctgctcggcggcgggcgcgaggtgggggagatccgggcggcgttc

SEQ ID NO: 4010 - DNA, 594 bp, Streptomyces avermitilis
  CDS (1)..(594)
atgagcacaccgattacgagtaccgggcagttgcccggggtcggcacacacaggccgcccgtgcagcgcacggacagccccctgcccgcggctccgcccgagcccgatctgtccgtgctgcggctgccggagctgcgcacgctgcgccgggacgcccagcgggacgaggccgacctcagctatgtgcggcggctgctccaggggcgtatcgacatcctgcgggccgagctggcgcgccgcggtgggctcgcggcaccggcggggggcacgccggcgggggtcatggagcggctttcggagatcctcacggacgcgcccgcccggcagcgttcgtcggcccgccatgtgacggtgggcacgccgcacggcgaggagccccggcgactggcgtccgagatgctcgccgaggtcgagctgtcggacctggaagcacggacggacgacgagctgggcgcgggaatgggccgcctcgtgcgctacgagcggcaggtctcccgcagccgccagcagctccagcgcacggcggacgattgcagcgccgagatcgcccgcaggtaccgtgaaggggaagcacaagtagacgacctgctcatg

SEQ ID NO: 4011 - DNA, 435 bp, Streptomyces avermitilis
  CDS (1)..(435)
atgcgtgcggtggtgcagagggtggacggcgcgagcgtcgtcgtggaaggcgagaacgggccggagacggtcggtgagatcaacggcgaggggctctgtgtcctggtcggggtcacgcacgacgacaccgaggagaaggcggcccagctggcccgcaagctctggtcggtgcgcatgctggccgacgagaagtcgtgcagcgacatcgacgcgccgctgctcgtcatcagccagttcactctctacggggacgcccgaaaggggcgccgccccacctggaacgcggccgcgcccggcgatgtcgccgagcccctcgtcgacgaggtggtcgcccggctccgcgcgctgggcgcgacggtggcgacgggccggttcggtgcgcagatgcgcgtatcactgacgaacgacggcccgttcaccgtactgatcgagaac

SEQ ID NO: 4012 - DNA, 963 bp, Streptomyces avermitilis
  CDS (1)..(963)
atgaagagccccctgctgtccctgcccggcgccgttcccgccgagggagcggacgaaggcgtcgcagcccactacggtgacctgttccgcgaacagcgcgccctcgcgggcggcgccggtttcgtggatctctcgaaccgcggcgtcgtcacggtcaccggcgaggaccggctcagctggctgcacctgctgctcacccagcacgtcagcgagctcccggcccaccgcgccaccgaggcgctgatcctctccgcgcacggccatatcgagcacgccctgtacctggtcgacgacggcacgacgacctgggcccacgtggagcccggcacccaggaggcgctgatcgcgtacctggagtcgatgaagttcttctaccgcgtcgaagtcgccgaccggacgggcgagttcgcggtcgtgcacctgccggccggttcgatcgccgacgtgcccgccgacgtcgtcgtacgggagaccgcctacggccgtgacctgttcctgccccgcgccgagctggagtcgtacgcggacaggagcggccccgcggccgggctgctcgcgtacgaggcgctgcgcgtcgagcaccaccgcccgcggctcggcttcgagaccgaccaccggaccatcccgcacgagctgggctggatcggcagcgcggtccacctggagaagggctgctaccgcggccaggagacggtcgcccgggtccagaacctgggcaagccgccccgccggctcgtcttcctgcacctcgacggcagcgaggtccacctgccgccgcacggcaccgagctgcgcctcgcggacgacggcccggacggccgcaagatcggtttcgtgacgacgtccgtacgccaccacgagctgggcccgatcgccctcgccctggtgaagcggaacgtgccgctggacgcaccgctggtggcggacaacacggcggccgctcaggaagtcgtcgtagagccc

SEQ ID NO: 4013 - DNA, 435 bp, Streptomyces avermitilis
  CDS (1)..(435)
gtggtgagcaccgactggaagaacgatctgcggcagcgcggctaccggctgaccccgcagcggcaacttgtgctcgaagccgtggacaagctggagcacgcgacccccgacgacatcctcgtggaagtgaggaagaccgcgtcgggggtcaacatttccaccgtctaccggaccctcgagctcctggaggagctggggctggtcagccacgcgcacctcgggcacggcgcgcccacgtaccacctcgccgatcgccaccatcacatccacctcgtgtgccgggactgcacgaacgtcatcgaggccgacatcggggtggccgccgagttcaccgcgaagctgcgggagaccttcggtttcgacacggacatgaagcacttcgcgatcttcggccggtgccagaactgcgcactcaagagttcaactaccaagtcg

SEQ ID NO: 4014 - DNA, 573 bp, Streptomyces avermitilis
  CDS (1)..(573)
atgatcgagatcccgtccgacctccacaaggacctcgtcccccttgccttcctgctgggcaactgggccggcgccggcgttcacgacttccccggctccgagaagtgcaacttcgggcaggaggtcagcttcacccacgacggccgcgacttcctggagtaccactcgcacacctgggtgctcgacgccgacgggaacaaggtcaggccgctggagaccgagtccgggttctggcgcgtcgatgccgcccgcaaggtcgaggccgtcatgacccgcgacgacggcgtcgtcgagatctggtacggcgagctggccgccaagaagccgcagatcgacctggtcacggacgcggtcgcgcgcacggcggccgccggtccgtacagcggcggcaagcgcctgtacggctacgtgaagagcgacctcatgtgggtcggcgagaagcagacccccgaggtcgagctgcgcccctacatgtcggcgcacctgaagaaggtcgtcaccccggaggacgtcgagcgctgggcgaaggccctgccggacgacatgccggacgacggcatcgccttcttcaag

SEQ ID NO: 4015 - DNA, 843 bp, Streptomyces avermitilis
  CDS (1)..(843)
atgaccgagcagacggacacgcagcccctcgcaccacctgtacccccagttccccctgttccccccgctcctcccgtcaaaaaagaccgccgcgtcctgcgtgccgtgctccggtggagcgccgccgtcgtggtcttcgcggccgtcggggcggcgtccgcgtacgggatcgcggcgatggagcggaccgatgtgccggggctcgcgaccgcgtcggacgggcggtgggagtacccggagatcgtcaaaccgccgctgccgtccggcagcccgggaccgctcgccgaggcgaacaaggccggcacccactacgccgacctgcgtgccctcgtcctgcccgcccccgagggcgcgaaggaggacaggacgctgcgtggcgaggacggctggctgcccgcgaagaccttcgtcgcggagtacgccgggaaggacgaccgcgacaccgtgcggcagctgctggccgacaacggcctgcggcacatcgccgcccgcggctggaccacccaggacggcacccgcacccggatctacctgctccagttcgacaccgcggcggtcgtggacgacctcctctccagcgagctgaccgactacgacgccccgcggtacgcgctgcgcggcgccgcgcagctgagccgggacgagaagttccccgagtccacctgggtcgagggcgtcgaccgcgccgtgttcgcggagaccaggccgtacgggcgcgaacaggaccgccaggcgtatctcggcgcctccgacactctcgcggtcgtcgtgcagtccggtgcgggcggcgcgaaggccgtgccgttccagcagacggtgaccctccagagccagatgctgggc

SEQ ID NO: 4016 - DNA, 789 bp, Streptomyces avermitilis
  CDS (1)..(789)
gtggtcctgccggaggccggcaccgccccgaagaagcccgtacgccgtggccgtgtcgccgccgtcacgggatccgtgctgctggccgccgcggtcgtcgccgggaccggctacaccgtcgtgaccgtcaacggcgccgaccgtgacgcgggcgcgcccgtctggaacctgcccaaggcgaagaaggaggccacgacggagacggccgcctcttcggggctcggcggcatgctcgtgccgtacgagaccgacggcttcacccgggggccggacctcgacgagttcggcgcggacgcggagctgagcggcgcccgggccaccgccctgcgcaaggagtcgctgcgcgatctgccccgctcgcagcgactccggctggagaagcggatcgacaagcagcgcatcaagggcatggtgatgcgcagctacctcagcacgtcccaggccggtaactcgacgctctacgcggacaaggcgttcacggtgagcatggtgctgtcccagctggagagccgggcggccgtacgggacatctcgacgttccagaacgagttcctcaccgccctcggcgtcctgcgcaaggggccgaaggtcgagggacacaagaacgcgcagtgctatctgccgccgaaggacgcggacgagaagctcgacgcgatgatctgctccgcgtaccagggcgacgtgctggtcagcgccacggcgtacggagccaagccactgaacgccaagggcgtggcgatgctgctccgcacccagctcgaccgcatcgccgaaccgggggaggcggta

SEQ ID NO: 4017 - DNA, 891 bp, Streptomyces avermitilis
  CDS (1)..(891)
gtgcgcgcggatacggaatccacgcttcgcgttctgtggggggacgtcttggaagtctcggaagtaccggaaagacccgaagcagctgacgtacctgtatcggctgacgtacctgtaccggctgaagcgcctgtatcagctgatgcgcctgtattagctgaagctcccgaggccgcgccgtcggcttcgcggcggcgcgggcgtacgacctcgctgatcgccacggccgccgtcctcggtgtcgtcgccggtacctgtaccggctttctgatccaggccgaccgcgagccaaccaggctgccgtccctttcgcagcccgtggtcgcgcaggccaaggggaagggccccgagccgctgtcggccgcgcgggaccgccgggtcaggacggacggcgacctgcgcgagctgctgctcaagcggccggccggggcgcgcgacaccgcgtacacgccgggccacgacggctgggtgggactcgcggagtacgcggagggcttcaagcagccggccggcgccttcagcggcgcgatcagtgacgagttccgccggtccgccgccaccacctggcgcgtgggcagcacgtacaacgtccgggtccagctcgtgcagtaccgccaggaggagaacctcgccgcggccgactccgccgccgacctccagtactgggcggagaaagaggccggcacccgcagctggaccgtccccggtacgggggacggcatggcgtacgtccacacgacaccggacgccaggccgggctatcagccggtgtactcggccgaggcgcacgcctggcgcggtgacatcgtcatgcagctctgggtgttcgacaccaagccgatccccaaggagaagatcatggatctggccgcgcggcagatggggcggctg

SEQ ID NO: 4018 - DNA, 345 bp, Streptomyces avermitilis
  CDS (1)..(345)
gtgatcaaggtgacggccggtacggacgccccggaacgctgctcgcaggcgttcaccgtggcggcggttgccgtggccagcggggtggaggtctcgctctggctgaccggcgagtccgcgtggttcgcgctgccgggccgcgccgccgagttcgaactgccgcacgccgccccgctgcccgacctgatcgactcggtcctggccggcgggcaactcaccctgtgcacgcagtgcgcggcccggcgggacatcacggagaaggacgtcctggacggcgtacgcatcgcgggcgcccaggtgttcgtgcaggaggcgatggcggacgggacccaggcgctcgtctac

SEQ ID NO: 4019 - DNA, 309 bp, Streptomyces avermitilis
  CDS (1)..(309)
ttggacgctcggggtgcggcccttcggcatgtgcgggcctacgctggacgtatgtacgcgcgacggcggcatgtctacttcgccatgatggggacgtgcatcggcctcttcgtcctggcctgggcagtcgtgcggctctggtcgattcccgtggccgtggggatgtgcgtggtggccatggtgatccccccgctcgccgccatggtggccaaccggcgaggccccgaggaccgctggtgggacgacccgtcgggggacccgaagtccgacgagtggtgggacgagctggacggcaagaagcggcggcag

SEQ ID NO: 4020 - DNA, 285 bp, Streptomyces avermitilis
  CDS (1)..(285)
atgtgtggagcgaaggccggcggccccgacgcctcgacgatcaagcccggtgagaccaccatccagggtcaggtgacgaaggacggcgagcccgtggtgggctacgtccgtctcctggactccacgggcgagttcaccgccgaggtccccacctcggcgacgggacagttccgcttctacgccgcggagggcacctggaccgtacgcgccctggtgccgggcgccacggcggaccgcacggtcgtcgcccagacgggcggcctcgcggaggtcgcgatcgccgtc

SEQ ID NO: 4021 - DNA, 837 bp, Streptomyces avermitilis
  CDS (1)..(837)
atgagccgcagcgacgtcctggtcgacgccgactgggtccaggaccacctggacgacccgagcgtggccatcgtcgaggtcgacgaggacacgtccgcgtacgagaagaaccacatcaggaacgcgatccggatcgactggaccaaggacctccaggacccggtccgccgtgacttcatcgaccaggagggcttcgagaagctcctgtcggagaagggcatcgccaacgacacgctggtggtcctctacggcggcaacaacaactggttcgcgtcctacgcctactggtacttcaagctctacggccacgagaacgtcaagcttctcgacggcggccgcaagaagtgggagctcgactcccgcgacctggtcgccgaggtgcccacccgcgccacgaccgactacaaggccaaggcccagaacaccgcgatccgcgccttccgcgacgacgtcgtggcggccatcggttcgcagaacctggtcgacgtccgctcgcccgacgagttcagcggcaagctgctcgccccggcccacctgccgcaggagcagtcgcagcgtccgggccacatcccgagcgcccgcaacatcccgtggtcgaagaacgccaacgacgacggcaccttcaagtcggacgacgagctcaaggagctctacgtcgaggagcaggtcgacctcgccaaggacacgatcgcgtactgccgcatcggtgagcgttccgcgctcacctggttcgtgctgcacgagctgctcggcgtggagaacgtcaagaactacgacggctcctggaccgagtacggcagcctggtcggcgtcccgatcgagctcggcgccaacaag

SEQ ID NO: 4022 - DNA, 741 bp, Streptomyces avermitilis
  CDS (1)..(741)
atgcgagcactgcgaatactcttgatcatcgccgtgatcctgggcggtctgttcgtcatcgcggaccgggtcgcggtcggcttcgccgaggatcaggcggccgagaagatcaagaccaccgagggcctgtccagcacgcccgacgtgtccatcaagggcttccccttcctcacccaggtcgccggcggagagctcgacgacgtcgaactcggcatcgagaactacgaggcggacacgggctccgccacgagcggcaccggcaagatccgcatcgacgacctgaacgccgagatgcacggtgtggtcttctccggcgactacagctccgccaccgccgacagcgccaccggcacggcgaccatcgcgtacagcgagctgctcaaggccgcgaagtccgagccgaccagggtcggccccgcgctcaccgcccgggtcgtcggcctctccgacggcggcaacggcaagatcaaggtcgaggtcgaggccaccgtcctcggcgccaaggtgccgcgccccgtctccgtgctgagcacggtcaccgtcgagggcgacacggtcaaggtgcacgccgactccctgcccaagctgggtgtcgagctggccgagaccgagatccgctcgatcaccgacttccagcagaagatcgacgaacttcccggcggcatcaagctcgacaaggtcgaggcggccaaggacggcgtggagatctcggtgaagggttcgaacgtcaagctcgtcggg

SEQ ID NO: 4023 - DNA, 1212 bp, Streptomyces avermitilis
  CDS (1)..(1212)
gtgacgggacctatgagcaaccagccgtatgaggggtcgtacgacgggccttacgacgggccgtacgaggggtacgacccgcatcagcaccagcagccctacgcgcagcagcaacaacaacagcagcagcatcagcaaccgcagcatcagcaaccgcaggcgtggcccgggcagcaggcgtacgacgacgccgctcagcagcagcagtacacccagcagtggcaggggcagacctgggagacgcagacgcagaagccggtctccgcggcggacaccacgtatctgccgcagcagcagtacgggatcgccgggcagccgctgccccatgaggccccggcgtacgacccgtccgcccacgctgcccatgccgcacccgccgcccccgtcgcccggagcaccccgcaggcgcccgccgagggatccggctacggcccggccaccaccaccggcaacgcccgcatcaccgacgcccagcgggcccgtctcgaggggcggtcgccgatcatcgagccggggatgcagcccgccgcgctcaccgcggtgctcggggccctgctgtccgtgtcggccacgatcggcgagtacgccctcgtcgtccccctggtgatcctccaggcggtgacggccgcgggctggttccggctgaacggcatgtggcccgcccggcagggcatcgcgctggcgttcgccggcgcgctcaccgccgacgtggcgctgctggcggccggccgggagaacgcgcccgccgcgatcctcggcaccctcggcgtctgggtgctgctgaccctcgtactccagctgcgcagccacgccgaccccgacgagcggatgtacggcctgatggcgaccgtcacctcggcggcgctggcgatcgtggcgaccggccacctcgcggcgacgccggacgccgtcaccgtgggcgccgcggcggtcgcggtggcgatcctggcgcgtgcgctgcccctgccgacggcggcctccgtggtggtggcgctgctcgccgccgcgggcgcgggcgtcgcggtcggtggcgtcaccgacctgggcacccagggggccttcctcggtctgggcgcgggtgtctgcgcgctgatcggccaccgggtcgcctcctacgactacccgtcccgcttcgtccacatgacggcgggcgtggcccttccgctggcggccgcggctccggcggtctacctgctggggcgggcgctgggc

SEQ ID NO: 4024 - DNA, 252 bp, Streptomyces avermitilis
  CDS (1)..(252)
atgccacagggcacggtgcgttactgggccgccgccaaggccgcggccggggtcgccgaggagccgtacgaggcggccacgctcgccgaggcgctcgacgccgcccgcgagcgacaccccggcgaattcgtccgcgtcctgcggcgatgctcgttcctcatcgacggtgacccggtgggcacccgcggacatgagacggtacggctggccgagggcggcacggtcgaggtgctcccgccgttcgcaggaggg

SEQ ID NO: 4025 - DNA, 891 bp, Streptomyces avermitilis
  CDS (1)..(891)
atgagcactggtccggcaggtcatacggcgcgttccagcgatcgtccgcactctgagacggcacgtcgtacccgtttgcggaggtttctgcgcacggtcgacggagtgacgatcgatgccgtatacgaaccggggaacgtcgtatacgacggtggaacgccgccttccacggcctcccgtgacgccgcccccgccgccgggcgtccggcgatcgtggtcgcgcacggcttcaccggggacctggaacggccccacgtacggcgcgccgcgagcgccttcgcgcagtacggggccgtggtcaccttctccttccggggccacggcgcctccggcgggcgctccacggtcggcgaccgcgaggtcctcgatctggcggcggcggtggcgtgggcacgtgagctcgggcacacccgcgtggtcaccgtcggcttctcgatgggcggctccgtggtgctgcggcacgcggcgctgtacggaccggagcacgaggggcgcacgcaggcgcgtacggacgcggtggtttcggtgagtgcgccggcccgctggtactaccggggcacggcgcccatgcggcggctgcactggctggtgacccggccggtggggcgggcggtgggccgcgtcggcctgcgcacgcgcatccaccaccgcgactgggacccggtgccgctctccccggtcgagtcggtcccgcggatcgcccccaccccgctcctcatcgtgcacggcgaccgggacggctacttccccgtggaccacccgcggatgctggccgccgccgctcaggaccacgccgagctgtggctggagcccggtatgggccacgccgagcacgcggcggacgacgcactcctgtcccgcatcggcgcatgggccgccgcgcacgccagc

SEQ ID NO: 4026 - DNA, 807 bp, Streptomyces avermitilis
  CDS (1)..(807)
atgagttctctgctgctcctgaccaatgcccttcagccgtcgacggaggtgcttcccgctctcggcctgctcctgcacaacgtgcgagtggctccggcggaaggccccgccctcgtcgacactcccggtgccgacgtcatcctgatcgacggccgccgcgatctcccccaggtgcgcagcctgtgtcagctgctccgctccacgggacccggctgcccgctgatcctcgtcgtgacggagggcggtctcgcggccgtcaccgccgactggggcatcgacgacgtactcctggacaccgccggtccggcggaggtcgaggcgcgactgcggctcgccatgggccgccagcagatcgtcaacgacgactcccccatggagatccgcaacggcgatctctcggtggacgaggcgacgtacagcgccaagctcaagggccgggtcctcgacctgaccttcaaggagttcgagctcctgaagtacctcgcgcagcacccgggccgggtcttcacccgcgcccagctgctccaggaagtctggggctacgactacttcggcggcacgcgcacggtcgacgtccacgtacgacggctgcgcgcgaagctcggtccggagcacgagtcgctgatcggaaccgtgcggaacgtcggctaccggttcgtcacgccggaaaagggcgagcgtggcggcggcagcgacgaggcgaaggccaaggccggcggcacgtccgggccggcggcgatcccggcaaagccggaggatgcggacgagacggcacacgtggtggcttccgaggtcacagccgaggca

SEQ ID NO: 4027 - DNA, 1041 bp, Streptomyces avermitilis
  CDS (1)..(1041)
gtggccaaggtgactcgggatgatgtggcacgactggcgggtacctccaccgccgtcgtcagctatgtcatcaacaacggacccaggccggttgccccggccacgcgcgagcgcgttctcgcagcgatcaaggaactggggtaccggcccgaccgggttgcccaggccatggcctcgcggcgcacggacctcataggcatgatcgtgcccgacgcgcgccagcccttcttcggggagatggcgcacgcggtcgagcaggctgccgccgagcgcggaaaaatggtgctggtcggcaactccgactatgtggccgagcgcgaggtccactatctgcgggcgttcctcggcatgcgggtctccggactgatcctggtcagtcacgcgctcaacaaccaggccgccgccgagatcgaggcctgggacgcccgggtcgtcctgctgcacgagcggcccgagctgatcgacgacgtcgcggtcgtcacggacgacatcggcggcgcccagctcgccacccgccacctcctcgagcacggctacgcgtacgtcgcctgcctcggcggcaccgcggagaccccgtccgtcggcgacccggtctccgaccacgtcgagggctggcggcgcgcgatgcaggaggccgggatccccaccgagggcaagctcttcgaggcgccctacaaccgctacgacgcctaccaggtgggcctggagctgctggccgggccgaaccggccgcccgcgatcttctgctccaccgacgaccaggcgatcggcgtgctgcgggcggcgcgcgagctgcgcatcgatgtgccgggggagctggcggtggccggcttcgacgacgtcaaggaagcggcactcaccgatccgccgctgacgacgatcgcctccgaccgctcggcgatggcccgcgctgcggtcgacctcgtcctcgacgacggtctgcgggtcgcgggctcgcgccgtgagcggctgaagctgtttccgtcgcggctggtggtgcggcggtcatgcgggtgtgctccgcaggagacgccgggttct

SEQ ID NO: 4028 - DNA, 1761 bp, Streptomyces avermitilis
  CDS (1)..(1761)
gtgatacctgccctgcgtggccgactgagaccgagacgcctcgtcacggcgtttcccgcggccgctctcgcgctggcgctgagctgcgccggcgtcctcgcgtcccagcccgccaccgccgccgacggacccggcggactgccggaccccggtgtcgccgcccagcagcgggcgaccccgcggcccaccgcctccaccaaggaactgcgcgaccgcgtcatcgcggcggccgaggaccaggcgacccaggccgagacgccgaagaacacgccgttcatcatcggcggcagcgagacgaccatcgccggcgcgccgtggatggtccagctcgcctactacgacgacgccaccggtgacggctacttctgcggcggcaccctggtcgccccgaacaaggtcctcaccgccgcccactgcgtcgcgggcctcgactgggtcaagaacggcgccgtcctggccggcaccaccgatctgtacgacgacaccaacggcaccgtcgccggtgtctggcgccagtggaaccacccgaactacaacccggtgaccatcaagaacgacatcgcggtgctcaccctcgaccggccgctggagcagaagtggatgcggctggcggccgcgggcgacaccccctggtacaccccgggccagaccgccacggtctacggctggggtctgaccgagggcgccggcaccgagctgtcgtcgaagctgcgcaaggccgacctgccgatcgtcgacgacacgacctgcaactccgcgatgcagtcggtcctgggcgaggacgacttcgtcgagggctcgatgttctgcgcgggcaccccggccggcggcaccgacgcgaccaccaagagcccctgcaacggggactccggcgggcccgtgatctacggcaacaagatcatcggcattgtctcgtggggcgtcgccggctgcacgggcaagggcgcctacccggtgttcaccaaggtgtcctcgtacacctgggcggcccagccgcgcatcgacgacaccgacctgtcctacgacggccgcgccgacctgctggcccgtacgccctccggcggtctgttcgagcaggacagcaagggcacctcgctggcccagcgcgcctaccagggcaacggctggcagagcgcgagctgggtcctccaggccgacctggaccgggacttcttccaggacctgatcgtccgcgacaagacggacggcaagctgtaccgcagctacatggaccacaccagcggcgagttcacctggatgcagatcagctcggtctggggcggctacaagtcgtacgccgtccccggcgacctgaccggtgacgcccgccccgacctggtcgcggtggacgcggacggctcggtctacctgtaccccggcaagggcaacggccagttctacggccgggtcaaggtcgtcgacaaggcctggaagaacgtgaagatcttcggccacggcgatctgtccggcgacggccgcgccgacctgctggtccgttccacggacggcacactgtggctctacaagggcacccagcaggagaaggcgccctggtcgagccggatcaaggcgcgcacgggctggaacttcacctcgtacgtcgccaacggtgacgtgaccggcgacggcatcgccgacgtgatcacccgcgactcgggcggcaagctgtggctgtacccgggcacgaacaaggcgtccagcagcctcttcggctcaaggatcgccctgggcagcggcttcaaccagtacaacctgctgttc

SEQ ID NO: 4029 - DNA, 1233 bp, Streptomyces avermitilis
  CDS (1)..(1233)
atgatcgcgggggaaccttctttcatgaccgagagcttccgccgcagcggcgagtaccccgagggcgaccaccagcagcctgcgtacccccagcagcagcactcttcttctcccgtgaaccccgagtggccgcccccgccggcctacgagccggtcacgccggtcgccgtcgagccgggcacgacggtctggccgtccccggcacaggctcaggcccatggccacgtcgcgggccaggccgcggaccacaccttcgcggcgaccggtgacggcggctacggcggcggccacggcggcgatacggctctcttcaccacgtcccccgagggcgccggtgccgctccgaagaagcgcgccagaggtccgctggccctgctggccgccgtcgcgatagtcgcggccgccatcggcggcggcaccgcgtacggcatccaggagctgaccggcaacgacaccgcgtcgagcagcaccagcacgaacgtggtgcccaccgccaagaagggcaccgtcgccggtgtcgcccaggcggtcagcccgagcatcgtcgagatcagcgccgcctcgaacgccggttcgtcgaccggcgcgggtgtgatcatcacgtccagtggcgagatcatcaccaacaaccacgtcatctcgggtgcctccgagatcaaggtgcaactgaacaacggcaagtcgtacaccgcgaaggtcgtcggcaccgacagcaagaaggacctcgcgctcatcaagctggagagcgcgccgtccggtctgaaggccgccacgctcggcaactccgacggcgtccaggtcggcgacgacgtcgtcgcgatcggctcccccgagggcctgaccggcaccgtcaccagcggcatcgtgtcggctctggaccgtgacgtgaccgtctcgacggacgagagccagggccagcagcaacagcagggcggcggcggcaacggcgagtggccgttctccttcggcggccagcagttcaacggcgacaccggctcgtcgaccacgacgtacaaggcgctccagacggacgcctccctcaaccccggcaactccggcggtgcgctcatcgacatgaacggcaacatcatcggcatcaactcggcgatgtactcggccgcttcggactcctcgtccagctcctcgagcgcgggcagcgtcggcctcggcttcgccatcccgatcaacaccgtcaaggccgacctggaaaccctgcgttccggttccaccggc

SEQ ID NO: 4030 - DNA, 252 bp, Streptomyces avermitilis
  CDS (1)..(252)
gtgtcgacaagtcgattcaaacgattaaagtcgagtaaggagtacgccatgatcaagaacctttcgcacacggtggccgacactgacccggccgaagtcgctcgcgccctcgcggtcgccctcgaactgcacgcaccggccccacgggcgcccgaggtggcggtcccgccgcagctgatgggcctccgtatgcccgccacgcgcaggcaccgccgcaaggtggtcctgagccacctcggcggggtgtgcgtg

SEQ ID NO: 4031 - DNA, 729 bp, Streptomyces avermitilis
  CDS (1)..(729)
atgagccccgccgaaggcgaccgtgaaccccagcgcatcctgatcgtcgacgacgagcccgcggtgcgcgaagcactccagcgcagcctcgccttcgaggggtacgacaccgaggtggccgtcgacggcgcggacgctctggagaaggcgacggcataccagcccgacctggtcgtcctcgacatccagatgccccggatggacggcctcaccgccgcccgccgtatccgcggcgcgggcacgacgaccccgatcctgatgctgacggcccgcgacacggtgggcgaccgcgtcaccggcctggacgccggcgcggacgactacctggtcaagcccttcgagctggacgagctcttcgcccgtatccgcgccctgctgcgccgcagctcgtacgcggcgacggcggtgggcgtgccggaggacgacgcgctgacgttcggcgatctgcggatggacctggcgacgcgcgaggtcacgcgcggcggccggtcggtggagctgatccgtacggagttcacgctcctggagatgttcctggcgcacccccgccaggtcctcacccgggagcagatcctgaaggcggtctggggcttcgacttcgagccgtcctccaactccctggacgtgtacgtcatgtacctgcgccgcaagacggaggcgggcggtgagccgcgcctcgtccacacggtacggggcgtggggtatgtgctgcggtcgggcggcgcggaa

SEQ ID NO: 4032 - DNA, 1482 bp, Streptomyces avermitilis
  CDS (1)..(1482)
atgaacagagcggtacgccgtttcagaaccctgccgatccgctcccggctggcgctgctggtggcggcggcggtggcgttcggagtggcggcggtctcggtcacctgctggttcatcgtgcaggggaagctgtacgacgagatcgacaccaacctcaaggcgcagaagggacccgtgtcgtacggatcggtcaagcgcgccggctacaactgcggccgggatccgaagagcagcgacgaaagcctccacggacgttccgagtactacacccaggtggtcaaggcagacggcaccgtctgcgccttcgacggctccgcgggcacggtgaaggtcaccagcagcgacatggccatggtcaagaacccgagctgggccggcggcgcgccccgaactggaaccgacagcgaaggcaaccccgtgcgggtgctgatcatgccgctcatcgtcaccgacggtccggtccccgtgccgactccggtagacaacaccgccgtcgtcgtggccgcccccctggagggcacccagtccaccctgaaggacctggccctcctcctgctcctcgtctccggcatcggagtcgtcggcgccggagccgccggcctggcggtggcccgcgccggcctcagccccgtcgacaagctcaccgacacggtggaacatgtcgcccgcacggaagacctctccgtccgcatcccggtcgaggaggacagcgaggacgaggtcgcccgcctctcccgctccttcaactcgatgacgtccgcgctcgccagctcccgcgagctgcaacagcagctcatcgccgacgcgggccacgaactccgtacgcccctgacgtcgttgcgcacgaacatcgaactcctcacccgcagcgaggagacgggacgcccgcttcccccggccgaccgcaaggccctcctggcgtcggtgaaggcgcagatgacggaactggcggcgctgatcggcgacttgcagacgctgtcccgctccgacgcgggtcatccggccgaccgcgtggaggtggtctcgctccaggacacggtcgaggcggccctgcgccgggcccggctgcgcggcccggagctgacgatcacggcggacctccagccctggtacgtacgggcggagcccagcgcgctggagcgggccatcgtgaacatcctggacaacgcggtgaagttcagcccggagggcggcacgatcgaggtcgcgctcgacaagggcgccctgaccgtccgcgaccacggccccggcatcgagaccgacgaactcccccacgtcttcgaccgcttctggcgctccccgtcggcccgcgcgctcccgggctcgggcctgggcctgtcgatcgtggcgcgcacggtgcagcagtcgggcggcgaggtgtccctgcggcgggcggagaacggcgggacggtggcgacggtccgcctgccgggcgcggcaacgccgccgccggatctggatccggacgacgccggaagccag

SEQ ID NO: 4033 - DNA, 213 bp, Streptomyces avermitilis
  CDS (1)..(213)
gtgcagatcatgaacggaacccccgacctcaccaccgctgtgtggcgtaagtcgtcctacagcgacgggggagactcgaactgcgtcgaggtcgccgacggctaccccggcctcgtccccgtccgcgacagcaaggccccgcagggccccgcgttggtcttcggggcggagccctgggccgcgttccttgcgatggccaagggtgaaggcagg

SEQ ID NO: 4034 - DNA, 831 bp, Streptomyces avermitilis
  CDS (1)..(831)
gtggacgaacttgttgacggggaacgggagtccgggcgtgccgcgctcgggcggacgctgcggttgctgcgggagaagtccggcaagacgctggggcagttggccggggagacgtcgtacgacaagagctatctgtaccgcttggagacgggggagcggctctccaagcgggcggtcatggaggacctggacaggtaccacgggtccggtgacctgctggttcgcttatggcgggacgcgcgcaaggacgtcatcaaggacaagtacaaggcgttcatggagctggaggcgacagcgcgggtcatgtggaagttccagctgcgggtgccgggcctgttgcagaccgaggactatgcccgtgtggtgttgtctgggttgtccagagcacagacaacggctggcaacggcgaggaggtcgaggaacaggtggccgcgcgcgtgggacggcaggagatgctccaccgccaaccggccccgagtgtccgcgtgatcctcgacgagggggcactgcggcgacgcgttcccaaggagaaggtgtgggcagaccagctggtacatctggttgacgtagccgaactggcgtcggtcacgcttcaggtgttgcccttcacggcaggcgtgcacgacctcatgaacagcgacctcacgctgatgtggcagcgggtcggcgagcccgttgcctacgtggagggcaatggctttggtgagctggtcgacgatccggacaaggtcctgtcctaccgtttgtcctacgatctcgtccgggatgcggcgttgactccggcggagtcgacgacgttcatcaagcgccttctggaggagtgcagatca

SEQ ID NO: 4035 - DNA, 294 bp, Streptomyces avermitilis
  CDS (1)..(294)
gtgaccagcgtggacggaacgtccgaacagcttcggctgctgccctggaccacccccgacggcaggccctgctacctcagcgccgccagtgaccacagccgtctgtccctgctcgccgacgacatggaggcggcccaactggactccgccgagcaggtgctggccggagcgaaggccgtgctcgccgaccccaaggccggcgaacgcgcggtgcgcttcgcgctcaccagggcgaccgagtccctcggggacaccctccgcatcgccgtcagccgaggcggacgcctccccggg

SEQ ID NO: 4036 - DNA, 1671 bp, Streptomyces avermitilis
  CDS (1)..(1671)
atggttgaggggactgagtccgcgacgggggccgcgtcggcgggggatctggtggaggggcggcatgccgctccgaaggccagggcgggcaagggcgggctggcccgttcgtcgttgctcatggcgctgggcacggtggtgtcgcgggcgaccgggctgatccggcaggtgctgcaagccgcggcgctgggcacgggcctgctggccagtacgtacaacacggcgaacacggtgccgaccagtctctacaccctgctgatcggcggcgcgctcaacgccgtgctcgtgccgcagctggtgcgggcccgcgcgacccagccggacggcggacgggcctacgagcagcgcctggtgacgctcgtcctgtgcgtcctgggcgtggggacggcgctggcggtgtgggccgccccgggcatcgtggccctgtacatgcgggacaccccggacagccatgaggcgttcgagctgaccgtggtcttcgcccggttcctgctgccgcagatcttcttctacggggtgttcagcatcctcggccaagtcctcaacgcccgcgagaagttcggcgcgatgatgtggacgccggtgctgaacaacgtcgtgctgataggcatgttcggcgcgtacttgagcctgatgacggtcccggaccgggtggaggacatcaccggacagcaggtgcgcttcctcggagtgtgcaccaccgccgggatcgcgctccaggccctcgcgctgattcccttcgtgcgggcggccggcttccggttccggccgcggttcgactggcgcggcacgggtctcggcaagagcgtccacgccgcgaagtggaccctgctcctcgtgctggccaaccaggtcgccctgaccgtggtcaccaactacgccaacgccgtcgaccaggaactcccgaaggccggcgccggatacacggcctacacgtacgcgcagacgatctggatgctgccgcagtccatcgtcaccgtctccctggtgaccgcgctgctgccacgcatgagccgggccgtcgcggaggaccgcctgccggatctgcgcgccgatctctcccgggtgctgcggatcagcggcgtggtcatcgtgcccgccggattcctcttcctcgcgctgggcccggggatcgcgaccctgctcttcgcccacggcgcggcggacgccgcctccgcgcagccgctcggacacatgctccaggcgttcggcctcggcctgatcccgttctccgcccagtacctcctgctgcgcggcttctacgccttcgaggacacccggacgcccttcttcatggccgtctggatcgccgtggtgaacatcgcgctggccaccgcctgccatctgctgctccccgcccgctgggcggtgaccggcatggcggccgggtacaccctgtcgtacctggccggactccttctcaccgccaggctgctgcggaagcggctcggcggccgccgcctcgacgacggggagctgcggcgcacgtacggaaaattgctgtgcgcgtccgccgtcgccgcgggcgcgggctgggcggcggcccgggccaccgccaccacgacaccgaccgcgctcgccctcgccgcgggagcggtgacgatggccctggtctacgtcgccctcgcccggctgttgaaggtcagcgagctacggctgcccgggcggggc

SEQ ID NO: 4037 - DNA, 1803 bp, Streptomyces avermitilis
  CDS (1)..(1803)
atgcgcgaggtcaaagaggcgttcgcgcgcttctggccgctgacgcgcggcgaccgcaagtggctggcgctcatcatcgggtgcgtgatcgtgtccgcgctcgccgagaccgcgtcgatcctgctcttcgccgagctcaccgaccacgccctgaaggccggttcgctctccgccttctggggtcccgccgtggcctggctgggcgccgccgccctcggcgcgttcgtcggctacctcggcaactcgctcgccacctggaccgccgagcgcttcgtcctgcggctgcgcgcgaacgtcttccggcacgtccaggacctgccgccggacttcttccagaagcaccgccagggcgacctggtggagcggctgacgggtgacgtggaggccatcgaacagctggtcgtatcgggggtggtcggcaccttctccgccgccttctccgccgtcttctacgcggccgccgcgctctggctgcgctgggacctggccctcgtcaccttcctgctcgcccctctcttcctcgtcaccgcacgccgcttcgccggccgtatcaaggagtccgcgcaggacgagcgggccgccgacggcgcgatcacctcggtcgtcgaggagtccctcggcaacatcgtcctcacccaggcgtacaaccgccgcggcgccgaggagaagcggctcgaccgcgaggcacgtgcctggatgcgggcgtccgtgcgcggggcgcgggcgagcgagatgtacgagcaggtcgtcgaggtcgtcgagacgctgtgcgtgctcgcggtgatcggcctgggcgcctgggagatctcccagggccgtatgacgctgggccagttgctggccttcgccgccttcctcggctatctctacccgccgatccgcaacctcggtcagctcggcctgaccctgaccgccgccaccgcgggcgcggcccgcctccaggagatcctcgatgcgaagccggcggtgaccgatcccgccgcaccggtcgccccgtggcccgtacgcggctgggtcagcttccacggcgcgtccttccgctacccgggctctggccgcgagtccctgcacgacgtgacgttcacggcgggccccggcgaactcgtcctggtcacgggcccgagcggcgccggaaagtcgacgctgtcgaagctgctgacccgcttctacgatccgacggcgggcgcgatctgcctggacggcgtcccgctgtcggacgtacccctggagttcctgcgcgagaacgtggccctgctgccccaggagaccctgatcctgcacggcacgatccgcgagaacatcgagtgcggccgcccgggcgccacggacacggagatcgagagcgcggcccgggacgcggcggcgcacgacttcatcgccgccctgcccgacggatacgacacggagatcgcccccggcacggcggccctgtccggtggccagctccagcggatcgcgatcgcccgcgcgatgctccgcccggccccggtgctggtcctcgacgagccgacggcaggcctcgacgcgctcgccgcgcgccgcgtggtgctgccgctgcggcggctcatgtccggccgtacgaccatcatgatcacgcacgacctgagcctggccccggacgcggacagcatcctcgtggtggacggcggccgcctggtcgagacgggcacgcacacggaactcatcgcccggggcggggcatacgcgaggctggcggcgccgctgccggaaacggtgacggagaccgtgtcagtggcggagaccatgtccgtgcccggcgaggacaccctgatgctccgcctc

SEQ ID NO: 4038 - DNA, 171 bp, Streptomyces avermitilis
  CDS (1)..(171)
gtggccccgcctcgtggcggacgtcagccctgcttgccgaccgggcggcgcctcggcgcggccttcttcggcgcgtgcttcttgggggcggccttcttcggggccggcttctcgttcttcttgatgggggtgatcttgtggaagctcatgggaatgcctctttccgcgaat

SEQ ID NO: 4039 - DNA, 132 bp, Streptomyces avermitilis
  CDS (1)..(132)
atgagcttccacaaggtcgccccggtcaagaagccccgcaaggccgctcccgccgcccccgcccccaagaaggcgcagcacaagccggccaggcgtcaggtccgccgcccggtcggcaacaagagccaggat

SEQ ID NO: 4040 - DNA, 1077 bp, Streptomyces avermitilis
  CDS (1)..(1077)
gtggaggactgggctccgcccaaccaccggcgccgcggcgcccggcgccgccgacgtcgcttcgccgggctgccgctcgcgatgaaggcggtggtcggagtccttgttctcgccgccttcctcaccctcgccgaccgctgggcactgctctacgccgagcagcgggcggccggagcgctccaggaccggctcggtctgagcgcggcgcccgaggtcgagatcgacggctttcccttcctcacccaactcggcgacagccgactggactcggtgaagctgaccgtgccggacgtggcggccgaccgggtctcgctggcgaaggtgtcggcgaccgcgacgggcgtacgcatcaacggcggcccgacgtccccgcgcggcgcccgcatacccgagctgcacggcgaggtgctgctcgccttcgacgacctcgaccgggaactcggcgcgtcccaggtgaggttcaggggcgagggccgcgaccgggtgctggcgcgcggcacgctgccggtggcgggccacgacctgcggctgagggcgcaggcccggatcgagcgggacggcgcgcgcggcatcgcgacgcggatcggcggtatgcgcctggacatcggggacgtggccacctaccggccgggcacccgcccctccgagggcctgcatctgagccggcggtcggcggcccggctcgcccacgagacggcgaaggcgaaggcgctgctgtcggtcccgtcgatcgtgcgtgccctgcgggtccccgacgcggcggtccgcgcggccctgagcgacgacacgaagctcgccgagctcaccggctcggaccgcttcgcgcgccaggcgatgggcctgaacctgatcgacgtggcggcggcccacccggagctgctgaagcgcttcggtcttgaccccgcgctcctcgacggcctgtcccggctcacccgcccggtcctcgtcgaccgtctctccttcggtttccgtctcccgcagccggagcacggggacctgtggctgcgggacgtacgcgtgatgaaggacggcatccgggtgcggctcgtggggtcgggactgcgcgtcggcaagtcc

SEQ ID NO: 4041 - DNA, 1809 bp, Streptomyces avermitilis
  CDS (1)..(1809)
atgccgccgacgtaccggcacagacgtatccaccgcatcctctccaccgccgcggggctcgccaccgtcggcgcgctggtcgccgcgctgcccgcgagcgccggcggcggcaggcccggcggccacgggcacggccttcccggccgctaccaggacgtacagctgctgtccttcaacgacctgcacggcaacctggagccgccggccggttcttcggggcgggtcacggagcttcaggcggacgggacgagcaagaccgtcgacgcgggcggtgtcgagtacctcgccacgcatctgcgtgaggcccgcaagggcaagaagtactcgatcacggcaggcgcgggcgacatggtcggcgcgtccccgctgatctccggcctcttccacgacgagccgacgatcgccgcgctgaacaagctcgacctggacgtgacgagcgtcggcaaccacgagttcgacgagggcgccaaggaactggcccgcctccagaacggcggctgtcacccgaaggacggctgttacgacgacgacagcgagaagttccggggcgccgacttcccctacctcgccgcgaacgtcaccgacgagaagaccggcaagccgctcctcaagccctactgggtgtggaagaagaacggcgtcaaggtcggcttcatcggcgtgaccctcgaaggcaccccgaacatcgtctccgccgacggcgtcaagggcctcaagttcggcgacgaggtcgagacgatcaacaagtacgccaaggtgctccagaagcagggcgtgaagtcgatcgtcgcactgatccacgagggcggcgcgcccgcgtcgacggcgtacaactacgactgcgacagcccgggcgccggcgacggcatctccggcccgatcgtcgacatcgccaagaacgtgaccccggcggtggacgcgctggtcaccggccacacccaccaggcgtacgcgtgcacgatcaacgacccggcgggcaagccgcgcatggtcacctcggcgtcctccttcggccgcctctacacggacacgaccctgacgtacgaccggcggaccggcgacatcgcgcgtacggcggtgaaggccacgaagtcggtgaaccgcgtcgtcacccgtgacgtgacgaaggccgccgacatgacggccctcatcaccaagtggaagacgctctccgcgccgatcgcctcccggcccctcggctacatcgcgggcgagatcggcaacacgggtgccgagtccccgctcggggacctgatcgcggacgcgcagctcgcgtacgccaggtccgtcgaccccgaggccgacgtggccctgatgaacccgggcggcatccgcgccccgctcacctacgcggcgagcggcggcgagggcgacggggtggtgacgtacggcgaggcgtacacggtccagccgttcgccaacaccgtgaacctggtgaacctgaccggcgcacagctggtcaccgcgctccagcagcaggtgagcgggtccaacgaggccgcgccgaagatcctccagatctccggcgggctgacgtacaccctggatctcaccaaggcgggcgccgcgcgcgtggtcaccgactccgtcaagctgaacggctcggcgatcgacccggccgcctcctaccgcgtcgcgatgaactccttcctcgcgggcggcggcgacggcttcgcggagctcggcaagggcacgaacgtcgtcgtcggcggtgacgacctggccgcgctcgaggcgtacctgacggccaactcctcggccgggacgccttatccggtgccggcggcgaaccggatcacggtcgtgaag

SEQ ID NO: 4042 - DNA, 924 bp, Streptomyces avermitilis
  CDS (1)..(924)
atgaccagcgacgacaccgtatggccgggcgccggccgttccatcgagacccttgccgcgctctcccccgggcaggccgaagccgtgctcgcgctcctcgacgaggccgcgcgggtcgacgggcagccggcggtgtccgagcaggggcggctacagctgcgcggcggcgagcgggagggcgtacggcatctgctgctgagcgcgggcgacacgctcgtcgggtacgcgcagctggaggacaccgacccggtggaggccccggccgccgagctggtcgtgcaccccgcgcaccgcgggcgcggacacgggcgggcgctgggtacggcgctgctggccgcgaccggcaagcggctgcgggcgtgggcgcacggcggacactcggccgcccggcacctggcgcaggtgctcgggctgaccctcttccgtgaactgcgccagatgcggcggccgttggccgggctcgacctggccgagccgaagctgccggacggtgtcaccgtgcgcgccttcgtgccgggccaggacgacgcggcctggctcgcggtgaacgcggcggccttcgcgcaccaccccgagcagggctccctcacccagcgcgacctcgacgaccgcaaggcggagccgtggttcgacccggccggcttcttcctggccgagcgcgacggcgagctgatcggcttccactggacgaaggtgcacgcgcaggagggcatcggcgaggtgtacgtgctcggcgtccgccccggcgcccagggcggcggcctcggcaaggccctgacgacgatcggactacgccatctggaggcacagggactgccgaccgcgatgctgtacgtcgacgcggacaacaaggcggcggtgagcgtgtacgagcgactgggcttcgccacgcacgagacggacctgatgtaccgaacggagtcg

SEQ ID NO: 4043 - DNA, 576 bp, Streptomyces avermitilis
  CDS (1)..(576)
gtgcgctcggcctggtgttcgccgggctgccgcggctgtggccctgggagagccttcccccgctgcgggccggcgccctgtgcctcgccctcgggctcgccttcctgctcgacgacccggcccggcacaccaccgccgcggtgccgacccggcggccggtacgcaccgggctgcgcctggcagctcgtcgcgccggtcgccgcgctgtggtggacggccgtactgctcctcgccccggggcggcccccggccgggccggtgaccctggaggcggccgcgctggcggcgctcgccctggccggcgcggccgccgccgtgcgctggtcggacacggcggagccgggcgcggccacggcggcctggctgctgttcgccgcctgtgccgggttgttgctgcttcccgggcgctggtcgctgtacgtcggcccggccgacccgcggtggcaggccgcgcatgtgcggtgggcggcgctcctcgccgtcggggtgctggtctgggccgcgtccgggccggaacccctgcgggcacgacggctgacctccggtacgcgccgccgtccgccgcgctccgggaag

SEQ ID NO: 4044 - DNA, 1569 bp, Streptomyces avermitilis
  CDS (1)..(1569)
atgagcacgagcacgaccccgagcgccctcagggacgcggacacggagggggccgcccccgccatggacgaaccggtacggcccgacgggcgccccgcggccgccgtcctcgccctcgcccgcttcgaggcgcgcgaactgctccatcacataccggtgttcgtgttcctgcccctgtacttcggcttcaccggctggcagctgttcgccggcgacgcggcgggcgactacccgatcctccaggacgtcgaccgcggtacccagtccgggccgctgttcctcgccatcgccctgctcgcctgcgtcaaccggaccgtactgcgctcccggcggaacggcaccgacggccacttcgacgtgctggtgatggagccgtggcggcgcaccctcgcgcacgccctgtccgtcgtcccgtacgccgtcgtcaccgcgctggtcgtcgccttcgagttcagctgggcggcactgaagccgggcgcggtcggacacgggtcggtggccgaactggccgtgggaccgctcatggtgctgctgaccgggatcctcggggtgctgctcgcccggctgatcccctactccctggccgtcccgctgctcgtggtcggtgccttcttcttcgccgtcctcgtggccgcgggcacgaacgacgggcactggcagaagtggctgtggccgaccgtctccgagaccggcgcccctccgctgccctccgatctgctgggccgcccggccgcctggcacgcgctgtatctggtgggtctcgcgggtctgctgctgggtgccgcggtgctgctgagcggcggacgggcccgcagggtgaaggcgctgaccgccctcgcgctcgccgtcacggtcgcgggtgccgccgggcagtccccgggcgactcggcggccctggccaaggcccgtacgacggcgtcccgtacgccggagaaggtccagtcgtgtgccccgctcggccggtcgacgtactgcgccttccccgagtggagcggccaacgtgccgactgggccgaggtggtggagcgcgtccagtccctcgcgggcggggccgccgggggcgagcggctgaccgtacggcagcgggtcgcggacatctccgatctgaccagcgacgccgcgatcgaccccgtccggacgccgcggcaggtcaccgtcggcaccgagtggggtggcaaccagcgtctgaagttcgcggtcgccgtcgcctcggtgctggtggcgggcaacgagaacgcgaccgtcgagatgtgcgacgcacgggtggtgaccatcatgtggctggctttgggcacggagtccgacccggtctacgcgctgggcgacgtccgcctcgacgactccgtcgagggctccgccctggccctgaccccgacggacgggctgtccatgacgcgcggacagaccacggtcgtacgggagttgttcgagcgcccgcgctacggcgtcacggcccgggtgaagacgcactggacggagctgacgtcctcgaagacgtcgctcacgagggcggccgagctgctgggggtggcggcgcccaaggcgaccggggacgagtgtgcggacgag

SEQ ID NO: 4045 - DNA, 864 bp, Streptomyces avermitilis
  CDS (1)..(864)
gtgaccagcgcacccacggtttcgggctgcggcctgaccctccgctacggcggtaccgccgccctcgacgacgtgaccgtccgcctccacccgggtgtcaccgggctgctcgggcccaacggggccggaaagaccaccctgttgcgggtcctggccaccgccgtgcccgccgaccggggtgccttcaccgtgctcggccacgacccgggcaccgcggccggacggcaggaagtccgccgggagctcggctatctgccgcagacccccggcttccacccggacttcaccgccttcgagttcgtcgactacgtggcgatcctcaaggagctgaccgagcgcggcacccggcaccgggaggtgcggcgcgtgctcgacgccgtcgacctgtcggacgtacgcggcaagcgcatcaagcggctgtccggcggcatgcggcagcgcgtcgccctggccgccgcgctggtcggcgaccccggcttcctcgtcctcgacgaaccgaccgtcggcctcgaccccgaacagcgcatgcgcttccgggagctgatcgcccaggcgggcgagggccggaccgtgctgctgtccacccaccagaccgaggacgtcgcgatgctctgccaccaggtgatcgtcatggcccggggccgcgtccgcttcgagggcaccccggccgagctgaccgcacgggcggcgggccatgtgtggagcagcacggagcgcgatccgggggcgcgggccggctggcgcacgggcacggggtcgttccgcaacgtcggcgacccgcccgagggcgcccggcttctcgaccccaccctggaggacggctacctgctcgccctcgacggcgagccggcggaggtggcggca

SEQ ID NO: 4046 - DNA, 204 bp, Streptomyces avermitilis
  CDS (1)..(204)
atgcccggcccgcgcggtctccttcgcggatggcgaccacgggcggccagggcggcccggctgaccgccgcggcggtcctcaccggtgccgcggcggccctcctggtcctggacgcggtgctccgcgtcctcggcccggtcgcccggatcggcctcggcggcacccgctcgcaccagaccttcggggacgacgggggcgactca

SEQ ID NO: 4047 - DNA, 855 bp, Streptomyces avermitilis
  CDS (1)..(855)
atgagggatacgacctggcatgtgccggaggacgacctccgggcttacgtacagggcgagttggcaccgccccggctctggtccgccgacacccacctcgccgcgtgcgagcggtgccgggcggcgctggccgaggccggcgacccggtcgcgctggacgccgcgtgggagcggctcgacgccgagctggacgcgccccggcccggaatgttcgagtcgctgctggtacgggcgggcgtggccgaccacaccgcgcggctgctgacggccacgcccgtgctgcgccgctcctggctgggcgcggtcgcgttcctgctggtcatgacggtgggcatcgtgctcaccgtggactctccggccctgttcctcgcactcgcgccgctgctcccgctcgccggggtcgcgctgtcgtacggccccgtgctcgacccgacgtacgagatggccgtggtcgcgccgctgcacggattccggctgctgctgatccgcacgctcgcggtgctggccaccggcctcctcctgaacgggctcgccacgctcgcgctgcccggctacggactgcgcgccctggcctggctgctgcccgcgctcgccctcaccggcaccgggctcgcgctgaccccccggctcgggccggttctcgcgcccgccctgaccggcggggcgtggatcgggctgctgctggtcgcgcaggcgaggacccacgagacgctcgcgccgttcaccatggcgggccagggagccgcggccgtggtcgcggcgctggccgccgggctgctgtaccggacccgggaccgtttcgactccgtcgccgcgcgcctgccgttcgcgcacctgccgggcgggggtgcggtg

SEQ ID NO: 4048 - DNA, 537 bp, Streptomyces avermitilis
  CDS (1)..(537)
gtgagggagacgagaagcgacggggaactgctgcgggccgcggcggacggggaccggcgcgccttcgaggagctgtaccggcggtacgcgccctggctgaccgcccggctgcgcggacgctgcgccgacgcgggcctcgtggacgacgtcgttcaggagacgttcctcgcggtgtggcgcggcacggcccgctaccgcgaggacggggacgtggccggctggctgtggcgcgtcggctcgcggcggctcatcgacgcgctgcgcggcgacggggcgcgcggacggctgcggcaggcgctggcgcggctgcggcaccgagacgaggcgtccgcggaggaacgcgtgctcgcgggggtggagcacggggacctcgcgggcgccctcgtccggctctcgccggagctgcgggcggtgctccaggccacggtgatcgacggtctcaccaccagggaagcggccgtcctgctcggcattccgcccggcacggtcaagacacgggccctgcgggcccggaagcagctgcgggaggcgctggca

SEQ ID NO: 4049 - DNA, 396 bp, Streptomyces avermitilis
  CDS (1)..(396)
gtggttgaacgggtggtcgagtaccgcatcgaccggcgctccggcgtcgccacctacgtccagatcgtccagcagaccaagcaggccctgcgcctgggcctgctcgaacccggcgacaagctgcccacggcccgcgaggtcgtggaggccaccgccatcaatccgaacaccgtcctcaaggcctaccgcgagctggagcgcgagggcctggtggaggcacgccgcggcctcggcaccttcgtccgccggacgctgggcgccgccccggccgactcgccgctgcgcaccgaactcgacgcctgggcgcagcgcgcccgtacggcgggcctcgaccgcgaggacgtcgccgcactcctcggctccgtactcgacgaacacttcccgaagggggaccag

SEQ ID NO: 4050 - DNA, 915 bp, Streptomyces avermitilis
  CDS (1)..(915)
gtgagttccacccgcaccaccgcggacgtcgccctggaggcgtaccggctcggcaagcggtacggcaggcgcccgtccgcggccctggacgactgctccttccgcctcccggccggccgcgtcagcgcactggtgggccccaacggggccgggaagtcgaccctgctggcgctggcggccggactgctgcggcccacctcgggcacgctcaccgtcctcggcggggctcccggcgaagcccgcgaccgcgtcgcctacctctcccaggacaagccgctgcacccccagctcaccatcgccgagaccctgcgcctgggcgccgagctcaacccgggccgctgggacgccgcccacgccgcctcgctggtcgaacagggctcgctcgaccccgcgacgaagatccgccggctctccggcggccagcgcacccgcgtcgccctcgccctcgcgctcggcaagcggcccgacctgatgctgctcgacgagccgatggccgacctcgacccgctcgcccggcacgagatgatgggcacgctgatggcggacgccgccgagcgcggcacgacggtgctgatgtcctcgcacatcgtcgccgaactcaccgacgcctgcgaccacctgctgctcctgggcgacggccgcatccggctcggcggcggcatcgacgacctgctcaccgcgcactccctggtgaccggccgcggaacgcccgccgacctcgccccgcacacggtcgtcgagtcccgggccagcggccgcggcctgaccgcgctgatccgccgcgacggacccgtcgacagcggctgggaggtccaggaaccgtccctggaggaactgctcctcgcccacctgcgcgccccgggcgccccggccctgatcactccgggcacggccgtctccgtggaggtgaccgca

SEQ ID NO: 4051 - DNA, 939 bp, Streptomyces avermitilis
  CDS (1)..(939)
atgagcgccaccaccctcgccacgccccggcgccgcacgctccccggcccccgcggcctggtctggaccgtcctgcgcctgcaccgcaccgcactgtggatctggctcgccttcgtgaccggcaccgcgggactgctgctctggctgtacggaccgggggcgacggcggcccagcaggcgttcgacacgtacgggtactacgtgccgggcggcctgaactcgacgaaggaggcgtacgacgacctcttctaccggcccgccaccctgatcagtgtcgccaccttcgtcgtcccgctgttcgcgggcggcgcgctcatcggccgcgagctggagaccggcaccgcgcagctcgcctggacgcagtcggtgagcccggcgcgctggctggccgcgcggctcgccgtgcccgcgctcctcatcgccaccggcaccggcctgctcgtggccctctaccggctcctgtggtccgcccacaacggcctgctggtggccggctacgccccccgtgagctctacttcgccatcggcccggcgaccgtcgtgcaccccctgctcggcctggccctcggcgcgctcatcggcctgctggtgcgccgcgcgctgccggcgatcgcggtcgccgccggcacccagtacgtgctcaccgcactccacaaccggctctggcccttccagcacaacacgccctacagcccgcccgcggaactctccgtgcacagcggcgcgttcacctcgggcggcgccctgatccccgacccgggctgctacgacagcaagcggtgcctcgccgaacaccatgtcgtgggcttcacccgcgactacctcccgtcccccgagtactggccccgccagctcctggaaacgggccttctgctggccgccacggcggtcgtcgtcgcggtggcgttccgcgtcctgaacaggagcgtgaccacccca

SEQ ID NO: 4052 - DNA, 951 bp, Streptomyces avermitilis
  CDS (1)..(951)
gtgcggggcctgtcatggacggtcctgcgtctgcaccgctcggcggtggtcctgtggggcggcgcgctgctcgccgccaccgtggccctcatctggatgtacgccatcggggacgacgcccgcgcgggcatcggcgcctgcgccacgcccgccaccggccaactgccgccctgctcggcggtccacgcgatcaccgccgacggcatctatgccgacaccctcgcgtcggtcggcaccgccgtgtcgtacctgatgttcccggtcgccgcctgggcgggcggcgcgctgaccggccgcgagctggagaccggcaccgcccatctggactggacccagtccgtcacaccggcgcgctggctcgccgcccggctcaccgtcccggcggcgctgctcgcgagcggcaccgccgcggcggtcctgctcaacgtctgggcccgccaggacggcaacccggacctcgtcggcgactggtactacgcggacgtcttcgtctccaccggcccggccgccgtcgcccacgtcctcgcgggcctcgccctgggcgcgctcgccgggctgctcaccaaaaagacgctgcctgccatcggcctggccctcgcggcgacgctcgtgctccacaacgcgctggactggtaccggacgagcctgtggccgaccgtcacgaccaccggacgggcggccctcgacctcccgcgcagcgcgctggacctcgaacacggggtcatcaccaccaccggcgaacgcatcggcaacaacacggcctgcgtcggctccgacagcctcgccgacgtccagaggtgcaagtcctccagcaatctgaccgacttctgggccacgtaccacccgcggtcccacttctggcccctccagttcatggagaccggcctcctcctcgccctcgccgccgcggccaccgccaccgccttctggctcctgcgccgccgcacggca

SEQ ID NO: 4053 - DNA, 2352 bp, Streptomyces avermitilis
  CDS (1)..(2352)
gtgcccgagccctcgccgcctccggtgaacggggagagcaagcgaaccggccgccaggtcgtcgcgctcccgcccgctcgctctgacgcgcccttcccccgcccggcgcggaagaatggggccatgagccagccaaatgtccaggcacaggtccagcacccgcagccctccgtggggtccatcgccgcgcaccgcccgcacaccgtggccgccgcggtctccgacctggagcccgacctcgatgccgacctcgacgcgtacgaggacaccgacgccgacggcgtccagctcccgcagggccgcttcctcgaccgggagcgcagctggctcgcgttcaacgagcgcgtcctcgagctcgccgaggacccgaacacgcccctcctcgagcgggcgaacttcctggcgatcttcgccagcaacctcgacgagttcttcatggtgcgggtggcgggactgaagcgccgcatcgccaccggcgtcgccacccgctccgcctccggtctccagccccgcgaggtcctggagatgatctgggcccgctcccgcgagctgatggcccggcacgccgcctgctaccaggaggacgtcgcccccgcgctggcggaggagggcatccacctggtccgctggaacgagctgacggagaaggagcaggcccgcctgttcaccctgttccggcaccagatcttcccggtgctgacccccctcgccgtcgaccccgcgcaccccttcccgtacatctcgggcctgtccctgaacctcgccgtggtcgtgcgcaacccggtcagcggccaccgccacttcgcccgcgtgaaggtcccgccgctgctctcccgcttcctggaggcgtcccccgaccgctacgtccccatcgaggacgtcatcgcggcgcacctggaagagctgttcccgggcatggaggtcctggagcaccacaccttccgcctcacccgcaacgaggacctcgaggtcgaggaggacgacaccgagaacctgctccaggccctggagaaggagctcatgcgccgccgcttcgggccgccggtgcgcctggaggtcgaggagtccatcgaccggcacgtcctcgatctcctcgtacgggagctgaaggtctccgaggcggaggtctaccccctgcccggccccctggacctcaccggcctcttcggcatcggcgccctcgaccggcccgagctgaagtaccccaagttcatcgcgggcacccaccgcgacctcgccgaagtcgagtcggcgtccgcgccggacatcttcgccgccctgcgcgagcgcgacgtcctgctccaccacccgtacgacagcttctccacctccgtccaggccttcctggagcaggcggcgggcgaccccgacgtcctcgccatcaagcagaccctgtaccggacctcgggcgactcgccgatagtcgacgcgctgatcgaggccgccgaggcgggcaagcaggtcctcgtactggtcgagatcaaggcccgcttcgacgagcaggccaacatcaagtgggcgcggaagctggaggagtccggctgccacgtcgtatacggcctcgtcggcctgaagacccactgcaagctgtcgctggtggtccggcaggagggcgagaccctgcggcgctactgccacgtcggcacgggcaactaccaccccaagaccgcccggctgtacgaggacctgggcctgctcaccgccgacccgcaggtcggcgcggacctctccgacctcttcaaccggctgtcgggctactcacgccgcgagacctaccgccgtctcctcgtcgcccccaagtccctgcgcgacggcctggtctcacggatcaacaaggagatccagcaccaccaggccggacggcccgcgttcgtccgcatcaaggtcaactcgatggtggacgaggccatcatcgacgccctctaccgcgcgtcccaggccggcgtcccggtcgacgtgtgggtgcgcggcatctgcgcggtgcgccccggcgtcacgggcatgtccgaaaacatacgggtgcgctccatcctcggccgcttcctcgaacactcgcgggtcttcacgttcggcaacggcggcgagcccgaggtgtggatcggcagcgccgacatgatgcaccgcaacctcgaccgccgcatcgaggccctcgtcagggtcaccgaccccgcccaccgggccgccctcaaccggctcctggaaaccgggatgtccgacaccaccgcctcctggcatctgggcccggacggcgagtggacacggcacgcgaccgatgccgagggccagcccctgcggaacgtccaggagatgctcatagacgcccggaggcgccggcgtggcacagcgacacct

SEQ ID NO: 4054 - DNA, 1080 bp, Streptomyces avermitilis
  CDS (1)..(1080)
gtggcacagcgacaccttgacccccccaccgaccccacggccgggcccgcccccaccggagacgccctcgcgggctacctgcgggcccaggccacggagttcctccgctcactgcgccagcaccgggagaccggcgcggtgagcggctcggaggactccgtcgacgcggcgcgcgccctgcgccgctcggcccgccgcatcagcggcacgctccacacgttccgcccgctgctggacacggactggtcggaggccatgcgccccgaactcgcctggctgtcgggcaccttggcccgggagcacgcgtacgcggcccggctggagcggctgctgctggccctgcaccgcctgtcgggctcggcggcgttccccacgccatcggccggccccgccccgcgcgcccagacctccccggaccgcggcaacctgacggtgggcgcggccaaggcgggcgccctgctggaccgccagctcaccctcgcccgcacccgggcccactccgccgccctccaggccctcggctcctcccgcttccacgcggtcgccgacagcgtcgccgtactggccagcgaggtcccgctcacccccgccgcggccaccgccgacccgcgcccgttcgccgcggcggccgacgagcgcctgtgcgacgccgtgagcgccctgcccctggtcaccgcgggccacccctacaacgcggaggccctgatccacggcctctcccccgacaccgccccgcatccccaggacgccccctggcaccaggtccggctgctgctgcgcctgcaccgctacgcccgcgaggccctgtacggggaggaggacaccgccctgcccgagcggggccgggagctcgggggagcccgcgtcgacgtccggctgaggtccgcgggccaggccctgaaccggcaccgggacgcggcggaggccgcggcggccgcctcctcggcggcccgtaccccgcgcatcgccccggcgacggcgtacgccctcggcgtcctgcacgccgaccagcgccacgaggtggaggccgcccgcttcgccttccagcagtcctggcagaaggaggcggtgggcacgcca

SEQ ID NO: 4055 - DNA, 411 bp, Streptomyces avermitilis
  CDS (1)..(411)
gtgaccgacgacatcatccgcgcggccggctgcgttctgtggcgccgctcgcccgtcgacggcaagctggagatctgcctggtccaccggccgaagtacgacgactggtcccaccccaaggggaaactcaaacgcggcgaggacccgctgtccggcgcggtgcgcgaggtggcggaggagacgggccgcacctgcacccccggcgctcgcctgcccaccctccggtatcaggtgaacggccgcctcaaagaggtcggctactgggcggccgaggccggcgcgggcaccttcacctccaaccgcgagatcgaccgcatcctctggctctcccccaccgcggcccgccatcgactcacccggccgagggaccgcgatctggtggacgccctgctcagcgcgctgcacctggcc

SEQ ID NO: 4056 - DNA, 1104 bp, Streptomyces avermitilis
  CDS (1)..(1104)
atgaaccggcgggccctcaccctcggtgctctcgccgtctccggcgccctggccctcacggcgtgcggctctgacgacaccggcaagagcaacaccgacgccacgacgtcgtccaacagcgccatcaagtgcgacaacgccaagggccagctccaggcctccggctcgtccgcgcagaagaacgcgatcgacgcgtgggtcaaggcgtacaccgcgagctgcaagggcgtgcagatcaactacaacccgacgggttcgggtgccggtgtcaccgcgttcacccagggccagacggcgttcgccggttcggactcgccgctgaagcccgaagaggtcacggcctccaagaaggcctgcggcggcagccaggccatcgacctgccgatggtcggcggcccgatcgcgatcggcttccacctgtccggcgtggacagcctgaccctggacgccgccaccctcgccaagatcttcgacggcaagatcacgaagtgggacgacgaggcgatcgcgaagctgaacccgagcgccaagctccccagcaccaagatccaggcgttccaccgctcggacgagtccggcaccacggacaacttcaccaagtacctgaaggccgtcgccccctccgactggaagtactccggcggcaaggcctggcaggccaagggcggccagtccgcgcagggctcctccggcctggcccagcaggtgaagcagaccgagggcgcgatctcgtacttcgagctctcgtacgccgccgacggcatcagcaccgtcgacctgaagacgggcgccgccaccccggtgaaggccagcgtcgagaacgccaccaaggccatctcgaccgccaaggtcgccggcaccggcaaggacctgtcgctgtccctgaactacaagccgaccgaggagggcgcctacccgctcaccctggtcacctacgagatcgtctgcgagaagggcaacaaggcggacaccctgcccgccaccaagtccttcctcacctacatcgcgagcgaggacggtcagaagctgctgaccgacgccaagtacgcgccgatccccgacgagatcatctccaaggtccgcacgaccatctcgagcctgagc

SEQ ID NO: 4057 - DNA, 1005 bp, Streptomyces avermitilis
  CDS (1)..(1005)
atggacatatcgacacagaacaccgaagcacctccccccgcccctgggcctcccgtggccgctccgacgagcgcgagccgcggcgccacccgccccggagaccggatcttcctcggtctctcgcgcggctccggcatcttccttctggtgatcatggccgccatcgcggccttcctcacctatcgcgccgccaacgcgatcagcaaggaccacaccaacttcctcaccacgttcgagtggaacaccaacctcgaaccggcgtccttcggcatcgcggtcctggccttcggcacggtggtctccgcgatcatcgccatggccctcgcggtcccggtctcggtcggcatcgccctgttcatcacgcactacgcgccgcgccggctcggcggccccatagcgttcgtggtcgacctgctcgccgccgtcccgtccatcgtgtacggcctctggggcgccctcgtcctggtgccgcacatggacggcctcttcggctggctcgaccactacttcggctggaccggcgtcttcgagtggcagggcggcgcgccccgctcgatgctcaccgtcggcgtcctgctcgcgatcatgatcctgccgatcatcaccaacgtgagccgtgaggtcttccgccaggtcccgcggatgcacgaggaggccgcgctggccctcggcgccacgcgctgggaggtcatccgcatgtcggtgctgcccttcggccgctccggcgtgatctccgcctcgatgctgggcctcggccgcgcgctcggcgagacgatggccgtcgccacggtcctctccccgaccttcgagatcaacgccagcctgctcgacccgggcggcggcacgttcgcccagaacatcgcgagcaagttcagcgaggccaccccgctcggccaggacgcactgatcgcctccggtctcgtcctgttcgtcatcaccctgctggtcaacggcgcggcgcgcatgatcatcaaccgccgcaaggagtactcgggggccaacgca

SEQ ID NO: 4058 - DNA, 1059 bp, Streptomyces avermitilis
  CDS (1)..(1059)
atgagcaacgcagccgtcaccgacaagcgcccgagcaccctgcgcggtgccagcctgccgaagtggtcgccgtgggcgatcgccgcgggctccgtcgccctcgccgtggtcatcggcgtgctgggcggcctcggcagcaaggtccagtggggtctgatcgccgcactgctcttcgtcctgggtacgtacgccgtcgccgccaaggtcgagggccgccgccaggccaaggaccgggtcgccaccagcctcgtctgggtctgcttcctgatcgccgtcgtcccgctggcctccctgatctgggagaccgtcaagcgcggcgtgaaggtcttcgacgtctacttcctgacccactccatgggtgtggtcgccgacaccgagaccggcggcggtatctaccacgcgatcatcggcaccctggagcaggtcggcatcgccaccctgatcgccgtgccgatcggtgtgctcaccgcgatctacctggtcgagtacgggcggggcaggctcgccaaggccgtcaccttcttcgtcgacgtcatgacgggcatcccgtcgatcgtcgccggcctgttcgttctcagcttctggatcctgatcctggacatgggctactccggtttcgccggttcgctcgcgctgtccatcctgatgatgcccgtggtggtccgctccaccgaggagatgctcaagctcgtaccgaacgagctgcgcgaggcctccctcgcgctgggcatcccgaagtggcgcaccatcctcaaggtggttctgccgacgtccatcggtggtatcaccacgggtgtgatgctcgcggtcgcgcgcatcacgggtgagaccgccccggtgctgctcctggtctggggcacgaacttcatcaacaccaacccgttctcggacccgcaggcctcgctgccgctgtacatctaccagcagtacgcgaacagtgccggttcgggcgcggcctacgaccgggcctgggcggcggcactcgccctcatcgccttcgtcatgatcctcaacctggcggcgcgcggcatcgcgcgctggaaggccccacggactcga

SEQ ID NO: 4059 - DNA, 774 bp, Streptomyces avermitilis
  CDS (1)..(774)
atggccaagcgaatcgacgtgagcggtctcaccgcctactacggctcccacaaggcgatcgaagacatctcgatgacggtcgagcccaggtcggtgacggcgttcatcggtccgtccggctgcggcaagtcgacgttcctgcgcacgctcaaccgtatgcacgaggtcacccccggcggccgcgtcgagggcaaggtgctgctggacgacgaggacctgtacgggcagggcatcgacccggtgtcggtgcggcgcgaggtcggcatggtcttccagcgcccgaacccgttccccacgatgtcgatcttcgacaacgtggcggcgggcctgcgcctgaacggctcgtacaagaagtccgagctgagcgagatcgtcgagaagtccctcaagggcgcgaacctctggaacgaggtcaaggaccgcctgaacaagcccggctcgggcctgtcgggcggccagcagcagcgcctgtgcatcgcccgcgcgatcgcggtggagcccaacgtgctgctgatggacgagccctgctcggcgctcgaccccatctccaccctcgcgatcgaggacctgatcggcgagctgaaggagcgcttcacgatcgtcatcgtgacgcacaacatgcagcaggcggcccgtgtctcggaccgcaccgccttcttcaacctggccgccgtcggccagcccggcaggctcatcgaggtcgacgagacggagcggatcttctccaacccgtcggtccaggccacggaggactacatctccggccgcttcggc

SEQ ID NO: 4060 - DNA, 996 bp, Streptomyces avermitilis
  CDS (1)..(996)
atggacaccttcgccctgatcgtgaccatcggtgtcgcgctcggatttacgtatacgaacggctttcacgactccgcgaacgccatcgccacctcggtctccacgcgcgcgctgacgccgcgggccgcgctggccatggccgcggtgatgaacctcgcgggtgccttcctcggcagtggcgtcgcccacaccgtcagcaagggactgatcgagacccctgagggttccaaggggatgggaatcctcttcgcggcgctcatcggtgccatcgtctggaacctcgtcacctggtacttcggtctgccgtcgtcctcgtcgcacgcgctgttcggcggcatggtgggcgcggcgctcgcgggcggtacggaggtcatctggtccggcgtcctggacaaggtcgtcatcccgatgttcctgtcgcccgtcgtgggcctggtcgccggttatctggtgatgtgcgcgatcatgtggatcttccgcagggccaacccgcacaaggccaagcgggggttccgcatagcgcagacggtctcggcggccggtatggcgctcgggcacggtctgcaggacgcccagaagacgatgggcatcgtggtcatggcgctcgtcatcggcgacgtgcagggcgcggacgatccgatcccggtgtgggtgaagatcgcctgtgccctgatgctgtcgctcgggacgtacgcgggcgggtggcgcatcatgcgcacgctcggccgcaagatcatcgagctggacccgccgcagggtttcgccgccgagacgaccggcgcgtcgatcatgttcgtcacggcgttcatcttcaaggcgccgatctcgacgacccacgtcatcacctccgcgatcatgggcgtaggcgcgacgaagcgcgtgaacgccgtgcggtggggggtcgcgaagaacatcgtcctcggctggttcatcacgatgccggccgccggactggtggccgcgtgcagcttctggatcgtgaatctcgcgttcctg

SEQ ID NO: 4061 - DNA, 618 bp, Streptomyces avermitilis
  CDS (1)..(618)
gtgcgctttcgtctgacccccagggagacgagcttctacgacatgttcgccgcatccgcggacaacatcgtcacgggctcgaagctcctgatggaactgctcggggcggacgcctccgcccgggccgagatcgcagagcgtatgcgggccgcggaacacgccggtgacgatgccacgcacgcgatcttccaccagctgaactcctcgttcatcacgccgttcgaccgtgaggacatctacaacctcgcgtcgtccctcgacgacatcatggacttcatggaggaggccgtcgacctggtcgtcctctacaacgtcgaggaactccccaagggcgtcgagcagcagatcgaggtgttggcgcgggcggccgagctgacggccgaggccatgccgcacctgcggaccatggacaacctcaccgagtactggatcgaggtcaaccgcctcgagaaccaggccgaccaggtccaccgcaagctgctcgcccacctcttcaacggctcgtacgaagccatcgaggtgctgaagctgaagcagatcgtggacgtgctggaggaagcggcggacgcgttcgagcacgtggcgaacacggtggagaccatcgccgtcaaggagtcc

SEQ ID NO: 4062 - DNA, 354 bp, Streptomyces avermitilis
  CDS (1)..(354)
atgacgaccaccgaggccggcgcgacggtgccctccgagggcaccccggccgtggtgaccgaccacgaccgcggcatccacggctaccaccagcagaagggcgaacacctcaagcgcctgcgccgcatcgagggccagatccggggccttcagcgcatggtcgaggaggacacctactgcatcgacatactcacccaggtctccgcctcgacgaaggccctccagtccttcgcgctccagctcctggaggagcacctgcgccactgcgtcgcggacgccgcgctcaaggggggcgccgagatcgacgcgaaggtcgacgaggcgacgaaggcgatcggccgtctgctgcgtacc

SEQ ID NO: 4063 - DNA, 186 bp, Streptomyces avermitilis
  CDS (1)..(186)
gtgatgcgcgtggctccggtcggcggtacggcagttcaggaccacgtggccctcgccgagatcgagctgtgcggcgatctgatgatcgcggcctcggccgccgacgaggaccggctcagcatggagagcatcgacgaggtgctgaaagtggccgaagagcgtgcccacgaggtcgagcccggccga

SEQ ID NO: 4064 - DNA, 831 bp, Streptomyces avermitilis
  CDS (1)..(831)
atgacggcgcggcagcacacgcggacgggcacggcggtcgccgtggcgacggggctcatcgtctgcacggggggctgcgcgggcgatccggccgacgccgaggacgcgcacgccggtgccgacgccgtcgcggtgctgcacaaggccgccggtgccctggtgagcgcgggcagttccaaggcgcggaccgcgatggagatggccaccggggggacccgcgtcaccattcgcggcgagggcgtctacgactaccgcaggcaggtcgggcagctgaaggtgctgctgccgcaggatcccgcgggagcccgggaacaccggtcgatcaccgagctgctcgcgcccggcgccctgttcatgaagaaccggggggccggggtgcccgccgacaaatgggtgcgcgtggacacggcctcgctctccgacggcaatctggtcaccggcggtgtcaccgatccctatgccgccgccgagttgctgcgcggggcgcgtacggcgacgtacgtgggcaggaccgaggtcgccggggagccggtgcggcactatcgggggaccgccgatctcggcctcgccgcgaagagcgcgtcgggtgtgaaccgggcccagctgagggccgcggcgcgggggttcgccaccgccgcggtcccgttcgacgcctacctcgacgaccaggggcgcatccgcaagatccggcaccggttcagcttcgtcaacgggcagcgcaagggcacggtcgcggtcgcctcgacgaccttgctgtacgccttcggggcgcccgtccgcgtacggctcccggaggccggggacatcttcgcggggaagatcgcggagggg

SEQ ID NO: 4065 - DNA, 1575 bp, Streptomyces avermitilis
  CDS (1)..(1575)
atgcaacggcggacgttcataggcggcggcgcggccgcgatagcggcggcggccacggccgcgtgcagcgcgggcaacggcgggggcggggacgcgaagacctcggcggccggcgagggcgccgagaccagcggcacagccatccgctcggccaccaccagcagccgcgtcgccgcgaactggaccgccctggcccgggacctggatggcgccctggtccgccccggagaccgctcctggccggccgcccaccagctctacaacacccgcttcgactccctgaagcccgccgccgtggcctatgtggcccacgccgacgacctccgcaccaccatggcgtacgcccgcgcgcacggcgtcaaggtcgcgatccgcaacggcggccactcctacgccggctggtcctccggcaacggcaggctgatcctcgacgtctcgaagctgaacaagacccgcgcgagcggaggcacggcggtcgtcggcgccggttcgaagctgatcgacgtctaccgcgccctcgccgcgaagggcgtcacgatccccgccggctcctgcccgacggtcggcgtctcgggcctgaccctcggcggcggccacggtgtcgtgtcccgcgcgtacggcctgacctgcgacagcctcacccaggcgacgctgatcacggcggacggcaagcagctcgtcgcgaacgcgaccgagaacaaggacctcttctgggccctgcgcggcgcgggcaacggcaacttcggcgtcgtcaccgagctgcacttcaagacccacccggccccgcagggggtctccgcgtacatgacgtggccgtggtcgaaggccgcggcggtcgtcaaggcctggcaggagtggggcccggaccagccggacgagatctggtcgtcctgccacctggcgaacgcggccggcggcacgcccaccgtctccgtcgccgcgttctcgctcggcacctacggcgagctccagaacgcggtcgaccgcctcgccgacaagatcggcgcccccgcgcgcagcgtgtcgctgaagcgccgctcgtacgaggagtcgatggaggtgtacgcgggctgctcgtccttccccaccgacgcgcagtgccacctccccggcacgacccccggccgctccccgcagggcgccctgggccgggagacgtacgcggcccgctcggacttcttcgaccgctcgatctcgtcggcgggcgtccagacgctcctgaaccagatgacggcggtacgcggcggcgccggcagcatcgccctcacggccctcggcggcgccgtcaaccgcgtctcgcccacggcgacggccttcgtccaccgccgttcgcggatgctggcccagtacatcgcgagctggcgcgcgggcacgagcggcacgacggcccagtcctggctgacgggggcccacgccgccatgcagcgccacgcctcgggcgcggcctaccagaactacacggaccccaccctcacgaactggcgcaaggcgtactacggagacgcggcgacccgcctgacccgactgaagcaccagtacgacccgaacggcttcttcacgtacccgcaggggctg

SEQ ID NO: 4066 - DNA, 696 bp, Streptomyces avermitilis
  CDS (1)..(696)
atggctgttctcgccgaatcagggtcgaaccccgacgtcaccctgctttatgacatcaatggcctggccaaggatgcgccgcactggttcgaccgtgctatggagttcgtcggtgagtacgggctgcttctcgccatggtgctgctggtggtgtggtgctggtggggcgtgcggcggcggagcggcgaggacgcggcgtcgtccgtggccgcgctcgtgtgggcgcccctcgccgccggcatcgccgtcctggtgaacgtgccgatacggggcttcgtggagcggcccagacccttcgtggaccatcaggggctcgaggtcctggtctccggcaagaccgacttctccttcgtgagcgatcacgccacgctcaccatggccatggcggtcgggctcttcgtcgccagccggaagttcgggctcgcgggcatcggcctcgcgctgctcgaagggttctgccgggtctacatgggcgtgcactacccgaccgacgtggtgggcgggttcgcgctggggaccgccgtggcgctgctgctgtcgccgctcgccatggcgctgctgactcccgtgatgagggctgtcgagcggtcgtcgcgggccgggtggctgatccgggcacgcggtacggcgcccgcggacaccctgattccggggacgcggccggggacagcgacggaagagcgggacctggcggcg

SEQ ID NO: 4067 - DNA, 1005 bp, Streptomyces avermitilis
  CDS (1)..(1005)
ttgacggtgcgtaaggcgtgggtcgtggcgtttgctgccgtcggggccgggctcagctttgtgatgctgctcgtcgtgggcgtctacgtggttgcggggaatctcgccaacggggtgggcaaagggtccgtcggactcgccaagggtgccgtgccggccgcgtaccagtcgctcgttcagaagtggggcaatctgtgcagcgccatcaatcctgcgctgctcgccgctcagctttatcaggagagcgggttcaacccgaacgcgaagagcccggcgaaggccgaggggatagctcagttcatccccggaacctgggccacgcacggcgtcgacggggacggtgacggagaccgcgacgtctgggatccgaatgacgcgattccatcggccgcgtcgtacgactgcaagctcgcctcgtacgtgaaggacgcgccggggaaccagaccgagaacatgctcgccgcctacaacgcgggggcctacgcggtcgtcaagtacggaggtgtgccgccgtacaaggagacccagaactatgtgaagaccatcacgagtctcgagaagagcttcgccgctcccgtcacccgggtcgacccctccaagcaagccgccgcggccatctactacgcgcagaagaagctcggcacgccctatctgtggggtgggaacgggaccgctgaccagggtgggcggttcgactgttcggggctcaccaaggccgcgtacgagagcgtgggcgtgacgctgccgcgggtcgccaacgatcagtacaacgccgggccgcaccccaagcgggatgaactgctgccgggggacctcgtcttcttctcggacgacctcaccgattcgcgggccatccgacacgtggggatttatgtgggtggcggatacatgatcgatgcgccgcgaacgggtgccgtcatccgtttcgaccccatcgacactcccgactatttcggggcgacgcgggtcaccgaagatggcgcgaaagcattgccgaccaccgtc

SEQ ID NO: 4068 - DNA, 1722 bp, Streptomyces avermitilis
  CDS (1)..(1722)
gtggaaggactgagagatcgggatcccgcgcggataggcgcgtacacgttgctcgcccggctcggggcggggggaatggggcaggtctacctggggcgttcgcccggtgggcggctcgtggcgatcaaggtgatccgggacgagatcaccgaccatccggaggcgctggcgcggttccggcgcgaggtggagacggcgggggcggtacgcagcgcgtacacggcgaacctgatcgacgcttcgctggacgcggctccttactggctggctacggagtatgtgtcggggccgacgctcggcggggcggtcactgagcggggaccatttccgccggacagcgcgcggcgactgttcgcggccctggccgaagcgctggcgagcgtgcacggatacggcgtgacacaccgggacctgaagccgcagaacgtgatcctttcggggcagggacccctgctgatcgacttcggtatcgcccggaacacgacggacacggcgctcacccagaccggtctggccccgggcacgccgggcttcaccgcgcccgaggtgctgacgcacaaccaagtgacctcggcagccgatgtgttcgcgctcggcgcgacgatcgcgaacgccgcgaccggacggccccccttcggatcgggcccggcacatgctgtctcctaccgggccgtgcacgaggacatcgacgtggacggggtcgacccggaactggccgcgctgatccaggcttgcgtcgcgaaggacccggtggaacggccggggctcgagaccgtcatcgcgcggtgtgcggtgacttccgcgctcaccgaggaccccttctaccgtcccttggcgggtacgggcgacaccgcgccgcccgatctgccggcggctgtcgccgccggtctggtccccgtgggacacggcatggcgacaccccccgcccatcggcccacggtcgggccgggttatgtgccgacactcgccccggtcaccccgcctccggcggcggcgcgtgggtggcgtaggccgctggtagccgggatcgtgggcgcggtggtgttggccgcagcctcgatcgtcgcctggcaggtgctgcccgacgaccgcgggtccgcgaagggaggcggtggcgcgtccggctcgccgtcgtcctcgagcagcgccggcgccgcgtcgcagaaggttccggcgtacatcgagaacgaccggatctcccgcgacaactggacactctccgacaacccggacgacgctgccaacggcatcggcaagtgtgcacagatcggtgcggtcagtgcgcccgaggagctccagtacagcgcgcgggacgcggacgatccgcagctcgcgtatgtcaaggagaaggcgaagatctccttccggttcaagtacgcggagctgaagaacaagaagcccgagccgtactacgtctccgtcggcgtgaagccgccccatgacatcgactccgagacgggcaaaccgtacgaggtgatggcggcgaacaagaccatcggctacagcagcaagccggtggacatctacaagcactggaaatccggcgggaccatcgagctcacctatccggacgacttccagcagcactggaagggcgagaccttggacgcgatccctgtcacccatgacccgggcgactggacggctgtcttctatcacgtcaagggaagtccgacggactacgagagcttcggttgcacgggattccgtggcggacaggga

SEQ ID NO: 4069 - DNA, 822 bp, Streptomyces avermitilis
  CDS (1)..(822)
gtggctcgtggggatgttttcgggcgctcgcaacgcctttctcacctcggtgggacacagtggcgcgtgatgaagcgcatcgcacgcccccctggcgcccgccggctcgcgctgttcggcgcggtggtgctgttggcgctcacgacctcctccgtggccgccgcggaccgcgggcccgggccgttcggggtgaccgtgcaggcggagccgagtccgcagatggtccgtgtgggtgcgcttttcggcggggacggcgacctcctcggcaaccacttctgtacggcctccgtggtgcgcagcacggcgcatgacctgatcgtcaccgccgcacactgtgtggacgggggcgggaagacgtggttcgtgcccgggtaccgggacgggcaggcgccgtacggggtctggcaggtcacgaagacgtacgtcggtgacgcctggagcgggggccaggacgaggacagcgatgtcgccttcgccgttgtggaggacctcggtgggctggaggtcgaggatctggtgggtgggaacgcgttcgtcacggggcaggccaccggggccaccgccgtcaccgtcaccggctatcccaagtccctcgacgtgccgatcacctgtacgaacaagccgaccgttcacagccgtacgcagcagcggatcgagtgtcccgcctttcccggcggtacgagtggcagtccctgggtgaacggggacggtgcggtcgtcggagtcatcggcgggtacgaggagggtgggtccaccgacgacgtctcctacagcgttgtgctgggggacgaagccgccgcgttgtaccgggcggcggctaac

SEQ ID NO: 4070 - DNA, 429 bp, Streptomyces avermitilis
  CDS (1)..(429)
atggcaaccgtatccccgtcctgggcctacacccttcaactcccgcacgatccacgcgcaccgggtatcgcccgcgccaccctccgtaccgtcctcgccgcgcacggtctcgccgaactcacgcccaccgccgagctgttggcttcggagctgctcaccaacgcgcatctgcacaccaaggggccgtacgccctgcggattcgttcgaccgagccggaccggctgcgtgtcgccgtgtgggacaccgatccgagagttccgcccgggttcgggcaggagggcgcctccgtcgtcgtacccgatcaggaagccgaaaacgggcgcggtcttcagctcgtgcgggcctgcgcggattcgtggggcgtgtccgtgctgcgggagctgggcgtctcgaagggcggaaagctgttgtgggccgaatgtgtgggg

SEQ ID NO: 4071 - DNA, 870 bp, Streptomyces avermitilis
  CDS (1)..(870)
atgcacggcagggaggcggaagacggcgtgaggagcaacccgacaggacgccaactccgcttcggcgcggagctgcgcaaactccgcgagcaggcgggcctgagcgccaccgacgccggtcaactcctgggcatcaagcagacgcaggtcagcaacatggaggccggacgcgtaggcgtgagcgccgatcgggtacgcacgctggcctgccactacgagtgctcggacaaggccctggtcgaggcgatcgcggcgatgaccggcgaccgcacacgcggctggtgggaggagtaccgcgaaatcctgcccgtcggcctcctcgacctcgcggaactcgaacaccacgccacgcgactgcgcaccgcggtgaccgtgcacatcccgggtctgttccagaccacggagtacgcccgcgagatcttccgccaggccgtgccggagctgccgcagccggacgtcgagcaccgggtctcgttcaggatcaagcggcaggcgatcctcttccgtgatcccccgacaccgcaccagatcatcgtccacgaggccgccctgcgcatgaggttcggtggctcggacgtcactcgcgatcagctgaagtacctgacagccatgaacgagcgggagcacatctcggtccaggtcatcccgttcgacaccggcgtcctccccggctccggccagtcgatctactacgccgagggacccgtgccgcagctcgacaccgtgaacctcgaccagtcgcacggcccggtgttcctcgacgcgggggcccagctgcgcaagtaccgagggctgctcgaccgcatggaatccgcggccctctcccccgaggactcgcagaagttcatccacaccatcctcaaggccctg

SEQ ID NO: 4072 - DNA, 213 bp, Streptomyces avermitilis
  CDS (1)..(213)
gtgagggaacctacgatgcccaccaccaagctgacctggcagaagtcgtcgtactgccccgaaggcaactcctgcgtccacatagccgccgacccgtccaccgaaaccctccacctcacggaaaccggcgactccaccggagcgatcctcaccaccacccccaccgcattccgcaccctcctccacaccctcaagaaggaaacgcaccgtggc

SEQ ID NO: 4073 - DNA, 243 bp, Streptomyces avermitilis
  CDS (1)..(243)
gtggctgaagtgccctcgaacctcacctgggtccgcgccgccccggacgacgcgacgggcccgggcccctggatcgaactcgccttcggcgacaacgacctggtctacatccgcgagacaagcgacccggaaaacgtggtcaccacgacccagcgcaagtgggacgcgttcgtactgggcgtacaggcaggcgagttcgaccacttcgtggagggcgtggagagcgcggcggcggacgagagc

SEQ ID NO: 4074 - DNA, 372 bp, Streptomyces avermitilis
  CDS (1)..(372)
atgaagcggatcgacatcgacgaccctgaggtcgacatggatctgagcctgcggctgctgtaccgaggtgagctgttcaccggcgaggtcgaggaatacctgggaggcgttcgcgtcagtctggcttcctacgcggacgggtttccgcacgggcccagccgctcctggcacaagaacggcacgcggcagtccgagggaacactccgcacgggaagccctgccggagtgtggaggacgtggcacgccaacgggacactcgcggtgcggatggtcatgagtgacgacggggcgcgtcagctggcacggtgcgagtgggacgaggacggaaagctgacgaaagagtggcatgccgacgggcacgccgacgggggg

SEQ ID NO: 4075 - DNA, 477 bp, Streptomyces avermitilis
  CDS (1)..(477)
atggcttcggggcagccgacacaggaagtgcttggctggctcactgagcgtggttggtttcctgggcgtgacatcggtgagcaggctgaagagctggtcagggtgcgtctacaggactcggagcgccaaggtgtgcctctcacgccggtttcggctgcagtccgtttcatccacacctacggaatgcttcgtttggatcatccgaaggcctcaggatgtgcgtgggtcatgaagccgaccatcggctatgacggagacgcagggaatatcaaggagcttggcgccggccttggggtggagctgtttcctgtgggatacgaagcttcggagtttgggatcctcttggtggatggaagagggcgcttgttccatctgcaccacacggggggctactacttgggagccgacgcatttgatgcgttttctcggttcgtcgaagggcttccggatctcgacgcggaggatttctatgtccag

SEQ ID NO: 4076 - DNA, 615 bp, Streptomyces avermitilis
  CDS (1)..(615)
ttgtgtaaagactggactccgggcaagttcccggagggcaggaccgcgtcccagcgtctgcgcgagtggatcgacgccggtgcgggcggtctcgatgctgtaggtctcgacctcaccggcgcggatctttcctatggtgacttctccgaatcgtggttcaccgacgcgaagttggtgaacgcgagacttgtggaggcggagttgtaccgctcggatgcgcagggcgccgacttcagtggagctgatctgacggggtgctcgttggttcgggtgaacctcgacgacgcggtcttgcgggatgccacgcttgacctggccaaccttgtgaaggcttccctctgcgatgtcgacgcgtcgggcgcaagctgccgcggaacacaattcaggggcgcgtcactgttgggcgtgaatctccgttccgcggatctcagtaatgccatgttccaggagaattcgtttcaggtgacgctggatcagaacaccaagatcgacggcgcgtccggatcggtcttcggaccggcggcgattgttgagggggacgtctcccgagagctgtccggtgccgcacttggaggctggatcaaagccaagggtggagacattcgcgtactttct

SEQ ID NO: 4077 - DNA, 909 bp, Streptomyces avermitilis
  CDS (1)..(909)
gtgagttacttgtgcgaaggctggactccgggcaagttcccggagggcaggaccgcgtcccagcgtctgcgcgagtggatcgacgccggtgagggcggtctggatgctgtagacctgctcactgaagtgagtgccgagctgtcacgtgcggtcctggagcgcctgcgcgcggtcgactggcacggcgactgggacgtggccaacagccacacccgttctcgtgctctgctgatgcgggagtacatgcgtcgggcggcgctgtgggcacgggcgtacggggccgaggccgagtggcctttcttcgacgtcacggagttcctcgatcccacgttccagctggacccggaagtcgcgtccgagctggaggagtatctcgcgcacaacgtcggcaccccgtcgacggcaaggacgtgccgaggcgccgtgcgctgggcggcgctgcgagccgtgcgaggggatgattttcctgcacttccggatccgtacgagcctttgctccttatgtacgggcgaggtggtggttactcgatcgaggagttcatcgacttgtacggggtgatgatcccgtacgggaatttcgattccagcctcaacgccgagccgttcctctcgctggccccgagcacactcgacgccctcgacgcctgggcagagggacgcatcacgtactacgcgaagatcagtgagggctatccccgtagcagcccgcgcggcattctgcgccggcgcctggtcggcagggaggccgagacacacgacgaggcgttcacccgcaatcttcgctgggagccgacggagtacctgcgtctttacgagttgggtcacaacgacgtcgatcacgtgcagatctccgaacgggaggcggccgcgttcatcgaggcggtgaccaagaaactgacgggtgtgcgt

SEQ ID NO: 4078 - DNA, 2322 bp, Streptomyces avermitilis
  CDS (1)..(2322)
gtgatcaagccggaggcgattccgcagtacacgggggatctggcgctgctggagagcgcgtacggcgatctgaagacggacgcgtcgcacatccgttccaccggtaaggacgtgcactcccagttccaggggcttgcggcgtactacacggcgccggaggcggagcagttgttcgcgtcgacgaagccggtggcggaccgggcggacgggttcgcggatgacctggagaaggtgtccggtgccctgtcgtcgtatggcaccgagatccgccccctcgtcgacaagctcaagcagctgaagatcgacgcgaccaatttcgtcagctcggtcaaggacgacgacgactgggagtacgacgaggacaagatcgacaagcacaacaagatccgggatgacgtgacggcgaccgtcgcggcgttctgggctgcggagcgcacctgtcacaacgcgatcaccaagctgttcggtgggacgcagatggtggccggtgacggttcggaccgtaaggaccagtacgggttcaacgcggacgacctgaagaacgcgaagcttccctggggtgacccgatggaggagaagcatcacgtctgggaggtcgggcactgggtcaagtcgttcgtgtgggacggcctgatcgtggacggcgtctggggcacgatcaagggtctgggcacgctggtcgggttcggcggctgggacgcgatggggcaggcctggaagggcctcgcgcagctcgcgaccggtctggcgatctcctcgattccgggtgcgagcgcgttgttctggacgttgccggacgacaagctgccctcctggctgcgggattcgcgcaccgcgatgaaggagaccggcaaggcgctggtggcgtgggacgagtggggcaagaaccccgggcgtgctgccggtgcggtcaccttcaatgtgctgaccaccgtctttaccggcggtgcgggtggtgccgcggctggtgccgggaaggcgggcgcggtcgcgaaggtgctgtccgtggcgggcaaggcgggcaagttcatcgacccgatgacgtacatcaccaagggcgcgggcgcgggtctgtcgaagatcggtgacatcgcgaagggcctgaaggggatcggcaacatcgagatccccaagctccccgacaacgcgatcactctcccggagggcgcactcaaactccccgacgggtcggtgcatatcccggagggcgcggcgattccggagggcgcggtcaagctgcccgacggcaacttcaaactccccgacgacacaccggcgttccccgagggcacgacgaaactgcccaccgagccgggtgccccggcccagtacctggacccgaacggcaacatcctcgaccaccagggcaacgtggtcgacaacgtcgacaacgcgcccaccgacgtggtcgacaagccggccaccggcggccacccggccgccgggtcggacgtcccgcacgtggagtccccagtcaaggaaccggccctggtcggcgcgggctcgcacagcgggcacgacctcccgtccggcacacctcattcgggccacgacctcccggccggcggcggccacacgccggacgcaccgcacggcacgggccacgacaccccggccggccacgcggacgacgcgtcccatggcggcggtcacgacgggcccgggcacgacgggccaggtcacgacgggccaggtcacgacggggccgggcacaccgacgacatggccggtcacggcgacgacgccgcccacacgggcgatcacgacggcacccacgccgagacgccgagcagcgactcgtcagcgccgggccacccccatggtggcgaggctgtacccggtcaaacgggcggtgccgttcgtccgccggacaacggcagcgttcgaagctatatgaagaccgaggaatgggcgggagaggcatacgacgccattcgtgacgcggatgacgtcgatgccatggcttcgcatctgcaggacgccccacgaatcgatgggggaacgggattcaccagtgaagaaatcgaggccatcaagcatcacgtcttcactgaggagcaccctctggagtcggtggacggcgacatagttcacgctcggtatgacgccaaccctgatatggccgaggcctggatcaggttgaggtcgggcacgcacacggagtctgacctgctcctgctggagcacgagcttgcggagcatcggtactatcaggctcacccaggctctacgtacgccgaagcgcatgccgctgccacgaaaatcgcggactgggcaagtcacatggagccgccccggcgcgagaactacacgtgggagaac

SEQ ID NO: 4079 - DNA, 390 bp, Streptomyces avermitilis
  CDS (1)..(390)
gtggtgtcgggctgggatctgaagccgcagggtattcagggtgtgctgaagacgacgggtgagacggcgtcgcacatcgagacgcatgcgaagtcgtacggggagcatctgacgtcggcggcgacgaacgccggcaccatttccgccgagggcggcgggggcggggagaaggcggccgggggtctggtggcgcttgctctgtcccagtacgcggaacacgcggccaccgacctgaagttcattgccgcgcgggcgggcaagtcgttgcagggtgcggtggatgcgacgacggcgtatctgaacggggatcaggagatggccgcggaggcgcagcgcaaggcgttgtcggcgccggatcttgatccgatgaagccgggggtgcagacgtcg

SEQ ID NO: 4080 - DNA, 315 bp, Streptomyces avermitilis
  CDS (1)..(315)
gtgatggctggtgcgggttcggatcgtcggtcgtacgacacgggtgcgtcggcggatgcgcagggcaatatccaggcggtgatcggccggttggaggaggtcatcgcggcgcgggaccggcaggtgaaggcggcgatgtcggatttcgcggctgatggtgtggcggatgagtaccacggcaaggaactgcggtggaatcgcgcgtcgaccgaggtgaagagcattatccagctgttgaagacgacgctggagaagaacgacgggacggcgcagtcgacgatctcgaaggcgaaggcggcggtcgacaacatcggc

SEQ ID NO: 4081 - DNA, 330 bp, Streptomyces avermitilis
  CDS (1)..(330)
atgaagttcgacatggggtcgcaggttctgtcgacgttgatcagtaactcgcgtgggtcgagtgatgatctggggacgttgattcgtcagttggtgcaggccgcgcagccgttggaggggaagttcaacggtgcgggccgggtggcgttcgattcgttcaaggggcggtcggacgagatcacggcgagcttgaactcggcgctctcggggattctgggcggtcagtcggggatggagtcggcgttcggttcgggtgatcaggagcagggcgagaacgcgcggacgaacgagaaggcggcgaacttcgacggggcgcgtttctccgggcgt

SEQ ID NO: 4082 - DNA, 306 bp, Streptomyces avermitilis
  CDS (1)..(306)
atgttccttgcagccgataagggcgacatcaccacaatcatcggcgggatcgccccggactggggtcccttcggcagcctgggcaacgaggccaaggtgatgatcgaggtcgtgatggcggtggccatcctcctctgcctcggcatcgcgatctggggcgccgccaagcagcgcatcggcgcgacggccctgcgcgacacgttcagcgcggaacagggcaagggcctgatcatcgcgggactcaccggagtcttcatcatcggttccctgggcacgctgttcaccatcgtgtacggcatggccgtc

SEQ ID NO: 4083 - DNA, 849 bp, Streptomyces avermitilis
  CDS (1)..(849)
atgagtctcggtgacgagcctgggtacggtgacgctccgcggggcgaggacggggggtacggcggtacggggcagacccgtacgcgactgcccgaccgcgccggggacgtgtacgggggcgcccgccgcggccgctcctcctcgcggagcctggtcacggtcgtcggcgtggtcgtcctcttgatcgcagccatcgccttcgcgaaccgcggcgacgacgagtccgcctcgggcgccggggacagcgacaagacgaatacggcacctacggcggcgaccggggaacagccggtgcagtcgaaggtgggcgacatccccgccgggttcgcccacagcgaccaaggggcacagagcgcggcggcgaactacggcgtagcgctcggctccacgggcatgttcaacgccaaccagcggcacgcgatcgtcaacaccgtgtacgcccccgaggtcgccgccgctcgacagtcagatctcgacagggcgtactccagcgagaagttcctggccaacatcggcctcgccaaggacggctcggcgcccagtgggcagaccttcgtctcacgcatcgttccggtgggcaccaaggtcacgaagttcagcacagacagcgcaaccgtcgagctctggtacacgtcgctcttcggcctgtccggcgaaagatccacgaaccccgtgtcggagagctggttcacgaccacgtatgacctgaagtggatcgacggggactggaagatcaccgacttcacgcagaaggacgggccggttccggtcggacgcgaccagcaggcctccaccgcagacgacatgaccaaggccgtcgaggagtacggagggttcacctatgcgcgc

SEQ ID NO: 4084 - DNA, 1332 bp, Streptomyces avermitilis
  CDS (1)..(1332)
atgcgcgctaagcgtcgcgtactcagggtcgccgccgctgtcacggccgtacagaccacaacggtgctgttggccacccgtgccttcgccgaacccactccgaagccgtcgaaaagcggcgacccctgcgacctcatccgcggccccgccaaggactactgcgaacgcggcaacccctcctccaaaaccggcggagccaccggcggagactccctcaccgactccaccctcgaccccctctcctccctggccaagggctgcgcggacgccgcatcctggaccgtcgacaagctgtccgaggccgtcaagagcaccgcgaacgtcgacttcaccaaccccaaattcctccagcagtacgccgtcgtcttcgccgcgtcgaccatcctgaccctcctgctgtggctgctggccgtcgcgaagagggccgtgcgaggtgtccccctcaccacggcgatctccgaagcggtcgggttcctctggctcaccgtgctcgcctccgccttcaccccgctgatcctctacaccgtcgtatcggcgaccgacggcgtcactcaggtcctggcgaagacgaccggcaaccagacggacaccttcttcggcacgttctccgccgccctcggcaagggcgagaacatcggcggcggcccgatcatgctgatcgtcgtgtcgatggtgtcgatcctcgcggccggagtcctctggctcgaactcgtcgtccgcgccgccctcctctacgtcggcgccctcctcggcaccgtcgtctacgccggcctcgtcgacaagaacctctggggccacgtccgccgctgggcgggcatcatgatcgccgtcatcctcgtcaagccggtcatcgtgatcgtgctggggctggccggcgccctgtcctccgacgagggccccgacgccttctccgccgtcgtctccggcctcgcgatcatcctgctcgccatcttcgcgagcgccatgatctaccgcttcgtccccggcttcggcgacgagatcgcgaactcccgcaacaaccgcatcatgcagggcgccgagggcaaggccgcggccgtcatcagctccccggcgaccctcgtcgcccagggcatcaagacccacagcacccgcgccgacaacaacggcggcggaggcggcggccagtcgtcctccccccgccccgccaacgcggcgtccggcggtatggccgcacacagctcgcgcccgtcgaacggcggcggcggatccggctcctccgccgcgcccccgccccgcagcagcccggccaacaccccccacgccagcaacagccgcaacagcagtagcaacagctcaggaggtgacgggcgt

SEQ ID NO: 4085 - DNA, 1539 bp, Streptomyces avermitilis
  CDS (1)..(1539)
gtgtcccacgtggtcacgccccgccgtacatatctgatcggccgcgcccggccgaacgcgatcgtcggccgcaaccgcgagtccggcgagatcgcactgatcatcgcgggcgcgttcctcggcatgatgtgcgggctcctcgtccccgtcctcgccctgcgcatcgtgctgctgaccggcttcccgatgctcgcgctcgcggcggtctacgtcccgtacaagcgccgtacgttctacaagtggttcgagatcaaccgcagctacaagcgcaccctgcgccggggaacgacctaccgctcgaccgtcatggaggccggtacgcgcctcgacgggcgggagatcgagatcggcccgccccccggtatcggccgtatcagctggctcgccgcccccttcggacccgacgagatcgccgtactcctgcacgccgaccgccgtacggtcacggccgcgatcgagatcgaggggcccggcgtgggcctgcgcgacagcgaggaccaggaggccctcgtcgaccgcttcggcacgctgctgaagcacgtcgcgaacggcgacggtttcgtcacccgcatccagatgctcgcccgcaccctccccgccgaccccgacgcccacgccaaagacgtcgccatgcgcggggacacgcgctcgcccggctggctccagcagtcgtacgaccagttgcagtccatggtgtccaccagcagcgagcagcaccgcgcgtacctcgtcgcctgcatgcactactcccgcgaactcgccgccgaagcacaggcgatggcccgcgccgcccggccccaggcgggtcggaagctcgaccgggacgcggggctcgccgtcgtcatggcgcgcgagctgaccgacatctgctcgcggctccaggaagccgacatccgcgtacgacagccgctcggccagggccggctcgcctccctcgtgcactccatgtacgacccggaccaccccatcgaccacatccaggcgatgacgaaacgcaatgcctggcccgccgagctggacgccatgtcgcccacctacctccaggcgaagacccgcgagtcctccacccgcgccccctggtgccacgccacggcctgggtgaaggagtggccgatgaccccggtgggcgtcaacttcctggcgcccctgctggtccacaccccggacgtcatccggaccgtcgccgtcaccatggacctcgaacccaccgaggtcgccatcgagcgcatgctgaccgagaagacgaacgacgaggcggaggccagccgcgccgccaagatgaaccgcaccgtggacccccgcgacgtcgcctcgcacaaccgtctggaccagcgcggcgaagacctcgcgagcggcgccgccggcgtcaacctcgtcggctacatcaccgtctcctcccgctcccccgaggccctcgcccgcgacaagcggacgatccgcgcctcggccggcaagtcgtatctgaagctggagtggtgcgaccgcgagcaccatcgcgccttcgtcaacacactgccgttcgcgaccggaatccgcagg

SEQ ID NO: 4086 - DNA, 1428 bp, Streptomyces avermitilis
  CDS (1)..(1428)
gtggtgatgcgggacccgctgtcgatcctcaccgacgccttcacgtccttcctgttcggcaaggtcgagacgacgcgcctgcccgtgcgcacctccacgggccaggcccaggccgtctatctgcccaccgccgcccccggcctcggcgactcgggcgtgatcatcggccgggaggtgtactccggaaagggctacatctacgaccccttccagctgtacgggcagcagctgccggccccgcactggctggtgctcggcgaatccggcaacggcaagtcagcgctcgaaaagacgtacgtcctacgccagctgcgcttccgggaccggcaggtcgtcgtcctcgacgcgcagggcgaggacggagtcggcgagtggaacctcatcgccgaggagctggggataacccccatccggctggacccgacggccgccctggacatgggcatccggctcaacccgctcgacccggcgatcaccaccaccgggcagctcgcgctgctccggacgatcatcgaggtcgccatggggcacggcctcgacgagcggtcgggcttcgccctgaaggtcgcgcacgcctatgtgaacgagacgatcctcgagcggcagccggtgctgaccgacatcgtggagcaactgcgccaccccgagccggagtcggccgaggcgatgaacgtcgccctggacgacgtacgggcctggggcctggacgtggcactggtcctggaccgcctcgtcgacggtgacctgcggggcatgttcgacggccccacgacggtcggtatcgacctggacgccccgctcatcgtcttcgacctgtcccacatcgaccgcaactcgatcgccatgccgatcctgatggcgatcgtcggcgtatggctggagcacacctggatccgccccgaccggaagaagcgcatcttcctggtcgaggaggcctggcacatcatcaacagcccgttcgtggcccaactcttccagcgcctgctgaagttcggccgccgcctcggcctgtccttcgtggcggtggtccaccatctgtcggacgtggtcgacggggcggccgcgaaggaggccgcggcgatcctgaagatggcctcgacccggacgatctacgcccagaaggccgacgaggcacggtcgacgggacgcgtgctcgggctgcccagatgggcggtcgagatcatcccgaccctgaccccgggcatcgcggtgtgggacgtgaacggcaacgtccaggtggtcaaacacctgatcacggagaccgaacgcccactcgtcttcaccgaccgcgcgatgaccgagtcgtccgcggaccggctcgccgacgacgcgcatcgcgccgcggaactggaggcggaggagcgggcggcggccttcgtggaacagcacctgagcgacctggacgactcgtccgagtccacggtggcg

SEQ ID NO: 4087 - DNA, 1626 bp, Streptomyces avermitilis
  CDS (1)..(1626)
atgagccgggacagacagacgtaccgggaccggggcagagagcacgatcacagccagggcggcgtccccgacggcctgttgatcggggtcctcgccttcctgctcggcatgaccctgatggtgtggtcggccacgggcctcgcgggctggttcgcgcggggcgcctggccggacgccgtgaccttcacccgtacgccgctggcgatgcggcacctcatcggccgaccgcacgacatcccgggcgcgtggccggacaccccggaaggccagctgtcggggtacggcctgttctggggcctgttcatcggccagctgatggttctgctcgtactgacggtgttcgtgatgggcacggtggcacgatggcgagcggtacgggcgggccgcagggcgtcgaggagcacggcggcggtggccgccgccgatcccgaccctacggggcatgaggtcccggcgcagcgggccacaacggaacggacgggaacttcggatccgaccggaactccggatccgaccggggcggcggaaccggcctggacggcggagcaggccgggagcgcggcgccggccgggagcgcggcgccggccgggagcgcggcgccggccggcggggcggcccccgccgctacgggtggcgtgggtggcatggcgaagtccgccgaggagaccgccctcgcccacctcatggcacgtgaccgggcgggcggacgggaaatcgtcctcggccccccggaaacccgaacagccgccgcgacccaggccatccacgacgcggccggccccgtcctcgtcctcacctcgaacccggccctgtggtcggagacgaaggacgcccgagccaaactgggcccggtcctcctctacgaccccacgcaccgttgcgacaccccggcccgcctccactggtccccctccgccggctgtgaggacaagcccaccgccgtggcccgcgcggcagcactcctcgccccggtccgccccaccgcgaagatcgaccaggcgctcgccgagacggccgagactcttctgcggagctatctgcacgccgccgccatagagggccgcaccgtccgccatgtccaccggtgggcccagggcacccaggtccaggaggccgtacgcgccctccgtgcgaaccccaaggccgcacccggcgcgggcggcgaactggagtcggccctcacctcgcaccccgaacgccgtgacatggcgcaggagttgacagcgcgcgcactgtcctcactcttcaccgtcaatatccgcgaggcatgcacacccaaccgaaatgacagcctcgccttggattccttcgtggatgaagggggcacgctttatgtggtcggtgaacccatcgaggaccccaggcagcatcccggcgccatgccgttcctgacggccctcgtctcacacgtggtcgagcgcggccgtcgcatggccgaacggtcatcctccggtcgcctcgacccaccacttacgctcgtcctcgacgacgtcgcggcggtggctccgcttccccagctcccggagctgctgtcgaccggagcggaccggggcatgccgaccctggccctgctccggtcccaggaacaggcccggtcccgctggccgcagtacgaactacctgtc

SEQ ID NO: 4088 - DNA, 543 bp, Streptomyces avermitilis
  CDS (1)..(543)
atgagccacctgatccgttccatacgcaccggcgagtgggccgaggccaagaagctgcggcttgtcgcgctccaggaccccgttgcgcatctggcgttcctggagacgtacgacgacgccgtcgccaggccggactcctactggcaggaccggacggcgggggccgccgaaggggttgccgagcggcagcagatcatcgccgaggggcctgacggggaatgggccggcagcgtgaccgtactggtcgaggaagccgggtcacgggatccgttcgacgtcgcggtcgagcggcgacaagggcacgtcgtcggcgtcttcgtgcggccggaacatcgggggagcggggtgacccgggcgctcttcgacgcggctctggagtggtcctgggccgctgggctcgaacgcgtacggctcttcgtgcacgagaagaacgggcgggccgaggcgttctaccgcaaggcagggttcatgccgagcggcgtgagcgtgccggcgcccggggactccggggatcaggagttggaattcgtgatcgagcgcacc

SEQ ID NO: 4089 - DNA, 546 bp, Streptomyces avermitilis
  CDS (1)..(546)
atggccgacacccccggcgccggcgagccgacactcgacgaacagatcgccgcctaccagcgcgagttccaggacctcgatccccaggtcgagaagatcgtctcggcgctctcccggctcaaccgccgcatgaacgtcgcctacggccgtcagaccgcggctctcgggatcagcaacgccgagtgggaggtcctcaaggccctcgtcctctccggcgccccctatcggctgggcccgggtgacctggcgaagcgactggggctcacgccggccgcgatgacccaccggatcgaccgcatgctggcggaggggctggtcaccagggagcgggacgagtcgaaccgcgtccgcgtgatcgtcgagctgaccgcggagggccgcgagaagtggctggaggcgatgcgcctcgccagcgtcttcgaggaggacctcctccaggacctgtcggccgaggaacgcgccgccctgggcgaggtcctgacccgtctcctgcggcgcgtggagcacgcccagccggacgcgggcggacggctcagcgacctggac

SEQ ID NO: 4090 - DNA, 1269 bp, Streptomyces avermitilis
  CDS (1)..(1269)
atgggcgcagcgatgcgccggatccatgtgggcaacgcactcagcgcgttcggcctcggcttcaccgtcccgtatctgtacgtctatgtggcgcaggtacgggatctcggtgctgtgacggcgggtctcgtactcgcggtctttgccgtggccgcactcgtggtgcttccgttcgccgggcgagccatcgtccggcgcggcccgctgccggtgctgctcgccgccctggtcaccgccgcgttcggcgcactgagcctgggactggcgagcagcgccacgactgtgttgctgtcggcggccgcgctgggtgccgggcaggccgtgatgcagccggcgctggccacgatgatcgtggactgctcgacggcggagacccggtcgcgggcgttcgccatgcagttcttcctggcgaacctcgggctcggtatcggcggcctcatcggcggccacctcgtcgacgcgtcccgggccggctccttcacactgctgttcgcgatcgaggcggtgatgttcctgctgctcgtcgtgatcatgtcgacggtacggatgccgcacgccccgaagatcgagggctccgctccgcaggccgagggcagctggaagcagctgctcggcaaccgggccatggtgcagctgtgcgtcgtgggcttcgtgctgttcttcgcctgctacgggcagttcgagtcggggctgagcgcgtacggcgtcgaggcggccggtatctccacctccgcgcttggtacggccctcgcggcgaacacggcgatgatcgtggtcgcgcagttcgccgtgctgaagttcgtcgagcggcgcaagcggtcccgggtgatcgccgccgtcgggctgatctgggccgtggcgtggctcgcggccgggtacgcggggctcgggcacggcagccggaccatggcgaccgccgcgttcatctccacgtacgcgctgttcgggctcggggaggcaatgctgtcgccgaccgtggccccgctggtcgccgatctggcgccgacgggcctggcgggtcagtacaactcggcctttgccctggtcaagcagctcgcgctggccatcggtccggcggtgggcggtcccatgggggcgtccctgcacgcgccgtacatcgtgacgttcctgctgttctcgctgggcatcacgttcctcgcggtgcggctcgggcgacagctcaccccggtgcagaaccagccgtccctcgcgaagagccgggtggtcgcccagggcggggcgcccgcggagccgctccccgcgaacgtg

SEQ ID NO: 4091 - DNA, 813 bp, Streptomyces avermitilis
  CDS (1)..(813)
atggcagacgaatcgggctttcagtccaaaggcagcgccccggagcgctacgagcagtacgtcgcgccgatcgcggcgcccttcgtgacggccgtcctggacgccgtcgacctgttcccgggcgccgcggtgctcgatctcgcctgcggcacgggcttcgcggcccgggccgcggccccgctggtcggcccggcgggccgggtgtcgggaatcgaccccgatgaaggcatgctcagggtggccgccgcccaccgtccgcgcatgtaccccgacatcgagttcaccgaggcctccgccgagaaactcccccataccgacgcggccttcgacgcggtcgtctgccagcagggcgcccagttcttcgcggacctggacgcggcagcggcggagacggcccgtgtcacccgccccgggggccgtttcgcggccaccgtctgggcacccaaggacctctccccgtacttcgccgcccagtacgaggccatcaagaagtacggcggcgaggagaccgcggccgaatacaccaaggccttcacctgtacggccgaacggctcacggccgcgttccgctcggccggcttccagcacacgaccgcccgcgaggtcaccttcggtatcgccctgccccgactggccgacttcgcccccggccatctctcggcgctgccctggggccaggagatcgtcgataccggcggcccggaggcactcgccggcgtgggccgcgcgatgtgcgcccgcctcgccgaccgcaccacaccggacggcacggcgaccctgcccttcacggccaccctggtcacaggcatccgc

SEQ ID NO: 4092 - DNA, 1647 bp, Streptomyces avermitilis
  CDS (1)..(1647)
gtgaacttcacgcgctggagcgcccggctccccggaacgcagcgccgcgccgcagcgcgggccgagcacacggtctccccggaccggcggggggacggctccgtgcccacagcccggggcgagcagctcaccgacgacacgcagcgcgtgcccgccgtcgacgaactgccggtacgggacgtcctcgaccgcgtcccggctctcgtcgccctcgtccacggccccgaccaccgcatcgcgtacgtcaacgacgcctatacggcggccttcggcgagcgtcccgtcggcgaacccgcccgcaaggggctgcccgagctggacgagctcggcctgctcccgctcctcgaccaggtgctgcgcagctccaagtcgcgcacggtcaagtcccgcaagaccccgggcggccgctcgtacacgttcacgtgcacgccggtggacgcgtccgaagacaaggacggcggcgtcctcgtcttcgccgtcgacgtcaccgaccacgccgaggccgccgaacggctgcgcgccagtgagcgcgggcagcgcgaaacggcggtgacacttcagcgctccctgctcccccaggagctggaggagcccgacgacctgcgcatcgcggccacgtaccagcccggcggcaccgaggccgcggtcggcggcgactggtacgacgtcatcaccctcggcggcggccgcacggccctcgtcatcggcgacgtgatgggcagaggcgtacgcgcggcagcggtgatgggccaactccgtacggccgtccgcgcgtacgcccgactcgacctgcccccgcacgaggtcctccagctcctggacggcctcgccgcggagatcgacgccaaccagatcgccacctgtgtgtacgccgtccacgaccccaacgagggccgcctggtgtacgcctccgccggccacctcccgatcctggtgcgcgacgacagcggcatcgtcctgcgtgccgacgagcccaccgggccgccgctcggcacgggcggctggatgcacgcctcgggctcggtcccgctcggccccggctccacggccgtgctctacacggacggtctggtcgagcgccgcgatcaggatctcgacgagggcatcgccgccctgtcgcgcgcgctggcgggcgccacgggcacgccccaggtggtctgcgaccggctggtccgctcggccggggtgaccgccgaccacgacgacgacgtggcggtcctggtcctccagcacccggcccgcacgggcgccgacagcgacctcttccgcaacgcggcgctggagctgctcggcggcgtggaagcggcgccacgcgcgcgtgccttcgcctccggcgtcctgaccagctggcgcttcccgaccgaactgcacgacctgggcgtgctggccgcgagcgagctggtcgccaactccctccagcacggcaccccgccgatgcgtctgcggctgcgccgcaccgaccgccgcctgatcgtcgaggtgaccgacggcgacgaccacctcccgcgccgccgccgcgccgaaccggcggacgaggcgggccggggcatcgcgatcgtggcgacgatcgcctcgagctggggctcccgtcgcactccgggcggcggcaaggcggtgtggtgcgagttcgcactcccgcgcaccaca

SEQ ID NO: 4093 - DNA, 1317 bp, Streptomyces avermitilis
  CDS (1)..(1317)
gtggggctgtacacggctctgcgcctgcaacggaagctcaaaccggaactccagcggggcgacgtggagatcgtggtcgtctcccctgatccgtacatgacctatcagccgttccttcccgaggccacggccggcaacatctcgccgcgccatgtcgtcgtccccctgcgccgggtcctgaccgaatgccgcctcctcgtcggcgaggcacagtccatcgaccacgccaagcgcgtcgccaccgtcgccacgctcgccacccaggagaccggccgcaccgagcagatcacgtacgacgaactcgtcctcgccccaggctccgtctcgcgcaccctcccgatccccggcctcgccgaccacggcatcggcttcaagacggtcgaggaggccatcggcctgcgcaaccacgtcatcgaacagatggacatcgcctcctccacccgcgaccccgcgatccgcgacgccgccctgaccttcgtcttcgtaggaggcggttacgccggtgtggaggcgctcggcgaactggaggacatggcccgcttcgccgcgcgctactaccacaacgtcaagcgcgacgacatgaagtggatcctcgtggaggccacgaaccgcatcctccccgaggtcggcgaggagatgggcaagtacgcggtcaccgagctgcgccggcgcaacatcgacgtacgcatggagacccgcctcgaatcgtgcgccgaccggatcgccgtactgagtgacgggtcccgcttcccgaaccgcacggtcgtctggacggccggcgtgaaaccgcacccgatcctcgccgccaccgacctgccgttgaacgagcacgggcgcctgaagtgcaccccccagctgaccgtggacggcgccacgcacgcgtgggccgcgggagacgccgccgccgtccccgacctcaccgccaaggaacccggcaaggagaccgcccccaacgcccagcacgcggtgcgccaggccaagctcctcggcgacaacatcgcccatgcgctgcgcggcgaggagctggagacgtacgcgcacaaatacgtcggctcggtggcctccctggggctgcacaagggcgtcgcgcacatctacgggcgcaagctgaagggctaccccgcctggttcatgcaccgcgcgtaccacctgagcagggtgcccaccttcaaccgcaaggcccgggtgctcgccgaatggaccctggcggggctcttcaagagggagatcgtctccctcggttcgctcgaacatcctcgcgcggagttcgaactcgcggccggtggaaagccttctcgggacccgaaggggtcgtcc

SEQ ID NO: 4094 - DNA, 756 bp, Streptomyces avermitilis
  CDS (1)..(756)
atgcacattcaggaatctcattggtctaccgcgtctgccgtcgcacccggcggagtggtcggcgcggcggcgggcaacggacgcggggacagctcgcgtacgacgccgctgcgcgtggacgcacagcgcaatctggagcacgtactgcgcgcggcgcgcgaagtcttcggcgagctgggatacggcgcgccgatggaggacgtggcgcggcgtgcccgggtcggtgtcggcacggtgtaccggcgcttcccgagcaaggacgtcctggtccggcggatagccgaggaggagacctcccggctgaccgaccaggcccggacggcgctcggccaggaggacgagccgtggtcggcgctgtcgcgcttcctgcgcacctcggtggcctcgggcgcggggcgtctgctgccgccgcaagtgctgcgggtcggcgtcgccgacgagggcctcggcgaggccgtcgcggacgaggcacgggtgccgcagcagcggccggctccggacctgcggctcgtggagcagcgtccggcgccggaggcggagcaggacgacgtgggtgcggcgacgctgctcgaggtcgtcgggcagctcgtggaccgggcgcgcgcggcgggcgagctgcgggccgacgtcaccgtgtcggacgtgctgctcgtgatcgcgacggcggcaccgtcgctgcccgacgcggcccatcaggcggccgcctcggccaggttgctggacatcctgctggaagggctgcggtcgcggccggtg

SEQ ID NO: 4095 - DNA, 3399 bp, Streptomyces avermitilis
  CDS (1)..(3399)
gtgcgccccggagagaataggtgcgtgcggtacggaatcctgggcgtcacccaggctcaggacgaccagggggccctggtacccatcggcggcccccgggtccgtgcgctgctcacggcgctggccctgcgccccgaccgcacgagcgccccgcagaccctgatcgacgaggtctggtcggaggaaccgccgctcgacgcgccggcggccctccaggccctcgtcggccggctccgccgagccataggcagggacgcggtcgtctccgaacccggcggctaccggcttgccaccgcccgcgacagcgtcgacctcttccgcttcgaggacctggtcaagcgcggcagggcagccctcgagcgcggcgacgcgggggccgccgcacgcgacctgggcgaggccctcgccctgtggcacggtcccgccttcgcggacctccccgaccgcaccgccgccgcccgccccgaggccctccggctggacgcgacccgcgcgcgcgtggaggccgaactgcgcctgggccgcgccgaggacgccctgccggagctgaaggaactgaccacggcacacccgtacgacgaaccgctccacgccctcctcgtccgcgccctgcgcgacacgggccgtggcgcggacgcgctggccgcgtacgagaacgtacgccgtgccctgtcggaggacctgggcaccgatcccggtccggagctcaaggccctgcacgcggagttgctgtccccggagacgcctgccggcgcctcccgcgccgccgcaccggccggggggatccgtgcgcaacgggcggcggagcgcaccggcaacctccgtccccggctgaattccttcgtcgggcgggaacccgaactcgccgcgatccgttccgatatgcacagggcccgcctcgtcaccctcaccggaccgggcggctcaggaaagacccgtctcgccgaggaagccgccgccgggctgccgcaggcgtggctggccgagctcgccccgctcgaccggccggaggcggtgcccggcgcggtggtcagtgccctcggcctgcgcgagaccgtcctgatcggcagcgagatggcgtccccgctcgacgatccggtcgccctgctcgtcgagtactgcgctccgcgcgagcagctcctgatccttgacaactgcgaacatgtgatcgacgccgcggccgaactcgcggagaccctgctgacgcactgcccagggctcacgatcctggccaccagccgcgaacctttgggtgtgccgggcgagtcggtgcggcccgtcgagccgctgccgccggatcccgcgcgccgtctgttcatggagcgcgcggcagccgtccgccccgatccggagaccgtcctgcgtgagtccgacgccgtggacgagatctgccggcggctcgacggactgcccctcgcgatcgaactggcggccgcccggctgcggatgctgacgccccggcagatcgccggccgcctcgacgaccgctttcggctgctcacctccggcagccgcaccgtgctgccccgccagcagaccctgcgcgccgtcgtcgactggtcctgggacctgctcgacgagcgggagcggacggtgctgcgcgaggtgtcggtgttcgcgggcggctgggacctcgcggcggcggaggcggtgtgcacggggccgacggccgatctcgtcggggcgctcgtcgacaagtccctgatcgtcgcgaccccgtacggcgcggacgacggcgacggcatgcggtaccggatgctggagacgatccacgagtacgccaccgagcgcgccgccgaggctcccgagctgcgcgccgccgccgagcgccgccatcgcgcgtgggcccgcgccctcgtcgaggaggccgaacccctgttgcgctccgccgggcaactcccgtggatccggcgcctggagacggagctcgacaacatcagggcggccctgtaccacgcggtggtctccggcgacgaggagcagagcagtgccctcgccctggccatgggctggttctggtggctgcgcaactactgtcgcgagggcgcggagtgggtggaccacgtgctgcgtctgggcgtggccctggacgcgtcggcggcgaacccggaccccgaggcggtgaacgggaggtcgcacccctgcaccgctcccgcgaccgccgacgtttttgacgaactggccacgatagatccggtcgccgcgtacctcgccgacgccgaggaggaccacccgctgcaccgaacgcggatgaagctccgtctgctgcaactgtttctgctctccgagtcgcagccggtgggcgccatgcaggacgagcggtcgcgggcgtacgtcgcccgggtgcggtccgccttcgcgaagggcggcccggacgcggcgaccctgccaggcctggtctggccgctgaccgagtactacataggcgcggtggaggacaggccacctcacgtggacatgcggccccagctggacgcggtggtcgccaactgccgtgcgtacggcggcgactgggagatcggcgtgaccttgatgctccgtacgcacatagtcgtcgactcccccggcggactgcacggcatcgacggcgacctggcggagctgcggacgctcagccgccgggtcggcgaccgctggatgcgtgcccaggtgtgcagcgcggccggcgagacggatatggcgcgcggcctcttcggggacgcgaagagcgagtacgaggaggcgctgcggctcgcctacgaggtgggcgcgtacgcggagacaccgttcctcatcgcccggctctccgagatcgcgttccgcgacggggaccgggccggggcgctgaccgcgctggaggaagcgagcgacgccgccgaccgctacggggtgacggactcccgcgcatacgtccggctgctgcgcgcgcagatcgcgctggacgcgggggagacggcccacgcgcgcgtgtggtgggaggaggcgcgggcggagaccttgcgcggtacaccgccgccgcatttcgtcgccgcgctcgacggcatggacgccctcgtgacgctcgccgagtccggcccggagcgcggtctgccgagggcggccgacgccctgcgccgggccgtgcggggccggtgcgcggagccggtgacggcggggctcgtggacatcgcggcgagcgtcctcgcccagctgggtgaccatccgcgcaccgtccggctgctggccgccgcctgtcactggcgcggcggtcacccgcgcgccatgccggagcgcgccgaggccgaccgggccgaggccgccgcccgccaggccctgggggccgaccgcttcgcgtccgaacgcaccctgggcacgtccttcaccgccgaggacgtcctacgggacctggccgaggcgatcgaggagtatcccgtcgacggg

SEQ ID NO: 4096 - DNA, 1746 bp, Streptomyces avermitilis
  CDS (1)..(1746)
gtgaccgtctgcggcgatctggcgggcgccaggccggtgttctacaccccctgggcgggcggcacggcgtatgcgaccgccgcgctccccctcgccgacctcatcgaggcgaacctggacttcgggcacctggcggccctgctcgcggcccccgacgtcccggcggccgtccacgactccaccccttacgacggcgtgcgacgtattccgccggggcatgcgctgatcctgcgcgcgggagcgcgggagatcgccggctacgagccggtcgcctccctcgccgtggccgcgcccccggccgacccggggcgcgcggtcgacgccgtacgcgacgccctcatcgacgcggtacgcgcgcgtctggccgcgccgaggcacgtaccggacgtggaccccggacccgtcccggggatggggcccgcggagcggcgcgcggcccggggcatgccggtgcccggcatcggcgcggacctctccgggggaccggcgtcggggacgctggtgctgctcgcggcggggctgccgggcaggccggggacggtgctcgggcacggcacgggcgcgggggagcggctgctggccgtcaccttcaacgaccttgccgtcggcgggcgggaggccgaactggagcgcgcggggaccctggccgcgaacccccggctgcaccacgtggtggtcgccggcggcgaggagatgctcccgtacgccgacctggacggcccgctgacggacgagcccggcccgtccctggtgacggcggcacggcaccgcgcgcggctcgcctccggcagcgcggaccacttcaccgggtacggcgcccggcaggtcctggacgcgcacccggcgcggctcgcggatctcctgatggaccgcaagcggcgccatctcgtacgcccggtggcggcgctcgcgaaggcggacggctcggtgatggtccccgcgcgcgtgtacggcgcggcgcggaagctggcacgcacgccgtaccggaccggggtggacgggctggccgaccggctgatgcggcggcggttcgaggagccgggcggtgcggtgggcgcgtcgctggccgcgctcacctgggccagaccggggccggcggcgcggtggctgaccggtgaggccctcgctgaagtatcggttcgcctccagggggccaccgggcggccgggggtcgggccggggcagcggccgggcgacttccgcgcacgggcggcgctgaccaggcatgcggcggatctgcgggtgctggagcaggccgcggagatccgcttccagcggctgcacgcgccgttcctggacaaccaggtcgtacgcgcgtgccgggcgcttcccgaggcgctgcgggtgcagccgggggcgcgagcggcgatcttgcgtacggtcctggagggcgccggggtggcggatctgccgccgggctggggtgcgccctcgcacgcgtcgtcggcggttgcggcgcggacggggttgcgggtcgctgtggattctctcgtcgcgctgttcgacacgccgttgctggcggaggcggggctggtcgaggcgcgggtggtgcgcaaggcggtgcgggcggcggcgcagggcgagccggtgccgttggacgggctggcggacctggtttcgctggagttgtggctgcggcggttgctggcgcggcgggggacgtgctggacggggacgccggcgcggcagcgggcggtgccggcggggatcgcgccgcagggacgggcgttgggggcggcgtcttct

SEQ ID NO: 4097 - DNA, 1422 bp, Streptomyces avermitilis
  CDS (1)..(1422)
atgtccagggagcaacgcgggccgaacgaaaaactcggcgccgttctcgccctcgcgggaatcagcaacgcaggactcgctcgtcgcgtcaacgatcttggcgctcaacgcgggttgactcttcgctacgacaagacgtccgtggcgcgctgggtgtcgaagggaatggtgccccagggcgccgccccgcacctcatcgccgcggccatcggccagaagctcggccgcccggtgccgctccacgagatcggactggcggacgcggatcccgcaccggaagtgggtctcgccttcccccgggacgtcggccaggcggtgcgctcggcgacggagctgtaccggctcgacctcgccggacgccgggccggcgccggcggcatctggcagtcgctcgccggatcgttcgcggtgagcgcatacgcaactcccgcttcacggtggctgataaccccggccgacagttcggtggcgcgcgaggcgaaccctggtgaggaggccggagcaccgctgaaagtcggccacagcgatgtgcagaagctccgtgaggcggcggaggacgccaggcgctgggactccaagtacggaggcggcgactggcgttcgtccatggtgccggaatgcctgcgggtggaggcggcaccgctgctgctcggcgcgtactcggacgaagtcggcagggccctcttcggagcgagcgccgagctgacccgcctcgcgggctggatggccttcgacacgggccagcaggaggccgctcagcggtactacatccaggccttacgtctcgcccgcgcggcggcggacgtgcccctcggggggtacgtcctcgcgtcgatgtcgctccaggcgacctaccgcggcttcggcgacgagggcgtcgacctcgcccaggccgccctggagcgcaaccgcggcctggccacctcccgcaccatgagcttcttccgtctcgtcgaggcacgcgcccacgcgcgcgcgggtgacgcccaggcggccggtggcgccctgaaggcggccgagggctggttggagcgggcccgcgacggggacaacgatccctcctggctcggcttctactcgtacgaccgtttcgcggccgacgcggcggagtgctaccgcgatctcaaggcgccgcgccaggtccgccgcttcaccgagcaggccctgtcgaagccgacggaggagttcgtacgctcccacggcctgcgcctggtcgtgtccgcggtcgccgagctggagtcgggcaacctggacgcggcatgcgagcagggcgtacgggcggtggaggtcgccgggcgcatctcctcggcccgcaccaccgagtacgtgaaggacctgctgcaccggctggagccgtacggcgacgaaccgcgcgtggtggagctgcgggagcgcgcacggccgctgctgatggctccggcc

SEQ ID NO: 4098 - DNA, 1239 bp, Streptomyces avermitilis
  CDS (1)..(1239)
gtgcactatcgaagccgggaggtggagcaggtggtgcagaagatcgcttacgactgcgatgtgctggtgatcggtggcgggatcgtcggcctgtcgacggcgtatgcgatcacgcgtgccgcgccgggcacgcgggtgacggtgctggagaaggagcagggcccggcccggcaccagacggggcgcaacagcggggtcgtccacagcgggatctactaccggccgggctccctgaaggcgcggtacgcggtgcggggcgccgccgagatggtgaagttctgcacggagtacggcatcgaccacgcggtcaccggcaagctgatcgtcgcgacggagcgggccgagctgccccgcctgcacgcactcgtgcagcgcggccgggagaacgggattccggtgcgagagctgggcccggcccagatcgcggagtacgagccggaggtccgcggcctcgcggccatacatgtgggcaccaccgggatctgcgacttcgtcgcggtggcccggcagctcgcggagtcgtccggcgccgagatccgctacggggcgaacgtcctgcgcatcgaccggcgcccctcgctcggggtcgccgtccgcacgggtgacggagcggtcgtccgcgcgcgcgtgctggtcaactgcgcgggactgcactgcgacgaggtggcccggctcaccggggacgaccccgggatgcggatcgtgcccttccggggcgagtactacacgctggcacgccccgagctggtgcacgggctggtctatccggtgccggatccggcgttcccgttcctcggggtgcacctcacccgcggcatcgaccgcagcgtgcacatcggccccaacgcggtaccggcgctggcccgcgagggatacggctgggggacagtgcggccacgggagctgggcgcgacgctggcgtggccgggctcgtggcggatagcgcggcagcactggcggtacggcgccggggagctgcggcggtcggtgtcgaagggagccttcacccaggcggtacggcgactgctgccggcggtgacggaggacgacctgcgaccggcggcggcgggcgtacgggcccaggcggtgctgcgggacgggacgctggtggacgacttcctgatccgggagggggcacgggcggtgcacgtactgaacgcgccttcgcccgcggcgacggcgtcgctgccgatcgggcgggaggtggcgcggcgagcgctggcggcgctggccgacacc

SEQ ID NO: 4099 - DNA, 870 bp, Streptomyces avermitilis
  CDS (1)..(870)
gtgtctgactctctccacacccccgaagagccccggcccggccccggtgagcagctcgcgcacgcccacgacggctcgctccgtcacacccgtgccaaaggcgagccccgtttccccgacgggccgaaggccgatcccgccggatcgcacttcgagcgccggatccggagtttccagccccggcggagccgggtgacggccgggcaggccgacgccctgcaacggctgtggcccaagtggggcctggacatcgacggacacgccctcgacctcaccgagctgttcgggaacacccaccccgtcgtgctggagatcggcttcggcatgggcgaggccaccgcgcggatggccgccgaggacccggacaccggaatcctcgccgtcgacgtgcacacccccggccagggcaatctgctcaacctcgccgaccagcacggcctgaccaacatccgcgtggccaacggggacgcgatcatcctgctccgcgagatgctcccgcccgactcgctcgacggcctgcgcgtctacttccccgacccctggcccaagaagcggcatcacaagcgccgcctgatccagccggagttcctcaccctcgccgcgacccgtctgaggcccggcgcgctcgtgcactgcgcgaccgactgggagccgtacgccgagcagatgctcgacgtcctcaccgcgcaccccgacttcgagaacacgcagcccaccggcggttacgcgccacgtccaggcttccgcccgctgacccgtttcgagggccagggactggacaagggtcatgtcgtgaacgatctgctgttccggcgcgtacagcccagggatcagcaccgagacctgcccccgtcggcgaccgaggccgac

SEQ ID NO: 4100 - DNA, 1359 bp, Streptomyces avermitilis
  CDS (1)..(1359)
gtggccacctgtcccccctatccgacgcaccccaccggccccgccggaggtgtgctgcgacggcacacccactggtggcaacggagatgggtgcggtacggggccctggtcaccctcctcgcgctctccggcctcgtcatcctggcgctcgtacgacagcagacgggcaccgagggcttcctggtgggcctgggcctcgcggtcctgccggtcccgctgctcatagccgcgttccgctggctggaccgggtggagcccggcccctggcgcaacctcctcttcgccttcgcctggggtgcctgcgccgccgcgctcatagcgatcgtcgccaacagcttcgcgacgagatggatagcgaccgcgaccgccgacccgaccagcgccgacaccctcggcgcgaccgtcatagcgcccgtcgtcgaggagtccgcgaaggcggcggccgtactgctggtcttcctgttccgcaggcgggacttcaccgggatcgtcgacggggtggtgatagccggggtcacggccaccggcttcgcgttcaccgagaacatcctctacctcggcaccgccttcggcacggaccagctgagcggcgagcgcggcctcgcctcggtgaccgcggcgacgttcttcgtacgcgtcgtgatgtcccccttcgcgcatcccctgttcaccgtgctcaccggcatcggtttcggcatcgccgcgctgtcggcggagcgccagcatctgcgccgggtgctggtcccgctcgcgggactgctgctcgcgatgggcatgcactccgtctggaacggctcgtcctcgttcggggaatacggtttcttcgcggtgtacgcgtccttcatggtgcccgcgttcgcgttgctgacctggctggtcatctggacgcggcagcgggagctgcggacggtgcgcgaggagctgccggcgtacgcggccgccggctggctgtccctgccggagccgttcctcctcagctccatgcgggcacggcggctcgccagggagcacgccgggcaccacttcgggaaggccgcggccaggtccgtggcggagtacgaggcgtacgcgacgtcgctggcgtttctgcggcaccgggcgcaccgcggtcgcgcggaggcgaatttcgccgtacgggagcgggagttgctccacgagctgtggagccggcggggggtggcgcggcccgcgctggcgtatgcggggcgggcgatgacgccggtggcggtgcagccgccctggccggtctacgggtacacggcgcggtatgggcagcagtcccgctacgggcatccggggtacgggcagccgccgtacggagcggcggcgccgtatcccgcgtacaacccgtatcgggtg

SEQ ID NO: 4101 - DNA, 942 bp, Streptomyces avermitilis
  CDS (1)..(942)
atgacttctcttcgcaagctcggcccgtccgacctcgaggtcttcccgctctccctcgggggcaacgtcttcggctggaccgccgacgaggcgcagtccttcgccgtgctggacgcgtacacggccgggggcggcaacttcgtggacaccgccgacgcctactcggcgtgggtgcccggcaacgagggcggtgagtcggagacgatcatcggcaggtggttcgccgcgcgcggcaaccgctccgaggtcgtcctcgccacgaaggtcggcgcgcacccgcggttcaaggggctggccgcggccaacatcaaggcggcggcggaggcttctttgcgccgcctggacacggactacatcgacctctactacacgcactacgacgacccgtcggtgccggtggaggagatcatcaccgcgctcgacgggctggtgcgcgagggcaaggtccgcgcgatcgcggcctccaacatctcccccgagcggctccaggagtccctggagttctccgaccgcgagggcctggcgcggtacgtcgccctccagccgcactacaacctggtctcgcgcgacacgtacgagggccagctccaggacgtcgcctcccgcaacggcctcgcggccgtcccgtactacgccctcgcctccggcttcctgacgggcaagtaccgcccgggcacgaaggtcgactccgcccgcgcggagggcgcgggcaagcacctcgggacggagcggggcgtgcgcgtcctggcggccctggacgagatcgccggggcgcgtggcgcggaggccgccacggtggccctggcctggctggcggcccagccgacggtggcggccccgatcgcctcggcccgcacggtggaccagctgcccgccctgctcgcggtgggcgagctgaccctgacggacgcggagctgtcgaagctgacgcaggcttccgcc

SEQ ID NO: 4102 - DNA, 1041 bp, Streptomyces avermitilis
  CDS (1)..(1041)
gtggcgtccaaccggcctgcccagcaaacctcgttcgcaccgagtgagaagtcgtacgagtcggagaccttcggtttccggggtgacgagggcccctgggaggagtggaatcccaccgcggagtccattcgccccgtgcgcggccggcaccgcgtcgccaagcagcgcggcggcggactcgcgcgcagctccaccgttctgggcgtcggcgtcatcgccgccgtcggcgcgggcggcatggccaccgcgcagaccggcaagccgcccgtctccatatcgatgcccgacctgtcgtcggtcaccgaatcggccaaggccttcgtaggcgccgaatccagcacccccaagggctcgtccaccccgctcaccagcgcgggcctgaccaccgccgacacggtcgcgggcagcgcggacgccggtgaggccctgcgcgcccgcatcatccagcaggccgagtcgcagcaggaccaggtcgaccaggcggccgcacgcgccgccgagaccgccgccgccaagaaggccgccgacgccgccgccaaggcacaggacgacgccaaggccaaggaagccgccgcgaagaagaaggcggaggacgagatcgaggcggagaaggaggccgcgcggctgacccagctcgccaagagctactcgctgccgacctcctcgtacacgctgacctcgcgcttcggtgactccggctccatgtggtcctccggctaccacaccggcctcgacttcgccgctcccaccggcacgctcatcaaggcgatccacagcggcaccatcacggaggcgggctgggccggctcgtacggctaccgcaccatcctcaccctcgacgacggcaccgagctgtggttctgccaccagtcctcgatcagcgccagcgtggggcagaaggtggccacgggcgacgtcatcgggcgcgtgggcgcgaccggcaacgtgaccgggccgcatctgcacctggaggtgcaccccggcggcaacgccaccgggatcgacccgacggcctggctccagagcaaggggctcaacccg

SEQ ID NO: 4103 - DNA, 1128 bp, Streptomyces avermitilis
  CDS (1)..(1128)
atgccccacccctacgtcctgttgtccgccgctgtctccctcgacggattcctggacgacaccggccccgaccggctgctgctgtccgggccggccgacttcgaccgggtcgacgaggtgcgggcggccagcgacgcgatcctggtcggtgccggcaccctgcgcaccgacaacccacggctgctggtgaactcggcggagcggcgcgcggcccgggtcgccgaggggctcccggagtatccgctgaaggtgacggtcaccgcgtccggtgacctggacccggacgcgcagttctggcacaccggcggcgagaaggccgtgtacacgacggacaagggcgcggagcggctgcgcgagctggggatcgccgccgatgtggtcgccgtgggtgccgaactggagtggcgggcggtcctcgaccacctggggagggtgaagggcgtacggcggctgatggtcgagggcggcggccgcgtccacacgcagctgctccagcaggggctcgcggacgaactccagctcgccgtcgcgccgctgttcgtcggacaggcgcaggcgccgcggatgttcgggtccggcgggtatccgcccggccggatgcggctcgtggagacacggccggtgggggacgtcgtcctcatgcggtacgtccccacggcaccgggcaccgggaggctcgccaccgccgccgaccggcactggctggcgctcgcctgcgaactggcggaccggtgtccgccgtcccggaccgcgttcagcgtgggggcggtgatcgtcgcggccgacggtacggagctggcgcgcggccactcccgggagggcggcgacccggtggtccacgcggaggaggccgcgctggcgaagctcgacgccgaggatccccggctggccggcgccacggtctacagcagcctggagccgtgcgcccgccggacctcacggccgcggccctgcgcccgcctgatcctcgacgcgggcgtacgccgggtcgtcacggcgtggcgcgagccggacacgttcgtggcggcggcggacgggagcggggttcttgtggcggagggggcggatgtggtcgtccttccggagtacgaggccagggcgacggcacccaatcggcacctgctcggc

SEQ ID NO: 4104 - DNA, 498 bp, Streptomyces avermitilis
  CDS (1)..(498)
atgacgacccgctggctcacccccgaggaacaacgcgcctggcgcgcctacctcgccgcctcgtcgctcctggaggacgcgatcgaccggcagctccagcaggaggccggcctgccgcacctctattactccatcctggccaacctctccgaggcacccgaccgccgtctgcgcatgaccgacctcgccgagaagctgaagatcacccgcagtcggctgacgtacgcggtgacccgtctggagaaggacggctccgtatgccgcgagggctgcccctcggaccggcggggcagcatcgcggcgctgacggacgcgggaatggccgtcctggagcgtacggcgccgggccacgtcgagacggtcgccgcctcggtcttcgaccacctcactccggagcaggtggaacagctggagacgatctgtgcggccatcgcgcggacgatccagggggacgagcggcggccggcgtgcgacgagctgccgtggcggcggcgttca

SEQ ID NO: 4105 - DNA, 705 bp, Streptomyces avermitilis
  CDS (1)..(705)
atgcgtgatcttccgagcgccaccgtgcgcacccgcgtcaccgtcccgctgcgtttcggcgacggctacacggtcaccggcgaactggtgaccttccacggcctggccgacggccaggaacacgtggccgtcgtactcggcgagcccggcccgaacccattggtgcgactgcactccgaatgcctgaccggagacgtcttcggctcggcccgctgcgactgcggcccgcagctgcgcgaggcggtggagcggatagccgaccgcggcggtgtcctgctctacctccgccaggaaggccggggcatcggcctctacaacaagctcgacgcgtacgccctccaggaccagggcctggacacgtacgaggcgaacgcggccctcggcctgcccgaggacggccgcgactacacggcggccgcgcagatgctcggcgccctcggcatcgacgccctcgacctgctctccaacaaccccgacaaggcgggccaactgcgcgacctgggcctcacggtcaccgaccgcgtcccgacgggcgtcttcaccaccgcccagaacgtccgctatctgcgcgccaaggtcgtccacacccagcacacactgccgctgacggaactgacggagctcaccgagcgcgcggagcgggccggactggcgaagctcaccgaacggacgggcctgacggagatgacggaactgacggcaggc

SEQ ID NO: 4106 - DNA, 1533 bp, Streptomyces avermitilis
  CDS (1)..(1533)
atgacagatgacgccatggcgagtgggctgtcggacgaagaacggcttgcccagctcggctacacgcaggttctcgcccgccgcatgtcggcgttctccaactacgcggtctccttcacgatcatctcggtcctgtcgggctgtctgacgctgtatctgttcggcatgaacaccggcggtcccgccgtgatcacctgggggtgggtcgcggtcggactgatgacgctgttcgtcggcctgtccatggccgagatctgttcggcctatccgacctccgccggcctgtacttctgggcgcaccggctcgcgccggccaagaacgcggcggcctgggcctggttcacgggctggttcaacgtgctcgggcaggtcgcggtgaccgccggcatcgacttcggcgccgcgtcgttcctcggcgcctacctgaacctccagttcgacttcgaggtcaccccgggccggacgatcctgctgttcgccgggatcctggtgctgcacgggctgctgaacaccttcggggtccggatcgtcgccctcctcaacagtgtcagcgtgtggtggcacgtcctgggcgtcggagtcatcgtgggcgcactcgccttcgtgcccgaccaccaccagtcggcgtccttcgtgttcaccgagttcgtcgacaacaccggatggggcagcgggccgtacgtcgttctcatcggcctgctcatggcgcagtacaccttcaccgggtacgacgcctccgcgcacatgacggaggagacccgggacgcggcgacggcgggcccgaagggcatcgtgcagtcgatctggacgtcgtggatcgcggggttcgtgctgctgctcggcttcaccttcgccatccagtcctacgacaaggagctgaactcgccgacgggtgccccgcccgcccagatcctcctcgacgcgctcggggcgacggccgggaagctgctgctgctcgtggtgatcggcgcgcagctgttctgcgggatggcgtccgtgaccgccaacagccgtatgatctacgccttttcgcgtgacggggcgctgcccctctcgcacgtctggcacacggtgagcccgcggacccggacaccggtcgcggcggtgtggctggccgcgctctcggccctggtgctgggtctgccgtatctgatcaactacacggcctacgcggccgtgacgtcgatcgccgtcatcgggctctatgtcgcgtacgtcatcccgacgctgctgcggctgcgcaagggggcggcgttcgaacgggggccctggcacctgggccgctggtcccggctgatcgggatcgtctcggtgatctgggtcggggtgatcacggtcctgttcatgctgccgcaggtctcgccggtcacctgggagaccttcaactacgcaccggtggcggtgctcgtcgtgctgggcttcgccgcggcgtggtgggtggcgtcggcccggcactggttcctcaaccccgagcacgaacggaccatcgcccgggagacggcgcgcgcgggggcgccggaaccggtcgatccg

SEQ ID NO: 4107 - DNA, 2241 bp, Streptomyces avermitilis
  CDS (1)..(2241)
gtgccgaagaactccggaaggttcgcatttcgcatgtctgtttccagtactgatcacatcgtcgtgcccgagaacaacgagggcgacaccaacgagggcgtccaggccatcgagaccgtcgagatcgttgagaccgtggagtccgctcccgagctcaccttcggcgacctgggcctgcccgagggcgtcgtccgcaagctcgcgcagaacggtgtgaccgcccccttcccgatccaggcggcgaccatcccggacgccctggccggcaaggacatcctcggccgcggccgcaccggctccggcaagaccctctccttcggtctgccgaccctggcgcgactcgccggcggccacaccgacaagaagaagccgcgcgccgtcatcctcaccccgacccgtgagctcgcgatgcaggtcgcggacgcgcttcagccgtacggcgacgtcctcggcctgaagatgaaggtcgtctgcggcggtacgtcgatgggcaaccagatctacgccctggagcgcggcgtcgacgtcctcgtcgccaccccgggccgactgcgcgacatcatcaaccgcggtgcctgctcgctcgcgaacgtcgaggtcgccgtcctcgacgaggccgaccagatgtccgacctgggcttcctgcccgaggtcaccgaactgttcgaccagatcccggccggcggtcagcgcatgctgttctcggccaccatggagaacgagatctccacgctggtcaagcgctacctgaccaacccggtcacgcacgaggtcgacagcgcccagggcaacgtcacgacgatgtcgcaccacatcctcgtcgtgaagcccaaggacaaggcgccggtcaccgccgcgatcgcctcccgcaagggccgcacgatcatcttcgtccgtacgcagctcggcgccgaccgtatcgccgagcagctgcgcgacgccggtgtgaaggccgacgcgctgcacggcggcatgacccagggcgcgcggacgcggacgctggccgacttcaaggacggctacgtcaacgcgctcgtcgcgaccgatgtcgccgcccgcggtatccacgtcgacggcatcgacctggtcctgaacgtggacccggccggcgaccacaaggactacctgcaccgctccggccgtaccgctcgcgcgggccgctccggcaccgtcgtgtcgctgtccctgccgcaccagcgccgccagatcttccggctgatggaggacgcgggcgtcgacgccgcgcgtcacatcatcaactccggtacggccttcgagcccgaggtcgccgagatcaccggcgcccgctcgatgaccgaggtccaggcccagtccgcgggcgacgccgcccagcaggccgagcgtgaggtcacgcagctcacgaaggagctggagcgcgcgcagcgtcgtgcggccgagctgcgcggtgaggccgaccgtctggtcgcccgtgccgcgcgcgagcggggcgaggacccggaggcggccgtcgccgcggccgccgaggccgtcgccgagcaggccgtcgtggcccaggctccggccgaggccccggtctccgagcagcccgccgagcgtcccgcgtacgagcagtcgcgtcagcgtcgtgacgagcggggcaactacgagcgccgtgacgaccgcggtggccgttccttcgagcgtcgtgacgaccggggcggcttcaaccgcgaccgtcgtgacaacgaccgtggtgggttccgtcgtgacgaccgtcgcgatgaccgtggtggccgttctttcgagcgtcgtgacgaccgcggtggcttcaaccgtgacgaccgtggtggcttcaaccgcgaccgccgtgacgaccgcggtggccgttccttcgagcgtcgtgacgaccgcggtggtgccggccgtgacgaccggggtggcttcaaccgcgaccgccgtgacgaccgcggcggcgccggccgtgacgaccgtggcggccgttccttcgagcgtcgtgacaacgaccgtggtgggttccgtcgggacaacgaccgcggcggccgtaccttcgagcgtcgtgacgagcgtggcggccaccgtggcagcgaccgtcccttcaaccgtgaccgtcaggacaaccgcccctccagcggtgcccgctccggcagccacgaccgtccgtacgcccgtcgtgacgaccaccgtggcaccaccggcacgggaaccagcaccggttccttcggccgccgcgacgacaagccgcgctggaagcgcaacggc

SEQ ID NO: 4108 - DNA, 438 bp, Streptomyces avermitilis
  CDS (1)..(438)
atggccatcgttgcggccgccggctgcatgagcgtgggggacgacggggccaagcccggggcgtcgcactcggcgggacggcacggtggtgaggcgccggacgggagggcggcgggcagcggtggacatggcgggtttcccggggggcggggcgcgcacggcgggtcgcccaagccggggaagtccgtgtcgggttcggcttcgccggacgcgtcggcatccgggcgggcgaagccgtccgccaaggccacgtcgaaggacggcaagggcggcacgggcggggcggggggtccggcgggcgggggcgagcagcctgagccctcgaagggggagccgagtcctacgcatacgacggaggagccgacgccgagcgcggagccgtcgtctcccgatccgaccacggcggagccgtcgtcgtcggcacatgagcagagcacg

SEQ ID NO: 4109 - DNA, 348 bp, Streptomyces avermitilis
  CDS (1)..(348)
gtgctggagatgacgcgcgaggagttcgaggaactggttgccgaggcgctggaccggatcccgccggagctgacgcggctgatggacaacgtggcggtgttcgtcgaggacgagcccgacccgtccgacccccagctgctcgggctgtacgaggggactccgctgacggagcgcggggagtggtacgcgggggtgctgccggaccggatcacgatctaccgggggccgacgctgcggatgtgcgagacgcgggaggacgtggtcgcggagaccgaggtgacggtggtgcacgagatcgcccatcacttcgggatcgacgacgagcggctgcatgcgctggggtacggg

SEQ ID NO: 4110 - DNA, 1635 bp, Streptomyces avermitilis
  CDS (1)..(1635)
atggcccgcgtccccgccgccaagagcaccgccgagaccaccaccgagggcactgtcacgaccaccgccacgaccaccgcgctccgccgcacgctgcaccgcgccctgcgccgcacgggaaagacccccggcgccctggcccgctactaccgcgcgcgccgggcgcaaccgcgaccggtcacggagctcaccccccagccccacccctggacccgggccctcggcctcgtcgccgtcgtcctcctgggcgcctggctcggcctgctggtcgtcggcaacgtacgggccccggtcggccccatgaacaccacgatgaccctgcgcccctccctcaccggcggcacgaagatcaacgtgtccccgctcggcgccctggagctgcacagccacgaggcccccgtccgcctcgacgtgaacgtcgaccagctcgacccggtgcgcgcccaggccctggtcgaccaccccgaacggatctccggcctccaggacgagatcacccaggacgtcgaacacggcaccctcgacctggccgtacgctcctgcgccgcggtcgtctccggcgccacggcgctcggcctcgccgtctaccgccgcccccgccgggccctcgcggccggcggcctggccctcagcctcctcgccgcctgtggagccaccgcctacgccacctggaaccccaagtcggtcctggaaccgaagttctccggactgctctcctcggccccctccctggtcggcgacgcccgcagcatcgtcaccgaattcgacgtctaccagaaggagttggcgcgcctggtgaccaacgtgacgaagctctacgacgtcacgtccacgctccccgcataccggccggacccgaccaccatccgcgtcctgcacgtctccgacatccacctcaacccggcgagctggaagatcatcgcgtcgctggtgcagcagtacgacgtcaacgtcatcgtcgactccggcgacaccatggaccacggcaccgcggccgagaacggcttcctggacccgatcgcggacctgggagccccgtacgtctgggtccgcggcaaccacgactcgcacgccacccagcgctatctcgagcgcatgaagaacgtgcacgtcctggacgacggccgggcggtcacggtggccgggctgcgcttcgccggcatcggcgacccgcagttcacccccgaccgcgccatcaaggcggcgggcgacccggcggaggagctggcgggggcgcgactggcggcggccgtcagcgaccagcggacggcgggcaccccggtcgacatcgccgtcgcgcacgagccggcggcggcccgcgggacggacggcgaggtgccgctggccctggcggggcatctgcaccacgcgtcgatggaggtcatgaagtacggcacgcgcctgcgggtcgaggggtcgacgggcggcagcggactgcgcgcggtcgagggcaagtacccggaccccatcgaggcctcgatcctgtacttggaccgggacacccgtcgcctccaggcctgggacgagatcaaactcggcggtctgggcctgacgacggcggaggtcagccgccacctgccgaaggagaacacccccggggcgaccggctcccccacccgcacgccgagtggccgg

SEQ ID NO: 4111 - DNA, 321 bp, Streptomyces avermitilis
  CDS (1)..(321)
atgtcgaagggtcagggcgggccgcggtccggcgaggacagcgacctggagcgggcacgcgcgcggtacggcctgctcgccgtcgtcctcagcaacctggcgatcgtggtggtcaccgtcgtcggcgtgtggcaactggacggcgacaagtcggtgatcgtcggcgtactgaccgcctccttcaccgcggtcagcagcatgacgaccgcctacctgggcatcaaggccgtctcgaacaccgccaagtccctcgcccagaccgaggccacccggcgcgaccgcccccagcagccccagctcccctcccagacagccggcagc

SEQ ID NO: 4112 - DNA, 3975 bp, Streptomyces avermitilis
  CDS (1)..(3975)
atgtctacgcatcctgcccccgttctcggcgtcctcgccccccgtctggccgagctgtccctgcgcgacgcgcaccggctcgggcgcaggctcgaaggcgcgcgcaagatccgcaagcccgaggcccgcgccgccgtactcgccgagatcgaggcggaggtcgccaagggcgagcagcggatggccgagcgccgcggccgcctgcccgggatcacgtacccggagcagctcccggtcagccagaagaaggacgcgatcgccgacgccattcgcgaccaccaggtcgtgatcgtcgccggcgagaccgggtccgggaagacgacccagatccccaagatctgtctcgagctcggacgtggggtccgcggcatgatcgggcacacccagccgagacggatcgccgcccgcacggtcgccgagcgcgtcgccgatgagctggacaccccgctcggcgaggccgtcggctggaaggtccgcttcaccgaccaggtgaaccaggactcgaccttcatcaagctcatgacggacggcatcctgctcgccgagatccagacggaccgcgagctgcgcgcgtacgacacgatcatcatcgacgaggcccacgagcggtccctcaacatcgacttcctgctcggctacctcgcccagctcctccccaagcggcccgacctcaaggtcgtcatcacctccgcgaccatcgacccggagcgcttctcccggcacttcggcgaggcgccgatcgtcgaggtcagcggacgtacgtaccccgtggaggtgcgttatcgcccgctgctcgaagaggacggcgacgacgccgaccgcgaccagatcaccgcgatcacggaggccgtcgaggagctggcggcggagggcaagggcgacatcctcgtcttcctctccggtgagcgggagatccgggacaccgccgacgcgctgacgaagaagaactaccggttcaccgaggtactgcccctgtacgcccgcctctcgcatgccgagcagcaccgcgtcttccagccgcacaccggccgcaggatcgttctggcgaccaacgtcgccgagacctcgctcaccgtcccgggcatcaagtacgtcatcgacccgggcaccgcccgcatctcccgctacagccaccgtacgaaggtgcagcggctgcccatcgaagcgatctcccaggccagcgccaaccagcgcaagggccgctgcggccgtacgtccgacggcatctgcatccgcctctacagcgaggacgacttcctcgcccgcccggagttcacggacgccgagatcctccgtacgaacctcgcctccgtcatcctccagatgaccgcggccgggctcggcgacatcgagaagttcccgttcatcgatccgccggaccaccgcaacatccgcgacggcgtccaactcctccaggaactgggcgcgctggacccgacggagaaggacgtacgcaagcggctcacggagaccggccgcaagctcgcccagctgccggtggacccgcgccttgcccgcatggtcctggaggccgacaagaacggctgtgtgcgcgaggtcatggtgatcgccgccgcgctctccatccaggatccgcgcgagcgccccgccgacaagcaggcccaggccgaccagcagcacgcccgcttcaaggacgagacgtccgacttcctcgcgtacctcaacctctggcggtacgtacgcgagcagcagaaggagcgcggctcgtcctccttccggcgtatgtgcaagcaggagtacctgaacttcctgcggatccgtgagtggcaggacatctactcgcagctgcggaccgtcgccaagcagatgggcatccatctgaacgaggacgacgcgcccgagcagcacgtccacatctccctcctcgccggactcctctcccacatcggcatgaaggacgtgaaggagaccggaggggagagcgggagaagcaccggcaagaacgagtacgtgggcgcccgtaacgccaagttcgcgatcttccccggctcggccctcttcaagaagcccccgcgtttcgtgatgtccgccgagctggtcgagacgtcgcgcctgtgggcgcgggtcaacgcgaagatcgagcccgagtgggtcgagccgctggccggccatctcctcaagcgcacgtacagcgagccgcactgggagaaggaccaggcggcggtgatggcgtacgagaaggtcacgctgtacggcgtgccgatcatcgcccagcgcaaggtcaactacgggcggatcgacccggaggcgtcccgcgagctgttcattcgcaacgcgctcgtcgagggcgactggcgtacacaccacaagttcttcgccgacaaccgcaagctcctcaccgaggtcgaggagctggagcaccgcgcccgccgccgggacatcctggtcgacgacgagacgctgttcgacttctacgaccagcgggtgcccgaacacgtggtgtccggggcgcacttcgactcctggtggaagcacaagcgccatgaggagcccgagcttctcgacttcgaacgctcgatgctcatcaatgagcgcgccggggacgtcagcaaggacgactatcccgactcgtggcgccagggacggctcaagttcaaggtcacgtaccagttcgagccgggcgcggacgccgacggcgtcaccgtccacgtcccgctccaggtcctcaaccaggtcacggacgagggcttcgactggcagatcccggggctgcggggggaggtcgtgacggagctgatccgctcccttccgaagccgatccgccggaactacgtcccggccccggacttcgcgaaggccttcctcgaccgggcggcccccctccaggaaccgctcacgctcacgctggcgcgcgagctgaagcgcatggtcggcgtgccgctcacggccgacgacttcgactggagcaggctccccgaccacctgaagatcaccttccggatcatcgacgagcggcgccgcaagctggccgaggacaaggatctcgaggcgctgaagctgcggctgaagccgaaggcgcgccaggcgatctcgcaggccgccgcggcgacggcggagcgcacgggcggggagtcgctggagcgcacgggcctgacggactggacgatcggctccctcacccgcgtcttcgagacccgccgcgccggccagccggtgaaggcgtacccggccctggtcgacgacggaccgacgacgaacacggtctccgtccgtctcttcgacacggaggccgagcaggcgcaagccatgtggaagggcacgcgccggctgatcctccgcaacatcccggtcaacccggcgaagttcgcgtcggacaagctgacgaacgcgcagaagctggcgctgtcggccaacccgcacggctcggtccaggccctgttcgacgactgcgcgatggcggcggcggacaagctgatcggtgacttcggaggtccggcctgggacgaggagtcgtaccggaagctgtacgacaaggtgcgtgcggagatcgtcgacacgacggtgcgcacggtcaaccaggtgcagcaggtgctcgccgcctggcaggcctgtgagcgccgtctgaagggcgtacggagtcccacgctgctggcgaacctgacggacgtacgcacgcagctggacgcgctcgtgaagccggggttcgtcacggcgacggggctgcggcgccttccggacctcatgcgctacctggtggcggccgaccgccggttgcagcagatgccgacgggcgtccagcgggacaccagccgtatggagaaggtccacgagatgcaggacgagtacgcgtggctgctcgagcaactgccgcagggccgtccgatcccttcgtcggtcctggacatccgctggatgatcgaggagctccgggtgagctacttcgcgcacgcgctgggcacggcgtacccggtctcggacaagcgcatcgtgaaggcgatcgacgcggcggccccg

SEQ ID NO: 4113 - DNA, 189 bp, Streptomyces avermitilis
  CDS (1)..(189)
atggcggtgtccgctaggcacgagacgcgagccctgctccgcgcccatctgtcggccgcttccgggtaccgccatctgacccggcactgcccgatctgccgccaactcctgcggctggccatggaacccgccccgaacggcgaggacggccccgagacggccgccgaggaggagatcctctccaaggcg

SEQ ID NO: 4114 - DNA, 204 bp, Streptomyces avermitilis
  CDS (1)..(204)
atgaccgctcgcacccctgatgccgagccgctgctgaccccggctgaggtcgccaccatgttccgtgtcgaccccaagacggtcacgcggtgggcgaaggccggaaagctcacttcgatccgcacgctcggcgggcaccgccgctaccgcgaagcagaggtccgcgcactgctcgcgggcatcccgcagcagcgcagcgaggcc

SEQ ID NO: 4115 - DNA, 843 bp, Streptomyces avermitilis
  CDS (1)..(843)
gtgcccaagaaggtgtcctcggtgatcgtcccgtacgcgtcgtacctgcgcgtgtacgagccgctggcggccttcccggagccggagcgcggccactgggcgcgctacgcgcggcgtcgggagcgcccctcctaccaggacgagctgcggcggtccctggccgacctgctgcccaccccacccatcccggtgcccgtccacgagagcggtgacgcgttcgtcctcgacgtcgagggcgtggtctgcgtctgcccctggcgcacccggctgcgcggctggcaggccctgggggagctggcggaggagtttccggcaccggtcctcgacgcggttctgccgccgctcgtacgccgtcaggccgcccaggactacgagcgctggctggcccgcaaccccgacgcacggccgtggatccgcacgtcgacctggcaggtgccgctgaactggttcgtcctggtctccgacgaggagcggaagtacgagaagggggcgggcgaggtgccgccggtgctgcgctaccggacgccgatggtgcaggcgcggcggcgggtggcgcggggcctgaggaccctcaaggacacgatcgacgagggtccgctcatcgacggtctgctggacgtcggccggtggctggaggagttccacccgcgctcactggtcgagctggactacggggggctcgtgcatgtcctgccggccgggcacctcgacggggaccactcggcggcggacgtcgcggcgggcatcgaggcgctgcgcatcggggacggggccgcggcgggcgaggcgtacggccggctggtggagcgctggcggtcggtacgggaccggcgctcggcgaac

SEQ ID NO: 4116 - DNA, 1083 bp, Streptomyces avermitilis
  CDS (1)..(1083)
gtgaccgatgtatccgacggcgtcctgcacaccctgttccgctcggaccagggggggcatgagcaagtcgtgctctgccaggaccgggccactggtctcaaggccgtcatcgccatccactccaccgccctgggccccgccctcggcggtacgcgcttctacccgtacgcgagcgaggaggaggccgtcgccgacgcgctgaacctcgcgcgcgggatgtcgtacaagaacgccatggccggcctcgaccacggcggcggcaaggccgtcatcatcggtgaccccgagcggatcaagaccgaggagctgctgctggcctacggccggttcgtggcctcgctcggcgggcggtacgtcaccgcgtgcgacgtcggtacgtacgtcgccgacatggacgtcgtggcgcgcgagtgccgctggacgaccgggcgctccccggagaacggcggcgcgggcgactcctccgtgctgaccgccttcggtgtcttccagggcatgcgggcctccgcccagcacctgtggggcgacccgacgctgcgcggccgcaaggtgggcatcgcgggcgtcggcaaggtcggccgccacctggtgcggcacctgctggacgacggcgcggaggtcgtgatcacggacgtgcggaccgactccgtacagcggatcctcgaccagcacccgacgggcgtcacggccgtcgcggacaccgacgcgctgatccgggtggacgggctcgacatctacgccccgtgcgcgctcggcggggccctgaacgacgactccgtcacggtgctcaccgcgaagatcgtgtgcggcgcggccaacaaccagctcgcccacacgggcgtcgagaaggacctcgccgaccgcgggatcctctacgcgccggactacgtggtgaacgcgggcggggtcatccaggtcgccgacgagctgcacggcttcgacttcgaccggtgcaaggcgaaggccgcgaagatcttcgacaccacgctggccatattcgcacgtgcgaaggaagacggcattccgccggccgccgcggccgaccggattgccgagcagcgcatggcggaggcccgccggggc

SEQ ID NO: 4117 - DNA, 249 bp, Streptomyces avermitilis
  CDS (1)..(249)
atggggcgcggccgggcaaaggccaagcagacgaaggtcgcccgccagctgaagtacagcagcggcgggactgacctctcgcgtctggccaatgagctgggcgcttcgacttcgagccagccgccgaacggcgagccgttcgaggacgacgacgaagaagacgacccgtacgctcagtacgcggatctttacaacgacgacgaggacgaggacgacgagtccggtcccacgtcgcaacgccgcggcgct

SEQ ID NO: 4118 - DNA, 1092 bp, Streptomyces avermitilis
  CDS (1)..(1092)
atgtctgctgttttcgatcaggggactccgtcccctggcaccggtgccagctacgcgtccgcgggcgtcgacatcgaagcgggtgaccgcgccgtagagctgatgaaggagtgggtgaagaagacccagcgccccgaggtcctcggcggcctcggcggcttcgccggtctcttcgacgcctccgccctcaagcgcttcgagcgcccgctgctcgcgtccgccaccgacggcgtgggcacgaaggtggacctcgcccggcagctcggtgtgtacgacaccatcgggcacgacctcgtcgcgatggtcatggacgacatcgtggtgtgcggcgccgagccgctcttcatgaccgactacatctgcgtcggcaaggttcaccccgagcgtgtcgccgccatcgtgaagggcatcgccgagggctgtgtgctcgcgggctgcgccctggtgggcggcgagacggccgagcaccccggcctcctcggtccggacgacttcgacgtcgcgggcgcgggtacgggcgtcgtggaggccgaccgcctgctcggcgcggatcgtatccgtaagggtgacgcggtgatcgccatggcggcctccgggcttcactcgaacgggtactcactcgtccggcatgtcctcttcgagcgggcgaagctgagcctggaccagcacatcgaggagttcggccgcacgctcggcgaggagctcctggaacccaccaagatctactcgctggactgcctggcgctgacccgcaccaccgaggtgcacgccttctcgcacatcaccggtggcggcctcgcggccaacctggcccgggtcgtcccggacggcctgcacgccgtcgtcgaccgcgagacctggaccccggacccggtcttcgacctggtcggcaggaccggcgacgtcgagcgcctggagctggagaagacgctgaacatgggcgtcggcatgatcgcgatcctccccgaggagtccacggacgtcgcgctcgccaccctcgcggaccgcggtgtgaacgcctgggtcgccggtgagatcaccgaccgcggcgaccacgagacgggcgcggcgctcatcggctcgtacgcgaac

SEQ ID NO: 4119 - DNA, 1578 bp, Streptomyces avermitilis
  CDS (1)..(1578)
ttgcagaacgcaccggattcggaacggtgcacgatctcgcctacactcggtggcgtgccacgtggtgacggtcgactcaatcatgatctgctccccggtgagaaaggcccccaggacgcttgtggcgtcttcggtgtctgggctccgggcgaagaggtcgccaagctcacttacttcgggctctacgccctccagcatcggggccaggaatccgcgggtatcgcggtcagcaatggctcccagatcctcgtcttcaaggacatgggtctcgtgtcccaggtcttcgacgagacctctctcggttcgctccagggtcatatcgcggtcggtcacgcccgctactcgaccaccggtgcctccgtctgggagaacgcccagccgacgttccgcgccaccgcgcacggttcgatcgcgctcgggcacaacggcaacctggtcaacacggcgcagctcgccgagatggtcgccgacctccccaaggagaacgggcgctccccgaaggtcgcggccaccaacgacacggacctcgtcaccgcgctcctcgcgggccagcgggacgacgagggccagccgctgaccatcgaggaggcggccgccaaggtcctcccgcaggtccagggcgccttcagcctcgtcttcatgaacgagcacaccctctacgcggcccgcgacccgcagggcatccgcccgttggtcctcggccgcctcgagcgcggctgggtcatcgcctcggagtccgccgccctcgacatctgcggcgccagctacgtccgcgagatcgagccgggcgagttcgtcgccatcgacgagaacggccttcgcagctcccgattcgcggaagcgaagcccaagggctgtgtcttcgagtacgtgtacctggcccgtcccgacacggacatcgccggccgcaacgtgtacctcagccgggtcgagatgggccgtcgcctcgccaaggaggcgcccgccgaggccgacctggtgatagcgacgccggagtccggcacccccgccgcgatcggttacgcggaggcctccggcattccgttcggcgccggcctggtgaagaacgcgtatgtcggccggaccttcatccagccctcgcagacgatccgccagctcggcatccgcctcaagctgaacccgctcaaggaagtcatcaagggcaagcgcctggtcgtcgtcgacgactcgatcgtgcgcggcaacacccagcgcgcgctggtgcggatgctccgcgaagcgggtgcggcggaagtccacatccggatttcctcgccccccgtgaagtggccctgcttcttcggcatcgacttcgccacccgtgccgagctgatcgccaacggcatgacgatcgaggagatcggtacctcgctgggcgccgactccctctcgtacatctccatcgacggcatgatcgaggcgaccacgatcgccaagcccaacctctgccgggcctgcttcgacggcgagtacccgatggatctccccgaccccgaactgctgggcaagcagcttctggagaccgagctggcggcgggtcccgccgccacggccgcggccgacgcgatccgtcgcccc

SEQ ID NO: 4120 - DNA, 873 bp, Streptomyces avermitilis
  CDS (1)..(873)
atgtacaggcagcgactgacactcccggccttgaccctcaccgccctgaccctgctcccgctggccgtggcctgcggcaatgagaagggcggcggtacgggcagcagctccgtcggcgcggacaccgaaccgtccgtcaccggcgtccactggaccgtggacagcgtgaccgtgaacggcaccacccaccaggcacccgacggcgcccatgtggagatcgccgaggacggccgggccacgggcaactacggctgcaacagcttccactcgaccgcgaccttcaagggcgaccgcatcaccctgagcagaacgctcagcaccgagatggcctgcgagaagcgtccgatggagttcgagacgaccctcgcccgcgccctcgccgccggcccgctcaccgccgaggccggccagggaaagctgacgctcaccacggccaagggcgaccgcgtccacctcaccgaggagaaggacgccccgctctacggcaccaagtggacggtcaactccctgatcggcggcgacgtcgcccagtcgctccccgcggcggccgacggcaaggcctggctcaccttcaccaagaagagcgagagcggcgacaagaagagcggcgaaaaggagcgcggcgacaaggaggtcggcaccgtcagcggcagcctcggctgcaaccgcgtctccgccatggccaccgtacgcggcagtcacatcaccctcggcgccccccgcaccacccgccagatgtgctccggctcactcatgacgaccgagaaaagcctgctgaagctgttcgacagcacggtgagctaccgcatcgaccaccgcgccatcacgctgaccagcgaaaacggcgagggtatcggagcgatcgccgacagg

SEQ ID NO: 4121 - DNA, 795 bp, Streptomyces avermitilis
  CDS (1)..(795)
atgcccccggccaagaagcgcacccgcacctacgaccccgccaggatccgggcggcggtactggcccagttcgggaacgtacgagagggcgtaagggcccttgacgacgagcagttggcgcggcccacgcacctcggggactggaatgtgcgggagttggccgcgcacaccacgatggccatcgaggccgtcaacaagttcatcgacaggcccgcgccaccgaaacaggaagtcacgctgctggactggccgttcgtgaccgcggtgaacgccgaagcgatcgccgacacgagccgcgagccggccgccggtcacccggacctggacgccttcctcgccgtcaccgagcagcgtttcaccgagcggctggccgcgcaccccgacacccgtttgctcctgacgggcaccggccccatgagcctcggcgactacctcgtcacccgcaccgtcgaactcgtcgtccacaccgacgacctcaaccggtccgtccccggcctcgacatcccgtacgaccgccaggccctcgccgcctgcacccggctgctcgccgacgcgctggccgtgaaggcacccggcgcctccaccgaggtgcgcatccctccgtacgccgtcgtgcagtgtgtcgaaggcccccggcacacccgcggcaccccgccgaacgtcgtggagaccgacccgctcacctggatccggctcgcgacaggccgcctcgactggacgaccgcgctcgacgacgcccaggtcagcgcgagcggcgagcgggccgacctgggcggactgctccccctcatgagc

SEQ ID NO: 4122 - DNA, 2256 bp, Streptomyces avermitilis
  CDS (1)..(2256)
atgagccgcacgcctctggacacggtcgagcacgcggccgcgacccccgacgtcgagctgccctgggccgaactcggcctgaagaaggacgagtacgagcgggtcgtggagatcctcggccgccggcccaccggtgccgagctcgccatgtactcggtcatgtggtccgagcactgttcgtacaagtcgtccaaggtccacctgcgccagttcggcgagaaggccccgcagagcgacgccctcctcgtcggtatcggtgagaacgcgggcgtggtggacgtcggccaggggtacgcggtcaccttcaaggtcgagtcgcacaaccacccctcgtacgtcgagccctaccagggtgcggccaccggcgtcggcggcatcgtgcgcgacatcatcgcgatgggcgcccggccggtcgccgtggtggacccgctgcgcttcggtgcggccgaccaccccgacaccaagcgcgtgctgcccggtgtcgtcgcgggcatcggcggctacggcaactgcctcggcctgcccaacatcggcggcgaggtcgtcttcgacgcctgctaccagggcaacccgctcgtcaacgccggtgccatcggcgtcatgcggcacgaggacatccacctcgccaaggcgtccggtgccggcaacaaggtcatcctgtacggggcccgtacgggcggcgacggcatcggcggcgcctccatcctggcctccgagaccttcgacgacgccaagccgtcgaagcgccccgcggtccaggtcggcgaccccttccaggagaagctgctcatcgagtgcaccctggaggccttcgccgagaagctcgtcgtcggcatccaggacctgggcgcggccggtctgtcgtgcgcgacgagcgagctggcgtccaacggctccggtggcatgcgcgtgacgctggacgacgtaccgctgcgcgactccaccctctcgcccgaggaaatcctcatgagcgagtcgcaggaacgcatgtgcgcggtcgtcgagccggagaaggtcgaccgcttcctcgcgatctgcgagaagtgggacgtcatcgccaccgtcatcggtgaggtgacggacggcgaccgcctcgagatctactggcacggcggcaagatcgtcgacgtcgacccgcgcacggtcgcgcacgacggtccggtctacgagcgcccgtacgcccgtccggagtggcaggacgccctccaggccgacgacgcgaacaagctgcccaggccgtcttcgagcgaggaactgagggatcaggtcctcaagctggtcgcctccccgaaccaggcctccaagtcctggatcacctcccagtacgaccacttcgtgcagggcaacacggttctcgcccagcccgaggactccggcatgatccgcatcgacgcggagtccgggctcggcgtcgccatcgccaccgacggcaacggccggtacgcgaagctcgacccgtacgcgggcgcgcagctcgccctctccgaggcgtaccgcaacgtggcgacgaccggtgccaagccgctcgccgtttccgactgcctgaacttcggctcgcccgaggacccggccgtcatgtggcagttcgccgaggccatccgcggactcgccgacgcctgccagcagctgggcaccccggtgaccggcggcaacgtctcgctctacaaccagacgggcgaggtggccatccaccccacgccggtcgtggccgtgctgggcgtcatcgacgacgtcgcccgccgcacccccgtcgccttccaggaggaggggcagctgctctacctcctcggcgacacgcgtgaggagttcggcggttcggcctggtcgcaggtcgtgcacgaccacctcggcgggctgccgccgcaggtcgacctggagcgcgagcggctgctcggcgagatcctcatctcggcctcccgcgacggcatgatcgacgccgcgcacgacctgtccgacggcggtctgatccaggccgtggtggagtcggcgctgctcggcggcaagggcgcgcggctggtcgttcccgatggtctggacgctttcaccttcctgttctcggagtcggcgggccgtgcggtcgtcgccgtcccgcgctcggaggagctccggttcaacgacatgtgcggggcgcgcgggctgcccgtcacccgtatcggtgtcgtcgacggcgattcggtggaggtgcagggcgagttcacgctcccgctggccgagctgcggaaggcgcacgaggagacgatcccggcgctgctggcc

SEQ ID NO: 4123 - DNA, 702 bp, Streptomyces avermitilis
  CDS (1)..(702)
gtgaccgctcgtattggcgtcgtcactttcccgggcagcctcgacgaccgggacacccagcgcgcgatcaagctcgccggcgccgaacctgtcgctctctggcacaaggacaaggacctcaagcaggtcgacgccgtggtgctgcccggcggattctcgtacggcgactatctgcgcgctggcgccatctcgcgcttctcgccggtcatggagaccgtcatcgagcaggcgaagtcgggaatgccggtcctcggcatctgcaacggcttccagatcctcaccgaggcccacctcctccccggcgcgatgctcggcaacaaccatctgcacttcatctgccgcgaccagaagctgcgggtggagaacgcggacaccgcctggaccagcgactacgaggccggccaggagatccacatcccgctgaagaacatggacgggcggtacgtcgccgacgagcggaccctcgacatgctcgaggccgagggccgggtcgccttccggtacgtggtcggtggcgcggccgccgacgggtacggcaacccgaacggttcgctgcgcgacatcgccggcatcaccaacgaggccgggaacgtcgtcggtctcatgccgcaccccgagcacgccgtcgagccgctgatcggtacgggccgtaccgacggcctccccttcttcacctcgatcctcaagaagctggtcaacgca

SEQ ID NO: 4124 - DNA, 264 bp, Streptomyces avermitilis
  CDS (1)..(264)
gtggcacgcgtcgtagtcgacgtcatgctcaagccggagatcctcgacccccagggccaggcggtgcagcgtgcactgccgcgtctcggtttcgaaggtgtctccgacgtacgtcagggaaagcgattcgaactcgaggtggacggaccggtggacgacgccgcgctcacccgcatccgtgaacttgcggaatccttcctcgccaacaccgtgatcgaggacttcaccgtgaaggtggaggacgagaaggtggaggccggaaag

SEQ ID NO: 4125 - DNA, 315 bp, Streptomyces avermitilis
  CDS (1)..(315)
gtggcgcagcgtgtcgtggtcactctctccgacgacatcgacggctcagaagcggcggaaacgatcgtcttcggactggatggcaagtcgtacgagatcgacctcaatcaagccaatgcgaagaaactgcgtaaggcgctggcgccctacgtcgaggccggccgcaagaaggcgaagtccgggaaggcgtacacgcacaccgcgttgacccccgatccggccgccgtccgggcctgggcccgttccaacaagctggaggttccgccgcggggccggattccgaagaaggtctacgaggcgttcgccgaggcgcac

SEQ ID NO: 4126 - DNA, 1011 bp, Streptomyces avermitilis
  CDS (1)..(1011)
atgaacacgagcgagcacgagcgtgagcacgatcatgtgattgaggtcactgatctgcggcgcgtgtacgggggagatttcgaggcggtccgcgggatcacgttctcggtggagcgcggggagctgttcgccctgctggggacgaacggcgcgggcaagacgtccacggtcgagctgctggagggcctcgcggccccgtccggcggtcgcgtgcgcgtcctcggccacgatccgtacgaggagcgggcggccgtccggcccaggaccggcgtgatgctgcaggagggcggcttcccgtccgagctgacggtcgcggagaccgtgcggatgtgggcgggttgtacgagcggcgcccggccggtgggcgaggcgctgtcactggtcggcctggagcgccggcccgacgtacgcgtgaagcagttgtcggggggcgaaaggcggcgcctggacctcgcgctcgcgctcctcggccgccccgaggtcctcttcctcgacgagccgacgaccggcctggacgccgaaggccgccaggagacctgggagttggtccgcgagctgcgcgacggtggtacgacggtactgctgaccacgcactatctggaggaggcggaaggcctcgccgaccggctcgcgatactccacgaggggcgcatcgcgaccgccggtacgccggccgaggtgaccgcggcccagccgtcccgtatctccttcgacctgcccgacggctacttcctgggggacctgcccccgctcgcggacctcggcgtgagcacccacgagacgacgggccgcacggtccggctccgcacgcacgaactccagcgcacggccaccgctctgctgctgtgggcacagcgcgcccaggtcgagctgcgggggctcgacgtgcgatcggcgtcgctggaggaggcgttcctgcggatagcccgggaggcagccggagaccgtccgggccggccgggacgcacggacgtgtcagggaccaccgcgagcggcaaggaggccgtggca

SEQ ID NO: 4127 - DNA, 777 bp, Streptomyces avermitilis
  CDS (1)..(777)
atgagcaccgtcgcgcccaccaccccggcagggcggctgcgcgccctggcgcgggccgagacgatgctgctgacccgcaacaggggagtgatcgtcacagccctgttcgtccccctggccctgccgttcagtgcgaagccggcagccgaccagatggacctcaagtccgagggattcaccttcggcacggtgatgctcacggccgcgatcggcttctccctgctcttcgcggtgtattcggccctggtcagcgtctatgtctcacgccgggaggaactcgtcctcaagcggctgcgcaccggcgagctcagcgatcccgagatcctcgtcggcgccgcgctgcccgccgtctgcatcggccttgcccagtccgtgctcctggctgtcggctgcatggcgctcctcgacgccggcgcgccccgagcgccccatctcgtcgtcctcggcctctcgctgggtctcatactctgcgcggctctggcggccgtcacagccgccttcagcaggaccgtggaaagtgcgcaggtgacggtgctgcccatgctgttcgtgtccatgctgggctcgggcatcacgatcccgctggaggctctgcccgaccgtgccgcctcggtctgcgagttgctgccgctctccccggcgatccggctgctacgcgcgggctggaccggcggcctctcgatgtacgacaccctgggcgccgtctgcacgggcgtggcctggatcgtgatcgcggtgtttgctgtacgacggtggttccggtgggagccgaggcgc

SEQ ID NO: 4128 - DNA, 1254 bp, Streptomyces avermitilis
  CDS (1)..(1254)
atgagcacacccagggcctggtggcgggggaagaccactccggcgaaggtcgagacgtatacgcggtggtcgttccacttcttcggactgatcgagatctccgcgatcgggctcgtggccttcggcagcgtgccggagccgttctcggtgctggtgctcgttgctgtgtgcgcgcacgccgccctgtgcatggcgacggcttcccaggcgctcgactggacgcgcggccgccgggaacagccgatacgcatgctcggcgcgctgggcgcggccaccgcgctgatcggcatcggcgcgctcctcctcgcgtcacacggtcccggcggcacggacgcggcgggcgcggcgggcacggtctttgtggcggtgctggggttcggcgccggcaccatggcgctcggcatccgtaacaggcggcgcatgctgtcgatggtggcgggcttcgcggtgggtgccgggagtgtgtcgttccccctgggcctgtccgggccggtggcgctggccacggccatcgcggtactggtgaccaccgggttcctcgccttcagctcggcgttctccgtctggctgctcgacgccgtctacacactggacgaggcccgcgagacccgggcccggctcgccgtcgccgaggaacggctgcggttcgggcgtgatctgcacgacgtgatggggcgcaacctcgcggtgatcgccctcaagagcgaactcgcggtccaactcgcccggcgcgagcggcccgaggcggtggagcagatgatcgaggtgcagcggatagcgcgcgagtcacaacgggaggtgcgcgaggtggtgcgcggttaccgcgaggccgatctcggcacggaactcgccggcgcgcaaggcgtgttgacggccgcgggcatcgactgcgaggtcagcggatcagcggccgggctgcccgcgccggtccagtcggcgctcggctgggtggtgcgcgaggcgaccaccaacgtgctgcggcacgggaacgccgcacgctgtgtggtgaccctgcggacggtggagggccatgtcgtgctcaccgtggagaacgacggggtacccgactccgcgccgggcggcggatccgggctggcgggtctgcgggagcggctgtccgtggtcgacggcacgctgcgggccgcgccctccggggaggggctgttccggctgaccgcgcggattccgcttccggcaccgcccgcgcccccactgtccacgcctgtcctgccctcggtgagtgaggtcactcca

SEQ ID NO: 4129 - DNA, 600 bp, Streptomyces avermitilis
  CDS (1)..(600)
gtgcgggtgctgctcgccgacgacgagcatctgatccggggggcgctggccgcgctgctcgcgctggaggaggacctgctggtggtggccgaggcggcgaccggcccggaggcgctcgcgatggcgcgggcacatgcgcccgatgtggccgtgctggatctccagatgccgggggcggacggtgtgagggtgagcacatctctgcgcgccgaactgcccggctgccaggtgctgatcgtgacgagtcatgggcggccggggcatctgaagcgggcgcttgaggcgggtgtgcgcgggttcgtcccgaagaccgtcagtgcccagcggctggcggagatcattcgtacggtgcacgcgggaaatcgttacgtggacccggagttggccgccgacgcgatctccgccggggactcgccgctgaccgtgcgggaggcggaggtgctcgaattcgccgccgacggggcgcccgtcgcggagatcgccgagcgggccgccctggcggaggggaccgtgcggaactatctgtcgtcggccgtgtcgaagctcggcgcggagaaccgtcatacggcggtgcgcctcgcgcgtgaacgaggttgggta

SEQ ID NO: 4130 - DNA, 897 bp, Streptomyces avermitilis
  CDS (1)..(897)
gtgtccggattcgtcgaaaagcccgagccccttcaggtgccgggtctggtacatctgcacaccggcaaggtgcgcgacctgtaccagaacgaggcgggcgacctcgtgatggtcgccagcgaccgtttgtccgcattcgactgggtgctgccgaccgagatccccgacaagggtcgcgttctcacccagttgtccctctggtggttcgaccggcttgtcgacctggccccgaaccacgtcctgagcaccgagctcccgcccggcgcccccgccgactggcagggccgcaccctcatctgcaagtccctgaagatggagcccgtggagtgcgtcgcgcgcggctacctcaccggatcgggcctcgtcgagtacaacgagacccgcaccgtctgcggcctcgccctccccgagggcctcgtcgacggctcggaactcccgggcccgatcttcacgcccgccaccaaggccgcggtcggcgagcacgacgagaacgtctcgtacgaggaggtcgcccgccaggtcggcgccgagacggcggcgaagctgcgccagacgactctcgccgtctacgcccgcgcccgcgacatcgcccgccgccgcggcatcatcctggccgacaccaagttcgagttcggcttcgacggcgacaccctcgtcctcgccgacgaggtcctcaccccggactcctcccgcttctggccggccgaccagtgggagccgggccgcgcgcagccttcgttcgacaagcagttcgtccgcgactggctgacctcgccggagtccggctgggaccgcaagagcgagcagcccccgccgcccctgcctcagcacgtcgtggacgcgacccgcgcgaagtacgtggaggcgtacgagcgcctcacgggcgcgaactggtcg

SEQ ID NO: 4131 - DNA, 1542 bp, Streptomyces avermitilis
  CDS (1)..(1542)
atgggatcggagcagatccgccgctgggagtcgggcgcgctggcgcacgccgtgacggaccccttcggccagggccccgtcccctggctgcgcggcgacgagcagtacttcgacgacaccggccaggtcgtcccctggtacatcgacccggccccgggagccaccgctctccagggcgacaccccggcccgcgacaacggccgagggacatcccgcacggggagcgcagcacgcgccatcccccacccccgcgccggcggcccccgctccgccgacgacgtccaccgccagatcaagggcttcaccgccaccggcgcggccgcccccggcgaggcgatcgacttccacatcaccgtcgacccgccccaggaattcagcgtcgacatctaccgcatcggccactacggcggcgacggggcatgcaagatcaccaccagcccccggctctccggcatcgtccagccacccccgctcaccgccgaccgcacggtctcctgccaccactggtggctgtcctggcggctccagatcccgacgtactggagcatcggcgcgtacgtcgccgtcctcaccaccgccgacggctaccgctcccacgtccccttcacggtccgcgacaaccacccggcggacctgctcctcctgctccccgacatcacctggcaggcgtacaacctctacccggaggacggccacacgggcgccagcctctaccacgcctgggacgagaccggccgcctgctcggcgaggccgacgccgccaccacggtctccttcgaccgcccgtacgccggcgcgggcctgccgctccacgtcggccacgcctacgacttcatccgctgggccgagcgctacggctacgacctcgcctacgccgacgcccgcgacctgcacgccggccgcgtcgaccccacccgctaccgcggcctggtcttccccggccacgacgagtactggtcgacgcacatgcgccgcaccgtggaactcgcccgcgaacacggcacgtccctcgtcttcctctccgccaacaccatgtactggcaggtggagttgggcccgtccccgtccggcgtcaccgaccgcctgctgacctgccgcaagcgccgaggccccggaaaacccgccctgtggcgcgaaatcgatcgcccggagcagcagctgatcggcatccagtacgcgggacgggtccccgaaccccaccccatgatcgtccgcaacgccgaccactggctgtgggaggcgtccggcgcgtacgagggggaggagatcggcggcctggtcgcgggtgaggccgaccgttacttcccgcgcaccgcgctcccggagcaccaggaccgcatcctgctctcccactccccctaccaggacagcgagggcagcacccgccaccaggagacctcgctctaccgggccccgtccggcgccctggtcttcgcggccggaaccttcgcctggtccccggccctggaccgccccggccacgtcgacacacgaatccagcgggccacggccaacctcctggaccgcatctgcaaacacgac

SEQ ID NO: 4132 - DNA, 1980 bp, Streptomyces avermitilis
  CDS (1)..(1980)
gtgaccggtatgggtgtggaggtgggcgtgcaggcagcgcgctcccgggctctcgccgtgctgcgcatccgcagcagggcgctggccgtcgccctgctgcccgcggccgtcgccgtcgtgctgatcgccggcggcaccagcggccacatcagcggtggtcactggggcgtcacgcgctggatcgtcacaggcgtggccgtcgtcgtcctgctctgtgccgcgggcgtcgcgctggtcgtcgcccgcgcccgccccgccgtgagccccacggtccagatcgccgaggactcggcccccgatctgtaccgcatggtgcgtgacctggccgaccgtctggaagtccccgccccctcggcgatagcgctcaccccggactgcgacagctggctggaggaccgcacccaccgcgcccagagcccgccggccgccgaatccggcgacgacacggacgggatacgaggcctcgcgggcccccggcacggccgcccgcccatcgcccccgtcctcgtcatcggctcgccgttcctgtggtggatgcgggtcggcgagctgcgggcggtcctcgccccggtcgtcgcaggtacgggtccctcggcgcaccccgacatagccgcggcccgccgtttcgtacgcgggctggacgcggcggtggccgtcaccgcggcgcccacccgtggccccctcgcccgtacggtgctggccggggtcggctgggtgacccgcctgctgctgcgcagctgccggggccatgcggcggagatggagcggggagtggcggccgcggcggccgagcgtgcacagactgtggactacggcgtgcggatcgtcgcccaggaacaggtgggcctggcgtacgcgggctgggaccgcctgctcaccagggtggcgctgccggcctggcggatgggccgctggccgtcgcgcctggacgcgggtgtggtcgcggccctgacggaactctcgcgccgggaccgcctcgccgagggcttcacctcgcgcctcggcgagcgtccggcctgtgacctgttggaagagcccggtgtggtggacgaggcggcctcgctcctcgccgcccgtctgttccacggagggcccgccgagtgcggtcccgactgggcgccggtggggtggcaggagtacccggacgaggtcgtcgaccgcacatggcgcacggacgcggcccgcctccaccgcgtcctggacgcccagggcgtccacgtcaccacgcatccgccgacccgggacgccgacgccccgaccctgtcccgggtactggaccacttgacggtcacccccgcggacaggcacgccgctccttccgctcctcgtgggggccgaccggaaaagaccggagcggctggtccggcggcggaccccaccgagcccgcagtccccaccgacgcgcgcgagcgccacgacgacgagcaccagcagcaccaccacgacggcgaggacggagacgacggggacaggggcggggtcggaagcgggaccgggaccggggacagggatggcggcagggacggggacaaggacggggacaaggacggggacggggacggggacgaaggcactctgggaacggaacgcacggcgacgctggcggccggtctcagcgcggaactggcccgcgaggaggcggcggccccggtacgcggcggcggcacggagcagacaggccccgaccgaaccctctgggacgacggaatgcttcctctcttccccctccagcccccgagatcgggccgggaaatcctcgccgaccacgtgacggcgatgatctgctgcgccgcgatggacacggcgggtgcgacacccggcctcgactggctcgacggccccaccctcctgatcaacggtgaacgggccgcggacctgaccccccgagtcctcaccttgatagaggacggcgaccccacacccctccgatcctggctccaccactcgggcatccgcccggaaaagccggtccgcctggtc

SEQ ID NO: 4133 - DNA, 1251 bp, Streptomyces avermitilis
  CDS (1)..(1251)
gtgaaggtccttgtcatcggtagtggcgcccgcgaacacgccctgtgccgttccctgtccctcgaccccgacgtcaccgcgctgcactgcgcccccggcaacgcaggtatcgccgaggtggccgagctgcacccggtcgacgccctggacggcgcggccgtggccgcgctggccaccgagctcggtgccgatctggtcatcgtgggcccggaggcacccctcgtcgccggggtcgccgacgccgtccgcgcggccggcatcccggtcttcggcccctccaaggaggcagcgcagctcgagggctccaaggccttcgccaaggatgtgatggcaggagcgggcgtacccaccgcgcgttcgtacgtctgcacgacgccggaagaggccgaggaggcgctcgacgccttcggcgccccgtacgtcgtgaaggacgacggactggccgcgggcaagggcgtcgtcgtcaccagcgacctcgacgccgccaaggcgcacgcgagggcctgtgagcgggtggtcatcgaggagttcctcgacggccccgaggtctcgctcttcgcgatcaccgacggcgtgaccgtcgtcccgctccagcccgcccaggacttcaagcgggctctggacggcgacgagggcccgaacaccggcggcatgggcgcgtactcgcccctcccgtgggccgacccgaaactcgtcgaggaggttctgcagacggtcctgcagccgaccgtcgacgagatgcgccgccgcggcaccccgttttccggtcttctttacgcgggtctcgcgatcacttcgcgcggcgtacgcgtgatcgagttcaacgcccgcttcggcgaccccgagacccaggtggtcctcgcccggctgcggaccccgctcgcgggcgtgctcctggccgcggccgacggcaccctcgcggacctgccgtccctgcgctggagcgacgactcggcggtcaccgtggtcatcgcctcccacaactaccccggcaccccgcgcaccggcgacccgatcaccgggctcgacgaggtcgcggccgaggacgccccgcacgcgtacgtcctgcacgccgggacgaagcacgacggcgacgcggtcgtgagcgcgggcggccgggtcctctcggtcaccgcgaccggctccgacctcgtacaggcgcgcgagcgtgcctacacggcggtggaccgcatcggcctcgacggctcccagcaccgtacggacatcgccgcgaaggccgccgtcggagcc

SEQ ID NO: 4134 - DNA, 2538 bp, Streptomyces avermitilis
  CDS (1)..(2538)
gtgtcgtctctcgcgctgtaccgccgctatcgcccggagtcgttcgccgaggtcatcgggcaggagcatgtcaccgacccgctgcagcaggcgctgcggaacaaccgggtcaatcacgcgtacctgttcagcggtccgcgcggatgcgggaagaccaccagcgcacgcatcctggccaggtgcctgaactgcgagcaggggcccacgcccaccccctgcggcgcatgccagtcctgccaggacctcgcgaggaacgggccgggatcgatcgacgtcatcgagatcgacgccgcttcgcacggtggtgtggacgacgcgcgtgacctgcgggaaaaggccttcttcggaccggcgggcagccggtacaagatctacatcatcgacgaggcccacatggtcacgtcggccggtttcaacgcgctcctcaaggtcgtcgaggagccgccggagcatctgaagttcatcttcgcgaccaccgagcccgagaaggtcatcggaaccatccgttcgcggacccatcactatcccttccggctcgtgccgcccgggacccttcgggagtacctcggcgacgtgtgcgggcgggagaacatccccgtcgcggacggggtgctgccgctcgtggtgcgcgccggcggcggttccgtacgtgactccatgtccgtcatggaccagctgctcgcgggagcgggcgccgacggtgtgacgtacgccatggccacctcgctcctcgggttcacggacgggtcgctgctcgactcggtggtcgaggcgttcgcgtcgggcgacggagccgcggccttcgaggtcgtggaccggatcatcgaggggggcaacgatccgcggcggttcgtcgccgacctgctggagcggctgcgggacctggtgatcctggccgccgtgcccgacgcgggcgagaaggggctcatcgacgctcccgccgatgtcgtggagcggatgcaggcccaggccggggtcttcggcgccgccgaactcagccgggccgccgacctcgtcaatgaggggctgacggagatgcggggcgccacttcgccccggctccagctcgaactcatctgcgcgcgcgtgctgctgccggcggcgtacggcgacgaccgttcgctcatggcccggctggaccggctggagcgcggcgtcaacttctccggcgggggtgcggggccggccatggggtacgtgcccgggcccggcgcgcacggcggggcttcggtgcctcagatgtctcagccggcccagacgcctcaggtgccgcagatgcctcagatgtcccaggggtcttacgcccagcaggccccccaggtgccgccggggggcggagtcgatgcggctcgggccgcggtgcggggcgggcccggtggggcgggcggtcctgccgccgggcagggcgtaccgggtgcggaggccgcgtacggggatgtcgacgccggggtggccggctcgggcgcggcttcggcgcccgtccaggaggcgcccgcggaggctgcgccgcccgcttcccagccgaccgctgagcagccccagccccagccaccggcacagccacaacctcatacccagccgcaggctcccgccgccgcgcccgcgcccgcaccgggagcctggcccaccgcgagcgccgcgggcagcggccggcgtccgggtggctggccgacggccacgcccgcgggcgggggacagccgcagactccggccgccgctgcctctgccgctccccccgcttccggccctgccccggcttccgctccggcgccctcagccccggcgcccgctcccgccgcggcctacgccccggctgccggtgggcccgacccccgcatgctctggccgaacatcctggaggcggtgaagaaccggcgccgcttcacctggatcctgctcagccagaacgcgcaggtcacgggtttcgacggcacgacgctccagatcggcttcgtcaacgcgggcgcgcgggacaacttcgcgagcagcggcagcgaggacgtactgcggcaggcgctggccgagcagttcaacgtgcagtggaagatcgaggcggtcgtcgacccgtcgggcggttcggcccaagcggcgggcgggggctccggcccccgggttcggcggcggcggtgccgggttcaacgcgggcggcggctccggcttcggcggcgggtacggcggagctccggccgccccgcgccccgcgccgcagcagtccgccccaccggcgccgggccccgccgcgtcggtggctccggccccgtccgccagacagactgcgcccgccccggcatccacaccaccgcccgctccgccacggcacatcgcccccgaggacgacatgggggaggacgacgaccccgacctcgacgagtccgccctctcgggccacgaactgatcgtccgggagctcggggcgacggtgatggaggagttctcccacgagtaagggcgccggcagcggcccggcgaggaggggtgtggctcgcggcgtcgcggatgtcccacagcccccgcccgttcctcgcccgacccttcgac

SEQ ID NO: 4135 - DNA, 2691 bp, Streptomyces avermitilis
  CDS (1)..(2691)
gtgttccttcttcaggtcgtgatcgtggtgctgctggtcgtggccgcggtggcggccatggtgctcgaggcggcgcgtgaagccgtgcagcaggcgcagcgggattcggtcgtcgcggcgcagtcgttcgcgagtgcccccgggatggtcgaggccctgcgcggcccgcacccgaccgcggtgctgcaaccgcgggccgaggaggcacggaagaaggcgggcgtggatttcgtcgtcgtcatgaacacccgggggatccgttacacgtacccctacccgcaggagatcgggaagaagttcgtcggcaccatcgaaccggcgctgcacggccgtaccgtcgtcgaacaggccggcggcccgcccctgccgaccggggagggaacggctgtgcaggcggtggttccggtgaccgatgcgcgcggcacggtcgtcggactggtgtccgccgggatcacggtcaagaacgtggcgaggctgtggctgccgcagttgccgatcgctctcggcgccggcgcggccgcggtggcgctggccggggccgggacgacgctggtgtcccggcggctgctgcggcagacgcgcggcctggccccggcggagctcgcggggatgtacgagcaccacgacgcggtcctgcacgcggtgcgggaaggcgtgctgatcatcgacgccgacgggcggctggtgctggccaacgacgaggcgaagcggttgctgggcctgcccggggacgcgcgggggtccctggtgcgggagctgggtctgccggagcagatcacgcgcctgctcacgtcaccggaggaggtcaccgacgaggtgcttctcgccgaggaccggttgctggcggtgaacaagcggcccaccttcccggacgagggccggggaggcagcgtggtgacattgcgcgacaccacggagctggcgacggtctcggggcgggccgaggtggcgcgggagcggctgaagctgctgtacgaggccggggtgcggatcgggacgacgctggatgtgaggtgtacggcgcaggagctggccgatgtggcggtgccgcagttcgccggggtcgtcacggtggatctgctggattcggtgcttcaggggtgggagccgacggcggagggatggcggcggctgcggcgcgcggcgatcggcggcgagcacgagatgatgccgatgtatccgctggacgaagtcatcacgttctcgccgaaaaccccgcagatgctggcgctgaaccaggggcagggcgtgctggaggcggacctgcggcaggcgcgcggctggcaggaacaggatccggagcgcgcccgggccgtcctggaacgcggggtgcactcgctggtgagcgtgccgctgcgagcgcggagcgtgtcgttgggcgtggcgaacttctaccggacgggggactccccggcgttcgagccggaggatctgtccttcgcggaggagctggccgcgcgggccgcggtggccatcgacaacgcccggcggttcacccgggagcacgcgatggcggtgacgctgcaacgcagtctgctcccccgggggcagccggagcaggacgcgctggaggtggcctggcggtatctgccggcggaggcgggggtcggcggggactggttcgacgtcatcccgctgccgggcggacgagtggcgctggtgatgggcgacgtcgtcggtcacgggctgcacgcggcggcgacgatgggccggctgcgcaccgcggtgcacaacttctccacgctggacctccccgtggacgaggtgctcgggaacctggacgacctggtcatacgcatggacaacgaggagagcgccgacgacgccgcacaggcccacgagggagagggggtgacgggagcgacctgtctgtacgcgatctacgagccggtgacgggggcgtgcacggtggcccgtgcgggacaccccgacccgatcgtcgtgcgcccggacgggaccgtcacctgccccgatgtgccggcctcggccccgctcggactgggcagccaccccttcgaaaccgcggagctgcacctgccggaaggctcacaactggtgctgtacaccgacggcctggtgagggaccgcacccgcgaccccgatgtcgggctggacgggctgcgcctggcgttgaagggagccggggagcgtactccgggggagacgtgccaggcggtgatcgacgccctgaagccgacgcacccctccgacgacatcgcactgctggtggcgcgtactcggctgttcccaccctcacacgtggccgaatgggacgtgccgtcggacccggcggtggtgccctcggtgcgggcacggtgcagggagaaactgcgggagtgggggctggaggagtccgaattcaccacggaactgatcctcagcgagctggtcacgaacgcgattcggtacggatctccgccggtcaccgtaagactgctgtacgggcgctgtctgagctgcgaggtgtcggacgccagcagcacctcgccacgcctgcggcgggcggcgaccacggacgaaggcgggcgggggctgttcctcgtagcgcagttcgcggagcgatggggaacgcggtacacgccctacggcaaggtcatctgggcggaacagaccctgcacgacagcgcgtccgccgctcccgcccacacacccatcgacgttctcctcgagcagttcggtgatcccgccatg

SEQ ID NO: 4136 - DNA, 1596 bp, Streptomyces avermitilis
  CDS (1)..(1596)
gtgaaggcgtcgttcacgcggtccccgcgggaatcggccgggcgggggcgcccccgccgtggccgccgtacccgccgcacggctctcgctctcggtctcgccctcgccggtgccgtcgggatcaccggtgccgccgtcctcgtcggcgccctcccctacgggggccaccgctccccggcccaccccggcacccacgccccgggcgcctccgccgcctcgtccggcgcggccccgtcccccggcgcgccgggcatcggcgacccgctcctgccgctcgacggcaacggcggctacacggtcggccactacacgctcgccttcgactggcggacaccgaggacgcccttcgaggccgccaccaccatcagcgccaccgccacccaggccctgtcccgcttcgacctcgacttcgcgggcaacacgctgcacacggtcaccgtcgacggcgcgccggcgaccgccgtacgcgacggtgacgagctcgtcgtcactcccgcgaagccgatcccccacgggagcgctttcaccgtgcgggtcgcctataccgccgacccgacgcagcgacggcaccgcagcgacgcgatcgcacactacggatgggtgcccacgcccgacggcaccgtgctctatccacagcccaacggcgccaagatgatcttcccggcgaacgaccacccgagcctgcgggcgccggtcaccttccgcatcaccaccccggcggacctcagcgcggtggccaacggccggctcgtcgagcgcgtccggcgacccgacggacgggtccgctggacgtacgactccgagcagccgctcgcggcgcagctggtccaggtggcgatcgggaagttcgcgttcgccgaaagcaccggtccgcacgggctgccggtccgggacgtggtcccggacggcctggtcaccgacaccgaggcgtaccgttcgctcacccccgggcacctggcctggctggaacggcggctcggcccgtacccgttcagccgctacggcgtgctggtcggggacaccgacctgccggtggcgctggagacgcagtcgctgtccctcgtgccgagggccgacctgctgggtgcccgggtcggcgccgagcgcaacctggtgcacgagctgacccaccactggaccggcgacagcgtagccatccggcggtggtccgacctgtggctgagcgaggggcacgccagcttctacgagcgtctctactccgacacgcacggcggtgacagcttcgagggggcgatgcgggcggcgtacgagcagcacgaccagtggcgtcacgacgacggggcacccgccgaacccagcgccgagccggccctgttcaagcagatgcggtacgacggctcggcgctggtgctctacgccctgagggagaaggtcggtgaggagaccttcgacaggatcgagcgggcctgggtgacgaagtaccggggccgggccgtcggcacgcgggatttcgtcgcgctcgcgtccgaggtcgccggcgaggacctgaacgcgttcctgaccccgtggctgtacggggcgcacaccccgcccatgccggggcaccccgactggcaggtggacccggtccaggac

SEQ ID NO: 4137 - DNA, 2013 bp, Streptomyces avermitilis
  CDS (1)..(2013)
atgagaagacgtctcgccccccgtgtcgccggtgccgtccgcaggcgccgccggaccgtccgcgtgaccgcttcggcggcgctcctggtgccgctgctggccggcccgtcggcctgcgtcggcggcacgacgcccgaccggcacctgcagaacgacttcaccgacgccgcggacgactaccacgtgccgttgagcgtgctcatgggcgtgtcctaccttcagtcgagatgggactcccggccgggcgccccgagcgtcgtcggcggctacgggccgatgcacctggtggacacccaccaggaccggaccccgtccccgtcggcgccgcggcgcgggagtgcccagccacccgcggtggcggcggggccgtcggccgcgcagggggcgacctcctcgggcagcccctccgcgcagccggcggcggacctgcgacgggccgcccgcctgatcggggccccggcggggcagttgcggacggacgccgccgccaacgtgcgcggaggcgcggcgctcctggcggcgacgcaacgacagctcggcaagccgctcagcgccgacccggcggactggtgggaggcggtggcgcgcttctcgggcacgggcgacaccgcggcggcggcgacgtacgcgaacgacgtcttctcggtgatccgccggggcgcgaaccgcaccaccgtcgagggacagcacctcaccctccccgccagcccgggcgtgcgcccccacaccccgcgcccgcagggcgcacagcggccgaaggaggtcgagtgccccgcggagctgtcctgcgactggctcagcgcgccgtacgtcgagatggacgacggccagtacggcaatcacgacctggccgaccggcccagggaccagaagatcgagtacatcgtcatccatgacaccgaggcgatcctgccgtccatgctcaggaccgtgcagtatccgacggaggcgtcgtggcactactcgatccgctccagtgacgggcacatcacccagcacgtcaggaccaaggacgtggcctggcactccgggaaccagttcgtgaacgcccgctcgatcggcatcgagcacgagggattcctcacgcagcccgacgcctggtactcggagcagatgtaccggtcctcggcccgcctggtgcgttacctggcgaagaagtacggcatcccgctcgaccggcagcacatcttcggccacgacaatgtgccggccccgaccgcctcgagcatccccgacatgcacgacgaccccggccccttctgggactggcggcactacttcgacctcctcggcgcgcccctgcgtgccacggccggaccggacagcgacgtggtgacggtgctgccggacttcgccacccacaagccgctgttcacggggtgcggcaagagcggtgaaccgtgtgcgcagcacggctccagcgccgtccgcctccacaccgagccggacgaggacgccccgctgatccaggacccgggccggcgcccggacggcgacgactccacggaggacgtcaacgacctggggtcgcgggcctccgccggccagacctacgcggtcgccgggcgcggcggcgactggacggcgatctggtacctgggccgcaaagcgtggttcaggaacccgaaggaacatccgacggccgtcggtgcgagcggccggacggtgactccgaaggacggcctgagcgagatcccggtgtacgggcgggccctcccggaggaggacgcctacccggagggggtgccggagcagcccgagtcgccgcttccgtacagcctcctcgcgggccagcggtacgtgacacagtcccgcgacgtcggttcctacatcgacaggtcgtccttcagcgacacaccggacctggtggtgaagggccgggaggagtactacgagatccagttcggccaccggctcgcctacgtccgggcgagcgacgtggacgtggacgaggtgagcgcaccggccacggcacaaccgccgtcaggagagggggcgcgccggccccggcgg

SEQ ID NO: 4138 - DNA, 201 bp, Streptomyces avermitilis
  CDS (1)..(201)
atggctactggcaccgtgaagtggttcaacgcggaaaagggtttcggcttcatcgagcaggacggcggcggcccggacgtcttcgcccactactcgaacatcgccgcccagggcttccgcgagctccaggaaggccagaaggtgaacttcgacatcgcgcagggccagaagggcccgacggccgagaacatcgttcccgcc

SEQ ID NO: 4139 - DNA, 1506 bp, Streptomyces avermitilis
  CDS (1)..(1506)
atgaaccgcacacgcacgaacgaccgcttcgaccgcacccgcaccaaaagctccggcgccgcacggggcggcagccgcttcggcgccgcgaagtccggctcgccgagccgctcgggtgggcacggccgtcggccgtccgcgccgcagggcgagttcgcgctgccggtgacgaccacccccgcgctccccgccgccgagaagttcgctgatctcgccatgccgtcgcagctgctggccgcgctcagctccgagggcgtgaccaccccgttcccgattcaggcggcgaccctgccgaactccctcgcgggccgggacgtcctcggccgcggccgcaccgggtccggcaagaccctcgccttcggcctcgccctgctggcccgtacggccggtcagcgcgcggagccccggcagccgctggcgctggtcctcgtacccacccgcgaactggcccagcaggtcaccgacgcgctcgcgccgtacgcccgctccgtgaagctgcggctgaccacggtggtcggcggcatgtcgatcggcaggcagtccggtgcgctgcgcgccggtgccgaggtcgtcgtggcgactcccggccggctcaaggacctcatcgaccgtggcgactgccggctcgaccaggtcggcatcaccgtcctcgacgaggccgaccagatggcggacatgggcttcatgccgcaggtgaccgccctgctcgaccaagtacgccccgagggccagcggatgctgttctcggccaccctggaccgcaacgtcgacctgctggtccgccgctatctgaccgacccggtggttcactccgtcgacccgtccgcgggtgcggtcaccacgatggagcaccacgtgctccatgtgcacggcgccgacaagcaccaggcgaccaccgagatcgcggcccgcgacggccgggtgatcatgttcctggacaccaagcacgccgtcgaccggctgaccgagcatctgctgagcagcggggtgcgcgccgcggccctgcacggcggcaagtcccagccgcaacgcaaccggaccctgagccagttcaagacgggtcatgtgacggtgctggtggcaaccaatgtcgcggcgcgcggcatccacgtcgacaacctcgacctcgtcgtcaacgtcgacccgccgagcgaccacaaggactacctgcaccgcggcggccgcaccgcccgcgccggccagtccggcagcgtcgtcacgctggtgacgccccaccagcgccgcgacatgagcaggctgatgacggtcgccggcatcgtcccgcagaccacccaagtacgttccggtgacgcggagctgaaccgcatcacgggcgcccaggccccctcgggtgtcccggtcaccatcagcgtgccggtcgtggaacgcccccggcgcagcgcctcttcgtctcgcgggcgccgcagccgcacggcgcagaaccggcgcaacggccaggcggcacgcggttcgtcccagcggcagaccaccgtcagcgcggcggcc

SEQ ID NO: 4140 - DNA, 294 bp, Streptomyces avermitilis
  CDS (1)..(294)
ttgacactggttcagatgcagcagcgctcggtggatgcaactcccacggccgtggtcgacgtcatggacacggccgggccgcaggtctgggccgccatgaccgtcgaggtggccttgtccgtcatggccagcgcccgggccgaacacttgttcctctgcgacgaggacggccagtgcacgggcctgatcacccgggcccagctcaccgtcgtacgcgacagcccctcctacaccgatcaggtccgtcttggggacatcctcggcgacgcctcgggcgttctcgagttctcccgc

SEQ ID NO: 4141 - DNA, 312 bp, Streptomyces avermitilis
  CDS (1)..(312)
atgcgctgtgtcatcgcccgtttcccgttcgacctctccaagagcggggtggtggcctcgatgaagggcgtcaagcccgagcccatcgtgggtgagtccgtgcagatcggccgccgccactttcccgtcaagcaagtgggcgaggtcgtcacccggcaggaccgccgtgacttcagcgcccaagaagtcgtccgggccatgacccgcctcggcttcacctgccacgacctcgccgagcccgcgcccgcccgtgtcctgactccgctccagagcgcgtcggcactgctcggcacaccggcgcccgcgcccgcg

SEQ ID NO: 4142 - DNA, 1593 bp, Streptomyces avermitilis
  CDS (1)..(1593)
gtggccatgagtctgcgctcgcggctcgcgctctcctttgccgctgtcggcgccgtggtggcggtactggtcgggatgctgagctaccgcgccgcctccgaccgcgtcaccgcggagatcgaccggacgctgcggtcggtcacggtcgccctggcccgtgaccaggaccgggcgctggccctctccgacgaggtcacccagggtccggacctcttccccgggccggaccggcccggaccgggggacgaagcggagtggcaggtgaccgtgcaggccgtggcgcccgacggcacgcccacccatctcggcggcccgcccgtggcgctgccggtgtccgacgccgcgcgcgccctggccgcctccggtgaacccggggagtcgcgtaccaccgaggtcgtcgtcgatcgcgccacgcaccgccagctgaccaccgcgctgggccgtgaccgcggggctctccaggtggcggtccaggtcgatcagacgcactacgtactgggcggcatggccagggagatcgccggagccggcctcgtggtcatgctcgccgcggcgggggcgggatggctgctcgcgcggcgcatcacccggcgcctggtgcggctggccggggtcgccgaagaggtcagcgtcgacggccgcgtcgacggtgcggccctggtggacggcagacgcgacgaagtcgggcggctctcggcgtcgttcggcaggatgctcacccggctcgccgtcgcccgtgaggcccaggagcggctggtccaggacgtcgcccacgagctgcggaccccgctgaccagcctgcgcaccaatgccaccgtcctgcgccggatcacggagctctccccggacgcccgcgaccggctcctccacgacgtcgagggtgagacgcgcgagctcagccacctcgtcgactccctcgtcgagctggccctcgcccgcagccgcgaggagcccgaagggcccgtggaactggccgaggtggcccgccgcgccgcccgccgcgtgcaccggcgcacccgccgtctgttccatatcgacgccgacgacaccgtggtccacggccgccccgaggcgctcgaacgcgcggtgggcaatctgctggagaacgccgccaagttcgaccgtgacggcctcgaccccatcgaggtgcgcatccaccgaggcacggtcaccgtctccgaccgggggccgggcatcggcgccaccgacgcggagcgcgtgttcgaccggttccaccgggccgacaccgcccgtggcctgcccgggtccgggctcggcctggccatcgtccgcgacgtcgccgaggcccacggcggcaccgccttcgcgcgcccacgccccggcggcggggcggcggtcggcttcaccgcgcacagctcgcggctcttgccacggtccgctccggagcgcgcgggcggtccggagcgcgtcgccggtccggagcaggcggctgatccggagcaggcggccgatccggaccatctcgtcggcccggatcatgtcgtcgacccggaccatctcgtcgaaccgggccatgtcgtcgaaccggaccgcggcgcgggctcgtctcgaccgcgagcgacgccggacacg

SEQ ID NO: 4143 - DNA, 720 bp, Streptomyces avermitilis
  CDS (1)..(720)
gtgggccatcatgtggacgtggtgaatcgtgtcctcgtcgtcgacgacgatcgtgcggtccgcgaatccctcgcgcgggcactggagttggaggggtacgacgtcgtcgccgtcgccgacggggtgcaggcgctggcccgggcccgtcggggctccttcagcgccctggtggtcgacgtgatgatgccgtacgtcgacggggtgggcgtgtgccgtgtgctgcgcgccgacggtgaccgcaccccggtgctgatgctcaccgcgcgggccgggacccgggaccgcatcgccggcctggacgccggggccgacgactatctgcccaagccgttcgagatacccgaactgctcgcccgattacgggcgttgctgcgcaggggcgatctgacgccggacgtcgacgagccggtggcccgggccggtgacgtactgcggatcgcgtcgctgctggtcgccccggccgcccggcgtgtgtggtgggcggacgaggaactgcggctgtcgaggaccgagttcgacctgctggagcttttggtacgcaacgaggggatcgtgctggaccacgcggcggtctaccggcggatctggggccacgacgtcggcgtggacgccaagaacctcgcgagctacgtcggctatctgcggcgcaagctcgccgacgccggcgcgcccgacctgatccacaccgtgcggggcgtgggctacgcggtgcggcggcca

SEQ ID NO: 4144 - DNA, 1191 bp, Streptomyces avermitilis
  CDS (1)..(1191)
atgtcgaccgtcagcgtccgactcgcgcgccgtgcctcagtcgccgccgcgtgcgtcgccctcgccgccaccggctgcaccgccctcaactccgcgtcctccacgtcggccctggcggccaaggctcggatcccggcctccgcggcccggcacggcgccggcggggcgaacaccgcccaggtcgtggccgccgcgaacgccttcctcgcgacgctctccgacgagcagaaggacaccgtcctctacgacttcgacgacgccgccaagaagaccggctggtcgaacttcccgacccccgtcgtggcgcgcaacggcctcaagttcggcgatctcaccgacgagcaggaggccgcggccctgaaggtcatggaggccgcgctcagcaagaaggggtacgaggagctcgtcgagatccgcaaggccgacgactacctcgccacgctgccgccccgcacgcccaccccaccgaccagcactcccacggccactcccaccggcacgccgaccgccactccgaccggaggcggcggccgtcccccgggcggcggcggaggcgccaacttcggctcggagtggtactacatctccttcttcggactgcccagcaggacaggtgagttcacggtccagtacggcggccaccacgcggcctacaacctcacctacgccggcgacaacgtgagcatctcgcccaccctgaccgcggtggagccgatggagttcaactgggaggacctgtactacgccccgctggaggacaagcggacctccaccatcggggccatccagtcactcaccgccgacgagctgaccgcggccgagatcgacggaagcttcgacgacctgtacctgggtcccggccatgacggccccttcccgcagcagcccgagggcgtcctcgtcagcagcctcaccaagaagcagcgggccgaggtcaccgcgatgctgaaggcctgggtcgacgacctggacgagaaggcggccaagcggctcatcgccaagtacgtctccgagtacgacaagacgtacatcggctggagcggcgggacgacgctcgacaacaaccagacgtacgtccgtctcgacggaccgtccgcctggatcgagttctccaaccagcccggcgcctcgaccgacgggatccaccagcacacgatcttccgggacgagaccgccgactacggctgggaa

SEQ ID NO: 4145 - DNA, 1287 bp, Streptomyces avermitilis
  CDS (1)..(1287)
atgcgccgcttcctgcccgcactcctgctcgcggcactgatgctggtcggcggcctcgcgtcgccggccggcgcccacccgatgagtacctcggccgttctcctcgacatcggcgacgaccgggtcgagggagaggtgcagctgcccatcgaccgtctggccatcgccgtgcaccgcgacctcacccgggacagcgtcctcgccgccgaccgggcgttcctgaagcgctacgtcgcccggcacatcagcgccgtcggtgagaacggcacgccctgggccgtcacgctcggcacggcgtcggtccggacgatcgacggggctgcgcacctcgtccacccgctcacgatccggccgcccgacggccacgtcaccgacttcgacctgcgttacgacgtcgtcgtcgaggaactgctcacccaccgggtcatcgtcaccgtccggtacgacttcgaccgcggcatcctgaaggccgacgacgccagcaccctcggagtcttcgactgggacaccaggagtctgaaggtccccgcgggcgagggctcgtggacgcgggggttcgccaccaccgccggtctcggcatcgagcacatcggcgagggcgccgaccatctgctgttcctgctcatgctgctcatcccggccccgctggtggcgaccgggggccggtggcacgccgccgctccgtcggcgcggcgcggcatcgtccgcgtggtccacgtcgtcaccgcgttcgccgtgggccactcactcaccctggcgctggcggccgccggagtgatcgacgtgccggcccggccggtcgagacgctgatcgccttctcgatcgcggtgtccgcggtccatgcgctccggccgctggtggcccgcggcgaggtgttcatcgccagtggcttcgggctggtgcacgggctggcgttcgcctcgctgatcggcgacctcggcctcggccgagggtcgctcgtgaccacgctgctgggcttcaacctgggcatcgagctgacgcaactgctcgtcgtcgcgctgatgatgccgtcgttgctcgttctggcccgtacgtccgtctatcccgcgttccgcatcggggtggccctcgtcggcctgctgttctcggtgtcctggatgctggagcgcgcgacgctgacctccgccgacccgttcgagggcatccagacgtggctggtcgggcacccgctgctcgtcgccgcgtcggtcgccgcactcgctgtcgtcgcccggcgcaccgccccacggacgcctcgggccacgcccgaacactcaggcgcccac

SEQ ID NO: 4146 - DNA, 1074 bp, Streptomyces avermitilis
  CDS (1)..(1074)
gtgttcctcggtgagctgaccgagcggccggtctccctgtacgccgcggcggtcctgcgcatcggatacggacttctctatctggccttcctgctgcgcgagtttccgcaccgcgacgagatctggggccccggctcaccgtggacgcccgagctggcgaggcagctgttcgaccagacggggtgggtcagcatcctcaccctgtccgacggccgggcgtacttcgaggcctgctacgcgctggccctggtcacgtgcgcactgttcctgctgggctggcggaccagagcggtgtccgtgctgttcgcggtcgtggtcgcgtcgttccacgccagggcgatcttcatgacggacggaggggacaacctcgtcctcctcatggccgtgtacctcgtcttcaccgcctgcggccgacgctggtccctggatgcccgcagaacccggctcagggcaggtgcgagccctgccgcgagccccccggcgcggcaagaagccgacgggttccggcggcaactcggcgcctcccgccggaccctgacggccgtgctgcacaactgcgggatgttcgtcatcgcggcccaggtctgtttcctctacgggtccgccggcctttacaaggtgcagggtggttcctggggcaacgggaccgctctccactacgtcctgaacctcgacctgttccgcccctggcccgagctctccctcctgacggacgagcacgacgtgctgatggccatcgcctgctacctgacggtgctgctccaggtcgcctttccgttcgttctgttcggaaggctcaagtacccggtactgaccgtgctgttgggtatgcacctggggatcgcggtactgctgggactgcccctcttctcgggcgcgatgatcgtcgcggacgccgtgttcctgccggaccgctgctacctcctattggggcggctgtggcgacgcgccggccggcggacgggcagcacggaggcaggtgccccggcccgcggagaatccgcgttcctgccgccgcagtccgcggtgtcgagcccgcgcaccgcagccgctccggtaaggggacggcgcgcc

SEQ ID NO: 4147 - DNA, 873 bp, Streptomyces avermitilis
  CDS (1)..(873)
gtgctcgggagcagccgtccgcatgagcgggagggacgggcggcgcgcggcggatcgttgtcgatcccgccgcgcgccgctgaccaaagcccaggagagacagtgaggggagccgggatggaaaggccgggtggggccgtgctgggtggtgtcgcggcaccggatgcggatgcggacgaatcggagctgcccggggccgggccgacggcgccgcgggagggccggagatccgttgcgcttccaggggcttcacagcccgggtcggccctcctgcgagcggggacgacggctgccgtggccctgtgtctgacgacggtcctggtccatgtgctgctggtgtttctgcacgtggcgcccccgaacccgctctcccagcagtacagccggcagatcaacgcatgggtcttccccctgttcgagcagaactggcgactcttcgccccggacccggagtcggtcaaccgccagatcgtggccaggaccatgcacaccgccccggacggcagcgtgcgggtgagcgactggtccgatctgaccgccgtcgacgacgccgcggtgcggcacaacccctttccgagtcacacggcgcagaacatgctgcggcgggcctggagttgctacctcgaaacccacggttccgacgacctgccgcgcacgcagcgggcgctgatgacgcagcggtacctggccaacatcgcggcggaccgcgtggccgcccatcgtggcgggaccttcgagtccatccaactacgagtggtcactctgcccgtcgccgcgcccgccgccgcagacggcacccgaccggccacggtcgcgccgaagcctgtcgacacgcggtatctgccctggtggaaggtggaatcccatggaaac

SEQ ID NO: 4148 - DNA, 1284 bp, Streptomyces avermitilis
  CDS (1)..(1284)
atgacgctggacatccctgaagcgcctctacggcgcaccctgtcggtttggatcgcggcggtaacggccttggtgatggccgctgccgtactcgtactgacaccgacgcgcgcacatgccgccacagctgtccctctgggcacggcggccactttcggagtactggctggttcgacggtcaccaacaccggcccctcggtgatccagggcaatgtcggagtgagtccggggtcggccatcgtgggtttcccgcccggtcaggtgctggcgcccggagtcctccaccccggtgacgccacggctctcggcgcccagaacgatctgagcatcgcgtacggccaggctgccggacagactccaccgaccgccacgtacctcgacgatcctcacgagttcggtgggcagacgctgactccgggcctctacaaggcgaacgtctccgccgggatcaccgacacactcaccctggacgccctgggcaatcccaatgccgtctgggtattccagatcggttcgacgctgactacggcgtcagcgagccatgtgtccctcatcaatggcgcctcgccgtgcaatgtgtactggcagatcggcagctcggccactctcggtaccaattcctcgttcgtgggcaacatcctggcccaggcctcgatcacagccaccacgaacgcggtcatcaacggccggctgctggcccgtaccggcgccgtgacgctggacaccaacacgatcttccagggtgggtgcgcagctgggaccggtgggaccacgggtgggaccaccggtggcaccgtcacgggcggcgcgacgaccggcgcgatcggcggagtgatcggcggcgtcatcggcggtgtcgtcgcggggactacgacgggcggcgtttccacgagcggcggtaccacgggtgccaccagtggtggcaccaacggcggcgtcaacggcggtgtgatcggcggcggcaacggcggcgtgatcggcggcggcaacggcggcggtaacggtggcgtgatcggcggcggcaacggtggcgtgatcggcggcggtaacggtggcggcaacggcggacccggacaccaccaccccggcggacagccgggcaggcccggtgatcacgaccatggcgggcagcccggtgagcaccacggccacgatcacggcgggcagcctggcgagcaccacggccacgagcacggcggcaagcccggcgccggcgagcaccacggccacggcgagcacagcggcaagcccggcaagcacgacagctatggcggcgcccgtagc

SEQ ID NO: 4149 - DNA, 354 bp, Streptomyces avermitilis
  CDS (1)..(354)
atgattcaggcagccgatatccgtgagtggcgcgaccacgatgtcgtggacccgaaagggcgcaagatcggtgtacttgaagcgatctacgtggacaccaccacggacgaaccggccgtggccaccgtccggaccgggctgcccacccgccaacgcctcgtcttcgtccccctcgacaaggcagtcctcggaccgggttatctcaaggtctcctacgccaagagcctggtgaagaaggccccttcgatcggcacggacgacattctgcccgccgagcaggaggaatcgatcttccagcactacgacatgccctaccagccgggcccgaacggcgaacgtcaactcgcgcgccgc

SEQ ID NO: 4150 - DNA, 1767 bp, Streptomyces avermitilis
  CDS (1)..(1767)
gtgctgaagaaggcgccggccgcgatcaccctcaccttcaccgagtccgtcggcctgctcgacgactccttccgcgtcctcgaccccgagaaccggcgcgtgcacatcggggagccgcagcacgcgggcggccgttccgagaccgcgcgcgtcaccctccccgacgacatgggcaccggcacgttcacggtgggctggcgggtggtgtcggcggacagccaccccgtttccggcgctctcaccttctccatcggcaagccctccgcgaccacggcggtcataccgacccaggccgccggtgacaccgcctccgccacgctctacgacatcgcccgctacttcgcgtacggcggtctggccctgctgctcggcacgatggtgttctccctggtcaccggggtcgaggcggcacggggtctgcttctgacgggctggtggacgctgctcgcgtcgaccatcgcgctgctgctgctgcgcggcccgtacgaacgcggcggcggtccggcggcggccttcgacccgtcggtcctcgctgagacggcgacgagcaggccgggtgtgacgctgctggtccggctggtgctgctcgcgggggcggcgttcttccccgtacgggccgggggccggtggtggaaggcgggcggcggcctcctgaccctggcgctcgcgggcacgtgggcggcggccgagcacgcctccgccggggtccaggtgcccgtggcgatggtctccgcggttctgcacctgctggcgatggcggcgtggctcggcggtctggccgccctgctcacggccctgtaccgggccccggaagaactcccggccagtgccgtcacccgcttctcccgcctggcgctcaccgccgtcaccgtcctggtggccaccggcgtctaccagtcctggcggggcctgggctccctggacgccctcgccaccacgtcgtacggcaggctcctggtggccaagctggtcgcggtactgctgctgctggccgcggcgacgtactcgcgccgctggacggcacgcctggcggcacccgtggagcggcgggcggacgtgcgggaacgggtcctggagccggtgggggccgcggcggacgccgaggtctccggcaccgacacgagcgccggcaccggcacggacacgagcgccggcaccggcaccggaacgggctccgacagcggcgccgagaccgggacgggcaccgagaccggctccgacaccgcaaccgaaaccggtccgcagtcggggccgctcccgcccaccgctggcggtgacccaggggcgtaccggcgtggattgcggcgctcggtgctcgcggaggcgatcgtcgcgatcgtggtgctggtgatcacgacgctgctgacgggaacgcagccgggccgggcggccacggaggcggcggcttcggcggcggaggcggcgcggcccatggcctcgacgacggtgatccccttcgacgtgggcacaccgggcggccacggcaagatacagatcgaactgacgcccggccgggtgggcgagaactcggtgcaggcggtgatcttcggccccgacggcggtttggcgacggtccccgaactgcgcctcaccttcaccctggagaagcaggacatcggccccctcgacgcgaaactcgcggaccgcgggggttattggacctcggacaccctcaacctccccctgccgggcacctggacgatgaaggccacggtccgcacgacggacatcgaccagatcacggtgtcgcggacggtgcggatcgag

SEQ ID NO: 4151 - DNA, 405 bp, Streptomyces avermitilis
  CDS (1)..(405)
ttggggacggggctgggggccggggacgggatcgtggggcgtgccgggaccgggggcagcatcacgcacatcgcctccatcgaggcccgtcaccccgccccgctgcacgcccactactccgcgtccaaggcggccgtcgtgatgcacgcccgttcggcggcgctggagtacgggccgtacggcgtccgcgtcaacaccgtctcgcccggcctcatcgaccgcgagggtctggcggaggcctggccggagggggtgcggcggtggcagcaggcggtgcccaccggacggttggggcgcccggaggacatcggcgacgcctgtgtgttcctcgcctcaccgctcgcgtcctggatcaccggccacgatctcgtggtcgacggcggggtgtcggcgcgaccgacctgg

SEQ ID NO: 4152 - DNA, 921 bp, Streptomyces avermitilis
  CDS (1)..(921)
gtgccggccgtgagcggcctgctggcggggcaggtggccctggtgaccggggccgcgggcggcatcggacgggggatcgcgctgcggttcgcgcaggagggcgccgcggtggcggtgcaccaccgcacgcgctccgccgacgacgtggtcgcgctcgtacgggagtccggcggcgcggcgatcgcgctgcgggcggacctgaccgacgaggccgagtgccgtcgcctggtgcgtgcggcggccgagtggggcggcggccggctgacggcgctggtcaacaacgcgggcgtacagccgacgcaggccctgcccggcatgacggcggctcagtggcgggcggtgctcgacaccaacctgtcgagcgtcttcgcgtgcactcaggcggcggcggaggtcatgcgcgcgaacggggacggagacggggttggggacggggctgggggccggggacgggatcgtggggcgtgccgggaccgggggcagcatcacgcacatcgcctccatcgaggcccgtcaccccgccccgctgcacgcccactactccgcgtccaaggcggccgtcgtgatgcacgcccgttcggcggcgctggagtacgggccgtacggcgtccgcgtcaacaccgtctcgcccggcctcatcgaccgcgagggtctggcggaggcctggccggagggggtgcggcggtggcagcaggcggtgcccaccggacggttggggcgcccggaggacatcggcgacgcctgtgtgttcctcgcctcaccgctcgcgtcctggatcaccggccacgatctcgtggtcgacggcggggtgtcggcgcgaccgacctggtgaggcggttcgagccgacccgccgacagggttcgagccgacccgccgacagggttcgagccgacccgatgacggggtccgggccgaccggg

SEQ ID NO: 4153 - DNA, 477 bp, Streptomyces avermitilis
  CDS (1)..(477)
gtgaccccagaagacctcgtcgcccactaccgcctggagccgatcccccgcgagggcggccgtttccggcgcacctgggcggggcccgaacgcgccgacggacgccccgaaggcaccgcgatcatggccctgctcaccgcggagccggacgacttctccgccctgcaccgcctcccggccgacgaggtctggcacttctacctcggcgacccgctggaactgctcctgctcgcgcccgacggcagcgcgcgcacgccggtgctgggaccggacgtcctggacgggcaggacctccagtacgtcgtgcccgccggtacgtggatgggggcgcgggtcgtcgcgggcggggcgtggtcgctcttcggctgcacgatggcgcccggattcacgtacggcggctacgagcacggggacgcgggggagttgagcgtgcggtatcccgccgaggcggctcgcatcgccgggctgtgccggccg

SEQ ID NO: 4154 - DNA, 612 bp, Streptomyces avermitilis
  CDS (1)..(612)
atgaccgctgagccgtacgcccccgcccgccgggccgtccacgaacaggtggtcgaaggcttcggcaccgtccgcatcctgcccctcgacccgcccgccgacgtggacgtggtccacggctgggtgagcgaggagcgcgccgccttctggggcatgaacgggctgacgaaggagcaggtcctggaggtgtacgcccatctggacacgctcgacacccaccacgccttcctcgcggtcaaggacggcgaaccggtcgccctcttccagacgtacgagccggaggccgaccgggtcagcgagtgctaccaggtcgaacccggcgacatcggcgtacatctgctgctcgccccggccggatccggcggcggccgtcccggctggtcggccgcgctgctgaccgcgttcacctcgttcgtcctggtcggcctggaccggcggcggatcgtggtcgaccccgacgaacgcaacacgaaggcgatcgcccgcttcgtacggcagggcttcgtgcccggcccgcgggtggtcctgcccgagatcgacctgccggacgtgtacctgcccgagaagcgtgcccagttggccttcctcacccgggaggcggcgttcggaaag

SEQ ID NO: 4155 - DNA, 2205 bp, Streptomyces avermitilis
  CDS (1)..(2205)
gtgaccatcgagatctaccgcgacgcctggggcatcccgcatctgcgggccggcggcgcacgcgaactcgcccgcgcccagggccgggtcacggccgtcgaccgggcgtggcagctggaggtcgagcggcatcgcgcgcggggcacctcggcgtccttcctcggtacggaggccgcggcctgggacgtgttcgcgagacggtcccgcctcgacgacacggccagacgctgcttcgccgccctggagcggacggacccggagacggcggactgggtccgggcgtacgtggacggtgtcaacgagggtctggccgaaggggcccgccgcgcaccggagttcgcggccaccggtctggtccccggccgttgggagccctggactccgctgggcgtctggctcggtacgcacatcctgttcgccggcttccccgccaagctgtggcgcgaggaggtcgtacggcggctgggtgacgaggcggtcggtctgttcgccaccgacgggccgggcaccgccggcagcaacggctggctggtgagcggcgaacggacggtcaccgggcagccggtcatcgcgggcgacccgcaccgcttcatcgaggaccccggcgtctaccagcagatccgcctctcctgccccgagttcgacgtcgtcggcctcgccgtcccgggcgttcccggcatcgcccacttcgcccacacgggcaaggtcgcctgggccatcaccaacgcgatggcggactaccaggacctgtaccgcgagcggctgcggcgcaccccggacgggaacgggaacgggaacggaatcggagacgggaccgggaccggggacggagccgggggcggggcgggcgtcgaggccctggacccggacggcacgtggcggcccgcggcgcggcacacggagacggtcgaggtggccgggggcgacccggtcgaggtggaggtgatcgagaccgcccgcgggcccgtcgtcatcggcggcgtcaccggaagcggcgacgatccgatcagcctccgctacccgccccgcgtcaccgaggacctaggcttcagcgccctcctccccctcctgcgcgcccgcgaggtcgccgatgtggaccgggcgttcgacctctgggccgagccggtgaacgtcgtccaggcggcggacaccgagggcggtctgctgcaccgcgtcgccggaaacgtgcccttgcgcggccgggacaaccgcacgcggctcgtccccgcctgggagcccggtcacgagtggcacggctggcacgagatgccgcgcgggacggtcgaggacggcctcgccgtgatggcgaaccagcgcggcccggcgacccccctcggcgtcgagttcgccccgccccaccgcgcggcccgcatccgcgaactgctggaggagcggcccacctggtcggccccggacatggcggccatccacatggacacccatctcgcctccgcgggagccctgttggaccacctggccgccctcgacggcctgaccccgcaggcgtccgccctgcgcgaccgcctcctgagctgggaccgccggatgacggccgccagcacggaggcggcccagtacgcggagctgcgcggcgcggtcgtacggcgcctggccgcgcaccccgccttcaccgcgctgaccgacccgcccgcctacccggaggtcttccgcccctggctcgccctcctcccccgcgtcggcttcgccctcgaaaacctgctgaaggcggacgagctgtacggcatcgaccgcgccgccgtcgtccgggaggccgtcgcggaggtggccgcggagacggccgggaaggcggccgcggagacggtcaaggcggcgggagcgtccggcacctggggcgacacccaccgcctggccccctggcgcgcgctccccaccgccgcgtacgccgcgccggcctcgcccgcctcgtacgcgtacgacgaacccggtctgtcgggcgaccacgactgcgtgctgtgcacctccgcggtcccggggctgaccgacctcagtgcgcgcggccccgccgcccgctacgtctgggacctcgcacggcgcgaggacagccgctgggtggtcccgttcggcgcctcgggtgtccccggctcaccgcaccaccgcgaccagctccccttgtggctcaagggggacctcgccccggtcgtcaccgactgggagcacctcacgaaggagaactccgatgaccgc

SEQ ID NO: 4156 - DNA, 624 bp, Streptomyces avermitilis
  CDS (1)..(624)
atggaccccaagcaccccaagagcgtcacgctccatctcgcccagcagcccgaggccgacgaactgctggggcgcagcccgctggccgtgatgatcgggatgctgctggaccagcaggtgccgatggagtgggccttcgccgggccgtacaccatcgcccagcggatgggcacggacgatctcgacgcgcacgagatcgcggcgtacgaccccgaggccttcgcggaactcctgtccaggaaaccggccgtgcaccgctaccccgggtccatggccaagcggatccagcagctgtgccagtacctggtggagcactacggcggtgacgcgagcgcggtgtgggagggcgtggagagcggcgcggaactgctgcggcggctgaaggaactgcccggcttcggggctcagaaggcacagatcttcctggccctgctgggcaagcagttcggcgtgcggcccccgggatggcgggaggcggcgggaccgtacggcgagccgaaggcgttccgctcggtcgccgacatcaccgggcccgagtcgctggccaaggtgcgggcgcacaagcaggaactgaaggcggcggccaaggcggagaaggccgcgaagtccccgaagacggggaag

SEQ ID NO: 4157 - DNA, 666 bp, Streptomyces avermitilis
  CDS (1)..(666)
atgaccgaggcaccgaacggctctcccaggggtccccagtacgacgaccggcgcgtgcacgcggccgcccgtgatccgctggccgaccgctccggccgcgatgccgtcgagggccccctccacgtactgtcccgcaccgcctggcactccctcctggtcgccgggatcgcggcgctcgtcctgggcgtcatggtgctggcctggccggagacgacgctggtcgtggcgggcgtgctcttcgggctctacctcctcttcagtggggtgctccaactggcctccgccttcgggacgcacgtcgcgacctccctgcgggtcatggcgttcatcagcggcaccctgtcgatcctgctggggctgttctgcctccgcggggcgatgcagtcgatcctgctgctcgcgctgtggatcggcatcggctggctgttccgcggagtcaccctgaccctggccgccgcgtccgaccccgaggcgccggcccgcggctggcagatcgtcctgggcatcgtcagcttcctggcggggatcgtgctgatcgtgtccccgttcacctcggtcggcgtcctcgcactcgtcggcggctgctggctcatcgcggtgggcgtcaccgagatcgtcacggcgctccgcatccgccggatcaccaagcagctgccgcccgcactg

SEQ ID NO: 4158 - DNA, 417 bp, Streptomyces avermitilis
  CDS (1)..(417)
gtgccccgcccatacgccaagacgagggatctcccggcccgcccggtgaaccaccccggtccggcggggagatcacgtcccatgagccccgaccggcgccccgcgcactcgccgcgccggcgtccccggctgcgggtgctgctcatgctgctgctcgccctgctggtcgcgggggcgcacaccgaggccctggcagggccggccgccgcggtgtccaccgagtcgtacggcgcggagcacgacgtactcggcacagcgctgcgcccaccggcgcggcccggccatccccggaccgccccgctgcggcctgcgccccgcgccgtcggatgcccgcagccgtcggctccccttcccttcgccgtacggccgccgcactcccccgtgctgcacgccctgcgcacggtggtcctgcgctgc

SEQ ID NO: 4159 - DNA, 1572 bp, Streptomyces avermitilis
  CDS (1)..(1572)
gtgccgcaggccgagacccccgaggtggccgggagtgctcccgcacttccccaggaggccctgaagatcgcttcggggtacgccttcgccggtcccgccctcgatctgggcgccctcctgtgggacggccggtgcctgccggacgcgcagatccgcatcccgctgcccatgctcaaccggcacgggctggtcgcgggcgccaccggcaccggcaagaccaagacgctccaactgatcgccgagcagctgtcggcgcagggcgtgccggtgttcctcgcggatgtgaagggcgacgtctccggcatctcggcgcccggccgggagaacgaccgggtgcacggccgggccgccgaggtccaccaggagtgggcgccggccggctttcccagcgagttctacgccctgggcggcatgggccacggcatccccgtacgcgccacgatcaccagcttcggaccggtcctgctgtccaaggtgctccagctcaaccagacccaggagcagtcgctcggccttatcttccactacgcggaccagaagggtctggagctggtggacctgaaggacctgcgggccgtggtcgccttcctgacctcggacgagggcaagcaggagctgaaagccctcggcgggatctccacggccacggccggggtgatcctgcgttccttcacggcgttcgaggcgcaggggatgagcccgttcttcggggaacccgagttcgacacgagtgagctgctgcgcacggcgtccgacggccggggcacggtctcggtcctggaactcccggccgtgcaggacaagccgcagctcttctcgaccttcctgatgtggctgctcgcggacctcttccacgatctccccgaggtcggtgacgcggatcagccgaagctcgtcttcttcttcgacgaggcgcatctgctcttcaacgacgcgtcgaaggcgttcctcgactccatcacgcagaccgtccggctgattcgctcgaaaggggtcggcgtcttcttcgtcacgcagaccccgaaggacgtaccggcggacgtcctggcccagctcgggaaccgtgtccagcatgcgttgcgcgctttcacgcccgacgaccagaaggcgctgaagtcgacggtgaagacgttcccgaactcggcgtacgacctggaggaggtcctgacgggcctgggcaccggcgaggcggtggtcaccgtactgagcgagaagggcgcgccgacgccggtggcggtgacccggctgcgggccccggagtcgctgatggggccggtcgacgcggccgtactggaccaggcggtgaagtcgtcgcccctgtacgggcggtacgcgcgggcggtcgaccgggaatcggcgtacgagaagctgacggcgcgggaggcggaggcggccggccgccgggaggaggagcccgcggcccgggggcgcaccgcggctcccgccgaggagccctcggtcgtcgaacaggtggtcggcagcggggtcttcaagtccctggcccgctccctgggcactcagctcggccgggagatcacccgctcgatcttcggtaccgcgaagcggagacgg

SEQ ID NO: 4160 - DNA, 294 bp, Streptomyces avermitilis
  CDS (1)..(294)
gtgatcttcaagcgcatcggaaacggccggccgtaccccgaccacggccgggaaagcacccggcagtgggcggacgtcgcgccgcgcccggtccgcctcgatcagctcgtgacgaccaagggccaactcgacctggaaacgctgctcgccgaggactccacgttctacggcgacctcttcgcgcacgtcgtgaagtggcagggcgacctgtacctggaggacgggctgcaccgcgccgtccgcgcggcactccagcagcgccaggtactgcacgcacgcgtgctcgaactggac

SEQ ID NO: 4161 - DNA, 627 bp, Streptomyces avermitilis
  CDS (1)..(627)
atgggcggcgagtaccggatcacgggggacaaatacccgcggatgcgccgcccccgagggcgccgcaggctcgtgttcgcggtcatcgcgtccgcggccgcgctgggcctgatcggctggggcaccctgcagctcatcgacgtcttcacgggcggcggcgaccgggcgaccgccgcgagctccaaggcgcactgcgcgaccggggcgagcccctccgccaccccgaccacagccgcggcgaaggcacttcccgagccggggaagatcaccgtcaacgtcttcaacgccacgccccgcagcgggctcgccaagaagaccgcggacgagctgaagaagcgcggcttccgcatcggcgacgtgggcaacgcgacgagtgagtacgacaagaaggtcaagggcgtcggcatactgttcggccccgaggcctccctcgacacctcgctgccggtcctcggcacgcagctcgccgacgccgagcgccgcacggacgcgggccgcaagggcacggccgtcgacctgatcatcggcaccggcttcaaggcgctgacgagcaaggcggacgccgacaaggccctggccgagctgaccggtcccgcgccgacgtccaccgccacgaagaagaactgc

SEQ ID NO: 4162 - DNA, 633 bp, Streptomyces avermitilis
  CDS (1)..(633)
atgcgtctccacgtcgtcgaccaccccctggtcgcccacaagctcaccactctccgcgaccagcgcaccgactccccgaccttccgtcggctcgccgacgagctggtcaccctgctcgcctacgaggccacccgggacgtgcgcaccgagcaggtcgacatcgtgaccccggtcgccccgaccacgggcgtcaggctgtcccacccgcgcccgctggtcgtgccgatcctgcgcgccggtctcggcatgctcgacggcatggtccggctgctgccgaccgccgaggtgggcttcctgggcatggtgcgcgacgaggagacgctccaggcgtccacgtacgcgacccggatgccggacgacctttccgggcgtcaggtgtacgtcctggacccgatgctggccaccggcggcaccctcgtggcggcgatccaggagctgatcaagcgcggtgcggacgatgtgaccgccgtggtgctgctcgccgccccggagggcgtcgagatcatggagcgcgacctggcgggcacgccggtcacggtcgtgacggcctcggtcgacgagcgcctcaacgagcacggctacatcgtccccggcctgggagacgcgggggaccggatgtacggggctgccgag

SEQ ID NO: 4163 - DNA, 549 bp, Streptomyces avermitilis
  CDS (1)..(549)
gtgtacttcgccgcactgctcgcgcgcaccgaagacgggtgggaagcgagcgacacagagctcgacgatgtggaaaccctgtcggatctgaccgacctggcccgtgaagcctcggacgaggacacggtgctcctgctcatcgagcaggaggacgcgtggttcggggtcctccgcgtggatggcgaggaggaccctcgtatctacgtctcggacgccgccgcggctgcccgcagctcgtacggcgagatcctgctcacggacgaactgctaggacgggagcccggcgacgacgacgtcgccgacctggactccctcgacctcgacggcaccgaggacggtgaacccgacagcgacacggacaccgccgacgacgacgatgacgacggcgcgaccggcgaggccgcggtgtcgcacagccccgtcggcgacagccagatcctcgacgacctgggcgtcggcgagaaggagctgcgcgctctcgacgccgacgacgctctcagctcgatcgccgaggccctgggagccgcggaggtcctggagaccgtccgc

SEQ ID NO: 4164 - DNA, 426 bp, Streptomyces avermitilis
  CDS (1)..(426)
atgcggctcgccctgacggaggccgtacgcgccgccgagagcgcggacgtccccgtcggggccgtggtgctggccccggacggttcggtgatcgcccgcgggcacaacgaacgcgaggcgaccggcgatccgacggcgcacgcggaggtactggccgtccggcgggccgccgaacggctcggccggtggcggctgtccggctgcaccctcgtggtgacgctggagccctgcacgatgtgcgcgggcgcgctcgtacagtcccgggtggaccgggtcgtctacggcgcccgcgacgagaaggccggcgcggccggttccctctgggacgtcgtacgcgaccgacgcctcaaccaccggcccgaggtgatcgagggcgtactcgccgacgagtgcgccggcctcctcacggagttcttccgcgaacgc

SEQ ID NO: 4165 - DNA, 921 bp, Streptomyces avermitilis
  CDS (1)..(921)
atggtcgggtacggcgtcgccgtgcggaagcacctgatccccgccctcggtgctcaccggctggacaaactcaagcccgagtacatcgaggctttctacgggcgcatggtcgccgacggccggaaggcggggacgatccaccagattcaccgcaccttccgcaccgcgctgaacgaagcggtacggcgcggccaccttgcccggaaccccgtccaactcgccaagtccccgcgcgtcagcgaagaggagatcgagccctacaccgtcgaagaagtacagcggctcttgcgggcggccgactaccgcaggaactccgcccggtgggccgtcgccctcgccctcggactccggcagggtgaggcgctcggactcaagtgggcggacgtcgaccttgaccggggcgtgctcatggtccggcggagccgccgccgaccgcgctacgcccacgggtgcggggacacctgcgggaggaaagccgggtactgctcgcagcgtcagcggaccaacccggagacggctgacacgaagtctcgcgccggtcggcgggccgtgggcttgccctcacagctcgtagacctgctgcggacgcaccaggccaagcagcaggccgaacgagcggcggccggcgccgactggacggacgaaggatggctcttcgcgacgccgaccgggcgcggcacatcaccccggacggattacgacgactggaaggagttgcttgacgatgcgaaggtccgagacggccgactgcacgacgcccgtcacaccgccgccacagtcctgctgatcctcggagtctcggagcgggccgtcatggggctcatgggctggtccaccacggccatggctgcgcggtaccagcacatggtggactcagttcgcagcgatgttgctcgtcagcttgacgggctcatctgggag

SEQ ID NO: 4166 - DNA, 231 bp, Streptomyces avermitilis
  CDS (1)..(231)
gtgctggtctacctcgcagccagccatgacgagctgtgggcgaggatcagcaagcgcaacgagttccacgcgaaagatcccaactcgatctacttctcggagagcgacctccagcggtaccgcacccggttcatcccccctcaggcagacgaaccgcacctcgtgtacgacggcgatactgcggccgtaatcgcggctctggacgcctccggccctgggtgcgcagagggt

SEQ ID NO: 4167 - DNA, 177 bp, Streptomyces avermitilis
  CDS (1)..(177)
gtggcggtgcagtcgaagaagatcgctctctatgtgctcgtggtcttcgtgctctacgtgatcatcacagacccggccaaagcggccgactatgtccagatagggttcgagggcatctccaatgccgctcaggccatcggcgacttcatgtcatggatcgccgacggggccaagaac

SEQ ID NO: 4168 - DNA, 291 bp, Streptomyces avermitilis
  CDS (1)..(291)
gtgatccgccacttggtcctcttcaagctcaatgagggcgtcgagcgcgacgacccgcgcgtcgtggagggcgtacgcgccttccgcgccctcggcggtcagatcgacgagctgcgcttctgggagtgcgactggaacatcaccgaccggcccatcgcgtacgacttcgcgatcaattcggcggtcgaggacacggacgccctcaagcgctatctggagcacccggcacaccaggcgggcgtcgcactgtggcgggagttcgccacgtgggtgatcgccgactacgagttc

SEQ ID NO: 4169 - DNA, 927 bp, Streptomyces avermitilis
  CDS (1)..(927)
ttgtcggccagtactgcgccaccccaggaaggtgctccggctcccgctccggccccctccgtcctacccgccaccgcccccgcccaggccgccacccccgttcagacccccgttcagacccccgctcccacccagttccaggacaccgccgccgcccccgagaagcgccgcggcgccgacacccgcgccctcacccaggtgctcttcgcccagctcaaggacttgcgtccgggcagtccggaacacagccgcgtccgcggggcgctcatcgaggccaacctcccgctcgtccgctacgcggccgcccgcttccgcagccgcaacgagccgatggaggacgtcgtccaggtcggcaccatcggcctgatcaacgcgatcgaccgcttcgaccccgaccggggcgtgcagttcccgaccttcgcgatgccgaccgtcgtgggcgagatcaagcggtacttccgcgacaacgtccgtacggtccacgtcccgcgccggctgcacgaactgtgggtgcaggtgaacagcgcgaccgaggacctgacgaccgccttcgggcgctccccgaccacggccgagatcgccgagcggctgcgcatcaccgaggaggaggtgctctcctgcatcgaggccggacgctcgtaccacgcgacctcactggaggcggcccaggagggcgacgggctgccgggactcctcgaccggctcggctacgaggacccggccctcgacggggtcgagcaccgcgacctcgtacggcatctcctcgtacagctgcccgagcgcgaacagcgcatcctcctcctgcgctactacagcaatctgacgcagtcccagatcagcgccgaactgggtgtctcccagatgcatgtgtcaaggctgctcgcccgtagcttcgcgcgactgcgatccgcaaacaggatcgaggcg

SEQ ID NO: 4170 - DNA, 921 bp, Streptomyces avermitilis
  CDS (1)..(921)
atgtccgcagaccagggcagctcgaaggtgctcacgctcacgaagagcgaatccgcgcccgacgtgcttcatgacgtcccggccgtcccggcctcggaagccccgacccttccggccccggaccttccggccacggaagtcccggctccgcagacctcgggggccatcgacacccgcaccctgtcccgctccctcttcctgcggctcgccgcactcgacgagagcagcccggagcgcgcgtacgtccgggacaccctcatcgaactgaacctcccgctcgtacggtacgcggcagcccgcttccgcagccgcaacgagccgatggaggacatcgtccaggtcggcaccatcggcctgatcaaggcgatcgaccgcttcgactgcgaacgcggcgtcgagttcccgacgttcgcgatgccgacggtcgtgggcgagatcaagcgcttcttccgggacacgtcgtggtcggtccgcgtgccgcgccgcctccaggagctgcgcctggccctcaccaaggcgagcgacgagctctcccagaagctggaccgctcgccgacggtcgccgaactcgccgccgtcctcggcgtgtccgaggaagacgtggtcgacggactggcggtgggcaacgcctacaccgcctcctccctcgactccccggcccccgaggacgacggcggcgagggctcgctggccgaccgcctcggctacgaggacacggcactggagggcgtggagtaccgcgagtcgctcaagccgctgctcgccaagctgccgccgcgcgagcgccgcatcatcatgctgcggttcttcgccaacatgacgcagtcgcagatcggcgaggaggtcggcatctcacagatgcacgtctcccgcctgctgacccgcacgctggcccagctgcgggaaggcctcatctccgac

SEQ ID NO: 4171 - DNA, 813 bp, Streptomyces avermitilis
  CDS (1)..(813)
atgcgtcgagggccgagtcaaaggctgagtcgaggactgagcggagggcctggccgtaggccgggtgcagcaccgacacatggccgccgaggcgctcttgcgggcgcctcggcggctttggtctgcctgggagccgtactggccgcgtgcggaaacggcgggggcggcggggggtatgccgcggtgggccccggggacacaccccgggcgtccggggcggcggctcctacgggggatgtgacgctggtgccgctggacggtgcgtccgtctccggcagccccggccgaaagtcttcggcggccgacggcaactcacccggcggcgaaggcggttcggggccgtccgcgtccggtgcgccggaaggctccggttccgcgccgtcgggcggccgtgccgaccccggtcgtgcgcacggaggttcgccgaccccgtcggtgtcgtccggcggcgggggcgggggcggcggcggtggcggcacgtcgacgggcgggagtgcgacgctcggcgggcccgccgcgctgagcgtgagtactcccgtgcgcgaagcgtccgacaagcggtggtgcgagaaggtgaccgtttcctttcacaacaccggtggcggcgcggcgcgttcgggcacggtgaccttcggtacgcacatcatcggggcgctcgggatcgactgggcgacgatcgagtccaccgaggacctgcccgtcccgatcgccgccggcgccacccggaagaagacctggacggtgtgcgtcgacgcctggcgcgtaccgctgggcatgcacatcgagacccgggacgtgtccgtccagggggag

SEQ ID NO: 4172 - DNA, 276 bp, Streptomyces avermitilis
  CDS (1)..(276)
gtggccgagggcgaggacgtccggcccggcaggggccccacttgggtagtccccgcgtattcgctagggtcctgggccatggctaacacccagggccccgagggcaactacgaccccgccggcagcacccagatgttccgtgccttcgtcgacgagggcccgcagggccgtcagcagccgcaggcgcccgctcccgccggaccccgcctcggcctgatcgtcggcatcgtcgtcgccgtggtggtcgtcgcggccgtcgcctggctcgcgctgaag

SEQ ID NO: 4173 - DNA, 513 bp, Streptomyces avermitilis
  CDS (1)..(513)
atggccgagcagacgcagtacgaggaactggcccgtcagctcagcgccttcggtgccgtgaagcgggacatgacgcggatcctgccgcacgactgtcccggcggctcggccgccgtgctcacgctgctcggccgccacggcgacatgcggatgagcaggctcgccgagctgctcgccgtggacatgtcggtgaccagccgccatgtcacccacgtcgcggaccggggctggatcgaacggtcccccgaccccgcggacaagcgctcgcgcatcctgcacctcaccgctgcgggaaaggagcagctgggcgagctgtcccggcgctcgtcgcagctcctggccgaacggctgagcgactggtccgacgacgaggtcggtctgctcatccagctcatggcccggctgcgcgagagcttcggcgactgccgctccacgctgcggcccccgcacccgtattcgacggaggccgacgacgtagtcggcccgcccgttccgaccacccgtacacccgca

SEQ ID NO: 4174 - DNA, 2559 bp, Streptomyces avermitilis
  CDS (1)..(2559)
atggcaacgaccacaccagccggtgtgcggggctctcacgccaagcacggaggcggtcccgacggcgccccgatgacgcaccggcagatcatggaggccctctccggtctcctgctcggcatgttcgtcgcgatcctgtcgtcgacgatcgtctccaacgccctgcccgagatcatcggtgacctgggcggcggccagtccgcctacacctgggtcgtcaccgccgcgctgctgtccatgaccgcgaccacgcccctgtggggcaagctcgccgacctgtacagcaagaaggcactcgtccagatagccctcgtcatctatgtgctgggatcggccgccgcgggtctgtcccagaacgccggcacgctcatcgcctgccgggtggtccagggcgtcggcgtcggcggtctctccgccctcgcccagatcgtgatggccgcgatgatctccccgcgcgagcggggccgttactccggctacctcggcgcgaccttcgccgtcgccaccgtcggcggcccgctgctcggcggtgtcatcaccgacacctcgtggctcggctggcgctggtgcttctacgtcggtgtgccgttcgcggtcatcgcgctgatcgtgctccagaagaccctgcacctgcccgtcgtgaagcgggacgtgaaggtcgactggggcggcgcgttcttcatctccgcggcggtctcgctgctgctggtctgggtcaccttcgccggtgacaagtacgactggatctcgtggcagacctacgcgatggtcggcggcgcgatcgtcctcgggctgctgttcgtgctggtcgaggccaaggcgagcgagccgatcatcccgctgcggctgttccgcaaccgcaccatcaccctctcctccatcgcctcgctcttcgtgggtgtcgcgatgttcaccggcacggtgttcttcagccagtacttccagctggcccgcgacaagtccccgaccatgtcgggcgtgatgaccatcccgatgatcggtggcctgttcatctcctccaccgtctccggccaggtcatcaccaagaccggcaagtggaaggcctggctggtcagcggtggcgtcctggtcacggcgggcctcggcctgctgggcacgatccgctacgacacggactactggaagatcgcgatcttcatggcggtcatgggtctaggcatcggcatgatgatgcagaacctggtgctgtcgacgcagaaccaggtggcccccgaggacctcggctcggccagctcgaccgtcaccttcttccggtccctcggcggtgcgatcggtgtctccgcgctcggcgcggtcatggccaaccggatcaccgactacgtcaaggacggcctgaccgacctcggcccgaagtacgcggccgcggccgccgggtccagctcctccagcagcatcccggacatggacaagctgcccgcgccgctgcgcaccgtgatggagagcgcgtacgggcacggcatcgcggacgtcttcctgatcgcctcctgcctggcgctgctggccttcgtcgtcaccctcttcatcaaggaggttccgctgcggacctccggcggtctggcgcaggccgctcaggccaacgccgaggcggcgacgccgaccggtgtcaccggaacccccgaggtcgcggaggccaccgaggccgccacggcgtccggcgcggcgcaggaacaggagaaggtccccagctgggccgtcgccaccaccgaggccggtcccgagggcacgcagccgctgtccgcggtcgccacgatggccgccggcccgggtgagcaggccttcggcgggatcccggtacgcggctacgtccgcggcaccgagagcgcccccgtcccgcaggccgcggtgacgctgatctcgctcgcgggacggcagctcggccggtcggtcgcgcagttcgacggctcctacgcggtggacgcgccgggcacgggctcgtacgtcctgatcgcctccgccgacggcttccagccgcaggcctccacgatcgtcgtgaacgacgagccggtcgcgtacgacatcctgctgagcggcaccagcggcctcagcggggtcgtgcgggccgtcgagaccgggaccccggtcaaggacgccatggtcatcgtgaccgatgtgcggggcgatgtgctggccaccgggacgaccggtgagcagggcgagttctcgttcgccgagctggtgccgggcgccgtgacggtcgccgtgaacgcggcgggtcaccgtccgctcgccctgcccgtcgaggtcggcggcaccggggtcacccgggtcgaggtcgagctcagctccggcgcgcaggtccagggtgtcgtccgggcaccgggcgggccgctcggcgacgcgcgggtcacgctggtcgacgcggccggcaacgtggtcggcacggccaggaccggtgcggacggcgcgtacgccttcaccgacctggacagcggcgagtacaccgtcatcgcgacgggctacccgccggtggcgacggccctgacggtgggcggccgcggcgtcgacgaccacgacatcgcgctctcccacccgggcgag

SEQ ID NO: 4175 - DNA, 819 bp, Streptomyces avermitilis
  CDS (1)..(819)
atgggactgaccgcacggatccgcacccgggacggatgggccgtgtcgcacgcggtcgtcacggtgaccgatatgacgggcgcccaggtggtgcgcgccgaggccgacggggagggcgtcgtccgcgacgggaccgcgctggcgcccggcgcccacaccgtgatcgtcaccgccgtggggtacgcgccggccgcgtcgagcgccatcgtcacggcgagcggccgggccgaggtcggcactgtgacgctggctcggcagggcggcaccgaactgccgccgcccggcgcctggaccatcgacccggcgcactcctccgtcggtgccgtcgcccagcacctggggatctccagcgtgcacggccggttcaccgagttcgcgggccgcatcgagatcgcgcccgacgacgtggcgaagtcccgcgtggaggccgtcatcggcgccgcgtccatcgacacgggcaacgccatgcgtgacgggcacctgaagtcgccggacttcctggacgtggagacgtacccgcagatcacctatcgctcgacgggcatcggcgcggccggttccgaccgctggacggtgcacggcgaactgaccatgcacggggtcgtacggccggtcgacctggacctcgcctatctgggcacgggctcggacccgtggggcggtacgcgggcggccttccgggccacggcggaactgcggcgcgaggacttcgcgatgaactacaaccaggtgatccaggcgggcatcacggcgatcggtacgacgctgaaggtggagctggacatccaggcggtacagggcgacacgctgccgcaggcg

SEQ ID NO: 4176 - DNA, 468 bp, Streptomyces avermitilis
  CDS (1)..(468)
atggcaccgaacatcgcgacgaacacctccgtatcgctggacgagttgctggaattcgtacgtccccgccaccgcgcgatcctgctgacgcgccgcaccgacgggagcccccagggttcgcccctgacctgcggggtcgacgactccgggcgcatcgtcgtctcgacctaccccgagcgcgccaagacgcgcaacgccaggcgggacgagcaggtcagcctgatcgtgctgagcgacgactggaacgggccgtgggtccagatcgacggcacggccgaggtcctcgacacccccgactccgtcgagccactggtggagtactaccggaacatcgccggggagcaccccgactgggacgagtaccgggaggcgatgatcaagcagggcaagtccatcatccggatcacccccgaacgctggggaccggtggcgacggggggcttcccggcgcggctcgcttcgcaggag

SEQ ID NO: 4177 - DNA, 768 bp, Streptomyces avermitilis
  CDS (1)..(768)
atggtgagggcagccgaccgggccgagcgtccggcacggaccagcgtctggctggagggcaaggtgccccggggcggcggggcgcgcggcgggcagccgtcggggctcgaccgggagcgcatcacccgggcgacgatgcggctgctggacgcggaggggctggccaagttctcgatgcgccggctcgcggcggagctgaacgtcacggcgatgtccgtgtactggtacgtcgacaccaaggacgatctgctcgaactcgccctggacgcggccttcggcgagctgcggttgccggcggccgacgcggacgaggactggcgcgagcagctgcgggcgctggccacggagtaccgggggctgctggtgcgccatccctggctgtccccgctggccggcacgtacctcaacatcggcccgcactcgctggacttctccctcacggtccagcgggtgatccgccgcaccgggctgccggcgcacgggcagatgggcgcgatctcggcggtcttccagttcgtgtacggcttcggcacgatcgagggccacttcatcgagcgctgctcggcggccgggatgagccaggacgactacttccgccaggccatgagcgcggtgaccgaggcccccgaagtcggcgaggccgtccaccagtccgcggacctcatggaggcccgcggcggcgacacggtggaggagatgagggaacgggacttcaccttcgccctggagaccttgatcgcgggcatcgaggcgatggtggaacgcggc

SEQ ID NO: 4178 - DNA, 1494 bp, Streptomyces avermitilis
  CDS (1)..(1494)
atgtccacctccccggctcccgaggtcccccagggccacccccagcgctggctgatcctcggtgtcatctgcctcgcgcagctcaccgtcctgctcgacaacaccgtgctgaacgtggcgatcccctccctcacccgggagctgggcgcggcgacctccgacatccagtggatgatcaacgcctactcgctggtgcagtccgggctgctgctcaccgcgggcagcgcggccgaccgctacggccgcaagaagatgctgatcgcggggctcgcgctgttcggcgtcggttccctgatcgccggactcgccgactccaccgggcagctgatcgccgcgcgggccgggatgggtgtgggcggcgcgctgctgctgaccacgaccctcgccgtggcgatgcagatcttctcgcccgaggagaccccgaaggcgatcggcatctggagcgcggtgaacgcgctgggcttcgcggtcggcccccttctcggcggcttcatgctgaaccacttctggtggggcgcgatcttcctgatcaacctgccggtggcggcgctggggctggtcgcggtcatcgccctcgtgcccgagtcgaagaatccgagcggcgaccggcccgacgccctgggcgccgtactctccacgatcggcatgacctcgctcgtgtacgcgatcatctcggggccggagcacggctggacctcgggcagggtgctgctgaccgcggccgtggcggtggccgtgctgggggccttcgcgtactgggagagccggatcccgtaccccatgctggacctgcacttcttccgggaccggcgcttcacgggcgcggtcgccggggcggtgctcatcaccttcggcatgggcggcgcgctgttcctgctcacccagcacctccagttcgtcctcgggtacggggcgttggaggcgggcctgcggacggccccgctcgcgctctcggtggtggcgctgaacttctcggggctgtcggcgaagtggacggcgaagctgggcgcgccggtgtcgatcgcgctcggcatggcgctgatgtccggcggactggtgtcgatcgcgacgctcgccgccgacggctacggcggcacgctcgtcggcctgctcctcatcggcgcgggctgcgcgctcgccaaccccgcgatggcgtacgccatcatgagcgcgatccccccggcgaaggcgggcgtgggcgcgggcatcaacggcacgctcgccgagttcggcaacggcctgggcgtggcggtgctcggcgcggtcctcaactcccgcttcgccgcgctgatcccggtcgcggcgtcctcgctgccggcggcgctggcgtcggcgggatcggccgaggagcgcggacggatcacggacgcgttctcatcgggcctggagaccagccagctggtgggcgcggtggccgtgctgctcggcggactgctggcggcggcgttgctgcgccgggcggagcgggcagactccgcggtggcggcgtccgcg

SEQ ID NO: 4179 - DNA, 2247 bp, Streptomyces avermitilis
  CDS (1)..(2247)
atgaccactcagcccgatacgacgtatcagggggacgcgagcccctcctggggaccgccgccgaacagtacggcggtgcgggaacccgcgcttcccggcgccccggcacccggatccggcgatcccgagcagccgttcctccgcagactctggcgcggccggcccgaggacccgcgctggacgcgtcccgcgttcctcggcctgctggccgccaccgggctgctgtacctgtacaacctgagctcctccggatacgccaactccttctactcggcggccgtccaggccggcagcaagagctggaaggcgttcttcttcggctccctcgactcggccaacgccatcaccgtcgacaagcccccggcctcgctgtggccgatggagctgtcggtgcggatcttcggcctcaactcgtgggcgatcctcgtccccgaggtgctgatggccatcgccacggtcgccgtgctgtacgcggcgatccgccgccggttcagccccgcggccggtctgatcgcgggcgcggtgctcgcgctgacccccgtcgcggcgctgatgttccggttcaacaacccggacgcgatactcgcgctcctgatgaccgtctcggtctacttcgtgatccgcgccctggaggacggccgcaccaagtggctgctctgggccggtgccgcggtcggcttcgccttcctgacgaagaccctccaggccttcctgatccttccggccctcgccgcgctgtacgcggtctgcgcgccggtgaagctgaagaagcgcctgggacagctcgccctcgcgggtgtggcgatggtcgtcgcgggcggctggtgggtcgccatcgtcgagctgtggccggcctcctcgcgcccgtacatcggcggctcgcagaacaactccttcctggagctgaccttcggttacaacggtctcggccgcatcaacggcgaggagaccggcagcgtcggcggcggtggcggtggcggtggcggcggcaccggccagtggggtgagaccggctggaaccggatgttcaactccgagatcggcggtcagatctcgtggctgctgcccgccgcgctgatcctcttcgtcgcgggcctgtggctcacccgcaaggccaagcgcaccgacctggtccgcggctcgttcctcgcctggggcggcgcgctgctgatgaccggcctcatcttcagcttcatggcgggcatcttccaccagtactacacggtggccctggctccttacatcgccgccctgatcggcatgggcgccaccgtcctgtgggaggagcggacgaaggtctgggcctcgctgaccctcgcgggcgccgtcgtggcgagtgcggtctggggctatgtgctcctcaaccgcacctcggactacctgccctggctgaagtggttcgtcctcgtcggcggcctggccggcgcgctgggcctggtcttcgcggccaagctgggccgtcggctcgctctcgcggcggtcggcctgagcttcgtggcctcggtcgcgggtccgacggcgtacacgctgagcacggtgaacaccggtcacacgggttcgatcgtcacggccggtccggccggcgccggcatgggcggccgtggtggtggtcccggcggcggcggtggcggcatgcgcggcgggttccccggagccggccagaaccagcagggcggcaccggcaacacccagcagggaggcggtccgcagggcggcggtcagcagggcggcggcatgggccagcccccgaccggcggcttcggcggcaaccagcagaacggcaacggcaacggcaacgcccagggccagaaccagcagggcggcatgcccggcggcggtcagacgggcgagcgcggcggcatgggcggcggcatgggcggtctgctcagcggtgccagcgtcagctccgcggccaagaagctgctggagaccgacgccgacagctacacctgggccgcggcggccatcggcgcgcagaacgcggcgagctaccagctctccaccggcgacccggtgatggcgatcggcggcttcaacggcagcgacccgtcaccgacgctggcccagttcaaggagtacgtggcggacggcaagatccactacttcatctccagcggcacgggcggcgggatgggcggcagcagctccggcacctcctcggggatcagcagctgggtggagaagaacttcacgaaggtcaccgtgggttcgtccaccttctacgacctgacgaagaagtccggcagc

SEQ ID NO: 4180 - DNA, 1539 bp, Streptomyces avermitilis
  CDS (1)..(1539)
atgcgaaccgactcttctcccggcaacctgccggcgcgggagcacctcccggccggaaacgccggtacgcctgtcctggacgtagtgatccccgtctacaacgaggagaaggacctccagccatgtgtgctcagactgcacgagcacctcgcgcgcaccttcccgtacgcgttccgcatcacgatcgcggacaacgcttccacggacaccaccccccaggtggccgcgcggctggaggcggagattcccgaggtcaagtccttccggttggagcagaaggggcgcggccgggcgctgcgcaccgtctggtccgcgtcggacgccccgatcctcgcgtacatggacgtcgacctgtccaccgacctcaacgcgctgctgccgctggtggcgccgctgatctcgggtcactccgacctggcgatcggttcccggctgtcccgctcgtcgcgtgtggtgcgcggcgccaagcgggagttcatcagccgtacgtacaacctgatcctgcggggttcgctgcaagcccgcttctccgacgcgcagtgcggcttcaaggcgatccgccgtgatgtggctcaggtgctgctgcccctggtcgaggacagcggctggttcttcgacaccgagatgctggtgctcgccgagcgtgccggactccggatccacgaggtgccggtcgactgggtcgacgacccggactcgacggtgcacatcgtgaagaccgcgaccgacgacctcaagggggtgtggcgggtaggaagggctctcgccacgggatcgctgtcgctggaccggctcgcccggcccttcggggacgacccccgcgatcgtgaactggccgacgtgcccaagggcctggcccgccagctggtcggattctgcgtggtcggcggtctgtccacgctcttctatctgctgctctacagcggcttccgttcgttcaccggctcgcagatcgccaacgcgctcgccctgctggtctcggcggtcgccaacacggcggccaaccggcgcctgaccttcggggtacgcggccggggcggcgccgtccgccaccaggcacagggcctggtcgtcttcggtatcggactcgccctcaccagcggctcgctggccgcgctgaacgcggcgacctccagccccgcgcacgccaccgagctggcggtcctcatcgccgccaacctcgcggcgacggtcctgcggttcctgctcttccgcgcctgggtgttcccggaccggcgcgacgccgacgcggagtcgaccgtcgtcgcgtcccacgccccgtcctcgcccacctactcgacggcgcttccgcaccaccagggccaccaccagggccaccatccgggccagtaccagggccagtacgagggccagtaccagggccagcactcgccgcagccccagcgccccccggcgcccgcggctccgtacgacacagcccagttccgcgccggcgaagccgcggaccgtacctggggggactcgaccatgcagatgcaggccgtgcgcccgcacgatcacgatccgaggaacgcacga

SEQ ID NO: 4181 - DNA, 1617 bp, Streptomyces avermitilis
  CDS (1)..(1617)
atgagcggacgacgacgaccgcgtacgcagcggcgagggcgaggacgacagccgcgcacgctgcggacgcggctcgtcgtctcggcggtggcgctcatcgccgtggtgtgtgccgtcatcggcacggtgacgaccatcgcgctggaccagcatctggacgagcagctcaacggcaagctgcacgagaccgccatgcgcgcgtccggcggcgccaaaccgccgggcggcaaagtcccggaccacggccccgcgggggacgcggtggagcagcagtcaccgagcgcccggctcaccagcttcgtccagcggggaggtccgcaggtcaagaccatggccgcctaccaggacagtggcgggacggtcgtcaaggcggtcgtcgccgagttcaagtcgtccgacaccgccggtcagaaaatggacgccggcacactcgacgacgcgcagacggcggctctcacctcggtgccgaagagcggcacgcacgacgtgaacatcccgtcgttcggggagtaccgggtcgagtacgttgccagtcccgacggaaagggtgggtactacgtcgccctccccacccaggacgtcaccaacaccatcaacaccctgatcctcgtcgaggtcagtgtcaccgccgccggtctcgtcgccgccgccatcgcaggatccgtcctcgtcggtgtcgccctgcgcccgctgcgcaaggtcgccgccaccgccacccgtgtctccgaactcccgctgcacaccggcgaggtgaccctcaacgagcgggtctccgagtccgagaccgacccgcacaccgaggtcggccaggtcggcgccgccctcaaccgcatgctcgaccacgtccacggcgccctccagtcgcgccagcagagcgagatgcgcgtacggcagttcgtcgcggacgccagtcatgagctgcgtacccccctcgcgtcgatccgtggatacgccgagctgacccgccgcggccgggaacagaccggtcccgacacccggcacgccctcgggcggatcgagtccgaggccggccgcatgaccctcctcgtcgaggacctcctcctgctcgcgcggctcgacgccggccggcccctccagtacgagcagaccgacctcgtaccccttgtcatcgatgccgtcagcgacgcccgggcggccgggcgcgaccacaactggcggctcgaactgcccgacgaaccggcgctggtgtcggcggacgccgcccgtctgcaacaggtcctcgtcaacctgttcgcgaacgcccgcacccacaccccacccggtacgaccgtcaccgcgcgcgtccaccggcacgggccgtggctgtgcgtggacgtccaggacgacggacagggcatcccgccggatctgcttccccatgtcttcgaacggttcgcgcgaggcgattcgtcgcgctcccgttcctccgggtcgaccggactcgggcttgccatcgtgcaggccgtggcggccgcgcacggcggcgcggtgaccgtcgacagcgtcccgggccgcaccgtgttcaccgtgcatctgccggcgcttgcccccgaaacaaactggcaatcgcactcacaggcacagcacagcgccaccacatgggtgcaacaggccgtt

SEQ ID NO: 4182 - DNA, 807 bp, Streptomyces avermitilis
  CDS (1)..(807)
gtgcgtttcttaggaaaatcacaggttccagaaagcgttctctcagggggccccgacatggtgtccaccatgaccacgacctcgccccaggggcgcaccgaactgctgaggccggacgggagccccgtccgagtgcttgtggtggacgacgaactgtcgatcaccgaactgctgtccatggcccttcgctatgagggctggcagatccgcagcgcgggcgacgggcagggtgcggtgcagaccgcgcgcgagttccgtcccgacgctgtcgttctcgacatgatgctgccggacatggacggcctcaccgtcctggggcgcctgcggcgcgaactgcccgacgtgcccgtcctgttcctcacggccaaggacgcggtcgaggaccggatcgcgggcctgaccgccggcggcgacgactacgtcaccaagccgttcagcctggaagaggtcgtggcccggctgcgcgggctgatccgccgctccggtgccgccgaccggcgctccgactccatgctcgtcgtcggagacctcaccctggacgaggacagtcacgaggtgtcgcggtccggggagaacatccacctcaccgccacggagtttgaactcctgcggttcctgatgcgtaatccccggcgtgtactcagcaaggcgcagatcctcgaccgggtgtggtcgtacgacttcggcggccaggccaacgtcgtcgagctctacatctcgtacctgcggcgcaagatcgacgccgggcgtgagccgatgatccacacccgacgcggagccggctacctgatcaagcccgcggtgtca

SEQ ID NO: 4183 - DNA, 927 bp, Streptomyces avermitilis
  CDS (1)..(927)
gtgcgcgggagcggtagcgggactgacggaaccggcgaggagatccttgccgtacgccggttctgggagcgcctcgggcttcccggcctcgtcgacgtccacacccacttcatgcccgagcgcgtcctgcgcaaggtctgggactacttcgacgggctcggccccctgaccggcgggctggagtggcccatcacctaccgctccgacgaggaccaacggctcgcgaccatcagggaattcggcgtccgggccttcaccgccatgctctacccgcacaaggccggcatggcgcgatggctcaactcctgggccgtcgacttcgcccggcgtacccccgactgcctgcacacggcgaccctgttcccggagccgggtgtcgaggcgtacgtgctggaggccgtcgagcaaggcgcccgtgtcttcaaggcccatgtgcaggtgggggcgtacgaccccgccgacgagctgctcgatccggtctggggactgctcgccgaggccggggtcccggtcgtgatgcactgcggatcggggcccgcgcccggcaagcacaccgggccgggaccggtcgcccaggtgctcgcccggcatccccggctgcggctggtcgtcgcgcacctgggcatgcccgagtacgaggacttcctcgacctggccgagcggtacggggaggtccggctggacacgaccatggcgttcaccgacttcagcgagcggctcgcgcccttcccccggggggcccgcccccggctcgccggcctcggcgaccgcattctgctgggtacggacttccccaacatcccctatcggtacgtcgaccagctgtacgccctggagcggctcgggctcggtgacgactggctccgctcggtctgccacgggaacggagcgcgactcttcgggctcgcgcagccgcaggaactctca

SEQ ID NO: 4184 - DNA, 444 bp, Streptomyces avermitilis
  CDS (1)..(444)
atgagcgatcaccgcgttgcacctgtcggaggagcgtctcccggcggtacacccgccgcccccgcccccgtcccttccccagcctccgccccttccccagcctccgcccccacccccacccccgcccacgaacccccttactactccgtcatcttcacctccgtacggaccgagggggacaacggatacggggagaccgccgagcgtatggaggagctggtcaaggagattccggggttcctcggggcggacatggcgcgtacgcccggtgggctcgggatcaccgtcgcgtacttccgggacctggacgccgtcgaggagtggcggagccacctggagcaccgcgcggcgcagcagtacggtcgagcccactggtacgagagctacaccctccatgtcgccaaggtcgagcggagtcacagttttgagcgtgcgcgggagcgg

SEQ ID NO: 4185 - DNA, 861 bp, Streptomyces avermitilis
  CDS (1)..(861)
atggcacaggcgtggagatgtacggggctgcggtggagcggcgacggggctgttctggtgtgggagggcggggtgcggagtgctctgccgcgggggaagcgggtggcctttggggtggtgacggggggtgcgcggacgtgtgtgggagcacgggggcacgcgtgtcccgtgcgggcggccgtgtcggggcggagcgcgggggcgcggtgcgaggagtgtgcgcggctggaccgggcgcactccgtggccgccgacaccctcgccgatgatccgcggccgtaccacgtgtatctcgcgtggttcgggaccggcatggtcaaggtggggatcacggcggtcgagcgcgggtcggcgcggttgttggaacagggggccgtctgcttcagctggctggggcgcgggccgttgatggccgcgcggcgggccgaggagttgctgcgggccgcgctcaaggtgcccgaccggattccgtacgccgacaagcgggcggtgcgggcggcgttgcccggggccggggagcggggcgccgagatcgccggactgcatgcgcgggcggtggtcctcgacggatggccggagtccttggagcgggagccgttccaggtcgtcgaccatgaagaggcgttcgggctggagggcctcccgcccgccgacggcgtggtgagtgagctcgtcgcgggcggtgcggtgggcggtgaggtgctcgccgtcgccggacccgatctgcatctggcgaccgagcggggcgtcatcgtcctcgacacgcggctgatgacggggtgggagctgaccgccggggacaccggattcaccgtgcccgtgcgggagttcagggaggcgaccgtgcaggacgggctgttc

SEQ ID NO: 4186 - DNA, 486 bp, Streptomyces avermitilis
  CDS (1)..(486)
gtgccacggtggggtgtgacatggacaaggttcacgccgctcctcggcgtcgtgctcggtgtggttgtgtcgtcgttggcccagtactcactcggacgtgcgtcggagcgggccgaagtgcgacggagtgctcgtgagcgcgccgaggcgcgccgtaacgaacgcgtcacccatctcatcgacttcctggccgtcgtgcaggaagccgaacgggtcgccgtagaccgctatcaccaccatctggccgacgagcagtggcaagcacggcagatgcaggctgtcgacaggatgtgggtggcgcagaagacgattcacatgctgtgcgcgtccgaggtcaacgcggcggcccgtcgtctggcgtacgacgttcaggacgtgatcagaaagggtcccgaggatccgggagagccgcaggacgagaaggtctgggcatacatccgtcccagccgaaaggcgttcctcgatgtggtgcgcgatcacttgaag

SEQ ID NO: 4187 - DNA, 402 bp, Streptomyces avermitilis
  CDS (1)..(402)
atgccgaaccagatcacacgggctgctgccgcgcttgtgctcctcaccagtgccctcggcggcgtcagcgttgtcggtgccaccgccgcgaacgccgccggcacatgcgaccgcgccaagaactaccagcacgccttcgttcccgcctccgagtcgggagtggactgccagctcgccctcggcaaccgcggcgacggcgtcctggctctgcaacgcacgcttcgaaggtgctacgggtcaaccatcgtcgccgacggcatcttcggcccctccaccagggacgcactgaagtacgcgcagcaccaggccgggacccaggatgacggcgtctacggcccgaacacccgacgggccataaagcaccgcccgagctcctggccctacggctgccagcgggtgagg

SEQ ID NO: 4188 - DNA, 465 bp, Streptomyces avermitilis
  CDS (1)..(465)
atgttccagctctcgacgcacaccccacgcggcgttcttctcaccgtcgccgccctcgccgcgtacgcggcgcccaccaccgcgtacgcccagggtctcccccttcccccggcgccggtccgcggcgacgaggtaggcgatcacctcaccgtcaccgtcagccacgcgggccgtgccgacgggacgtaccggctgcgctgtcatcccggcggcggcagccacccggaccccggcggtgcctgcggcacgctcgaccggcggaccatctggggccgtgaccccttctccccggtcgcgccggacggcctctgcacgatgcagtacggcggccccgccaccgcgtatgtcaccggcacctgggccgggcgccccgtcaacgcgacgtacgaccgcagcgacggttgccagatcgcccgctggaacgacctcgtccccctcctgcccgacctccgttcgccacgctcg

SEQ ID NO: 4189 - DNA, 4437 bp, Streptomyces avermitilis
  CDS (1)..(4437)
gtgagcagcaggccatcccgaggcgctgctcgcctcgcagccatactggatgcgctccccgacgcgttggtactggtcaacgccaacgggaccgttgtcaacgccaacaccatcgcgctggaggcgttcgagaccccgggtacggccctggtgggtcgcgggctgctggatctgctgcccgagttcgactcccggctcatcccgggctccatgcgccggcccgactccatggacccgcgcggacggaccaagccgacccggatggtggcccggcggaccgacggcagcgagttcccggtcgaggtcaccagcgcgaacctcgagaacgggcagcaggcctacgacggttacggctacaccggcgacgaactgctgatgctcgtcgtacgcgacctgtccggcaccgtcgacaccgaggccgaactcgcccgctcgcagcgccagaccgagatgatcctgcgtgccgccgccgagggcgtggtgggtacggacaccgacgggcggatcgtcctcgtcaatcccgccgccgcgcagatactcggtttccgggccagcgatctgggcggccaggaactgcacccgctcatgctgcactcccgcgaggacggcgagcccttcccgtacgaggagtccccgctcgccgacaccctgcgctccgggcgcaagcaccgggtgcgcgggcaggtgctgtggtccaagagcggggacaaggtgccggtcgacctgacgaccgcgcccgtacgcgacggcgaccagctcgtcggcgccgtgatgaccttcaccgaccggcggccgtacgacaccctcgccgaggagaaggacaaggccgaggagcagcacgagcaggaactcgcgcggatcgccgaggagcacgacgaggagctcaagcggctgcgcgaggagcacaccgccgagctcaccgagctgcgcgagctgcacgaggaggaactcgcggcgggcgacgagcgctatgccgccctgggcgagcgggagaaggaccgccacgaggtactcaccgcgcggcacgagcagctgctcgccgtgctcggccagtccctgcgcggtccgctggaccagctccgcggtgaactgtcgaaactcgccgccgacgacgccgggcagctgtggcccgaagccaaccaggtgctgcaccacctcgcggcgggctattcgcgtatcaccacgctcgtcgacaacgtcctcggctaccagcgcctcgactccggcgaggacgatctcgtccgtacgacgacgatgctcgacgcggtcgtggcggccggtgtcgacggtgccgtcgaactgatcgggcccgggcgcgtccagttcgccgtgcacgcgccgcccatcgaggccgaggtcgacccgcagcggctggcgaccgcgctcgcgcatctcatcgccgacgtcgccggtgtcgactcgacgggcaactcgcccgtctcggccggcggctatatggacaacaccgtggtcgtggcggcggcgcagcgcggcgaggtcgtacgcatcgaggtgcgcgggccgtacgccgggggagacctggtgcaccagccgatcgtccgcggcatcgtgcgttcccacggcggtgtgctgcagacgcacgaggtgccggggatgagcggcaacgcgtacgtcctcgaagtaccgatcggcggcggcgcggggacggtcgcgccgggcgcggtacccgctcttgcgccccctgtggcggccgacgcgtcggccggtgtggtgaccggcgccgaggtggctctgcccgagcaggcctcgcagcagggcggcgggcggcggcgggcccggcggtcgtccgtggatgccttcctggagagtgaggtggggggcgactccccttcgggcgctgttcccgccacctcctcggacacgggcgcggccgcgcccaccgggcggcgcaggcggcgcgcggcggacgggccggcggccgacgaggtgtcggtcccggttcaggggtccgaggccgagaacgacaaagacgccgggccttccggcggtaccgggcgacgccgtgggcggccgagcccggtcgagggcgccgcttcggacgccgcggacgggctcggtcagagcgtggctcaaggtgtcgccgagggcgcggtcgtcacggcggccgagcacgcggcggggaccgccgccaccgggctgggccagaccgtgccaccgcagggcgtgcccacgccctcgggccgacgtgcccgccggggcgacgaacgacaggcattgcctgctgcgcttcccgcggctccctccggagccgggaccggagccggcgccggctccggagccggcgtgcccgaggacgcgaatggcgcggcgcagccgaccggacgccgtcggcgtgcgctggccgccgccaacgagcgcgccgcttccccggacttgggcccccgacaggtgttcgcgctgccgccggccgaggcggaccgggggccggagtacgacgccggcctaccgcacgcggagaccggcgtcggggtcggagtcggagtcggagtcggagtccaggctgtcggcgccgaggccgcccctgccgacggccatgatcaggccgacgaaggccgtcacgacgcgatggcgcacgatccggccgacgaccacactccgccgcagccgcatccggtagccacaccgagcggccgccgccgggcccgtccggcagcgacgccggcccaggggcagccgacgccggcccaggcagcacccggccagccggttcccggtcagggtcagggccaggtgccgggtggcgcggacgcaccggcgggtatgcccgtgccgggccagaccggtccgcgccagcccggtcctggccaggcgattccccatcaggtcgctccggggcaggtcgcggccgcccagggtcttccggcgcaggccgctcctggccaacccgttccctcgcagtccgggcaggcggcccaggcgcagctcgcccccgccccgcaggcacagcccgcacccggtcagcctgtccctggtcagcccgtgcccgcgcaggtcccgcccgccgccgacggatccgtgagcggcgttccctcgggcgccgaccccgccctaggacccaccccagctccccaggctccccagcccgccgcagccccgcagccgcaaccgtggcccgcgggtgcccacgccacgtccggcgccggtacgcccctcgtggccgggcagcagcctcccgccgcaccgcagcccacagccacgcccgcccccggcaccccgctgccgccggagcgcgccgctcagccccgggccgcgcagccgctgcccgccgaggccgccgcgcccatcgaccccaactcgacccaggggcgcgcgatcagcgtgcgtaccctcgggcagggcgtaccgttcgcgcgtcaggcggccgcgcagaacaagcccggcgcccaggcccagccgcgcccccagtcccagacgccgacgcctccgccgcaccagaccaacggctcgggtcggcgccgcaagctcggcacccctcccgagcccgccgccgagcgcccggagaacgcggcccggccgcaaccgcaggccggccagtccccgcaggcccggccggccggggccaccgacggcgccggacggtcgtacgccataggagccccggacaagaacgccgacgaaggccccgagccgctcgacggccccggcggtgccgtcgagatcgccgaccagccccatccccggcccgtggacgacgaactgcccccggagccgctggacaacccgcgtcggctgctcgtctggcccgcaccggatgtgacgacccagcaggcgctcagcgaccgcggctaccggcccgtgatcgtgcattcgcgcgaggaggtcgacgcgcagatcgccgccttcccggccgcgctcttcgtcgacccgctcaccgggccgatcacgcgtaccgcgctccagtcgctgcgtcaggcagcggtggccgccgaggttccggtcctggtcacggcgggactcgggcaggcgacacgcgaggcggcgtacggcgccgaccccgccgtactcctgaaggcgctggccccgcgggactccgagcagcatccgccgcgggtgctgctcatcgaggagcacgcggagatctcgctggcactcacatcgacgctggagcggcgcggtatgcaggtcgcgcgggccgcgtcggacgaggacgcggtcaccctggccgggcagatgcggccgaacctggtggtgatggacctgatgcaggtacgccgccgccgggccggaatcgtcgactggctgcgggcgaacggccagctgaaccgcacgcccctcgtcgtctacacggccgccgtcgatcaggccgagctgccgcgcctggcctcgggcgagacagtcctgttcctggcggagcgctcgacgagcaccgaggtgcaggagcggatcgtggacctgctcgcacggatcggcaccaac

SEQ ID NO: 4190 - DNA, 1674 bp, Streptomyces avermitilis
  CDS (1)..(1674)
atgtcgccccgggaggacaccgtgctgagcacgatgcaggacgtaccgctgctgatctcgaggatcctgacccacgggtccacgatccacggttcgtcgcaggtgatcacctggaccggcgagggcgagccgcagcgccgctcctacgccgagatcggcgcccgtgccgcccagttggcgcacgctctgcgcgaggacttcggcatcgtggacgacgaccgggtcgccacgctcatgtggaacaacgccgagcacgtcgaggcgtattacgcgatccccgccatgggcgcgatcctgcacacgctcaacctccgcctccccgcggagcagctggtgtggatcgccaaccacgccgccgaccgggtcgtcatcgccaacggctcgctgctcccgctcctcgcaccgctgctcccgcacctcaagacggtcgagcacgtggtcgtttcgggccccggcgaccgttcgctgctggacggggcgagcgtccaggtccacgagtacgaggagctgatcgccggcaagccggtctcctacgactggcccgagctggacgagcgctccgcagcggccatgtgttacacctccgggaccaccggcgatcccaagggcgtcgtctactcccaccgctccatctatctgcactccatgcaggtcaacatgacccagtcgatgggcctgacggaccaggacacctccctcgtcgtggtcccgcagttccacgtcaacgcctggggtctgccgcacgcgaccttcatgaccggcgtcaacctcctcatgccggaccgcttcctccagcccgcgccgctcgccgagatgatcgagagcgagcggccgacgcacgccgccgccgtcccgaccatctggcagggcctgctcgccgagctgcacgccaagccccgcgacgtctcctccctcacccaggtcacgatcggcggctcggcctgcccgcccgccctcatggcggccttcgacaagctcggcatgcgcgtctgccacgcctggggcatgacggagacgtccccgctgggcacggtggcccggccgccggcccatgcggtcggtacggacgaggagttcgcctaccgcctcacccagggccgcttcccgtccggcgtccaggcgcgcctcagcggccccggcggcgaacggctcccctgggacggcgagtccgccggtgagctggaggtgcgcgggccgtggatcgcgggcgcgtactacaacggcccggacgccgagcccctgcgccccgccgacaagttcagcgaggacggctggctcaagacgggtgacgtcggcaccatcagccccgacggcttcctcaccctcaccgaccgggccaaggacgtcatcaagtccggcggcgagtggatctcctcggtcgatctggagaacgcgctcatggcgcacccggacatcgccgaagccgccgttgtcgccgttccggacgacaagtggggcgaacgcccgctcgccacggtcgtgctgaaggaaggcgccaccgccgacttcgccacgctccgcaccttcctcgccgacgaggcgaagatcgccaagtggcagcttcccgagcgctggacgatcatcgagtcggtgcccaagacgagtgtcggcaagttcgacaagaaggtgctgcgcaggcagtacgccgagggcgagctggacatcacgcagatc

SEQ ID NO: 4191 - DNA, 468 bp, Streptomyces avermitilis
  CDS (1)..(468)
gtgaaggcccggcagccggtgctgctgcgtaccgcccggtcgctgaccgcgaacccgagcgatgccgaggacctgctgcagaccgcgctggcgaagacctatgtggcctgggagcggatcgaggaccaccgggcgctcgacggctatgtacgcagggcgctgctgaacacgcggacgtcgcagtggcggaagcggaaggtcgacgagttcgcgtgcgaagaactgccggagccggagggcgtcaccgccggtgatccggccgagcagcaggcgttgcacgacgcgatgtggcgcgcgatcacgaagctgcccgcgcgccagcgggcgatggtggtcctgcggtactacgaggacttgagcgaggcgcagacggccgaggtgctcggggtgtcggtcggcacggtcaagtcggcggtctcgcgcgcgctgggcaagctccgtgaggacccggagctggagccggttcgc

SEQ ID NO: 4192 - DNA, 1164 bp, Streptomyces avermitilis
  CDS (1)..(1164)
atgagcgtacggacgagagacagcctcggtgggcgtgcggcgatcgtcgggatcggggccaccgagttctccaaggactcggggcgcagcgagctgcggctggcggtggaggcggtgcggaccgcgctcgacgacgcggggctgagaccggcggacgtggacggcatggtcacgttcacgatggacaccagcccggagatcaccgtggcgcaggcggccgggatgggggagctgtccttcttctcgcggatccactacgggggcggcgcggcatgcgcgacggttcagcaggccgtgctcgcggtggcgaccggggtggccgaggtcgtggtctgctaccgcgcgttcaacgagcggtcgggccgccgcttcggctccggagtgcggcaccgggagccgtcggcggagggggcggcgctgggctggtcgctgccgttcgggctgctcacccccgcgtcatgggtggcgatggcggcccagcgctatctgcacacgtacgggctgaccccggaggcgttcgggcaggtcgccgtcgtggaccgcaagcatgcggcgacgaacccggcggcgtacttccacggcagacccatcaccctcgccgagcacgcggcctcccgctggatcgtcgaacccctgcgcctgctggactgctgtcaggagacggacggcggccaggcgctggtggtgacctccgtggagcgggcgcgtgacctgccgcgtccgcccgtggtgatcacggccgccgcccagggggcgggtcgcgcgcaggagcagatgaccagtttctaccgggacgacctgacggggctcccggagatgggagtggtggcccggcagctgtggcggacgtccgggctggccccggcggacatcgacgtggggatcctgtacgaccacttcaccccgttcgtgctgatgcagctggaggagttcggcttctgcgggccgggcgaagcggccgacttcgtggcagccgagcgacttccgctgaacacgcacggggggcagttgggggaggcgtatctgcacggaatgaacggcatcgcggaaggggtacgacagctgcgcggcacggccgtgaaccagctacccggagccgcccgggccctggtgacggcgggcaccggtgtccccacgtcggggctgattctgggggtggacgga

SEQ ID NO: 4193 - DNA, 393 bp, Streptomyces avermitilis
  CDS (1)..(393)
atgaagcgcggtgaggagctgccgccgctggagatcgaggtcacgcgcacgctgatcgtcgccggggcgatcgcgtcccgcgactaccaggacgtgcaccacgacgcggagtccgcacggcggaggggctcccccgacatcttcatgaacatcctgacgaccaacggcctggtcgggcggtacatcacggaccacttcggcccgggcgcggtcctccgcaaggtggccatacgcctcggtgcccccaactacccgggcgacacgatggtgctgaccggcacggtcgtggaggtcgagggcgacaccgcgaccgtgaaggtcatcggggcgaacggcatcggcacccacgtcaggggaaccgtgacggtcaccgtcccacccgggagcgcgtca

SEQ ID NO: 4194 - DNA, 1134 bp, Streptomyces avermitilis
  CDS (1)..(1134)
atggatttcacgccgacggaggatcaggcggcggcccgcgacctcgccgcacggatcttcggcgacctctccacccacgaccgcctgtcggccgcggggaccggctccgatgccacgctgtggaagacgctgtgctcggcggggctcgtcgccgcggtgacggacgtcggcctcctgggcttggtgctcctgctggaggagcaggggcgcacgacggcacaggtgccgttcgcggcgagctgtgtgtacgggctgctggcggtggcggcacatgggtcgcccgagcagcgcgagcggttgctgccggggatcggggacggttcggtggtggtgagcggggcgttgcccgcccagggaggtgtaggggccggcgcgcgcggcgggctgagcggcaccgcgccggtggtgccctggctccaggacgccacgcatgtccttgtcgcggacgaccggcggcggctgtggctggtgcggaccgccgacgcgcgttgcgagccggtggagctgacggcgccctggtcggccgggcgactgacactggacgggacaccggccgagcggctcggcggggaccatgacggcgccggtcacgaacgtgtcgatcacgaacgtgtcgatcacgaacgtgtcgatcacgaccgcatcgatcacgatctgatcgataacgaccacatcgatcaggtctacgcggacgtggtcgccaccgcacgtaccgccttcgcggggttgcaggccggggtgtgcgcggggtcgctggcgcgggcggtggcgcacacgaacacccgcgagcagttcgggcgcccgctcgccgccaagcaggcggtgcaactccgggccgccgacgcgtacatggacaccgaggcgatacggctgacggcgtacgaggcggcctggcggcgcgacgagggcctgccgtacgccgctcaggccctgaccgcggcctggtgggcctcggaagcggggcagcgggtcgtgcacacgggccagcatctgcacggcggagcgggagccgacctcgagcacccggtccaccggcacttcctctgggggcgccagctggacgcgtacctggggtgcgggagcgaagtgctccaggagctcggggagttgatcgcgtacggggaggtggagaga

SEQ ID NO: 4195 - DNA, 948 bp, Streptomyces avermitilis
  CDS (1)..(948)
gtgacggaggagctgtacgcacgcctgaaggcgtacgaagggcggcccgccgcggtcgggggcgtgggcaaggaccgggtcaacgagccgatgatccgccactggtgcgaggcgatgggcgacacgggttcggcgtacgcgggcccggcggccgtggcgccgcccaccatgctccaggtgtggacgatgggcggcctctccgggcacgaagggcggacggacgcgtacgacgatctgctgggactgctcgacgacgccggctgtgcctcggtggtcgccacggactgcgagcaggagtatctgcgcccgctgcggcccggggacgagatcaccttcgacgcggtcatcgagtccgtgtccgagcggaagcggacgaagctcggcaccgggtacttcgtgacgacccgcatggacgtacgagcggacggagagctcgccggcacccaccgtttccgcatcctgaagtacgcgccgaacgcccagcgctcacccgaccggaccccggacacccgaaaggctccggccgacgagggcacccgcaggccccggccggtggtgaaccgggacaacgccgggttctgggcgggtgtcgagcaccaccagttgctgatccagcggtgcgccggttgcggaacgctgcgcttcccctggctgccggggtgcaacgcgtgcggctgtgcggagtgggacacggtcgaggcgagcggcgaagggaccgtctactcgtacgtcgtcatgcaccacccgtccttccccgccttcgaccctccctatgcggtcggtctgatcgagctggccgagggcgtgcggatcgtcagcaacgtgatcggggtgccgtacgacaaggtgcggatcggcctgcccgtacgtctggaattcgtgcgctacgacgacgatctggagctgccggtgttccgggccggtgagggcgccgggggcggtgggggc

SEQ ID NO: 4196 - DNA, 1287 bp, Streptomyces avermitilis
  CDS (1)..(1287)
gtgcacctcgcccccaccgaacgccagcagcggctgcgcgccgagctgcgtacgtacttccgggacctgatgccggacggcccgccgcccgccgacgaccccggccggcagcgcgcactgctgcgtcgcatcggcgccgacggactgctcggcctcggctggccggtcgcgtacggggggcaagggcgtggcgcggatgagcagttcgtgttcttcgacgaggcgtaccgggcgggcgcaccgctgtcgatggtcacgctgaacaccgtcggccccacgctgatgaggtacgggagcgaggcgcagaaggcgttcttcctgccccgcatcctgagtggcgacctcgtcttcgcgatcgggtactcggagccctcggcgggcacggacctcgcctccctgcggacgcgcgccgtgcgggacgacggagccggggatggaaccggggacggaggcggggatggaaccggggacggaggcggggacggaggcggggacggaatcggggacggaatcggggacggcggtggggacgcaggcggtggcctggacggggactggctgatcgacgggcagaagatcttcacctccaacgcccagcacgccgactggatctggctcgcctgtcgcaccgaccccgacgcgcccaagcaccacggcatctcgatcctgctcgtccccacggacgcccccgggttctcgtggacgccgatcgagacggtgggcggcctgaccacgacggccacgtactacgacggcgtccgggtccccttctcgaacctggtcggtgaggtgaacggaggctgggggctcatcaccagccagctcaaccacgagcgggtcgcgctcgccgcgatcggcatgcaggccgaggacttctgcacggccgcgctgaaggcggcacgtacccccgatccggtgaccgggcggcgccgggttgacgagccttgggtgcggtcccggctggccgaagcgcatgcccggctggcggcaacgcgcctgctcaactggcgtttggtgggggatgcgggggcgggcgggccggcccccggcgacgcgagcggggtgaagttcgcgggaactgaatcgactgtcgcgacgtatcgcatgtgtcaggaaattgtcggagaggcaggactgatccgctccggttcgccgggagtgctcggggacggtgagttggagcggatgaacagagcggcgcagatcaacacgttcgggggcggggtgagcgaggtgcagcgggagatcgtggccacgatgcggctcgggatgacgagggggcggcgg

SEQ ID NO: 4197 - DNA, 234 bp, Streptomyces avermitilis
  CDS (1)..(234)
atggcaagcatccgtaccgctcgcgtcctcgccgccgtcgccgcgctgccccttgcggccgcactgttcacgggcgttgccgcggcggacaacggcaactcggccatcacgtatcagcaggcggtgggcttcggcgcctcgaaccagagcaacacggcccaggtgaacgggtccccgttcacgaccatcaaccagaagaacgagaacgtcgccgtcaacttcggcaacctctgg

SEQ ID NO: 4198 - DNA, 915 bp, Streptomyces avermitilis
  CDS (1)..(915)
atggccaccactgaccggcaggccacgaccctggctctggcccacgccctgtccgccgccgaacgcggactcgcggtgatcccgctgtcccgcaccaagctcccggccctgcgctccccccaccgcgccacctccgaccgcaccccctccgaccgaggcacgccccgccacgacgtaccgggcccgacggcccccgtctgccacggcgaatgcggccgcttcggacacggggtgtacgacgcctcgaccgatccccggcgcatccgccggctcttcgcggccgccccctgggccaccggctacggcatcgcctgcggcctgcacccgcatttcctgatcggcatcgacctcgacaccaaatccggtacggactcctcggctgccctgcgcgaactggccctgcgccacctgttcaccatcccggacacggtggtcgtgctcaccccgagcgggggccgccatgtgtggctcagcggcccgccggacgtcgtcgtccccaactccgcgggccggctcgctcccggcatcgacatccgcggcgcaggcggctatctggtcggccccggctcacgcacccgacacggggtgtacagcacggctccgggcaccgcccgcctggcgcccgcgccctgcccgaccgccctcctgcgcctgctcacgcccccgccccgcacgcaccaccccacgcccccggcgacgggcgaacacggccagggactggtccagttcgtcctcgccgcacacgagggccagcgcaacacccgcctgttctgggcggcttgccgcgcctacgagaacggcatcggccccgatctgtcccccgctctgatcgacgccgccgtccacacgggcctctcggaacgcgaggcccgctcgacgctcgcgtcggcggcccggatgacggggcggcggccc

SEQ ID NO: 4199 - DNA, 441 bp, Streptomyces avermitilis
  CDS (1)..(441)
gtggaccgaggtaagccgggttccaagatgcacgtcctgtcggacgcgaacggactgcccctggtcgtcggcgtctccgccgccaacgtccacgacagcgagggcctgaagccgatggtggccggtcaccaaacgagacacgacccccaccgcggccgctgcttcaagccccagcgcctccatgcggacaaggcgtacgacattcctcacctgcggaaatggttacgcggcaagcgcatcggcgtgcgcatcgcccgcaaaggcatcgagtccagcgaacggttgggccgccgccgttgggtcatcgagcggaccatctcctggctgtccggctaccgccgaatcagcccccgctacgaacgcaatctccggaactacctggcctttctcggcctcgccgctgcactgtgctgctacaaacgactggtccgcctcaccaca

SEQ ID NO: 4200 - DNA, 180 bp, Streptomyces avermitilis
  CDS (1)..(180)
gtgctgccttacgggccggggccaaagcggctcggccgccaccgctgggtcgtcgagaggaccgtgtcctggctcgccggctgccgccgactccaccgccgctacgaacgcaaggcagaacactgcctcgccttcgctggcatcgccgcagccctcatctgccagcgccgcctcaccaaa

SEQ ID NO: 4201 - DNA, 615 bp, Streptomyces avermitilis
  CDS (1)..(615)
gtgctgggctgcctgaccacctggatcggccgcaagttcgacatcccgtccctgatacatcccggacggcggctgtaccggcggatggtgcagaccgcgggcgatcagcgcgcggcgcgtgacgaggccgcccgccaaaccctgcgcgagcaggaggccgccgcggatgcggaggcagcgcaggacggcacggacggcatcgcggacggtgtcgagcgtccggccgcgaaggttcccgccagcacgaatcccgaggtcagcgaaggagagcacgtgtccggattccagttcgaagaggtcgcctccgagatggagcaggccgccaaccagtacgaccccgagaacgccatggagatcctcgccatggtcgagggtctgccggccgcgctgaccagcgtggcgaacgtgatgaagatcctcgcggagcgctccgactcggagttcccgctggagaaggaggtcgcggacggcttcaacgacatcttcggcgccctgatgagcgccgtcgcggtcgccgaggacatggggccgctgttccggcaggcccacgagcaggacatcgcccggcatgaggacccccgcaacggcaccgaggctgagaagggctggaacgtc

SEQ ID NO: 4202 - DNA, 516 bp, Streptomyces avermitilis
  CDS (1)..(516)
gtggcgccgccgggcgggagttctgcgtcgatggagaacccggcaccggtctcccacatctccacccccagcacgcgcacggtgatggagcagacgcgctggatgcggtcgacccattccgcggcgatcgcgcggcgttccgtggacaactccgcggcgatctgccgctgttccgcagcgatggcctcctcctcgcgtgcctcctcgtacagcgcggcagagcgggcggcggcgccgatgcccacgccgatcgtggcgagcgagccgagagcggcccaggtcagcgggccgttcgtcatggcccacgtggtccagccggcgccgaccagccaggaggcggcgcgggtggcgagggtgcggccggcgttgcgtactcgcaggccgacgacggtgtgtccgagcgcgccggcggcaccgacggccagggcccagccggggggcatggcggttgcggcgccggtggtggcgacggcgaaggctccggtggtcgcggacagggcgccggtcacgggtccg

SEQ ID NO: 4203 - DNA, 1401 bp, Streptomyces avermitilis
  CDS (1)..(1401)
gtgaccacggtcaacgtcctggagcaggaacgcacctaccccaccgactacagcacgctgtccctgcacacgggcatcccgtgggggtatcgcaccaacgcacagcagatcctcgcctacctgcgcgagcagtgcgccctgatcgtcggcccgaccggatcgggcaagacgaacatggtgcacgcgatcctcgccgggttcgcccgtgccgaggacgtcctcacgtgggtgatcgacctgaacgccggatcggccggtctgccgtgggtgctgcccgcgctgaacggccagatcgtgcgggaggacggcaagcccgtgcggcccggtatcgactggctcgccggcacgttcgatgaggccatgacgatgctggatgcggccgtgcgcgtggccaagcagcgcaagatgggctaccaggcgcttctgtcgaaggccaacacggacctgttgccgatcagcgccaagattcctcagatcatgctcgtgatcgatgagggcgcggagatcctggtcagccccgaccggcaggtgcgcaagctcggggaaaagatcctggaagtcatccggatcgcccgcgccatgggcgtgcgcaccgtgctcaccgcgctcggagcgactggcagcgtgctgagcaacctgatgatccgccgcgaggcaaaggtccgtgtcgctctcacgggtagcgagacggagggcatggacctgagcaagatgttccccggcagccggggcctgcgcgtggaccaggccccttacaagggcgccgggttcatgggaaccccggagtcgccggccgcgctgttcaaggcctggcggatcctcccgaaccagatccgggagatcaccgccgccacatccgaccggcacccacggctggacgacgtgtccgcaaaggcagccggacccgcatacgcgcggcgctgggatgccgaccgcaccgcatggatgcgcgaccaggccgtgtcggacgacgccggcgatgactcgcccgtgacgcccggagcgctccgcctgtccgcactgaacgagcagcaggagtctcccgaggacgccctcgcacgccgattccgggaggagatcgacgcgcagttcggcaccgcacccgaaccccacaccaccgagcaagacgacgtggcggagcggccggtcggactgaacctgtcggcgctgcgggacgagcaggacagcccagcgcaacaggccgcgctcgccgcactgatcgccgccgggcccgccgggacgggagcatccgcgatcgcccgcactctcgccgacgggttcgggacgacgcgtcagacggtcgtgggctggctgaaaacttggctgaccgacggcaccgccgttcgcgtcggggagggcaccaaggcccgctacgtacaccgctcccacacccccaacggc

SEQ ID NO: 4204 - DNA, 321 bp, Streptomyces avermitilis
  CDS (1)..(321)
ttgagggagtcagaaatgcgccagcccaccccgcccggacagatagccccacacatccccgccgacgtcttccagcgctctcaagcgaccggacagccggtcgtgttcgtcgtcaacgacaccccgcccgccgtcccctgggcccggctcctgatcccgttcgcgatcgccggggccgccgctcttggcacctggggcgtggtcgccgccttgtgctggctgatggacgtggccgcgcacaccgcaaccgtcatcgggggcgccgcgggacccatcggagccggcggcatcacgctcaagctcgcccgcggcaagaacacc

SEQ ID NO: 4205 - DNA, 354 bp, Streptomyces avermitilis
  CDS (1)..(354)
atgacccaacctgccaacgtaaggcgagaccccgccttaccgatcagcacagatctcacccgactcggactgctcgcctgggcaacgcaaaccgcacagcgcggccggcacgtcatcccgctacggccgaacgacaagcgcccggcaggccacgcggagcagtactgccccgccaccgggcggtgcgcggatggacacaagacacccgagcagcgcgccaccaccgacgttgaactgctcatcgccgcatgggcacaagcgccgtacaacgtccgtatcgccaccggcccttccgggctacgggtcatcgacctggacggctccatccgcaccgcccgcccgcgggaggccgca

SEQ ID NO: 4206 - DNA, 210 bp, Streptomyces avermitilis
  CDS (1)..(210)
atgaccgcccgcaactccccccacctggaaggcctaccgcgccccgcccgaccggccggatctcaggcgactgtgggcgaaccgaaggtcgccgcgcgcgccggccacagcatcgctgtgctgtaccgcttctacgcgaagatcttgaaggggggccagcagcagtccaacagcctgatcgcccgcgcgctcgacgagggggaatggccc

SEQ ID NO: 4207 - DNA, 1416 bp, Streptomyces avermitilis
  CDS (1)..(1416)
gtgagcaccgagaacgagggcaccgcggtacccccggccccgtcagcacctcccgtgccggtggaaactcccgctcccgtgcagagcgccgcgcctgtcggtgccgctccgtcggcgagcgcccccggacagggtttcggtgagccgcccgcacatcagggcttcgcccagcacgctccgggcgccgccgaggcgggctggccgcctcccccgcccgcgacgcccgcgtacgccgacggtggcggcgcgggcgccgaatggggctcctcgtaccagcagcccgcgccgaagccgaaggccggccgcggcggactgctcgccgcgatcctcgtggccgcgctggtcgcgggcggagtcggcggcggcatcggctacacgctggccaaggacaacgacggatcgagcggctcgacgacggtctccgcctccgacagcggcggctccgtcaagcgggacgcgggcacggtcgcgggcgtggcagccaaggcgctgccgagcacggtcaccatcgaggcccagagcagcagcggagagggcggcaccggcaccggcttcgtcttcgacaagcagggccacatcgtcaccaacaaccacgtggtggcggaggcggtcgacggcggcaagctcaccgcgaccttccccgacggcaagaagtacaacgccgaggtggtcggtcacgcgcagggctacgacgtcgcggtcgtcaagctcaagaacgcgccgtcggacctgcagccgctgaccctgggcgactccgacaaggtggctgtcggcgactcgacgatcgcgatcggcgcgcccttcggcctttcgaacacggtgacgacgggcatcatcagcgccaagaaccggccggtggcctccagcgacggcagctccagcagcaaggcgtcgtacatgagcgcgctgcagacggacgcgtcgatcaacccgggcaactcgggcggtccgctgctggacgcgcagggctcggtcatcggcatcaactccgcgatccagtcctccagcagtggcggtctgggcagctcgggccagtccggttcgatcggcctgggcttcgcgatcccgatcaaccaggcgaagtacgtcgcccaggagctgatcaagacgggcaagccggtctacccggtgatcggcgcctcggtctccctcgaagagggcacgggcggcgcgaagatcactgagcagggtgccagcggctcggacgcgatcaccccgaacggccccgcggccaaggccggcctcaagccgggcgacgtcatcaccaagctcgacgacatggtgatcgacagtggcccgaccctgatcggcgagatctggacccaccgccccggcgccacggtgaagctcacgtacacccgggacggcaaggcccgcacgacggacgtcacgctgggagagcgcgtgggcgacagc

SEQ ID NO: 4208 - DNA, 807 bp, Streptomyces avermitilis
  CDS (1)..(807)
gtgacccacgcacgacagcacccgatccaggtcgtcgcccaccgaggggcctccgaagaggcgccggagcacaccctggccgcgtacaagaaggcgatcgaggacggtgccgacgccctcgagtgcgacgtccggctgactgcggacggccatcttgtctgcgtccacgaccgccgcgtcaaccgtacgtccaacggccgtggcgcggtctccgcgctggagctcgccgagctcgccgcactggacttcggctcctggaagaacggcgacgaggcccccgactgggagcaccgccccgaggaccgggagaacacctccgtactcaccctggaacggctgctcgaactcgtcgccgacgccgggcgtccggtcgagctggccatcgagacgaagcaccccacccgctgggcgggccaggtcgaggaacggctgctgcacctgctgaagcgattcggcctcgacgcccccgagtccgccgcgacgtcgccggcgcgcgtcatgagcttctcggcgcgctcactgcaccgcgtccggaccgcttccccgatgctgccgaccgtctatctgatgcagttcgtctcgccccggctgcgcgacgggcggctgcccgcgggtgtccggatcgcaggcccctccatgcggatcgtgcgcgggcaccccggatacatcgagcgcctcaagcgggccggacaccaggtgcacgtatggaccgtgaacgagccggaggacgtcgatctctgcgttgagctgggcgtcgacgccatcatcaccaaccgcccgcgcgcggtgctgcatcagctcggccgc

SEQ ID NO: 4209 - DNA, 651 bp, Streptomyces avermitilis
  CDS (1)..(651)
gtgcgtcagcggacgtggaccggccggtttccagttcagtccaaaggggcattcacaccgtggcgtggggcgaaggaggtctcgggggtggcgttggtggtggcacaggaggtgcccacgtcgtcgagcatggccgtaccccatggccctgcgggcgtggggaaagcaagacaccggatgcgtgatcagttgcgtaccggtggagtggcggattcggtcatcgacgatgccgtactgattctttccgaactgctcagcaacgcctgccgccacggcaggccgctgggcgacgccctcgcgggagacggcgatgtacgcgccgcgtggcgcgtcgacgactgcgggagactcacggtcgaggtgacggacggcggcggtccgacccgcccggttccggcgacgccctcggtcaccgcgcgcggcggccgcgggctgaacatcatcacggcgttggccgaggactggggcgtgcgggatgacgcccggggtgaagtgacggtgtgggtcgtgatgcacggcgacgtggacgccgggcaccgtcgcgacgacttcgctacgcgcgtcacggcaccgtcgccgcttcggcagccgctgctgtcggactcggggatatccgacctggacttcgcggacgccttcgacgacgtcgac

SEQ ID NO: 4210 - DNA, 963 bp, Streptomyces avermitilis
  CDS (1)..(963)
atggccaagaagcgaccccagacgaagtccaagcagccccagctgaaggacggagagatcccggtcgtcggcgctcgcgaaccctgcccctgcggcagcggccggcgctacaaggcctgtcacggccgcagtgccgcgcacgcggtgacggagctggtgcagcgccccttcgagggactgccgggcgagggcgactggatcgcgctgcgcgagctggtccccgcggcgaccgtcgagctgaagctcagggaggacctccccgagggcgtcccgtcggtcacgctcgccaccgtcctgccgatggcatggcccgcgctgcgccgcgacgacggctcggtcctgatcggcctgcagaacgacacggcgtcgggtgacatcagccgcgacctggccgacaccctccagcgcgcgctgacggcggagcccggcactccggtccagggccggcgcgctccggccgacgggcctcggctccaggatctcctcgaccccgaaggcgcgttcgagccagttgtgcacagcggcttcgaattctgggtcccggacgccgagaacgcgacgcctgaggtcgccgcgtccctggagcgggccaacgctgccgccatcgcgacggtcaaactctccggcgtggacgcggcctactggtgcgagacccccgacaagaaccacctgcgctgggtcatgccgtaccccgaggagcagcttctggacgctctcgcgcggctgcacgcggccgggcagtcgggcctcggcgagggcacgcggctggtcggttccttccgtgcccacggcctgacggtgccggtctgggacctgccgagcggggtcggggcggaggacgtggagaagccggcggccgagttcgccgagcgtctggcggccgctctcgccacggatgcgccgctgaccgcggacgagcgccgggcgcgcggcggactgaccaaccgacaggtgacactcagc

SEQ ID NO: 4211 - DNA, 573 bp, Streptomyces avermitilis
  CDS (1)..(573)
atgcagcgtcattccggggaacagcgaacgtcatcgccgcgccgtcgcgggctggacccccgaagggtgcggctgttcgccctcgcggccgtagcggcggccacggtcgcgctcccgctggccgtggcgtccgcgggccctgtcggtgacgagggccgcgcggccctacgagcgtccgaagccgacgacaaggtgccggtaccctcccgttcccccctggtgctgggcctcggcctggccaccgcggcccgctgcggccccgaactcttctccgccgacggcatcgaggcgcagacctgtgtcatgacccaggggcgggacacctgggcgcgcacctactaccgcaacgcgaccggcgaggacctgcactccgtcctgagcctcatggagcccggcggccgtaccgtgcagatgcgctgcgtggtgggcgcggaggacgacccgggggcgtgtgagacgcccagggagcgcaccgtgggggatgtgggggcgtacacggcgatcgcggagttcgcgaagggcgccgggagcggaccgctgctgctgcgctccgggagcgactcgggcgggtcg

SEQ ID NO: 4212 - DNA, 663 bp, Streptomyces avermitilis
  CDS (1)..(663)
atgcgcgagatcctcggaaggcgacgcaggctcctgtccaagcggaacgacgggaggcctgagttgatcagcgcggccctgaccttcgcggccgaatggaagtggcccgttctcccgggtgtggcgccggacccgcaggggcgtgcccgctgcggctgtcccgacccggagtgcacggtgcccggcgctcaccccttcgacccagggctgctcgcggccaccaccgacgagcgcatggtgcgctggtggtggacgaacaggcccacggcccccatcgtgctggccaccggaggcaaggcgccctgcgcggtgagcctgccggccctggcggcctcccgggccctcaccgcgctcgaccagatggggatgcgcctcggcccggtcgtcgcgacgccccaccgctgggcgatccttgtggcgccctactccatggagcagctgggcgagctgctctacgcgaaggactacgtccccggctccctgcgcttccacggggagggcggctacatcacgctgcccccgtccgagaccggccacggccggatcggctgggagcgggcaccgctgcccggctcggcagcgccctgggtgcccgatgtggaggccgtcgtggacgcggtcgtcgaggccctcactcgtacgggtgtgagcgcgcccgagttg

SEQ ID NO: 4213 - DNA, 1392 bp, Streptomyces avermitilis
  CDS (1)..(1392)
atgaacgcccctcacctcccgaaagtggctggaatcgattcaacggttccctcgcccgcacacactgtcgcgccgacgtccgccgccacaggcaccccttcggccacgtccgccaccggccccggagcagttctgcaggaccgtctcgccagctgggtctccgacctcacgacccttcacgaactcaccgaacgcctggcacgcacggactcgctcgccgacgcactccaggagctgctgcgcgccggagccgccctggtgggcgcccggcgcggtctcgtcgtactggaaccacgcgacgggctcggcccggacacgaccatcggcctcggcctggcccgcgccgatctcggccacatcgagaccgtgccgcgcagctccatgtcgtacgggaagatcctcgacggacttcccggcggcgagcgcgagatcacccagcccgacctgttctccgaggacggcctggacccccgccaccgcgaggtcgccgcccggctcggctacgccgcgagctacgcccttcccctgtccacccaggccgcgggccgtctcggcgcggccgtgtggctctacgacgagcccgccgagccggtcgagcgccagcgccacctcatcggcctctacgcccgctacgcgaccgaacacctggcgcggctcgtcgaaatggaacgcacacgcgcgtgcatgacgacgatctccgaggagctgcttccgtcccggctgccccgggtcaccggcgtccagctcgccgcccggcgccgtaccggaccgcgcggcggcggcgactggtacgacgcgctgccgttgcccgacgcggcgctcggcctcgcggtcggctcggtcaccggctccggccccagcgcgatcgccgcgatgggccggctgagggcctccctgcgcgcgtacgccgtgatggagggcgaggaccccgtcgccgtcctgtccgacctggagctgctcctcagactcaccgaacccgcccggtccgccaccgccctcttcgcctactgcgaacccgccctccgcaagatcacgctcgccggggccgggcacagcccgccgctggtgatcggcgagcggcgcacggagttcgtggagacctcactgtcggcgcccctggggatgctggcctgctgggaggccccgagcgtcgaggtgaccgcggcgcccggcgagaccgtgctcctgtacacggacggcctgctgcatcgcaccggcgaccccatggaccgcgccttcgcccggctgcacgccgccgcggcgagcgttccgcgggcggtgcgcaccgatccgggcgccgtcgccgaccacgtactgcgcagcgtgctgccggacggcctggacgcggcggacagcgaggaggacgtcgtcctgctggcggcacgcttcgag

SEQ ID NO: 4214 - DNA, 1461 bp, Streptomyces avermitilis
  CDS (1)..(1461)
atgaccgtggcggaggagctcccggagaccccggagaccgctgaagaagagcctttgaagcagcgaaagaacagtctgtacccgggcgtgtccgacgagctggccgagaacatgaagtccggttgggccgacaccgagctgcgcgacctgcagcccatcgcccaggccaccgagacggccgcccgccgcaccgcgctctccgcgcgcttcccgggcgagcgcctggtcgttcccgcgggcaacctgaagacccgctcgaacgacaccgagtaccccttccgagcctcggtcgagtacgcgtacctcaccggcaaccagaccgaggacggcgtcctggtcctggaacccaccgccgagggacacaaggcgacgatctacctgctgccgcgctccgaccgtgagaacggcgagttctggctctccggccagggcgagctgtgggtcggccgccgccactcgctcaccgaggcggagcagctgtacggcatcccggcctccgatgtgcgcgagctggccgacaagctgcgcgaggccaccggacccgtccgcgtggtacgcggctacgacgccggtgtcgaagcggcgctgaccgacaaggtgaccgccgagcgcgacgaggagctgcgggtcttcctgtccgaggccaggctggtcaaggacgagttcgagatcggtgagctccagaaggccgtcgactcgaccgtgcgcggcttcgaggacgtcgtgaaggtcctcgacaaggcggaggccacctccgagcgctacatcgagggcacgttcttcctccgcgcgcgcgtggagggcaacgacgtcggctacggctcgatctgcgcggcgggaccgcacgcgtgcacgctgcactgggtgcgcaacgacggcccggtccgctccggcgacctgctcctgctggacgcgggcgtggagacgcacacgtactacaccgccgacgtcacgcgcacgctgccgatcaacggcacgtacacggagatccagaagaaggtctacgacgccgtgtacgaggcccaggaggccggtatcgcggccgtgcagccgggcgccaagcaccgcgacttccacgacgcggcgcagcgtgtgctgaccgagaagctcgtcgaatggggcctcgtcgagggccccgtcgagcgcgtcctggagctcggcctccagcgtcgctggacgctgcacggcaccggccacatgctcggcatggacgtccacgactgcgccgccgcgcgcaccgagacgtacgtggagggcgtcctggaggcgggcatgtgcctcaccgtcgagccgggcctgtacttccaggcggacgaccagacggtcccggaggagtaccgcggcatcggcgtccgcatcgaggacgacatcctggtcaccgcggacggcaaccggaacctgtcggcggggctgccgcgccgctccgacgaggtcgaggcgtggatggcgtccctgaagggc

SEQ ID NO: 4215 - DNA, 1413 bp, Streptomyces avermitilis
  CDS (1)..(1413)
gtggacgacttctggtccggtgtcggagtggatctgcatctggaaccggacgcggcggcgggccgcagggcgggcctcgaacgggcgctgcgggacgccgtgcgcgacggacggctcgcccccggcacccggctgccggccacccggcggctcgcggccgagctgggcatatcccggggcacggcgaaggcggcgtacgaccagctggtcgcggaggggtacctcacggcccgccagggtgccggcaccgaggtggcggcactgccgagcgcgtccttggagacgcgggacggcgacgcacgcacgcgtgcacctcgtttcgatctgcggccgggcagccccgacgtcggcgcgttcccggcggcggcctggctgcgggcgctgcgccgcgccatcgcgacggcgccctcgctggcatacgactacggcgacccgcgcggccgcatcgaactgcggaccgcgctgtcgggttatctggggcgggcgcggggcgtgatcgcaccgcccgaacggatcgtgatcacctcggggtacgtacaggggctggccctcctcacgcgcgtgctggacggcgggacggtcgccatggaggatccgggactgccgttccaccggaacgtggtgcggcggggcggcgcgagcgtcgtaccgcttcccgtcgacgaacgcggtgcgtgcacagaggggttggggacggagtcggccgtcgtcgtcacgcccgcccaccagtatccgaccggggtcacgctgcaccccgagcggcggcgggccctgacggactgggcacgcgcgcggggcggactgatcgtggaggacgactacgacggggagttccgctacgaccggcagcccgtcggcgcgctccagggcatggcacccggtcacgtcgcctacctgggcacggcctccaagacgctcgggcccgcgctgcggctgggctggatggtgctgccgccgcacctggtcgacgcggtggccgacgccaagctgcacagcgaccatcacacggagtccatcggccagctggcactcgccgaaatgatcaacagtcacgcgtacgaccggcacgtacgcacctgccgcctgcggtaccggcggcgccgtgaccagctgctggaccggctggggccgcggtggtacgtacgcgggatagcggccggtctgcacgctctcgtcgaagtgccggacgagtcggcggtgttggcgcgggcggaggcggaggggctcgcggtgggacgcctcgggaaccactggcatgcgtcggcgggggatggccgtgcggagagggatggccacgcgacgggggacgagcgtgcggcggggcggccgcaggggatcgtggtcgggtacgggacgcctcgggagcgggtgtatccggaggcgttggaggtgctggggcgggtgctggacacg

SEQ ID NO: 4216 - DNA, 1467 bp, Streptomyces avermitilis
  CDS (1)..(1467)
atgacgaacgacgccgcagcagtcgagcccggaaccccgggcaccgggacctcgggcaccgggacaccggacgcggccctcgtgggggcgagccgtgccgtgggcgacggctctcctggacgggcgggccgtaccgcctctcccgggcgggtgggccatctcgtcccgcccgccggcccgcggcgcgtgctggccctggcccagctgagcaactccgtgggggacggcgcctattacgtgacctccgcgctgtacttcacgcacgtcgtcggtctgcccgcaggacgcgtggggctggggctgaccgtcgcatgggcgatcggctccctggtcggcgtaccgctgggccggctcgccgaccgccgcggtccgcgcggcaccgcggtactgctcgcgctcgcgaccggattggcggtggcatccttcctggtcgtacgcggcttcctccccttcgtcctcgcggcctgcgcatacgcgtccgcgcagtcggggctggcggcggcccgacaggcgctgctcgccgggctgataccagccggcgagcgcacaggcctgctggcccaccttcagtcgacgctcaacgcgggcctggcggtgggcgcggggctcggcggcctggcgctgcacgccggatcgcgggctgcgtacctcggcgtgttcgccgtggacgcggtgagcttcctgctgtgcgcggcgttgctgctgcggctgccgtcggtggcaccgaccgcgacgggggtgcggcggggccacggcctcggggttctccgcgaccgtccctatgcgctggtcacgctcctcaacacggttctgctgctgcggatgccgctgctcagcctcggcatcccgctgtggatcacggaacgcacggatgcgcctgcttggctggtctccgcgctgttcgtgctcaacacgggggcggtgatgctgttccaggtgcgcatggcacggggggtcaccgggctgacgacggccacgcgggcgatacgggtctcgggcgtcgtgatgctggcgtcctgcgcggtgttcgccctgtcgtccggcctctcgccgtggggcgcggcggggatcctggtcctcggcgccgttctccaggtcgtcgccgagatgaagcagtcggcagggtcctggcaactggccttcgacctggcaccggccgaccggacaggggagtaccagggcttcttcggcacgggtgtcacggtggcccgcacgctggggccgctggtcctgacggcactgctggtggactgggggacgcccggatggttgctgctgggcggactgatgctggctgcgtcgtacggaatggggccggcgacgaagtgggctgccacccgcggcgcggtgacagcccaggacgatcaggaccagcaggacccacacaacccacagggccagcagggcgacccgaacaggtcgggcaggcagggcgcggccgaggtcaggcagcctgcgccggtgagc

SEQ ID NO: 4217 - DNA, 837 bp, Streptomyces avermitilis
  CDS (1)..(837)
atgagcagccgtgagaacgaggcgctggcgcaggccgccgtgagcgcactgacccggcaattggaactggctcccaagcccggcctgcccgatccgcgcgacctcggggcccgcgccacccggcaggatcactgtctgctgcgctggtcggccaaggcgctgacgcccggcctcgcggcgatggcggcggccgcgcgccgcaccggtacggcgacgccggaactccgcaccgaactcggcgcgatcggacgctccaccgagcactccgtgcggctcgccggcgggggacaccggggcgccctgtgggtgctggggctcctggtcgcggcggccgccctggagcctcgggccaccgggcccgacgtggccgcgaccgccaagaagatcgcggcgcacaccgaccgacgggcgccgcggcggccttcccgggggtcgtcggtctcggcgaagtacggggcggcgggcgcgcgaggggaggcgcgagccggatttccgcacgtacggcgggcgttgaccaccctggccacggcgcgctcggccggcgccgccgaatccgaggcgtggctcgatgctctgctgacggtcatgtccaccctccaggacacggagttgctgtacacggcaggtccgcacggtctgcgccatgtgcaggccggtgcgcggggagtgctcgaggcgggcggcacggcgacggaggcgggtcgtgaggccctgtccgcgttcgacgccgatctgcaggcgcgtgggtggagcccgcgggggagcggctcgctgctggcgggggcgctgttcgtggacgcgctgccggtggtcgtcagctcaccggcgcaggctgcc

SEQ ID NO: 4218 - DNA, 1032 bp, Streptomyces avermitilis
  CDS (1)..(1032)
ttgccggcattctcaggctgctcacagcgtgaccccatgtccctgaggggcggcgtccctagcgtcccgagcatgactgggaaccacacggacaaaaacatcacccggcgccgcgcgatcgcggtgaccggtggaacggtcgcggccggtgggctcgccgtcgccggataccagtcggccttcgccgacgagaccaccgccgacaccgaagccaccgcggccgacgcgtccgcctcggcgagctccggcagcggcacctgcgtgctgatgtcgagcgtcaccgaggggccgtactacctcgacggcgcgctcgtgcgcaaggacatcaccgagggcaagaacggtgtcccgctgacgctgcgcatcaccgtccaggacaccaccgaatcctgcgctccggtcgccggtgcggcggtggagatctggcactgcgacgcctggggctactactccggctacaccaccgccaaccccggcggctccgcacccgccgagagcgaggacggctcgaccgccgacgaccagacatacctgcggggttaccagatcgccaatgccaacggggtcgtcaagttcaagacgatcttccccggctggtacaccccgcgcacctgccacatccacgtcaaggtccacacgggcggcgagaaggaggacggcacgtacgagggcggcaaggtcaaccacaccggccagctcttcttcgccgacgacgccgccgaggagatcttcgccctggagccgtactccaagcacaccggcagctacaccaagctcgacgacgacatggtctacgacggcggcggtgccgccagcggtctgctcactctcgaaccggtccacacggcggacccgtccaagggctacaagggctacatcatcctcggcatcgaccccgacgcggagaacaccggcgcgggcagcggcggtggcggaacgcccccgagcggtgccccgagcgatgcccccaccggcacgccgccgagcggcgctccgagcgacagcacctccccgtccgcgtcggcgtcttcg

SEQ ID NO: 4219 - DNA, 3204 bp, Streptomyces avermitilis
  CDS (1)..(3204)
gtgacggcaaggttcacgccactggacatggctcagagactgggcaggaccgagcagcgacagatccgcccctcgattcctcctcaggtccacagcaggagcgacagccaccccaggcgcacggcgtccccgtcgcccgcgccgtccgagccgacgctgaccgccctcctggagcagcgcttccccgaggtcgtccagctgctgcggtgggtgggttgtgagtccctcgacgactggatgagcgtctgggtccagcaccgcggcgcgggatgggtgtacgaagtcctcgacgcggagcgggacccaggcggtgtcatcacggcgtggaaagccgttctggacgcccgtgaccaggccatcctggtcctggaatcgcttgtcttcgagagcaacctgtgcagattcgcggccgaggcgtccgcgaagatgcccagcaggctccggtacgacaagaccctgcacgtggtcaggcagcgcgtggctctctccctgtgggaccacgctctttccatcaactggtggcgcccctttgtcttctgccgcgcgttgcgcctggcgcgtacctatctggtccatgtggtccgggacaacgccctgaccgagggcagcagcagattccagttctccggccggctgggccaggccaccgtgctgctggcgcggttcgaacaggtgggcgccgccgatctggagtcgtcggccgcgcacatccgggcctcgatcacggaggggaaccccgccgaggacgccgtcccctatctcctggagtgctatctgcggctgcacgaccacacggggaaccgggagtatctcggccgcgccgtaaagaccgacaaggatttccccggcgagcggcgcggcacgtcatggatgctgcacatggccgagatctggttgcggctggccgacgggctgcccaagggcgacgccttcggcacctatctcgaacgagccgagaaggcgttactggccgcgggcgagccaggcggtgaggacgccgtacgtcatgccctcctggactgcgtcgcggccgccgcccgcaggacccccgaactggtgccccacataaggctcgggctgcgacggctcaacaaccccttcgggctcggcgagcatctgcgccggttcgcggaggacgggtacccggccgtgacgctcccggccacgctcgtccaccatctgcaacgccgcttcgagtcctccaccgaacccctgcaccgccgtctcctgtccgactgcctgcgggcgtacatccaactggacgacgtcagtgagatggaacgcgcccggctgctgcgcaaggcactcgacctccaggagaggtcgctcgtgagagccgctccgctgacggacgaactcagcaggatgcgctatgccgacgacctcctcgccacggccgagttgcagggcaaccgcaagttctggatggtcggcatctcacttctgatccgggagacggcggcgaacagcacgtcctgtgtgccgctggtacggctcggccgtgaactggagaagggcgggaccctcaaccggtccgaacaggcggacatgcgccgccggctgggggacgtcccgcaggccgaccggtggatccgggcggtcgcggagggcgactccggcctcttctacgaggaggccgccgaccgggccatcagcagccccgacctggtgcgccgcaacctcggcggccgcagcaacgtggtcaccgtcgacgactatctcggcttcaccagctccaccctcgtcttcaaaccgaccacgcggctctgcttcgaccgcgacaccgagaaatcggccgcggtggcgcgcacgctgcgccgtatggacgccgaggacgaattcgccaccatcgacctgatcaccaccatctcggccaccgatctgtcgcacagcgaggagcagttccagatcggtacggagatcatcaccgtacgtcggttcgagcacggcacggtgctcgccgagtgcctgtcgcccgcatccccggacacgtcctgtgaactgctgaagcgtgccgcgaagttcctcgcctacgtgcacggttccgacgacccggcatcggggcggatcggcggggtgcgcaaggaggtgcgcaacgaggtgcggatgtggctgcgggcggtgctgcccgacgagccgtccgacggggccaacgagctcttcgaggagtggtgggccctgctggaggggatcggcctgccgccgcagccccgcagggacgcccacgccttcaactggctcgtgaccgacaacgaccggatcatcgcggtcgacctggaggcggcgcgctggcgccccatgggctacgaactcgcccagctgacggacgacgtgccggcccttccggtggaccgctgggatctgcgccgcgatgtggtgacctgctacgtggaggcgctcacgcggtgcgccggcccctcccggcccattgacgtcgagaaggtctgggccgcctaccgggcttcgctgctggcccgggcggtgcggtgcctgagcgaccggaccaacgaaccggggatccgcgagcacggcgaggccctgctggacgagctgagctcgcagccgaagggcgacctcacgcgcgatctcgcgatcaggctccgtgacgcctgggcgaaacggcgcggcacaccgggcgacgccccgctgcgggagctgaaggacggccgcagacgccggatcagccggtcgctctcctaccatctgcggcacgggcgggagctgacgcagaacccgcagggctgggtgccgatcgactccctcgtgcgggccctggaccccaaactcagggtctccgcagacgagttgatcagtgtcgcgcgcgcggtgagcgaggagcgcttcgaggtccggggcgatctcgtccgagcccgctacggccactcgcggcccacggcgatcgagtacgagatcagagcacccgaaggccggctctaccactgcacccccaccaccgcgctccacaacatctttgagcgcggcgaggggctgaggccgatgacccggcagtgggtccacctgaccacggaccgcgccgcggccctcagcgccgggcggcggcacggcccgtgcaccctcctgtgcgtgcccgacccctccgcgctggaatgccggcatgcgggaggggccacttggctcgtcgcccaagtcccgcccagcgcgctgacggtggtgcccctgcaccggctgttctccacgcacggg

SEQ ID NO: 4220 - DNA, 456 bp, Streptomyces avermitilis
  CDS (1)..(456)
atgagcatctggtggtcactccatttgcggcgcgatgctgcgagcgtgccgctcgcccgtcggctcctgctgggcacgatggagaccgcgggcgtcgatcccgacatttcctacgacctgtcggtcgccctcagcgaagcctgcgccaacgcggtggaacacggcggcgacgccgcgctcggcggcacgtccgaggcgtaccgggtcaccgcctacctcgacggcgagaagtgccgcatcgaagtcgccgactccggcccgggtttcccgtccggccggtcccgccccgtgatccgcgccgcgcacatggacgccgagcacggccgcggcctcggactcatccaggaactcgccgaccacgtccacatcggcaacaaaccgggccggggcggggcggtggtcagcttcgacaagatcctcaaatggcgcaagggcgcgccactggtcaccgcgtcc

SEQ ID NO: 4221 - DNA, 891 bp, Streptomyces avermitilis
  CDS (1)..(891)
atgactgccccccgccagcgcgcggcgcgctccggatgcgatctccgggttctgagggccgcggtgttcgccgcggtctgtgtcgtgctggccgcggccggtcatggtctcgcctcctgcaccgctgttccgctgtggacgctgggcgccgggttcctcgccgtcttcaccgtcgccgcggcgctcgccgggcgcgagcgtgcgctgccgggcatcgccgcggccctcgcggtcggccagtcggtgctgcacacgctgttcgggctcgggcaggtctccggtacgtcgatgacgtcgggcggcatgtccatgggctccatgggctccatgagttccatggcttccatggcctccatgggcgacgggtccctcgtggaacgggccgcacggctcgcgtgcgggagctccgtcgcggcgatcagtcccgcacaggcccagcggatcctcgccgaggcgcgactcgacacgggtacaagcacgggcacgggcacgggcacgggcatggtctcggcctccatgcaccatgccgcggacgccgtaccgaccgcggccggttcctcaatggcgatgctgccgtccctgcccatgctgctcggtcacgttctcgcagccgtcgccgccggctgggtgctgcgtcgtggagacatggcgctgctgcgtctcatccggctgtcggcgcacggcgtcgcggagggcgcactcgtacgctccctgcgcggggcgctcacgctcgtacgcgccctgttggccggacttcccggtacgcccgacacggccccgcgcgccccgcgcacggcactgctcgtaccgccgaagccgccgaccaccgcgctccagcacacggtgatccggcgcggcccgccacccgccgccgcgctcgtcctcgccgcc

SEQ ID NO: 4222 - DNA, 732 bp, Streptomyces avermitilis
  CDS (1)..(732)
atgaaggcaacccgtatcgccgccgccggtgtcgccgccgcctcggccgtcctcgtcctgtccgcccccgccttcgcgcacgtcagcgtgcagcccgagggcgaggccgccaagggcggctacgcgaccgtgaacttcaaggtccccaacgagcgcgacgacgcctcgaccaccaagctcgaggtgagcttcccggccgaccacccgctcgcctccgtcatgccgcagccgatcgacggctggagcgtcaaggtcaccaagtccaagctggccaagccgctcaccctgcacggcgagaagatcgacgaggccgtctccaaggtcacctggaccgccaccggcaagggcgtcgagccgggcttcttccagaagttcccgctctccatcggcgcgctccccgaggacaccgacgaactcgtcttcaaggccctccagacgtacgacaacaaggaggtcgtgcgctggatcgagccgcagaaggagggccaggaggagcccgagaacccggctccggtgctcgccctgtccgccgcgtccacggacggccaccacggctcctcgaccgccgaggacgcctccgacacctccaagtcggccgccgacagcagcaccgaggcctcctccgccgacagcagcgacaccaccgcccgggtcctcggcgtcgtgggcatcgtcgtcggcgtcgcgggcgtggcgtacggcgttctggccggccgccggcgtacgagcgcc

SEQ ID NO: 4223 - DNA, 651 bp, Streptomyces avermitilis
  CDS (1)..(651)
atgcgcaagaagacgtatgccgcggccgcgctgttcgccgccgccgctctgagcctctccgcctgcggcaccggcgacgacagcaacaagcccatcgcggatgtgtccgccgagaccggttcggacaaggcggcggtggtcctcgacagtccgttcgagaagcccgacctcgtcctcaccgacacgcacggcaagaagtacgacctgcgcgcggagaccaagggcaggccgacgctgatctatttcggctacaccaactgccccgacgtctgcccgctgacgatgaacaacctcgccgtcgccaagaagcagctgcccaaggcgacgcaggacaagctccgcatcgtgttcgtcaccaccgacccgaagcgggacactcccgctgaactcggcaagtggctcaagggcatcgaccccgacgtcgtcggcctgaccggcgacttcgacacgatccaggccggcgcccgcacgctcggcatctccatcgaggcgccgcacaaggacaagaacggcaagatcgtctccacgcacggcacccaggtcatcgcgttctcgccgaagaccgacggcggctatgtgctgtacgacgaccagaccaccgtcgacgactacaccaaggacctccccaagctcgccaagggggagaacccg

SEQ ID NO: 4224 - DNA, 465 bp, Streptomyces avermitilis
  CDS (1)..(465)
gtgaggcgtcccgcaggagccgccgtgggcctggccgtggccctggcgctcgcgggctgcggctcggacgacgaggcggcgtccgcgtcctccgccaagcccgaactgaaggtcaccggcgcctatatgcccgccccctccatgggcaccatggcggccggcttcttcactgtcgccaactccgggggcgccgacaccctgacctcggtgtccagcgatctctccgccgacgtcaccctgcactccaccaagggcggcgccatggaggaggagacgtccttccccgtacccgcgaagggacagctcgacttcgcgagcggcggcaaccacctcatgttcgaaaagctcacccacaagccggagcagggcgagaaggtgtcggtgaagctgcacttcgccaagtccggcacggtcgcggtggagatgccggtgaaggccgccacctacaacccgaagaccggacac

SEQ ID NO: 4225 - DNA, 2082 bp, Streptomyces avermitilis
  CDS (1)..(2082)
gtgggaacgctgctgttgctgttcctcgctgtcgccggcgcgctcctggccggcgccgcgcccgtctccgcgcacgccgcgctgaccgggagcgaccccgcacagggagcggtggtcgacaaggcacccacccaggtctcgctcaccttctccgagaaggtcgcgctgtccgacggctcggtgcgcgtactggaccccagcggcaagcgggtcgacaccggcaaggcatccaacccgagcggtacgacgtacggcgtcaagctgcactcgggcctgcccgacggcacgttcaccgtctcctaccaggtggtgtccgccgacagccaccccgtctccggcgccttcaccttctccatcggcgcgccgtccacgacctccgtctcgctgtccgaccagacggcgggcggcggagtcgtcggcgggctctacgggttcggccggtacgtctcgtacgcgggcttcatcctcatggtcggcggcggtgccttcgtactggcctgctggcagcgcggggcggcggtgcgggcggtgcagcggctcgtggtctccggctgggtcgcgctcacctccgcgacgctcgcgctgctgctcctgcgcggctcgtacaccggctccggcaaggtgggcgacatcttcgatctgacgctcctcggccaggtcctgcagaccaaggcgggcgcggcactggtctcgcgactgctgctcctcgcggcagcggcgctgttcatcgccgtgctcttcggggcgtatgtgaagcgggacgccgagaacgcagacgcagagggcgaggacgaggacggcgagaccgagaagagcggttccgacgccgaccgggccgccgagaagaaggacctcaccttcgggctggcgatcggcgggaccgtcgtcgcagcggggctcgcggcgtcctgggcgatggccgagcacgcctcgaccggcatccaggccgggctcgcgatgcccgtggacgtactgcacctgctggccgtcgccctctggctgggcgggcttacgacgctgctcgtggccctgtaccgggcaccgtcgatcgaggtggcggccgtacgccgtttctctcgcgtcgccttcgcaagcgtggtggcgctgaccgtgaccgggctctaccagtcgtggcggcaggtcggttcgtggtcggcgctcaccgatacgacgtacggacagttgctgctggtgaaggtcggcctggtagccgttctcgtcggcatcgcatggatctcccgacgctggacggcgcggctgccggagacgccggaggccacggctacggccgagaccgctgtgacggccgacgcaacagatgccacggacgcgacggacgcgacggatacgaccgagacggcggatgcggaagagaagcagcgggcggaggtggccgccggtgcctccccggcagtcggcgcctcatccatggccgctgcctcccccggctcccactcctcagaggcctccgacgcctccgacgcctccgacaagggtccggaagacgccggagactcccggcgtgccgctcagctcgcccggcagcgcgtcgccgtggccaccgcccgccagaagcggatccgcgacgccgacccgctccgctccgggctgcgccgctcggtgctcgccgaggcgggcgtcgcggtcgtgctgctcgccgtcaccaccgcgctgacatccaccgagccggggcgcacggaggaggcggccaaggcggtcaccgcctccgcctcccagcggtccgggccgctgtcactgacgatcccgttcgacacgggcggccaggacggcaagggcaccgcgcggctgaccctcgacccggcccgcgtcggcggcaacgagatgcacgtcttcgtgacgcggccgaacggcaaggcgttcgacgtccccgaggtgaaggtggccttcacgctcgacgcgaaggacatcggaccgctgcccgtggtgcccgaccgcatcgccaccggccactggacggcgagcggcgtgcagatccccatggcgggcgactggaagatcacggtgaccgtgcggacctccgacattgaccaggcgaccgtgaacaagaacgcgaagatcggc

SEQ ID NO: 4226 - DNA, 1359 bp, Streptomyces avermitilis
  CDS (1)..(1359)
atggctgaccactccacgccggaggcgtcttccgcaggcgtcccttctcctcagggtgccgtttccgcaaagggctcccccaagaacgctgtttccgaaaacagcactcctggggatgccgtttccgaaaacacgctctccaggggcgtcttttcgcggcggcggctgctcggcaccgccggggccaccgggctcgccctcggcgcggtcggcggggccgccggatacgcggcggcgccctccgccgagaagaccgcgctcctggcgtcgctcggcgcggaccgggtgatgtttcacgggaaacatcagccgggcatcaccaccgccctccaggcccgcggccacgtcgtcgccttcgacctcgccgcgggcgcgggccgcaaggaggccgccgcgctgctgcgccgctggtcggccaccgcccagcggctgatggcgggcgaggcggccgcactcgacgacaccgacgtcgcccgcgacgccggcccgtcctccctgacggtcaccttcggcttcggccacagcttcttcgcccggacgggactggagaagcagcgcccggtcgccctcgacccgctgccggacttctcctccgaccacctcgacaagacccgcagcaacggcgatctgtgggtgcagatcggtgcgaacgacgcgctcgtcgccttccacgccctgcgcgcgatccagaaggacacgggcagtgcggcccgtgtgcgttggcagatgaacggcttcaaccggtccccgggcgccaccgcgcagccgatgacggcccgcaacctgatgggccagatcgacgggacgcgcaatccgaagccggccgaagcagacttcgaccagcggatcttcgtgcccgcgtccggccacccggagtggatggcgaacggctcgtacgccgtcgtacgccgtatccgcatgctcctcgacgactgggagaagctctcggtcacggcccaggagcaggtcatcgggcgccgcaagtccgacggggcgccgctgagcggcggtaccgagaccacggcgatgaagctgcagaagaccgacgccgacggcaacctggtcgtccccctcaacgcgcacgcccgcatcacccggcccgaccagaacgggggcgcggccatgctccgccgccccttctccttccacgacggcttcgatccggacggggtacccgacgcgggcctgctcttcatctgctggcaggcggacccgctgcgcggcttcgtaccggtgcagcgcaagctcgaccggggggacgcgctgtcgcacttcatccggcacgaggcgagcgggctgttcgcggtgccgggcggggcggcggacggcgagtacgtggggcagcggctgttggaggga

SEQ ID NO: 4227 - DNA, 930 bp, Streptomyces avermitilis
  CDS (1)..(930)
atgccagccagctatgcgtatctcggtcccgagggcactttcaccgaagtcgccctgcgcacgctgccggaggccgcgacccgggagctcgtcccgatggtgtcggtgcccgccgcgctcgacgccgtgcgcaacggcgaggccgaggccgcgttcgtcccgatcgagaactccgtggagggcggcatcacgaccaccctcgacgagctggtcgcgggcgagccgctgatgatctaccgcgaggtgctgctctcgatcaccttcgccctgctggtcaggccggacacgaagctgtcggagatcaagacggtcaccgcacaccccgccgcgcagccgcaggtccgcaactggatgaaggcgaacctcccggacgtcgtctgggaatcggcggcctcgaacgcggacggggcgcgcctcgtccaggagggccggtacgacgccgccttcgcgggcgagttcgcggcggccaagtacggtctggtgccgctggagaccggcatccacgacgcggagaacgcgcagacgcggttcgtcctggtgggcaggcccgcccggcccgcggcgccgaccggcgcggacaagacgtccatcgtcctgtggcagcgcgacgaccaccccggcgggctgcgcgacctgctgggcgagttcgccgtacgaggcgtcaacctgatgctgctgcagtcccgcccgaccggagcgggtatcgggaactactgcttctgcatcgacgccgagggacacatctccgaccgacgggtggccgaaaccctgatgggcctgaagcggatctgcctacaggtgcgattcctcggctcgtacccgcgcgcgggcgtcagggcggaggacgtcccgaccgcgctgccggggacgtcggacgacgagttcgtgaaggcctcggactgggtggcgcgctgccaggacggccggttc

SEQ ID NO: 4228 - DNA, 1275 bp, Streptomyces avermitilis
  CDS (1)..(1275)
gtgattgaccttcgcctgctccgtgaggaccccgaccgtgttcgcgcctcccagcgcgcccgtggagaggacgtcgcgctcgtcgactccctcctctccgccgacgagcggcgcaggtcgtccggcgtccgcttcgacgagctccgttccgagcagaaggcgctcggcaagctgatccccaaggcctcccccgaagagcgcgccgagctgctgaagaaggccgagcagctcaaggccgacgtcaaggcggccgacgtcgagcagcacgaggccgacgaggaggccaagcgccttctcctccagctcggcaacctcgtgcaccccgacgtcccggtcggcggcgaggaggacttcgtcgtcctggagacgcacggcaccatccgtgacttcggcgccgagggcttcgagcccaaggaccacctggagctcggcgaggcgctcggcgccatcgacgtcgagcggggcgccaaggtgtccggctcgcgcttctactacctgacgggcgtcggcgcgctcctggagctcgccctcgtcaacgcggcgatcgcgcaggccaccgaggccggcttcatcccgatgctgacccccgcgctggtccgcccgcgcgccatggagggcaccggcttcctcggccaggcgtcggagaacgtgtaccacctggagaaggacgactactacctggtcggcacctccgaggtcccgctcgcggcgtaccacatggacgagatcctcgacgccgacaagctgccgatgcggtacgcgggcttctcgccgtgcttccgccgcgaggccggcacctacggcaaggacacccgcggcatcttccgtgtgcaccagttcgacaaggtcgagatgttctcgtacgtcgctcccgaggacgcggagaacgagcacaagcggctcctggagtgggagaagcagtggctgaccggcctcgagctgcccttccaggtcatcgacgtggcctcgggcgacctcggcgcctccgcgacccgcaagttcgactgcgaggcgtggatcccgacgcagggcaagtaccgcgagctgaccagcgcctccaactgcgacagcttccaggcgcgtcggctgtccgtccgtatgcgcgacggcaagaaggtgcagccgctggcgacgctgaacggcaccctgtgcgccgtaccgcgcacgatcgtggcgatcctggagaaccaccagctgcccgacggctccgtgcgggtgcccgagatgctgcgtccgtacctgggcggccgggagctcctggagccggtagccaag

SEQ ID NO: 4229 - DNA, 828 bp, Streptomyces avermitilis
  CDS (1)..(828)
gtgagcagccccgctccgggttcctccgcggaggggtttccctacaagctggtcgcgaccgatctcgacgggacgctgctgcgttccgacgggacggtctcggcgcgtacgcgtgcggcgcttgccgcggtgaccgcggcgggcgccgcgcacatcgtggtcaccgggcgggcggtgccgtggacgcggcacatcctcgacgacctcggctaccagggcctcgcggtgtgcggccagggggcacaggtgtacgacgcgggggagcaccggctgctcacctccgtgaccctggaccggcagctggccggtctggccctggcgaagatcgaagcggaggtcggcccgctgctgctggccgcgagccgcgacggcctggacggtgaggtcctggtcggccccggctatcgcgtgcagggcggcccgctgccggttcagccgatccgggacgcggcggacctctggtcggcgccgctgaacaaggtgtacgtccagcacccgacgctgaccgacgacgaactcgcggcggtggcgacacaggtcgcgggcgggctcgtgggcgtgacgatggcgggcgagggcatagtggaactcctccccctggggctgtccaaggcgaccgggctgtccctggccgcccgccgtctgcgcctgaaggccgcggacacgatcgccttcggcgacatgccgaacgacattccgatgttcgcgtgggcggcacacggcgtcgccatgtccaacgcgcacgaggagcttctggcggtggcggacgaggtgacactctcccatgaggaggacggcatcgcggtggtgctggagcggttgctggga

SEQ ID NO: 4230 - DNA, 237 bp, Streptomyces avermitilis
  CDS (1)..(237)
atgacggccgaggcaccacgggacgacgggcaggggaagttccaggacgtctgggacgacctggtcctggacgaggacttcatacggtccgccgaggcggcggagccctccgcgcgggcccggatgctggccgcgcgctggcgcgacgaggcgcccgatccgcagccctggcggtccgacgagccgcctgcggggtggttcttcagcaaggcgcgtcgccgcaggtggcggcgacgg

SEQ ID NO: 4231 - DNA, 717 bp, Streptomyces avermitilis
  CDS (1)..(717)
atgtacgaccccacagtcgcccggctcacctatcggggcctgctcggccgccgccgggccctcatcctcggcgcgctgcccgtcctgctgatcgtgctctccgccgtcgtgcgcgcgctgaccggcgcggacgaccaggtggcagccgacgtgctcggcggattcgcgctcgccacgatggtgccgatcatcggcgtcatcgccggcaccggcgcgatcggacccgagatcgacgacggctcggtggtgtatctgctcgccaagccgctgaagcggccgacgatcatcttcaccaagctgatcgtcgccatcgccgtcaccatggcgttctccgcgctgccgaccttcatcgcgggcatgatcctcaacggcaacggccagcagatcgccgtggcgtacacggtggccgcgctggtcgcctccatcgcgtacgccgcgatcttcctcctcctgggcacggtcacgcggcacgcggtggtcttcgggctcgtctacgcgctcgtctgggaggcgctcttcggatcgctggtgtccggcgcgcgcacgctcagcgtgcagcagtgggcgctcgccgtgggccacaaggtctccggcaactccctcgtcacctcggacgtgagcctgacgaccgcgaccgtgctgctggccgcggtcaccgtggcagccacctggtacgcggggcagaagctgcggacgctgaagctggccggggaggag

SEQ ID NO: 4232 - DNA, 909 bp, Streptomyces avermitilis
  CDS (1)..(909)
gtgaccacgctgaacatcgaccacgtctcacgctggttcggcaacgtggtggcggtcaacgacatcacgatgacgatcggccccggcgtcaccggcctcctcggcccgaacggcgcgggaaagtccaccctcatcaacatgatgggcggattcctcgccccctccacgggctcggtgaccctcgacgggcagccggtctggcgcaacgagcagatctaccagcacatcggcatcgtccccgagcgcgaggcgatgtacgacttcctcaccggccgcgaattcgtcgtcgccaacgccgagttgcacggcctcggcaagaaggccgcacagcgagcgctcgccacggtcgagatggagtacgcgcaggaccgcaagatctcgacgtactccaagggcatgcggcagcgcgtgaagatggcctccgcgctcgtccacgacccgtcgctgctgctgctcgacgagcctttcaacggcatggacccgcgccagcgcatgcagctcatggacctgctgcgccgcatgggcgacgagggccgcacggtgctgttctcgtcgcacatcctcgaagaggtcgagcaactcgcctcccacatcgaggtgatcgtcgccggtcggcacgcggcgagcggtgacttccggcgcatccgccggctgatgaccgaccgcccgcaccgctatctggtgcgctccagcgacgaccgtgtgctcgcggccgccctgatcgcggacccgtcgacgtcggggatcgaagtggacctggcggagggcgcgctgcgcatccaggccgtcgacttcggccgcttcacgacgctgctgccgcgggtcgcgcgcgagcacggcatccggcttctcacggtctcgccgtccgacgagtccctcgagtccgtcttctcgtatctcgtcgcggcg

SEQ ID NO: 4233 - DNA, 927 bp, Streptomyces avermitilis
  CDS (1)..(927)
atggcggttgagcagcccacggcccatgcgggcgggcagtccccggcccacgcgggcgagcagtcccgcatccacaacatcggctaccgcaactacgacgggccgcgcctgggccgcgcgtacgcccgccgctccctgtattcgcagtccctgcgcggcgcctacggcctgggccgctcggtgaagtccaaggtgctgccgatgctgctcttcgtggtgatgtgcgtacccgcgctgatcatggtcgcggtcgccgtcgccaccaaggcgaaggacctgcccgtcgactacacgcgctacgcgatcatcatgcaggccgtcatcggcctgtacgtggcctcccaggcgccgcagtccgtctcgcgagacctgcgcttcaagaccgtaccgctgtacttctcacgtcccatcgagaccgccgactacgttcgcgccaagtacgcggccctggcgtcggcgatgttcatcctgacggcagcgccgctgctcgtcctctacgtgggcgcgctgctggccaagctcgacttcaccgaccagacgaagggattcgcccaagggctggtctccgtggcactgctctccctgctcttcgccggcatcggcctcgtcatctcggcggtgaccccccggcgcggcttcggtatcgcagccgtcatcgccgttctgaccatctcctacggggccgtctccaccgttcaggccatcgccgacgcgcagaacagcacctcggccgtcccctggctcggcctcttctcccccgtcacgctcatcgacggaatgcagaccgccttcctcggcgcgagctcctccttccccggagaagcgggaccctcgtccgcgcagggcgtcgtcttcctgatcgtcgtcctgggcctcatcgcgggctgctacggccttctgatgcgccgctaccgaaaggtcggactg

SEQ ID NO: 4234 - DNA, 960 bp, Streptomyces avermitilis
  CDS (1)..(960)
gtgatcgcgaccgaaagcctgagcaagcggtaccccagggtgaccgcgcttgaccggctctctgtggacgtcggacccggtgtgaccggactcgtcggtgccaacggagccggcaagtccacattgatcaagatcctgctgggtctgtcccccgccaccgagggccgcgccgaggtgctcggactcgatgtcgccaccaagggcggcgacatccgcgagcgcgtggggtacatgcccgagcacgactgcctgccgcccgacgtctcggccaccgagttcgtcgtccacatggcgcgcatgtccggactcccgcccacggccgcccgcgagcgcaccgccgacacgctgcgccacgtcggcctgtacgaggagcgctaccgccccatcggcggctactcgacgggcatgaagcagcgcgtgaagctcgcgcaggccctggtccacgacccccagctggtcttcctggacgagccgaccaacggcctcgacccggtcggccgcgacgagatgctcggcctgatccgccgcatccacaccgacttcggcatctcggtgctggtcacctcgcacctgctcggcgagctggagcgcacctgcgaccacgtcgtcgtcgtcgacggcggcaagctcctgcgctccagctccaccacggacttcacccagaccaccacgaccctcgcgatcgaggtcaccgacagcgacgagcacccggacggcacccgtgcggtccgcgacgtgctccacgcgcgcggggtggacacccacgacggcagcgggctgccgggcgcgggtcatgtcctgctgctgaccgcgtcgggtgaggagacgtacgacctggtccgcgacgtggtggccgacctcggcctcggcctggtccggatggaacagcgaaggcaccagatcgccgaggtcttcacgaacagcgacgagcagcggaaggaggcggtcggccatggcggt

SEQ ID NO: 4235 - DNA, 876 bp, Streptomyces avermitilis
  CDS (1)..(876)
atgactggcatgactggcatgacgcgcatggtcggcatgaccaaaggagcggcagccgaactctccgcggagctgcgggggttcaaagaggtgcagcgcctcgcgtacgcgtgtgcggaggcggtcgcggcgcagctgaagcccggtgtgaccgagcgcgaggcggcgcggatgcagcgggtgtggctgcgcgagcgcggcgtgcgggactggttccatctgcccttcgcctggttcggcgaccgcaccgcgttcgtgaacttccgcgttccgctccagttcttccccaccgaccgccggctggagccgggcatgccgttcattctcgacatggcccccgtccacaagggctgcacggcggacatcggctactcgggctccctgggcctcaaccccgtgcaggacaagctcctcgcggacctggaggcgcaccgcgagctgatcctgcgcgaggtgcgcgaacgtcgcccgctgcgcgagatctacgaggacgtggaccggctcatggtccgccaggggtatgcgaaccggcatcgcgcgtaccccttcggtgtgatcgcgcacaaggtggaccgggtgaaggaacgtgcctggtcaccgcatctgttcgggttcggcacgcagtccctgaaggggctggcgggcgacgcgctccgtggtcaccgcgacggctggtcgccgctgtggtctccgtacaggttctccgatcacccgcccaggccggggctgtgggcggtcgagccgcacctcggctttcggggcacgggcgcgaagttcgaggagatcctggtcgtcaccgactcccgggacccggaacagagcgccttctggctggacgacgatctgccgcatgtgcggcgctgggcggaggacaga

SEQ ID NO: 4236 - DNA, 1752 bp, Streptomyces avermitilis
  CDS (1)..(1752)
atgagtcttgagggggcgcgcgagcgctgggtgcggacaggcggaatcgagctgtgcgtagccgagttgggggacgagacacagcccacggtggtcctcgtgcacggctatccggactccaaggaggtgtggtccgaggtcgccgggcgtctgtcggagcgcttccacgtcgtgctgtacgacgtgcgcgggcacggcaggtccacggcgccgcagccgctgcgcggcggcttcacgctggagaagctgacggacgacttcctcgcggtcgcggacgcggtcagtccggatcggccggtgcacctcgtggggcacgactggggttcggtgcagtcctgggagttcgtcacggtcaagcgcaccgagggccggatcgcgtccttcacgtcgatgtccgggccgtccctcgaccacttcggccactggatcaagcggcgggtgaagcggccgactccgcgtagggtgggccagctcctgggccagggcgccaagtcctggtacgtctacctgttgcacacccccgtgctgcccgagctcgcctggcgcggcccgctcggcagacgctggcccaagatcctccagcgggtggagaaggtaccggcggacggctatccgactccgtcgctcccctcggacgcggcgcacggcgcctggctgtaccgggacaacgtacgggcccggctgagccgcccgcgcaccgacgcgtacgcgcacgcgcccgtgcagctcgtcacgcccctgggggacgcattcctgtcggagaagctctacgacgaactggaactgtgggctccgcagctggtccgccgcaccctgccggccaaacactggatcccgcggacgcgccccgaccagctggcgtcatggatcacggagttcgtgatcgcgagcgagggcgggcgcccggctccggtggcgagcggcccgtacgccgaccggttcggcgggcagctcgtgctggtcaccggcgcgggcagcggcatcgggcgggccacggcctacgcgttcgccgaggcgggcgcgcgcgtggtggccgtcgaccggaacgcggagggcgcggcccgcacggcggagatgtcccggctgatcggcgctcccgacgcctgggccgagacggtcgacgtctccgacgagcaggccatggagaagctcgccgagaaggtcgccaccgagtacggcgtggtggacgtcctggtgaacaacgcaggaatcggactctcggggtccttcttcgacacgaccgcggaggactggcggaaggtcctcgacgtgaacctgtggggcgtgatccacggctgccggctcttcgggaagcagatggccgagcgcggacagggcggccacatcgtcaacacggcgtcggcggcggcgtaccagccctcgaaggcgctgcccgcctacagcacctccaaggcggcggtgctgatgctcagcgagtgcctgcgcgcggagctggccgggcagggcatcggggtgtcggcgatctgccccggcttcgtccacacgaacatcacgtcgaccgcgcgtttcgcgggcgtggcggcggaggaggagaagcggcggcagaagagggcggcgcggctgtaccggctgcgggggtatccgccggagaaggtcgcggacgcggtcctgcgggccgtcgtacgcaaccaggccgtcgtgcccgtcaccccggaggcgcgcggcgcccacctcatgtcccgcttcgcgcccagggcactgcgcgcgatcgcacggctggagcctccgctg

SEQ ID NO: 4237 - DNA, 927 bp, Streptomyces avermitilis
  CDS (1)..(927)
gtgagcggtaccgcgagccaccctccgagcgagggccaccatgtgatcgccccgcgccgggtctccttcgactggggccggactccactccactggatcccggacgagcccgtcgccacccacgtcatcaacgtgctgcatctgctgctgccggcgggggagcggtggttcgtgaaggtcttcaaggagggactgccgctgataacggatcccggactcctcgacgacgtgaaggggttcatggggcaggaggccacgcacagcgtgcagcacgcgtacgtgctggagcacctcgcggcgcagcggctcgacgccgcggacttcaccaagtacgtcgacttcctcttcgagaggctgctgggcgagcggccgcccctgagcgcaccgataccggcccgcgagtggctgcggttccggctctcggtgatcgcggcgatcgagcagttcacggcggtactcggcgactgggtgctcgccgcggacggcctggaccgggccggggccgacgaggtcatgaccgacctgctgcgctggcacggggcggaggaggtcgagcatcgcgcggtcgccttcgacatgtatcagcactgcggcggccagggcctgccccggtacgcccgccgggtcgcgggcatggcggtcacggcacccgtgatgctctacctgtgggcgtggggcgccgcgcatcttctgcgccacgacccacagctcgccggacggctgcgctactcgctcgccgcgcacaacagggccgtacgcagggggctgctgcccggctggaaggagctgggcacggcgataccccggtatctgcggcggtcgtaccatccctcgcaggagggctcgctgcgcagagccgtcacctatctggcgcagtcgccggcggcacgagcagcggcgggggcggccaggcgggcgggtacagcg

SEQ ID NO: 4238 - DNA, 921 bp, Streptomyces avermitilis
  CDS (1)..(921)
gtgacgtaccggatcgaggacctggcgcaccgcagcggtgccacggtccgcaccatccgcgcctaccaggaccgcgggctgctcccccggcccgagcggcgcggccgcgccaacgtgtacgcggacgcgcatctggcccggctgcgccagatcgccggcctcctcgaccgcggctacaccctggcctccatcaaggagctcctggaggcgtgggactccggccgcggcctgggcggggtgctcgggctggtcgcggaggtcgacggtccgtggtccgacgaggaggcggggcggatctcacgggccgagctgtccgagcgtttcggcggcagccccgacgacgcggcggtcgcggacgcgctcgagctcggggtgctggagccggtacccgggcacgaggacctgttcctcgtgccgagcccccaagagctcgccgtggcggtcgagttgcatgaggcgggcgttccgctgtccgcgatcgccgggcacctaagggagttgagggggcaggtggagcacatcgcctcccgtttcctggagttcacgaccgagcacgtgttcgcgcgctacctcggtgaacatccgccgaacgaggtggacgcgacggaggcggcctcgctcgttcgacggctgcggccactggcgcagcagacggtggacgccgaactcgcccgcgcgatgcgcctgttcgccacccggcacctgcgcctgcacctcggcgcggaccagccggctccccccgaggaggagacccgttccgtgtcgattccggcggacacgatgcgggccgtggagagactggttggctcggaccaggccgcctccttcgtcgcgttggcggccgaacgcgagctccgggccagggctttggaccaactcgccgcaaagcatatgcataagcacatagttgacgaagagtcc

SEQ ID NO: 4239 - DNA, 1068 bp, Streptomyces avermitilis
  CDS (1)..(1068)
atgaatgccggcgagacgcacgtcactcgcgccatcggtgcgggcccgggactccgccgccgcaccgttcacaccgcaccgtcgcggaccgctcacgcactgtcatcaccacatcgcccgcccccgcaccgtgcgtgggcattccgcggctgcgcttacgctcgatgtatgagtctgcgtctgagcaccgtgatcctgccgtacgtccgctggcacgagggcgggcgttccgcatggcagcgtgcggagcagctcggcttccacaccgcgttcacctacgaccacctgtcgtggcggtccttccgggacggcccgtggttcggcgccgtgccgacgctgaccgccgcggccgccgtcaccgaccgcctgcgcctcggcacgctcgtgacctcgccgaacttccggcaccccgtgacgctcgccaaggagctgatctccctcgacgacatctccggcgggcgcgtcgccctgggcatcggcgcgggcggcaccggcttcgacgccaccgcgctcggccaggagccctggacaccgcgggagcgcgccgaccgcttcggcgagttcgtaccgctgctcgaccggctgctgaccgaggactccgtctcgtacgagggcgactactactccgcgcacgaggcacgcaacatcccgggctgcgtccagcgcccccggctgccgttcgcggtggccgccaccggtccgcgcgggctgaagctcgccgcgcgccacgggcaggcctgggtgaccaccggcgacccgcggctgtacgagaacggcacccctgaacagtcggttcaagccattcgcggacaggccgagaagctggccgacgcgtgcgccgcgatcggccgcgacgtgaaggagctggacaaggtcctgctcaccggcttcaccccggaccgcggtcgcccgctggagtccctcgacgcgttcgtcgacttcgcgggccgccacatggagctgggcatcaccgacatcgcgatccactggcccatccccgactccgacttcgccgcggacgagaaggtcttcgaacagatcgccatggaggcaccggcccagctgcgc

SEQ ID NO: 4240 - DNA, 915 bp, Streptomyces avermitilis
  CDS (1)..(915)
gtgcggaccactgcacggccgtgcgcgcatatgcgggagaatgggccggtgacctcagcgactcgacggcccgagaccccggcctccaccgttccgccccggctgatcgccacggacctcgacggcaccctcctgcgcgacgacaagtccgtctccgagcgcacggtcgccgccctcgcggccgccgaggaggccggcatcgaggtcttcttcgtcaccggccgcccggcccgctggatggacgtcgtcagcgaccacgtccacgggcacggtctggcgatctgcggcaacggcgcggccgtggtcgacctgcacggcggccccggcgcgcaccgcttcgtcaaggtccgggaactggagcgggagaacgccctcgacgccgtgcggctgctgcgcgacgccgcgccgggcacggtgtacgccgtcgagcagacgtacggcttctaccaggagcccgcgtacccgaagctgcacatggaggtccccgacagcctcgcgcccgccgagaagctcctggcgccggacgctctcggagccgacgagcccgtcctgaagatcctcgcgtaccacccggagatcgacccggacgcgttcctcaccctcgcgcgcctcgccgtcggcgaccgcgccaacatcacccggtcgagtcccagcgccctcctcgagatcagcgggcccggcgtctccaaggccagcaccctcgcgctgtgctgcgccgagcgcggcatctcccacgaggaggtcgtcgcgttcggcgacatgccgaacgacgtcgagatgctcacctgggccggccgctcgtacgcgatgggcaacgcccacccggacgtcctcgccgcggcgtccggacggaccgtcgccaacaacgaggacggggtggccgtggtgatcgaacggatactcgcggagcggttg

SEQ ID NO: 4241 - DNA, 1704 bp, Streptomyces avermitilis
  CDS (1)..(1704)
atgcccgcagcccccgtatcgccaggcgacgcccccgagcccgaagcgggcagaggggatgacgccgattcccgtgggctgaccgcgcgggtgccgcagttgctgaaggcgatgcggtcggtcgggagcgggctcgagctgcactccacgctggtccggatctgcgagacggcggccgagctggcgaacgcccgctatgcggctatcggcgtcgtggccgaggacggcgacggtcttgcggatttcgtccaccacggggtcgacgcggagaccgcccgcctgatcggccggctgcccgacggacacaaggggctgctcggtgcgctcatccacgacccggcgccggtgcggctcgcggagctgaccgaggacccgcgctcgtgcggcttccccgagcaccatccgccgatgcgcagcttcctcggagttcccctttgcgtacaggggaagaccttcggcaacctctatctcgccgagaaacgcggcggcggcctgttcgacgactacgacctcgacatggtccgcgtgctggccatcgaggccggcatcgcgatcggcaacgcccgcctgtacgaggccgccaagcagcgcgagcggtggatcgacggctcggtggccgtcaccaccgcgttgctgtccggcggcgatcccgaggacgccctccaggtcgtcgccgaacaggcacggcggctctccggttcgacggccgggatcgtgctgctgcccgcggacgagggcggtctggagatcgtcgccgtggccgcggatcagcgcccgaaggcgctgggcgcggtcatcccgccggagagtgaactggcctccgaactcctcgacggccgggccgtgttcctcgcggacgcggccggcgacccccgcacgatcacccatctcttccgcgactacgggccggtcatgatgctgccgctgcggagcgacggccgggtgcacggtgccctcgtcaccccccgtgcacgcggcggccgcccgttcacggagaccgagcgcacccttgccgcgcagttcgcctcccaggccgcgctcgcgctgatgatggccgaggcacagcgggaccgggagcggctcgcggtgtacgaggaccgcgaccggatcgcccgtgatctgcacgacctcgtcattcagcggctctatgccaccgggatgatgctggagagcgcgcagcgccggtccggcgtgcccgaggtgcggcgaggcgtcggtaaggcggtcgacgaactcgacgtcaccatccaggagatccgcacggcgatcttcgcgctccagcaggggcccgccgaggtgccgtccgggctgcgggcccaggtgctgcgtgagatcaagacggccgcgatccccctcggcttcacaccgtcgtaccgtttcctcggacccgtcgacacggcggtcggtgaactcacccgcaacaacctcatcgcggctctccgcgaggccctgtccaacgcgttccggcacgcgggggcctcgcgcatcgacgtcgtcgtcgacgcgacggtgacgctgcccgacggccggccgggtgtgcggctgacggtcacggacgacggtgtcggcatccccgacatcggccgtcgcagcggtctgacgaacctcgagcggcgcgccgggtcactgggcggggacagctggttcgggccggggacgggagagaacggggccggtacgacggtgacgtggcaggcgccgtac

SEQ ID NO: 4242 - DNA, 3552 bp, Streptomyces avermitilis
  CDS (1)..(3552)
gtgaaaccaatcgacccgcgtctgcttcgatacgctcgcgccacccgcgtcttcctggcggcggtcgtcgttctgggtgctgtcggagcggtgctggtcattgctcaggcgatgctcatcgccgagatcgtggtcggtgccttccagcacggtcactcggtcgctgagctccgcacgccccttgtgctgctggcagccgtcgcggccgggcgcggtcttgtcgcgtggctcaccgaacttgccgcgcatcgggcgagcgcggcggtgaagtcggagctgcggaggcggctgctggagcgggcggcctcgctcggaccggggtggctgagcgggcagcgcaccggctcgctcgttgccctggccacgcgggggatcgacgccctcgacgactacttctcgcgctatctcccgcagctggggctcgcggtggtcgtacccgtggcggtgctcgcgcggatcgtcaccgaggactgggtgtcggcggcgatcatcgtcggcacgctgccgctgatcccgttcttcatgattctgatcggctgggccacgcgcacccagatggaccgccagtggcggctgctgtcccagctgtcgggacatttcctcgacgtggtcgccggattgccgacactcaaggtgttcggccgtgccaaggcgcaggccgagtccatcaggcggatcaccggcgagtaccggcaggcgaccatgcggacgctgcggatcgcgttcctgtcgtccttcgccctggaactgctcgccacgatctccgtcgcgctggtcgcggtgaccatcggcatgcggctcgtccacggcgagatggacctgtacatcggcctggtcatccttgtcctggcgcccgaggcgtatctgccgctgcggcaggtgggcgcccagtaccacgcggcggcggaggggctcgcggcggcggaggagatcttcgcggtgctggagaccccggcgccggtctccggctcactgcgggcaccggagggtgagatcgccttcgaggacgtgaccgtgcgctaccccgggcggtcggccgacgcggtgtccaaggtgtccttcacggtggcagccggcgagaccgtggcgctcgtagggccgagcggcgtcgggaagtcgacgctgttgaacgtcctgctggggttcgtatcgcccaccgaggggcgggtgcgggccgggggagccgatctcgcctcggcggacctggaggagtggcgttcgcggatcgcctgggtgccgcagcggccgcacgtgtacgcggggaccatcgccgagaacgtgcggctggcccgtcccggcgcggacgacaccgaggtgcgccgggcgctcgccgacgccggagccctggaattcgtggacgcgctgcccgagggcgccgagacgctgctcggcgaggacggcaccgggctctccgccgggcagcgccaacggctcgccctggcccgggcgttcctcgcggaccggcccgtgctgctgctcgacgaacccacggcagccctggacggggcgaccgaggccgaggtggtggctgcggtgcggcggctggcagtgggacggacggtgctgctggtggtgcaccggccggcgctgctcggggtggcggaccgggtggtgcggtgtgagcccgtcgagtcggcagcgatggagctcgcggagccggccgcggccgtggagtcggcggagtccgccagggccgccggtgctgtgtccggcggaggggaccagacgtccggtcgcgaggcggccgatgccgtgccctcggccgccgaggacgatgtccgccgctctcccctgcggcacggacgagtgctttctcgcgtgcgtgccatggccggtccccggcgagggcgcctcacgttcgccctgctgctcggtgcggccgcactcgggagcgccgtggggctgatggcgacctccgggtggctgatctcccgggcctcgcagcagccccccgtgctgtatctgatggtcgccgtgaccgccacgagggcgttcgggatcgggcgggccgtcttccgctacgcggagcggctcgtgtcgcacgacgcggtgctgcggatgctcgccgacacccgggtcgccgtctaccggcgtctggaacggctggcccccgccgggctgcgcacgacccggcggggtgatctgctgtcgcggctggtcgccgacgtggacgcgcttcaggactactggctgcggtggctgctgcccgccggggccgcactggtcgtctccgccgcctcggtcgggttcaccgcctggctgctgcccgaggccggggccgcccttgccgtcggcctgctggcggccggggtcggcgtcccgctggtgaccgcggccgtggcccgtcgcgcggagcgcaggctggcgcccgcccgaggcgtgctggcgacccgggtgaccgatctgctgaccgggacggccgagctgacggtggccggcgcgctgcccgcacggatcgccggagcacgccgggccgacgccacgctcacccgtatcgcctcccgtgccgctgccgccaccgcgctcggcgacgggctcaccgcgctgctgtccggactgaccgtggtggcggccgccctcgtaggcgcgcaggcggtcgtcgacgggcgcctgagcggggtggccatggccgtcgtcgtcctgaccccgctggccgcgttcgaggccgtgctgggactgccgccggccgtgcagtaccggcagcgcgtgcgcaggagcgccgagcgcgtgtacgaggtgctggacgcccccgagcccgtacgggagccggagcggccgcgtacggcgcccgcgtcgccgttcccgctcgtcgtcacggggctgaccgcccgccacgaggggcagcaccgggacgcgctcgccgggctcgacctcacgctcgaaaagggtcgcaggatcgccgtggtcggcccctccgggtcgggcaagacgacgctcgcgcaggtgatgctgcggttcctggacgcgggtgcggggacgtacacgctgggcggtacggatgcgtacgccctcgacggcgacgacgtacggcggctcgtcgggctctgtgcccaggacgcgcacctcttcgacagttccgtgcgcgagaacctgctccttgcccgcagggacgccaccgagggggatctgcgcgacgcgctggcgcgggcccggctcctcaactgggtggacgggctgcccgacgggctcgacacgctgatcggcgagcacggggcacggctgtccggcggccagcgtcagcggctcgcgctggcccgtgccctggtggccgacttcccggtgctcgtcctcgacgaacccgcggaacacctcgacctgccgacggcggacgcgctcacggcggacctgctggccgcgacggaggggcgtacgacactgctgatcacccaccggctggccggactggaagcggtcgacgaggtgatcgtgctggcggacgggcgcgcggtgcaacgcggggcctacgcggagctggcagccgtgaacgggccgctgcgggagatggtgggccgggagaccgaggacgggttgctggtgggggcggtggcccgc

SEQ ID NO: 4243 - DNA, 1002 bp, Streptomyces avermitilis
  CDS (1)..(1002)
atgcatcttcacgacgtctggttcgtactcatcgccgtcctctggaccggctacttcttcctggagggcttcgacttcggggtcggtgtcctcaccaagctgctggcccgcgaccgcaccgagaagcgggtcctcatcaacaccatcggacccgtctgggacggcaacgaggtgtggctcatctccgcgggcgccgcgaccttcgccgccttccccgagtggtacgccacgctcttctccggcttctatctgccgctgctgatcatcctggtctgcctgatcgtgcgcggtgtcgccttcgagtaccgggcgaagcggcccgaggagggctggcagcgcaactgggagaccgcgatcttctggacctcgctgatccccgcgttcctgtggggtgtggccttcggcaacatcgtgcacggagtgaagatcgactcgaagttcgagtacgtgggcagcttcggggatctgctcaacccgtacgcccttctcggcggcctggtcacactgacgctgttcacgttccacgggaccgttttcgtcggcctgaagaccgtcggggatatccgggagcgggcgcgcaagctggcgctcaaggtcggcctggtggccgccgtgctggcgctcgtcttcctgctctggacccaggccgacagtggcgacggcaagtccatggcggcgatgatcgtggccgtgctggcgctcgtcgccgcgctggtggcagcccaagtaaggcgtgagggctgggcgttcgccctgtcggggctgaccatcgtggccgcggtggtgatgctcttcctgacgctgttccccaacgtcatgccgtcctccctcaacgcggactggagcctgacggtgaccaacgcgtcgtcgagcccgtacaccttgaagatcatgacctggtgtgccgggatcgccacgccgttcgttctgctctaccagagctggacgtactgggtgttccgcaagcggatcggcacgcagcacattgccgacgctgcgcac

SEQ ID NO: 4244 - DNA, 1506 bp, Streptomyces avermitilis
  CDS (1)..(1506)
gtggaattggctctggcgccggagaccctggcgcgatggcagttcggcatcaccaccgtctaccacttcctcttcatccccctgacgatctccctcgccgcgctcaccgccggcttgcagaccgcctgggtgcgcacggagaacgagaagtacctcagggccacaaagttctggggcaagctcttcctgatcaacatcgcgatgggtgtcgtcaccggcatcgtccaggagttccagttcggcatgaactggtccgactactcgcgtttcgtcggcgacgtcttcggtgccccgctcgccttcgagtccctgatcgccttcttcttcgagtccaccttcatcgggctgtggatcttcggctgggacaagctgccgaagaagatccacctggcctgcctctggatggtctccctcggcacgatcctgtcggcgtatttcatcctcgcggccaactcctggatgcagcaccccgtcggctaccggatcaacagggagaaggggcgcgcggagctcaccgacttctggcaggtgctgacccagaacaccacgctcacgcaggtcttccacaccctctccgcgtccttcctcacgggcggtgccttcatggtgggcatcgccgcctaccacctgtcccgcaagaagcacatccccgtgatgaagacctcgctgcggctcggcctggtcaccgtggtcatcgccggactgctcaccgcggtcagcggcgacttcctcggcaaggtcatgttcaagcagcagccgatgaagatggcagccgccgaggcgctgtgggacggccaggactccgcgccgttctcgatcttcgcgtacggggatgtggacaagggccacaacaccgttgccatcgaggtccccggaatactctccttcctctcttcggacagcttcacctcgtacgtccccggcatcaacgacaccaacaaggccgagcaggagcagtacgggcccggcgactaccggcccaacatcccggtcgccttctggggcttccgctggatgatcggcttcggcatggcgtccttcgccatcggactggccggactctggctgaccaggaagaagttcatgctgccgcagcagctgcgggtcggcgacgacgaggtgccgcacctggtgctcttcaagaacaaggcgctcggtccgacgctcaccaagtggtactggcgcatcgcgatcctgaccctgggcttcccgctgatcgccaactcgtggggctggatcttcaccgagacgggccggcagccgtgggccgtctacggcgtactgcggacccgggacgcggtctcccccggtgtctcgcagggtgaggtcctcacctcgatgatcatcttcacgtcgctctacgcgatcctcgccgtcatcgaggtcaagctgctcgcgaagtacgtcaaggccggaccgcccgaactcaccgagtccgatctcaacccgcccaccaggatcggcggcgactcccatgacgccgacaagccgatggccttctcctac

SEQ ID NO: 4245 - DNA, 1077 bp, Streptomyces avermitilis
  CDS (1)..(1077)
gtgagcgagacgagcccgaagctgcgtgccgagctggagggtatccccacctacaagcccggcaagccggccgcggccgccggaccggtggcgtacaagctgtcctccaacgagaatccctatccgccgctgccgggtgtgttggagagcgtggcctcgtcggtcgggtccttcaaccgttacccggacatggcgtgctcggggctgatgagcgagctgtcggagcgcttcggagtgcccctgtcgcacctggccaccggtaccggctcggtcggggtcgcccagcagctcctccaggccacgagcggtccgggcgacgaggtgatctacgcctggcggtccttcgaggcctacccgatcatcacgcaggtcagcggcgcgacctccgtacaggtgccgctgacgccgggcgatgtgcacgacctggacgcgatggcggacgcgatcaccgaccgtacgcggctgatcttcgtctgtaaccccaacaaccccacgggcacggtggtgcgccgggccgagctggagcggttcctcgaccgggtgcccagcgatgtgctggtggtgctggacgaggcgtaccgcgagttcatccgtgaccccgaggtgccggacggcgtggccatctaccgggagcggccgaacgtctgtgtgctgcggacgttctcgaaggcgtacggcctcgcggggctgcgcgtggggttcgcgatcgcccacgagccggtggcggcggcgctgcgcaagacggcggtcccgttcggagtgagccagctggcgcaggacgccgcggtggcctcgctgcgcgccgaggacgaactgctcggccgggtcggcgcattggtgtgcgagcgccagcgcgtggtcgcctcgctgcgcgagcagggctggacggtgcccgagacacaggcgaacttcgtgtggctgcggctgggggagcgcacgctcgacttcgcggccgcctgtgagcaggccggtgtcgtcgtacggccgttcgccggcgaaggggtgcgtgtgacggtcggcgagaacgaggcgaacgacatcttcctgaaggtgacggaacggttccgcaaggagctc

SEQ ID NO: 4246 - DNA, 1110 bp, Streptomyces avermitilis
  CDS (1)..(1110)
atgacagcagcagggaagcaccaggtgagccgggcggagacctcccgccgaggcggtcggccaggccgggcaggcatcagagacgtggccgcggcagccggggtctccatcacgaccgtctccgacgccctcaacggcaagggccggctgccggacgccacccgacgccacgtccgcgaggtcgccgaccggctgggctatcgcccatcggcagcggcccgaacgctccgtaccggcaagtcgggcctcatcggcctgaccgtgacgacgtacggggatgaacctttcaccttcacggagttcgcgtacttcgcggagatggccagagccgccacctcggccgcgctcgcccggggctacgccctggtcatcctccccgcgacctcgcgccacgacgtgtggtccaacgtcgccctggacggcacggtcgtcatcgacccgtccgaccaggacccggtggtcagcgagctggtccggcagggcttaccggtcgtctccgacggccgcccggccggcacgctcccggtgaccgcctgggtcgacaacgaccacgaggccgcggtgctggggatcctcgaccacctcgccgacgcgggcgcccgccggatcggactcctcacggggaccaccacggacacctacacccacctgtcgacgaccgcgtacctgcactggtgcgagcgcgtcggccaggaccccgtctacgaggcctacccggcccacgacccgtgcgcgggcgccgtcgccgccgaccggctgctggcccgccccgaccgccccgacgcggtctacgggctcttcgacccgaacggcaccgatctgctggccgcggcccgccgctacggcctgcgcgtaccggacgacctcctgctggtctgctgcagcgagtccaccgtgtacgcgaacaccgaaccgcccatcaccacgctctccctgaaaccgcgccggatcggcacggccgtggtccagctcctcatcgacgccatcgagggcctcgagtcggaccaaccggtcgagcaggtgataccgaccgagctgatcgtgcgtacgtcgtccgagcgacgtccgccgcgtacgacggtcagtccgccccgctcacccgagcagggg

SEQ ID NO: 4247 - DNA, 1107 bp, Streptomyces avermitilis
  CDS (1)..(1107)
atggtggaggggtcgatgactcagggggccggtcagggacccgaggtggtgcgcacggagacgctgcgcgacttccgggtacccgcgtacgtccacgagaccggtccgtacgcgcagagcacacctcccgacgaggtcaccggacccgtcgcggagccgcggggctaccctgagagttacccggaggggtacacgcccacccagcgcgacctgccggtcatcaatcgaggtgacacgcttcaggtgaccatcgaccccacgccccagtccgtcccccagtccgccgacgggcccggccccctgtacgtcgtcggtgacgtgcacggctatctcgaccagctcgtcgcggcgctccaggagcagggcctcgtcgacgccgcgggcagctggtccgcgggcaccgcgcggctgtggttcctcggcgacttcaccgaccgcggccccgacggcatcggcgtcatcgatcttgtgatgcggctgtccgccgaggcggccgcggccggcgggtactgcaaggcgctcatgggcaaccacgagctgctgctgctcggcgcgaagcggttcggcgacacccccgtcaactccggcgcgggcaccgccaccttccaggccgcctggctgctcaacggcggccagaagaccgacatggaccgcctccaggaccaccaccttcagtggatggcccgcctcgacgccatggagcaggcggacggacacctcctggtgcactcggacaccaccgcctacctcgactacggcgactccatcgaagcggtcaacgacaccatccgcgagaccctcacgcgcaacgacgcggacgagtgctgggacctgttccgcaagttcaccaagcgcttcgcgttccgcgacgacggcggcgccgaggcggcccggtccctgctggacgcctacggcggtacgcgcatcgtccatggccacagcccgattccctacctcctgggcgaggtcggctccgaggacgacgaggacggcaccggccccgtggtggagggtccgcacgtctacgccgacgggctggccatcgccatggacggtggagtgaccatggccggaaagctgctggtccagcaacttcccctggatagc

SEQ ID NO: 4248 - DNA, 855 bp, Streptomyces avermitilis
  CDS (1)..(855)
atgaacagcgttccgcagcacctgctgagcgaggaccgccaggaatacgagcggatcctcggtgaggtgctgcgctccgccccacaccgcccggaactcgccgccgtcgaccggcggctcaacaccgaacagctgcgcaccatggcactcaacgccaccgcactcatcacagcggccgcggcgaccgagtaccagcactatgtgaaggtccgcgaggaactgcgccagccggcgccgtccaccccgcccgtccgcgaggaagccggtgccatggagccgggcgcggccgcggtggggctcgccaccaccctgggagaggccgccgagaccgccggggccggcgccgtcgccgtcgtcctcgcccccgtcctcgccggcaccgccgcggcgatattcctgctcgtcggctacatcctgaagatgctcaatcccgagcaggcgttcacccagaccctcctgaccaccgggtgggtcttcggcgcggtcaccgcggcagcgatcctggtcgccgcggtcggcctgctgctcaccgctctgcgcaacagccccagcgccctggagaccagcgcccagagcgagctgaccgatgaagtggcccgggccagggaggcctggcacgaggccctgctggagcggggcctcctgccgttcctccgcgaggcactcgccgaccccggcacggccgcactgggcagccccgccccctcggaggcacccagccgcatcccgcacctcggctaccaccgcccgggcttcaccagccccgacggcgggcccgcggcgggcccccgccccagcttcacgagcccggacttcaccagcccggacttcggggggccggagcaccagccggag

SEQ ID NO: 4249 - DNA, 1803 bp, Streptomyces avermitilis
  CDS (1)..(1803)
atgaccaacaaggacgcacgcacgcctgcctccagccagacgggcgaggcgctcgcctcgccccagggcgaccaggaggccgggaaatccatcggctggcacaaggcgtacgtcgcgggttcgcgccccgatctgcgggtgccggtccgtcaggtgcacctcaccaacggggagtcggtgacgctctacgacacctccggcccgtacaccgacccgtccgtcgacaccgatgtccgcaggggactcgcgccgctgcgggagaactggatcatcgcccgcggcgacaccgaggagtacgcgggccgacccgttcgccccgaggacgacgggatcaagcacacctcgccgcgcggcgggctgcgcaacctggacgcggtgttcccggggcggccacgtcagccgcgccggggccgtgacggacaggccgtgacgcagctcgcgtacgcgcgccgcggcgagatcacgcccgagatggagttcgtggccgtccgggagaacgtctcggcggaggtcgtgcgcgaggagatcgcggccggacgggccgtaatgcccgtgaacgtcaaccacccggagatcgagccgatgatcatcggcaagcggttcctggtgaaggtcaacgccaacatcggcaactccgcggtcacttcctccatcgaggaggaggtcgagaagatgacctgggcgacccgctggggcgccgacaccgtcatggacctgtccaccggccgcaacatccacaccacgcgcgaatgggtcctgcgcaactcccccgtgccgatcggcacggtcccgctctaccaggcgctcgagaaggtcgacggcagggccgaggaactgacctgggagatctacaaggacacggtcatcgaacaggccgagcagggcgtggactacatgacggtccatgcgggcgtgcgcctcccctatgtgccgctcaccgcgaaccgcaagaccgggatcgtctcgcgcggcggctcgatcatggcggcgtggtgcctggcgcaccacaaggagagcttcctgtacgagaacttcgaggagctctgcgagatcctcgcggcatacgacgtcacgtactccctcggcgacggtctgcgtcccggctcgatcgcggacgccaacgacgaggcgcagttcgcggaactccgaactctgggggaactcaaccggatcgcgaagcgtttcaacgtacagaccatgatcgagggcccgggccacgtcccgatgcacaagatcaaggagaacatcgaccttcagcaggagatctgcgatgaagctcctttctatacgctcggcccactgacgacggacgtcgcgccggcgtacgaccacatcacctccggcatcggtgccgcgatgatcgcctggtggggcacggcgatgctctgctacgtcacgcccaaggagcacttgggtctgcccaaccgtgacgacgtcaagaccggcgtcatcacctacaagatcgccgcccatgccgccgacctcgccaaggggcacccaggcgcgcaggagtgggacgacgcgctgtccgacgcccggttcgagttccgctgggaggaccagttcaacctggccctcgacccggacacggcacgggagttccacgacgagacgctcccggcggagccggccaagacggcccacttctgctcgatgtgcgggccgaagttctgttcgatgaagatctcccaggacatccgccgtgagcacggcgggacgcggacggaggtcgaggaaggcatggcacagaagtccaaggagttcgcggcggccgggaaccgggtctatctgccgttggcggac

SEQ ID NO: 4250 - DNA, 1440 bp, Streptomyces avermitilis
  CDS (1)..(1440)
gtgaccacgacgcaacagcccccattcccgccgtccgagcctccgcgcggccaaggccccggcggcggccgtggacaaagcgacggtccggggggccacagccctggagacggccatgaccatggccagggctccggaggcgggaacggtcccggccactcgcacagtcacagtcatggcccggccgcccccgtttcccaacatctgcgcaaggtcatcgccgcgatcctgatcccgttcgccgtggcggtcgtagtgggtctcgcggtgctgtggccgggcggtgtcccgggacatgagcgcagcggtgtgggcttcgaccggcagacccagcaggccacggtcaccaaggtcgacgaggtcgactgcaagtccgtgaacgcctcgggtgacaccccgaccggcgacacctccaccgccgaaggctcctctgcccagcagcaggccagtggcacctgcaagaaggcaaccatccgcgtcgacaccggcaaggacaagggccgtacgttcaccgagatcgtccagccggaccagacacggcagttgcaccagggcgagaaggtcgtggtcgcctacgaaccctccgcacccaagaacttgcagtattcggtcaccgatgtggagcgcaagttccccatggctttgctcgccggcatcttcgcactcgccgtcgtcgtcgtgggccggatgcgcggcgtcatggcgctggtcgcgctggccatcagcttcatggtgctgaccttgttcatcctgcccgcgatcctggagggctcgaatccactgatcgtggcggtggtcggggcgagcgccatcatgttgatcgcgctctacatgtgtcacggtctttcagcccggacatcggtggccgtactgggcacgctgctctcgttggtgctgatcggcctgctcggctcacagttcatcggctgggccgcgctgaccggcaacacggacgacaacactggcctgatccacggcctgtacccgcacatcgacatgagtggtctgctgctggcgggcgtgatcatcggttccctcggtgttctcgacgacgtgacggtcactcagacgtcggcggtatgggagctgcacgaggccaatccgacgatgggctggcgcggtctgtatcgcgcgggcatccgcatcggccgcgaccacatcgcgtcggtcgtcaacacgttggtcctggcgtatgcgggtgccgccctgcccctgctgctcctcttctcgatcgcgcagagcagcgtcggcacggtcgccaacagcgaactggtcgccgaggagatcgtccgcacactcgtcggctcgatcggcctggtcgcctctgttcccgtcaccacggccctggccgccctggtggtctcggcggaccgcccgggaacgcccgcaccggctgcggccgcaccgctgcgctccgggagggggcgccgccgcaagcgc

SEQ ID NO: 4251 - DNA, 405 bp, Streptomyces avermitilis
  CDS (1)..(405)
atgagcttcctcgtgtcggaggagctctctttccgcattccggtggagctgcgatacgagacctgtgatccgtttgccgtgcagctgaccttccacctgcccggcgacgcgcccgtgacctggacgttcggccgggagctgctgatcgacggggtgggccggccgtgcggtgacggtgatgtgcacatcgcgcccgctgatcgcgaggcgttcggcgaggtgctgatccggcttcaggtgggcggcgatcacgcactgttccggtccggggcggtaccgctggtgacgttcctcgaccgcaccgacaagctggtgcctctgggccaggagtgttcccttgctgacttcgatgcccatctcgacgaggcgctggaccgcatcctcgcggaggagcagagcgcgggt

SEQ ID NO: 4252 - DNA, 723 bp, Streptomyces avermitilis
  CDS (1)..(723)
gtgcagcgggcgatgcgcctgctggaagccgtcgccgcccgcgagtacggggcacccgccaaacagctggcccgcgaagccgggctggcgctgccgaccgcctaccatctgctgcgcacgctggcccacgaaggctatctacggcgtgagaaggggctgttcttcctcggggaggcggccgagcggctgggcagcagcggagctcaggagaaacgtcgcagcgcggtgaacgacgtgcttgcgcactggcacgattcgatcggtgtacccgtgtacttcgcggtctaccgcgacggcgagatcgaggtcgtctgcgtcgccgatactccgggcaatccggcggtcgaggagtgggccgacttccgggagaccgggcatgcgcacgcgatcggccagtgtctgctgtcccagctcgacgagggggcccgccgggaccacctcgatcgctacccggtgcagtcgatcaccccgtatacggtgcgtgacgaacacacacttctgaggcggctggaacgcgtgggacggatggaacccgtggtcgagcggcaggagtacgcgctgggtacggtctgcgccgcgattccgatcacggccggcacgacggccgcggccatggcgctctccctcccgctttcccaggccgaccggttgctgccggcagcacggcagttgcagggagagatcggaaggctgctggggacactctccatctctatcagcatc

SEQ ID NO: 4253 - DNA, 210 bp, Streptomyces avermitilis
  CDS (1)..(210)
atgcgagagattttcgcgggtatgccgtggtgggttaagtgggtcgcggtgccggtcatcgccctggtcgtcttcggcggcctgatagcgagcgtcgtcggctttgtcatcggcctgcttttcaagctgctggtctttgtggcgctggtcggcggactgatcttcgtcgtgcggaagttcatgtcgagctcctcgtcgcacagcgactgg

SEQ ID NO: 4254 - DNA, 315 bp, Streptomyces avermitilis
  CDS (1)..(315)
atgaaggcattccggctggacgaactggaggcggagcgcgccgccaacgacggcgcctacctgcagttcctgcgcgaacggaacatgtcggtcggcctgtacgcgctcgacgcgggcgaactcgacccgcagaagccgcatcagcaggacgaggtgtacctggtcgtcagcgggcgcgcctcgatcacggtcggtatggaaaccacccaggtcgcgcgcggcagcgtcgtgtacgtgcctgccggagtcgcccacaagttccaccacatcaccgaggatctgcgggtcgtggtggtgttctctccgcccgagagc

SEQ ID NO: 4255 - DNA, 378 bp, Streptomyces avermitilis
  CDS (1)..(378)
atgaagaatttcgtagtcaagacgatcgccaacgcgggggccctcgccgtcgccgtgtggctgctcgacaagatcaccctgacgggcgacagcaccggcaagaagatcggcacgctgatagtcgtcgccctggtcttcgggctggtgaacttcctggtcaagccgatcgtgaaggtgctgaccttcccgctgttcattctcacgctcggcctgatcacgctggtggtcaacgccctgatgctgctgctcacctcgtggctggccgacaagctcgacctcagcttccatgtcgagggcttctggaccgccgtcgtgggcggcctcatcatctccgtcgtctcctgggccctcaacgtcgtcctgcccgacgacaaggac

SEQ ID NO: 4256 - DNA, 489 bp, Streptomyces avermitilis
  CDS (1)..(489)
atgacctatcgcgtctgcttcgtctgcaccggcaacatctgccgctcgccgatggccgagtccgtcttccgcgcccggatcgcggaggccggactcgacggcctggtggaggtctccagcgcgggcacgggcggctggcacgagggcgacggcgccgatccgcgcactgtggccgtgctggaggcgaacggctacgaaagcggtcatacggcacggcagttccaggcctcgtggttctcccacctcgacctcgtgatcgccctcgactccggccatctgaaggccctgcgccggctcgcgcccgccccggcggacacggagaaggtccgactcctgcgttcgtacgatcccgccgcggacgccgatccggacgtaccggatccgtattacggacaaatggacggcttcgaagagtgtcttgaaatggtggaggcggcgagcccaggcctgctcgccgcggtacggcagcaactggagggacgggcagca

SEQ ID NO: 4257 - DNA, 1143 bp, Streptomyces avermitilis
  CDS (1)..(1143)
atgacctcaggagatttcgtcgcggagaccggtgacggcactcgggccgttcgggccgggctaccggaccccgtgaagcacgagccgaccctcccaggccccgtcttcgccgcccatttccatctgcccggcgagcccaccggcccgtacacctacggccgcgacgagaaccccacctggacccatctggaacgggcgatcggcgagttggaggcgcccggacaggacggcgtcgagacgctgaccttcgcctccggcatggccgccatctccgcggtcctcttctcccagctgcgcgccggcgacaccgtggtcctgcccgacgacggctaccaggtactgccgctggtgcgcgagcagctgaccgcgtacggcatcgaggtgcgcaccgcaccgacgggcggcgacgcccagctcgacatcctcgacggcgcgaagctgctgtggatcgagaccccttcgaacccgggtctcgacgtgtgcgacgtacggcgcctcgtcgcggcggcccacgcacagggcaccctcgtcgcggtcgacaacaccctggcgaccccactggggcagcggccgcttgagctgggcgccgacttcgccgtggccagcggcaccaagatgctcaccgggcacggagacatcctgctcggatacgtcacgggccgcgacgcggcgccgatggccgccgtacggcgctggcgcaagatcgtcggggcgattccggggcccatggaggcgtggctcgcgcaccgctcgctggccacactgcaactgcgcgcggaccggcagaacgccaatgccctcgcggtcgccgaggcgctgcgcggccggtccgaggtgagcggactgcgctatcccgggctgcccgacgacccctcgcacaagatcgcctcgcagcagatgcggcgctacgggtgcgtggtgtcgttttcactgcccacgcgcgggcgtgccgagcgttttctcgacgccctgacactcgtggacgatgcgaccagcttcggcggggtacggtccaccgccgagcgacgtggccgctggggcggcgacgcggtggcggagggcttcatccgcttctcggccggagccgaggatccagaggacctggtggcggatgtgctgcgcgcgctcgacgagtcggcacac

SEQ ID NO: 4258 - DNA, 903 bp, Streptomyces avermitilis
  CDS (1)..(903)
gtggacctggctctgctgcgcaccttcgtgaccgtgcaccgggccggctccttcacccgcgccgccgccctgctcggcctctcccagccggccgtcacctcgcagatccgcacactggaacggcaactgggccgccctctgtttctgcgccaggcccgcggggtgacccccacgaccatcggcgacgaactcgcccacaaggccgccccgcatctggacgccctggtggagatcgccgagaccggcctcgacgaggaatcctcgctacgtacgctccatctcgccggcccgccggagttcaccgccgaacgggccctgcccgcgctcacggagctgaccggcgacgacggccagggcttcgcgctgcgggcgtccttcggcaacgccgaggagacgctggaggggctcgccgccggacatcatgatctggccatcacgacggcccagccacgcggcgccctgctcaccgccactccgctctgcgacgaggagcacgtcctggtcgccgcccctcgctgggccgtccgcatcggccacggcaagctgcgccgcaagggtgcgcccgccttggagaacatccccctggtcgaggttcacgagtcgctgccgttcgtcgcccgctactgggcctccgtcttcgactcccgcccggccgcctccggcaccgtcatcgtcccggacctgcgcgcggtcctcgcctgcgccaccacgggggcgggcctcgccgtactgccccgctatctgtgcgctccggcactggaacgtggcgatgtcgtgccgctcctggaccccgcggtgccgccgctgcgcacgtatttcctggtggtccgcaccggcaccctcgccatgccgcacatcgcacgggcgcacgaatggctcctgcgggctgccgccgactgggtg

SEQ ID NO: 4259 - DNA, 480 bp, Streptomyces avermitilis
  CDS (1)..(480)
atgaccgttcgccccgtggtcaagcgcaccgcccgcgccatcctgctcgatggtgacgacctgattctgatcaagcggaccaagcccggcgtcgatccctactggctcacaccgggcggtggggtcgaaccggaggacacgaccgtcgtcgacgcgctccatcgtgaggtgcacgaggagctgggcgccaagatcaccgatgtggtgccttgtttcgtggacaccgtggaacacatcggggaggacggcggtgccaccggtgtgaaggtgcagcacttcttcgtctgccatctggagtccatggacccggcacagcggcacggccccgaggtcgaggacccgtgcggcgagtacgagatcgtccgcatccccttcacccgggtcggaatcgcctccgtccacctcgtaccgctgtccctgcggcactatctcgacggcaatatcgagggtgtacgggcgatgcacgcgcccgacctgggc

SEQ ID NO: 4260 - DNA, 1695 bp, Streptomyces avermitilis
  CDS (1)..(1695)
atgttcgaggcgaggcacaccatggacgctccgaccactacgtcggccgacaacggcacgtccggcggtaccggcggggccggctggttcacgccccgcaagcagccggagacgcctcagggcggcggccaggaagcgcccgagggcagccgtctcgcggcgatgcgcccggtcggccggccatccgcgggtgagggcacggagcagcagcgaataccgccgacggaggaagcggtcgtcgcgcccacccagcccatgtccggcgagccgctccggtcgctccccgaccctgcggcacccgcacccgcccgacatctcggggccacgctcaccgaagagacacggcccgccccggctcccatcgcggcgtcgcagcccgagtcggcccacgaggccctacggccgctggccggacagccgcagtttggacagccgcagtccggccccgttcagccgcagccggcggccgcgctgcccgagcgtggcatcccgcagcgcgaacccgggccgccggagcccggctccccgcgtcctggccccgacccgcaggtgcccacaccggggcccgctccggggccggaggcgtcccccgacgccgtcctcatccgccgcaccatggccgaggtggggcccgtcgccggcaaggtgacctcctacttctacgcgctgctcttcgtgcgccaccccgatctgcgctcgctgttccccgccgcgatggacacccagcgggaccggctgctcaaggcgctgctgaccgcggccgagcacatcgacaacaccgaagtcctggtcgcttacctgcagaacctgggtcgcggccaccgcaagtacggcacccggccggagcactacccggccgtcggcgagtgcctcatcggtgcgctgagccggtatgcgtccgggatctgggacgaggagaccgaggcggcctgggtccgtgcgtacacgacgatctcccaggtgatgatcgacgcggcggccgcggacgagctgcgtgcccctgcctggtggtacgcggaggtcgtctcgcacgatctccggaccccggacatcgcggtgatcacggtccgccccgaccagccgtatcctttcctcgccgggcagtacaccagcctggagacgccgtggtggccgcggatctggcggcactactccttcgcctcggcgccccgctccgacggcctgctgtccttccacgtgaaggcggtcccggcgggctgggtgtccaacgcgctggtgcaccgcgcccggcccggcgacatcatccggctcgggccgccggccggctcgatgactgtcgaccacaccaccgagagcggattgctctgtctgggcggcggaaccggtatcgctcccatcaaggcgctggtcgaggacgtcgccgagcacggtgagcgccgcccggtcgaggtcttctacggcgcccgtagggaccatgacctgtacgacatcgacacgatgctgcggttgcagcagagccacccctggctctcggttcgccctgtcgtggaccagcgggcgcatctccagcttcccgacgtcatacgcgagtacgggccctggaacgagtacgacgcctacctctcgggcccgccaggcatgatccgtagtggtgtggacgccctgaggggcatcggcattccgccggaccgcatccgccatgactcggtggaggaactggtggcggccggggac

SEQ ID NO: 4261 - DNA, 657 bp, Streptomyces avermitilis
  CDS (1)..(657)
gtgccggtatcgctaatctcgccctccatgacgcgactgcacctcttcgatcttgacgggacgctgttgcacggcacggcggcccctgtggagatttccaggcaactgggtatcgacgcggagatagccgatctcgagcgcgatttcgtggcgcggcgaatcgactcgcacgggtatgcgcggcgtgtgcatgcgctatggggagatctcaccgaggcccatgtcgcggcggccttccaagaggcaccctggctgcggcggatccggtacacctgggccgacatccgctcgcgtggggagtactgtgcggtcgtctcgctttcaccctcgttcttcgtggagcggctcatcgggtggggcgcccacgccgcgtacggttcgaggttcccggccgtgccgttcagcgaacccgtggacccggccgggattttgactcctgcggccaaggtggagatcgccgaccggctctgtgaagagttcggggtgacgcgggccgactgtgttgcctacggcgactcgctctccgacgcggaactcttcggatcggtgccggtctcggtcgcggtcaatgcggaccggcatctgctgggcctcgccacctacacctacgcgggccgggatctgtgggatgcctatgaattggtgcggcgcgcccgg

SEQ ID NO: 4262 - DNA, 864 bp, Streptomyces avermitilis
  CDS (1)..(864)
gtgtcgacaccttcctccgcctctctgcccatccgtcatctgacgcctcgcgatctcaccgcctgcgccgacttgtccgaggaccggggctggccccgcgaagagcacaagtggggcctgcttctcgcagcgggaaagggctacggcatcgacgaccccgaagggggtctcgtgagcgcctgcgtcgtaaccgagtacggtcctcaggaccgcccggatctgggagcgatcggcatggtcctggtcgccgaacggcatgcccgccagggcatcggccgccggctgatgcgccatgtgatggcggagatggccaccacccccctcaccctgtgcgcgaccccgttcggccgtccgctctatgaggagctcggtttcaaggtcgtgggtcattccgagatggtgcgcgggtacttcgctccgggtggggcggagccagcggtggtcactcggccggccacggcggaggacctgatcccgatcctccggctcgacgccgaggtcttcggtgccgaccgcacccatgtcctcacccggcttcccgccttcgccgatcagctgcgggtggccgaggagaacggccggatcatcgggtacacggcggcctggcccaacatggacactcatgtggtgggcccgctgacggcccgcgacacggagaccgcgaaggccctcgtcgcctcgctcgccgctcacaccgaccgcccgctgcggacagacatcgatgtacggcacgaagagctgctggcctggctgaaggagcgcgggctcgcgccggtcggtctcaacgcggtgatgacgtacggcatcccggacctgcccggtgatggaacccgtcgattcgctccgctgaccgtggcggcgggc

SEQ ID NO: 4263 - DNA, 417 bp, Streptomyces avermitilis
  CDS (1)..(417)
atgagcaccaccgctgtcaccccgctctccaccgaggacgcggaggtcctcgtctccgccgcccgccgggcagccgaggccgccggggtcacggtcagcatcaccgtcctcgacgcgggcgggcatctgcttgccttccgccgggatgaccgggccgtgctgatctcgggcgagaccagcacccgcaaggcgtacaccgcgctccagctgaacgcgtccaccgccgacctcgtcgaggcggtccagcccggcggcctcttccacaccctgcccaccgcgctcgaccggccgctgctcttcatcgcgggcggagtgccggtccaccgcgacggacgcctgatcggagcgctcggggtcggcggtggcgcaccggagcaggaccacggcttcgccgccgcggccgtgaaggcgctttcc

SEQ ID NO: 4264 - DNA, 1206 bp, Streptomyces avermitilis
  CDS (1)..(1206)
atgcctctcgcgcttctggccctcgcgatcggggccttcgggatcggaaccaccgaattcgtgatcatgggtgtgctgcccgaggtcgcaggcgacttcggtgtctccatccccaccgccggacttctggtgaccggctacgccctcggcgtggtgttcggcgccccgatcatgaccgcgctcggcaccaaggtgccccgcaagcggatgctgatgctgctgatgggcctgttcgtcctcggcaacctgctctccgccgtcgcccccgtcttcgggctgatgctggtgggacgagtggtcgcctccctcgcccacggcgccttcttcggtatcggctcggtggtcgccgccgagttggtggctcccgagaagaaggccggcgccatctccatgatgttcagcgggctgacggtcgccaatgtcgtcggcgtccccctcggcaccctcatcgggcagtccatcggctggcgggtcaccttcgcggtggtcgccgcgctcggtgtggtcgggctgctgggcgtggccaagctggtgcccgagatgcccaagcccccgggtgtccgtctgcgccacgaactggccgccttcaagaacgtccaggtgctgctcgcgatggcgatgaccgtcctcggcttcggcggcgtgttcgcggccatcacctacatcgcgccgatgatgacgcacgtggccggcttcgcggacggctcggtgacctggctgctggtcctcttcggcctcggcatggtcggcgggaacctcatcggcggcaagttcgcggaccgtgcgctgatgccgatgctctacgtgtcactgggcggcctcgctgtcgtgctcgccctgttcaccgttaccgcgcacaacaaggtcctcgcggcggtcaccatcatgctgatcggtgcccttggcttcgcgaccgtgccgccactgcagaagcgggtcctcgaccatgcgcacggcgcgcccacgctggcctcggccgtgaacatcggcgccttcaacctcggcaacgccctctcggcctggctcggcggcatcgtcatcgcggccggtctgggatacaccgctcccaactgggtcggcgccgttctcgccgcggcggccctggtcctcgccgtcctctcggccgccctggagcgccgtgacacgggccggagcgccgtcgtcgcggacgccgcgcccgcagagcggcagacccccgtccaccac

SEQ ID NO: 4265 - DNA, 456 bp, Streptomyces avermitilis
  CDS (1)..(456)
atgacagcgacggaccccgcgctcaccgccctagcccagggctggtgcgccctttctctgctgcacgggaggatcgagggccacatcgagcgcgcgctgcaggccaagcacggactgagcgtgcgggagtactccctgctcgacgtactcagccggcagcacgacggcgagggcggccatctgcagatgaagcaggtcgccgacgcggtcgtcctcagccagagcgccaccacccggctggtcacccggctcgaggaccgcgggctgctctctcgctacctgtgcccgaccgaccgtcgcggcatctacacgaatgtcagcgaagcgggcctcaagctccttgaggaggcgcggcccaccaacgacgccgccttgcgccaggctctcgacgaagccgccaggagccccgagctggccccgctggttcgggtcgtggagtcggtgaacgcgcccgca

SEQ ID NO: 4266 - DNA, 450 bp, Streptomyces avermitilis
  CDS (1)..(450)
atggaagatcttgagatacggcctgccgttgcgggtgacatccccgcgatcgtcgcgatgctcgccgacgacccgctgggcgcccagcgggagtcaccggacgacctggcgccctatctgacggcgctcgagcgtctggccaaggatccgaaccagcacctggtcgtcgccgtacgcgaggaccgcgtcatcggcaccctgcagctcacgatcattcctggtctgtcccggcgcggttccacccgctcgatcatcgagggcgtacgcatccacgcggacgaacgcggcagcgggctcggtacacggctcatcgagtgggcggtcgacgagtcccggcgccagggctgccagctggtccagttgacctccgacgccacccgcaccgccgctcaccgtttctatgagcggctgggcttcgaggcctcgcacgtgggcttcaagctgccactc

SEQ ID NO: 4267 - DNA, 1383 bp, Streptomyces avermitilis
  CDS (1)..(1383)
atgaagacatcccaagaagagctgctcccggcaacccgccgggctctgctgcaccggatcgcggttgctcaggccgaggggcgcgccccgtcgttggcagcggcggtcgtacggggcgggcagacggtgtggtacggctcgcggacctcggtggacgggcacgcgccggacgagaacgtgcagtacaggatcggctcgatcaccaagaccttcaccgccgtactcgtgctgcggctgcgggacgagggagtgctggacctcggcgaccccctggagaagcatctgccgggcacgggtgcgggggaggccaccatcgccgaactgctcgcgcatacgggcgggttggcggccgagtcgcccgcgccctggtgggagcgcacgcccggctcccttcgcccggagcttgccgatgtcctgggcgaactgccgctgaggcatccggtcggccggcggcaccattattcgaaccccggctacacgcttctgggtgctctggtcgaggaactgcgaggcgctccctgggaggaagtgctgcggcgcgaggtgctcgaaccgctgggcatgcgccggacgagcggagacccgcgggcgcctcatgcgggtggctgggcggtgcatccgtgggccgatgtgatgcttccggagcctgccgaggacctcggcaggatggcaccggccggtcagctctggtccacgaccggcgacttggcgcgcttcgccgtcttcctcgcccagggagacgagcgggtactgagcgcggattccgtccgggagatgcgtacgccggccgcgcccgccgaggccgcggacgtgatgtccggctccgcctacgggctgggtatgcagctccagtaccgggacggtcgactcctcgtcgggcactccggttccctgccgggctttcttgcgaacctcaccgtcagcgtggaggacgatctggcggccgtcgtgctggtcaactgcacttccggcccgatgccgtcggccgtcgccgccgatctcgtgcgcatcgtcgccgaggccgaaccccggattcccgagccgtggcgaccgctgcccgatgtcgacgagggcgtcctggagttggcggggcagtggtactgggggacccaggccttcgtgctgcggctgaccgtcgacggaggggtttcgctggagccgctgagcggcgtcggccgtcgggcgcgcctgcgggcgaacggtgacggcacctggaccgggctcgacggctattacgcgggagagctcctgaaggccgtacgacggcctgacgggtccgtgagccacctggacctcgggtcgttcgtgttcacgcggcagccgtacgacgagggggctccggtgccgggcggggtggatcctgaggggtggcgcggcatccca

SEQ ID NO: 4268 - DNA, 1473 bp, Streptomyces avermitilis
  CDS (1)..(1473)
gtgagtctttccgagcctttggacgacccctgggccgacagcggtcccagtgatcgtctgcctgcctcccgccagcgccgcgaaggtggccggggacgggacgagcagcacgaccgtggtcgggacagcgacgcatgggagggggcgggctcgtccttcgagcgcgtaccgccccaggacctggacgccgagcagtccgtcctcggcggcatgctcctctccaaggatgcgatcgccgacgtcgtcgaggtcctcaagggccatgacttctacaagccggcgcacgagacgatctaccaggcgatcctcgacatctacgccaagggcgagccggccgacccgatcaccatcgccgccgagctgaccaagcgcggtgagatcacgaaggtcgggggcgcctcctatctgcacaccctcgtccagacggttccgacggcggcgaacgccgagtactacgcggagatcgtccacgagcgtgccgtgctgcgtcgcctggtcgaggccggcacgcgcatcacgcagatgggttacgcggcggacgacgacgtcgacgagatcgtcaaccgggcccaggccgagatcttcgcggtcaccgagcagcgcaccactgaggactatctgccgctcggcgacatcatggagggcgcactcgacgagatcgaggcgatcggttcgcgatcgggggagatgaccggtgtgcccaccggcttcaccgacctcgaccagctcaccaacggcatgcatcccggccagatgatcatcattgcggcccgtcccgccatgggtaagtcgacgctcgcgctggacttcgcgcgtgccgcctccatcaagaacaacctgccgagcgtgatcttctcgctcgaaatggggcgtaacgagatcgcgatgcgtctgctctcggccgaggcgcgcgtagccctgcaccacatgcggtccggcacgatgaccgacgaggactggacacgactcgcccgccgtatgcccgacgtctcggccgcaccgctctacatcgacgactccccgaacctgtcgatgatggagatccgcgcaaagtgccgccgcctcaagcagcgcaacgatctgaagctcgtcatcatcgactacctgcaactgatgcagtcgggcggcaagcggtccgagagccgccaacaggaagtctcggacatgtcgcgaaacctgaagctgctggccaaggagctggagctgccggtgatcgcgctctcgcagctgaaccgtggccccgaacagcgcacggacaagaagcccatggtctccgacctgcgtgagtccggatccatcgagcaggacgctgacatggtcatcctgctgcaccgcgaggacgcgtacgagaaggagtctccgcgcgcgggcgaggcggacatcatcgtgggcaagcaccgtaacggcccgacggccacgatcacggtcgccttccagggccactactcacgcttcgtggacatggcccaaacc

SEQ ID NO: 4269 - DNA, 1344 bp, Streptomyces avermitilis
  CDS (1)..(1344)
ttggtggccatgacacaggctccagcgagacccagcgccgcccggcgtcggcacgaccgagagatcgtcgcgctggccgttccggcctttggcgcactcgtcgccgagcccctcttcgtgatggccgacagtgcgatcgtcggccacctcggcaccgcgcaactggccggcctcggtgtcgcctccgcacttctcaccactgccgtgagcgtgttcgtcttcctcgcttacgcgaccacggcagccgtcgcacgccgggtcggagccggagatctgcgggccgccatccgtcagggcatggacggcatctggctggccctgctgctcggcgccgtcgtcatcgccgtcttcctccccacggcacccgccgtggtggacctcttcggcgcctctgagacagcggccccgtacgcgatcacctatctgcggatctccgcgctcggcattcccgccatgctcgtggtgctggccgccaccggtgtgctgcgcggactccaggacaccaagaccccgctgtacgtcgctgttgcgggcttcgttgccaacgccgtcctcaacgtagtcctcgtctacggcgccggtctcggcatcgcaggttccgcctggggcaccgtcatcgcccagtacggcatggccgtcgcatatctgtacgtcgtcgtccggggtgcccgtaaactcggcgcccctctgcggccggacatcgccgggatacgggcttgcgctcaggccggcgcccccttgctggtgcgcaccctctcgctgcgcgccgtcctcatgatcgccactgccgtggcggcccggctcggggacgcggacatcgccgcacaccagatcatcctgtctctgtggagcctgctcgcgttcgccctcgatgcgatcgccatcgccgggcaggcgatcatcgggcgctacctcggcgcgggcgacacggagggcgcccgagcagcctgccgccgcatggtcgagtgggggatcgcggccggggtggtgctcggtctgctggtggtcgtcgcacgccccttgttcctgccgctcttcaccggcgactccgcggtcaaggacgctgccctgcccgcactgctcctggtggcgctctcccagccgatctgtggcgtcgtcttcgttctggacggagtcctgatgggtgccggagacggcctctatctggcgtgggcgatgttgctgactctggcggtcttcacgcccgtggctcttttggtacccatgctcggcggcggactgaccgccctctggggagcgatgaccctgatgatgacggtacgcatgctgaccctgtggctacgctcccgctcgggccgctggatcgtcaccggtgcgagccgc

SEQ ID NO: 4270 - DNA, 444 bp, Streptomyces avermitilis
  CDS (1)..(444)
atgaagatcatcctcacccacgaggtctccggcctcggtgccgcgggcgacgtcgttgacgtcaaggacggttacgctcgcaactacctgatcccgcggaacttcgcgatccgctggaccaagggcggcgagaaggacgtcgagcagatccgtcgtgctcgcaagatccacgagatccagaccatcgagcaggccaacgagatcaaggcccgcctcgagggcgtcaaggtccgcctggccgtccgctccggcgacgccggtcgtctcttcggttccgtcaccccggccgacgtcgcctcggcgatcaaggcttccggtggccccgaggtcgacaagcgccgcatcgagctgggctcgccgatcaagacgctgggcgcccacgagacgtccgtgcgtctgcaccccgaggttgccgccaaggtcaacatcgaggtcgtcgcggcc

SEQ ID NO: 4271 - DNA, 234 bp, Streptomyces avermitilis
  CDS (1)..(234)
atggcgaagccgcctgtgcgcaagccgaagaagaaggtctgcgcattctgcaaggacaaggtcacgtacgtggactacaaggacacgaacatgctgcggaagttcatttccgaccgcggcaagatccgtgcccgccgcgtgaccggcaactgcacgcagcaccagcgtgacgtcgccacggctgtgaagaacagccgtgagatggcgctgctgccctacacctccaccgcgcga

SEQ ID NO: 4272 - DNA, 606 bp, Streptomyces avermitilis
  CDS (1)..(606)
atggcaggcgagaccgtcatcacggtcgtcggcaatcttgtcgacgaccccgagctgcgcttcaccccttccggtgcggcggtcgcgaagttccgtgtcgcgtccaccccccgcaccttcgaccgtcagaccaatgagtggaaggacggcgagagcctgttcctgacctgctcggtctggcgtcaggcggcggagaacgtcgccgagtcgctccagcgaggcatgcgcgtcatcgtgcagggccggctgaagcagcggtcctacgaggaccgtgagggcgtcaagcgcacggtctacgagctggacgtcgaggaagtcggcgccagcctgaagaacgccacggccaaggtcaccaagaccacgggccggagcggccagggcggccagggcggttacggcggcggtggcggcggccagcagggcggcggctggggcggtggctccggcggcgctccgcagggcggcggcgctccggccgacgacccctgggcgaccggcactcccgccggtggcaaccagggcggcggcggtggcggcggctggggcggaagctccggcggcagcagcggcggcagcggcggcggctactcggacgaaccccccttc

SEQ ID NO: 4273 - DNA, 288 bp, Streptomyces avermitilis
  CDS (1)..(288)
atgcgtcactacgaagtgatggtcatcctcgaccccgatctcgaagagcgcgctgtctccccgctgatcgagaacttcctctccgtcgtccgtgagggcaacggaaaggtcgagaaggtcgacacctggggccgtcgtcgtctgtcctacgagatcaagaagaagcccgagggcatctactcggtcatcgacctgcaggccgagcctgcggtcgtcaaggagctcgaccgacagatgaacctgaacgagtcggtcctccggaccaaggtcctccgccccgagacccac

SEQ ID NO: 4274 - DNA, 312 bp, Streptomyces avermitilis
  CDS (1)..(312)
atggcacaggcatttcgacccaacaccgccggatccctcttcgccacggatggaaaggcccatccgctccaggacaccttgctagcggtgacgctggtgctcggagtgatcgccttcgtcacggcgatgttccacggtctgcatctgatcagttcctgggccggcctggtggggatcgccacaggcgcgtacgggcagttcatctccgtgacgacccgcgagcgcttcggtctgatcctgggcctgggtgcgtccgcggtcggcttcttcctcggcatggcccatggaggtctcttcggcggggtcttcggc

SEQ ID NO: 4275 - DNA, 1119 bp, Streptomyces avermitilis
  CDS (1)..(1119)
atgagtctgaccctgaggaccatcagccgagagcagcatctggcatacatccagagcctgcccgcggctagtcacatgcaggtcccggcctgggcagatgtaaaggcggagtggcgctccgagagcctcggctggttcgacgacaggaccggcgagatggtcggcgcggggctggtcctgtaccggcagctgcccaagatcaagcgctatctcgcctatttgcccgaaggcccggtcatcaactggttcgcgccgaacctcgacgactggctccagccgatgctcgcgcacctcaagcagcagggcgccttctcggtgaagatgggcccgccggtgatcatccggcgctgggaggccgcctccatcaagggcggcatccagaaccccgatgtgaagcgtctgcgcgacatcgaggcggacttcatcgaaccgcgcgccttcgaggtcgccgacaagctgcgccgcatgggctggcagcagggcgaggacggcggcgccggcttcggcgacgtacagcctcgttacgtcttccaggtgccgctcgccaaccgctccctggaagaggttcacaagaacttcaaccagctctggcgccgcaacatcaagaaggccgagaaggccggcgtcgaggtcgtccagggcggctaccacgacctggaggagtggcagcggctgtacgagatcacggccgtccgcgaccacttccggccccggccgctgtcgtacttccagcgcatgtggacggccctcaacactgaggaccccaaccgcatgcggctgtacttcgcgcgtcacaacggcgtgaacctgtcggccgcgacgatgctcgtcgtcggcgggcacgtctggtactcgtacggcgcctcggacaacatcgggcgtgaggtccggccctcgaacgcgatgcaatggcgaatgctgcgcgactcctacgccctcggcgcgaccgtctacgacctgcgcggcatctccgactcgctggacgagaccgaccacctcttcggcctgatccagttcaaggtcggcacgggcggcgaggccgccgagtacctcggcgagtgggacttcccgctcaacaagctgctccacaaggcgctcgacatctatatgtcgcgccgc

SEQ ID NO: 4276 - DNA, 1029 bp, Streptomyces avermitilis
  CDS (1)..(1029)
atggcgctcacgctctacgtcgacaccgcgcgctggcgagcacaccacaagcacgtgcaggagcagttcccgggactcgtacccgtctgcaaaggcaacggctatggcttcggccatgagcggctcgcggacgaggccacccgcctcggctcggacgtcctcgccgtcggcaccacgtacgaggccgcccggatcaaggactggttcggcggcgatctgctggtgctgacgccgttcaggcggggcgaggagcccgtgccgctgccggaccgcgtcatccgctccgtgtcgtccatcgacggcgtgtacggcctcgtgggcgcccgtgtcgtcatcgaggtgatgtcctcgatgaagcggcacggtgtgagcgagcaggacctcccgcacctgcactccgccatagagaacgtccgcctcgagggcttcgccatccacctgccgctggaccgcaccgacggctcggacgccgtcgaggaggtcatcggctggatggaccgtctgcgcgcggcccggctgccgctgcacacgatgttcgtcagccacctcaaggccgaggaactcgcccggttgcagcagcagttcccgcagacccgcttccgcgcccgtatcggcacgcggctgtggctgggggaccacgaggcgacggagtaccgcggggcggttctggacgtcacgcgcgtctccaagggcgaccgtttcggctatcggcagcagaaggcggcctccgacggctatctggtcgtcgtggcgggcggcacgtcacacggagtgggcctggaggctcccaaggccctgcacggcgtcatgccgcgcgccaagggcgtcgcccgcgccggcctcgcgaccgtcaaccggaacctttcgccgttcgtctgggcgggcaagcagcgctggttcgccgagcccccgcacatgcaggtctcgatcctcttcgtgccctcggacgccacggagccgaaggtcggcgacgagctcgtggcacaccttcggcacaccaccacgcagttcgaccggatcctggaccgc

SEQ ID NO: 4277 - DNA, 1515 bp, Streptomyces avermitilis
  CDS (1)..(1515)
atgtgcggcatgcccagtgcagagacgacgcgagcgagcgtgcaccagccggagccggtacggccgaccagggaggacgaggtcgccgcggccggcagtgagctgatcggcggccccatcgggcgacgcgcactgttcgggacgtcctggtggacgcccgtgcggatcgtggcgctcgtcgcgatcggcatgttcgccctcggtatggtccagaagctgccctgctacgacagcgcctggttcttcggcgccagctcgcagtacacgcacgcgtgctattcggacatcccgcacctctatcaggggcgcggcttcgccgacgggctcgtgccgtacttcgacaagctccccggcgacatggactacctggagtacccggtcctcaccggtgtgttcatggaggtcgcctcctggctcacaccgggcagcggcaccatccagcaccaggagcaggcctactggatggccaacgccgggatgctgatggtgtgcaccgcgatcatcgccgtgtgcacctcccgcacacaccgccgacggccctgggacgggctcctggtggctttggcgcccgcgttcgcgctgacggccaccatcaactgggacctgctcgccgtggccctcctggccgccgcgatgctgatgtggtcgcggggccgggccctcgctttcggcatcctgctgggactcgccaccgctgccaagttctaccccttcctggtgctcggaccgctcttcctgctgtgctggcgggccggcaagtggcgggagttcgcgaccgcgctgctcggcgcggtcggcgcctggctcgtcgtgaaccttccggtgatgttcctggcaccggagggctgggcgaagttctaccgcttcagccatgaccgcggcgtcgacttcggctcggtcttcctggtcctctcgcagcggtggaacatccagatcaccgccgatgcggccaacacctgggccatggtcatgatgctggccgtctgcgcgggcctggccgccctcacgctgaccgccccgcgccgcccacgcctcgctcagctcgccttcctgatcgtggcggccttcatcctcaccaacaaggtctactcgccgcagtacgtactctggctggtccctctcgccgccctggcccggccgcgctggcgggacttcctgatctggcaggcgtgcgaggtcgcgtacttcctggggatctggatgtacctcgcgtacacgaccagcggcgacgctcacaaggggctcccgaccgagggctaccaactcgccgtcgtcctgcacctgctggggacgctgtacctgtgcgcggtggtcgtacgcgacatcctgatgccggagcgggacgtggtgcgccgggccggagacgacgatccgtccggcggcgtgctggacggcgctccagacgtcttcgtgctcggtgccgccgcccatccgccgcgtcacgcggtgcacttcgagggaccgcaggtggaatggggcagtaggggcccgatgtcggtcggcgacagttcgccc

SEQ ID NO: 4278 - DNA, 2787 bp, Streptomyces avermitilis
  CDS (1)..(2787)
atgcgaaaacgaccgcatccgtacttgggggggaccggaaaccagccgccgtttccaggcgcgcaaaggtgcgcctgcccgaggagtaatcgttcgatgagcgagcaccgtcgcaaactgccgcagccgcaggaaggcggacgtgccgcggcccgacgcggccagtcggcgccctccggccgccgagcggcaccgcgagccgccaccgggtctccttccgactcgtatggggcgggagatgaggaacgcccgtacggtggccgagccgaggcccggcgggcgtcacagagaagtgagcccggccggcgtagggccgccgacggcgcgggacgcggttccggaggcggcggtggccgccgaggcggtccaggcggtccaggcggtccgaatggaccagggcgcggcaggggccgctccgttcccgaacggaagcgcttcatcgactacccgcgcgccggtaagtacggagccgcgcgctggctgccgtcctggaggctggtcacgggcctgtgcatcgccttcttcggcagcatggtggcggtcgcgggtgtcgcgtacgcgctggtgggcgttcccaaagtcgctctgaccgctaaggcgcagaacaacgtctactactggaaggacggcagccagatggttgccaccggtggtgagacgaaccgccagatcgtcaacatctcgcagatcccgaaggcgatgcggtacgccgtcatctcgcaggagaacaagaccttcgagaccgacagcggcgtcgaccccaagggcatcgcccgggccttcttcaacatggccaggggcggcgagacgcagggtggttccaccatcacccagcagtacgtcaagaacgcgatgctggacgaccagtcgcagacgatctcgcgtaagttcaaggagatcttcgtcgcgataaaggtgggggccaaggtcccgaaggacgagatcatggccggctatctgaactccgcgtactacggtcgcggggcctacgggatccaggcgggcgcgcgcgcttacttcgacgaagatgccaagaacctgaaccccggccagtgcgccttcctggcggcgatgctcaagggcgccacgtactacgaccccgcgggtgcgacgtcgctcgacccggccgccacttcggaggccaacagccggcgggcgaagctccagatgcaggacaccctcgacaaggaggtcgagtacggccacctggacgaggcgacgcggaacaagtacacggaactccccaaggtcgagaacccgcgctcgaacgcccgcctcagcggccaggtcggctatctcgtcgacctcgccaaggcgtacctcgtcaacaacagcgagatctccgccgatgaccttcagcggggcggctactcgatctacacgaccttcgacaagaagaaggtcaccgagctcgaggacgcggtgaaggcggtccggaagaagaacatcaagcccaagcagcgcccggacacggacacctacgtccagttcggcggagcctccgtggacccgaccaccggcgcgatcaaggccatctacggcggtgaggacgcgaccaagcacttcaccaacaacgccgaccagaccggcgcccaggtgggctcgacgttcaagccgttcgtgctggcggccgccatgtcgtggggcaagaaagaccccgatctcgacgactcgcagtcgcaggacgagcgcaccgtcgtctccccgaagagcctgtacagcggcaagaacaagctcaagatcgaggactacaagggcaacgtctggacggacaacaagggcaaggagtggctccagacgaacgacggcggtgagtcgtacaacgcgcccagctacaagatcgacctccgcgaggcgatgagggtctccgcgaactccgccttcgtccagctcggtatggacgtcggcctggacaaggtcagggatgccgccctgagtgcgggcatcctcaagaccagcctggccagtgccaactacccgtcgttctcgatcggcacctccgaccccagcgcgatccgcatggccggtgcctacgccacgttcgcggcgagcggcaagcagcgtgacccgtactcggtcgagaaggtcacgagcaaggacggtccggtcttccagcacagtgacatcgccaaggtcgacgacgccttcaccgccaaggtcgccgacaacgtgaccgacgtcctgaagaccgtggtcgaccagggcaccggcaccgcggctcagctgaccggccgtgaggtggcgggcaagacgggtaccaccgacggcaacaagtcggcctggttcgtcggctacaccccgcagctctcgacgtcgatcacgatgtaccggatggacgacaacgagtccagcaagaagcgccagttcctggagatgtacgggacgggtggccaggacaagatccacggcgcctcgttcccggccgagatctggcacgactacatggaacaggccctgaaggacacggcgccgaaggacttcccgacgccgcagcccatcggtgtggtggtcgacgacaacccgaccccgacggtgatcccctcgcccacgaagagcgtggaggagagcccgacgccgactccgacgcccagcaagaccacgacctcgccgacgcccacgccgaccgacagctgcttcggcttcggctgcaccgacaccgggggcaccgacacgggtgggaacaccagtggcaccgatggaggcgtcaccgcgacaccgacggagtccactgggaacgggaacaccagaggcaacggcaacggaggcatcttcggaggaccgaacgga

SEQ ID NO: 4279 - DNA, 681 bp, Streptomyces avermitilis
  CDS (1)..(681)
atgagccggcgttccgggatcctcgagttcgccgtactcggcctgctccgcgagtccccgatgcacggctatgagctgcgcaaacgactcaatacgtcactgggtgtgttccgtgcgttcagctacgggacgctctacccctgcctcaagacgctggtcgccaacggctggttgatcgaggaatcggggagcgcccctgaggacgccctcgccgcttcactcgctgggcgccgcgccaagatcgtctatcggttgacggcggaaggtaaggagcacttcgaggaactgctctcacagacgggtcccgatgcgtacgaggacgagcacttcgccgctcgtttcgccttcttcggacagacgtcgcgcgatgtacgcgtgcgtgtactggagggccgccgcagtcggctggaggagcgcctggagaagatgcgcgcctctctgacacgcacccgggagcgcctcgacgactacacccttgagctccagcgccacggaatggagtccgtggagcgcgaagtgcgctggctgaacgagctcatcgagagtgagcgggccggacgggacctcaaaggttccgcttccgcaggctccgctcagcagaacagcacatctggagagacgggcggcctgccccggcaccgggacgagtcccggccggatccgtccgacgacaccaccacg

SEQ ID NO: 4280 - DNA, 1080 bp, Streptomyces avermitilis
  CDS (1)..(1080)
atgggttcggttcgcgtagccatcgtcggcgtgggcaactgcgccgcctcgctggtgcagggcgtcgagtactacaaggacgccgacccggcgtccaaggtgcccggtctgatgcacgtccagttcggcgagtaccacgtcggtgacgtcgagttcgtcgccgccttcgacgtcgacgcgaagaaggtcggcctcgacctctccgacgccatcggtgccagcgagaacaacaccatcaagatctgtgacgtcccgaacaagggcatcacggtccagcgcggccacaccctcgacggtctcggcaagtactaccgccagaccatcgaggagtccgccgaggccccggtcgacgtcgtccagatcctcaaggacaagcaggtcgacgtcctcgtctgctacctgcccgtcggttccgaggacgcggcgaagttctacgcccagtgcgccatcgacgccaaggtcgccttcgtcaacgccctcccggtcttcatcgccggcaccaaggagtgggcggacaagttcaccgaggccggcgtcccgatcgtcggtgacgacatcaagtcgcaggtcggcgccaccatcacgcaccgtgtgatggcgaagctgttcgaggaccgcggtgtccgtctcgagcgcaccatgcagctcaacgtcggcggcaacatggacttcaagaacatgctggagcgcgaccgcctcgagtccaagaagatctcgaagacgcaggccgtcacctcgcagatccccgaccgcgacctgggcgagaagaacgtccacatcggtccctcggactacgtggcctggctcgacgaccgcaagtgggcgtacgtccgcctcgagggccgtgccttcggtgacgttccgctgaacctggagtacaagctcgaggtctgggactccccgaactccgcgggtgtcatcatcgacgccctgcgcgccgcgaagatcgccaaggaccgcggcatcggcggcccgatcctgtcggcgtcttcgtacttcatgaagtctccgccggttcagtacttcgacgacgaggcctacgccaacgtcgagaagttcatcaagggcgaggtcgagcgc

SEQ ID NO: 4281 - DNA, 1260 bp, Streptomyces avermitilis
  CDS (1)..(1260)
atggctgtcgtgcgtgacctgcgcatcctcctgcgcttccagggcttcagacgcctgctcgccgtgcggctgttctcccagaccgccgacggggtctaccaggtcgcactcgccacctacgtcgtcttctccccggagaagcagacctcggccgcggcgatcgcctccgcgatggcggtactgcttcttccgtactccgtcatcggccccttcgccggcgtcctgctggaccgctggcggcgccgacaggtcttcctgtacggcaacctgctgcgggccctgctggcgtgcgtgacggctgttctgatgctcggccatgtgccggactggctcttctacgtctccgcgctgtccgtcaccgcggtcaaccgcttcgtcctcgccgggctctccgccgcactgccccgcgtggtcgacgacaagcgtctggtgatggccaactccctgtccccgaccgccggaacgctcggggcgaccgcgggcggcggtctcgcgttcgccgtccggctggtggccgcggactccgacgccgtggtggtactgctgggtgcggccctgtatctgtgcgcggcgctcgcgtcgctgcgcatcgctccggacctgctcggccccgaccagaggccggtacggccacggttgggagcggcgctcgtgggcaccgcacgcggcctcgtgctgggcgtgcgccatctggccgaggccccacgccgggaggcggcctgggctctcatcgccatgacgctgatgcggttctgctacggcgcgctgacggtcatggtgctgatgctctgccggtacgccctgtcgtcggattcggacgacggtctcgctctgctggggctggcggtgggcgtctccggggcggggttcttcacggcggccgtcctgacgccctgggcagcggggaagctcggccccgggcgctggatcgtcgtctgcgccgctgccgccgccctcctggagcccgccctcggcctgccgttcaccaccgtcccgatgctggtcgcgtccttcgtcctgggggtgaccacgcagggagccaagatcgccactgacacgatcgtccagtcctcggtcgacgacagcttccgtggccggatcttctcggtttacgacgtgctgttcaatgtcgcatttgtcggagcagccgcagtggccgccctgatgctgccccctgacggccgctcagccaccctcgtggtcacggtggccgttatctacggggcaattgctggcgctatggcccgctttgatctccag

SEQ ID NO: 4282 - DNA, 489 bp, Streptomyces avermitilis
  CDS (1)..(489)
gtgaccgttccgccgcagccccagggccagaacccgtacgctcagcagcccgccccgcccgagggtcagcagcccggccagccgggagttcccccgcagcagccttacgcgccgttccccaaccagggtggaccggttccgccgccgcccgcgccggccgggcgtgcgggcaagaaggtgatgcgcgtcctcgggatcatcgtcgtcggcataatcgtcatcgccgtgaagttcggcgcgggctggttcttcagccgtagcgatgcagagaccacctcggtgggcgcgtgcatgcacaacgacggcacggacaccaacgcggacctcaacgaggtcgactgctcttccggcgactcccagtacaaggtcgtcgagaagttcgacgacaccagcgacgacagcaagtgcaaggccgtcaagagctccacggtctactacgtccagtcgggcggcggccacaacgtggtgctctgcctcaaggagaccaag

SEQ ID NO: 4283 - DNA, 1440 bp, Streptomyces avermitilis
  CDS (1)..(1440)
gtgccgaacgccaacgaagacaaccccagtgccctgagtcaggtgcagcgccgcgcggtgagtgaactgctgcgggtgtcccctgtcgccgacgagctcgcccgccgcttccaggaggccgggttctcgcttgccctggtcggcggctcggtgcgggatgcccttctcggccggctcggcaacgatctggacttcacgaccgacgcccgccccgaggacgtactcaagatcgtccgtccatgggcggacgccatgtgggaggtcgggatcgcgttcggcacggtcggggcccagaaagagggctaccagatcgaggtgaccacctaccggtcggaggcgtacgaccgcacctcacgcaagcccgaggtgtcgtacggcgactccatcgaggaggatctcgtccggcgtgacttcacggtcaacgcgatggcggtggcactgcccgagaaggagttcatcgacccgcacggtgggctcgacgacctggccgcgcgcattctgcgcaccccgggcaccccggaggagtcgttctcggacgacccgctgcggatgatgcgggcggcgcgcttcgccgcgcagctcgacttcgaggtggcccccgatgtcgtcacggcgatgacggagatggccggccgtatcgacatcgtctccgcggagcgggtacgggacgagctgaacaagctggtcctgtccgcgcacccgcgtaaggggctgacactgctggtcgacaccggtctcgccgatcacgtcctgccggagctgcccgcgctgcggctggaacgtgacgagcatcaccggcacaaggacgtctacgaccactcgttgatcgtgttggagcaggcgatcgcgctggaagagaacggccccgacctgacgctgaggctcgccgcgctcttgcacgacatcggcaagccgaggacgcgccgcttcgagaaggacggccgggtctccttccatcaccacgaggtggtgggcgccaagatgacgaagaagcggatgacggcgctcaagtactccaacgacctggtgaaggacgtctcgcggctggtcgaactccacctccgcttccacggctacggcacgggcgagtggacggactccgccgtgcgccgttatgtccgtgacgcgggcccgctcctcgaccgtcttcacaaactgacccgctccgactgcacgacccgcaacaagcgcagggccgccgcgctgtcccgcgcgtacgacggtctggaggagcgcatcgcccagctccaggaacaagaggaactggacgcgatccgtcccgacctcgacggcaaccagatcatggaggttctgggcgtcgggcccggcccggtcatcggtcaggcgtacaagttcctgctggaacttcgtctggagaacgggccgatggagtacgacgcggcggtggccgcgctcaaggagtggtgggccgagcagaac

SEQ ID NO: 4284 - DNA, 2415 bp, Streptomyces avermitilis
  CDS (1)..(2415)
gtggccgaggcggcagacttccaagggatgagtccctcacctgcccgccggtggctgaagcgcaccggcgcactgctcgccggagcgcctctgctggccggcctcctccagctgcccgtggcaccgtccgcgtacgccgcggagaaggcctccccggccgacgcttccggatcccgcacggtcgacgtctccctcgactcgctcagccccagcgtccccaccgacggcgacaccgtcaccgtctcgggcacggtcacgaaccacggcaagcagacgatcacgggcgcccatgtgggactgcgggtgaacgcgcccctgagcgaccgcacggcgatcaccgacgccgccgagcgcaggggataccagccgggcgtggacggcgccgagatcggcggcaagtacgtcgagaagttcccccagctcgccgcgggcgtctcacagcacttcgacatctccgtgcccgtcaaggagctggacctcggttccgacggggtctaccagctgggcgtctcgctgtccggccagaccgcggctcagccgtgggaccaggtgctcggcatccagcggacgttcctgccctggcagccggacggcgccgacccgaagacgaagaccacctacctctggccgctgatctccaccgtccaccagaccgcggagaccggctcgaacgaacagcagacgcccgtcttccggaacgacgacctggccaaggagatctccccgggcggccgcctggaccagctcctgtcactcggcaaggaactcgacgtcacctgggtgatcgaccccgacctgctcgcctcagtggacgcgatggcgggcagctacagcatccagaacgggaacggcagcaagacggcgggcaagaaccaggcggtcgccaagcagtggctcgccgaactggagaagacggtcgaggacaaggagatcgtcgcccttcccttcgccgaccccgatctcgcctcgctcgcgcacaacggcaagaacgtcaccggctccctgagccacctgaaggacgccacggacgtggcggcgagcaccgtggagaccgtcctccatgtgaagcccagcacggacttcgcctggcccgcggacggtgccgtcgacccgtcgatcgtcaaggtcgccacctccgcgggcgccgacaaggtgatcgcccgcagcgacagcctcaaggagaccggcggactgtcctacacgccctccgccgcccgccccgtcggcggcggcaccacggcggtcgtcgcggacgcccccctgtccacggcgttccagggcgacatgaccaaggccgacacctccacgctcgccgtgcagcgattcctggcccagagcctgatgatcagccttcaggatccggacaagcagcgcagcatcgtcgtcgccccgcagcgcatgccgtccgcgagtcaggcccagacgatggcgcaggcgctgacggccctccaggaaggcaactgggcccagccacaggatctgtccgcggccgcgaaggccaagccggaccccggcgccaccacgcggatcccgtccgcgtccgcgtacccctcctcgctgcgcaagcaggagctgccgcagtctgcgttcgaaaagatcgaggccatccagagcaagctcgacaacttcaaggtgatcctcaccgccccgccccgggtcgtgacccccttcgggcgggccatagaccgcggcatctccgcctcctggcgcggccgcgccagcgaggcggagaccttccgcgaggaggtggagtcgtacctcgacgtgctcaccgagcaggtgaagctgatcgagaagtccgacgccaacctgtcgggccgcagtgccaccatccccgtcaccgtgcagaacaatctgctgcaaggtgtcgaacacctcgtgctgcgtctcaagtcatcgaatccgactcgcctcaagatcggcgacggaccctacgacgagaagcccatcgcggtcgcgggcggacacagccagtcggtgaaattcaccacctccgccaacgccaacggccccgtgacggtcgtcgcccagctcttcacggaggacggccagccctacggccccgaggtcgccttcgatgtgaaggtcaccgaggtcacgcccacggtgatgctggtcatcgctggtggcgtcctgctcctcgtgctcgccgggttccgcatgtacacccagcgcaagcgcgccgccgcccgacggacggcggaggaacaggaggccggtccgggggacgaggggctgaacgaggaacccgaaggcaccgtagacactgaggacaccgaaggctccacggacggtccccgggacgagtccggcacggagcccgaggcagacgacccggagcacccgagtgacccgacaccggacaccgcaccggaaagcgccgacccgtccggcacgggtgagagagtggaccgt

SEQ ID NO: 4285 - DNA, 2265 bp, Streptomyces avermitilis
  CDS (1)..(2265)
atgaacgcgccgtacgacggtgaccgcggccagggcgccgcgggcagctcggggcaccccgagggcccgacgcccgagcccggccaggtgtcgccgcagccccccgcggacatgtacctccaggacgcctacgaccaggacccctaccgggcgcaggacctctccgcccaggacccggtcgccgaggcgctctacgaccgtgccgcgcaccccccgccgcctccgggcgcgtaccagccgcagcagccgctctacacgcagccgcccacgtcgcagtacgcccccgatccgcgggtgtgggcccagacgccggcgcccgaacccgaagggccgacgcagtacctgccgtacggcgacgaccctcgtacgacccagttcgtgggtgtcgacgacctggtcacacaggccggtgaggagcgccacgagccggacgccttcgcccatctcttccgcgaccagcagcagggcggcggacacccgcgcaccgagtccccggcggtccccggtccgtctccggagccgtccgccgcgggtcagggaccggtggcacaggcccaggcgccggcgtccgagcagacgatgcagctcacccccacagccgctcccacagccgctccggccgccgccccgaagaagggcgggcgtgcctcaggtctgctgaagtcgagcgcggtcatggcggcgggcacgctggtgtcccggctcaccggcttcgtccggtccgcactcatcgtctccgcgctgggcgtcggcctgctcggagacaccttccaggtcgcgtaccagctgccgaccatgatctacatcctgaccgtgggtggcggcctcaactccgtcttcgtgccgcagctcgtgcgcgccatgaaggaggacgacgatggcggcgaggcattcgccaaccgcctgctgaccctcgtgatggtggccctcggcgcactcaccgcgctcgcggtcttcgccgcgccgctcctgatccgcctgctgtccgactcggtcgccagcgatccggcggccaaccaggtcggcatcaccttcgtccgctacttcctgccctcgatcttcttcatgggcatccacgtggtgatgggccaggttctgaacgcgcgaggcaagttcggcgcgatgatgtggaccccggtcctcaacaacatcgtcatcatcatcacgctcggcatgttcatcggggtgtacggctccgcggcgagctccgggatgaaggtcacgaccatcccgccggagggagagcggctcctcggcgtcggtgtcctcctcggcctcgtcgtgcaggccctcgcgatgatcccgtatctgcgcgagaccggattccggctgcggctgcgcttcgactggaagggccacggcctcggcaaggcagcgatgctcgccaagtggaccgtgctcttcgtcctcgccaaccaggcgggcgccctcgtcgtcacccagctgtccaccgcggcgggcaaggactctcccgtcgacggcaccggcttcgcggcctacgccaacgcccagctcatctggggcctgccgcaggccatcatcaccgtgtccctgatggccgccctgctgccgagactctcgcgctcggcccacgagggcgacgccggcgctgtccgcgacgacatctcccaggggctgcgcaccacggccgtcgcgatcgtgcccgtctccttcggcttcgtcgcactcggcattccgatgtgcaccctgatcttcggttcctcgggcaccagcgaagccacgaacatgggctacatgctgatggccttcggcctcggcctgatcccgtactccgtgcagtacgtcgtgctccgcgccttctacgcctacgaggacacccgcacgcccttctacaacacggtcatcgtggccgccgtgaacgccggcgcctcggccctgtgcttcttcctgctcccgggccggtgggccgtggtcggcatggcggcctcgtacggtctcgcgtacgcgatcggtgtcggcgtcgcctggaaccggctgggcaagcggctcggcggcgacctggacggcgcccgcgtcctgcggacgtacgcgcgtctcggcatcgcctcgttgccggcggcactgctcagcggtgcggcctgctacggcgtcggtcagacgctgggccagggtgtcggtgggtcgttcgtcgcccttctcggcggcggagccgtactgctcggcgtcttctacgtagctgcgcggaagatgcgcatcgaggagctcaactcaatggtcggtatggttcgcgggcgcctggggcgc

SEQ ID NO: 4286 - DNA, 1719 bp, Streptomyces avermitilis
  CDS (1)..(1719)
gtggcggaacggagcacggctgccgtcgacgtggcagacaacagcggcgatgagccgctgaccgccaaggcggaccagtccacgtccgacggggtggcccagaaccgggagcgggacacggacagcaaagaggcacaggggagcggcgggaccgagagtcccggaaaggcctcaccgcccgaactgcacagcgggcacaaactcgccagacgctaccgtctcgaagagtgcgtcacccgtctggacggtttcagcagttggcgtgccgtggacgagaagctgcgtcgcgccgtcggcgtgcatctgctgcccgccgatcacacgcgcgcccgctccgtgctggccgcggcccgctcgtcggcgctgctcggcgacccgcgcttcgtgcaggtcctggacgccgtcgacgagaacgatctcgtctatgtggtgcacgagtggctgcccgacgccacggagctgaccacgctgctggcctcgggcccgctggaggtgcacgaggcctaccagatggtcacccaggtttcccaggccatggccgccgcacaccgcgagggcctttcgcatctgcggctgaacccgggtgccgtgctgcgcacctcgtccgggcagtggcgtatccgcgggctcgccgtgaacgccgcgctgcgcggcatcagttccgacaccccgcagcgcactgacacggaagcgatcggcgcgctcctgtacgccgcgctcacccagcgctggccgtacgagagcgacgcatacggtctctccgggctgcccaagggcgtggggctcatcgctcccgaccaggtgcgggccggcgtccaccggggtctgtcggagctcgccatgcgcgcgctcgtcaacgacggtgcgaccgcctcacgtcaggagccgccgtgcaccacgccggaggaactggtgaaggcgatcagcgagatgccgcgcatccgcccgccggagcccgcgttcaccgccccgccggagtaccagcgcacgacgtaccagcagggcacgtacggccgccagatgccgcgtccgggtgtcacacaggccattccggccccgccgcccccgctgcagagccgtaccggaaaggctctcaagtgggctgtctccgggctgctcatcgccgcgctgggcctgggcagctggcagctcgcggaagtcttgatggaccaccgcaagtccgacgacaccggaccgacgcacacgacggacggcaacgacaagggcggcagcaagaccacacctctgaagccgatcaccatccaggatgcgcaggagtactacccggacgggaagccgcagcacgccaaggacgtggggctcacctacgacggtgacagctccacctactggcgcacctactcgtacaacggcgggccggtgctggcgccgttcaagcagggtgtgggcatcgtctacgacctgggatccgcgcggagcctgtcggcggcctcaatagggctgaactacggcggcaatcacaccacggtgtcgctgtacgcggccgactcactctcgtcgtcggccccactcagctccatgaagaagatcgacggcgccgatgccacgacctccggtcggcaactgaagatctccgctgccaaggcggtgaagacgcggtatgtgcttgtgtggatcaccgcagccccctactcgggcaaggacgagtacagcggcgccggctacaagcaagcgatcaccgatgtgaagttcactggc

SEQ ID NO: 4287 - DNA, 711 bp, Streptomyces avermitilis
  CDS (1)..(711)
atggccgatgaggccgcgtacggcaccgcaagcgatcaggacctcctctcccgccatgtggcgggcgaccccgaggccttcggggaactcgtgcgccgccaccgcgaccggctgtgggcggtggcgctgcggacgctgggggaccgcgaggaggccgctgacgccgtccaggacgcgctggtctccgcctaccgggccgcccacaccttccgcggccagtcggccgtcacaacgtggctgcaccgcatcacggtgaatgcctgcctggaccgcgcccgcaaggccgcctccaggaagacgtcccccgtcgacgacaccgaacgcctggaacaactcctggagccgcacgagtccgcatccgcccccgccgagcgcaacgatctgcatcgcgagctgatggaggcactgggtactctgccggccgaccagcgagccgccctcgtcctcgtggacatgcagggctacccggtggctgaggcggcccgcatcctcgacgtaccgacagggacggtgaagagccgctgtgcgcgcggcagagccagacttctgccgctgctcacccatctccgcgcggagagcggcggcgaggccggtaagaagtcggccggcggaaggaaccggacgcagggtgcatccgtcccaccggcagcgggaccacatgatgcagggccaagcgattcagctgctgtgaagggcggaggtgggcgagcg

SEQ ID NO: 4288 - DNA, 921 bp, Streptomyces avermitilis
  CDS (1)..(921)
gtgacatccacgaccgacacggccggacacccagaagtcgaggagatctcggacctcaccgaaggccttcttccgccttcccgtaccgcggatgtgcgtcggcatctggacgactgcgtcctctgtgccgacgtctacgactctctggaggagatccgcgggctgctgggtacgctgccgaccccggctcgtatgcccgacgacgtagcggggcgcatcgacgcggcgctcgccgcagaggccctgttggactcctccgcacccgccctcgactccggggtcgctgctcctgcggagtccgcgaccgctcatgtttcacgtgaaacatcggccgccactccggccgaccgccccactggtcgtcctcgagcggcgaccggccccggccgtacgaacgtcaggcgccgtggtcgccgccggatcgccctcggcgcggtcttcaccgccgccgctctggggctggggacactgtgggtacagacgctgaatgacgacaccgggaagacctccggtccctcggcacttcacaccgatgcggcgcacacctactccgacggcaaactggggagtcaggtcgcggacctgctctccacaaagaaggccggtggccgcaccgggagcggcaagccgtcgatgggtatcgagtccgactccacaggggctacgggcatgaagccgaacaacaccttcgggaccgccacggtgaaggtgcccacctgcatcgagcgggccatccccgatgaccacgtgctgctcgccgcagacaagggtgtctacgagggagtcggcgtctatctcctggtgaccccggactcctccgacagcacgcgcgtcgcggcctacgtcgtcgatgccgcctgcacgaagcaggcctcgccagcccccggcaaggttctgctgaagcgctcgtacgcgcggtcc

SEQ ID NO: 4289 - DNA, 969 bp, Streptomyces avermitilis
  CDS (1)..(969)
gtgagcgacgtccgtaacgtgatcatcatcggttcagggcccgccggctacacggcggcgctgtacaccgcacgcgcgtcgctgaagccgctggtgttcgagggcgccgtcaccgcgggcggcgcgctgatgaacaccaccgaggtggagaacttccccggcttccaggacggcatcatgggccccgagctcatggacaacatgcgcgcgcaggccgagcgcttcggtgccgagctggttccggacgacgtcgtcgccgtcgacctgacgggcgagatcaagaccgtcacggacaccgcgggcaccgtgcaccaggccaaggcagtcatcgtcaccaccggctcgcagcaccgcaagctggccctgcccaacgaggacgctctctccggacgcggcgtctcctggtgcgccacctgtgacggcttcttcttcaagggccaggacatcgccgtgatcggcggcggcgacaccgcgatggaggaggccaccttcctctcgcgcttcgccaagtccgtgacgatcgtccaccgccgggacacgctgcgcgcctccaaggcgatgcaggagcgtgccttcgccgaccccaagatcaagtttgtctgggacagcgaggtcgcggagatcaagggcgacccgaagctggccggcctgtcgctgcggaacctcaagaccggtgagatctccgagctgccggtgacggggctgttcatcgcgatcggccacgacccgcgcaccgagctcttcaagggtcagctcgacctggacgaggagggctacctcaaggtcgacgcgccctcgacccggacgaacctgagcggtgtcttcggcgccggcgatgtcgtcgaccacacctaccgccaggcgatcaccgcggccggcaccggctgctccgccgccctggacgccgagcgcttcctgtccgcgctcgcggccgccgaggacgccgcggagcccgagaagaccactgtc

SEQ ID NO: 4290 - DNA, 330 bp, Streptomyces avermitilis
  CDS (1)..(330)
gtggccggcaccctgaagaatgtgaccgacgactcctttgagcaggacgtcctcaagagcgacaagcccgtcctggtggacttctgggccgcctggtgcggtccgtgccgccagatcgcgccgtcgctcgaggcaatcgcctccgagtacggcgacaagatcgagatcgtcaagctcaacatcgacgagaacccgggcacggccgccaagtacggcgtcatgtccatccccaccctgaacgtctaccagggtggcgaggtcgccaagaccatcgtcggtgcgaagccgaaggccgcgatcgtgcgtgacctcgaggacttcatcgccgag

SEQ ID NO: 4291 - DNA, 615 bp, Streptomyces avermitilis
  CDS (1)..(615)
atggggcgccggctcgtaccgctcacgctggacaaccttccggaccttcccaagcgctgtcgcgcgtgtgtcttctgggaattggaccccgtcagcggcgaggccgcggtaaaggcgggtacgtccgcactggagaaggaggcgtggatctctgcagtccttctggactggggatcctgcggccgtgtggtctacgtggacgacgtcccggtgggctttgtgctgtacgcgcccccggcctatgtcccccgctccacggcgttccccacaagcccggtgtcgcccgacgcggttcagctcatgaccgccttcatcatgccgggataccaagggcaggggctgggccgtgtgatggtccagacggtcgccaaggatttgctgcgtcggggcttcaaggcgatcgaggccttcggtgatgcccactggaaagagacggcgtgtgttctgcccgcggaccatctgctggcggtgggcttcaagacggtacgaccgcacccgacttacccgcggctgaggctggaactgcggacgacgctctcctggaaggaagacgtggagttggcgctcgaccgtctcctgggagccgtacagaaggaacccgccctgcgcccgctg

SEQ ID NO: 4292 - DNA, 1101 bp, Streptomyces avermitilis
  CDS (1)..(1101)
gtgagcgagcgacggagggggttgggccgtggtctcggcgcactgatcccggcagccccgacaggggagaaggcggcagttcctgctgcggcaagcggtggtgggtccacgtcgccggcagcggtgccggtactgaccgcggagcgaggggtggcggccgcgaaggtggctacgctcccgcctgtttcacatgaaacagacgagctgtcatcgaacggattcggggaggcgcccgcggcgccggtcggcgcccacttcgccgagctgcccctcgacgccatcactccgaactcacggcagccccgtgaggtcttcgacgaggatgcgctcgcggagcttgtcacctccatcaaggaggtcggcctgctgcagcccgtcgtcgtacggcaggtgggtccggcgcgctacgagctcatcatgggcgagcggcgctggcgggcctgccgtgaggcggggctggatgccatcccggcgatcgtgcgggccaccgatgacgagaagctcctcctggacgcgctgctggagaacctgcaccgtgcccagctgaacccgctggaagaggctgccgcctacgaccagctcctcaaggacttcaactgcacgcacgaccagctggcggaccgcatcggccggtcccgtccgcaggtctccaacaccctgcgtctgttgaagctctctcccgcagtccagcgccgggtcgccgccggggtgctgtcggcggggcatgcacgggctcttctgtccgtcgaggactccgaggagcaggaccgcctggctcaccggatcgtggccgagggactttcggtacgggccgtcgaggagatcgtgaccctcatgggatcgcgtccgcagacggctccgcgctccaagggaccgcgcgccggtacccggctctccccggcgctgagtgaactcgcgactcggctctcggaccgcttcgaaacccgggtgaaggtcgacctcggccagaagaaggggaagatcgtcgtcgagttcgcctcgatggacgacctgcagcgcatcctcagctccctcgcccccggtgaggggccggttcttcagcaggttctctcggaggacgactccgaggagacggagagc

SEQ ID NO: 4293 - DNA, 1071 bp, Streptomyces avermitilis
  CDS (1)..(1071)
atgggaggctctgttcattgcgagcctgaagtcgaggagagtgaatcgttgcggtccgacgccaacatcgcgggaccgatgaccgatccggtccccggtccccgtaccgagtcgatgggggaggatgtttcacgtgaaacaccgcccccgatggacgacactcccatcggtcgtgctgcccaacttgcggtggaagcactgggccgggccggcgagggcctgccacggcccgagcagacccgagtcatggtggtcgccaaccagaagggcggcgtgggcaagaccacgaccacggtcaaccttgccgcttcgcttgccctgcatggcggacgcgtcctggtgatcgacctcgaccctcagggcaatgcctccaccgcgctgggaatcgaccaccacgccgaggttccttccatctacgacgtgttgatcgacagcaagccactctcggaagtcgtccagccggtccccgatgtcgaaggcctcttctgtgcccccgccacgatcgatctcgccggtgcggagatcgagctggtgtccctggtggcccgagagagtcggctggagcgggcgatccaggcgtacgagcagccgctggactacatcctcatcgactgcccgccgtcgctcggactgctgaccgtcaacgcgctggtcgccggcgcggaggtccttatcccgatccagtgcgagtactacgcattggagggcctgggccagctgctgcgcaacgtcgacctggtacgggggcacctcaatcccgacctgcacgtgtcgaccatcctgctcaccatgtacgacggccggacgcgtctcgcgtcccaggtcgcggacgaggtacgcagccacttcggcgaagaggtgctgcggacgagcattccgcgctcggtccgcatctcggaggcgccgagttacgggcagacggtgctgacctacgatccgggatcgagcggtgccctctcgtatcttgaggcggcacgagagatcgcactgcgcggcgtcggtgtggcctacgacgcgcagcatgcccacctgggcgcagagaacgaacagagcatggtggaggggatccag

SEQ ID NO: 4294 - DNA, 738 bp, Streptomyces avermitilis
  CDS (1)..(738)
atgcggtacggaaggacggtccccgtgacggaggcagcggagcttccccctgcgcccgagcaggcacgcgaggtattcggtgatcggttcgcggacgcggtccggtacgcggagctgctggccgaggcgggagtgcagcgcggcctgatcggccctcgcgaggtgccccggctgtgggagaggcacctgctgaactgcgcggtgctctccgaggtcgtgcccgaaggcgtgacggtgtgcgacgtgggctccggcgccgggctgcccggcattccactggcgctcgtccgggaggacctcaagatcacgctgctcgaacccctgctgcgtcgtacgaacttcctcaccgaggtcgtggagctcctgggcctcgaccacgtgacggtcatccgtggccgcgccgaggaggtcatgggcaagattccccccgtccatgtcgtgaccgcgcgtgccgtggctccgctggatcgcctggccacctggggcatcccgctgctgcgtccgtacggagagatgcttgccctcaagggcgacacggcggaggaggagctgaagagcgccgccacggctctgagcaagctcggcgccgtggagacgtccgtactgcatgtgggtgagggtgtcgtggatccgctgtcaaccgtggtgcgtgtcgaggtcggggagagccccggtggtgtgcgcttcgcagcgaagcgagccaaggcggcacggacaggacggacgcgtcgacggcgc

SEQ ID NO: 4295 - DNA, 510 bp, Streptomyces avermitilis
  CDS (1)..(510)
gtgacggaaggcaccacctccgccgccaccgagggtggcgacaccctgacccgcctggagcaggaaggcgagatcgcggcggactacctcgagggtctgctggacatcgccgacctcgacggcgacatcgacatggacgtcgaggccgaccgtgccgctgtctcgatcatcagtgacaccggcggccgtgacctgcagaagctggtcggccgggacggtgaggtgctggaggcgctccaggagctcacgcgccttgccgtgaaccgggagaccggcgaccgcagccgtctgatgctggacatcgcgggctaccgcgccaagaagcgcgaggagctctcggagctcggcgccaaggccgcggccgaggtcaagagctctggcgagcccgtgaagctgaagccgatgacgcccttcgagcgcaaggtggtccacgacgcggtcaaggccgcggggctgcggagcgagtccgagggcgaggagccgcagcgcttcgtcgtcgtgcttcccgcc

SEQ ID NO: 4296 - DNA, 1284 bp, Streptomyces avermitilis
  CDS (1)..(1284)
gtggacacgattgccagcctcttcagcttcatcacgattcccgtttcctgggtcatcgtccagttccactcggtgtacgggaaggtcttcggtgccgacacgggctgggcctggggcctgtccatcgtgtccctggtgatcctgatccgcatctgcctgatcccgctcttcgtgaagcagatcaaggcgacccgggccatgcagaccctgcagcccgagatgaagaagatccaggagcgctacaagaacgacaagcagcgccagtccgaagagatgatgaagctgtacaaggagtcgggtaccaacccgctctcctcgtgccttcccatcctggcgcagtccccgttcttcttcgccctctaccacgtgctcaacggcatcgcgaccggcaagacgatcggcgtcatcgacgatcagctgctggcgagcgcccgtaaggcgcacatcttcggcgccccgctcgcggcgaagttcaccgacagcgcggacaaggtcactcagctcggcgccaccctgatggacgtccgggtcgtcaccgcgatcatgatcgtcctgatgtcggcgtcgcagttctacacgcagcgccagctgatgacgaagaacgtcgacaccacggtgaagacgccgttcatgcagcagcagaagatgctgatgtacgtcttcccggtcatgttcgccatcttcggcatcaacttcccggtcggtgtcctcgtctactggctgaccaccaacgtgtggaccatgggccagcagatgtacgtcatccgcaacaacccgactccgggctccaaggcccaggccgcgttcctggagcgtctgcagaagcacgtcctgcaccacggcaagacccgcagccgcggccagagggccgtcgtcaaggcgatcgtcgccaaggggcgcgaccgcaacgagttcgagcgcaagttcatcaacgctctgaccaaggcgggcctggcggcccagtccgacggcaccatcgggaagggcgaggctaccgccgtcgccgagaccgaggacggtacgcagacgaccggtggcgctccccggcggcagcagcccaagcggcagagcaagtcccagcgccagtcgggcagcgcgaaggccgccggcgagtccgagccgaagagcacccctttgtcgctgagcaagtccgatgaaccggacgacgccaagcccgccgccaagccggccggcggcgcaaacaagcccagcaccggtacccgcagcaaggcccagtccggacagcgcaagggtccgcagcggcccaagtccccgtccaagaag

SEQ ID NO: 4297 - DNA, 351 bp, Streptomyces avermitilis
  CDS (1)..(351)
atgaagtacccgctgctggcgctgatcaagctgtaccagtggaccatcagcccgttgctcgggccggtgtgcaagtactacccgtcgtgctcccactacgggtaccaggccatcgaccggcacggtgcgatcaagggaacggcactcaccgcctggcgcatcctgcggtgcaatccgtggtcgctgggcggtgtggaccatgttccgccgcgcaagcgtccgcggtggcacgaaatgctgcgtaacgcctggcgcgcacgcaagggcgggccctccgccgccgaaccggccatcgaggggcacattccctcgagcccggccgcagagaccccgtcccatgtccaaggagca

SEQ ID NO: 4298 - DNA, 369 bp, Streptomyces avermitilis
  CDS (1)..(369)
gtgctgcctaccgagaatcggctgaggcggcgcgaggacttcgcgaccgcggtacgccgaggacgccgggccggacgcccgcttctcgtcgtccatctacgtagcggtgcaacggacccgcacgcgcctggggagagcgctcccccgacgcgtgcgggtttcgtcgtcagcaaagcagtgggtggcgcggtcgtacgcaacaaggtgaagcgccggcttcgccacctgatgcgtgaccgagtggccctgttgccccccggtagcctggtagtcgtacgagcgctgcccggtgcgggtgacgccgaccatgcacagctggcccaagacctggatgccgcccttcagcggctgctgggagggggcgcgcga

SEQ ID NO: 4299 - DNA, 135 bp, Streptomyces avermitilis
  CDS (1)..(135)
gtgagcaagcgcaccttccagccgaacaaccgtcgtcgcgcgaagacccacggcttccggctgcgtatgcgcacccgtgccggccgcgcgattctcgcgtcccgccgtggcaagggtcgcgccagcctgtccgcc

SEQ ID NO: 4300 - DNA, 1959 bp, Streptomyces avermitilis
  CDS (1)..(1959)
gtggctgacgtacctgccgatcttgccgcagtgtggccacgcgtactcgagcaactcctcggcgagggccgcggccagggtgtcgaggtcaaggacgagcactggatcaagcgctgccagccgctggccctggtcgccgacaccgctctgctcgccgtaccgaacgagtttgcgaagggcgttctcgaaggccgcctcgcgccgatcgtcagcgagacactgagccgcgagtgcggtcgcccgatccgcatcgcaatcactgtcgacgactccgcgggcgagccgccggcgtcggcgtcccccgccccgccgcgctacgaggagcccgagctcccctccggccccggccagggccgtgacccgtacgagagccgggggcgcgagggatacgaggggtacggtcgtcaccgcgccgacgaccaccggcagggccacaacgaccgccaccagggcggccccggcgaccagctgcctccgtcccgcggggaccagctcccgaccgcgcggcccgcgtacccggactaccagcgccccgagccgggcgcctggccgcggccgtcgcaggacgactacggctggcagcagcagcgcctcggcttccccgagcgcgacccgtacgcgtcgccgtcgcaggactaccgcccgcagtcgatggaccgtccgtcgtacgaccaggaccggccctcgtacgaccatgaccggccgtcatacgaccatgaccggccctcgtacgagcagcagcgagcggactacgaccagcagcggtccgactacgacaagcgtcccgatcgccgcaacatcccggactcgtcccccggcagtggtcatgtgcaccgcggcggcccggtcggttccgcgctgcccgcctccagcggcgcccccggtccgctggccgcgcagcccgcgccggccaccggacccggcgagcccaccgcgcgcctgaaccccaaatacctcttcgacaccttcgtcatcggtgcctcgaaccgcttcgcgcacgccgccgcggtcgccgtcgccgaggcgccggcgaaggcgtacaaccccctcttcatctacggggagtcggggctcggcaagacgcacctgctgcacgcgatcgggcactacgcgcgcagcctctacccgggcacgcgtgtgcggtacgtgagctccgaggagttcaccaacgagttcatcaactccatccgcgacggcaagggcgacagcttccgcaagcggtaccgggagatggacatccttctggtcgacgacatccagttcctggcggacaaggagtcgacgcaggaggagttcttccacaccttcaacacgctccacaacgcgaacaagcagatcgtgctctccagcgaccggccgccgaagcagctggtgaccctggaggaccggctgcggaaccgtttcgagtggggtctgatcaccgacgtccagccgcccgagctggagacccgtatcgcgatccttcgtaagaaggcggtgcaggagcagctcaacgccccgccggaggtgctggagttcatcgcctcgcggatctcccgcaacatccgtgagctggagggcgcgctgatccgggtgacggcgttcgcgtcgctcaaccggcagccggtggaccttgggttgacggagatcgtcctcaaggacctgatcccgggcggcgaggactcggcaccggagatcaccgcgcccgcgatcatggcggccacggccgactacttcgggctgacggtggaggacctgtgcggcacctcgcgcgggcgcgccctggtgaccgcccgccagatcgccatgtacctgtgccgcgagctgacggacctctccctgccgaagatcggcgcccagttcggcggccgcgaccacacgaccgtcatgcacgccgaccgcaagatccgcgcgctgatggccgagcggcgctccatctacaaccaggtcaccgagctgaccaaccgcatcaagaacggc

SEQ ID NO: 4301 - DNA, 1128 bp, Streptomyces avermitilis
  CDS (1)..(1128)
gtgaagatccgggtggaacgcgacgtactcgcggaggcagtggcctgggcggctcgcagcctcccggcacgaccgccggcgcctgtcctcgccggcctcctgctgagggccgaggacggggctctcagcctctccagcttcgactacgaggtctccgcacgcgtgtcggtggaggcggaggtcgaggaggacggcacggtcctcgtgtcgggccgtctgctcgccgacatctgtcgcgccctccccaaccggccggtggagatttccacagacggtgtacgggcgacggtggtctgcggctcctcccgcttcaccctccacaccctgccggtggaggagtacccggcgctcccgcagatgccgaacgccacgggcaccgtccccggtgaggtcttcgcgtccgccgccgcccaggtggccatcgccgccgggcgcgacgacacgctgcccgtcctcaccggtgtgcgcatcgagatcgagggcgacacggtcaccctggcgtccaccgaccgctaccgcttcgcggtccgcgagttcctgtggaagccggagaacccggatgcgtccgcggtcgccctggtgcccgccaagaccctcctggacaccgccaaggcgctcaccagcggcgacagcgtcaccctggcgctgtccggctcggggtcgggcgagggcctgatcggcttcgagggcgcggggcggcgtacgaccacgcgtctgctggagggtgacctcccgaagtaccgcacgctgttcccgacggagttcaactccatcgccgtcatcgagaccgcccccttcgtggaggccgtcaagcgcgtggccctcgtcgccgagcgcaacaccccggtgcggctcagcttcgagcagggcgtgctcatcctggaggcgggctccagcgacgacgcacaggctgtggaaagggtcgacgcgcagctggacggcgacgacatctccatcgccttcaacccgaccttcctgctggacggcctgagcgccatcgactccccggtggcacagctctccttcacgacgtccacgaagcccgctctgctgtccggcaagccggccgtggacgccgaggcggacgaggcctacaagtacctgatcatgccggtgcgcctcagcggc

SEQ ID NO: 4302 - DNA, 873 bp, Streptomyces avermitilis
  CDS (1)..(873)
atggagctcggtctcgtcggcctcggcaagatgggcggcaacatgcgcgagcggatccgccgcgcaggtcacaccgtcatcggatacgaccgcaacccggacgtcgccgatgtccacagcctcgaagagcttgtgggcaagctcaagggcccgcgcgtggtgtgggtgatggtccccgccggtgccgcgacgcagtccaccgtcgacgagctgggcgagctcctggagcccggcgacatcgtcgtggacggcgggaactcgcgctggacggacgatgagaagcacgcggaggagctggccgccaagggcatcgggttcgtcgactgcggcgtctccggcggcgtctggggcctgcagaacggctatgcgctgatgtacggcggcgacgccgagaacatcgccaaggtgcagccgatcttcgacgcgctcaagcccgagggcgacttcggcgccgtacacgcgggcaaggtcggcgcgggccacttctcgaagatggtccacaacggcatcgagtacgccatgatgcaggcctacgccgaaggctgggagctgctcgagaaggtcgactcggtcacggacgtccgcgaggtcttcaggtcctggcaggagggcacggtcatccgttcctggctgctcgacctggcggtcaacgccctcgacggggacgagcacctggagaagctgcgcggctacgccgaggactccggcgagggccgctggacggtggaggccgccatcgacaacgcggtcccgctgccggcgatcacggcgtcgctgttcgcgcggttcgcctcgcggcaggacgattcgccgcagatgaagatgatcgccgcgctgcggaaccagttcggcggccacgcggtcgagaagaag

SEQ ID NO: 4303 - DNA, 1119 bp, Streptomyces avermitilis
  CDS (1)..(1119)
atgcacgtcacgcatctgtcgctggccgacttccgctcgtacgcccgggtcgaggtcccgctcgacccgggcgtcaccgccttcgtgggacccaacgggcagggcaagacgaacctcgtcgaggcggtcggctatctcgccaccctcggcagccaccgggtctcgtccgacgcgcccctggtccgcatgggcgccgaacgcgcgatcatccgggcccaggtccggcaggacgagcgccggcagctcgtcgagctggagctgaacccgggcaaggccaatcgcgctcgcatcaacaggtcctcgcaggtcagaccccgtgacgtgctgggcatcgtacgtactgtcctgttcgccccggaggacctcgcgctgatcaagggcgaccccggggagcggcgccgtttcctcgacgagctgatcaccgcccgctccccgcgcatggccggcgtccgttccgactacgagcgggtcctcaagcagcgcaacaccctcctcaagacggccgcgctggcccgccggcacggcggccgttccatggatctgtccaccctcgacgtgtgggaccagcacctcgcccgcgccggcgccgaactgctcgcccagcgcctggacctgatcgccgcgctccagccgctcgccgacaaggcgtacgaacagctggcacccggcggcggcccgatcgccctggagtacaagccgtccgccccgggtgaggcccacacgcgggacgccctctacgagcagttgatggccgcgctcgccgaggcccgcaagcaggagatcgagaggggcgtcaccctggtgggtccccaacgtgacgaacttctcctcaagctcggccagcttccggcaaagggatacgcgtcacacggcgagtcctggtcgtacgcgctggcgctgcgcctggcgtcgtacgacctcctgcgcgccgaggggaacgagccggtgctcgtcctcgacgacgtcttcgccgagctggacacccgcagaagagagcgcctcgcggaactcgtcgccccgggagagcaggtgctggtgaccgccgcggtcgacgacgacgtgccgggggtcctggcgggaacgcggtacaccgtgtccgaggggaccgtggagcgcgta

SEQ ID NO: 4304 - DNA, 543 bp, Streptomyces avermitilis
  CDS (1)..(543)
atgagcgacacccccgcacagactcccgagccttcgaagaagacgcccgaaccctccggagtggacctcgcgcgcgtggcgctcagagcggccaaggagcaggcacgcgcgcgtggggacgccgcacagcagaagaggcaggcgcggcgcggcggcctgcgctccggcgcgcgcgccgacggccgcgaccccatggcgctcggcgcggcgatcaaccggctgctcacggagcgtggctgggagaccccggccgcggtgggcggggtgatggggcgctggccgcagatcgtcggggaggacctcgccaagcactgtgtgccgcagcggtacgacgaggacgagcgtgttctgaccgtgcagtgcgactccacggcctgggcgacgcagcttcggctgctggccccgcagctggtcgcccgcctcaacgaggacctcgggcacggcaccgtgcggctgctcaaggtgcaggggcccggcggccccgcccgccgttacggccccctgcgcgcccctgggagcacgggccccggcgacacctacggg

SEQ ID NO: 4305 - DNA, 2076 bp, Streptomyces avermitilis
  CDS (1)..(2076)
gtggccgattccggcaaccccaacgagaacatcccgtccaccgacgccggcaacggcgaggccaacacctcgatcggcgaggtcgcagcctcgaacggcgaagtcacagcctcgtacgacgccagcgccatcaccgtcctcgagggtctggacgcggtccgcaagcgacccggtatgtacatcggctcgaccggtgagcgcggacttcaccaccttgtgtacgaggtcgtggacaactccgtcgacgaggcgctggccggccacgcggacacgatcgacatcacgatcctcgccgacggtggcgtgcgcgtcatcgacaacggccgtggcatccccgtgggcatcgtcccctccgaggggaagccggccctcgaggtcgtgctgacggtcctgcacgcgggcggcaagttcggcggcggcggctacgcggtctccggcggtctgcacggcgtcggcgtgtccgtcgtgaacgccctgtcgagcaaggtctccgtcgaggtcaagaccgacggcttccgctggacgcaggaatacaagatgggcgtcccgacagccccgctctcccagaacgaggctacggacgagaccggcacctcggtcaccttctgggccgacgcggacatcttcgagaccaccgaatactccttcgagacgctctcacggcgcttccaggagatggcgttcctcaacaagggtttgacgatcaaactcactgatgagcgcgagtcggcgaaggccaccgccggggcggacgaggcgggtgcggacgagaaggacgaggtcaagaccgtcacgtaccactacgagggcggcatcgtcgacttcgtgaagtacctcaactcccgcaagggagacgcggtgcaccccaccgtcatcgacctcgaggccgaggacagggacaagagcctgtccctcgaggtcgcgatgcagtggaacagcggctacaccgagggcgtgtactccttcgccaacatcatccacacccacgagggcggcacgcacgaggagggcttccgcgcggcgctgacctcgttgatcaacaagtacgcgcgcgacaagaagctgctgcgcgagaaggacgacaacctcacgggcgacgacatccgcgagggtctgaccgcgatcatctcggtcaagctgagcgagccgcagttcgagggccagacaaagaccaagctgggcaacacggaggcgaagaccttcgtccagaaggcggtctacgagcacctcaacgactggctggaccgcaacccgaacgaggccgcggacatcatccgcaagtcgatccaggcggccaccgcgcgcgtggcggcccgcaaggcgcgtgacctcacccgccgcaagggcctccttgagtcggcgtccctgccgggcaagctctccgactgccagtcgaacgaccccaccaagtgcgagatcttcatcgtcgagggtgactccgccggcggttcggccaagtccggccgcaacccgcagtaccaggcgatcctcccgatccgaggaaagatcctcaacgtcgagaaggcgcggatcgacaagatcctgcagaaccaggagatccaggcgctgatctccgccttcggtaccggagtccacgaggacttcgacatcgagaagctccgctatcacaagatcatcctgatggcggacgccgacgtcgacggccagcacatcaacaccctgctgctgaccttcctgttccgcttcatgcggccgctggtcgaggccgggcacgtgttcctctcccgcccgccgctctacaagctcaagtggggccgggacgacttcgagtacgcgtactcggaccgcgagcgcgacgccctgatcgagctcggccgccaggcgggcaagcgcgtcagggaagactcgatccagcgcttcaagggtctcggtgagatgaacgccgaggaactgcgcatcacgacgatggaccaggagcaccgcgtcctcggccaggtcaccctcgatgacgccgcccaggccgacgacctgttctcggtcctgatgggcgaggacgtcgaggctcgccgcgcgttcatccagcgcaacgccaaggacgtccgcttcctcgacatc

SEQ ID NO: 4306 - DNA, 2592 bp, Streptomyces avermitilis
  CDS (1)..(2592)
atgaccgacgagaacactccgagcactcctgaagaagagggcgagatcgccctgcgtgtcgagcccgtcgggctcgagaccgagatgcagcgctcgtacctcgactacgcgatgtccgtcatcgtgtcgcgcgcgctgcccgacgtacgggacggtctcaagcccgtccaccgccgtgtgctgtacgccatgtacgacggcggctaccggcccgagaagggcttctacaagtgcgcccgtgtcgtcggcgacgtcatgggcaactaccacccgcacggcgactcctcgatctacgacgcgctggtccgcctcgcgcagccgtggtcgatgcggatgccgctggtggactccaacggcaacttcggttctccgggcaacgaccccgcggccgccatgcggtacaccgagtgcaagatgatgccgctgtcgatggagatggtccgcgacatcgacgaggagaccgtcgacttcacggacaactacgacggccgctcgcaggagccgaccgttctgcccgcccgcttcccgaacctgctgatcaacggctcggcgggaatcgcggtcggcatggcgaccaacatcccgccgcacaatctgcgcgaggtggcgtccggcgcccagtggtacctggagaaccccgaggcctcccacgaggagctcctggacgcgctgatcgagcgcatcaagggccccgatttcccgagtggtgccctcgtagtgggccgcaagggcatcgaggaggcgtaccgcacgggccgtggctccatcacgatgcgcgcggtcgtcgaggtcgaggagatccagaaccgccagtgcctggtggtcaccgagctcccctaccaggtcaaccccgacaacctcgcgcagaagatcgccgacctcgtgaaggacggcaaggtcggcggcatcgccgacgtccgcgacgagacgtcctcgcgcaccggccagcgcctggtcatcgtcctgaagcgggacgcggtcgccaaggtcgtcctgaacaacctgtacaagcacaccgacctgcagacgaacttcggcgccaacatgctggcgctcgtcgacggcgtgccgcgcaccctctccctggacgcgttcatccgccactgggtgacgcaccagatcgaggtcatcgtccgccgtacgaagttccggctccgcaaggccgaggagcgcgcgcacatcctgcgcggcctcctcaaggccctggacgccatcgacgaggtcatcgcgctgatccggcgcagtgacaccgtcgagatcgcacgcgagggcctgatgggcctcctggagatcgacgagatccaggccaacgccatcctcgagatgcagctgcgccggctggccgccctggagcgtcagaagatcattcaggagcacgacgagctccaggcgaagatcaccgagtacaacgcgatcctcgcttcgcccgtgcgccagcgcggcatcatcagcgaggaactcgccgcgatcgtcgagaagtacggcgacgaccgccgctccaagctggtgcccttcgacggcgacatgtccatcgaggacctcatcgccgaagaggacatcgtcgtcaccatcacgcgcggtggctacatcaagcggaccaagaccgaggactaccgttcgcagaagcgcggcggcaagggcgtacgcggtacgaagctgaagcaggacgacatcgtcgaccacttcttcgtgtcgacgacgcaccactggctgctgttcttcaccaacaagggccgcgtctaccgcgcgaaggcgtacgaactcccggacgccggccgggacgcgcgaggccagcacgtcgccaacctgctggccttccagccggacgaggcgatcgccgagatcctcgcgatccgcgactacgaagcggtgccctacctggtgctcgccaccaagggcgggctggtcaagaagacgcctctgaaggattacgattcgccccgctccggcggtgtcatcgcgatcaacctccgtgagacggaggacggttccgacgacgaactgatcggagccgaactcgtatcggccgaggacgacctgcttctgatcagcaagaaggcacagtcgatcaggttcaccgcgaccgacgaggcgctacggcccatgggccgtgccacctcgggcgtcaagggcatgagtttccgtgagggggacgagctgctctcgatgaatgttgttcgacccggtacgttcgtgttcactgccacagacggtgggtacgcgaagcggaccgccgtcgacgagtaccgcgtccagggtcgcggtggcctcggtatcaaggccgccaagatcgtcgaggaccgcggctcgctcgtcggcgcgctggtggtcgaggagaccgacgagatcctcgccatcacgctgtccggtggtgtgattcgtacgcgagtcaacgaggtcagggagacgggccgtgacaccatgggcgtccaactgatcaacctgggcaagcgcgatgccgtcgtcggcatcgctcgtaatgccgaggccggccgcgaggcggaggaagtcgacggtggcgatgccgtggacgagaccaccgagggcatcgaggccgccggtacggacgagggcgagcagtcctcggacgag

SEQ ID NO: 4307 - DNA, 612 bp, Streptomyces avermitilis
  CDS (1)..(612)
gtgacggacacccgaggcccgcaggcccagcagcccaaggctggagcgggcccggccgcgccgggtgccgcgtcggccggcgcaccggcccaggctccggcctccgccgccactgcggcgggctctccgctgccgggggagcgccagccgcagcccgcggggccgtaccacccgccgcaggcctaccagccggctccggcgggtgccgtacgccgcccccgcaccggcgcgcgcaccgcgccccgtacgcgcaaggcgcggctgcgggtggccaaggccgacccgtggtcggtgatgaaggtcagcttcctgctctccatcgcgctgggcatctgcacgatcgtggcatcagcggtgctgtggatggtcatgaacgcgatgggcgtcttctccaccgtcggcggcacgatctccgaggccaccggctcgaacgaggccaacggcttcgatctgcaggcgtacctgtcgctgccgcacgttctgacgttcacgacgatcatcgcggtcatcgacgtcgtcctcgcgaccgcgctggcgaccctcggcgcgttcatctacaacctctccgcggccaccgtgggcggcatcgagctgacgctggccgaggacgag

SEQ ID NO: 4308 - DNA, 345 bp, Streptomyces avermitilis
  CDS (1)..(345)
atggcccagaacaaggtcatgaagctgtggaccgccatcgtcaccgccttcctggcgctgtgcacgacgctcggactcatcacgacgaccgccgccgcggctgtaccgcagagcgggaccacgcgcaacggcaacgccaccgtgaccgcaccggcgatgttgtcccacgggatgtggtcctacgcccggtccctgccccccacgatgaagcagcgcatccgcgccgaggcgcacggctcctccccgagctgccgccaccgcccgacctcggacgacaccgccacggacaccgccgccctgcgcgcccaggagacccccgccgagccggacgcgcccctgcggcac

SEQ ID NO: 4309 - DNA, 1503 bp, Streptomyces avermitilis
  CDS (1)..(1503)
atggggcggcgcacggggtggtggcgtacggaagcgcgacgcgcggcggggtggcacggggtgctgcgacgcggccgggcgctggcggcggcggccggagcggccctgtgcgtcacggtggcgctgccccagacggcgacggcggccggcacgccgacgccgtacgccttcgccgaggacgcgcgaacggtgaagggcgccaccggcaccacggacgccgtacggctcgagcccggagggacctacaggagcgccgtacgtgatggcggcaagctctactaccgcctcgaactcgacgccaccgccgacgcgtacgtctccgtgaccgcggtccccgggacggcggcgaccgtcacctcgtcggacggcctcaaagtgtccgtgcaggatgccgacagccatacctgctccaccggggccgcccacttcggcgccacgcagagcccgcacccgatcgccgcgtgggcgtcgcgcgaagtcgggcccgacacgtatctgtgcaagcaggcggggacgtactacgtggtcgtcgaacgccgcaccacgcccggatccgcgccgggcgactgggacctggaactcgactacgtgtccgaacccgccctcaagaaagcggcgggctccggtgcgacgagcgcgcccgaggcatggaactccgcctccccgcaagccctcgtgggcgacgcgacgcgccgcgcgggaggcgccggcttcgcctcggcggccgccctcgggcaaggggtctggaaggacgcggtccggcccggacagacactgttctacaaggtgcccgtcgactgggggcaacagctctacgccaccgcggagacgggcagttcgaccggcggcgacggctttgtgggcaccgcgctcaccatgtcgctctacaacccggtacgcggatacgtcgacgacgtgggctccggctacagcggcgaccagacctcggccgcgctcgatccgctgcctcccgtcgcctacgacaaccggcacgccgtgcagaaccgggtgagcgggatgcgcttcgcgggctggtactacctcgcggtgcatctcggcgctcccgtcgcggacaagttcgggaaggggccgttcgggctgacgctgcgcgtgcgggtgagcggtacggcgggttccggtccgtcgtacgcggggcaggccgagccgagcggtgtgttcgaggtgacccggcaggaccgggaggaggcggccgccggggcggggggcagcaccgcaaacgtgccgggcggtacgacgggaagcgcgtccggaggggccacgggcggtggcacgggggccgcggagacgggcgccgacggtgcgcgaaccggtgacgacggcacgatgacgctggtcgccgtgggcgggatcggcacggggagcctgctggtgctggcgctcgtggtgtggacggcggtggcccgccgccgggcggtgtccgacggcgcggcgatgggggcggctcccgtcgtacgaggggagtacggcccgccgcgggcctgg

SEQ ID NO: 4310 - DNA, 1692 bp, Streptomyces avermitilis
  CDS (1)..(1692)
atgggtgaggtcttcgccggacggtacgaactggtcgaccccatcgggcgcgggggagtcggtgcggtctggcgcgcctgggaccaccggcggcgccgttatgtggccgccaaggtgctgcagcagagcgacgcacacgcgctgctgcgcttcgtacgcgagcaggccatgcggatcgaccacccgcatgtgctcgcacccgccagctgggccgccgacgacgacaaggtcctgttcaccatggatctggtcgccgggggctcgctggtccatctgatcggtgactacggtccgctgcccccgtcgttcgtctgcaccctgctcgaccagctcctctcggggctcaccgcggtgcacgcggagggggtcgtgcaccgcgacatcaagccggccaacgtgctgctcgaagccaccggcacgggtcggccccggctgcgcctgtccgacttcggcatcgccatgcgcctcggcgaaccgcggctgacggagaccaactacgtggtggggacgcccggttacctggcgcccgagcaactgatgggcgacgagccggacttcccggccgacctgttcgccgtggggctggtcgccctgtatctgctggagggcgccaagccggacgccagggcactcatcgagtacttcctggcgaacggcactcccgcggcgccccggggcattcccgagccgctgtggcaggtcgtggccgtgctgttgcagccggacccggccgcgcggttccgcaccgcgacgggggcgcgcaaagcgctcgccgcggccgcggagctgctgcccgagcccggccccgacgacgaactcgtcgagatcttcgaccaactcggcccgctcccgcccggattcggcaccgacggaccgctcaagagggctccgggggtgacggcggcgcatgccgtgcctcagcggcccggccgggacgccaccgggagcacgccgtccggcgacgactccagctccggcccccgcccggaacggccgaaccagcgcccgaaccgacggcaccacgacccgggtgccgcgtcgggggcggcatcgggggccgcgccggggacgggcagcaccggtgccgtgcggccggccgaagactgcggtgaggtaaggccgaccacaggctccagccacataccccctgagcccgattccggtcccccgcagcccgggccgcccacgccccttcccccaccgccgaactccgcgcccctcccgccgcaaccggcatcagctcccggttccgctcccggccccgtacagatgccgccgctgcccgacgcgacgccctcgcgctccttcaccatgtcggacaccggcagtttccatctgccgccgccccggccgtccacgcccgtcaggccccagccccttcccgagcggccgcccactccccccgcctcggtcgcgctcccgtcgccggcctacgccccgcacctcgaacccacgcgtgtgccctctccccgcccgtccgcggcccccgccgcctcggtgcagcaccacgcgtacgcctccgccggtgcgcacaccgctccagccgcgcaggttcacacccggccacaggcgatttcccggcgtcgtcgcaggcgccccaagcgcccgggcccgccggcgaaggtcgccgtgccggtcctgctcctcgcgctggcctgcttcgcggtgggcttctgggcactggcacagctc

SEQ ID NO: 4311 - DNA, 546 bp, Streptomyces avermitilis
  CDS (1)..(546)
atggacgccgcacagcaggaagcaaccgcgagagcgcgggagctgcagcggaactggtacggggagccactgggggcgctcttccgtaggctcatcgaggatctcgggctcaaccaggctcgtctcgcgggggtactgggactgtccgcaccgatgctgtcgcagctgatgagcggtcagcgggccaagatcggcaaccccgcggtggtccagcgggtgcaactcctgcaagacctggcggggcaggtcgcggacggcagtgtcagcgccgccgaggcgaccgagcggatggacgagatcaagaagtcgcaggggggctcggtgctcagcaacaccacgcagtcgacaagcagttcaggcgcgcccaccgtcaagcgggtggttcgtgagatccagtcgctgctgcgctcggtggcggcggcaggagacatcatcgacgctgcggacactctcgccccgagccacccggaactggcagagttcctccgggtgtacggcgcgggccgcacctccgacgcggtcgcccattaccagtcccaccagaac

SEQ ID NO: 4312 - DNA, 699 bp, Streptomyces avermitilis
  CDS (1)..(699)
gtgacccgcatcgaaagcgtgcgcgccgcgaccggctcggcgaaggacagcgtgctgcacgccgcggaagtggtggcgccctacgccgacacggccaaggacagggcctcgcactacgcgcaggaagcacgcgtacggcttgcgcccaaggtgtcccaggccgccgaccaggcccgcgtccagtacgacgtccatctggcgccgcgactggagcaggcccgcgctcatgtgccgccgaaggtcgaccaggccgcgcacgacgccgctgtccttacccgtaaagctgcccggcaggccgccgactactcccgcccgaaaatcgagcaggcagtggccgcggccggtccagtacgcgaggaggccgcggcccggagtgtcgccgcactggccgcgctgcgcggccaggtctcacctcaggagatccagaaactggtccgcaagcacgagcggcgggcccgggtcggccgcgtcgccaaggggctggccattctgggcatcctggcaggcggcgctttcgccgcctggaagtggtgggacaagcaggccaaccccgactggctggtcgaaccgcccgccgcgaccgaagtaccggcaagtgaccgcctggcgtcggtcgacggcaccggtcagtccgtcctggaccccgaagtccaggtcaaggaagccgaggaggacgcggctgatcgcgacgagcaccgc

SEQ ID NO: 4313 - DNA, 558 bp, Streptomyces avermitilis
  CDS (1)..(558)
gtggccgagcagctttacgccaccttgaagaccagccaaggcgacatcgcggtgcggctgctgccgaatcacgcgcccaagacggtccggaacttcgtcgagctcgcgaccggtgagcgtgagtggaccaacccggccacgggtgagaagtccaaggacaagctctacgacggcacggtcttccaccgggtgatcagcggtttcatgattcagggcggtgacccgctgggcaacggcaccggcgaccccggttaccagttccaggacgagttccacccggacctgcgcttcgacaagccgtatctgctggccatggccaacgcgggcccggggaccaacggctcccagttcttcatcaccgtcgccccgacggcctggctgaaccgcaagcacaccatcttcggcgaggtgaccgacgtggccagccagaaggtcgtggacgcgatcgcgggaacccgtaccaacccgggcaccaagcgccccgtcagcgacatcgtcatcgagtcggtcgtcatcgagacccgcgagggccgaggggccgtcgagttccgcaagggc

SEQ ID NO: 4314 - DNA, 894 bp, Streptomyces avermitilis
  CDS (1)..(894)
atggacgaccccatgaaccagaaaccacagaacgcccagggcgtgcccacctgctaccggcacccggaccgcgaggccggcgtccgctgcacccgctgcgagcgccccatctgccccgagtgcatggtcgacgcctcggtcggtttccagtgccccgagtgcgtccgtgggggctccggcaccggtcacgctccgacggccacccagccccgtacgatcgcgggcggcaccgtggccgcggacccgaggctgatcaccaagatcctcatcggcctcaacctcgcggtcttcctggtccagctgtccgtgggtgatcgcttcaccgagcgcttcgaactcctcggccgcgcctacgtgccacttctcggttcgttgcaaggtgtcgccgaggggcagtcgtaccggctactgaccgcgatgttcctgcacgacccccacagctatgtccacatcctgttcaacatgctcagtctgtggtggatcggcggccccctggaagcggccctcggccgtatccgctatctcaccctctacttcgtctccggtcttgcgggcagcgggctcacctatctgatcgccgccccgaaccagccctcgctcggcgcctccggcgccatcttcgggctcttcggcgccaccgccgtcctcatgcgcaggctcaactacgacatgcgcccggtcatcgcgctgctggtgatcaacctgatcttcaccttcgggtggagcaacatcgcctggcaggcgcacatcggcgggctcgtcggcggagtggtggtcggctatgcgatggtccacgcaccgcgtgaccggcggaccctcatccagttcggggtcagcggcctggtcctggccgccgtggtcctcatgacggtcctcagaaccatccagctcacc

SEQ ID NO: 4315 - DNA, 252 bp, Streptomyces avermitilis
  CDS (1)..(252)
gtgccgaagtcacgtatccgcaagaaggccgactacacgccgccgccgtcgaagcaggcgacgaatatcaagctgggcagccgcggctgggtcgccccggtcatgctcgccatgttcctcatcggtctggcctggatcgtcgtcttctatgtgaccgacgggtcactgccgatcgacgccctggacaactggaacatcgtggtgggcttcggcttcatcgccgctggattcggcgtctcgacccagtggaag

SEQ ID NO: 4316 - DNA, 810 bp, Streptomyces avermitilis
  CDS (1)..(810)
ttgagcaatactgccgactcccacggaacgggttccggttcccccgaaacgggttccggttcggactccgaggcggcccgcccccgtcgtttcccgcccgtccgcgtcctcacggtggccgtgttcgcgctcgccggcctcattttcttcaccagcttcaacaccgccaaaggcaccaatatccgtacggatgcctcgatgctgaagctctccgacctcattcaggaacgcagccacaagaacggccggctcgacgagtccaatgccgcgctgcgcgacgacgtcgaggccctcgcccagcgcggtggcggcaacaccaaggccgaggaggagaagctcgcggcgctggagaagagcgccggcacccagaagctcaagggcaaggccgtcacggtgacgctcaacgacgccccgccgaacgccacggccaagctgcccggctatcccgagccgcagcccgactacctggtcatccaccagcaggacctccaggccgtggtgaacgccctgtggcagggcggcgccgagggcatcaaggtgatggaccagcggctgatctccaccagcgccgtgcgctgcgtcggcaacaccctgatcctccagggccgcgtctactcgcccccgtacaagatcacggcgatcggcgacccggacaagctccaggagtccctcgccgcttcccaggcgatccagaactacatggtgtacgtgaatgtgtacggcctcggctggaaagtcaccgagaacgggacggtgactcttcccggctactcgggcacagtggatctgcactacgccaaacccgtcgag

SEQ ID NO: 4317 - DNA, 690 bp, Streptomyces avermitilis
  CDS (1)..(690)
gtgcgcgtgatcgtcaggaccgtcagcgaactgtgcatcaccctcggcacgttgatcgttctcttcgtggtctacgtcctcttctggaccggcgtgaaggccgacagcgcgatgggccaccaggtcgatgtgctccaggaacagtggtcgaaggggacggtccgtccgacggccgcgcccggcgcctccgcccgcacgagtcccgagaagcccgccccctacacgtacggcaagcccttcgccgtgatgtacatcccgcgtcttggtttcacgtggaacaagcccgtgctcgaaggaaccggaacggaagtcctgaagaaggggctcggccactacgcgaacaccgcgcggctcggtcagaagggcaacttcgcggtcgccggtcaccggcgcacgtacggcgatcccttcaaagattttcccaagctgcggcacggcgacgaggtggtgctgacggacgggacgacatggttcacgtacgtcatcgacaccgggccctacaagaccgtgccgacggacgttgaggtcatcgaccctgtgccacgtaaatcggggtacgagcgcgagggccgctatctgacgctgacgacgtgtgagccggagtggggacacagtcaccggctgatcgtctgggcgcatctcgactccacacagcctgtggaggccgggaaaccggaggctctacgccgt

SEQ ID NO: 4318 - DNA, 186 bp, Streptomyces avermitilis
  CDS (1)..(186)
gtgcggtacggcgacggaagggacggcatgtacggctggatctggcggcatctcccggggaacctctgggtgcgggcgttgacctcactcgtactcgttctcgctgtggtctacgtcctcttccagtatgtcttcccctgggcggaaccgctgctgcccttcaacgacgtgacggtggacggccag

SEQ ID NO: 4319 - DNA, 636 bp, Streptomyces avermitilis
  CDS (1)..(636)
gtgagtacgcgcattctcgttgtcgacaactacgacagcttcgtcttcaacctcgtccagtacctgtaccagctgggtgcggagtgcgaggtgctgcgcaacgacgaggtgtcgaccgcgcacgcccaggacggcttcgccggcgtcctgctctcgcccggccccggtgcccccgagcaggcaggtgtctgcatcgacatggtccggcactgcgcggcgaccggcgtgcccgtcttcggggtctgcctcggcatgcagtccatgcaggtggcgtacgggggtgtggtggaccgggcgcccgagctgctgcacggcaagacctcactcgtggagcacacgggcaagggcgtcttctcggggcttccctcgcccttcacggcgacgcgctaccactcgctggcggccgagccccggaccgtgccggacgagctggaggtcacggcccgcacgcacgacgggatcatcatggggctccggcaccgtgaactcccggtcgagggcgtgcagttccaccccgagtcggtgctgaccgagcacggtcaccggatgctggccaactggctggtggagtgcggcgacacggatgccgtggcgaggtcggcggggctcgccccggtggtgggcagggccacggcg

SEQ ID NO: 4320 - DNA, 1347 bp, Streptomyces avermitilis
  CDS (1)..(1347)
gtgaccgcgctgcgccccgagcgcgaatccggcgcgtacggagacgccggagaacacggttcctcgtacgggcagcagccgtacgaggccgccggtgcgttcgaggtgcccggcgcgttcgagcagcgcggtgcgttcgcggccgcggtcgagcagctgtccgatccgctgaacgatccgctcccgggggcagggcccgcggggcacccggcctacgagggcgggcagggggcgtacgcggcgccggcggcgccggtgcaggaggccgggtactacccgtcgtacgaggagccggtggccccgccgccctacaccgggcaggtgcccgcccccgtgccgcagccgtaccccgggccggtggccgcccccgtaccgccgccgcacgaccaaccggtcgcgatggcgccgccgttggacgacaggacggtcgcgctgcgggccgcggacgtcgccgaggcgcggcgcatggccgatggtggggcgagcggtgccgggagcgcgcccatatccgctccaggaggccgtgcagcgcgccggaaggccgcccggaggcagggacggcacggcggcgcccaggaggcgcccgaagggccttctggggcctctgatgcgcctggggcggccgacggggctccccgctcgcggatggaggcacggcgggcggcgcgtgcgagcaagcccggtgcgggggtcatcgcgagccggatggtcggcgaggtcttcatcaccaccggtgtgctcatgctgctgttcgtcacctaccagctgtggtggtcgaacgtcagggcgcaccagcaggccggcagtgagacgaaccacctccagcaggactgggcgagcggcaagcggaagccgggggcgttcgagccgggccagggcttcgccatcctggacattccgaagctggacgtggtcgcgccgatcgcggagggcaccagcaagaccaaggtgctcgaccgcgggatggtcgggcactacgccgaaggggccaccaagacggcgatgccggacgccaagacgggcaacttcgggctggcggggcatcgcaacacgcacggtgagccgttccggtacatcaaccgtctgaagccgggcgacgcgatcgtcgtggagacgcaggacacgtatttcgtgtacaagatgacgtcgatcctgccggtgacgccgcccagcaacacgagcgtgctgaatccgatacccccgggatcgggtctcacgaagccgggccgctacatcactctcaccacctgcacccccgaattcaccagcaagtaccggatgatcgtgtggggcaagatggtggaggaacggccgcgcagcaagggcaaaccggacgcgctcgtcgag

SEQ ID NO: 4321 - DNA, 738 bp, Streptomyces avermitilis
  CDS (1)..(738)
gtggcagcgacgaccgaccaggaagagcgtgccgaggcgggggtgccggagccgggacaccggttgcgtggccggatcgcgatggcggtcagcgtcttcggtgaactcctcatcacggcgggcctggtactgggcctgttcgtcgtctactcgctgtggtggacgaacgtcctggcggaccgcaaggcgaaccagcaggccgacaaggtgcgccacgaatgggagacctccgacaccgggccgggggcgctggacaccaaggacggcatcggcttcctgcacgtacccgcgatgaacaacggcgaggtgctggtcaggaagggcacgtcgacgcaggtcctcaacaacggtgtggccggctactacacggaccccgtcaaggcgatgctgccgatgaccggcaagaacggcaacttcacactggccgcgcaccgggacgggcacggcgcgaagttccacaacatcgacaaggtgcggaagggcgatccggtcgtcttcgagacgaaggacgactggtacgtctacaaggtcttcgcgatcctcccggagacctcgaagtacaacgtgaaggtcgtggccgggctccccaagcaggcgggcgtgacgaagccgggccgctacatcacgctcacgacgtgcacgcccgtctacacgtcggagtaccggtacatcgtgtgggggaagctcgtgcgggtggacaaggtgaacgcgaagcggaccccgccgagggaactgggc

SEQ ID NO: 4322 - DNA, 2001 bp, Streptomyces avermitilis
  CDS (1)..(2001)
atggaagagccgcgtcgcctcggcggccggtacgagctgggccatgtgctcggccgtggtggcatggccgaggtgcatctcgcccacgacacccggctcggccgcaccgtggcggtgaagacgctgcgggcggacctcgcacgtgacccgtcgttccaggcccggtttcgccgggaggcccagtcggccgcctcgctcaaccatcccgcgatcgtcgccgtgtacgacacgggtgaggactacatcgagggcatctccatcccgtacatcgtgatggagtacgtcgacgggtccacgctgcgcgagctgctgcactcagggcgcaagctgctgcccgagcgcaccctggagatgaccatcggcatcctccaggccctcgagtactcccaccgcgcaggcatcgtccaccgcgacatcaagccggcgaacgtcatgctgacgcgcaacggccaggtcaaggtgatggacttcggtatcgcccgcgcgatgggcgactccggcatgacgatgacgcagacggccgcggtcatcggcacggcccagtacctctcgccggagcaggcgaagggcgagcaggtcgacgcacgctccgacctgtactcgaccggctgtctgctctacgagctgctgaccgtacgtcccccgttcgtgggcgactccccggtcgcggtcgcgtaccagcacgtacgcgaggagccgcagcctccgagcgtcttcgaccccgagatcacgcccgagatggacgcgatcgtcctgaaggcgctgaccaaggacccggactaccgctaccagtccgccgacgagatgcgcatcgacatcgaggcgtgcctcgacggccagcccgtcgcggccacggcggccatggggtcggtcggctacaacggctacggcgacgaccaggcgacgaccgccctgcgcgcggacgccggcgccacgacgatgctgcctccgatgaatccggacgacggcggcttcggcttcgacgaccgcccggaccggcgccgccagagggaccagaagaagtcgaacacgtcgacgatcctgctggtcgtggccggtgcgctggtcctgatcggcgcgatcctgatcggcaagtggatcttcgacggggaccgcgcggccaacgacaccgttccggccccgaacttcgtcggtctgacgctggccgacgcgaagcaacaggccgtcaacggcgatgtgaagctgtcgatcacgaagaagccgtgcgaggaccaggcgaagggcaacgtctgctcgcagagcccggacgccaagaccaaggtcaagaagaacagcctggtcaatctggtcctgtcgaccggggcacccaagatcgcggttccggacgtcacgggcctcactttcggcaaggcgaagtcccagctcgaagacaagggcttcagggtcgaaaagaagaccgaggtgtcggaccagacacccggcgtggtcactgcccaggacccctcgggcgactctgagcggcagaagggcaccacgatcaccctgaccgtggcggcagaagcgcagaaggtcacggtccccgacgtcaccggcaagagctgtgacgaggccaagcagcagatgcaggccaacaacctcaccggcaactgcaccgaagtcgacaccagcgacgcctcgcaggcgggcaaggtcatccagacctcgcccacggcgggcaccgaggtgaagaagaactccgcggtggacattcaggtcggcaaggccccgcagcaggtcgccgtcccgaacctggggggccagtccctcaaggacgccaagaaggccctccaggacgccggtctgaacgtcggcaacatcacgggctcccaggacgacaacgccatcgtcatcgcctcggatccgcaggcgggcacccaggtcgcccagggcaccgcggtcaatctgacggccgcgggcggcaacaacaacaacggcgggaacaacaacggcggcaccacgttcttcggaggagccaccggaacggcgttccgcacggaggac

SEQ ID NO: 4323 - DNA, 1482 bp, Streptomyces avermitilis
  CDS (1)..(1482)
gtgaacaagcccctgcgccggatcgcgatcttctgcgggctcctggtcctcgccctgctcatccgtgacaactggatccagtacgtccaggcggacaccctgaagtccgacacgaagaaccgccgcgtcgccatcgagcgatacgccacaccgcgcggcgacatcatcgtcgacggcaagtcgatcaccgggtccgcgaagggcaccggcagcggctacaacgacttcgaatacaagcgcacctacaaggacggcgcgatgtgggcgcccatcaccgggtacgcctcccaggccttcggcgccacccagttggagagcatcgaggacggcatcctcaccggcaacgacgaccggctgttcttccgcaacaccctcgacatgctgaccggcaagaagaagcagggcggcaatgtcgtcaccaccctcaacgccgccgcgcagaaggccgcgtaccagggcctgaaggcgcgcggcaagggcgccgccgtggcgatcgacccggagaccggcgcgatcctggcgctggcctcgaccccctcgtacgacccctcgaccttcgcgggcaactccacgaagaccgacggcgaggcctggacgaagctccagaagaagaacaaccccaacgagccgatgctgaaccgggcgctgcgcgacacctacccgccgggctccaccttcaaggtggtcaccgcggccgccgcgctcgagaacgggctgtacaacggcgcggaccagaagaccgactcgccgctgccgtacacgctgccgaacacccgcaccgagctgaagaacgaggggaacatcccctgcaagaacgcgacgatgcgggtcgcccttcagtactcctgcaacaccgtcttcggcaagatcggcgccgacctcggcaaggagaagatgctcgcgcaggccaagaagttcggcttcaacgaggagcagttcacgccggtgcgcgccagcgcctccaacttccccgagaagatggacaagccgcagaccgcgctcagctcgatcggccagttcgagaccgccacgaccccgctgcagatggccatggtcgcctcggccgtcgccaatgacggcacgctgatgaagccgtacatggtcgacaagctgcaggcgccgagcctggacgtgctctcgcagaccgacccgcaggagatgagcaagccgctctccgagaagaacgcgcagatcctgcagtccatgatggagacggtcgtcaagcagggcacgggtacgaacgcccagatctccggcgtcaccgtcggcggcaagacgggtaccgcccagcacggtctcaacaacagcgagaacccgtacgcctggttcatctcctacgcgaagctcagcgacggcagctcgccggtcgccgtcgccgtggtcgtggaggacgagaacgccaatcgcgacgacatttccggtggcggtctcgccgcgcccatcgccaggagcgtgatgaaggcagtcatcgacagcaagaag

SEQ ID NO: 4324 - DNA, 1446 bp, Streptomyces avermitilis
  CDS (1)..(1446)
atgagcagtagtacgaacacgccgacgcaccacacgtcgaccatcggctcgatcggcgcaccgagccgccgcaacaccgagttggcgctgctggtgttcgccgtcgtcatcccggtcttcgcgtacgccaacgtcggcctggccatcgacgacaaaatgcccgccgggctgctgagctacggcctcggcctcggcctgctcgcaggcgtcggccacctcggcgtacgcaagttcgcaccgtacgccgacccgctgctgctgccactggcgacgctgctcaacggcctcggcctggtgatgatctggcgtctcgaccagtccaagctgctccagtcgctgcccaacttcgcccaggcagcgccccgccagctgatgtacaccgcgctgggcatcggtctgttcgtcgccgtgctgatcttcctcaaggaccaccgcgtcctgcagcgctacacctacatctccatgttcggcgccctgctcctgctcctgctgccgctggttccgggcctcggcgccaacatctacggcgccaagatctggatctcgattcccggcctgggcaccctccagcccggcgagttcgcgaagatcatcctcgcggtcttcttcgccggctacctcatggtcaagcgcgacgcgctggccctcgccagccgccgcttcatgggcctctacctgccgcgcggccgcgacctcggcccgatcctggtggtctggttcgtctccatcctgatcctggtcttcgagaccgacctcggtacctcgctgctgttcttcggcatgttcgtgatcatgctgtacgtcgccacggagcggaccagctggatcgtcttcggtctgctcatgtcggcggtcggcgccgtcggcgtggcgagcttcgaaccgcacatccagacgcgtgtccaggcctggctcaacccgttgcacgagtacaagctcagccaggccggaacccacgacggcatcctccactccgagcaggccatgcaggccctgtgggccttcggctccggcggcacgctcggcaccggatggggacagggtcactcggaactcatccggttcgccgccaactccgacttcatcctcgccagcttcggcgaggaactgggcctggcggggatcatggcgatcctgatcatctacggcctgatcgtggagcgcggcatccgaacggcgctcgcggcccgcgacccgttcggcaagctcctcgccgtcggcctctccggcggcttcgcgctccaggtcttcgtcgtcgcaggcggcgtcatggggttgatcccgctgaccggtatgacgatgccgttcgtggcctacggaggttcctccgtcatcgccaactgggcgctcatgggcatcctgatcagaatcagcgacaccgcccgccgcccggcacccacacccgcgcccagccccgacgccgagatgacccaggtggtccgcccg

SEQ ID NO: 4325 - DNA, 1542 bp, Streptomyces avermitilis
  CDS (1)..(1542)
atgagtctgtcactgcgcttcgccgccggatcgcacaaaggcatgatccgcgagggcaacgaggactccggttacgccggaccgcgcctgctcgcgatcgccgacggaatgggcggccaggccgccggtgaggtcgccagctccgaggtgatctcgaccatcgtcgcgctcgacgacgacgtgcccggttccgacatcctcacctcgctcggcacggccgtgcagcgcgccaacgaccagctgcggatgatggtcgaggaggacccccagctcgagggcatggggaccaccctcaccgccctgctgtggaccgggcagcgcctcggcctcgtccatgtcggcgactcacgcgcgtacctgctgcgggacggcgtgctgacgcagatcacgcaggaccacacctgggtgcagcgcctcgtcgacgagggacgcatcaccgaggaagaggccaccacccacccgcagcgctccctgctgatgcgcgcgctgggcagcggcgaccacgtcgagcccgacctctccatccgtgaggtccgcgccggcgaccgctacttgatctgctccgacggcctctccggagtcgtgtcccatcagacgatggaggacaccctcgccagctatcagggcccgcaggagaccgtgcaggagctgatccagctcgcgctgcgcggcggtggccccgacaacatcaccgtcatcgtcgccgacgtcctcgacatcgatgcaggtgacaccctcgccgtgcagctctccgacaccccggtcgtggtgggcgcggtcgccgagaaccagaaccagctgcacgacaacggcgccatgcagacgcccgcgggccgcgcctcgcacctggggcgccagctgcccgggcagggaggcggtggcggcgagttcggcccgcccggctccggcgacaccaccggctacgtccccgcgggcagcttcggcagctactcggacgaggacttcgtcaagccgcgcaccggcctcaagtggctgaagagatccttctacatcgtgctggccctcgccgtcatcggcggcggaacgtacggtggctaccgctggacgcagacgcagtactacgtcggcgccagcggcgagcacgtcgccctgtaccggggcatcagccaggacctggcctgggtctcactctcgaaggtgcagaaggaccaccccgagatcgaactcaagtacctgccgccgtaccagcagaagcaggtcaaggcgaccatcgcggagggcggtctcaaggacgccgagtcgaaggtcagcgaactcgccgtacaggcgtccgcctgtaagaaggacgccctgcgccgtgcttccgagagccagaacaacgccaagaccggcgagggcgaggcaggtgggaccacgggaaccacaaagacctctctgacgtccaaggccacgtcgtcgccgaccccgaacccgtcgacgtcggcaccgtcgtcctccaagtccaagaccgcacccactcccacacccggccccagcctctccgacgaagagcagaagctggtctcgctgtgcggtaagcag

SEQ ID NO: 4326 - DNA, 525 bp, Streptomyces avermitilis
  CDS (1)..(525)
atgtcagagctgaccctcacggtcatgcggctgggtttcctagccgtactgtggctgttcgtgatcgtggccgtgcaggtcatccgcagcgacctgttcggaacgcgcgtcacacagcgcggctcgcgccgggacgccaacaggcagcagccggccgcggcccgccaggccgcgcctccacagcagcgccagcaggcggcgccgccgagcggcggcggccgccagcgccgtggcgctcccaccaagctggtcgtctccgagggcaccctcacgggcacgacggtcgcgctccaggggcagaccatcaccctgggccgtgcgcacgactccacgatcgtgctggacgacgactacgcctccagcaggcatgccaggatctacccggaccgcgacggccagtggatcgtcgaggacctcggatccaccaacggcacgtatctcgaccggacccggctgacgactcccacaccgatttcgccgggtgcgccgatccgcatcggcaagaccgtcatcgagctgcggaag

SEQ ID NO: 4327 - DNA, 855 bp, Streptomyces avermitilis
  CDS (1)..(855)
atgggagtcctgaagaagttcgagcagcgcctcgaaggtctggtcaacggcaccttcgccaaggtgttcaagtccgaggtccagccggtcgagatcgcaggcgcactccagcgggagtgcgacaacaacgcgactatctggaaccgcgaccggaccgtcgtacccaatgacttcatcgtggagctgagcacgcccgacttcgagcgtctcagcccctactccggccagctcggggacgagctggccggcatggtgcgcgactacgccaagcagcagcgctacaccttcatgggccccatcaaggtccacctggagaaggcggacgatctcgacaccggtctgtaccgggtgcgcagccgtacgctcgcctccaccagcaaccagcaggcccccgagcgcgcccccgcgggtccgcccgcgggccgcggcggagccatggcgggaggctacggctatccgccggccgcccccgcgggcgctccgcccatgccctccgccccgccgcccggcgggcgccccggccccgcgcccacggcccaccggccgggcgcaccggcggccccgcagtccggcggccgtatccggcactggatcgaggtcaacggcacccgccatcagatctccggcccgacgctggtgctgggccgcagcaccgaagccgacgtgcggatcgacgaccccggcgtctcgcgccggcactgtgagatccggaccggaacgccctcgacgatccaggatctcggatccaccaacggcatcgtggtggacgggcagcacaccacccgcgctacgctccgcgacggctcgcggatcgtcgtgggcagcaccaccatcatttaccggcaagccgaaggg

SEQ ID NO: 4328 - DNA, 651 bp, Streptomyces avermitilis
  CDS (1)..(651)
atggccacccttctccacatcgactcgtccgtgttcccgagcgcggcgtccgcgtcgcgcgccgtcgcggagaccttccgcacggcatggcaggagcagcacccggacggcacggtgatctaccgcgacctctccgcgaacccggtgccacacatcaccgccgacgcccacaccgccggtttcgccgacccggccacccacacccccgggcaggccgccgcgttcgccgagcgcgagaagctcatcgcggagctggagcaggccgacgcggtcctgatcggcgcaccgatgtacaactacgcgatcccgtcgacgctcaaggcgtggctggacaacgtgatcctcatgggccgcaccgccgcgaacgagaactcgaaggtgacgggcaccccggtaacggtcatcgccagccgcggcggctcgtacgcgccgggcaccccgcgtgagccctacgagtacgtgcagaactacctgaaggccgtcctgagcgacgcgctcggcctcgaactggagttcatcgttcctgagctcacgatggcggcgcacaacccggcgatgtccgagctggtcccgctcgccgaggcctcccgcgccaaggcccacgaggacgccgccgcgaaggccaaggaactcgcggaccgcttcgccgcc

SEQ ID NO: 4329 - DNA, 405 bp, Streptomyces avermitilis
  CDS (1)..(405)
gtggggcgccagtacgctgggggcatggcggtccaggagagtcacgagcagcaggcgcaccagcagccgtgcgcgcgtgtcgatgacggcatcacgcgcgtcttccagctgctcggcaagcgctggacaggtctgatcgtggccgtgctgctggaacggcccgtccacttcgccgagctgcgtcgggcgatccccggcatcagcgagcgcatgctctcggaccggctcacggaactcgccacggccgggctcgtggtgcgcgaggtcgacgagggaccgccgctgcgggtggcctaccggctgacgaccgccggcgccgcgctcgaagcctcactcggggagctgcggacctgggccggggtgtatctcgcggaggacgggcggtgtccggaggagttccgcacg

SEQ ID NO: 4330 - DNA, 1464 bp, Streptomyces avermitilis
  CDS (1)..(1464)
gtgaccgaggtcggttcagaggcggttggttcggagacggtcggttcggaggctggggcggcggccgtcgcggcccgggcggccaggattcccccggtgcgggggttcgcgtcccggaccgcgcagagcggctcgcccaaggaagagggcaaggcgctgcgccgccgggtgccgcgcgccgcgcacgccgagctggcgctggacgtcgaccggccggacgcggtgaccgcggtcgaggagtccaaccgcggcagactccccgagctcaccccgatccgcgtgggcaggatggcggccacgcccttcgccttcctgcgcggcgcggccggcctcatggcgtacgacctcgcacgcacccccatgacaggcatcgccgcccagatctgcggcgacgcgcacgcggcgaacttcggtctgtacggggacgcgcgcggcgagctggtcatcgatctcaacgatttcgacgagacggcgcacggcccctgggagtgggacctcaagcgcctcgccacctcgctggtgctcgccgggcgcgcggcgggggcggacgaggacagctgccggaaggcggcgcacgacacggcgggcgcgtaccgccgcaccatgcgcctgctcgccaagctgccggtcctggaggcgtggaacgccatcgcggacgaggagctcgtctcgcacgcggacgcgcacgatctgctcggcacgctggagcgggtctcggagaaggcgcgggcgaacaccagcggacggttcgcggcgaagtcgaccgagccggtcgagggcggcggccgccgcttcgtggacgcgtcaccggtgctgcgtcgcgttccggacgccgaggcggcggcggtggcgaccgcgctggaggagtacctgacgacggtgtcggaggaccgcctgccgctcctcgcgcgctacgcggtgcacgacgtcgcgttccgcgtggtgggcacgggcagcgtggggacccgctcgtacgtggtgctgttgctggaccaccgcggcgaacccctcgtcctccaggtcaaggaggcccgcccctccgccctggtcccccacctgtcgacggcgggccacgccgtggccgatgtcgcccacgagggccgacgcgtggtcctcggccagaagcgcatgcaggtggtcagcgacatcctgctgggctggacgacggtcgacggccgccacttccaggtacggcagttccgcaaccgaaaggggagcgtcgaccccggcgccctcgccgccgaccagatcgacgactacggccgcatgaccggcgccctcctggcccgcgcccacgcccacagcgccgacccccgcctcatcgccggctactgcggcaagaacgaggaactggacgaggcgatggcggcattcgccgtggcgtacgcggactgcacggagaaggaccacgcgaagctggtggaggccgtgcggggtggccggatcgcggcggagatgggggtc

SEQ ID NO: 4331 - DNA, 837 bp, Streptomyces avermitilis
  CDS (1)..(837)
gtggccggtgacggggcgggcgaaggtgccccgggcggggcggcccagggtgagccgaggcccgaggagcggctcgagcgggccgtgcgggtggccgagcaggcactgatcgagttcgagatcgcggtggagaccttccgcgtcgaggtcgagaacttctcgcggctgcaccaccagaagctcggcccgatgtacgcgcgcctcgacgaactggacgcgcagatcgccgaggcgcgggctgcccgcaccggcgatcccgaagacatacgcaaggccgacgaggcccgtgcccgggtgatgccgatgccgggcgtcgaggagctgttccacggctggatggactccgacgggctgttccccgaggcggcggcgatgctcaccgagcagcccgtacggccgccgcagcgcgtccgccccagcgaggaggcccgcaagctctaccgcgaactcgtccgcaaggcccaccccgacctcgcacaggacgacgccgagcgcgagcggcgcgacgagttcatctcccgggtcaacgccgcgtacggccggggcgacgaggcactgctgcgtgaactgtccgacgagtgggccgcgggccccgtccccgcggagtggaagccgagtcgcagcgaggagctctacgcccgcctcgaatggctcgcccagcgcaaggaaatgctcaccttcgtcgcccgggagctcgaggagagcgcgatcggcgcgatgctcaagatcgcccctgacgaccccgaccgcctcctcgaggaaatcgccgagcagctcctggcacaggtcgccgcacgggagaccgagctggcggagctggctgagctggaggagggc

SEQ ID NO: 4332 - DNA, 327 bp, Streptomyces avermitilis
  CDS (1)..(327)
gtgcccacggtcggggtcgcggacctcgcggacggagactttctgctggacgtccgggaggacgacgagtgggaggccggtcatgccgagggggcgctgcacatccccatcagcgatttcgtggcgcgctacggcgagctgaccgaggccgcgccgcaggacggccgggtccacgtgatctgccgctccggcggacgttcggcccaggtcacgatgtacctggcccagcagggcatcgacgcggtgaacgtcgacggcggcatgcaggtctgggcagcagcgggccgcccggtcgtggacgacaagggacagccgggcttcgtgctc

SEQ ID NO: 4333 - DNA, 1137 bp, Streptomyces avermitilis
  CDS (1)..(1137)
gtggacttcaccttcagcgaggagcagcaggcggcggtcgaggcggcgaaggccgtgttcgccggggtcgcgccggacggagtgccgagtccgtcactgaccgcgggctccgtcgccgacgacttcgaccgggcgctgtgggcgcggctggcagacgcggatctgctgagcctgccgctcgacgcggagtacggcggcgtcggcctcgacgccattgccctctgcctcgtgctgcgggagtcggcgaaggtgctggcccgggttccgttgttggagagcaccgctgcggcgatggccgtacagagctacgggagcccggagttgaaggggcagctgctggcgcaggcgggccggggagagctggtgctgacggtcgccgcgaacggccgcaccgggcacgacccggccgaactcgccgtgaccgcacggcaggacggtgccgcgtcgtgggtcctggacggggtacagaccgcggtgccctgggcgcacaacgccgacttcgtcgtcgtaccggcgcacacccacgacacgggccgtgccgtactcgcgctcgtaccccgcgtgcacgagggggtcgtcctggccgagcagatctccaccaccggggagcggctgggtgagctgcggctggagtcggtaagggtctccgagcggtacgttctcggcgccgacggggcgtgggagtggttgcgcgagctgctcgccaccggcacatgtgcgctggcgctcgggctcggggagggggtgctcgggatgaccagcgcgtatacgagcaagcgggagcagttcgggttcccggtcgccacgttccaggccgtcgccgtgcaggccgccgaccggtacatcgacctgcgcgcgatggaggccacactgtggcaggcggcatggcggatcagcacgggagccgggggtgcgctgccggcggccggggatgtggccgtggccaagatctgggcgtcggaaggggtacggcgggtcgtacagaccgcgcagcatctgcacgggggcttcggcgccgacacggactatccgctgcaccggtatcacgcctgggccaaacatctcgaactgtcgctcggccctgcgcccgcgcacgaggaggcgctcggtgatctgctggcggcgcatccactgggg

SEQ ID NO: 4334 - DNA, 1062 bp, Streptomyces avermitilis
  CDS (1)..(1062)
atggcccgcttccacccgctcccggtggccgcggtcgaccggctcaccgacgactccgtggccctgaccttcgccgtgccgccggcgctgcgcgaggaataccggcacgcggccggccagcacctggcgctgcgccgcacggccgatggcacggagatacggcgcacctactcgatctgctccccggcaccggcggccgccgacgagggaccccggacgctgcgggtcggggtgcgcctggtcgagggcgggtccttctcgacgtacgcgctcaaggagatcgccgcgggcgacgaggtcgaggtgatgacgccggccggacgcttcacgctggagcccgcgcccgggctgtacgccgcggtggtgggcggcagcgggatcacaccggtgctgtcgatcgtgacgacactgctcgcccgggagccgggcgcgcggttctgtctcatacgcagcgaccggacgtccgcctccacgatgttcctcgaggaggtcgccgacctcaaggaccgtttccccgagcggttccagctggtgacggtgctctcccgggaggagcagcaggcggggctgccgtcggggcggctcgaccaggagcggctcaccgagctgcttccggcgctgttgcccgtaaaccgggtggcgggatggttcctgtgcgggccgttcggactggtgcagggggcggagcgggcgctgcgcggactgggtgtggcgcgctcccgtgtccacgaggagatattccacgtggacggcggggcggcgacggtgcccgcggggccggcccccacgcacagcacggtgaccgcgcggctcgacggacgaggcgggacgtggcccgtccaggacggcgagtcgctcctggaggcggtgctgcgcaaccggccggacgcgccctacgcctgcaagggcggagtgtgcgggacctgccgggccttcctggtctcgggcgagatccggatggaccgcaacttcgcgctggagccggaggagacggaggcggggtacgtactggcctgccagtcgcatccggccacggagaaggtggagttggacttcgaccgg

SEQ ID NO: 4335 - DNA, 510 bp, Streptomyces avermitilis
  CDS (1)..(510)
gtgcccgaccccgagctgcccgtgatcaccctggaggagctgggcgtactgcgggcggtccacgtacgcggcacggactcggtcgaggtcgagctgaccccgacgtacaccggctgcccggccatagaggcgatgtccacggacatcgagcgcgtgctgcgcgagcacggcatgcggaaggtgtccgtgcacacggtgctcagcccggcctggtcgacggacgacatctccgccgaaggccgtcgcaagctgcgggagttcgggatagcgccgccgcgcgtacggcaggcgtccgggccgaaggagccggtggcggtggagctgggcccgacgcgtacgtcccgtccggtcgccggcccccccgagctcgcgccggtgcccgaccccgtgtgctgcccgcactgcggatcggccgacaccgagctgctcagccgcttctcgtccaccgcgtgcaaggcgctgcgccgctgtctggcctgccgcgaaccgttcgaccacttcaaggagttg

SEQ ID NO: 4336 - DNA, 717 bp, Streptomyces avermitilis
  CDS (1)..(717)
gtgaccgtcaccgtgcacaccgcggccgccctggccctcggcgacgacgccctggtgctctcccaccgactgggggagtgggcggggcacgcacccgtgctcgaagaggaggtcgccctcgccaacatcgcgctggacctgctgggccaggcccgcgtgctgctgtcgatggccggcgacgaggacgagctggcctacctccgtgaggagcgcgccttccgcaacctccagctggtggagcagccgaacggcgacttcgcgcacacgatcgcccgccagctgtacttctccacgtaccagcggctgctgtacggacaactggcggccggaagcggcgagttcgccggtctcgcggccaaggcggtcaaggaggtcgcctaccaccaggaccacgccgagcagtggacgctgcggctcggcgacggcaccgaggtcagtcatgagcggatgcggcaggcgtgcggggcgctgtggcggttcacgggtgagatgctccagcccgtcgagggggtggacgtcgactgggacgggatgaagtccgcctggctggagtccgtcggcgacgtgctgcgccgcgccaccctggagctccccgaggggccgcagtacggggcgtggacggcgggcgcgggacgccaaggactgcacaccgaacccttcgggcggatgctcgccgagatgcagcatctgcaccgcagccacccgggggcgtcatgg

SEQ ID NO: 4337 - DNA, 285 bp, Streptomyces avermitilis
  CDS (1)..(285)
atgacgaccaacgaatggcccctgtgggaggtcttcgtgcgctcgcgccggggcctgtcacacacccacgccggcagcctgcacgcaccggacgccgagctggccctgcgcaacgcgcgcgatctgtacacccggcgcggcgagggcgtgtcgatctgggttgtgccgtccaccgcggtcaccgcgtcctcgccggacgagaaggacccgttcttcgagccctccgcggacaagccgtaccggcacccgacgttctacgagatcccggaaggggtgaagcacctg

SEQ ID NO: 4338 - DNA, 1017 bp, Streptomyces avermitilis
  CDS (1)..(1017)
atggcgacagcagcagcgcaccagacggcccgcgcacaggcggacgggacggcaggcgcgggcgcgcctttggaggagtccgcgcgcgcgacggcgtacgaggccgccttcgacgccgccgtggcggccgacgagcgcatcgagccacgcgactggatgcccgacgcctaccgctccacgctggtccggcagatcgcgcagcacgcgcactccgagatcatcggcatgcagccggaggcgaactggatcacgcgcgcgccctccctgcgccgcaaagcgatcctgatggcgaaggtccaggacgaggcgggtcacgggctgtatctgtacagcgcggcggagaccctcggcaccggccgggacgagctgctcgacaagctgcactcgggccgccagaagtactcctcgatcttcaactacccgacgctcacctgggcggacgtcggcgcgatcggctggctggtggacggcgccgcgatcaccaaccaggtccccctgtgccgctgctcgtacgggccgtacgcacgcgcgatggtccgcgtctgcaaggaggagtccttccaccagcgccaggggtacgagctgctgctggccctcagccgggggacggccgagcagcacgcgatggcgcaggacgcggtggaccgctggtggtggccgtccctgatgatgttcggcccgcccgacgacgagtccgcgcactccgcgcagtcgatggcctggaagatcaagcgccattcgaacgacgagctgcgccagcgcttcgtggacatctgcgtgccccaggcccagtcgctcggcctgacgctccccgacccggagccgaggtggaacgaggagcgggagcaccacgacttcggcccgatcgactggacggagttccgcgaggtcctcaagggcaacggcccgtgcaacgagcagcggataacccagcgcaagcgggcgcacgacgagggcgcctgggtacgggacgcggcggccgcatacgccggcaagcacaccacggcagggaaggcg

SEQ ID NO: 4339 - DNA, 1029 bp, Streptomyces avermitilis
  CDS (1)..(1029)
gtgctccgtgtgggtgatgtgccgccgcgcggccgacggcggaaacgggaagcgggccggggtccgaggccatcggcatcggacgtcaccgggatcgggaagttggggagacggggcggaatggacgtgtacgacgagggctcggaccctcggcaggagtcgggaggccccgacggaccggtgcccgaccggcccgacggctccgcacagaacgcacccgacgacccgtccccgagcggaccgagcggaccgggcggccgggaacccgcatccgcagaccgcggagcgccagtcatgccggccacgtcggtcgcgccagtcacgccggccggcgagcccggcccccaccaggtcaccgcccttccggacgcgtacgccgtgccccgcaccggcatcgccgcgctctctctccgctaccagatcgccgccgccctcgccctcgcggtcgtcgcggtcgcgggctgtgtgcacgtcgccatggtgttcctgcacgtcgcgccctcgaacaccgtcaccaagcagcacgggcgggcgatcgacgactggatatatcccgagttcgagcagaactggaagctcttcgcccccaacccgctgcaacagaacatcgccgtccaggtccgcgcggaggtgcgcaccgaggacggaagccaccgcaccaccggctggtacgacctgtccgcgctcgacggcgcggccatcgacggcaatctgctgccgagtcacacccagcagaacgaactgcgccgcgcctgggacttctacctggccacgcacgacaacgagaaccgccccgcgggcatgcgcggcgacctctcccagcgctatctgcgcagcatcgtggggctgcgcctcgaacgcgagcacgcggcaggccggggcgaagccgtcgagcgtgtccaggtccggtccagcaccacgaacgtgcagcctccccggtggagcaacgagaaggtctccgacaagcccatgtaccgcgtgctcccctggtggccggtcccgacggattccgggacgggggcgaacgcc

SEQ ID NO: 4340 - DNA, 1227 bp, Streptomyces avermitilis
  CDS (1)..(1227)
atgaaccgcttcgccctgttgatctcgcgcggcatcacccgcgtcaccgaagccgccctcggcccctatcagagcgcggtcatccggatcggcttcgccgccacctggctgttgttcctgctgcgcgagttcccgcaccgccaggagatgtacgggcccgacgccccgtgggcctggggcctcgcccagcagctcatcgcgaacaaccacgccttcacggccctgatgtggtccgacagccaggtgtggttcgagatcgtctacgcgctggccgtcgtgtcgagcgccctgctgctgctgggctggcgcacccgcgcgatgtccgtgctcttcatgatcggcgtgctgtcgctgcagaaccgcagcatcttcatgggggacggcggcgacaacgtcatccacctgatgtcgatctacctggtgttcacgcgctgcggccaggtgtggtccctggacgcgcggcgggcccggcgtacggatgacgcacgcgcgcgtggcgagcttcccagggcgaccggcgcggaccgggtcggtcccgtgctgtgggccgtgctcggcctcgccctggccgtggcgacgggcgcgggccggctcagcggcggctggctggcggtcttctgggggctgtgggcggttcagggcctgtggtggctcgtgggccgccgcgcgcgcagcgccgagccgcggatcctgctggacatcgtcgccaacaccgtccacaacgcggccatgttcgtgatcatggccgaggcgtgtctgatctactcgacggccggctggtacaagatccagggctcgcgctggcaggacggcaccgccgtctactacccgctccacctggactacttctcgccctggcccgcgctgtccgacctgctggcctcgcacggcatcatggtgatgctcgtgacgtacgggacggtcatggcgcaggtcgccttccccttcaccctcttcaaccggcgcgtgaagaacgttctgctcggggtcatgatggtcgagcacgccgccatcgccgtgatcctcggactgccgttcttctcgctggcgatgatcgccgccgacgcggtgttcctgcccacgcccttcctgcgtcgtctgggcggctgggcggcacgggcgcgtagggagctgtcgtcgcgccgcggcggtacgctgccgggcccgcgcaagcaggagccgcgcaccgaggagacgaccgagcacacgcacgtaggcttcacggca

SEQ ID NO: 4341 - DNA, 747 bp, Streptomyces avermitilis
  CDS (1)..(747)
atgaacgatccggtacgcgcctggcatcggctcgccgacggctccgtgctgctcgacggcttccacgcactcaagcacgcggtgcgcttccaggcgcgtgtcccggtggccgtcaccaccgaccggcgggccgcgctcgccctcgccgacgaactcgcccccgacgtacgcgagacgctcgacgccctcctggccgaggtgccggaggagaccctgaaggccctcgtgccgcgcccgcaccccacggcggtggccgccctggccgtacgcccgtcccgtgcggccaatctggaggctctcgcgcgcaccccccgcagcgcgccggtcgtcgtcctcgacaacccgcgcaatcttggcaacgccggggcggtgatccggctcgcggccggtttcggcgcgaccggcgtggtcacgacgggcacgctcgacccctggcatcccacggtcgtacgcggcggcgcgggtctgcatttcgcgaccgccgtggagcggctcacggtggacgaactgccgccgggccccgtgttcgccctcgacccggagggtgacgacatccggggcctgaagctccctgacgacgccgtgctcgccttcggctccgagcggaccggtctgtcggccgaactccgtgcgcgcaccgaccacctggtggccctgccgatgcgtccccaggtctccagctacaacctcgcgaccagtgtggccatgacgctgttccactggagtgccaccgggggcgcaccggcc

SEQ ID NO: 4342 - DNA, 1689 bp, Streptomyces avermitilis
  CDS (1)..(1689)
atggccgccgaactgaccgcgcacgagctgatcgcccagcaccggcccaccctcgaccaggcgctggaagcgatccgcacacgcgcgtactggtccccgcaccccgaacaccccaaggcgtacggcgagagcggcagcctgggcgcggcggagggcaaggccgccttcgacgccctcctgggcacccgcctcgacctcggacagcccggcacggacgactgggtgggcgccgaggtgtcgccgtacgggatcgatttgggtgtcacctacccgcatgcggacatcgacgtgctgctgcccgccatgcgcgcgggacagcgtgcgtggcgggacgcgggcgcggagatccgcgcgatggtctgtctggagatcctgaagcggatcagcgaccgtacgcacgagttcgcgcacgcggtcatgcacaccagcggccaggccttcatgatggcgttccaggcgggcggcccgcatgcgcaggaccgaggtctggaggcggtggcgtacgcgtacgtggagcaggtccgcacccctgacgccgcggagtggaccaagccccagggcaagcgcgacccgctcgcgctgaccaagcagttcacgccggtgccgcgaggcatcgcgctggtcatcggctgcaacacgttcccgacgtggaacggctacccgggcctgttcgcctccctggccaccggcaacgcggtgctggtgaagccccacccgcgcgcggtactgccgctcgcgctgaccgtgcgggtcgcgcgcgaggtgctcgccgaggcgggcttcgacccgaacctggtggcactggccgccgagcggcctgacgagggcatcgccaaggcgctggccgtgcgcccggagatccggatcatcgactacacgggctcgacggcgttcggcgactggctggagaccaacgcccgccaggcacaggtctacacggagaaggccggcgtcaacacggtgatcgtggagtcgaccgacaactacaaggggatgctttccaacctggccttctcgctgtccctctacagcggccagatgtgcaccaccccgcagaacctgctgatcccgcgcgacggcatccgcacggaggagggccccaagtcgtacgacgaggtggtcgcggacctcgccaggtcggtcggcggactcctcggggacgacgccagggccaacgcgctgctcggcgccgtggtgaacccggacgtgaaggcgcgtctggaagcggcggcggggctcggggaggtcgcccttgcctcacgggagatcgtcaacccggaattcccggacgcgaccgtccggacgcccgtgatcgtgaagctggacggcgccaagcccgacgacgaggccgcctacatgagcgagtgcttcggccccgtctccttcgcggtcgcggtcgactcggcggcggacgcggtggagctgctgcggcgcaccatcagggacaagggcgcgatgaccgtcggcgcgtacaccacctcggacgaggtgacggaggccgtccaggagacctgtctggaggagtgcgcccagctgtcgctcaacctgaccggcggggtgtacgtcaaccagacggcggccttctccgacttccacgggtcgggcggcaacccggcggcgaacgcggcgctgtgcgacggggcgttcgtggcgaaccggttccgggtggtggaggtgcgccgggaggcg

SEQ ID NO: 4343 - DNA, 1512 bp, Streptomyces avermitilis
  CDS (1)..(1512)
atgacagcactcgacctcagcagcccggtggccgtcgtcggcaccggcaccatgggccagggcattgcccaggtcgcgctggtcgcgggccaccccgtgcggctgtacgacgccgttcccggccgcgctcaggaagcggccgacgcgatcggtgcccgcctcgaccggctcgtcgagaaggaccgcctagccgcggccgaccgggacgcggcacgggcccgcctgcggcccgccgccgacctcgccgacctcgcggactgcttcctcgtcgtcgaggccgtcctggagcggctcgacgtgaaacagcagctgctgcgcgagctggaggacgtcgtcgaggacgactgcctgctcgccaccaacacctcgtccctgtccgtcacggccatcggcggcgccctgcgcaaccccggccgcttcgtgggcctgcacttcttcaaccccgcgccgctgctgcccctcgtcgaggtcgtctccgggttcgccaccgacgtcacctcggccacgcgcgcgtacgagacggcacgggcctggggcaagaccccggtcgcctgcgccgacacccccggcttcatcgtcaaccgcatcgcgcggcccttctacgccgaggccttcgcggtgtacgaggcccaggccgccgaccccgccaccatcgacgcgatcctgcgcgagtcgggcggcttccggatgggcgccttcgaactgaccgacctcatcggccaggacgtcaacgagtccgtcacgcactccgtgtggcaggccttcttccaggacgtccgcttcacgccctcgctcgcgcaacggcggctcgtcgagtcgggccggcacggccgcaagacggggcagggctggtacgactacggggaggccgccgagcgccccgaaccgcacaccgcggagaaggcgcaggcgcccgcgtacgtcgtcgtcgagggcgacctgggcccggcttccgaactgctcgcgctgatccgcgaggcgggtatccagatccgcgaggacgaggaggaccacggcacgcggctggtactgccgagcggcggccagctggtcctcgccgacggccagacctccgtcgagttccgggacgtcgtctacttcgacctggcgctcgactaccgcagggcgacccgcatcgccctgtccgcctcccaggacaccgccccggcgaccgtcgccgaggcgaccgggctgttccaggcgctcggcaaggacgtcagcgtcatcggggacgtgcccggcatgatcgtcgcccgcaccgtggcccgcatcgtcgacctggcgcacgacgccgtcgccaagggagtggccaccgaggaggacatcgacacggcgatgcgcctgggcgtcaactaccccctggggcccttcgaatggtgccgcaggctgggcagggtctgggcgcacgacctcctggaggagctgagcctgcgcgaaccctccggtcgctatgcgccctctctcgcgctgtaccgccacgggcatgccgccgacaagcgggagggcacctca

SEQ ID NO: 4344 - DNA, 588 bp, Streptomyces avermitilis
  CDS (1)..(588)
atgaccaccgccaagcgcgacacgtacaccccggagacgctgctctccgtcgccgtccaggtcttcatcgagcggggctacgacggcacctccatggagcacctctccaaggcggcgggcatctccaagtcgtcgatataccaccacgtcgcgggcaaggaggagctgttgagccgcgccgtcagccgggcgctcgacggcctcttcgggattctcggcgaggagcacgcgcgcgtggggcgtgccgtggagcgcctggagtacgtcgtacggcgcatggtcgaggtgctcaccgccgaactgccgtacgtgacgctgctgctgcgggtgcgcggcaacacggacaccgagcgctgggccctggagcggcgacgcgacttcgaccaccgggtcgccgagctgctgaaggccgccgccgacgacggggacgtacgcggcgatgtggaggtccggctcgcgaccaggctcgtcttcggcatgatcaactcgatcgtcgagtggtaccggccggacggccggggcatgggcgagcgggaagtggccgacgcggtcgtgcggttggtcttctcagggctccgcagcgaggcc

SEQ ID NO: 4345 - DNA, 405 bp, Streptomyces avermitilis
  CDS (1)..(405)
atgctccaggcggacggccgcgcctcgatacggtccgtggccgagcgcgcccacgtgtcgcgtgccaatgcctacgcgcgaatcaaccggctcatcgacgacggcgtgatccgcggtttcggagcccgcgtcgaccacgaacgcgcgggccagggcacctccgcgtacatcaccctcaagatcgtgcagaactcctggcgcacggtccgcgagcagctgaggctgctccccggcgcctcccacatcgccctcgtggggggcgatttcgatgtcctgctcctcgtgcacacgccggacaacaaggcgctgcgcgagctggtcctgacccggttgcaggccatcccggaggtgctcagcacgcgcacgctgctggtgttcgaggaggaggacctggagccggagggg

SEQ ID NO: 4346 - DNA, 1143 bp, Streptomyces avermitilis
  CDS (1)..(1143)
atgacggtcatggagcagcggggcgcttaccggcccacaccgccgcccgcctggcagccccgcaccgaccccgcgccactgctgcccgacgcgctgccccaccgcgtcctgggcaccgaggcggccgcggaggccgacccgctactgctgcgccgcctgtacgcggagctggtgcgcggccgccgctacaacacgcaggccacggctctcaccaagcagggccggctcgccgtctacccgtcgagcacgggccaggaggcctgcgaggtcgccgccgcgctcgtgctggaggagcgcgactggctcttccccagctaccgggacaccctcgccgccgtcgcccgcggcctcgatcccgtccaggcgctcaccctcctgcgcggcgactggcacaccgggtacgacccccgtgagcaccgcatcgcgcccctgtgcacccctctcgcgacccagctcccgcacgccgtcggcctcgcgcacgccgcccgcctcaagggcgacgacgtggtcgcgctcgccctggtcggcgacggcggcaccagcgagggcgacttccacgaggcactgaacttcgccgccgtctggcaggcgccggtcgtcttcctcgtgcagaacaacggcttcgccatctccgtcccgctcgccaagcagaccgccgccccgtcgctggcccacaaggccgtcggctacgggatgccgggccgcctggtcgacggcaacgacgcggcggccgtgcacgaggtcctcagcgacgccgtggcccacgcgcgcgcgggaggggggccgacgctcgtggaggcggtgacctaccgcatcgacgcccacaccaacgccgacgacgcgacgcgctaccggggggactccgaggtggaggcctggcgcgcgcacgacccgatcgcgctcctggagcacgagttgaccgaacgcgggctgctcgacgaggacggcatccgggccgcccgcgaggacgccgaggcgatggccgcggacctgcgcgcacgcatgaaccaggatccggccctggaccccatggacctgttcgcccatgtgtatgccgagcccaccccccagctgcgggagcaggaagcccagttgcgggccgagctggcagcggaggccgacgggccccaaggagtcggccga

SEQ ID NO: 4347 - DNA, 1002 bp, Streptomyces avermitilis
  CDS (1)..(1002)
atgaccaccgttgccctcaagccggccaccatggcgcaggcactcacacgcgcgttgcgtgacgccatggccgccgaccccgccgtccacgtgatgggcgaggacgtcggcacgctcggcggggtcttccgggtcaccgacgggctcgccaaggagttcggcgaggaccgctgcacggacacgccgctcgccgaggcaggcatcctcggcacggccgtcggcatggcgatgtacgggctgcggccggtcgtcgagatgcagttcgacgcgttcgcgtacccggcgttcgagcagctcatcagccatgtcgcgcggatgcgcaaccgcacccgcggggcgatgccgctgccgatcaccatccgtgtcccctacggcggcggaatcggcggagtcgaacaccacagcgactcctccgaggcgtactacatggcgactccggggctccatgtcgtcacgcccgccacggtcgccgacgcgtacgggctgctgcgcgccgccatcgcctccgacgacccggtcgtcttcctggagcccaagcggctgtactggtcgaaggactcctggaacccggacgagccggggaccgttgaaccgataggccgcgcggtggtgcggcgctcgggccggagcgccacgctcatcacgtacgggccttccctgcccgtctgcctggaggcggccgaggcggcccgggccgagggctgggacctcgaagtcgtcgatctgcgctccctggtgcccttcgacgacgagacggtgtgcgcgtcggtgcgccggaccggacgcgccgtcgtcgtgcacgagtcgggtggttacggcggcccgggcggggagatcgccgcgcggatcaccgagcgctgcttccaccatctggaggcgccggtgctgcgcgtcgccgggttcgacatcccgtatccgccgccgatgctggagcgccatcatctgcccggtgtcgaccggatcctggacgcggtggggcggcttcagtgggaggcggggagc

SEQ ID NO: 4348 - DNA, 1365 bp, Streptomyces avermitilis
  CDS (1)..(1365)
atggcccaggtgctcgagttcaagctccccgacctcggggagggcctgaccgaggccgagatcgtccgctggctggtgcaggtcggcgacgtcgtggcgatcgaccagccggtcgtcgaggtggagacggccaaggcgatggtcgaggtgccgtgcccctacgggggcgtggtcaccgcccgcttcggcgaggagggcacggaactgcccgtgggctcaccgctgttgacggtggctgtcggagctccgtcctcggtgcccgcggcgtcctcgctgtccggggcgacatcggcgtcctccgcgtcctcggtgtcatcggacgacggcgagtcgtccggcaacgtcctggtcggatacggcacgtcggccgcgcccgcgcgccggcggagggtgcggccgggccaggcggcacccgtggtgacggcaactgccgccgcggccgccacgcgcgtggcggctcccgagcggagcgacggccccgtgcccgtgatctccccgctggtccgcaggctcgcccgggagaacggcctggatctgcgggcgctggcgggctccgggcccgacgggctgatcctgaggtcggacgtcgagcaggcgctgcgcgccgcgcccactcctgcccccaccccgaccatgcctccggctcccactcctgcccccacccccgccgcggcaccccgcggcacccgcatccccctccgaggggtccgcggtgccgtcgccgacaaactctcccgcagccggcgtgagatccccgacgcgacctgctgggtggacgccgacgccacggcactcatgcacgcgcgcgtggcgatgaacgcgaccggcggcccgaagatctccctcatcgcgctgctcgccaggatctgcaccgccgcactggcccgcttccccgagctcaactccaccgtcgacatggacgcccgcgaggtcgtacggctcgaccaggtgcacctgggcttcgccgcgcagaccgaacgggggctcgtcgtcccggtcgtgcgggacgcgcacgcgcgggacgccgagtcgctcagcgccgagttcgcgcggctgaccgaggccgcccggaccggcaccctcacacccggggaactgaccggcggcaccttcacgttgaacaactacggggtgttcggcgtcgacggttccacgccgatcatcaaccaccccgaggcggccatgctgggcgtcggccgcatcatccccaagccgtgggtgcacgagggcgagctggcggtgcggcaggtcgtccagctctcgctcaccttcgaccaccgggtgtgcgacggcggcacggcaggcggtttcctgcgctacgtggcggactgcgtggaacagccggcggtgctgctgcgcaccctg

SEQ ID NO: 4349 - DNA, 885 bp, Streptomyces avermitilis
  CDS (1)..(885)
atgaccgagtacgagcggccgcagacgcccggcgtcgtcacccacgacgccgtcgtactcgccggcggcgccgcccgacggctcggcggggccgacaaacccggcgtacgcgtcggcggccgggcgctgctcgaccgggtgctggcggcctgcgccggtgcggccaccacggtggtggtggccgaccccagagcgaccgcacggcccgtggtgtgggcgcgcgaggagccgcccggcgccggaccggtcgccgcactcgacgccggactgcggcggaccacggcggcgtacgtcgtggtgctctccgccgatctgccgttcctggacgaggagacggttcggcggctgctgagcacacttcaggcgagcggcaccgaaggcgtgttgctcaccgaccccggcgggcgggaccagccgctcgtcgccgcctaccgcagtgcggcgctgcgccgggagctcgcggaactcgcagccgggcacggcacgctcgccggactgccgctgcgggtgctggtcgccgcgctcgacctcacccgcgtctccgaccccgtcgcgtccttcgactgcgacacctgggacgacatcgccgccgctcggtcacggatcagggagcatgggaacgtgttggatgaatggatttccgcagtcaaggacgaactcggcatcgacctcgccgtcgacaccggcatcctgctcgacctcgcccgggacgccgcacacggtgtggcccggcccgccgcgccgctgaccacgttcctcgtcggatatgcggccgcgcaggccgggggaggtccggaggccgtggccgaggccgcccgcaaggcggcggcgctggccctgcgctgggcggacgaggccgccgccgaggccgggccggacgccgga

SEQ ID NO: 4350 - DNA, 1392 bp, Streptomyces avermitilis
  CDS (1)..(1392)
gtggtcaacgacagcggcgaccggggccgtccgcgcgaggcccgcccggccggacggcatcaggaggagcacgacctcgacgtcgaagaggccctcgcgctggtgcgggaacccggctcccgcgagccggagcccgcccgggacaccccgtccgcccccgcgccctccccccggaccacgtcccacgcccagcaccaggccaccccctggccggaggcccgcgtcaccgccgagcgggccgcccgctccgtgccccggcgcgcacccgtctccgtacccctcgacgccgccctcggccttgttctcgccgcgcccctcaccgcactcacggacctcccctccttcgacacgtcggccatggacggctgggccgtcgcggggcccggcccctgggacgtacgcgacgaaggggtgctcgcgggccacgcggggcccaggtccctcggcgacggcgaggcggtccgcatcgcgaccggcgcgcgcgtcccgcaggacacgacggccgtactgcgcagcgagcacggcaccacggacgacaaggaacggctgcacgccacccgcgaggtcgtccacggacaggacatcaggccgcgcggccaggagtgccgcagtggtgaccagctgctcccggccggcgcactggcgacccccgccgtgctcgggctcgccgccgccgccggttacgacaccctctccgcgatgccccgcccgcgtgtcgaaatcctcgtcctgggcgatgagttgctgaccgccggcctgcccgaggacggcctgatccgggacgcgctcggcccgatgctgccgccgtggctgcgcgcgctcggcaccgaggtcgtggccgtgcgcaggctgggcgacgacgccgaggccctgtaccaggccgtgaagggctcggacgccgagctgatcgtcacgaccggcggtacggccgcgggccccgtcgaccatgtgcatcccgtcctccgccgcctcggcgccgaactcctcgtcgacggcgtcaaggtgcgcccgggccaccccatgctgctggcccgcaccagggagaaccagcacctcgtcggcctgcccggcaaccccctcgcggccgtgtccggcctgctcaccctcgccgagccgctgctgcgcgtcctcgcgggccgtgcggccccggagccgtacacgctgcccctcagggacacggtccacggccatccgtacgacacccggctcgttcccgtcgtcgtacgagccgaccgtgccgtgccgctgcactacaacggtcccgccatgctgcgcggtatcgcggcggccgacgcgctcgtggtcgtcccgcccggcggtgcccaccccggacaggagctggaactcctcgacctgccgtgggcctgggcgggaatcggggagtgtttcacg

SEQ ID NO: 4351 - DNA, 1032 bp, Streptomyces avermitilis
  CDS (1)..(1032)
gtgaacctcccgaggaaggtcgtcgaccgcccgatccgccaggtcggcaaacggctggcgatggccctgctggtgcttgcggcgaccgcgttcatcgtctggatcgaccgcgacggctacaacgacaacgcgggcgacggggtcgatctgctcgactccttctactacgcgaccgtcactctctccaccaccggctacggcgacatcacaccggtcagcgacggcgcccggctcaccaacatcttcgtcatcacgcccctgcgcgtgctgttcctgatcatcctggtcggcaccacgctggaagtcctcacggaacgcacccgggaggaatggcgcctgaaccgctggagggcggccttgcgagaccacactgtcgtcgtcggcttcgggaccaaggggcgttcggcgattcagaccgtctgcgcgacggggctgaagaaggagcaggtcgtggtcgtcgaccccagctccagggtagtcgacgcggccacggccgaggggtacgccggagtcgtcggggacgccacgcgcagcgatgtgctgctacgggccgaggtgcagcgggcgcgccagatcatcatcgcgacgcagcgggacgacacggccgtcctcgtcaccctgaccgcccgtcagctcaaccgcggggcgaagatcgtggccgccgtgcgcgaggaggagaacgcgccgctgctgcggcagtccggcgccgacgccgtcatcaccagcgccagcgcggccgggcgactgctcgggctctccgtgctcagccccagcgccggcatggtcatggaggacctcatccagcagggcagcgggctcgacatggtcgaaaggcccgtcataaaggccgaggtgggcaagggcgtgcgcgagacgggcgacctggtggtgagcgtcgtacgcggtcaccgggtgctcggatacgacgatccggcgatcggcaccttgcagttgacggaccggctgatcacgatcgtgcgggcctcgcccgccacaaaggccacgcccgacacccgaccgctgccgcgggac

SEQ ID NO: 4352 - DNA, 978 bp, Streptomyces avermitilis
  CDS (1)..(978)
atgtacgcgatcacgattcccgaacccggtgggccagaggcgctggtgtggaccgaggtccccgatcccgagcccggcgagggtgaagtcctggtcgaggtggtggccagcgccgtcaaccgcgccgatctgctgcaacggcagggcttctacgccccgccgcccggtgcgtccccctatcccggactcgagtgctcggggcgcatcgccgcgctcgggccgggtgtctcggggtgggccgtcggcgacgaggtgtgcgcgctgctcgcgggcggcggctacgccgagaaggtcgccgttccggccggacaactgctgcccgtgcccgaaggcatcggcctgcggcaggcggccgcgctgcccgaggtgacctgcaccgtctggtcgaacgtcttcatggtggcccatctgcgccccggcgagacgctgctcgtacacggtggctccagcggtatcggcacgatggcgatccagctggcgaaggcggtcggcgcgaaggtcgcggtgacggcgggcaccaaggagaagctggacttctgtgccgagctgggcgcggacgtcctcgtcaactaccgcgagcaggacttcgtcgaggaggtccgccgggccaccgacggggcgggtgcggacgtcatcctcgacaacatgggtgccaagtatctcggccggaacgtggacgccctcgccgtcaacggacggctggcgatcatcggcatgcagggcggggcgaagggcgagctgaacatcggcgccctgctccacaagcggggcgcggtcaccgccacatcgctgcgggcccgcccgttgggcgagaaggcggcgatcgtggcggccgcccgggaacacgtctggccgctgatcgcctccggccgggtccgcccgatcgtcgaccgcgaacttccgatgagcgacgcggcgacggcccaccgggtgctggaggagagcgggcacatcgggaaggtgctgctggtggtcccg

SEQ ID NO: 4353 - DNA, 960 bp, Streptomyces avermitilis
  CDS (1)..(960)
gtgcacggagaggcggcgcgcgtcagacgccggacacggcccggtcatccggggcggcggccggatcgccgagatgccggaggcggcggcccgtgtgaccctgggggcgttgatcttggtgcccgagtacgggagggggtcacgcacgtgactccgaggacgcgcacgacgcgcacactccgcacggccgtacgcccgctgcttctgtcgacgggcgcggccctcgccgtgtacgccaccaccaccgcgtacgtcactccgccagcctacgccgcggcggtccggtacgcgctcactcccgcgtcccccgcggcggtccggtacgccccggcgcacccgtcagccgcggcggtcccgtacgctccggcgcagccgtcgaccgcggccgctccgtcccccctgccgccgtcctccctcgcggtcgccacggcttcctcaccccccgcggcccccaccgccgcggcgccctctcgtctcgcgcccgccgagcaggcagaccaagccgatcccgccgagccggccgatcccgccgcggccgcaacacggcctgttccctcccgggacgccgccacgccctcccggggggccgtcggtgcccccggtcgccccacccccgacccctctcgtgcagggagccaggccggggaggggcggatgcggcccgggcgggcggacgacgggtcggagagcgaggacgcggagcccacgtacacggaccgggaccccgccgacggcgacgccgaggaatcgggcgtcgaccccggcgcgtccgtgcggccggaggtcaccgacgccccgcaaccctcacagcacgccgcggccaccccgccccagagcgtcgtacgcccgggcgagcgcaccccgaagcccgtgctcgaggttctgcccctcggcagcggtctgatcctcatgggcctcggcctgggactcgccttcctggccctgcgcgtacgacgcggc

SEQ ID NO: 4354 - DNA, 543 bp, Streptomyces avermitilis
  CDS (1)..(543)
atggagatgccgaggaacgaaaggtcgccggagaacccccagatcctggtcgtgggccaggacggaatggctctcggtggcgccggggacgagggctcccgcgaggtcccggtgacagagatggtcgaacaacctgccaaggtcatgcgcatcggaagcatgatcaagcaactgttggaggaagtgcgcgcggctcctctggacgaggccagccggcagcgcctcaaggagatccactccagctcggtcaaggagctggaggacgggctcgcccccgagctcgtcgaggagctggagcggctttccctgcccttcacggacgaagcgacccccagcgacgcggaactccgcatcgcgcaggcgcagttggtgggctggctggagggactgttccacgggatccagacgaccctgttcgcccagcagatggcggcccgggctcagttggagcagatgcgacgcgcccttccgccgggcgtcggtggccccgagggcgacggcgacgacctgagggcgggcggccgttcgggcgggccctacctg

SEQ ID NO: 4355 - DNA, 1650 bp, Streptomyces avermitilis
  CDS (1)..(1650)
atgagccaggacggcgcacagggccggtacgcgggccgagcggtcgccggcggccgctaccagctgcgcgacttgctcggcgagggcggcatggcctcggtgcatctcgcatacgactcggtgctcgaccgccaggtcgcgatcaagacactgcacaccgagctgggacgcgagcaggccttccgggagcgattccggcgcgaggcccagtcggtggcgaagctcacgcacacgaacatcgtctcggtcttcgacaccggcgaggacagcctcgacggactgacgaccccgtacatcgtcatggagtacatcgagggcaagccgctcggctcggtcctcgacgcggacatccagcagcacggcgcgatgccggccgacaaggcgctgaagatcaccgcggacgtgctggccgccctggagatcagccacgagatgggcctggtccaccgggacatcaagccgggcaacgtgatgatgacgaagcggaacgtcgtcaaggtgatggacttcggcatcgcccgcgccatgcagtccggtgtcacatcgatgacgcagaccggcatggtggtcggcaccccgcagtacctgtcgccggagcaggcgctgggccggggtgtggacgcccgcagcgacctgtactccgtgggcatcatgctgttccagctggtcaccgggcggctgccgttcgaggcggactcgccgctggccatcgcgtacgcgcatgtgcaggaggagcccgtggctccttcgtcggtcaaccgctcactgccgccggccgtcgacgccctggtcgcccgcgcgctgaagaagaacccgaacgagcgtttccccagcgccgagatcatgcgcgacgagtgcctgcgcgtggcccagtcgttccaggccgccgcgcccagcatcgtccccggcgcgcagacgccgagcggcgccggtgtcggctccgcggtgttcccgccgatcgaccagtcgacgcccgccccgacgggcccggtgcagacgccgtaccagccgggtccgtacggtccggcgacgcccgcccccgcaccgtcctacggctacccgcagcagggcggctaccagacacctccgcagacctcggcgtacgcgccccagcagtccacggcctactcggcgcagcagggcacgtcgactccgccgccgtacaacctctcgccgcactcgacggcatccgcctcgggcggttcgggcggcggaaagagcaacaaggcggtgatcatcggctcgatcgtggtcgcgctgctcgcgatcggcggcctgaccacggcgctgacgctgaacggcgacgacgacaagggcggcggtgacgccggctcatcggcgtcaccgaccgtggtcgaggggcacaaggacccggacacgaccaagacgatggaaacgaccgagtgcacggagccggacgagtcgtacaacgacccggacaagatcaagatcccggacttcacgttcaagaacatcgactcggtgaagaagtgcctccaggcggccggctggccctacgaccccaagaaggtcgacgagaacaccttcggcgaggggacggtcatggagcagtaccccgcggccggcgacgatgtcgaccccaaggacatgcccgacatcgtcctgaagatctcgacgggcgacccggcg

SEQ ID NO: 4356 - DNA, 1497 bp, Streptomyces avermitilis
  CDS (1)..(1497)
atgtcagatgcgccggagatgtggggcaacggcggactggtcggggacggccggtaccggctgacgggcagactcggccggggcggcatggccgaggtgttcgcggctgaggacgtgcgcctcgggcgcaccgtcgcggtcaagctcctgcgctccgacctggccgaggacccggtctccaaggcccgcttcacgcgcgaggcccagtcggtggccgggctcaaccaccatgcggtcgtcgccgtgtacgactccggcgaggacgtcgtcgggcactccaccgtcccgtacatcgtgatggagctggtcgagggccgcaccatccgcgacctgctgctcaacgccgaggccccggggcccgagcaggcgttgatcatcgtctccggggtgctggaggcgctggcctactcgcaccagcacggcatcgtgcaccgcgacatcaagccggccaacgtcatcatcacgcacaacggtgccgtgaaggtcatggacttcggcatcgcgcgcgccctgcacggcgcgcagtcgacgatgacgcagaccggcatggtcatgggcacgccgcagtacctgtcgcccgagcaggcgctcggaaaggcggtcgaccaccgcagcgacctgtacgcgaccggttgcctgctctacgaactcctcgcgctgcggcccccgttcaccggtgagaccccgctgtccgtggtctaccagcacgtgcaggacatcccggtgcccccgtccgaggtcgcggaaggggcgccgccggagctcgacggactcgtgatgcgctcgctcgcgaaggatcccgacgaccggttccagaccgccgaggagatgcgcgggctggtccagtacggcctgcagatgctgtacgaccagggcggccacaccgggacctggaacaccggcccggtggccgtgcacgaggggcggcacactccggcggccggcttcgccaacacgaccgtgctgccgcaccccagcgactccggcacctcgcagatcccgcagccgatcctgcccgcgtacggcggcggggacgacggcggcttcgaggggcacggcaacaggggcaccggccgtggcaagttgtggatcctcgcggtgctcgcggtgatcgctgtcgcggcgggcgtcgcgctggcactgaacaacaccggcggcagcggcaccgggaccgatacgacgaagtcgccgaccgcctcgcattccagcaaggacaaggagtccagcaaggcgcccagcgacgaggcgagcgacgactccacggacgacaacaccggcacgggatccgacccggactacccaacgccgtcgtacgagcagtcgcatagctacagcagccagccgtccgacgagccgacggagccgtccaacgagccgacggacacgacgccgacgaagccgacgccgtcgaccgatccggtgacgccgtccggcgacgcgtccgacccggccgagacggacggcgggggcgacggcgagggcgacacggcgggcccc

SEQ ID NO: 4357 - DNA, 1047 bp, Streptomyces avermitilis
  CDS (1)..(1047)
gtgccgcgcccatctgtaccactgcctgtgcttcacgcgccccctgtgtcccacgcaccccctctgggcaccctcctccgccagtacgccgccgggtccgcgctcacctgcgtccccgtggatcaggggctgctcaaccgcggctaccgggtcgccacgacccgtggccgctacttcctcaagcaccacttcgaccccgagaccgccgacccggccgcgatcgcccgtcagcaccgggccacccagcgcctggcggacctcggcgtaccagtggcaccgccactggccggcaacgacgggcgcacggtcgcggtcgtcggcggccacgcgtacgccctgcacccgtggatcgacggacggcaccggcacggcggccagctcacggccgagcagtgcgggcggctgggggcgctgctgggcgtggtgcacgcgagcctggaacgggtgatgccggcgcagggccgggcacccgccgagccggccgagagcgccgaccccgccgacaccttcacactcatcgacgatctcctcggccgcgtacgccgccaccggccctcggacgccttcgacgaactggcccggcaccggcttctcgaacggcgcgcgctgctggagcagcacgcggaccgacggccgccgcggggcggctcggtggggtgggtgcacggcgacttccacccgttcaacctgctctacaagggggacgcgccggccgccatcgtggactgggaccggctcggcgtacagccccgcgcggaggaggcggtacgggccgcggtgatcttcttcgtacgtcccgtcggcacgctcgacctccccaaggcacgggcctacgcgcgcgcgtaccgccgtaccgcggacgccaagccctccgagctcgcggccgccgtgcaccgcgtgtggtgggagcgcctcaacgacttctggatgctgcgctggcactacgaacgcggcgacacccgggccgactcccagttcccggccgcctcggcgctggcggtgtggtggacgcgggagtacgacgcggtgtgcgaggccttcagcggc

SEQ ID NO: 4358 - DNA, 492 bp, Streptomyces avermitilis
  CDS (1)..(492)
atgcccaccaacgaacacctcgccgtcgaactgatcggccgcgccgaccacggccgggtggccacgagcatgcgcgcgctgcccttcctcgtgtgcgtccgccacatcgtgctggccggacgcgtactgctgcgcctgcacaggggctgggggtaccaccgggcctgcgtgggcagtgtggtggcctacggctccgacaacctcgggcgccccgggccgggcgggaacctgtggtccgcgcagatcgtgggccggtgtgaggcgatcgagccgaccgccgcacagatcgcgctcttcggcccggcgccgggccgcgtggacggcgagcccttcgaccccgtgtatctgcgcatcgagccgcagctcggcacggtgcacttcatggacgatcacaccatggacgatcgctccatgaacgatcactccgtggagggactctccatggacgatcgccccgtgccggtggccggaacgccgcttcggagccgaccg

SEQ ID NO: 4359 - DNA, 657 bp, Streptomyces avermitilis
  CDS (1)..(657)
gtgagcgaatccggaaaaataactgtattcctcttggacgaccacgaggtggtccgccgaggagtgcacgacctgctctcgggggaggacgacatcgaggtcgtcggcgaggcggggacggccgccgacgccttggcacggattccggccacccacccggacgtggccgtgctggacgtacggctcccggacggcagcggtgtggaggtgtgccgtgagatccgctcgcagaacgacgccgtcaagtgcctgatgctgacctcctacgccgacgacgaggccctcttcgacgccatcatggcgggcgcctccgggtacgtcctgaaggacatccgcggcagtgaactgctggccgcggtacgcgacgtcgcggccgggaagtccctgctcgaccccgtggccaccgcccgcgtcctggagcggctgcgcgagggtggcggccccaaggaggacgaccggctcgcgcacctgaccgatcaggagcgcaggatcctcgacctcatcggcgaggggctcaccaaccgcgagatcggtgagcggctgcacctcgccgagaagacgatcaagaattatgtatcgagtctgctttccaaactggggatgcagagacgttcgcaggcggccgcctatgtggcgcgcatacaggcggaaaagagc

SEQ ID NO: 4360 - DNA, 1218 bp, Streptomyces avermitilis
  CDS (1)..(1218)
gtgaccgtggagagcactgccgcgcgaaagccgcgacgcagcgccggtacgaagagcgccgcagccaagcgcaccagccccggcgccaagaagtcaccgagcacgaccggcgccgagcacgagctgattcagctgctcacgcccgacggccggcgggtgaagaaccccgagtacgacgcgtacgtcgcggacatcacccccgaagagctgcgcggtctgtaccgggacatggtgctgagccgccgcttcgacgcagaggccacctccctgcaacgccagggcgagctgggcctgtgggcctcgatgctcgggcaggaggccgcccagatcggctcgggccgggccacccgtgacgacgactacgtcttcccgacctaccgcgagcacggcgtcgcctggtgccgcggggtcgaccccaccaacctgctcggcatgttccgcggcgtgaacaacggcggctgggatcccaacagcaacaacttccacctctacacgatcgtcatcggctcgcagacgctgcacgccaccggctacgccatgggtatcgccaaggacggcgccgactcggccgtgatcgcgtacttcggtgacggcgcctccagccagggtgacgtcgccgaatcgttcaccttctccgcggtctacaacgcccctgtcgtcttcttctgccagaacaaccagtgggcgatctccgagcccaccgagaagcagacccgcgtcccgctctaccagcgcgcgcagggctacggcttcccgggcgtccgcgtcgacggcaacgacgtactggcctgcctcgccgtcaccaagtgggccctcgagcgggcccgccggggcgaggggcccacgttggtcgaggcgttcacgtaccgcatgggcgcgcacaccacctccgacgacccgaccaagtaccgggccgacgaggagcgcgaggcgtgggaggcgaaggacccgatcctgcgtctgcgcacgtatctcgaggcctcaaaccacgcggacgagggattcttcgcggaactcgaggtggagagcgaggcgttgggaaggcgagtgcgcgaagtggtgcgtgccatgccggacccggaccacttcgccatcttcgagaacgtgtacgcggacgggcatgcgctcgtcgacgaggagcgggcgcagttcgccgcctaccaggcgtcgttcacgacggagcctgacggcggctccgccgcgggacaggggggtaac

SEQ ID NO: 4361 - DNA, 975 bp, Streptomyces avermitilis
  CDS (1)..(975)
atggccgagaagatggcgatcgccaaggcgatcaacgagtcgctgcgcaaggccctggagtccgaccccaaggttctgatcatgggtgaggacgtcggcaagctcggtggcgtcttccgcgtcaccgacggcctgcagaaggacttcggcgaggagcgggtcatcgacaccccgctcgccgagtcgggcatcgtcggcacggcgatcggtctcgccctgcgcggctaccgcccggtggtggagatccagttcgacggcttcgtcttcccggcgtacgaccagatcgtcacgcagctcgcgaagatgcacgcgcgggcgctcggcaagatcaagctccccgttgtcgtccgcatcccgtacggcggcggcatcggcgccgtcgagcaccactccgagtcccccgaggcgctcttcgcgcacgtggcgggcctcaaggtggtctccccgtccaacgcgtcggacgcgtactggatgatgcagcaggccatccagagcgacgacccggtgatcttcttcgagccgaagcggcgctactgggacaagggcgaggtcaacgtcgaggcgatccccgacccgctgcacaaggcccgtgtggtgcgtgagggcaccgacctgacgctcgccgcgtacggcccgatggtgaaggtctgccaggaggccgcggccgccgccgaggaggagggcaagtccctggaggtcgtcgacctgcgctccatgtcgccgatcgacttcgacgccgtccaggcctccgtcgagaagacccgccgtctggtcgtggtgcacgaggcgccggtgttcctgggcacgggcgcggagatcgccgcccgcatcacggagcgctgcttctaccacctggaggcacccgtgctgagggtcggcggctaccacgccccgtatccgccggcgcgtctggaagaggagtaccttccgggccttgaccgggtgctcgatgccgtcgaccgctcgctggcgtac

SEQ ID NO: 4362 - DNA, 1386 bp, Streptomyces avermitilis
  CDS (1)..(1386)
atgactgaggcgtccgtgcgtgagttcaagatgcccgatgtgggtgagggactcaccgaggccgagatcctcaagtggtacgtccagcccggcgacaccgtcaccgacggccaggtcgtctgcgaggtcgagaccgcgaaggcggccgtggaactccccattccgtacgacggtgtcgtacgcgaactccgtttccccgaggggacgacggtggacgtgggacaggtgatcatcgcggtggacgtggccggcgacgcaccggtggcggagatccccgtgcccgcgcaggaggctccggtccaggaggagcccaagcccgagggccgcaagcccgtcctcgtgggctacggggtggccgagtcctccaccaagcgccgtccgcgcaagagcgcgccggcgagcgagcccgctgcggagggcacgtacttcgcagcgaccgttctccagggcatccagggcgagctgaacggacacggcgcggtgaagcagcgtccgctggcgaagccgccggtgcgcaagctggccaaggacctgggcgtcgacctcgcgacgatcacgccgtcgggccccgacggcgtcatcacgcgcgaggacgtgcacgcggcggtggcgccaccgccgccggcaccccagcccgtgcagacgcccgctgccccggccccggcgccggtggccgcgtacgacacggctcgtgagacccgtgtccccgtcaagggcgtccgcaaggcgacggcggcggcgatggtcggctcggcgttcacggcgccgcacgtcacggagttcgtgacggtggacgtgacgcgcacgatgaagctggtcgaggagctgaagcaggacaaggagttcaccggcctgcgggtgaacccgctgctcctcatcgccaaggcgctcctggtcgcgatcaagcggaacccggacatcaacgcgtcctgggacgaggcgaaccaggagatcgtcctcaagcactatgtgaacctgggcatcgcggcggccaccccgcgcggtctgatcgtcccgaacatcaaggacgcccacgccaagacgctgccgcaactggccgagtcactgggtgagttggtgtcgacggcccgcgagggcaagacgtccccgacggccatgcagggcggcacggtcacgatcacgaacgtcggcgtcttcggcgtcgacacgggcacgccgatcctcaaccccggcgagtccgcgatcctcgcggtcggcgcgatcaagctccagccgtgggtccacaagggcaaggtcaagccccgacaggtcaccacgctggcgctcagcttcgaccatcgcctggtcgacggcgagctgggctccaaggtgctggccgacgtggcggcgatcctggagcagccgaagcggctgatcacctgggcc

SEQ ID NO: 4363 - DNA, 828 bp, Streptomyces avermitilis
  CDS (1)..(828)
gtgctctccaccggcgccctcaccgcggcacccgcgcaggccgtcaccaagcccacgatcaccgccaagggcggttacgtgatgaacaacggcaccggaaagagcctgtacaccaaggcggccgacaccaagctctccaccggctccaccaccaagatcatgactgccaaggtggtgctgtcgcagtcgaacctgaacctggacgccaaggtcacggtccagaaggcgtacagcgactacatcgtcgacaacaactacgcctcctcggcgcacctgatcgtcggcgacaaggtcaccgtccgtcagctgctgtacgggctgatgctgccgtcgggctgcgacgccgcgtacgcgctcgccgacaagttcggcagcggctcgacccgggccgcgcgggtgaagtcgttcctctccaagatgaactccacggccaagagcctgggcatgacgaacacccacttcgactcgttcgacggcatcggtcacggcagcaactactcgacgccgcgcgacctgacgaagctcgccagcagcgcgatgaagagctccaccttccgcacggtcgtgaagacgaagtcgacgaagcagaaggcgacgaccaagagcggcggctaccgctactacaactgggacaacaccaacccgctgctcggcacctacaccggcacgatcggtgtgaagacgggctcgggccccgaggccaagttctgcctggtcttcgccgccacccgcaacggcaagacggtcatcgggacggtcctcgcctcgacgtcggtcgccaaccgcacggcggacgcgaagaagctgctgaactacggcttcgcggtc

SEQ ID NO: 4364 - DNA, 681 bp, Streptomyces avermitilis
  CDS (1)..(681)
atgtcttcagccccgtccgcggcccccgcgcccgagcagccgaccctcaagcggccgcccgccgccgaccgggtgtacgcgcacgtcaagcagggcgttctggaacgccgttacgaaggcgggacgctgctcaccgagggcgaactggccgaggaggtcggggtctcacggactcccgtgcgggaggcgctgctgaggctggaggtcgaagggctgatcaggctctacccgaaaaagggagctctcgtcctgccggtctccgcccaggagatcgcggacgtggtcgagacccgtcagctcgtcgaggagcactccgcgcggaaggcggtccccgcctcgccgcagctgatcgcccgtctcgaagagctgctcgccaagcagaaggagcaggccgcggccggggacctggccggcgccgccgtcaccgaccgctgcttccacgccgagatcgtgcgcagcgggggcaacgagatcctctcccggctctacgaccagctccgcgaccggcagttgaggatgggcgtcgccgtgatgcacgcccaccccgaccggatcaccaagacgctcaccgagcacgaggcgattctcgaagcgctgcgctccggtgacgcggaggccgtcgtcggcatcatccaccagcacgtcagctggttctccaacctggcccggggcgaggtccga

SEQ ID NO: 4365 - DNA, 1344 bp, Streptomyces avermitilis
  CDS (1)..(1344)
atgagcgcggggcgcggaccgacgggcggggggcgcggaccgatgagctccggcggcgccgtctcgctccccggggacccgcccggcgggcgccgcgccgttgccgtctggggcatcggtgtctccgtctacttcgtcgcggtcatcttccgtacgtcgctgggggtggccgggctcgacgccgcggaccgcttccacgtcaacgcctcggccctgtccaccttctcgatcctccagctcctcgtgtacgcgggcatgcagataccggtcgggctgctggtcgaccggctcggcaccaagaaggtgctggccatcggtgtggtgctgttcacggcggggcagttgggcttcgcgttctcctcctcgtacggcatggcgctcgcctcacgcgcgctgctgggctgtggtgacgcgatgaccttcatcagcgtgctgcggctcggcacacgctggttcccggcccgccgcagtccgctggtcgcccagctcgcgggtctggtcggcatggcgggcaacctggtctcgacgctcgtcctcgcccggctgctgcacggggtgggctggacggcggcgttcgcgggcagcgcggccgcgggggtcgtggtcctcgtactcctgctgctgttcctgaaggaccaccccgaggggcacgagccggagccgttcccgcaccacggatcggcgtacgtacgacggcagatcgcggcgtcctggcgcgagcccggcacgcgcctggggatgtgggtgcacttcacgacgcagttcccggcgatggtgttcctgctgctgtgggggctgccgttcctggtgcaggcgcaggggctgtcccgggcgacggcgggggagctgctcaccctggtggtgctctccaacatggtggtgggactggtgtacggccaggtcgtcgcccggcatcacgcggcgcggctgccgctggcgctcggcacggtggcgtcgacggcggtggtgtgggcactcacgctggcctacccggccgaccgggccccgatgtggatgctgatcgtgctgtgcacggtgctgggagcctgtgggccggcgtcgatgatcggcttcgacttcgcgcgccccgcgaatccgccggagcggcaggggacggcgtccgggatcaccaacatgggtggtttcgtcgcctcgatgacgacgctgttcgcgatcggggtcctgctcgacgcgaccggtgacgactacggcgtggcgttctccgcggtgttcgtcctccaggccgtcggcatcagccagatcctgcgactgcggaagcaggccgcccggcgggagcgggagcggctggtggccagccgggtggagacggtgcacgtgcctgcc

SEQ ID NO: 4366 - DNA, 822 bp, Streptomyces avermitilis
  CDS (1)..(822)
gtgagtctgcatcccactcttcagccctacgccgacgcctggacccactcgatcgaagcgatatccgagctggtgacgccgctcgtggagggtgagtggaaccggcgtacgccctgccccggctggtcggtgagggacctcgtctcgcatgtcatcggcctcgactgcgagatgctcggcgacccccgtccgatccacaccctcccccgcgacctgttccacgtcacgaacgagcaccagcggtacatggagatgcaggtcgacgtccgccgtcatcacacggcgccggagatgacgtccgagctggagtacacggtgatccggcgcaaccggcagctgcggaacgagtcgcgggccccagagacgaaggtgcgcgggccgctgggctccgagccgaccctcgaagaggccatgcgcaaccgggcgttcgacgtgtgggtgcacgagcaggacctccgcgccgcccttggccggccggggaacctggactcgccgggtgcgtacatcacccgcgacgaactgctcgccgccctcccgaaggtcgtcgccaagaacgcgggtgcccccgcgggctcggcggtcgtcttcgacgtccacggtccggtcgagttcctgcggacggtacgcgtcgacgcggagggccgcggttcgatagacggcaccccctcgctcggcccggcggtgaccctgacgctcgactgggagacgtactaccgcctggcctgcggccgggtgacggcggacgtcgtgaaggaccgcatcaaggcggagggcgacccggagctgaccgcggcgatcctgctgtcgttcgcggtcacgccg

SEQ ID NO: 4367 - DNA, 804 bp, Streptomyces avermitilis
  CDS (1)..(804)
gtgcgcgcctctctcctccagatccgtgtagacgagggcgaatcggttgattcgcgtcggcggcgtgtgacgtctctcgtacgagaacaagccggtgtcgatctcgtggtgctgcccgagctgtggacgacgggtgcgttcgcctacgagtcgttcgacgcggaggccgagtcgctcgagggaccgacgtccgacgccatggcgaacgcggcgagcgaggcgggcgtgtggctgcacgccggctcgatccccgagcgcgcgccggacggcaccctgtacaacacctccctcgtcttcacccccgggggtgaactcgccgccacgtaccgcaagatccaccgcttcggtttcgacaagggcgaggccgtgctgatgggggcggggagcgagctggtgacggtgcggctgccggagacgaccgtgggcgtggccacctgctacgaccttcgctttcccgagctcttccgcgggctcgtcgacgcgggcgccgagacgctcgtgatcccggcgggctggccggagcgccgacgctcccactggacgctgctggctcaggcgcgggccgtcgagaaccaggcgttcgtgctcgcgtgtggaacggccggtacgcatgcgggagttccccaggcgggtcactcgatcgtggtcgatccgtggggtgaggtgctggccgaggccgggacggacgaggagatcctgacggtcgagttcgacccggcgaaggtggccgtgacgcgggaacagttcccggcgctgaaggaccgggtgctggggtcgacgtccaccgcccgcaggcaagcgccg

SEQ ID NO: 4368 - DNA, 492 bp, Streptomyces avermitilis
  CDS (1)..(492)
atgagattcctcgtacgcgaccggctcctcggcttcggtgacgactactggatcgaggaccagcacggcaacaaggtgttcctggtcgacggcaaggcgatgcggctgcgggacaccttcgagctgaaggacacgcagggacgtgtgctgatcgacatccaccagaagatgttcgccctgcgggacacgatggtgatcgagcgggacggcgaaccgctggcgacgatcaagcgcaaacgcctgtccctgctgcgcaaccactatcgcgtcaccctggtcgacggcacggaactcgacgtcagcggcaagatcctggaccgcgagttcgccatcgactacgaggacgaactcctggcccagatctcccggcgctggctgcacgtccgggagacgtacggcgtcgacgtcgtcagggacgacgcggacccggcgctgctgatcgcggtggcggtgtgtgtgatccacctggcggagaaggaacgcggagaggac

SEQ ID NO: 4369 - DNA, 231 bp, Streptomyces avermitilis
  CDS (1)..(231)
atgccacggaacaccaaggactcgaacatgcgcgacgacgacacccgcaaccgcggcccgcagcgcgaccggatgcggggcgagggcgagatagtcgaccgcgaggggatgcctccgtcgcgcggctcccggcgcgaggacgacatgcgcgaccgcgagcaggggcgggagcggatgcgggacgaggaggagctcctcggcgaggagaacaagcggggcgagggctaccgg

SEQ ID NO: 4370 - DNA, 1023 bp, Streptomyces avermitilis
  CDS (1)..(1023)
atgaacgactccgcaccccgccgcgtccgtgtgcgcgcccccgagctgatcggcaagggcggctggctgaacacgggagacaagcagtacaccctcgctgacctgcgaggacgcatcgtcgtcctggatttctggacattttgctgcatcaactgtctgcatgtcctggacgagctgcgggagctggaggagaagcaccgggacacggtggtgatcatcggtgtgcactcgccgaagttcgttcacgaggcggaacatcaggcggtggtggacgcggtcgagcggtacggcgtggagcacccggtcctcgacgaccccgagctggcgacctggaagcagtacgccgtccgcgcctggccgacgctcgtcgtgatcgaccccgaggggtacgtcgtcgcccagcacgcgggcgaggggcacgcccacgccatcgccgcgctcgtcgcggagttggaggcggagcacgaggccaagggcaccctgcgccgcggcgacgggccgtacgtggcgccggagcccgagcccacggtgctgcgcttccccggcaaggccctcctgctgccctcggggaacttcctggtcagcgacaccacccggcatcagctggtggagctggcggcggacggcgagtcggtggttcggcggatcgggtcgggcatccggggattcgccgacggcccggccgacgcggcgagcttcagtgagccccagggcatgacgctgctcgacgaggacgtagtggtcgtcgccgacacggtgaaccacgcgctgcgccgcctggacctcgcgaccggcgaggtcacgacgctcgcgggcaccggccggcagtggtggcagggctcgccggcctccggtccggcccgcgaggtcgacctgtcgtcgccgtgggacgtggcggtcttcggcggccgggtgtggatcgcgatggcggggggtgcaccagctgtggacgtacgacccggcggcggggacggtcgaggtcggggcgggcacgacgaacgaggggctggtcgacggaccggg

SEQ ID NO: 4371 - DNA, 882 bp, Streptomyces avermitilis
  CDS (1)..(882)
gtgcaccagctgtggacgtacgacccggcggcggggacggtcgaggtcggggcgggcacgacgaacgaggggctggtcgacggaccgggtgaggaggcgtggttcgcccagccgtcgggactcgcggcgaccgcggaccgcctgtggctggcggactccgagacgtccgccctgcgctgggtggacctggacggagcggtccacacggccgtcggcaccggcctgttcgacttcgggcatcgggacggggacgccgaacaggcgctgctccagcacccgttgggggtgacggcgctgcccgacggctcggtcgcggtgagcgacacgtacaaccacgcgctgcggcgctacgacccggcgacgggcgaagtgaccacgctggccacggacttgcgggagcccagcgacgcggtgctcgtgggcgacgacatcgtggtcgtcgagtcggcccggcatcggctgacccggctgcggctgccggaggaggcggtacgagtggcctcggtcgcccatcgcacccagcgcgcggcgaccgaagtggcgcccggcaggctccagttggatgtgatcttccaggcgcccgcggggcagaagctcgacacccgttacggcccgtcgacccgcctgctggtctcctccaccccgcccgagctgctgctgaacggggagggggcggacccggacctgtcccgcacgctggagctgaaccccgcgataccggagggtgtgctgcacgtctccgcgatggcggcgtcctgcgacgacgaccccgcgaacgagtacccggcctgccatgtccaccagcaggactggggcgtgccggtccgcctcacggaaggcggcgcggaccggctcccgctggtgctggcgggcatggacgcc

SEQ ID NO: 4372 - DNA, 246 bp, Streptomyces avermitilis
  CDS (1)..(246)
atgggcctgggtggatgcatcattctgatcgccgtgggggccatcctcacgttcgccaccgactggcacatggaggggatcaacctccctctggtcggtgtcatcttcatgatcgtcggcctgatcggggtcgcgaccttcagcagcatcgcccgccggaggcgggtggtgatgccgcccagcgccccggtgatcgaggaggagcggcaccaccaccgtgacggctacagcgacgggtacggcgtg

SEQ ID NO: 4373 - DNA, 1296 bp, Streptomyces avermitilis
  CDS (1)..(1296)
atgagcaacccagtccgcttcgaccgcggccacaccgacgacctcatgtccttcctggcggcgagcccgtcgccgtaccacgccgtgacgaacgccgcggagcggctggagaaggccggcttccggcaggtcgccgagacggacgcgtgggactcgaccagtggcgggaagtacgtggtgcgtggcggcgcgctcatcgcctggtacgtccccgagggcgccgacccccacacgccgttccggatcgtgggcgctcacaccgactcccccaatctccgggtgaagccccggccggacagcggggcgcacggctggcggcagatcgccgtggagatctacggcggaccgctgctcaattcctggctcgaccgcgatctgggcctggcgggccggctgtcgctgcgcgacggctccacgcgcctggtgaacatcgaccgcccgctgctgcgcgtgccccagctcgccattcacctcgaccgttccgtctccaccgacggcctgaagctcgacaagcagcgtcatcttcagcccatctggggtctgggcggcgacgtccgggacggcgacctgatcgcgttcctggaagcggagctggggctgtccgcgggcgaggtgaccggttgggacctcatgacccattccgtcgaggccccctcctacctcggccgcgacaacgagctgctggccggcccgcgcatggacaacctgctgtcggtgcacgcgggcacggcggcgctgaccgcggtggccgccgccgacgcctcgctcgcgtacatcccggtgctcgcggcgttcgaccacgaggagaacggctcgcagtcggacacgggcgccgacggaccgctgctcggatcggtgctggagcgctcggtgttcgcgcggtcgggctcgtacgaggaccgggcacgcgccttcgccggctcggtctgtctctcctccgacacgggccacgccgtccaccccaactacgcggagcggcacgacccgacgcaccacccgcgcgcgggcggcggcccgatcctgaaggtgaacgtcaacaaccgctacgccacggacggttcgggtcgcgcgatcttcgccgccgcctgcgagaaggcgaacgtccccttccagaccttcgtctccaacaactccatgccctgcggcaccaccatcggcccgatcaccgcggcccgccacggcatccgcaccgtcgacatcggcgcggcgatcctgtcgatgcacagcgcccgcgaactgtgcgccaccgacgacccgttcctgctggcgaactcgctggtggcgttcctggagggc

SEQ ID NO: 4374 - DNA, 1824 bp, Streptomyces avermitilis
  CDS (1)..(1824)
atggggcactacaagtcgaatctccgcgacatcgagttcaacctcttcgaggtgctcgggcgcgacaagctgtacggcaccggcccgttcgcggaaatggacaccgacaccgccaagagcatcctcgaggagctgacccgcctttcggagaacgagctggcggagtccttcgcggacgccgaccgcaacccgccggtcttcgaccccgagacgaacaccgcgcccgtcccggcgtccttcaagaagagctaccaggccttcatggactccgagtactggcgcctcggcctgcccgaggagatcggcggcaccacctccccccgctccctgatctgggcgtacgcggagctggtgctcggcgccaacccggcggtctggatgtactcctccggcccggccttcgcgggcatcctcttcgaagagggcaacgaggtccagaagcacatcgcgaagatcgcggtcgagaagcagtggggctccaccatggtgctcaccgagccggacgccggctcggacgtgggcgcgggccgcaccaaggcggtccagcaggaggacggctcctggcacatcgagggcgtgaagcggttcatcacgtccggtgagcacgacatgtcggagaacatcctccactacgtgctcgcccgtcccgagggcgcgggccccggcaccaagggcctgtccctcttcctcgtaccgaagtacgagttcgacttcgagaccggcgagctgggcgagcgcaacggcgcgtacgcgacgaacgtcgagcacaagatgggcctcaaggcgtccaacacctgcgagatgaccttcggcgaccgccaccccgccaagggctggctgatcggcgacaagcacgacggcatccgccagatgttccgcatcatcgagttcgcccgcatgatggtcggcacgaaggcgatctcgaccctgtcgaccggctacctgaacgccctggagtacgccacggagcgcgtccagggtccggacctcgcgaacttcatggacaagaccgcgcccaaggtcaccatcacgcaccacccggacgtgcgccgctcgctgatgacgcagaaggcgtacgcggagggcatgcgcgccctggtgctgcacaccgccgcgatccaggacgacatccaggtcaaggagtccgccggcgaggacaccaccgccctcgaggccctcaacgacctgctcctgccgatcgtcaagggctacggctccgagaaaggctacgagcagctcgcccagtccctgcagaccttcggcggctccggcttcctccaggaatacccgatcgagcagtacatccgcgacgccaagatcgacaccctgtacgagggcacgaccgcgatccagggccaggacttcttcttccggaagatcgtccgcaaccagggcacggcgctgaactcgctggccgaggacatcaagaagttcctggcgatcggcaccggcggcgaggagctggccccggcccgcgagcagctcgccaaggcggccgtcgagctggaggccatcgtcggcctgatgctcacggacctcgcggcgaccgagcaggacgtcaagaacatctacaaggtgggcctgaacaccacccgcctgctgctggcctcgggcgacgtggtcgtcggctacctgctgctgcgcggtgccgcggtggccgccgagaagctggagacggcctcggcgaaggacaagccgttctacacgggcaagatagcggcggcgaagttcttcgcggccaacgtcctgcccggcgtcaccggcgcccgcaagctggccgagggcgtcgacctggacctgatggagctggacgaggccgcgttc

SEQ ID NO: 4375 - DNA, 462 bp, Streptomyces avermitilis
  CDS (1)..(462)
atgtacggctacgagcagagcgcgggtgcccagcagggctacatcccgccgcagcagcagatgcccggcggttacgggcagcaggcgccgctgtaccccgagccgtcgccgccgtcgctcgcggacgcggtccgcgccttcaccacgggctccatgtccgccgaggacttccagcaggtcttctcggcctcgaaggtgtactgcccgcgcggcgacaaccccggcttcctcgcgctgcacaacacccagcagcccgtgatcccgatgttcacctcgctcaaggagctgcgccggtacgcgggcaaggagtccaagtacttcgtgatcaccggtgccgaggtgatcgacctgctgccgaccgggtacgggttcgtgctcgacatggagggcgagcaccggatggtgttcgacgccaaggcggtcgagcagatggtcgacttcgccatgcgccgtatgtacggc

SEQ ID NO: 4376 - DNA, 969 bp, Streptomyces avermitilis
  CDS (1)..(969)
atgcctgcagtgaccgtcgagaacccgctgaccctgccccgcgtggtcgcgtcggccgacgccgtggctcgtcccgtactcgccgtgacgaccgcgccgagcggcttcgagggcgaggggttcccggttcgccgtgcgttcgccgggatcaactaccgccacctcgacccgttcatcatgatggaccagatgggcgaggtggagtacgcgccgggcgagcccaagggcaccccctggcacccgcaccgcggcttcgagaccgtgacctacatcctcgacggcatcttcgaccaccaggactccaacggtggcggtggcaccatcaccaacggtgacacccagtggatgaccgccggctcgggccttttgcacatcgaggcgccgccggagtccctcgtcatgtcgggcggcctcttccacggcatccagctctgggtcaacctgcccgccaaggacaagatgatggccccgcgctaccaggacatccgtggtggtcaggtccagctgctgagcacccccgacggcggcgcgctgctgcgcgtcatcgccggtgagctcgacggtcaccagggccccggcatcacgcacacgccgatctccctggtgcacgccacggtggcgcccggcgcggaggtcaccctcccgtggcgcgaggacttcaacggtctggcgtacgtcctcgccgggcgcggcagcgtcggtacggaccgccgtccggtgcacaccggtcagacggccgtcttcggcgcgggctcgtcgatcacggtccgcgcggacgagaagcaggacgcgaacacgccggacctcgaggtcgtcctcctgggcggtcagccgatccgcgagccgatggcgcactacgggccgttcgtcatgaacacccgcgaggagctccagcaggccgtggaggacttccagaagggccgcctcggcacgatcccggcggtgcacgggatggccgagggcgggctg

SEQ ID NO: 4377 - DNA, 1041 bp, Streptomyces avermitilis
  CDS (1)..(1041)
gtgcagctactccccgaaggcgcccggcggctggcggcctggtgtgccgtcatcctgctcgtcgccggggtcgggtgggtcggggtccagctgtgcggggagttgcgcaccgccgtcgtacccgtgctgctcgcgctgctggggaccgcgctcctcgggcccctccaccgcaggctcgtcagggtcggcgtgaaccggtcgctggccgccggcatcacctgtgtcgcggtcgtggccgtcgtcggcggcgccgtgtacatcgtcgtcgccgcgctcctcgacaccggcgacgagatcgtcgcctcgctcaagcgggcggcgcagtccgtcgccgcccacttcggggccgccgggacctcgctggacgacctggcctccaacgcgaaggaacttctcaccaagttcggcgggacggccgcctccaacgtcatcagcggcgtcagtgtcgtcggcgagagcatcgccatggccgtactggccctgctgctcgtgttcttcttcctgcgcgactcccaccgggccgccgggctgctgcggtcgctcgccccgggcggcaccgccgacaccgtcgaggcgatggcccggcgggccttcgaggccgtcgagggctttatgcgcggcacgacgctcatcgcgttcatcgacgccgtgtgcatcaccgtcgggctgctgatcctcggcgtgccgggcgcggtcggcctcggcgcgctggtcttcgtcggcgcgtacatcccctacctcggcgccttcatctccggcgcgctggcggtgctggtggccctcgccgaccgggggttcgtcatcgcgctgtgggcgctcggggtggtcgccgcggtgcaggttctggaagggcatgtgctccagccggcgatccagagccggaccgtgcagatgcatccggcggtggtgatgctcaccatcacgggaggggcctcggtcgccgggatcctcggcatgctgctcgccgtacccctgacggcggccgcgttcgcggtcgtgcacgaacttcgtgcgcggtacgcggcggacaccccccagcca

SEQ ID NO: 4378 - DNA, 2142 bp, Streptomyces avermitilis
  CDS (1)..(2142)
atgcgcactggtgagcccctgcccgccgtgggggacgtgctgaccgccctcgcgaccggactgtggcgttgggacgacgccgccggactggtcaccgtggacgccgaggccgctcggctcctcggtctgccccccgagccgacgacgctcacccaggccggcgtccgcgcccgtttccaccccgtcgactggaacgaggtcgacggcgtcgtccagctcgccgtcgccgagggcaccctcgccgaggtgcggatgcggatcatggacgagcacggccgggtgatccgtaccgtacgcagccgctccaagccgtcgaccgaccccacgaccggggcgtacgagctggtcggcacccttcaggaggtcaccgagcccccgccgggcaccgccgcgcgcaccccggtcaccggcgactggcggcgctcgcgcgaggcgttcctgctggatgcggggcgggcgctggccgaggcgcggtccacggcggaggtgctgcgggtcgcggcgggcctgtcgatgccggggttctcaccggacgggctcgcggtcttcggcgcggagggcgaccggctcaccgtcataggccaccacgggcaggcgccgggtgacgagaacccgtttctgaacatgccgctggacacggactacccggccgcggaggtcgtgcgcaccggacgcgccgtctacctctcctcccaggccgactacaaggcccgctacccggcgtcctggccgctcgcccagcacttcgaccggcagtcgtgggcgttcctgcccctcacggtcgcggggcgcacgctgggcgcgtggatggcggcgttcgcctaccccgtcaccttcacaccggacgagcgttccgtcctcaccaccgtggcccggatgctcgcgcaggccctgtcgcgggcgggcgccgccgagtcggagcgggagcttacggacgggctccagcggtcgatgctgccgacgctgggcccggagatacccgggatggcggtcgccgcgcgctatgtaccgaccggcggcggactccaggtcggcggcgactggtacgacatgatcccgctgcccggcggcagccgcttcgcgctggtcatcggcgacgtccagggacacgacgtacgcgcggcgggcctcatgggccagctccgcatagccctgcgcgcgtacgcctccgagggccaccgcccggacgcggtcctctcgcgcgcctcgcggttcctgtacgggatgacgtatgccgatgacggcgacgcgggcgccgacatgcgcttcgcgacctgtctgtacgtcgaggtggacccggcgaccggcgccctcgagatcgcccgcgccgggcacccggaccccgcgatccgcatgtccgacgggacggtgctcacccgctccaccgcgggcgggctgccgctgggcatcgacccggacgcggactatccgacgacgcggctcgtcctggagcccggcgagacgatgctgatctgcacggacgggctgatcgagaccggcgggcacgacctggagaccggctggcggcggatccggcggatcctcgaggagcacgacggcgacatggaggagctggccgacgcgctggtccaggccgtgcacgggccctcctcgcaccacgccaccgggccgctgacggaccggcgcgaggacgacatcgccgtactgctgctgtgccgggcgggggaccggctcggcctcggccagccggacaccctgctgccgagcgtgcgccgcaccatgctgaccgtcgcccaggccgagcccgagcgggtcgcgagcgcccggcagcagctgcgcgagctcctgcacgactgggcctccgaggaccaggtcgactcggcggtgctgctggtctccgagatgctcacgaacgtgctcgtgcacacggacgccgaagcgctcctgacggccgaggtgaccggcgagaagaaggaacggcggatacgcgtggaggtcaccgacgcgagcgacgacctcccgcaccgacggcagcccggcgagctggcctcctccgggcgggggctgatgctcgtggaactgctcgcggacacctggggcgtggacccgcggggcgaaggcaagagcatctggttcgaactgcacgaaccgcccgccgagtcctacgagacctacgcgacc

SEQ ID NO: 4379 - DNA, 1761 bp, Streptomyces avermitilis
  CDS (1)..(1761)
atgcatcggtacaggtcccacacctgcggcgagctccgcgcctctgacgtcggcagcgacgtccggctgagcggctggctgcacaatcgccgagacctgggtggcatcctcttcatcgatctgcgcgaccactacggcatcacgcagctcgtcgcccgccccggcacccccgcctacgaggccctcgacaaggtctccaaggagtcgacggtccgcgtcgacggcaaggtcgtctcgcgcggcacggagaacgtgaacccggacctgccgaccggcgagatcgaggtcgaggtgagcgaggtcgagctgctcggcgcggccgccccgctcccgttcacgatcaacgccgaggacggggtcaacgaggagcggcgcctggagtaccgcttcctcgacctgcgccgcgagcgtatgcaccgcaacatcctgctgcgtacggccgtgatctccgcgatccgtcacaagatgacggcgctgggcttcaacgagatggcgaccccgatcctcagcgccacctcccccgagggcgcgcgcgacttcgtggtgccctcccggctgcacccgggcaagttctacgccctgccgcaggccccgcagcagttcaagcagctgctgatgatctccggcttcgaccgctacttccagatcgcgccctgtttccgcgacgaggacgcgcgcgcggaccggtcgccgggcgagttctaccagctcgacgtggagatgtccttcgtcgagcaggaggacgtcttccagccgatcgagaagctgatgacggagctgttcgaggagttcggtggtggccgtcacgtcacctctcccttcccgcgcatcccgttccgcgaggcgatgctgaagtacggctcggacaagccggacctgcgggcccagctggagctcgtcgacatcaccgacatcttcgagggctcggagttcaaggcgttcgccggcaagcacgtacgcgcgctgccggtgccggacgtgtccggtcagacgcggaagttcttcgacggtctcggtgactacgcggtcgagcagggcgcgaagggcctggcctgggtgcgcgtcggcgaggacggttcgctgaccggcccgatcgccaagttcctcaccgaggagaacgtcgccgagctgaccaagcgcctctccctggcccccggccacgccgtcttcttcggcgcgggcgagttcgacgaggtctcgaagatcatgggcgcggtgcgggtcgaggccgcgaagcgctcgggcaacttcgaggagaacgtcttccggttctgctggatcgtcgacttcccgatgtacgagaaggacgaggacaccgggaagatcgacttctcgcacaacccgttctcgatgccgcagggcggtctggaggccctggagacccaggacccgctggacatcctcggctggcagtacgacatcgtctgcaacggtgtcgagctgtcctccggcgcgatccggaaccacgagcccgagatcatgctcaaggccttcgagatcgcgggctacgaccgggacaccgtcgaggagcagttcgcgggcatgctccgcgcgttccgcttcggcgccccgccgcacggcggcatcgccccgggcgtggaccgcatcgtcatgctgctggccgacgagccgaacatccgcgagacgatcgccttcccgctcaacggcaacgcccaggacctgatgatgggcgcgccgacggagctggacgagacccgcctgcgcgagctgcacctttcggtacggaagccgcagccgaag

SEQ ID NO: 4380 - DNA, 873 bp, Streptomyces avermitilis
  CDS (1)..(873)
gtgaccggtggcgcggccatcgcggccgtgggcgtgggcggcggactggccgtcaacgccttcgcggacgaggcgacctccgacgtctcctcttcgtcgggctccgagacgtgttacaccctcacctcggagaccaccgagggcccttactacatcgacgccgacaagatccgccaggacgtcaccgaggacgaggagggcattccgctgaccctcaccctcaaggtgatcgacgcggacacctgcaagccgctgcggaacgcggccgtggacatctggcactgcagcgcgttgggcgtctactcgggctacgagtcgagcggcaacggcggtggcggcggtggaaacccgccgccgacgggagcccccaccggcaccccgaccggcgagcccccgaccggcggcccgggcggcggcggtggcggtcacgccgagccgacggacgacgagcgctacctccggggcacctggaagacggacaagcatggctatgtcacgttcaggacggtcttcccgggctggtaccagggccgttgcgtgcacatccacgtgaaggtgcacgtcgacggcacctggacggacgcgggttacgagggcgggcacacctgccacacgggccagctgttcttcgacgagaagtcggtgctggcgtcggcggaagtggctccgtactccacgaacgcggccacccgcacgaccctcgacgaggacaccatctacccggacaacgggcacgcgggcggcttgctgtacctcaagtacaacaagaggcacatcgcgaagggcgtccgcgcccacctgacgctgggcgtggccccggacgagacgcacgacagcacggacacgccgccgagcgcgtcggcgtccgccggc

SEQ ID NO: 4381 - DNA, 279 bp, Streptomyces avermitilis
  CDS (1)..(279)
gtggtgaagggcccggaactccaggaggccggagttccgggcccttcgggctgccgtaccgggtcaggcaggggcggccggctccgccgcgaacaggtcgtctgccgtgccggcggtgacggctcggccgagccggtggccgagggtgtcgaggtcggtcaggcctggtccgggacgtccttcggatcctcggcgaacaggtcttccgcgtcgctgaccgtgacggcctggtcgagccagcggtccagcgtgtcggggtcggcgcagtcggaaacacgc

SEQ ID NO: 4382 - DNA, 441 bp, Streptomyces avermitilis
  CDS (1)..(441)
atgcccgaaaacggcgaaccggccgacgccccggccgacgcaccgtgggagtacaccctctccatccccaacgatcctcgcgccgtcacgatctgccgccgcaccctccgcctgatcctcgccctccacggtctgccccatctcacggagtccgccgaactcgtggccaccgagctcgtcgccaacgccgtccagcacaccaaggggccggcggccatacggctccgctgggcgaaccgcgtcctgcgcatcggcgtatgggacgcggaccccaccccaccgaccccggctccgactccggcaacagcactcgcagagtccggccgcggcctggctctcgtacagggatgtgcgaacggctggggctggtaccacctgggcaggtcccacgtcccgggtggcacaggcaagttcatctggtgcgaactgaccaccgcggcg

SEQ ID NO: 4383 - DNA, 846 bp, Streptomyces avermitilis
  CDS (1)..(846)
gtgcccgcgaggattcaaccgactgctcgccaagtccgcctaggtgctgagctgcgcaaattgcgggatgctgcgggtctgacctcccggcaggcggcagcgctgctggggacgaacccggcgcagatgagccagatcgaagcgggcaacgccggagtcagcggggaacgcgtacgcaagctcggggtgcagtacgcctctgccgacatggagttggtcgacgccctggtggagatggcgacggaccgtacgcgcgggtggtgggaggagtaccgggacgtgctgccacccgtcttccaggatctggcggagctggagcaccatgccaccttcatgcgggtggtcggcactgtgcatgtgcctggcctgcttcagacccaggagtacgcacgcgcggtcttcgcctatgtcgtcccggaactccctgtggacgaactggatttgcgtgtgaggcaccgtatgcgccgcaagctggttctctcggagaggaccgtcccctacgaggcggtgatacacgagtccgtactacgtacgcgagtcgccgaccgccgagtggccgtcgctcaactcgatgagctgctcagccagtcggagcgccccaacgtcagcttgcgggtgatccccttcggtgtcgacggcttcgccggggcgggcgcgatgatgctctacgcgggcggtcgggtgccggcgctggacaccgtgcagcgcgacgccccgtatggctccgtgtttctggacgcctccgcgcaactgctggccatgcgaactctcttccgtagggtggagtcggcagccctgccgcccgccaagtcgcgggactacattcaccgattgacgaaggaactg

SEQ ID NO: 4384 - DNA, 423 bp, Streptomyces avermitilis
  CDS (1)..(423)
ttgatcggtgaggagttcgccggggctctctccgtggtgctccgggatcttcgggcgcagtgctccgtgcagccggaggtgcgtgaggacgaggagtatcccggcgtcatcctctacgcccccgacggctccggacagggcgtgtacggggagccggacggcaggcccgcggccgcgctgctcgtcgccgtcgccgaccaggtgcaggactgggccgtggaggcgctgtggggccagggcgagccggccgtgtggccgcactgtccggcgcatccgggcggtcaccccctcacggcgaccgtcgtgggcggcgcggcggtgtgggtctgcccggcaagcggtaggcccgtggggcatatcggcgggctgccccccgcggacgtcgcggacgtcgcggacctcgcgcctacgcctcgtactcgg

SEQ ID NO: 4385 - DNA, 531 bp, Streptomyces avermitilis
  CDS (1)..(531)
atgaccgagatccacacccctcgcctcctcctccgccgctggaccgacgacgacctcgcccccatggcggagatcaacgcggacccggaggtcatgcgctgggtcggggacggttcggtgcgcgatctggagctcacggcccaggacatcgagcggtgggaggaggagtgggacgaggaaggtctcggcctcttcgccgtcgaactgctggcctccggcgagctggccgggttcaccggcctgtcctggtccgagttcctgcccgacgcgctgcccgacgtgcagatcggctggcggctcggccggcagttctggggtcaggggtacgcctccgaggccgcccaggcgacgctggagttcgccctccaggaccgtggcctcgaacgcgtcgtcgccgccgtccggccgggcgacgaggcctccgagaacgtactgcgcaagctcggcatgcccgcggaacgcgagatcacgcaccccgaacacggcttccccctgaccgtgcacgccatcgacctcaccgagtacgaggcg

SEQ ID NO: 4386 - DNA, 483 bp, Streptomyces avermitilis
  CDS (1)..(483)
atggcagtaccccacgtcatcccgatcgcctaccagccgaagcaccgcacggacagcatcggtcgctacgcggacggccagttcctggcgtcggtcacgtacgcgttccccgagggcttccggccggccgacggctgggaggagcacaagcgtctctacacggtgctccacaccttcgacgccgaaggccgctaccgcgactcggagatctggtgtgccggcacctgggccgagcagcagcgcaccccggccggtgagaacggcgagaacccggtcctcgcccgagcccgcgcccacctggccaaactcctgcgcagcctcccccggcgcgcctacaccgacatcgcgatacgccccttccggctcacggtcgacggcgtcctcttcggcctgctgacgggggaggacgagggggagcactgggcggagctctacccggaccgcctcggcttcggcgagccgtgggacggccgctacgacacc

SEQ ID NO: 4387 - DNA, 1722 bp, Streptomyces avermitilis
  CDS (1)..(1722)
atggctcgacacctcatcaccagcgcccttccgtacatcaacgggatcaagcacctgggcaacatggtggggtccatgctcccggcggacgtgtactcccggtacctccgccagcgcggccacgacgtcctgtacatctgcgcgacggacgagcacggcacgccggccgagctggcggcgaaggagcggggcctcccggtcgacgagttctgcgcgcaggcgcacgacgcgcagaaggcggtgtacgacggcttcgagctggccttcgactacttcggccgcagctccagcgagcagaaccgcgagatcacccagcacttcgcccgccgcctgaacgagaacggcttcatcgaggagcgcgcgatccgccaggtgtactccccggcggacggccgcttcctgcccgaccgctacgtggagggcacctgcccccactgcggttacgacaaggcccgcggcgaccagtgcgagaactgcacgcgcgtcctggacccgaccgacctcatcaacccccgctcggcgatctccggctcgacggacctggaggtccgggagacgaagcacctcttcctcctccagtcgaagctccagcacgaggtcgaggagtgggtcgcccgccacgaggaggagtggccgcagctggcgtcctccatcgcccgcaagtggctgaacgaggggctgcacgaccgcgcgatcacccgtgacctggactggggtgtcccggtcccggccgacacctggccggagctggccgccgagggcaaggtcttctacgtctggttcgacgcaccgatcgagtacatcggggcgacgaaggagtggtcggacctggacccggagaaccgtgactggaagtcgtggtggtacgacgccgactccggcgagaacccggtccgctacacggagttcatggcgaaggacaacgtccccttccacaccgtcatgttcccggccacggaactcggcgtgcgcgagccgtggaagaaggtcgactacgtcaaggcgttcaactggctgacgtactacggcggaaagttctccacgtcccagaagcgcggcgtcttcacggaccacgcgctggagatcctccccgcggactactggcgctacttcctgatcgccaacgcgccggagtcggacgactcgtcgttcacgtgggagcacttcacggcgacggtcaacaaggacctggcggacacgctgggcaacttcgtgaaccgcgtcctgtccttctcgaagaagcgcttcggcgaggaggtccccgcgggtgccccggccggcgagtcggagacgaagctgggcgaggagatcgcggccctgctcgcggagtacgagtcgcacatggagacgctccagttccgcaaggcggccgccgccctgcgcgccctgtggtcggcgggcaactcctacctggaggagaaggctccctggctggagatcaagaccaaccccgagggcgcggcgctgaccctgcgtacggcgatgaacctgatccacctctactcggtggtctcggagcccttcatccccgcctcctccaaggccatgcgctcggcgttcgcgctgagcgaggacacggcgacgtgggtgacgcaggacgaggcgaagtccctggactcggtcccggcgggcacgccgttcaccgtccccccggtcctcttcgccaagatcactgacgaggacctggagtcgtacaaggagcgcttcggcggcgcaccggag

SEQ ID NO: 4388 - DNA, 1746 bp, Streptomyces avermitilis
  CDS (1)..(1746)
atgggcattcttactctcctgaggaacgcgttcggccgctcacgcaagggtcgtgccgccgacggggagccctcgcgggagaccacgtcggagccgaccgttccggccccggcgggcgagcgggaggctaccgcggagccggaccggcccaccgaggccccggcggaggtaccggcccaggcgtccgtggtggacgaactggtgtcggcagcgttcgacaacgtggcggtcccgaagccgagggctacggaggcaaccgaaaaggccacggaggccacggaggccaaggaaacgaaggccgaggaggccgaggagccggaggtcacagaggccgaggcaccggaggccgaggcaccggaggttgcaccggagccgacggtcgagccggagccggtggccgagaccacccctgagcccgagccggagcccgagccggtggccgagaccacccccgagcctgagccggtggccgaggtggcacccgagcccgagccgaagcccgagccggaggccgaggtggcacccgagccggagccggtggccgagaccacccctgagcccgagcccgagccggagccggcggtcgccgaaaagaccgcggagcccgaaccggtcgtcgagccggagtcggagccggtggccgagacggcccctgagcccgaaccggcggtcgagccggagcccgaccccgaaccggtggccgaagcggcccccgagccggtagccgaggtggcccccgagccgcagcccgagccggagccggcggtcgaaccggagccggtggccgaagcggcacccgagcccgagcctgcggcagaggcgacctccgagcccgaaccggcggtcgagccggcccccgagccggtagccgaggtgacccccgaaccgcagcccgagcccgtggctgaggcgacccccgagcccgagccgacggtcgaagccacccccgagcccgaaccggtggccgaaaccacccccgagcccgagcccgagccgacggtcgccgaaaagaccgcggagccagagccggagccggtggccgagcagcccaccccggaaccgtcagccgccgacggcgaccaggccccacagggccccgccacccgcgtgaagtccgacgcccccggcctgctcaccgcctacaaggccgccgccaccaccctcgagaagaacgacctcaccggcacccgggccaaggtctacctcgtcctcgaccgctccgcctccatgcgcccgtactacaaggacggctccgcccaggccctcggcgagcagaccctcgccctcgccgcccacctcgaccccgaggccacggtccacgtcgtcttcttctcgacggaactggacggcaccggcgagctcaccctcaccgagcacgagaacaagatcgacgagctccacacggccctcggccgcatgggccgtaccagctaccacgcggccgtcgaggccgtgctcgcccaccacgagaagtcggcggaccccaaggcccccgccctggtcgtcttccagacggacggcgccccggacgccaagaccccggccacccaggccctcacggacgcggccaagaaccaccccaccgtcttcttctccttcgtcgccttcggagagcacgacaacaaggccttcgactacctccgcaagctgaagaccggcaacacggccttcttccacgcgggcccgaccccgcgcgaactcacggacgccgagctctacgagggcgtactggcagcctggcgcccg

SEQ ID NO: 4389 - DNA, 2100 bp, Streptomyces avermitilis
  CDS (1)..(2100)
gtgcgcagactgctgccgttgatcggaacgcccgcctcgcatcccggtggccggtccgccctgacctgtcgcttccggtgcggtgacgcctgcttccaagaggtgcccaacaccagcgccaaccaatatgtcggcgatgtcatcgcgggcgcgctcagccggcgctcgatgatgcgggccgccgccgtcgtcacggtcgccgccggcgcgggtaccgccgcggtcgcccgggccccgcaggcgcaggcgcaggccgcgaccgggaccccgtacgcggcgcagcccaccgcgcagcccaccgcgcagtccacctcgtcccggcgcggcgcgcgcgggcttcggttcacgcccgtcgcccccaacaccaccgacgccgtcgtgacccccgacggctaccggcagaacgtcgtcatccgctggggcgagcccatcctgcgcggtgccccggccttcgacccggagaaccagaccgccgaggcccaggccggccagttcgggtacaacaacgacttcctcgccctcctgcccctgcccggcgagcgggggcggcagctgctcgtcgccaaccacgagtacaccgacgagatcctgatgttccgcgggtacgacgccgccagcccgacccgccggcaggtcgaggtcgcctgggccgcccacggtctgtccgccgtcgtggtggaggaggaccgcgggacggggaggctcaccgccgtcacccggcaccacctcaaccggcgcgtcaccgccaccaccgagttccggctcaccgggcccgccgccggctccgccctcctcaggacgtccgccgacccgaccggccgcaaggtcctcggcaccctcaacaactgctccggcggtacgaccccctggggcacgaccctccacggcgaggagaacttcaaccagtacttcgcgaacggctcccgccccaccgacacgcggtacggcatcggcaccggcgccaccgagcgcaagtgggagcggttcgaccggcggttcgacatcgcccaggagcccaacgaggtgcaccgtttcggatacgtcgtcgagttcgacccgtacgaccccgcctccacgccccgcaagcacaccgcgctcggccgcttcaagcacgaggccgcgaccgtgcggctcacggacgacgggcgcccggtcgtctacaccggcgacgacgagcgtttcgactacttctacaagttcgtcggcagcaagcggatgcgccacggcacctcccgctccgcgcgtgagcacaacctctcgctcctcgacgagggcacgctgtacgtcgccaagctgaccggtgactccccggccaccgacatcgacggcagcgggaagctgccgggcgacggggagttcgacggcggcggcagctggatcccgctcgccaccgccaccgccggcggggccgtgtcccacgtcgaggggatgacggccgaggaggtcttcgtcttcacccggctcgccggcgacaaggtgggcgccaccaagatggaccgcccggaggacatccagccctcgccgcacaccggcaaggtgtacgtcgcgctgaccaacaactccaaccgcggcaagaccggctacgcgcccgccgacgaggccaacccgcgcaacgccaacaagcacgggcacatcctggaactcacggaacgccacagccggcccgaaagcctcaccttcggctggtcgctcttcctcgtcgcgggcgacccggccgactcgtccacctacttcgcgggcttccccaaggaccgggtcagcccgatctcctgcccggacaacgtggccttcgacccgcacggcaacctgtggatctccaccgacggcaaccagctcggttcccacgacggactgttcggcgtcgcgaccaggggggaccggcgcggtgagctgaagcagttcctgaccgtgccgaccggcgccgagacctgtgggccgatcgtccaggaccggcgcgtgctggtcgccgtccagcacccgggcgaggtcgacggcgcgtccgtcgagaagcccgcgagcacctggcccgacggccccgggaagatcgtccgcccggccgtggtcgcggtgtggcgcgcggacggctgcgacatcgggatc

SEQ ID NO: 4390 - DNA, 948 bp, Streptomyces avermitilis
  CDS (1)..(948)
atggagcttgaggtcaggcacctccgcgcgctgtgcgccatagcggacaccggcagcctgcaccgtgccgcccgccaactcggcgtggcacagccctcgttgagcacgcagttgcgccgcatcgaacaggagctgggcggcgagctgttcacccgcgagcgcaccggctgccgccccaccccgctcggccggaccgtcctgggccgggcccgcccgctgctggccgaaatgcgcaccctggtcgccgaggcgcgggccgccgccgcggacgagccccagctgcgcatcggctccaccgcgagccgcgccctcgcgggctggctgcgccgcctgcgcgtccgtcgcggcgaaccccttctccagatggacgtctccgcgaacgcgctgctcaacctggtcgccgagggccgcctcgacgtcgccttcgtgcacgaggtggagggctgcccgctgcgcgtcccggacgggctgcggctgcgcgtcctggtggagcgggagccccagttcgtctccctcccccacgaccatccggccgccggccgccccgtcgtccacctctccgacctggccgcggaccgctggatggtggacccgaccgtcgacggcgagtgggacgccgtgcaccggatgctgcgcgcggccgggctcaacccgcgcatcctgcacggcgattaccacacggccgcgaccctggtggccaccggcgaggtcgtcacggtctgccagccgacctccccgtcccgccccgagatggcggtccgccggctgcacggcgaccccctcggcgtacggctgctggtggcggcccgcacggaggcggaactggacggcgtcttcccggaactggcggaggcgtactgggagacggcgcgccaggcaccggcataccgcgagtggctggaacgcgtcgcgtcccagccactgggccccgatgccgtggccgtctgc

SEQ ID NO: 4391 - DNA, 681 bp, Streptomyces avermitilis
  CDS (1)..(681)
atgcgcatgtccacgtccgccctcgcggcggctgcggtcggtctgagtctcgcgaccgcctcgctgagcatggccgtaccggccacggccgcgcccgtcgcaccggccgccgccacggcgtactcgggctacaccggctcggccgcggaggccaaggccaaccaggcgttcttcgaggccgtcatcaagtccgtcgccgagaagcgcgccgcccagccgagaagcgccgcggccgtcaccgtcgtgtacgacgcctcccgcgcgccctcgttcagctccgtgatagcccgcagcacccagatatggaacggctcggtgtcgaacgtgaagctccagtcgggctccgcgtcgaatgccgacttcagctaccgcgagggcaacgactcccgtggctcgtacgcctccacggacggtcacggcagcggctatgtcttcctcgactacgcgcagaaccggcagtacgactccacccgcgtgaccgcccacgagaccgggcacgtgctcggtcttcccgaccactacaccgggccgtgcagtgagctgatgtcgggcggcggccccggcacgtcctgcaccaacgcctacccgaactcggccgagcgctcccgcgtgaaccagctgtgggtcaacggcttcgcgaaggccctcgacaaggccctccagaaggccggccgccagggc

SEQ ID NO: 4392 - DNA, 1938 bp, Streptomyces avermitilis
  CDS (1)..(1938)
atgtcccgtgcgttccccgtcagcctcacccctcccgactggctggtcaggaacctccaaccgcagcaggcacccgtcaaccgctccgccgtcgtgcgcgcctccgtggccctggccctgccgctggcgctcgggctcgctgccggccgacccgcgtacggcgcgctggcctccatgggcgccctgtccggggtcatcagcgacaccgcggacgcgtaccgcatgcggatactcaacatcgcgatcccgcagctcttcggcgcgctcggcgtcacgatcggcgcactggcgttcgggcagggctgggtcaccgtcgccgccgtcaccgcggtcgcgctggtgtccgggatgatctcgtcgatcggcgcggtcgcctccgtctccggtctgctgctgctcctcaactgcgtgatcggcgccgggctgacgttgcccggcgcctggtggctggcacccctgctgatgtccggcggcggactgctcgtcctcgctctcgccctgctcacctggcccctgcgctcgggcgtcccggaacgggccgcggtcgcggaaacgtaccgaagggtcgccgacctgctggccgcctgcgcgacggacgcgtacgacgacgcccggtacgccatgaccgcctccctcaaccagtcgtacgacctcgtgctcgcccggcgcgcccaccaccacggccgcagccccgacctcgtccggctgctcgcccagttgaacgccgccaccccgctcgtcgaggccgccccggccgcccaccaggccggaaagcggctcccggacgcgatccccaccgccgtacgccacctcgccgacgccctggagagcgactccaccggccccctcaggctcagcctgcccgagccggagggggagaccgcccgcgccgtcgaccacgccctgcggcacaccgccgacgtcgtcaccgaccagcccaccgagaagggcaccccgcacaccgtcgacgacctgggccggcccgccgccctgcccgtgcgagccgcgcgggccgcccgcaacgtcgtactgtccgccgcctcctggcgctacggactgcgcctcgccctgtgcatcggcatcgcccaggccctggtgtcgctcgtcgtggtcccgcgctcgtactgggtggccctcaccgtcaccttcgtcctgaagcccgacttcggctcggtcttctcccgggcgctgctgcgcgcgctggggacggtggcggggctcgcggtcgcggccggggtgctcaccctcgttccgcgcggctggtgggacgtgctggtgatgatgctcctcggcccgctcatcccggcgctcaccccgcgcggctacggctaccagaccgccgccatcaccccggtgatcctcctcctctccgacaccctcaaccaccagggcacgggcctgctcgtgccgcgcctggtcgactcactggcgggctgcgcgatcgcgctcgtcgccggatatctgctgtggccggagagctggcacacgcgggtcgggcagcatctcgcgaacgcggtcgccgacaccgcgtcctacgtggagaacgcgttcggcgcgggcgtcgaccccgccgcccgcccccggatgcggcgccgcctctaccgcgatctgtccgccatccgtacggagttccagcgggcgctgaccgaaccgccgcccatgggacggcgggcggccgcctggtggccgctggtcgtggccaccgaacggatcgtggacgcgacgacggcggcgcgggtgcgggtgaaacagggcgccccggccccgaccgccgccgagatcgcccaggtgaccctgcagctgcgggagttgtcggacgggctgcgcgagacgaacgtgctcgtgggggtgcgtacggacctcaccgggcccgcggacagtgtgctggagccgctgcggcaggaggtggcggcggcgcgggcgatcacctcgccccgc

SEQ ID NO: 4393 - DNA, 1011 bp, Streptomyces avermitilis
  CDS (1)..(1011)
gtggagactgcgaccgcggagcggaccggcccggccgaggtccgccgacggtctccggcccggaccctcgccgcctggctcgccacgctgctgctcaccggcgtgagcgtcgtcatgggctgccgggccaccggccgcgacggcatcacccccgttccgcagctgctcgccttcctgccctggctgctcgcccccaccggcctcgccctgctgctctttctgctcgcccgccggcgcaccggcctggtctggggcgtcctcgtgctcggcgccctcgcctggttcatcgagccgtacgggaagaccggcgaacccaccggcaccccgctcgccgagctgcgcgtcctgacctccaacgtgcagttcggacgcggcaccgactccctcgtcgccgccgtccgccgcgcacggcccgacatcgtgttcgtggaggagtgcgagtaccgctgctcggcgaccctggagcgggccttcggcgggagcgacggcacctatccctaccggcgggccgtcgagggcgccgggtccgacgggtccgtgatcctcagccggttcccgctcagggccgccgcgggcgtgcccggcaccatgggcatgccgggcgccgtcgccgacgtgcgcggccacgacgtacggctgcaactggcacatcccatgcccccgctgcccgggcagctcgacgtatggcgccgcgaactgggcaggatccgggactacgccgtcgccggtgacgaccccacgatcctcgccggtgacttcaacgcctcccaggaccacgcagccttccgccgcatcctggacaccggactgcgcgacggcgcccgcctcgccggagccgaccgcacgcccagctggcccgcgaggaccgccggcggccgtctgcgcctgggcgcccagatcgaccacgtcctggtctccccggacttctcggcgaactccgccgacttcctcggcatcgacggcaccgaccaccgcgcgctgctcgtcgatctcaccctccaccagcacgga

SEQ ID NO: 4394 - DNA, 783 bp, Streptomyces avermitilis
  CDS (1)..(783)
atggcacccttcctcgcatacgaggacaaaggcacccagcgtgacacctcgctgccgcttgtcctggtccacggccaccccttcgaccgcacgatgtgggccccccagctcgccgcgttcgcgccgtcccgtcgcgtgatcgccccggacctgcgcggctacggcgcgtccccggtcgtccccggcatcaccccgctctccgtcttcgccgaggacatcgccgccctgctggacgagctgaaggcggaccgcttcgtcctggccggtctgtcgatgggcggccagatcgccatggagtgctaccggctcttcccggagcggatcgcggggctggtcctcgcggacaccttcccgaccgcggagaccgaggccgggaagcgggcccggggcgccatggcggaccggctgctgcgcgaggggatgcgggggtacgcggacgaggtgctgcaccggatggtcgcgccgtacgcggacgccgacgtccaggcgcacgtccaccggatgatgacgggcacggaccccgagggcgccgcggcggccctgcgggggcgggcccagcgcccggactaccgcgacctgctcacccgtgtctccgtcccggccctggtcgtggtgggcgccgacgacacgttcacgccggtcgcggacgcggcggcgatgcacgcggcgctcccgggcgccacgctccgggtgatcgacggcgcggcacacctgccgaacctggagcgcccggaggagttcaacgcggccctgggggagttcctcttcagcctgtccggcgtg

SEQ ID NO: 4395 - DNA, 1434 bp, Streptomyces avermitilis
  CDS (1)..(1434)
atggcggaggactaccggcggatcgccgaccggatcgccgcggacatcgcgtccggacggctcgagcccggcaggcggctgcccccgcagcgggtgttcgcgcgccgccgcggcatcgccgggtcgaccgccggacgcgtgtacggcgaactcgtacgccgtggcctggtcgtgggggaggtcggacgcggcacgttcgtacgggcgtccccgctgccctcgggccgtgcgctcgccgagccggcgaccaccgcgccggtcaacctggagctcaactacccttccgcgcccggtcagtcggagctgctggcggccggtctcgccccgctgctgcgccccgacgtcctcgccgaggcgacccgcacggcgtccgccgcgggcacccgggccgcccgcgaggccgcggccggactcctcgccacggagggctggcgaccggccccggaccggctgctgttcgcgggcaacgcccgccaggccatcgcgggcgccctcgcgtcgctggttccgccgggcggccgactcggcgtcgagtcgctcacgtatccgctggtccgggagatcacggcgcggctgggcgtcgagccggtcccgctgcccatggacgagcagggcctttgtgcccgacgcgctggccgccgcccaccgttcggcgccgctcgcggccgtgtacgtccagccgacgctccacaatccgacatcggtgaccatgcgggcggaccggctgcgcgaactggccgacaccgtgagggacttggggctgccggtcgtcgaggaccgcatctggtcgttcctccaggaggacggcgacccgctggccgcgtacgcccccgagcgcacgtacgtcgtcgacggactgtccaagcgggtcgcgccggggctcacggtcgggttcctcgtggtgccggaggacccggaagggccggaggagggggcggggcgggacgaggccgcggccgccggggcgctgcggtcgggcgggtggacggcggggcggttcgcgctggaggcggcggtgcggtggagcggggacgggacggtcgcccggctggtcgccgcgaagcgggcggacgcggccgagcggcagcggctggtcggcgagcaccttgccgggttcaccgttcgggccgatccgcgggcgtactacgcctggtgggagctgcccgagccgtggcgggcggacacgttcgcggcggcggcggcacggcgggggatcgcggtgacaccggggcccgccttcggggccggccagggtgcggcggacgccgtcaggctcgggctcgcgtcggttccgccgcccgaactggcgcgggcgctgcggacgctcgccggcgtcgcgtgtacacgcccgtgagccaggcggccagggcgaccgtcaggccgagggccagcagcagccagcagaccgtgcgcagcgtctcggtcagggcgtcg

SEQ ID NO: 4396 - DNA, 732 bp, Streptomyces avermitilis
  CDS (1)..(732)
gtgcccgacgcgctggccgccgcccaccgttcggcgccgctcgcggccgtgtacgtccagccgacgctccacaatccgacatcggtgaccatgcgggcggaccggctgcgcgaactggccgacaccgtgagggacttggggctgccggtcgtcgaggaccgcatctggtcgttcctccaggaggacggcgacccgctggccgcgtacgcccccgagcgcacgtacgtcgtcgacggactgtccaagcgggtcgcgccggggctcacggtcgggttcctcgtggtgccggaggacccggaagggccggaggagggggcggggcgggacgaggccgcggccgccggggcgctgcggtcgggcgggtggacggcggggcggttcgcgctggaggcggcggtgcggtggagcggggacgggacggtcgcccggctggtcgccgcgaagcgggcggacgcggccgagcggcagcggctggtcggcgagcaccttgccgggttcaccgttcgggccgatccgcgggcgtactacgcctggtgggagctgcccgagccgtggcgggcggacacgttcgcggcggcggcggcacggcgggggatcgcggtgacaccggggcccgccttcggggccggccagggtgcggcggacgccgtcaggctcgggctcgcgtcggttccgccgcccgaactggcgcgggcgctgcggacgctcgccggcgtcgcgtgtacacgcccg

SEQ ID NO: 4397 - DNA, 897 bp, Streptomyces avermitilis
  CDS (1)..(897)
gtgtctctacgcgtacggagcgccctgtcggccgtgttcatcggcctcgcctgcctgctcgcgccgctcggcgcgctcgcggcctgggcgacgtacggcatcgaggacagcgcccggtacgaggcgacgaccgcgccgctcgccgccgacgccgaggtgcgggaggcggtcgccgcggccgtcaccgacggcatcatgcgggaggtgcacgtgggttcgccgctccaggagccggtgcgctccttcgtgcacgacgcggtgcgctcgttcaccggcaccgaggccttccgcaccgcctggggaaccgccaacctcgccgcgtacgacgccgtgatgcgcgccctgcgcagcgacggcgaccgcccggtcaccatcgacctcgcgcccgccacggagcggatgaagcgtcagctcgtcgaggaccaggtgccgttcgcggaccgcatcccggtcgaacacaccgagatcaccctgctcgggacccgggacctggccacgctccggaaggggttccacgtgctcgagatcgccggattctggctgcctgtcgccacggtcgtgttcgccctcacgggcatcctcgcggcggtgtgccggcgccgcgcggtgctggcgaccggcctgggtacggccctcggcgcagcgtcgctcgccggcgcggtcgccgtgggccgccggctgaccctcgcggatctgccgcccggcgcctcccgcccggccgcgggcgcgatctacgacgccctgaccgagacgctgcgcacggtctgctggctgctgctggccctcggcctgacggtcgccctggccgcctggctcacgggcgtgtacacgcgacgccggcgagcgtccgcagcgcccgcgccagttcgggcggcggaaccgacgcgagcccgagcc

SEQ ID NO: 4398 - DNA, 396 bp, Streptomyces avermitilis
  CDS (1)..(396)
gtgcccgtcgtgctcgggctcgtctacggcttctgggccgcggccatcaaccgcgacaccggaccgatcacgggctggaacatcctgttcggcttcgtgtgcgccttcgtgttcgcggcggcctggatgggcgtggcgaagacggcctcgcatctgcggcgcgaagtgcacgcgctgctgtggacggcgttcgcgggctgcgcgttcggtttcatctacagccagaccggcgcgtccgtcctgcggtccgtgttcatgtcgctggcggtcgcggcgggcgtgttcgcggtggcgttctaccgcttctacacgcacgaggacgcgcagggccaccgggtgaacgcgcagggccgcccggtgagcaccccggtgagcacggagggccacccggcgacg

SEQ ID NO: 4399 - DNA, 1257 bp, Streptomyces avermitilis
  CDS (1)..(1257)
atgaacaggcggtccggcgcaggtcagcagcgccgtgcccggcgttcttcgctcgatccgcggccccccggcgccggggggccggacgccgttcagcggcagaagctgctgcgcgtgcgcggccgcagcgtcgcctggatcccaccggtggccctgctcgccgcgatcgccgcgttcgactggaacaccacgggcgagttccgggtcatctcctgggtcgtgctcgtgcccggtatcgccgccgcgatctgcggcgtgtggggcacgctggtgatcgccgcgctcgcgctcggcacgttcgtgctcgaggacaactcctggccgcaccagtaccagaccggactgcccgacttcatcctcgtcgtcgcgggcggggcgctggccgtcctcgcctgcgtggtgcgcgtccgcggcgagcagcggatgctgcacatgcgggacatcgccgagaccacccgcagcaccgtgctgcgcccgctgccgcccggctggggcgacctcgaacacgccgccgtctatctcgccgccgacagcgaggcccgcgtcggcggcgacttctacgacatccagcccggcccgcagggcacgcggctcctcctcggcgacgtccagggcaaggggctcggcgcggtggccgcggcggcggcactcctcggcaccttccgcgagtcggcgtaccacgagcccgacctcggcacggtcgccgcccacctggaggtacggatggcgcggcacgtccggtactgcgcggcggtcggccgggacaatgacgccgacgccgaccgtttcgccacggtggtgctggtcggcttcccggagacggacccctcgtacgtggaggtcgtcaacttcgggcacgagccgccgttggtggtcacccccgaaggggtacggtccctgccggccggcgaaggcctccccgcgggcttcggcgagctggcccacggggcgacaccgcccacgctccgggtgccgctcactcccggtgagacgctgctgctggtcacggacggggtgacggaggcgcgcgacgcggccggggagttctacccgctgcgggaacgggtggccggcgcggtcgccgccgaccggcgcgtcgccgagcccgcgcgcctggtgcgctacgtccgtgacggcacgctgcgccactgcggcggccgcctcgacgacgacacgacgatcttcgcggtacgccggcaccgccgcgaggaacgttccgcacgcagccccttcacgtccgttccgcccggcgccccc

SEQ ID NO: 4400 - DNA, 747 bp, Streptomyces avermitilis
  CDS (1)..(747)
atgcagcagccgtacgaattccggggggccgaggcggtggagcggggcgccggagccggagcccgcgtgctcgtcgtcgacgacgaccccaccgtcgccgaggtcgtctccggctacctcgaccgcgccgggtacgtcgtggaccgggccgaggacggccccaccgcgctcgcccgcgccgcggcgcactggcccgacctggtggtgctggacctgatgctgcccgggatggacggcctggaggtgtgccggcggatgcgcggccgcgggcccgtgccggtcatcatgctcaccgcccgcggcgacgaggacgaccgcatcctcgggctcgaggtgggcgccgacgactacgtcaccaagcccttcagcccgcgggagctggtcctgcgggtggagtccgtcctgcgccgcacccggcccgtcaccgccccgcgccccctgcacgcgtccggtctcgccctcgaccccgcggcccgccgcgccaccaaggacggcgaggaactcgccctgaccatccgtgagttcgacctcctcgccttctttctccgccatcccggccgggcgttcagccgcgaggacctgatgcgcgaggtgtggggctgggacttcggcgacctgtcgacggtcaccgtccacgtacgccggctccggggcaaggtcgaggacgacccggcgagaccccgtctgatccagacggtgtggggcgtcggataccgcttcggcaccacgccccgccaggaggcggtc

SEQ ID NO: 4401 - DNA, 1122 bp, Streptomyces avermitilis
  CDS (1)..(1122)
atgcacgacatgctgctgatcgcccttttcgccttcctcggcgccgcggcggccgggctgtgcggggcgggggtgctcgtgctgatccggcggcggtcgctcaccgtgtccctcgccgtggtctccgccgtcgccgtgaccgcgatgctcgccgggacgctggccgtggcgtgggcgatgttcctctcggcgcacgacctgaccgtcgtcacgaccgtcgtcgcgatggccgccgtcgtctccctcgccaccgccctgctcctcggccgctgggtcgtcgcccgcagccgtgaactcgcgctcgccgcccgctcgttcggcgacggcggcgacttcgccgcccccgacggcccggcgaccgccgaactcgacgccctcgcccgcgagctggcggccaccagcgcgaggctcgccgagtcccgcgaccgcgagcgcgccctggagtcctcccggcgcgaactcgtcgcctggatctcccacgacctgcgcaccccgctcgcgggcctgcgcgcgatgtcggaggcgctggaggacggggtggccgccgaccccgaccgctacctccgccagatccgcacggaggtcgagcgcctcaacgacatggtgggcgacctcttcgagctctcccgcatccacgccggcaccctcgccctctccccctcccgcatctccctgtacgacctcgtcggcgacgccctcgcgggggccgacccgctcgcccgcgaactcggcgtacgcctggtcggcgaccgcgtcgaacccgtaccggtcgaggtggacggcaaggagatgagccgggtcctggggaacctgctgatcaacgcgatccgccggacacccgccgacggcacggtcgcgatcgccgccgagcgctcgccgggcggtgtcgtcctgtccgtcaccgacggctgcggcggcatccccgaggaggacctgccgcgcgtcttcgacaccggctggcgcggcacccacgcgcgtacaccccccgcgggggccgggctcgggctcgccatcgtccgcggcatcgtggaggcccaccaggggcaggccgccgtacgcaacatccccggcggctgccgcttcgaggtgacactcccgacggcgcgggcacaaccccagcca

SEQ ID NO: 4402 - DNA, 1140 bp, Streptomyces avermitilis
  CDS (1)..(1140)
atgcccggaaccgtgctgctgctcgcggcctcgccggcgggcaaggggtgcctggtggacgcggcctccgtgctcccggtgctcgcggccgtcgccccgtcggtcctgtccggcacggacacggcgaacgtggtggagctggcggacccgctggagccacaggcggtcctcacccggctgcgcgccgcggcgaccgcccccggcccgctcaccgtcttcctcgccggtcagctccagctcgaccgccgccagcatctgccgcatctggccctggcccgtacgacgccgtccacggtccgctacacgggtttcccctggcactggatccgcgaggaactgcgactgcgcccgccgggcacgacgacgctgttcgtggacctgcacgcggacgcggagacctggcagcacctgcgcaccggtccgctcgacgcgggccgggccgccgcgctctacggacgcgtcgccccgcccccgccgcgccgcacggtggcgccgccggcgtacatgaaggcggtcgcgacgatcctgcgcagcggtcaccgtcccgagccgggggtcctgcacgagcaggcgctgggccgcgtcgcccacgagggtggtcacgcggacatcgtgctgacgccacccggcgggggcgcggcccttcccggcggcttcgtccccgggcccgcgtacccgcccgaacagcctcgcccgcgcactccggacgggccggccgcggcggacgtccacgccacgatcgccgccgccgtgcgggccgggcggcacggtgaggccgacgcgctcgccgcgcagtgggagcagacggccgcgagcacgcacggcgccgcctccgaagaggcactgcactggcgggaagtacgcgcggatctcgcgatgttcgcgggcgacgcggcccgcagctgccgcgcctggctgaccgtcgccggcacccggctggccgccggacaggcccccgcggaccccgccgtcgaggcggccgtcgaccgggcacaccaccagtggggccggatcgacgacccggcgcgggcccgtgaactcgggcccgcgctggccgacctgcggctgcgcgtaccgggccgccgcgagggcgccctggaccatgtccagcagcatctgcggcagctccagacgcagggc

SEQ ID NO: 4403 - DNA, 2094 bp, Streptomyces avermitilis
  CDS (1)..(2094)
gtgaaggacgacctcatgcgggggcacgacgacctgcacacgacgcgcgcggacgggcctccttatctatttcgtgcctgggggttcgaaatcatcgtgcgtatccgcaccctgccgaccgcgacggcgctcgcggtcctcttcagctcggccgcgctcgcggtcggatcggccgcgcccgcgctggccgacagcagcacgctcctcccggtccgctcgaccggtgacgtcgtggtggacggggtccaccagcgcgtcttcatcagcgacccggccggcggcaaggtcgtcgcgacggactacgcgggcacggtcctcgggaccgtcgactcgctgcccggcgcgcgcggcctcgaactgtccgccgactcgggcacgctctacgcggcggtgccgggcgccgacgcgatcgtcgccatcgacaccgcgacggccaccgaggccgagaggtacccgacgggcgccggcaccggcccggagtacccggccctcgcgggcgacaagctctggttcggctacggcggttcgggcgagggcaacatcggctcgctcgacctgtccggcgccgaccccgtggtcacgctcaagcaggacaccaaccgcacctggtacgacgcgccgatcctgggctcctccgcgggcgccccgggcacactcgtcgcgggcgcgccgggccagagcccggtggtgctcggcgtgtacgacgtctcgtcgggcacggccacgctcaccgcgcacgccttcgacccgggcaacaccggcggcggcaacctgtccgacctcgcggtcaccccggacggcaaggacgtcgtcacggccagcggcgccccgtactaccaggccgtgtacaagatctcggacctgtcggcggacggcaggtaccagacgaacacctacccgaacgcggtggacatcgccccggacggcacggtcgcggcgggcaccttctcctggtacgaccccgacgtccacgtcttcaagccgggtgtctcgacgcccgtacggcagtacgacctccccaacaccggcaccagcagcggcgccgacacgctcgcgggctcgggactcgcctggtcgccggacggcagccgcctgttcgcggtgtcgtacaacgacaaggacgtctactcgctgcgcgtcttcgacgacccgaccaaggcggccaccagcctgaccatggtcgcgccggtcaaggccacccgcggcaaggccctgtccgtcagcggcaccctgacgtccgccgaggcgctgccggccggcgcgacggtgtccgtcacccgcaccgacatggagtcgccgagcggcaagcccgtcggcacggcgacggtcgcggccgacggctcgtacacgttcggcgacaccccgccggccggcggcaaggtcacctacaccgccacgtacgcgggcgacgcgagtcactcgggcgccacggccacgggctcggtggaggtctcgcgcagcacgcccacgctgacgctgaacaacgacggcaaggtgtacgcgtacggcagcgacgtgaagttcacggcgcacctggggaccacctacaagaaccgcgcggtcgagctctgggccgacccgtacggctccgacaagccgggcaagctggtgaagtccggcacggtcaacgccgacggcaacctgtccgtcaccctcgacctgacccgtgacaccaaggtcacggccaagttcgcgggcgacgcgcgctacgcgccgaagacggcggccagcacggcgggcgccaaggtcaaggtctccacgtcgctcagcggcttctacaagaccaagtcggcctggggccacacgtactcctacttccacaagtccaaggaccccgtcgtcaacaccacgatgacggcgtacccgaaccgcaagcagaagctgacggtccaggcgtactacaacggcgcctggcacgagacggcgtcggagtacttcgcgctgagcgcctcgggcaagtcctcggtcaccctggagggcaccccgtcgacgggcatccgcttccggctccggtccgcgtacatcaacaactcgtcgggcgacaacgtgaactcgacgacgtacggcagctggaagtacctcatcttcaccagc

SEQ ID NO: 4404 - DNA, 153 bp, Streptomyces avermitilis
  CDS (1)..(153)
gtgttcagacgaacagccgcccgctactcccggagtgccgccgcggccgtcatcgccgtggccgcgctcgtggcggccgcgaacgcgggccccgcgcgggccgccaccccgcccgcccacgaggcgtcgcactcccggctcgcccccaccccc

SEQ ID NO: 4405 - DNA, 1341 bp, Streptomyces avermitilis
  CDS (1)..(1341)
atggcggaccgcgacgagccggagatcatcggccgcagagtgcagcggctgcgtgccgagcgcgggctgacccaacggcagttggccgagccggcctacacgcccgcgtacatctccaccctggaggccggccgcgtccgcgcctccgagcccgcgctgcggcacatcgccgaccggctcggcgtcgcctacgaggagctggccaccggccgccccgcccacctcgccaccgcgctgcggctgcggctgaccgacgcccagcggacgctggcgacgggtgaggccgaggccgcggcggagcagtacgcggcgctgctcgccgaggccgtggagcacgggctcgcggccgaggaggcggccgcgctgctgggtctcggcgaatgcgcgacggaggccggtgacctggtgaccgggcggcggcggttcgaggaggcggagcagcgcctgggcgacgccccgctgccgctgcgcgtccccgccatccgcggccgggcggtctcccactacctggcgggcgaactccgctacgccgtctacctgctggagtccacgctcgacgagctgaaccggacgggactgcacgacccggacgcgctgctgctgctctacgccagcgtcatcggcccgtacatggacatgggcgcccacgcgcgggccgcgcaggcggccgagttcgcgctcgcgctggcgccgcaggtcggcgacccggcgctggtcgcgcggatgcaccggtcggtggcccggacgatgctcgccgaggggcgcgccgccgaggccgacgcgtccctggtcaaggcggccgagctctaccggcagctacagatccgtacggagctggccaactgccactggatgcgcggctacctccacgcccagaacggcgagctggagcgcgccgagggcgagctgcggcaggcgcacagcatgctcgccgcccagcgggccgcgctctacagcagccaggcggccgtggagctggcggacgtgctgcaccggcgcggcaagtcggacgaggcggcggccctcctgcacgaggtgctcggcgacctcagccccgagcggggcgcggtccactcggccggcgcgcaccgcctcctcggcatcatcgcggaggacgcccacgacacggaggcggcggaggagcactacgtacgcgcactgagcctgctggagcgggcgggcgcggcgggcgacctggccgacctgtgccggatgctgggcgacctgctgcggcgctcgggacgggtggaggcggccctggacgcgtaccgcacgggcctcggccaccgcacggccccgggcacgacgaccctgggcccggccccggcacagccgccgctg

SEQ ID NO: 4406 - DNA, 219 bp, Streptomyces avermitilis
  CDS (1)..(219)
atgacgaagccttccgcgccccggcgccacctgcctaccagccccttcgctgccccggtcgcccccgaggccaagcacttcggtctcggagaccgggtgtcgcacgaccagttcggtctggggacgatcgtcggtgtcgaggagggcatcgccatgctcgtcgacttcggctccagccaggcccgcatcctcaccccctacacccgtatgcacagcctc

SEQ ID NO: 4407 - DNA, 1620 bp, Streptomyces avermitilis
  CDS (1)..(1620)
atgagcgcccccgaggagcagggccgacggcgtcggatcccccgccgcgtccgcacccgtcgccgccgggagcgctggatccgccgcgcactcgcggcggtgctcgcgctgatcatgctgctgtgcggtgcggtcgtggtggcgtacctgctgacgggcgtccccgagccgcaccccgagacggtcagccagagcacggtcttcctggacgcggacggcgagtacctgggccggcgcggcccggtggaccgccaggacgtcccgctctccgaggtcccccgccatgtccaggacgcggtgatcgccgcggagaaccgctcctttcgcaccgactcggggatctcacccagcgccgtcgtgcgcgcggcggtgtccacgctgagcggcggcgcgcgccagggcggctcgacgatcacccagcagtatgtgaagaacgccctgctcagcccggagcagtcgctctcccgcaaggcccgcgaggcgctgatcgcggtcaaactggaccgcacccgctccaaggactcgatcctggagggctacctcaacaccgtgtacttcggccggggcgcggcaggcatcgagtcggcggcgcgcaactacttcggggtggacgccaaggacctgacgctcgcccagggcgcggcgctcgcggcgatcatcaacctgccgtcgtactacgagcgcgccggcgcggacgcgaaggtgacggcgacgctggagaagcgctggtcgtgggtcctggacggcatgcggacgtcgggcacgatcacggcgaaggagcgtctcgccgccgcgttcccggccttccggttctatccgccggggaacacggacggccagcgccagtatctgatcgacgcggccgcgacggaggccgccgaccggctcggcatcaccgcggaccagctggcccgcggcggctacacggtccgcacgacgttcgacctggcggcgcagcaggcgacggcggagcaggtgcgcggcgccccggcggcccgcaagggcacccggctgcacacggccgtcgtggcgctggtcccgggggacggcgcggtgcgggtgctgtacgggggcgcggactacgcccgtcagccgttcaacgacgccgtgaacggagcggtggaggcgggtacggccctcgacccgttcagggccgtccggttcaccggccccctcgccgccctctcccgtacggccgcgccgtccccgctccggctggcctccgcgtacgcggcgacggtggcgggcggcacctacgcgaagccgtacacggtcgcgaagatcacgcgtggcggccggacgagctacacggcgcgcccggacacgcggcgggtcgtggcgtcggtgcaggcacagatgctgacgaagtacaccggcgccgccggcgccgtgggccacttctccggcggcgcgggctcgggccccggcgcgcggaccctctggcagaccacctccggcggccgcctgagcgtcacggtggcccttttcgcggaatatccggccgcgggaaagcgcccggcccgcccggcgcacctccccgacaccgccccgtacctggccgccggactcaccgagagcgtctcgtccaagaccctcgaagtaccccccgccgggctcccg

SEQ ID NO: 4408 - DNA, 672 bp, Streptomyces avermitilis
  CDS (1)..(672)
atgagccgtacggtcccgcccccgcaccacgccgagctgcgcgaggcgttcgcccgcatggcggacgacgtcatgccgtcccccgtcccgctggcggagatcgagcgggagggccgggcccggcggcgcagacgccgtacgacggcgctggtgaccggctgtctgctggtgctcgccccgctcgcctacgtctcctggcgcctgaccccgaccgcgcccgacggcgcgacggcgccctccgcctccgtatcgggcaaggccgtgcgggtggtcgcggccggcgagcgcgtacagccgctgcccggggcggagttgtggctggcgaaggacggggagcactggtcgacgccggcgggctccggggtgtccctgcccgaggagagccgcggagcgggcggccccgccgtcaccctccggctggaggaggtgcacgaccgcttcctcctctccggtacctaccggggcacgggacaggcggcccgcgccgaggtggagacaccgtccggcacgacggcgggcacgctgctcacactggcgggcagtcccggctggagcgtctggtacgcgatcgcgccggagccgaagtccgccgggaagcggctgttcgcgacggtacgggtcacgatgtacgacgcgcgaggcgccgttctcgcgcggagcggagacggatca

SEQ ID NO: 4409 - DNA, 435 bp, Streptomyces avermitilis
  CDS (1)..(435)
gtgaccccgcaacccccctccccacgcgaggacttcgccgcgtacgccgcccacgcctggccgcgtctggtccgcaccgcccacctcctcaccggcgacccgcacgaggcggcggacctggcgcggaccgcgctggccgacgcgtacgcacgccgccggcgcatcccgcgcgacgacgccgacttccacgtacggcggacgctggtgcgcgcccatctgaggcgcagacgccccgcgcccgcaccggccccgctcgcccgggcgctggccgcgctgcccgcccggcagcgggtggtgctggtgctgcgccacggggagggcctggccgaggcggagatcgccgagacgctgggctgctcggtcggcacggtcaagtcgtacgcccggcgcggcctcgcggccctcagcgcccttcccctctccggagttccccga

SEQ ID NO: 4410 - DNA, 759 bp, Streptomyces avermitilis
  CDS (1)..(759)
gtgtgcgcgctcgggctcgcgggctgctcgccgggcgcgcaggcgcagagtgcggacacccgggcggacacggcccggcggccggcctccgcggtcacgcacaagaccgcccccaaggctctggagaggctgagcggcgcgcgcatcaacatcgccgacggccggaccgtgggcgtcggcatgccggtatccgtgaccttcgaccacccggtagcggcggccgaacgcgcccgtaccgaacggcagttgacggtcaccgtccgggccggcgcgggcatcacccggcacttcaccgtcggccgctcgctcgtcgccacggtagacgtgcgcacccacaccatgaaggtcgtgaaggacggggcgacccgcacggtcccgatcagcgcgggcgcccccggcatggacacctggaacggcacgatggtcgtctccgacaaggcgaccagcgtcttcatggacgcgcggaccgtcggctacggcgacgcgtacgcggactactactcctacgccgtccacctcaccgcctcgggcacgtacctccaccagaatcccaaggcccatacgtacgcgggccgccagaacgtcacccacggctgtgtcggcctcgccacggacggcacggcgaagcgcttctacgacgaggtgatccccggtgacgtggtgaaggtcgtcggttccaaggacacggtcgcgccgggcaacggctacggcgaccggaacgtggactgggacgactggcgggcaggcagcgcactgacg

SEQ ID NO: 4411 - DNA, 525 bp, Streptomyces avermitilis
  CDS (1)..(525)
atgacggagggccgggcggggggcatgaccgaggaagagttcgacgcgttctacgccaccgcgttccctcgcctgaccggccagctctacgccttcaccggggaccacggcgaggcgcaggacgtcgtgcaggaggcgttcgtccgggcctgggaccggcgccgggagttcctcgcggacggggcgcccgaggcgtggatacggaccgtggcgatgcggctcgcggtgagccgctggcgccgggcgcgacgctggctggaactggtgcgccgtaatccgccgccggagcacacacccgggccgggccccgagcgcgcccaactggtggcggcgctgcgcaaactgcccgaggtgcagcggatggcggtggtgctgcaccatctgtgcgacctgagtgtcgagcaggtagcctccgaaaccggtgctcccgtgggcacggtcaaggcccggttgtcccggggccgggccgcactggcgcgggaactggccaccggcgacggggagagggaggacgaccgtgtccga

SEQ ID NO: 4412 - DNA, 720 bp, Streptomyces avermitilis
  CDS (1)..(720)
gtgccgggggcggagatccgccgccgggccggagcgcgcaggcgccgccgtcgtacgagtgccgcggtgggcggcgcggcggccgcgctgacgctggggctggcgctggtcctgaacctcggtggtccgggggccgagcggaagccgtcgcccgccgggcgcccgacgagtacgcccagcacccaggaggcccccgtcgcgaccgtccggctcgccagccggatcctcagcgtcgacggccgcacgctgttcgtctcgcccggcaccgcccggagggacacgccgaccgggcggctgaccgtcgcggccaagtacgaggtcaagctggtgtccggcgaggacatcggcttcaagggaacgtactcctacaaggttccctggatggtcgaactgcgggcggacgacggtacgtcggtgtacctcggaggcctgtcgtccgatgagaaggcacccggcaactacgacaccacccgcggctggatcggcctgcgcgtcgtcgacgcgaagtggctgtacgggcggctggccgtcggtgacgccgtgaacatcgacggcaccgcctccccggcggactcggccacgccggacccggccggggtggacacggccacgacggaaacggccacggggggcccggccgcggcggggtcggccccggaggcatccgtccgtatctcgccgaccacggtgaccccctccccgacggcacgtaacggcacg

SEQ ID NO: 4413 - DNA, 300 bp, Streptomyces avermitilis
  CDS (1)..(300)
gtgcggatgagcgtctcgccagccatggaaatacttggtttcttcgtcgtcttcgcgcttgtgctggccggtttcgccggagtggagagcaagatcggccgagccgaccgcagagtcgcccgcgtggagaagaagctcgacctgatcctcgaccacctggggatcgaccatgtggacccgcgcatggagcgggtcgacgccctcctgcgcgacggcaggaaggtcgaggcgatcaagacctaccgcgaactcacgggcgcgggcctgaaggaggcgaaggaagcggtcgagcggatgggg

SEQ ID NO: 4414 - DNA, 381 bp, Streptomyces avermitilis
  CDS (1)..(381)
atggaaaccctgcgagagaccggaaccgagtccaccgcccacgccgacaccgtgcagaagaacgtcgccgacatcgcgcgcttcttgcaggagaacttcggccagcggctggccgcgttcgtcgcaggcatcgaggaccccaagcaggtcggcaagtggtgcagtggccagaacagcccgcgcatcgactccgaactgcgactacgggcggcataccaggtgttccgaatgatcgcgctcgccgagaatccgcacacggcacgcgcctggatgatcggcatgaacccgcagctcgaggacgactcaccggtccaggccatcgccgaggaccgccacaaggacgtcatggcggcggctcgctcgtatatcaagggcgacctt

SEQ ID NO: 4415 - DNA, 690 bp, Streptomyces avermitilis
  CDS (1)..(690)
atgcactcgtccgacgagtcccccgtcaccctcgtccccgcgccggagcgcggcgtgtggcgcctgggcaagaagggccaccccgtggagtacaaccggctggaacccgagaccagtcagggttccagcgccggccgcttcagcctcgccacctacgggatgctctactgcgcctccgacccggcaggctgctacgccgaggccctgacccgcttcagagtccagccgaagatgcgcagactcatcgggaaccactgggacaaccagtccggcaacatggggctcggccggctgggctcgggctggcgggacgaccacatcctgatcaggctcgtgcccgccaaggacgcgtggttcctcgacgtcgactccgaggccacccgcgcggtcctctcgaaggaactccacaacgagttcgaggcgtggggtgtggcgagccccctcaccgacgaccacatccacggacgcgaccgccggatcgcccgccagatcgcggcctggacggtcgcccagcgcaaccgggccggccaccgcctggcccagggcatcgcgtaccgctccggatacggcggacaccgctgctgggccgtgctgagcgacgtcgacctcgaaacggccgaacagcgccccatccggctggaggacaccgccctgcgcaaggtcgcggcggagttcgggctgaagctcttc

SEQ ID NO: 4416 - DNA, 2316 bp, Streptomyces avermitilis
  CDS (1)..(2316)
atgagcgacgccagggcctgggactccccggacgacgcgcaccggctgatcgcgaaggcgctggccgagctggtcgccgaggatccgaccattccgccgcatccctacctcagccgtcatctcgcccagcacgccgcccggggccgcgtgctcgacgacacccatgtgcccctggccatacttccctgggagtcgagcaggaacgtccgcatcctgctgcggcagacgggcgccacccagcagcaggactggctggaggcctgggcgggcatcgagccgttcgtccgcgacgccgacccggactcccgtctgacgagccttcacctggcccaccacaccgccacctgccgccgtctctcgctcaccgcgcggccggtgtccgagcggcggctggccggctcgcgcatcacccccctgtggagcgactggacggcaccggacaacgtcctggccgtctcggacaccctcgtcgagtcgctggcccacaccacgacggcccccggccggaccctgctgatcagcggggacagccacggcacgatccgcatgtgggaggcgaacggcacaccggccggagctccgctgcacacccacggcggcgccatccagcacctgctgccgctccagcacgacctgctggtgtccggcggcaccgacggggccgtacgcgtctggcacagcacccgcgggcagcagctcgtcgagcccgtacgccgcccgcacacctgggtcagcgccctcgccctgttcgaaccggcggacggcgcgcggttcctcctcgtggcccacagcgacggccacctcaccgccctggaccccgtcaccttcgagccggccgacactccgctgccggccctcgacccggcaccggcgatcctgacgcccctcgccacggccgacggcacggcgctggtcatcgctcaggggcggcgggtcgtcgtctggcggccggggcggggcgtcgtccacatctcggagcaccagggcgaggtgcgggccgtcgtggccctgccgtccgggggccggtacgccgtctgcgacgactcggggtacctcgggttctgggacgtgtcgacgggccacgagacggtcgcggcggggccggcgcacgacggaccggtcatcgccctcaccaccctggccgtggacgggcggcaaaccgtcgtctccgcgggcctcgaccacacgctgcgggtgtgggacgccgacaccggccggccggtcggcggcgccctcgaaggacacacggatcccccggtcgccctgaccacgctgccgggcgaggggcaggagctggtggtctcggccgccgcggaccacaccctgcgccgctggaagctcgccggccacggcacccgcccccggcgtcccgtgcgccggccggtgaccgcggccgcgctgcccggtccgaccgtcgtccccgccctgctggcagccgtcgccgacggggcggggaccgcgctgtggaacgtacgcacgggccgccatgtgtcccttccggccggcgagcccccggtgacggccttcgcctgggccaccgtgcacggcgacccggtcctgctcacggcccacagcgacgccgccgtgcggctctggtccctgtacgcgggcaacgccgtgaccccgagcctgcgcggcacactcctcaaccacagcctgcccgttcaggccatgaccgccttcccgcacgccggggcgaccctgctggccaccggcggcgccgacggctcggtacgcctctggcacctcggcgaccggctggagctggcccactgggacgaccacgcgctgagcgtccgtgacgtcacgctgctcggcaccggggaggacgcgctgatcgtgtcggccggctccgacgggaccgtacggctctgggatcccggcacccggcgggcgtcaggggggccggtccactgcggccagcaggtcgtgcacgccgtgacgacggtcgcaccgcatccggacgaggccgcgctgatcgcgtccggcggcgaggacggcaccgtacgcctctgggatcccaccacgcggcagcccgtcggcgacccgctcgacgcccgcgacggagccgtgaccgcgctcgcgtccttccacaccccggccggccggccctgcctggccgcggcgggccccagcggcaccatccacctgtgggacgtcgccgcccggacccatctgctgcgcatcgtgaccggcaatccgctgagcaccctggccgcccggcagacgggcgaaccgttcacggagcaccccgttctcctggccgccgggaccgcgggcgtatgcatgttcgacgtacgcctggagcgattgagg

SEQ ID NO: 4417 - DNA, 2268 bp, Streptomyces avermitilis
  CDS (1)..(2268)
atgcgacggcgggcgggcgggcttgtcaggatcgacgggacaccggcggaggacgaacggcgggcggcggggaacaccagtacgcaggccgggaacacgggttcgcggacgggggccacggagccgcggacgggggaccccggggcgcggacgggggacgaaccacccccgcagcgcaccctgttgaccgtcgccgtccgtgaatacccggacggggacgaggacttcacggccggtattgacgaacagctctccgtcgtcaccgactggtggtgcgaccccgaggccgacgagccgttccaccgggtggtccagccggagcttcacgagcgctacgacgtggagaggttcctgcacgaggcccgggtacgcgagacgggcggccaggcgttggtcctgttcgtcaccggacacggaaagctgggcgcctccggtacgcacttcctgcaactgccgaagaccgagctgcggcgtcagctggccacggccatccgcaccagcgagatcgtcgccgccgccctcgactcccgggccgagcacgtcctggtcatcgtcaacacctgctacgcggaggccatcgccggcgaactgagcgagctgcacaaggagatccggcagagcaggcgcgaacagggcagcctggacgtcatcgccacctgcgcccaggaccagctggtccaggtggggcgcttcccgtccgtgatgcgccaggtcctgcgacggctgcggaccaacgcccagatcaccacgccctggctgagcgtcggcgatctgatgacggaattcgagagcgagttacggggcgacaccgagcggcgcaggcaccggctgcggcgcatcatcgacggcggcggccagaccgtgctgaccccctgcctgcccaatcccggctaccggcccagacggcagctggtggggcccgcgcgccgccaggtcgccacgcccgccgaggacatcgacatctggctcgaccgggccagcggccgcccgcaggaggccgaccccggctggtacttcagcggccgcgaacgcctcaaccgcgaactcgccgtcttcctcacccgcccggagggagtgctcctgctgaccggaaccgccggcagcggcaagtcggccgtgctcggccgggccgtgaccctcagcgatccgctgttccgcgagaacgccgactacgccgacgccgtcaggtcggcctcgccgcggaccgttccacccgagaactcggtgtccgtcgccgtactggcccggcaccgctccgccgcggacgtcctgcgcgacctcctgctcggcctcggcgtcgcaccgcgccccctggggcccacggacgatcccgtcgacctctggggcacccagctggacacccacctggcggagcccggcgagacgctcaccctggtcgtcgacggcctcgacgaggcgtacgagcccttccggatcgtccgcgacgtgctggccccgctgaacgcccactgcgctccctcggctcccctgcccggccagcgcggcccggcgcggcagcccgcggaacccgaagggcagcggcgcaacctccggctgctcatcggggtacgcagcagccggccccccgcgcatctggcggccccccggggatccgccccgcgcaccgccctcacccggccgcccgtcacccaggaacccggcctgctcgccgcgctgtgcgagatcttccccacggcgtcggtcctgcgcacggacgacaccggcagccgggacgacatcgccgcctacgtcgaggcgctcatcggcccgaaggactgcgggagcgagagcacgcgccgggccgccgaagccgtcgccgaccgggtgtggccctcgttcctggacgcccggctggcgggcgagcagctgagggagaccaccgatccggcggtcctggccgccgacccgcggtggctcgacctgttgcaggcgggcaccatcggcctgctgcgacgcgacctgcggctggcggccgacgaggggcttccggcggacgtggcgctggcactgctgcgggccagcgccttcgcgctgggcgccggcatcccctggtcgaacgtgtggccggcgatggcgggcgccctcctcgggcggccgatcgaggaaccggaccggatgatcgacagcctgctgcgccggctctccggatatctggcccacgaccacgaggacgagcggttcgtgtaccggccggtccacgaagcactggccgagatcctccgggacccccggcaggacctgctgaccgacctgtcgggggacgccgta

SEQ ID NO: 4418 - DNA, 1371 bp, Streptomyces avermitilis
  CDS (1)..(1371)
atgggcagcgagttgtacgacacggagaaggacgccgtgatctggggcctgtcccccggtctgctgctgaaggcgtggacgacgcccgccggactgggcgcgctgcacctcacccccgacgaacgggaggggcggctgggccgggtacggccgtcgcggctgctgagaaccgccggctgggcccccgtcctcaagggccaggagccgtacaccgagctggtcaggaccgtcaccaggagcgtggccgccccggaggcggtcctcgagttcccgtacgactggcggctgtcggtggccacgaacgcccgcttcctcgcgcaggccgcgcgcgagcacctggagcggtggcgccggcaccccgcgcacaccgcggcccgcaggcaccgggtggacgagcgggagggccggctcgtcttcgtcgcgcactccatgggcgggctgctgaccctcgccgcgctgagcaccgggcccgacggcgacctcgcgggggacacccgtggggtgctcacgctcggcacgccgttccagggtgcggtcgccgcggccgtcatcctcaacaccggccggggcgcgccggttccgcttccgcgcggcaggctcaggagtctcgcggtgaccatgccgggactgcacgatctgctgccgacgtacccctgtgtggccgagggcgcggacatccgggcgctcagcccggtggacgtcgcggacctgggcggcgacaaggatctcgccgtccggtcggaggcgttccacgagggtctgcgcggccgtacgctgcccggccaccgtgccgtcgtcgggatcagccagccgacgatgcagtccctgacgctgcggcagggcgtcgtcaccgcctacgagcactgctaccggtaccaccgtgacggcacgttgctgacggacggcggcaccccgcgccgcttcgacgtcgcgggtgacggaacggtgcacaaggagtcggcctccctgacccggggcgccgtcccgttcgccctccagcacggcacgctggccaagggggaggccgcgatggaggcggtcacctcgttcctggcggaggacgagcacctggggcccacgcaggcggccgcggggatgggactgacggtgccggacttcgtcacccccggcgccgactggacgctccgcgtgcacggtgcggacagtccggcgggcctggagtgcacggtcgaggaggtgggcacggggtccgccgtcccggtgcgcgcggccctgtacgccgacgaggacgagctcgcggcgcgggtctcggtgcccgcgagcggcctctaccgcgtgaccctggactcgggcgaccgcacgcccctcacccagctcgtcctcgcgggcccggacgatctcgtcgccgac

SEQ ID NO: 4419 - DNA, 1038 bp, Streptomyces avermitilis
  CDS (1)..(1038)
gtgactcatgtgaccagtgagtccggtgtttctcttcgaccactcatccccggtacggcccccggtggcttcgcgctgcccgccgccgtcgaccgggacccggcacatgaagatggggtctgcatgtccattgcgagacgggtcaccgtaagccgcctgctggggacaggcgccgcggcgctcaccctcaccgccgtcgcgtgcggctcggcctgggccacggatacgcccggcggcgacggctgggacaactcccaccgcggctacacgtccgggcagggccccggcacggtgaccgagaccgaccgctgccagttctccctggacggcaccgtcttcaccgactcggtgcgggtcgacgaccagaacctgaagccgaccgaggacggcaaggtccacatcaaggtgcgggcggccgaggacgcgacgagctgcacggcctcgctggccgcgtaccgggcccacggcgcgaccttcgcgacctccggcgtccaggtcttccacgacttcgactcggtgacggtgaagcggggcgagaccgactcgctggacatctcggtgccggacgcgggctgcttcgcgcagatagacctgtaccggggcaaggtcaagttcgacggcgagctggatgccaaggacggcttcgagcacggtgacgtgcccaagggtccggaccgtccggtcatcaaggacaagctgatcgcggcgtggaacggcggcgcgaaggactgcaccgcccagccgccgagcaccccggagtcgaagccgccggccacgacgcccccggcgtccacgccgtccgcctcgaccccgccgaaggcgtcgactcccaagccctcgacgacgcccccgtccgacgagaagtccagcaccccgccggcggccaccccgaacggcggctcgtccaccccgcccggtgacctcgccgagacgggtggcggcaacaccctgccgctcgcggccggtgccgcggccctcctggcggtaggcgcgggaatcgtcgtggccggccgccgccgtacggcgaagtcccgctcc

SEQ ID NO: 4420 - DNA, 735 bp, Streptomyces avermitilis
  CDS (1)..(735)
atgggcatttcacggaacgcggcgggaaccctcttcgtcggtggcgccctgatgctgacactgtcggcgctcgcctaccccagcatgctcgggattcagaacacgtccagctccccgtcgcgcgtgatcgccaacaccgagtccgggccgctgaccgaggccgaccgcgacttcgtggtcaaggtgcgcgcggcggggctgtgggagttccccgccggtgaactggccgtgaagaagggcaccatcgcgtccgtccgcaccgccgggcagcacctcatcaacgggcacgtcaatctggacaagagctgcctgaagatcgcccagcagctgaacatcaccctgcccaatcaggcgtctccgcagcaacagggctttgtggcgacgctgacctcggacagcggcaagcagttcgactccgacctcgccaacatccttcgggtgacccacggccagatcttcccggccatcgcgaacatccgggccaccaccaagaacacgctggtccgccagctggccgaccaggccaacgacacggtcctcgaccacatcacggtcatggagcagaccggcctggtcgacttcgactcggtcctcttccaggagacgaccccgccgaaggacgccaagagcaaccacaccccgcccgctccccagccgggagaaccgacggtcgtcctctccccgcccgcgggcttcacgcccccgcccgccacgaccccgtctccgacggtgggg

SEQ ID NO: 4421 - DNA, 765 bp, Streptomyces avermitilis
  CDS (1)..(765)
atgccgtgtctgactgcgtggtggatccgcacggagcggtccgacgtccggaggtacggccgggacgcgggtgaagaatctttggagcaggcaaaatccgtgccgcgggaagtgtcctgggtcacatggagcggcacgcggcacgcggtacgcggtacgcagcacgaggcccgtcggcccgccacatgcgggccacatgcccgccactggttgccccgcgcccggcggaacggcaccgtggagtgcgctgttggtaccgggacacttcggaggccgtcgcccatgagcgtgatcgcctggatcgtcgagggaacctggcccgcctgcgtggacgcggcccggcggtacgcgcccgaaccggccggcctcgatctgctgtacgtcggcggcggcgacgtacccggcatcgcgcacggcgccttcgccggactgctcggccgcggccaccccgagcgcgaccccggcacccggctcgaggacctcggcgccgcctcggccgcccggctcctggacgcggccgaggaacggctcgggcgcccgtgcgggcggatggagcggtacgggcgcgtcgagcgggaggtcgtggccgccgccgagggcgcggagctgctgatcgtggcccgtgacggtgaccgtgcccggctcggcccgcacagcctcggcccggcgagccggttcgtcgtcgaccatgccccgtgcccggtgcttctggtctggccggccccggcgcccggcctggggacgatcccgccaccgccgcatccc

SEQ ID NO: 4422 - DNA, 768 bp, Streptomyces avermitilis
  CDS (1)..(768)
gtggaacagacctgtgaacggggaagaacacccatgcgcaagcaccgcatccgcaccgtcaccctggccgccgccgcactcgtggccgccctgtcgctcaccgcctgcaacggctccgacgacgcctccggggcctcctcggcgggctcctccaccggcgccccggcgaagggcaccgacacgaacggcacggcgaccggcggtaccggcggtaccggcagcacggggaacaaggggacggggaacggcggttcgtcgtcgggctccgccgactccgacgactccaagtcctcttcgtcctcttcgtcgtcgtcctcttcgtcctcgtcctccggcggcagcggcgacaagagcggctacgggcagagttgcgggaccaacgacctcacctggagctcccgttcggagtcgcaggccggcggttacatcctggtcatggcgaaagccaaggcgggcatcacctgcgtcctctccggcgatctgccggtcgtggcgttcggctccgacggcaccgaggcgagcaacgccgagcaggtggccggcgatccggtgacgctgagcggatccacggtcgcgtacgccggtgtgaacccgaagaccacgaacaacgactacggcaaggaactgaccagcatcatcgtcagtgccagcaacgacgacccgaaccccgtctccctgaagaccggcgccatcatcgtcgacaggccgatcgtcacgaactggcacacctccgccgcggacgccgtccccggcgacggcaccgacggc

SEQ ID NO: 4423 - DNA, 1053 bp, Streptomyces avermitilis
  CDS (1)..(1053)
atggccgaggtggtggaagtgtcggccgtgaccgtgccggcgcccggcggagcaccggggcggcccgcgacccgccgtccgcgcaccgcccggttcacggcgatcggcctctcgctggccgcactcgccgtggccgccgccctcaccggcatcggcccacggtggctcgacgccccggccgtcggggcctggcgcaccgtctgcctcgccatcaccatccaggcgctgcccttcctgctgctcggcacggtgctgtccggtgcgatcaacgcgttcgtaccggcgcaggtgttcaccagggtgctgcccaagcgacccgtgctcgccgtccccgtcgccagtgccgcgggtgtcgtcctgccgggctgcgagtgcgcgtcggtgccggtcgcgaacagcctgatcggccggggcgtcaccccggccgccgccttcgcgttcctcctctccgcccccgcggtcaatcccgtggtcctgaccgccacggccgtcgcgtttcccggcagcccggcgatggtgctggcccggctgctcgcctcgctcgtcaccgccgcggtgatgggctggctgtggctctggctggggcgcgaggagtggctgcgcgccgccgtccggcacaccggacaccggccggggcacagtcgccggaccgagttccgcctcggtttccagcacgacttcctgcacgcgggcggcttcctcgtcctgggagccatggccgcggccaccttcaacgtcgcggtgccgcgctcggtcctggacacgttctccggctcgccctggctctccgtgctcttcctggccgggctggccgtcgtcctcgcggtctgctccgaggccgacgcgttcgtcgccgcctcgctcaccgggttctcgcccaccgcgcggctcacgttcatggtggtcggcccgatggtcgacctgaagctgatcgcccttcaggcgggcaccttcggacgggccttcgccgtccgcttcagcgccgccaccaccgtcgtggcggtcgggtgcagcgtgctggtcggcggcgcgctggtcgggggtggtctgctg

SEQ ID NO: 4424 - DNA, 837 bp, Streptomyces avermitilis
  CDS (1)..(837)
gtgcagcgtgctggtcggcggcgcgctggtcgggggtggtctgctgtgaagcgccccgcacaggtgctgctgctggtcctcagcggcctcggtctgctgcacgcctcgctcttcagcgacctctgcctgcgctacgtcaaggagggcgtacgccccctgctgatcgcctccggcgcgctgctcctcgtcctgggcctggcggcagcggcgttcgacggcagacgcgccgacggccgacacgcccgcgaccaggcacacgagggcctcgagcgcgagcacgagggccacgggcacgagtacgggggccacgggcacgaccactccgccgcgccccgcatcgcctggctgctgttcctgcccgcgctgagcctgctcttcttcgcgccgcccgccctcggcgcgtacaccgcgtcgcgcgcgggcgaccagagcgcggtggtgcaggagcagaagcgcttcgacccgctgcccgcgacctcgcccctgccgatgaccctcacggacttcaccgcccgggtgcggcaggaccgcgagcggagcatcaaggggcgggacgtccgtatgaccgggttcgtcacgcccggcagacagggcggcggctggtacctgacccggatcatcttcacctgctgcgccgcggactcgcagtccgtcaaggtccgcatgtacggcaccgccgcgctgccggccaacacctgggtgtccgtcaccggcacctggcacccccggggagcgctgggcacgaggtccgccgaggcggccctggacgtccggcggacgaccaggatctccccgccggtcaacgcgtacacggacgatcttccgctcacaccgtcc

SEQ ID NO: 4425 - DNA, 720 bp, Streptomyces avermitilis
  CDS (1)..(720)
ttgaccaggcgcggggaaatcgcttgcccatgcggtcgtaagttcggcggcatgccgtctcgccccccacaactgccggttctcccctatcgcaaacccacccgggggcgcgactactggatcatcgacgacgtcctgccggacgtggacgctgtgcgggcccgttgtctcgccaaggacgaatggaccgaaggccatccctacaagcccgagagctggccgggcctgcggacgatgcccggcctcgaaccgggcgaactcgcccgcgtggagcggctggtgaagaaggcgaccggcgctcggagactctggcaggaagcggcccccggcggcggcaccctcaaccacaactgcgttcaggtcgtcggcagggacgagggcgaggtacgcccgcacacggattcgcgggcgctgtgccgatatgccgcggtgctgtatctcagcccgaacgtccccaaggactgcggcacgagcttctaccggcagagcctgccggggggtgtcctcggcgggaacatggtgacggcgccgcacaccaatctggtcgaagcgctgggcacgcggtacgtctcgcccgacgccttcgtcgaggacgtacgcgtgccgcagcgctacaaccggctgctgctctacacggccaacatgatgcacagcgccaccggttactggggcgtcgacctggaggagaagcgcatgacggccgtcttcttctggatggcc

SEQ ID NO: 4426 - DNA, 687 bp, Streptomyces avermitilis
  CDS (1)..(687)
ttggtcaaccggagctcaaaaccgggcaccgcggcggtcccggccggtggctggggccggtcggggagggagactggaggcacaccggccgggccgaaggctttcacggaggctttgatgcgcgtcaccgcactgccgtacgtcgatgagcacacgatggtcgtggcggcggaggccgaggacgtctggcggggtcttggcgccactttggaccggtccttctcgggtcccggcgcggccggctacgcgcggctcgtcggatgcgccgaccgtacggcgggcgggccgcggccgctcgcggagggctcgacgcttcccgggttccgggtggccgccgccgctccggggcgggagctggtactgatgggacggcaccgtttctcgtcgtacgccctgatcttccgtctcgaagcggccggtcccggccggacgcgggtgcgtgccgagagccgggccgcgtttcccggcccggcgggcgccctctaccggtggctcgtcatcgcgacgggcggacacgtggccgggatgcggcgcctgctgtcgggggtgcgccgccggtccgagcagggcgacgggagccttggcggcaccgaagaggcagcccgctcccgaaggcggggcgcggcccgccgcaccatgggcacccatgggcggccgacgcccatccgcccggagatcacggagcac

SEQ ID NO: 4427 - DNA, 813 bp, Streptomyces avermitilis
  CDS (1)..(813)
atgcccaggtggaggaggtggtggtgcgcgcgctggaggaaaacccccaagggcgcgacgcactggtcgaagcgggagctggccagggccgtggggatctccccggcgagcgtgctgcggatctggcacgccttcggcttgcagccatggcggaccgagaccttcaagatctctccggacccgcttctgatcgacaagatccgtgatgtcgtcggcctctacctcgccccgccggccaacgctgcggtgttcgcggtggacgagaagccgcagatccaggctctggaacggacggcaccggtgctgccgatgctgcccggagtgcccgagcggcgcagcttcgactacgtccggcatggcacggtcgatctgttcgccgccctgaacaccgcgacgggcagggtgatcacgaagctgtccgcgcagcaccgggccgtggacttccgggacttcctcgacgagatcgaccgccagaccgagcccggcctggcggtccacgtgatctgcgacaacctctccgcccacaaggcaccggtggtgcacaagtggctgctcgcgcatccccggttccgcctgcatttcacccccacgtactcgtcgtggatcaatcaggtcgagcggtggttcgccgaattagagcggcgctgcctggagcgcggagtgttctgctcgctggacagcctcaaggccgcgcttgaggaatggatcaaggtctggaacgaggaggcccggccgttcaagtggaccaagaccgccgaccagatcctcgaccggatctgccgttactgctcacgcatctccgaaccagctcac

SEQ ID NO: 4428 - DNA, 939 bp, Streptomyces avermitilis
  CDS (1)..(939)
gtgcactacgtcgacgcctacgaacagccgaccgcacccagcgctcccgcaggccccgcacaggaacggaacatgtccacttctccctccgcccccgccgcaccgcacccccacccgggcgcgcccgacatcaggctcatagtcaccgacatggacggcacgctgctggacggcgccggccggctccccgccgccctgtggtccgtactggccgaactgcgcagccgtggcgtgctgttcagccccgcgagcggccgccagtacgccacgctggcacggcagttcgcggacgcgggtcagggcatggtgttcatcgcggagaacggcacgtacgtcgtgcgcgacggcgtggagctcagttccgatccgctggacagcgccgtcgccgcccgggtcgtgggggcgacgcggcagctcgtggcggacggcgcggacgtgggtgccgtggtctgcgggaagaagtcggcgtacgtcgagcggaccgatgcggcgttcctcgccgaggcgcgcaagtactacgccctgctccgtaccgtcccggacgtgaccgccgtcgaggacgagatcatcaaggtggcggtcttcgacttcgggccggcggagcgtacgaccgcgcccgccctgaagccgttcgcggcgacccaccaggtcgtcgtctccggtgagcactgggtcgacatcatgaacctcacggccgacaagggcgcggcgatccgccgcctccagcaggacctgggcatcacacccgcccagacgatggtgttcggcgactacctcaacgacctcgggatgctcgacaccgccgagtggtccttcgccatggccaacgcccatccggacgtcctgcgccgggcccgccacatggccccgtcccacacggagaacggcgtcctgcgcacgatcaccgacctgctgcgcctgccgccgctcgacggccgc

SEQ ID NO: 4429 - DNA, 375 bp, Streptomyces avermitilis
  CDS (1)..(375)
atgtcgcaccctgatgatctgctcgtcgacatcgccgccctggtcgagtcggagcaaagcagtcagatgtccctcaccgtggtggtccccggagccgtcatcaccggacggctggcccccgagaccatgtggaaagagcgcgtggcggaagtgctgcgggactccgagaagctcgggttcttctccgccgtgttcaccgcgtccggcagaggcggtgaaccgccgcggagcggtgcccggcccacgcacctccacttccacgtcgcacggatcctccaggggagcttcggcatccccgacaccggcggcatgtaccgcgtcgccctggcggacgtgagcgcctggaccatcggggacatcggctactcggaccag

SEQ ID NO: 4430 - DNA, 1530 bp, Streptomyces avermitilis
  CDS (1)..(1530)
atgaaccgcacagctcgcacgaacaatggctccggccgctcccgtacggacgcgggctccggcggctccgcccggggcaaccgcttccgctcgcagggaacgggtggccgccaaggcgccccctcccgctcggccaagtccggacggaacggccgcggaggccgtcccgccgcgaccggcggggaattcgcactgccggtcaccctcaccccggccctgccggcggtcgaggcgttcgccgctctcgacatgcccgagcgcctgctgaccgcgctcggcgccgaaggcgtgaccgagccgttcccgatccaggccgcgacgctgccgaactcgctggccggccgggacgtcctgggccgcgggcgcacgggctcgggcaagaccctcgccttcgggctcgccctgctcgcccgcctggacggacagcgggccgagccccggcagccgctgggactcgtcctcgtacccacccgcgaactggcccagcaggtcaccgacgcgctcaccccctacgcccgcgcgctgcgcctgcggctcaccacggtggtcggcgggctgtcgatcggccgccaggcgagcgccctgcgcggtggggccgaggtcgtcgtcgcgacacccggacggctcaaggacctcatcgaccgggacgactgccggctggaccgcgtcgccatcaccgtcctggacgaagccgaccagatggccgacatgggcttcatgccgcaggtgaccgccctgctcgaccaggtgcgccccgacggccagcggatgctgttctcggccaccctggaccgcaacgtcgacctcctggtccgccgctacctgcacgaccccgtggtccactcggtcgacccgtccgcgggcgccgtcaccacgatggagcaccacctgctgcacgtgcacgacaccgacaagcacgccaccaccacggagatcgccgcccgcgacggacgagtgatcatgttcctggacaccaagcacgcggtggaccggctgaccaagaacctgctgtccgtcggtgtccgcgcctcggccctgcacggcggcaagtcccagtcgcagcgcacccggaccctcgcccagttcaaggacggccacgtcacggtcctggtggccaccaacgtcgccgcccgcggcatccacgtcgacaacctcgacctcgtcgtcaacgtcgacccgccgagcgaccacaaggactacctgcaccgcggcggccgtaccgcccgcgccggcgagtccggcaccgtcgtcaccctggtcctgccccaccagcgccgcgagatgacccgcctgatggccgacgccggcatcaccccgcagaccacccaggtccgctcgggcgaggccgagctgagccgcatcaccggggcccaggcgccctcgggcgtgcccgtcaccctgacgcccccgcccgccgaacgccccgagcgctcgggatcctccagccgtggacgccgtggccgccccgcccaggcccgccgccgctcctccgccccctcttcctcctccgccaaggggcgaagcagccgc

SEQ ID NO: 4431 - DNA, 201 bp, Streptomyces avermitilis
  CDS (1)..(201)
atggcatctggcaccgtgaagtggttcaacgcggaaaagggttttggcttcatcgagcaggacggtggcggcgctgacgtgttcgcccactactcgaacatcgccacctccggcttccgcgagcttcaggagggccagaaggtgaacttcgacgtcacgcagggccagaagggcccgcaggccgagaacatcgttcccgcc

SEQ ID NO: 4432 - DNA, 342 bp, Streptomyces avermitilis
  CDS (1)..(342)
atgcccgctgagaactctcccgtcgtcgacagcctcgacgacgacgactaccccgcctacaccatggggcgggccgccgccatcctcggcaccacccccgccttcctccgcgccctcggcgatgccaggctcatcactccgctgcgttcggaaggcggccaccgccgctactcccgctaccagctgcgcatcgccgcccgcgcccgcgaactcgtcgaccagggcaccccggtcgaggccgcctgccgcatcatcatcctcgaggaccagctcgaagacgccctgcgcctgaacgaggaaatgcgccgaagcagcgaccagcccaccgcggacgaaagctcc

SEQ ID NO: 4433 - DNA, 180 bp, Streptomyces avermitilis
  CDS (1)..(180)
gtgcgcacctacagcagcctcctgcccgaccgccgggacggtcacggcacggccccagcggccgcacggcaggaccagcccgggacggcgggcgccggcgagcggcacgaccatcgcgacggaggccgcggccgcttcccggcgcgccgtcgccggagccgcaccacgcacaacgaacgc

SEQ ID NO: 4434 - DNA, 471 bp, Streptomyces avermitilis
  CDS (1)..(471)
atgccggcttccgcgccggtctcgtcctcagtcgcgcagcagacacgggccgctccggtccggggcaggttccgccctatgacatccgaagccacgtaccgcccggaccgtgccgaggccgacgaccgccccgaagcccacgaccgtcccgaggccgaagaccgttcccggaccgaagaccgtccccacgctgtggaccgtccccagggtgtggacgggcagccggacaagcagggcagggtggaggtccggctcgtctccgaggaccccgcagcggcccggcgcgtcgcggacgcgctccggctgctcttctccgggggcgagcagcggagttatcccgcgggcgtcacggggacgggtgcgcggctgcatctcacgctcgacgcctcgcgggccgcggggccgctccgctcctggctcgacagcagcaggccgcccgccgaccggacgcaccagggcgagaccgcctcc

SEQ ID NO: 4435 - DNA, 423 bp, Streptomyces avermitilis
  CDS (1)..(423)
atgacactggccccgccgtcgcccggcccctccccgaccgctgtgcccggcacctgcccgaccgctgtccgcgtgcggctcgcggtgcagcctccgcatggccggcaggcccggcgcatcgacggcgcctggtggccccgctcgtacgacctgatgtccgaactccccgtgctgctcggcggattgccgcaggtctggggccagatcagtagcgtcgtcgtgaacggcggggagtggtccgcgccgcccggccggatgctcgtcgccgaccacgtcgtacgtgtgcgccggacggacttgccgcaggccccgcccaccgcctgcctgctcgcgccgggccgcggccggtgggacctgctggtggtgccgcccggcgcgtcggaggcgcaggcgcggcagctcatggccgacgcttccggattc

SEQ ID NO: 4436 - DNA, 963 bp, Streptomyces avermitilis
  CDS (1)..(963)
atggctggcgacacggctggcgacacgacgtggaccgcgccgggacccggccgtcgcgcggtactgaccctcggcgcggggacgatgctcgccgccgccctgtcccggggcgggagggcctacgccgcgacccccggtggaggggcgtccggggcgcggtccgaacggttgtacgggcggctgagggaactcgaacgggagcattccgcccgtctgggcgtgttcgcccgcgacatggccacgggcagaaccctgctgtaccgcgcggacgaacggttcccggtctgctccgtcttcaagaccctggcggccgcggccgtgctgcgggacctcgatcacgacggcgagttcctcgcccggcgcatccggtacacggagcagtacgtcaaggactccggctacggcccggtcaccggcagggccgagaacctcgcggccggtatgaccgtcgcggaactgtgcgccgccgccgtcagcgacagtgacaacgcggcgggcaaccttctcctgcgcgaactcggcggccccacggccatcaccggcttctgccgttcgatcggcgacgggaggacccggctcgaccggtgggaacccgacctgaactcggcggagccgtggcgtgacaccgacaccaccagcccccgcgccatcggaaagacgtacgcgcgcctcatcctcggtgacgtcctcccgccccaggaccggacccggctgacgaactggctgatcgccaacaccaccaacaccgcgcgtttccgggccggccttccggcggactggatcctggcggacaagacgggcggcgggaacagttacggggtcgccaacgacgtgggtgtcgtatggcctccaaaccggtcaccgatcgtcatgaccgtcctgacgaccaaacacgcggctgccggacccagcgacagcccgctggtggcgaggaccgccgagctgctggcggcggaactcacc

SEQ ID NO: 4437 - DNA, 1149 bp, Streptomyces avermitilis
  CDS (1)..(1149)
gtgcgcctgacagggtgtcgggccatggaacacctcttacggcggctgaagaccgccagcccctgggtcgtggacgcggggatcacgctgctggtacagatcgcggtgacgatgccgttcgtcatcccgcgcggccccgagctgcccgcggccacctggccggcgtacgggctcaccgcgctgggtgtgctgcccctgctgtggcgccgccgggctccggtcgcggtgctcaccgcgatctccggcgtccagatgctgtacatagcgacgctggacgggccgggccagcccctgccgtacgcggccctgatcgccgtgtacacgatcgccgtcctctccccccggcggcggcgcctggccgtcctcacggtgtccggcccgctgatcttcatcggcgtgcggatgaacaccggggacgtacgtgagctgctcttctcgctcttctgcttctgcggcgcctacgcgctcggccgcagccagttgcgcgccacacgggtcgaggccgaccaggccgccgcccgcgaacgggcccgcatcgcgcgggagatgcacgacgtgctgtcgcactcggtggccctgatggtcgtccaggccgaggccggccccgtgtcggtgcgtacggcgcccgagcgggcggaggccgcgttcgacgccatcgccgggaccggcagggacgccatgacgcagctgcgccggatgctcggcgtgctgcgtgaggacggctccggcccgcgccggccgcagccggtcctcgcggaactggccgcgctggtgcggcgcgtgtcggacagcggtgtccccgtcgcgtacgccaccacgggcgaggtacgtccgctgccgccggacatcgagaccacggccttccgggtggtccaggaggcgctgaccaacgcggtcaagcacgccgcccccagccggatcaccgcccgtctggactacggcccgcgctccctgaccatcaccgtgacggacgacggccgcggaccggcgaccgggggcggcggcaccccgggacacggcctgatcggtgtgcgcgagcgcgccgcggcccacggcggcacggcccgcaccggcccggggccgggcggccggggcttcgaggtcgaggtcgcgcttcctctcgtaggatctgccccgggggtggcacag

SEQ ID NO: 4438 - DNA, 648 bp, Streptomyces avermitilis
  CDS (1)..(648)
gtgacgatcagtgtggtgatcgccgacgaccaggaactggtgcgcagcggcttcgcgatgatcctggacgcccagcccgacatcgaggtcgtcggcgaggcgggcgacggcgcggccgccgtggcggccgtccgccggacctcccccgacgtcgctctgctcgacatccgcatgccgggcacggacgggatcgaggcctgccgccagatgtgctcctcgtccggggtgcgcgccatcatgctcaccaccttcgacgccgacgagtacgtgtacgaggcgctgcacgccggggcgagcggtttcctgctcaaggacgtgcgccgcgacgacctggtgcacgccgtgcgggtggtggcggccggcgagtcgctggtcgccccctcggtggcccggcggctgatcgccgactacacccgtcgcgggcgcaggaccgcacccgtctccggcaggctggacgtgctgaccgcccgggagcgggagaccttgctgcatctggcgcacggactgtccaacgccgagatcgcggccgcgatggtggtcagcgagcacaccgtcaagacgcatgtcggcaacgtgctgtcgaagctcgccctgcgggaccgcgtccaggcggtcatctgcgcctacgagacggggctggtcagcatc

SEQ ID NO: 4439 - DNA, 1164 bp, Streptomyces avermitilis
  CDS (1)..(1164)
atgaactcctccacccgtatcgccctgtgcgccgcactggccttcgcggtcgtcaccgggcccgccgcgtcagccttcgccgacgccggatcaccagcggcgggcacctccgcccgcgccacccagggtgccgggtccctgaacagcaccgccctgcggcaggccctcgccggccttccggacgacgacgcgacagccgccgtcgtccgggtggccggccaggacggcacctggcgcggcgtcggcggcgtccacgacacggagaccggccgcgaggcgatcgccgacgggcggttccgcgcgggcagcgtgaccaaggtcttcacggccgctgtcgtcctccagctggtggccgagcaccgggtcggcctggaccggccggtccaggactacctgaagggcctgttcccggcggaccggccgccgatcaccgtcgcccagctcctcaaccacaccagcggcatccagcccgccgacggcgccggggactccttcgccgaccagtacgcgcaccgcttcgacagcaccactccgcggcagctggtcgcctccgccctctccaagccactggagttcaccccgggcacgcagcaggactacctcaacatcaactacaccgtcctcggcctgctcatcgagaaggtgaccggtaccagctacgagcaccaggtgcagcgccgcatcctcgacccgctgcacctgcgcgacacgtatttccccggcgacgacatccgcatccgcggcgcccacaaccacggctaccaggccaccgccgacgggctcgtcgacgtgacggagtggaacgcctcggccgggtgggccgccgggaacatcatctccagcaccgccgacctggaacgcttcaccaccgccctgttcggcggcaagatcgtgccgagggctcagttccggcacatgctggaggttcccgcggggatcccgggcgccgtccagaccatgggcatgagccgtatggtgctgcccgacggcaccgtgacgtacggcaagaccggggagcgctacggctacgcgaccggcatcggggcgatcctcgacgaccacgggcgcatccggcgcaccctcgtctactcggtcaactccaccgacgccaagtccaagaacggcaacgcccgtgttctgccgatcgtgcaggcctggatgtcc

SEQ ID NO: 4440 - DNA, 390 bp, Streptomyces avermitilis
  CDS (1)..(390)
gtgttctgccgatcgtgcaggcctggatgtcctgaaccggccctcgcccccaggtcgtggacctcgcgagtgccctgcttggatcaggccatgacttctgtgggctcaccggacgggacgcgagacgcggcggaactcgcggtctggttcggcggggtgtccgtggcgtgctggttctgctgcccgttctggacgctcgtctgctttctcgcgctgccgacgggactggccggtctcgtgcgggcccgcgtcgagtaccgggcgtccacgcagggccgggcgagcaggccgcgagccgtggcgggaggggtgctgtccctgctggggtcagtggcggcggtcgcctacctgatcttcctcggcacccacccggacctgcccgcccagggg

SEQ ID NO: 4441 - DNA, 1107 bp, Streptomyces avermitilis
  CDS (1)..(1107)
atgacgaggttgatcgtcgcagcagggggagggggcgacgcggtcgcggccgcaacggtcgacgccgccctctacggcgacggggaccgggcggtgatcctcacgtacgcgtgggaccgcctgccgatcgacccggttccgggcccgcgaggcccggaccagttcaccggcctcgaagcgatcaccccggcggtccgggcggtgccggccggcgcccgcccgatcgcaccggcgggctccaccctcccgcgcctggcggcgcagctcccgcacaccttcgcgctgatcgacccgcaccacggcgccgagggcatcacccgccaactcgaggagctggtgagccacttcgcaccggagtcgatcgatctcctggacgtgggcggcgacatcctcgcccgaggcgacgagccgacactgcggagccccctcgcggacgccctgacactcgccgcgtgctgccaggtgaacgcacccgtccgactcctggtcgcgggcccgggactggacggcgaacttccgctcgacgacctgcgtggcctcctcggccccctggtccgcacgctcacggcaaaggacgtcgagccgatcggctcggtcctggagtggcacccgtccgacgccgccggaatgctcgcggccacggcccgcggggtacggggcgcctgcgaagtacgcgacgccggaccgccggtaccgctcacggacgaaggcccgactctccatgaggtcgacgtggacgaggccgtcggccgcaaccggctggcccgcgccatcatggagaccgagagcctcgacgaggtcgaggcgcacagccgcgaaatccgcggctgctcggagatcgaccacgagcgcgaccaggcggcacggctcggcgaacggccgtcggcgaagccggcccccgaggcggtcctggccgagctgggccggttcgaggccgcggcccgaagccgcggagccacccacacgacgttccgccacatcaccgagaccctcggcctcgacggctcacaacgcgacggcctccgtcacctgctgatcaacagccgcccggaacagtacgaggcaccgctgtggcgcatcacagccgaagcccgaacgaccgcggcg

SEQ ID NO: 4442 - DNA, 327 bp, Streptomyces avermitilis
  CDS (1)..(327)
atgaaccggacacgtcgtctcgcagcactcacgttcctggtcgtccccgcgctcgggctgggccccgcggctgccgcgtacgcgtcgaccaccaccgcacccggtgccgcgtcccgcgcgacgtgccacgtcgaaagggagtcgaacggcaagtaccacctctggggtgtgggattcaccggcggccagaaggtgacctactcggggtccgcctcgggcactgtctctacggacaagtcgggaaggttcgacatcggcggtctcagcgggagcaagtgggtcgtcaagacagggaagacgacactcacctgcgccaaggtcaagcac

SEQ ID NO: 4443 - DNA, 1689 bp, Streptomyces avermitilis
  CDS (1)..(1689)
atggcactcgcagacgaggaaccgatgaccagtcagaaacaccgcagccgcccgagacgtgtggcgctcgccgccggagccgcgctcaccgtcgccgtcgccggggccggggccgctcccggagccggggcggcgagcacggccgcgaagccgaagctcaagctgatcgccgcgtcgaactccgtgacgctcgagcgctgggagggggagcccggggtctatctggacctcgggacgtatgtcacggtcgacggcgcgccgctggagttcaaggtgacgcggaagtcgtacaaggaccctgtcgtcgcccagcagatcatccgcaacggaacgagcacgcagaagaaggcactgcccgccggactggtgaaggacttctccggtctgcccggctttctcgaggtgtcggtcaagaacgcggccggtgcggtggtgtcgaagagcaaggggaccttctgccccaacaacgcctccgggcgcctgcgtccggacgccccggcgacctcgcactatccggagagctgcgccaccaatccgttcacgctgggctcggtgtggggcgtcgagaagggatgggcgtccaactccagcaccgtcgactacgacacgccggtggacctgccgacgggcgagtacacggccaaggtgtcggtggccaagaagtaccgcgacctgttcggcatccccaatgaccagccgaccatcaaggtgacggtacgggagcagagtgacgggggcggagaggggatgacctcctcgcggtcctccgcccaccacggtggcgcgcactccgggcactccgcgcactccgcccaccactacggtccccgtggcgccgacgaccccacgccgcccgcgctctcccacgcgctggaggaccgcggcacggcacaccacctgggcgacggccgcgggcacaccgacggctcgcgcatcgcgcccgcgctgaagccggccgccaagcggcccaccggccgtgcgggcgtcccggcgaacgtgccgaagccggacctgcgttcgctgccggcctggggcatcgccatcaccgacggcgaggacggggacgtacccggcaaggactacctcgccttcagcgcgaacgtctggaacgcgggccccgccccgctcgtcgtggacggcttccgcagccccggcaaggacctgatggacgcgtaccagtacttctacgacgcgaagggcaagcaggtcgggtacacgcccaccggcaccatgcagtgggacccgcgggagggccacgagcactggcacttcacggacttcgcgagctaccggctgctgagcgcggaccagaccaagcaggtgcgcagcggcaaggaggcgttctgcctggccaacaccgacgccatcgactacacggtgaagaacgccaactggcacccgaacaacaccgatctgtcgaccgcctgcggcgagcagaactcgatctccgtccgtgaggtcctcgacgtcggctccggcgacacgtacacccagtaccgtcccggccagtccttcgacatcaccggcctgccgaacggcacgtactacatccaggtgatcgccaaccccgagaagcggctccaggagaccaacctgaacaacaacgtcgcgttgcgcaaggtcgtcctgggcggtacgccgggcgcccgtaccgtgaccgtgccgccgcacgacctgatcaacgccccg

SEQ ID NO: 4444 - DNA, 1185 bp, Streptomyces avermitilis
  CDS (1)..(1185)
gtgaagaacatccggaagaccggccgtggaatcgcgggcctgctgaccgccggcgcactgagcgccgggctgctcacggcgaccgccaccacggccgaggcggccaccacctgctcgggcggcgtgaacatctacggcgtgctcgacgacggcagactgacgttcagcaccatcaacccggccaccggaaacctcgccaaggtgctcgtcggaccggatctcggcttcgagccgaaggccatggcgaccctcaacttcaacaccattctggtgacctcgacctccggcgccctctaccgcgtcgacgtcaagaccaacagcagcaacctcgccctgctgaacgcgccggtgaagatagccgacagcggctggacccacgacaagctcacctacgacggtcacggccacctctacggcaccaccgccgccggtctgctgctgcgctacaacgtgaccgaggacaagcccgccggctcccagcacatcggcgcgcgcaccgagatcgacaccgggttcgtgctgaagaccctcaccgccaccggcgacgaccggctcagcgccaccaccgaggacggcaggctgctcgactacacgatcgccggcgcgggttcctggaagagcaacgccctgaagacctccggctggtccggcttcaaccagctcgtctcgcccggcggcggcctctactacggccgtctggccaccggtgccatgtactggtacaaggacgccaacccgaccgacggctccggcgccgacatctcgtaccacctcgacgacccggtcaacaccagcggctggacgcagaagctgctgtccgcgcagccgggcacctatacctgcaccaccaccgcggacacggtcgaccgcgacaacatcaccgaggtcaaggccgccggccggcagctgatgaacgacaaggactccgcctgggccacctccgcgcagtggaactgcttggagacgctctggaaccacgagagcaactggcgctggaacgcgaccaacccgtcctcgggcgcctacggcatcccgcagtccctgcccgcctccaagatggacgtcgcgggcgacgactggaaagagaacccgctcacccagatcaagtggggcctgagctacatcgacggccgctacggctccccgtgcgacgcgtgggccttctggcaggccaacaactggtac

SEQ ID NO: 4445 - DNA, 1305 bp, Streptomyces avermitilis
  CDS (1)..(1305)
atgtgccttcgcccgctcgacttccatgccgcaggagatcccatgaagctgagcaacgccgtccgccgtacctccgccgccctcgccgtcggcgcgatgtccctcggactggtcacggtcaccggcggggccgcgcaggccgccgcctcgtgcaccggtgacgtgtcgatctacggcacgctgtcggacggccggctgacgtacacgcagatcgagccgaacaccggcgaccgcaccaagacgctcatcggcccggccctcggcttcacaccgaaggccatggcgaccctcaacttcaacacggtcctggtcacctcgaccaccggcgacctctaccgcgtcgacgtgcagacgaacaacacctcgctgaccgtggccggcgtcgtgaagatctgggacggcggctggacgttcgacaagatggtgtacgacggcgcaggccacctctacggcacggtcgagggccagctccaccagtacgtcgtgtcccaggccaagccttcgggttcggcgcacatcggccagcacgtggtgatcgacaccggtttcgtcctcaagaccctcgccgcggccggcgacgaccgcatcatcgcctcgacctcgggcggccagctgtacagctacaagatcgacggtgtgggcgactggacgcgcgccacgctcaagagcgacggctggtccgcggtcgactcgctcacctcccccggcggtggcctgtactacggccgtaccaacggtggcatgtactggtaccacgacgtcgacccgaccgacggtgacggctccgacatcgcgtaccactccagcgacccggtggacgcctccggctggacccagagcctgctgtcggcctacgcgaacaactgcgcctacgtgcccccggcgccctccgccaccaccggcgagaagatagccaaggtcgccaacgcccaggtcggcaaggacttcaacgacttcgacttccactacccgggtgcctggtgcgccgagttcgtccgttacgtgtgggccaacgtgggggccaagaccagcggcgtgaccccggaggccggcagcctctacacctacgggcagaacaacggcaccctgcacagcaccccgaaggtcggcgacgccgttgtctacggctacagcggcggcggcaacgccaaccacgtcaacctggtcgtcgcggtcgacggcgactacgtcaccacggtcggcggcaacgagagcgacatggtgaagaagaccacctacaactggaagaccaacaacaacccgctgaacgcgggcgacatcgcgggcttcacctcccccgtcgac

SEQ ID NO: 4446 - DNA, 1257 bp, Streptomyces avermitilis
  CDS (1)..(1257)
atgcacgtttgcgtgctcgggcagggctatgtcggcctgcccctggccctgagggccgccgaggccggacacaccgtgaccggctacgaaccggaccggaagcgttgcgagcagctggccgccggatcgtcctacatcgaggacatcgaatccacgcggctccagcgagtgctgcgttcgggcgcctacaccgccagctcggatccgaaggacctcaagggcttcgacgttgcggtcatcaccgtgccgaccccgctgaccgaccgtgccccggatctcagctgcgtacgagaagccggcggcgtactggccgagtggctggagccgggcgccaccgtggtgcttgagtcgactacgcatccgggcaccacccgtgacttgctcatccccctgctggaggagggctcgggcctggtcgccgggcaggacttccatgtcggcttcagccccgagcgcatcgatcccggcaacgccgactggcggctggagaacacgcccaagatcgtcgccgggctcacggatgcctgcctgcggcaggtgaaggccttctacgactcggtcaccgaagtcaccgtcccggcctcggggctggaagaggccgagctggccaaggtgttcgagaacacctaccggcacgtcaacatcgcgcttgtcaatgaactctcgcggatggctcacacacttggcgtggacgtgtggcacaccctggagttggccgcgaccaagccgttcgggttcaccaagttcctgcctggaccgggcgtcggcggacactgcctgcccatcgaccctgtctacctcagccaccacgtcaaggcacggcacgggcagaccttccggctcatcgagctggctcaggacatcaacgaaagtcagcccgactatgtggtgcgtcgcttgcaggactcgctcagccgtcgctttcgccgcagcgtccacggtgctcgcattctcgccctgggtgccgcatacaagccgggaaccgcggacgcccgccagtcgccggccgtccaggtcatcgaccggctgcgcaccatgggcgcggacgtcaccgtcgtagacccctacttgtcggacggcggctccagggagatccccttcgccgctgtggaggacggcacgagcgtcgccgacttcgatgcggtggtcctgctcaccccgcatggcgagttcgacctcactcagctcgccgccgaggccgcatacgtgctcgacacccgtggcgtcatggcgacagccccgcacgtcgagcggctg

SEQ ID NO: 4447 - DNA, 1317 bp, Streptomyces avermitilis
  CDS (1)..(1317)
ttgagcacttcatcacgggcccgattcaccgtggtgaccgctgtggtggtggcggctctggccgctgccaccgtggtggtgcacctccagtcgaagagcccgatcctgacgttctactggtggctgggcacgatggtgatcgtgctctgcctggtctctttcctgaagggccggtccttcacgcacctgcccgtggcccccggtcgaacggtggccatcatccccgccttcgaggagcccacggacaacctgcaccgaacggtgtggtcgctgctggcccagacgcatccgatcgacgagatccacgtgatcgacgacggctcgaagcaacaccccgtggagcccttcgaacacccccgggtcttctggcaccggcaggagaacaagggcaagcgcggagcgcaggtcacggtgctccgccaccttcaggcggagggcaagcacttcgacttcgttctcaccatcgactcggacggcgagcctttcccggatgcactggagcagcagctccgggccatgagcaatccgaagatccaggccaccacggggatgatctacatccgcaacttcgaggagacctgggtctccagggctgcggacatcgacatcggtacctcgtgcgtgatgatgcggtcctcgcgctccatgctcggagcgctggagaccacgtcgggcgcactcgctctctaccgggccgagctgctctacgaccacctggatgcctacgaggtggagtgcggaacgggcgacgaccgttggctggcgctgcgggccctcatgcgcggtgaggtcgtggccgtcaacgaggccggcgtgatcactgacatgccgaccacgctgaagaagacctaccggcagcgcctgcgctgggcccggtcatggtggtggatgctgccgttcgtctactcccggctgtccctgaagcaactcatctcgccgaccttcggtctgctccagctcgtcatcacccctgtgatgctggcctggacactcgtgatgacgctgatgaccctgggcggccggtaccacaaccccggcgtggccctggtctacctcggggtctacctcgtggtccggtacggccagtcgggtctgtacgtactcatgcggccggacatgaccacgcgccagcggtggcgctcgtggctcgtcggaaccccgacggccgtgttcatgaacatcgtgctcctgtgccccacccgctactgggctctgttcaagctccgcgacaacgcgtggcagtcccgaggactgacggccaagacggccctgccgaagggccgccactacgccgaggcgaaggatctgacgaacgcg

SEQ ID NO: 4448 - DNA, 573 bp, Streptomyces avermitilis
  CDS (1)..(573)
gtgcttctctcagacaaggacatccgggccgagatcgacgccggacgggtccgtatcgacccgtacgacgaatccatggtgcagccctcgagcatcgatgtgcggctcgaccgctacttccgggtgttcgagaatcaccgctatccgcatatcgacccttccgtcgagcaggccgatctgacgcgtctcgtcgagcccgagggcgacgagccgttcatccttcatcccggggagttcgtcctcgccagtacctacgaggtcatctccctccccgacgacctcgcgtcccggctggaggggaagagttccctcgggcggctcgggctggtcacccactccaccgccgggttcatcgatcccgggttctccgggcacgtcacgctcgagctctccaacctcgccacccttccgatcaagctctggccgggcatgaagatcgggcagctgtgcatgttccggctcagctcgcccgccgagttcccctacggcagtgaccgctacggttcccgctaccaggggcagcgcggacccaccgcctcccggtccttcctcaacttccatcggacccaggtg

SEQ ID NO: 4449 - DNA, 507 bp, Streptomyces avermitilis
  CDS (1)..(507)
atgagtgacgtacgcgagaacctcacctacgagcggttcggcaccgctgtccgtgagctggcccaggccatcgccgacgacgggtacgagcccgacatagtgctcagcatcgcccggggcggggtgttcgtcgccggcgggctcgcctacgccctggactgcaagaacatccacctggtgaacgtggagttctacacgggggtggggacgacgctggagatgccggtgatgctcgctcccgtccccaacgccatcgacttctccgacaagaaggtgctgatcacggacgacgtggccgacaccgggaagacgctgaagctcgtgcgcgacttctgcgtcgacgccgtcgccgaggtccgcagcgccgtgatctatgagaagtcccactccctcgtgaagtgcgagtacgtgtggaagcgcacggatgagtggatcaacttcccgtggagtgtcttgcccgtagtacggaagtctggcgagcccgtgacgccttctaaggaggccatc

SEQ ID NO: 4450 - DNA, 786 bp, Streptomyces avermitilis
  CDS (1)..(786)
gtgaccacgagcgggcgcatgcgcctgctgactgacgaacagtgggctcgcctggtgccctgccttccccacaacacggggaaggcagggtgtccgttcgccgatcaccggcgcatcgtcgaagggatcatctaccggtaccgcaccgcaatcccctggagagatctgccccgcgaagcgttcggtccatggcagacggtgtcgaagcgccctcgcaggtgggcagcggacggcacctgggacacggttctggcgcagctgaccgcccaggcggactcgatccacagagtcgactggacggtctcggtcgactcgacgatcaaccgggcccaccagcacgccacgaacacggtccggccggagaaggacaccggcgccgccacctgccgcagcaagaccgaagttcctgccaccaggagtgagccggcgggccacgccataggccggtcccgcgggggcctgacgaccaaaatccatcacgccgtggacggcaacggccgcccgctggccgtcgtagtcactccgggccaggtccacgacgcgcaggtcctgccccttctgctgggcgacatccgggttccgcgactcggccgcggcaggccgcgcactacaccggacgccctgctcgcagacaaggcgtactcctcgaagcaggtccgcgcggacctcgcggcccgtggcatccgcaccgtgatccctgaacgcgccgatcagcaggccaaccgcaagagaaagggctgcagcggcggacgcctcccgcgctatggacaccgagacctacaagcg

SEQ ID NO: 4451 - DNA, 849 bp, Streptomyces avermitilis
  CDS (1)..(849)
gtgcccgtgtcgcttccccctgccctcgcactgtccctcgacctgctgtgttgcccgacgtgccgcacgcgccatctgtacctcctccgcggcgcactgcgctgtccggtcggccacaccttcgacatcgcccgccacggctacgccggcctgctgacgggcacacgcgccaccagcggcgatgacacagccatggtccaggcccggagccggttcctgtccaccggcacctacgcgcccatccgcaacgtcggggcccgcctggcgatcgataccgcgcctgagcaggccacgattgtggacgtgggatgcggcacgggctactacctggccggcgtactcgaccggctgcccggcgcccgtggtctgggtctggacacatcggtgcgcgcgctgcgctcggcagcccgtgcccacgaccgaggcgccgcggtggcctgggacgtcttccgtcccttcccgctggccgacggggtggccgatgtcgtgctggacgtgttcgccccgcgcaacccggccgagttccaccgcgtgctgcgcccgaccggccggttgatcgtggtccgtcccaccggacggcacctggccgagctgcgcgaccggctgcctgcgatggtcacgatcgacccggccaaggaacagcgcctgcaccaggcgctggaccccttcttcgaggccgccgtcaccgaagaggtggaataccccgcgaccttgtccaggcaggatgccctggacctggtggcgatgacgccgagcgcccgccatgtgagccgtgcagacctcgacgatgacggcttcctgtccgaccaggtcaccgtctccgtgctggccaccgcctaccagcctcgg

SEQ ID NO: 4452 - DNA, 1431 bp, Streptomyces avermitilis
  CDS (1)..(1431)
gtggcacgccgagtggggatctacacccgcatctcgcgggacgacgagggcgatgcgctgggtgtagcccgccagcaccgagactgcgagcgacttgcagatctccgttcctggcaggccgtgaaggtctatgaggacaacgacgtatcggcctacaagcgccacgtcgtacgcgagcagttcgaactgatgctgagcgacctaggcgccggcctcatcgacggcatcgtggcgtacgacctagacaggctcgcgcggcagccgcgagacctcgagcggctgatcgagatcttcgatgagcgcccacggctggagttcgcgacggtcaccaacgacgtcaacctcggaacgccggacggccgcaccatgtcgcgcatcatggtcgccttcgccaacaagtcgtcgcacgatgcctcgcgccgcatcaagcgcaagcatctggagttggcccagcaaggcaaggacagcggcggaccggcaccctacggatggctcaaggaagaccgaagcaaggtcgacccgaaagcagccgcagccatccgggaggcccagcgcgaaatccttgccggcgttcgcatcggcacgatccgtacgcgctggcaggagcagggcctgggcaacccccgcgcaggtaccaagcggatggctcaccaccacgtcgagcacatcctcacgagcccacgactggtcggataccggacctatcacggcgaggtcctgaacgacgaggacggccgacccgtcatgggcgagtgggaagcgatcaacacgctcgaagaatgggaagcggtgtgcgccgcagttgccgagcgaaagcagaagcagcccggcaggtcgctcgcccggaagtacatgctgtcgggtatcgcgcgctgcggcctgtgcaagacgaagatccgaggccagatcaaccaacgttggcagccaggttccaaagcgacgaagttcacctatcagtgctcagtcgtcaatggcggctgcgggaaggtgggacgcgtcggggaaccagtagacaggctgatagccgaactcgcactcgaagagcagcgggcgagagcagcggccacaaccgttccgattgaccaacggtggtcacggaatgccgaattggagcaggtcaacgacgacatcacccagctagtgaacgccgagcggtcgaagcagatcactgtgaccacgctcttgcagctccttcccggaaaggagcgacagcgcgatgaactgaagttggagcgcgcccggttctacaaggaactgaagcagtccgaggccaagggcgacgctgcgaacctgactctggacgagttcttcggtctgccgatcgaacggcagcaggagattgtgctgcacagactgtcagccgtgatcatccacccagcaggcaaaggccggcgaaggttcgaccccagcctcatcgagcctgtgtggcgc

SEQ ID NO: 4453 - DNA, 1011 bp, Streptomyces avermitilis
  CDS (1)..(1011)
atgtcacaggtcggcagcaaagccgggcccgttgccccgggcccggcacgtgactcttcgggaccaggtacgttcgattacgtggctggattcaggatcggacgcggcgaccgggacaaccgggccccgcaagggcgaccgcaacaacacccgcagcagcagccgtacggacagcaggccccgcagggcccgtcgtacggctaccccgccgcgccgccgcagcagcagtacggcggtgcacagccgtacggcggccagcagggctggccgcagccgggcggcggcgggcacggcgagccggagtacttcggcgacggcggcggacagcagggctacggccaggggcacccgcagagccccgatccgtacgcggcgaacagtccggggcacacccaggcgttcacggtcggcgaggacccgtacggccagggcgagacctaccgcgccggacaggcctccgccccgcccgtcggaccccgtctgcactggaaggacctgctgcgcggcatcgtgctcgcgcccaaccagaccttcctccagatgcgggactacacgatgtggggcccggcgctcatcgtgacgttcctctacggcctgctcgccgtcttcggcttcgacggggcccgcgcggacgcgatcaacgcgacgctctcgaacgcggtgccgatcgtcctgatcacggccgtggccatggtgctgagcaccttcatcctgggcgtggtgacccacaccctcgcccgccagctcggcggcgacggcgcctggcagcccacggtcggcctctccatgctgatcatgtcgctcacggacgccccgcgcctggtcgtcgcgatgttcttcggcggcgacgcgtcgttcgtccagatcctgggctgggcgacatgggtggcggcgggcgccctgctgacgctgatggtcagccgctcccacgacctcccgtggccgaaggcgctcggcgcgtcggcgatccagctgatcgcgatcctgtcgatcatcaagctcggcacgttc

SEQ ID NO: 4454 - DNA, 513 bp, Streptomyces avermitilis
  CDS (1)..(513)
gtgacgcgacgcacacactgcgaaacctccggggacccggaagcgcaccgccccgtcacgccacgacggtcgcgacacagccaccgcccgcaggccgcccacccctcacgcccccaccgggagacccgtatgcccgccccctgggagtacaccctctacatcccccacgacccccgagccgtaggcatctgccgccgcgcgctccgcgacatcctcaccgtccaccacctccccgccctcatcgaaccggccgaactcctggcctccgagctcctgggcaacgccatccgccacacggacggccccgccgcgctcaagctcagacagtcgggcccctcgttccgcctcggcgcgtgggacacggaccccacgcccccgacgaccacccagccgcacggtgaaacgggccgcggcctgcacctcgtcgacgcgtacgccgacgactggggctggttccaggtcaacggcacggcgggcaaatacgtctggtgcgagctgaaagccgttcccttc

SEQ ID NO: 4455 - DNA, 840 bp, Streptomyces avermitilis
  CDS (1)..(840)
atgccggcacggagcatcgtcaccgcgcgccagcaacggcttggcgcggagctgcgaaagctccgggagcgggcggggctgaccgccagggaggccgcccaggcggcgggcattgccgagagcaagatctccatgacggaggcggggcgcgtcggggtgagcgaggagcgggtgcggtacctcgcgagccagtacgcgtgtgacgacaccgagtacgtcgatgctctggtagccatggcgaacgagcgtgtacgcgggtggtgggccgagtgccgcggtcaacttccgccgagcttcctcgatttggccgaactggagcatcacgcagcgcgcttgaggtcgttcgagagcgtgcacatcccggggctgttgcaaaccgaggagcaggtacgggcgatgtacgccgcgtccgtctcggggttctccgaggagcaggtggacgcacgaaccgagttccggctgcgtcggcaaggggtgctggacaaggtccgctatgaagtggtcatccatgaggcggcgttgcgcgtcagggtcgccgatcgcaaggttgcccgcagacagctgttgcacatcgtggagcagtccgagcgcgcgcaagtcacgctcagggtcgtgccgttcgacttggacggcttcaccaggatcggtaacgcgatgctcatcgcgggtggtcctgtggagcagttggacaccgtccttctcgacagcgcgcacggagggacattcctggatgcggaggcgcagctcagccggtaccggagggtcatcgacgacgtggagcgggccgctctgggagtcgtagagtcgagggacttcgtacaccggctggctcagcacacc

SEQ ID NO: 4456 - DNA, 183 bp, Streptomyces avermitilis
  CDS (1)..(183)
atggcggcggtaagcgtgtggcagaagtcgtcgttctccagcgacgaggacgcgcccaactgccttgaggtcgccgccacccaaggagccctgcggctccgcgaaagcgaagagcccggcacggtggtgaccaccaccgcgaccgggctcgccgccctcatacgtcacatacgctcgcgtcgc

SEQ ID NO: 4457 - DNA, 1434 bp, Streptomyces avermitilis
  CDS (1)..(1434)
atgcgcagcacaacggcactcgcggccctcctgaccacggccttaaccccactgtccctgccgaccccggcctcggcggcccccgcgacgtacgcggacgacttcaacggggacgggtaccgcgacctcgtcgtcggcgcccccgatgccaccgtctcgggcaaggagtcggcgggcgccgtcgtcgtcctctacggctcggcgtccggccccggcacaaccaagaagctgctgatctcgcagaacgccacgggagtcgagggcgcggccgaggcgggcgacggcttcggctcctccgtggcctccgccgacctggatgccgacggttacgccgacctgctcgtcggagcgccctacgaggacgtgaccggtgcgaagacccggggcagcgtcaccgtgctgtggggcggcgcgcagggcctgaagggcagcgccgtcctgccggccccgagccccttctcggacggcgacaccaagggctgctcgtacggcaccggagtagcggcggtcaatccgaaggccgcgccgggcgccgccgaggtctccgtggcgggctggtgcgccggtctgcgcctgaccggcccgttcacccgggccggcaagccggcccgcaccagcctgagaacggccaccccgtcgctcgacgacgcggccctgggcgacctcgacggcaacggacgccccgagtccgtcgacatcagcgtgggcctgtccgaccacccttccgggggcgtgtacgtcaaccccccggcctcgtccgcctccccgctctccaccgacggtgacaacgtggccttgggtgacgtcaacggcgacggctacggcgacctggtcgtcggcgaccccggtgacacggtcatcgacgggactccacaggagggcaccggccacaagggcggccagatcgcgatctggccgggcggggcacacggcatcgacgccaccgccgagccgatcctgatccaccaggacactccgggcgtgccgggttccgccgagtcctacgactccttcggcgccgacgtgagcgtcgcggacgtcaacggcgacggctatggcgacatcgcggtgggcgtgcccggtgagcgcctcggctcggcccgtagtgccgggtccgtgattctcgtcccgggtcgggcgggtggccccacaggcgccggctccaccacgatcacccagaactccaccgccgtaccgggcaccgccgagaggggcgacaccttcggctcgaccgtccgcctcaccgatctcaccaaggacggcaaacccgacctggtggtcggcgcacccggcgaggacaactccaccggcggcatctgggtgttcaagggaaccacgaccggcccgtccctgaggaactcgtacagcgtcatgggcaacgcggtggggctccccaaggagcactacaccaactggtcctccgtgcagtcctct

SEQ ID NO: 4458 - DNA, 1443 bp, Streptomyces avermitilis
  CDS (1)..(1443)
atgcgcagccgcaccctcctcctggccgccaccctcaccaccggcctcctcaccaccctccccaccacccccgcctccgccgccccctcgggccggtcgggcgacttcaacggggacgggtaccgcgacgtcgcgatcgccgcccccgccgccaaggccggcggcaaggcgtgggccgggcaggtcgccgtcgtctacggcacggcgagcggcctgaacccggacaagcggacggtcatcagccagaacaccgcgggcatcccggattcggccgaggccgacgacggtttcggctcccaggtcgcgacggccgacctgaaccgcgacggctacgcggacctggtgatcggcacccccgaggaggactcgggcagcctggagtcggccggcacggtcgtcatcgtctggggttccgcgtccggactctccggcggtacgacggtcaagaaccccgagccgcagtacgggagttccttcgggctgagcatcgcggcggccgacttcaccggcgacggaaagcccgacctcgccgtctccacgcagagttccaccggaagccgttacaagatccgtctgatccgcggcccgttcaccaagtccggctcgacgggccgtgtctcctcgtactcccccggggtcgacaagccgcgactgaccgcgggcaaggtcgacaagaacgccaaggcggacctcgtcgtcaccggccggaagaccaacagcgaacacctcgccgccgccgccttctacaagggcacgtcgaacggcctgaccaagggcgccgccctgcgcgccggtacgacggcggcgatcggtgatctcgacggcgacgggtacggggacatcgtcctcggcaaccccgacgagccccacaacgagccctcgggctccaagggcggcgagatcagcgtcgtctacggcacgtcgacgggccccagcggcagccgtcgtacgacgctgacgcagagcagcgcgggagtgccggactcgcccgagtacggcgacgacttcggcgaggcggtggcggtcggggacctcgacaaggacggccgggcggacctggcgatcggcgcgcccggcgaagccttcggcgacgacgcgcactacgtctccagcgcgggtgcgatcaccctgctgcggggctcggcctcgggtctcacgaccaccggcgcggtgttcctcacccaggacagccccggcgtcccgggcgccgtggagtccgtcgacagcttcggctcccagctgctcgcctcggacgtcaacggcgacggccacgccgacctgaccgcgatcgccgcgcaggagaacgacccggcgggcgccgcgtggcacctgcccggcgcgaccggctccctctactccaccaccaccgcgacgaccttcggcccgacccacctcggcctctccaccgcccaggccggagccttcggctcggacctcgcgggc

SEQ ID NO: 4459 - DNA, 1371 bp, Streptomyces avermitilis
  CDS (1)..(1371)
atgcgcatacgccccgccgcactcgcggcactgacggccgccgccctcaccggcgcgctcctcgccaccacgggttccgcctcggccgccccctccggcctggtgggtgacttcaacggcgacggcttccaggacgtcgctgcgggcgcccccttcgccacggcgggcggcaagttcgacgccggttcggtggccgtcggatacggatcggccaccggcctcggcaccaggaagtccatcgaccagggcacctccggcgtcccgggttcggccgaggaggaggacggcttcggccggtcgaccgcggtcggcgacctcaacggcgacgggtacagcgacctcgccgtcggagccccgtacgagaaggtcggcgacgacaccaacggcggcgccgtggtgatcgtctggggctcggcgagcggtctgtcgggggccaccacggtcaaggacccggccgtctcccagcacgactactggggcgcgagcctcgccgtcgccgacttcaccggcgacggcaaggccgacctcgccgtcggtgcctccggcaccacccagtggatcatcaagggcggcttcaccaaggcgggtgcgaccggcgcgaagctcacgtacacgctccccttcgccgccgcgcgccttgtgaacctgaccgccggaaaggtcaacggcgacggcaaggccgacctggtcgtcggcgccgggaagaagctcggctccgagcgctatctggaccgcaacttcctctactacggcaccacgtcggcccccgcccggcagctggagcttccctacggcaagagcaccgccatcggcgacctcgaccaggacggctacggcgacatcgtcatcggcgagacggagagcgcgaccgagggcgacctgggctcgacgggccggagcgcgctctcgtacggcaccgccaccggcgtgaagccggccgtggagctgtcggacggcgcgtacggccgcccgtcgatcggcgacatcgacggcgacggcttcccggagctggccgtgggcgccccggcgagcggcgccgcggccgactacgcgggcgcggtcgtcgtccaccggggcaccgcggacgggcccggttccgtcgtgacgctcacccaggacaccgcgggcatccccggcaccgccgagaccaacaacttcttcggcacggccaccctgctcaccgacgtcacgggcgacggccacgcggacctcgtcgtcggctcggacaccgagaacgacggcaacggcctgctcaccttcctgaagggcaccgccgacggcgtcaccaccgccggcgccacgaactacagcccgagcgccttcggaatgtccacggcgtactacccccagctcggcatgtacctggcgggc

SEQ ID NO: 4460 - DNA, 1443 bp, Streptomyces avermitilis
  CDS (1)..(1443)
ttgcgcaagcgcacccttctcctggccgccacgctcaccaccggcctcctcagcgccctccccggctccgcctttgcggccccctccggcctgaccggcgacttcaacggggacgggttcggcgacatcgccttcgccgcgccgtacgccaaggtcggcgaccagggcatggccggctatgtggccgtcgtctacggcagcgcgaccggcctcgaccccgccaaccgcacggtgatcgaccagagttcggccggcgtgcccggcacccccgaggcggaggacaccttcggctccgcgctcgcgatcgccgacttcgacggcgacggctacgcggacctcgcggtcggcgcctcgggcgaggacgtcgacagcgacatcgacggcggtacggtcgcgatcctgtggggcggtgcgagcggcctcgcgggcggtacgacggtcaaggacccggcggcgtccgcgcacgacgagtggggccgtgtcctgacggcgggcgacttcgacggcgacggcgcggcggacctggcgtccggcacgaccgcctcgcacgcgtatgtcgtcaggggcggcttcacccggtccggcacgaccggcagcgcgcagcggatcggcctgccccagacggcgaagtacggcatcgacgccatcaaggcgggggacaccaacggcgacaagaaggccgacctcgtcctcacctaccgcaccgccctgaacgaggacggttccggcgactggtccaagggcgtcgcctacctgggcacgtccgggggcctggagacctccgtaccgcgcggcctgaacggcggcaccaccatcgcgatcggcgacatcgacggcgacggctacggcgagatcgccctcggcaacgtcttcagcacggaggacgaccacacgggcagcctcggcggcaaggtcaccgtcatccgcggttccgagggcggcccggtcaacggcgacgcgcccatggccgaactcacccaggactcccccggcgtacccggcgccgacgaagcgggcgacggcttcggcagcgccgtctccatcggcgacatcgacggcgacggctacggcgaactggccgtcggcgtcatcttcgaggacatcgacggcatcgaggacaccggctccacggtcctcctgaagggctcggccgccggcgtctcacccaccggtgcccgcaccctctcgcaggcctcctccggcgtccccggcaccgccgaggcgatggactacttcggctccgacgtcctgctgaaggacgtcacgggcgacggcaaggcggactacacggtctccgcgaccttcgagggcgagggcgtcggcgcggtcaccgcgatgctctccgacggcaccggcatctcccccgacggcgaccgcggcttcggccccaccgccttcgaccgcccggccacgtacggcgcgttcggcgcgaacctcatcggc

SEQ ID NO: 4461 - DNA, 1479 bp, Streptomyces avermitilis
  CDS (1)..(1479)
atgcacaagcacctgcgactcgctctcgcgacggccgccgcggccacgctgacgagcggtctgctcacgttcacggccgtcacggcgacggccgcggactccaccacggtcccgcaggccgacttcaacaacgacggcatcggcgacgtcgtcgtctcggcgcacggcgcctatgtgaacggacgccagggcgccggccagatcgtcgccctctacggcagcgccaccggcgtgtcgtccgccaagcgcaccacgatcagccagaacaccaccggtgtcccgggcaccgccgaggccggggacggcttcggcggcgagacggcgtacgccgacttcaacgacgacgggtacgacgacctcgccgtggccaccccgtgggagaaggtcggcaccgacaccaacggcggtgccctcagcatcctctggggctcggcgagcggcctcaccggcaagggagtcgacgtcccggacccggccgtctcctcgcacgactactggggcaaggacctggcggccggtgacttcgacggcgacggcaaggccgacctggccgtcggcagctcggccagcacgatctacgtctacaagggcggcttcagctccaccggtacgccgggcggccgcaccacgatcaagccgccgatcgtgtcgggcagcggcaccgacccgtacggtccgatgagcctcaccgccggcgacgtgaacggcgaccaccgcacggacctgatcgtcgacggctacgagacccagaccgactacggctggaacacgaactacttcgtgcccggcaccgcgagcggtctgaacgtggcgtccgcccaggccctcaagccgggcatcgtcacgggcatcggcgacatcaacggcgacggcttcggcgacatcgtcagcggcgccggctgggaccacaccaccaccgacggcacgaccgtcccggactccgccgacggcggcaaggtgaacatcacctacggctccgcgtccggccccgcctcgaccgcgggagtcacccagaacaccggcagcgtgcccggcacctcggagaagggcgacggcttcggctgggacctggacctgggcgacgtcaacggtgacacctaccaggacgtggtcgtcagcgccccgaacgaggacatcggcggcgtcaccaacacgggcatcgtcaccgtcctgtacggctcggcgagcggcatcaacaccgcctccggcacgcaggccttcgcccagagcaccgcgggcgtccccggcagcgacgagaagggcgacctcttcggcgcggacgtgaagctcgacgacgtgaacggcgacggcagggccgacctgctcgtgggctcgtacgagaacagcgccaacggcgcggtcacctacctgccctccagcggcacgaagatcaccacgaccggctcccgcaccctttccccgagcacctcgggcgtctcgacgacgggcacgccgcagttcggcgccctcttcgccgac

SEQ ID NO: 4462 - DNA, 1443 bp, Streptomyces avermitilis
  CDS (1)..(1443)
gtgcgtgcaaagaagctggctgtcgcggtgggcgtggccgccctcgccgcgacgggactcaccctgccgctcgccggatccgcggccgccgtgtccacgctcaaggacgacttcaacggcgacggctacgcggacctcgccgtcggcgtgcccgacgcgaccgtcgcgggccacgccagggccggttacgtgcacgtgctctggggcggcccccagggccccggcaccgccggctcgaccacgctcagccagaacaccgccgggataccgggccacgccgaggccacggacctgttcggccaggcggtcgcgacggcggacgtcgacggcgacggctacggggacctgctggtcggcgcgcccggcgagtccctcaccgacagcgcgcacgacgcgcagggcacgatcaccgtcgtacgcggctccgcgtccggcttccgcacggacgcgatgctcgccatgaagggcgcgtacggcgacgagcgcgtcggcggcctcctcacgaccggcgactacgaccacgacggggacgtcgacctcgcgctcggcgtcagcggcgaggagggcggcgcgctcctgttccgccccggcccgctggcgtccccggccgccaccaccctcctcgacggctatgacttcggcggcccgggcgccctggccaccggcgacttcgacggcaacggcacggacgacgtcgcggtcacctggtccggcatggagctgtacggcacgagcgtctggtcctggtcgggcggcagcgcggccgagtcccggcgcaccggcgactacgcggtgtcgctcgcggcggccgacctggacggcgacggcgcggacgacctcgtcctcggccagaagcacgacaaccccgaggccgacgagccctcgccgtgccccgacgagtcgagcggagcggtgctgatccgcttcggcggggcagacggcgcgggcggggcgagcggggagtccggccggaagacctgcctctcgcagtcgtccgagggcgtccccggcaccgccgaaccgggcgacgcgtggggcgcgtccgtggcggcggccgacctcgacggcgacggggcgcccgaactggtcgtgggcgcgcccggcgaaggcgtcggctcgctcaagagcgcgggctcggtcaccgtcctcgacggcacgggcgagggcccgttgtccggcggcgtcacgtacacccagaacacgccgggcatccccggcacggcggagacggcggaccgtttcggcgcgacgctgacggcgggcccgtaccacccgggcgggcggccggacctggcgatcggcgctcccggcgagaacgcggcgaagggcggcgtctggtacgtaccgacgacggacgacgcccgcccggccggcgcccgcgccctgaccccgaaggcgctcggcctgtccggcgcgaaggggttcggctcggcgctggctccc

SEQ ID NO: 4463 - DNA, 1464 bp, Streptomyces avermitilis
  CDS (1)..(1464)
atgcgcacgcgccgccgaccgaccgccgccgccgtcctgggctgcgccctgctgttcaccgccgcggcgtgcgcctcggacgaaccctccgacagcgaccgcccccagcgccccaccgccggaaaggccgccgcgcaccccgactccggtgacttcaacggcgacggcttcgacgacttcgcggacatcgtggagtcgacgtccaaggacaaggagaagtacgccgccacgctggtcgtcgtctacggctcgcgcgaagggctcaacaccgccaccgcgcagcggactccggcgggcagccggccgttctcgatgttcatgtcaccgctgctgcgcaccgacctcgacggcgacggcttcacggacctggtcggcggccgcggcgtgaacgagaccgtgagcgagcccttcgcgctgttcggcggcgcgcacggactgggccccgccaggcggctcggcctgcccgacggcttccgcccgctggccgccgccgacttcgacggcgacggctccgtggacctgctcgacggcggccacggcggctccggtgatcccaactccaccggcaagggcagcgacggcctgctcctgtacggccccttcgaccgcgccggaaaaccgaagcggcaggccgtgctcgacctcggccagcacggctacgccacccccgccacagccaccaccggcgacttcgacggcgacggcagggccgaggtggtgttcacgtactccttcgaccccgaggaggacgagaccgcgcccgcggacctgcacggcgtcggctactacgagggcggcgggcggggtctggtccgggacacccgtcaggaggcccgcatcggggccctggcgggaaccgacgacggcctgcgcacgccggtcgccggcgacgcggacggcgacgggctcaccgatctgctggtgcccacccagctggccgtggcccccgcggacatgcccggcgcgggcggtgccctgacgatcctgtacggggcgaagtccggcctgaacaccggccggaaggagaccgtgatcggcggcatggacaccgccgaccggcgccgcgtcgacttcggctcctcgccctccgtcggcgacgtcgacgccgacggcaagccggacatcgtggtgaacaccccgggcttccggcggcacgacggcaaggtgacgctgctgcccggcggcgcggacggggcccagtccctggccggcgagcaggtggtcgacgcccggaccggcggcctgcccggcaccccgaacccgtactactggaacgccttcggccaccggcccccgctgctcgacgtcgacgacgacggccacgcggacgcggtcgtcttcgggccgctctacgagaagcggaagggcgcgtacctggtcctgcggggcacggacgacggcttcgacccgaagaaggtccagctcttcacgcccgacgccatcggcgtaccgctgcggctgaag

SEQ ID NO: 4464 - DNA, 426 bp, Streptomyces avermitilis
  CDS (1)..(426)
ttgctcttccaccggaaggacgcagtgatgaccggttcaacgtccatgagggccgtactggccgcggcggctctcgccgccctggccgtcgggtgtatgccgtcggacggcggtggtgtcagcgcggggtcctgcgacgacgtgatggagttcgatcaccgcacctacctgagcgtcggcgatgtcgagttcacggtcggggccgaggcgggcgcggcgggccggccgccctgcgacgacacgggcggagagagcgaggaggagacgcggttcgatatgaccgcgtacgaggtcgaggggctcgacaccggcgtcgcgatcgcggtcggcgactcaccgcacggcgcccggctctacgcgatgtacgaagaggacggggacctgcccgccgaggtgcagaagttcatcggcgggggccaaaaggac

SEQ ID NO: 4465 - DNA, 1446 bp, Streptomyces avermitilis
  CDS (1)..(1446)
gtgccttcacttcagaaggagaaagccatgatgagcaagacgcgcagcaatgagaaagtccgccccaagtaccgtctgggaatggcggtggcggccgcgtcggcggcggtggtcgccggaggtgtcattctgccggccgccgtcgcgtcggcggccccgatgcccaagatgccgcccacggccccggggcaccacgccaaggagcagaagaagccttgcggtaagaagcctggcaagggccacaagaagagtggcaagaagtattcctgcaaggccaacaaccgcacgtactacttcgaagagcactgcagctgctactactacacagaaaacgaccacaactactactgggacgaccactacaactcctactacgtagtgcagtacaaccacaagtactactgggactaccactacgactgctactacgtggtggaaaagcactgcaagtactactactggaacacgtacaaggagtacaactactgggagaagcacaaggacgacaagtgctactggaacgagaaggacacgaagaactggaaggaggagaactgggtcgagaagcacgacacggataagaagccgggggacgagggtccggaaaagggtccggacgggaccaagccgggcaccgaggacggcaacggcaaggagcacgaggagggcaccgaggacgacaccggcaagggccacgaggaaggcaccgaggacgacaccggcaagggccacgaggaaggcaccgaggacgacaccggcaagggccacgaggaaggcaccgaggacgacaccggcaagggccacgaggaaggcaccgaggacgacaccggcaaggccccggacgagaagaccgaggacgacaccggcaaggcgcccgacgaaggcacggagcaggccccggacgacggcaccggcaaggcccccgacgagggcacggagcaggccccggacgacgacgccggcaaggccccggacgagggcacccaggacgacaccggcaaggcccccgacgagggcaccgagcaggccccggacgacaacgccggcaaggccccggaggaaggcacggagcaggccccggacgacaacaccggcaaggcacccgaggaaggcaccgagcaggccccggacgagggcaccgagcaggcaccggaggaaggcgccgagcaggcaccggacacgggcaccgagcaggccccggaccagggcaccgagcaggccccggaggaaggcaccgagcaggcaccggacacgggcaccgagcaggcaccggaccagggcaccgagcaggcaccggaggaaggcgccgagcaggccccggacgcgggcaccgagcaggccccggaccagggtgttgccgacacgggtgcgggtaccgacacgggtgcgggcgctgaccagggtggaggcgccgacgcaggagccggcgacgcaggagccgccgag

SEQ ID NO: 4466 - DNA, 2265 bp, Streptomyces avermitilis
  CDS (1)..(2265)
atgcaactcgccgcgatcatcgtgtcgctggtcctgaccgtggtcggcgtggcgctgctcgcacgcgccatcggccagttcgtccggtatttcaagctcggccagcccgtgcccgccggcacccggaccgacaacccctatcagcgcagtgtgacgctggtgcgggagttcctcggccacacgcggatgaaccggtggggcatcgtcggtttcgcccactggttcgtggcggtcggcttcctgacgctgccgccgaccatcatcaccgcgtacggccagctcttcgaggccgactggacgctcccggtgatcggcggcttcctgccgtacgagctgtacatcgagttcatcgcggcgatgaccaccctcggcatcatcacgctgatggcgatccgcctcctgaacctgccgtcgcggcccggccgcaagtcgcggttcgcgggctccaagatgggccaggcgtacttcgtcgagtacgtcatcctcaccatcggtctggcgatctacgtactgcgcggcctcgagggcgcgctgcaccacgtggaccacttcgaggcggcgtacttcgcctcgtacccgctgatcctggccttcaagggcctgggcctcggcacgctccagaacctcgtgtacttcaccgcgatggtcaagctgggcaccaccatgatctggatgatcacggtgagcctgaacaccaacatgggtgtcgcctggcaccgcttcctcgccttcccgaacatctggttcaagcggaacgcgaccggcgggacggccctcggcgggctccagccgatgacgtcgggcggcaagccgatcgacttcaccgaccccggtgaggacgacgtcttcggcgtctcccaggtcgagcagttctcctggaaggggctcctcgacttctccacgtgcaccgagtgcggccgctgccagtcgcagtgccccgcctggaacaccggcaagcccctctcccccaagctcctcatcatgtcgctgcgcgaccacgcgcacgccaaggccccgtacctgctggccggcggcggcaagaccatggagggcgaggagaaggcgagcgaggagcagctcaaggacgtgcccgccgccgctctggcggaggccgagcgtccgctgatcggcaccctcgaagagaacggcgtcatcgaccccgacgtcctgtggtcctgcaccacctgcggcgcctgcgtcgagcagtgcccggtcgacatcgagcacgtcgaccacatcgtcgacatgcgccgctaccaggtgatgatcgagtccgcgttcccgtccgaggcgggcacgatgctcaagaacctggagaagaagggcaacccctgggggctggccaagaagcagcgcctggagtggaccaaggaggtcgacttcgagatcccggtcgtcggccgcgacatcgaggacctgtccgaggtcgagtacctctactgggtcggctgcgccggagccctggaggaccgcgccaagaagaccaccaaggccttcgccgagctgctgcacatcgcgggcgtcaagttcgcgatcatgggcggcgacgagaagtgcaccggtgactccgcccgccgcctgggcaacgagccgctcttccaggagctcggcatggagaacgtcgccgcgctgaacatggcgttcggcgaggatgacgaggacgagtcgacgaagaagccgaagtcggccaagaagatcgtcgcgacctgtccgcactgcctcaacaccatcggcaacgagtacccgcagctcggcggcgactacgaggtcatccaccacacccagctgctccagcacctcgtcgacgagggcaagctggtcccggtcacgccggtcgagggcatcatcacgtaccacgacccctgctacctgggccgccacaacaagatctacacgcctccgcgcgagatcatcggcaaggtgccgggcctgcggaacgaggagatgcaccgccacaaggagcgcggcttctgctgcggcgccggtggtgcgcggatgtggatggaggagcggatcggcaagcgcatcaacaacgagcgtgtcgacgaggctctttcgctgaacccggacatcgtgtcgaccgcctgcccgttctgcctcgtcatgctgaccgactcggtcaacggcaagaagaacgacggcaaggcgaaggagtccatccaggtcgtcgacgtcgcccagctgctgctcgactccgtcaggacgcccctcgacccggccggcgaggccgaggccgagagcgcgccggagcccgagcccgtgaag

SEQ ID NO: 4467 - DNA, 1050 bp, Streptomyces avermitilis
  CDS (1)..(1050)
gtgctgtacgggatcattgccgccacctcggccctcctcctcgcctccgcgctcgccgcggtgctgcgggtgcccgcgctgcggctcggcctcgtcgagcggcgccgggggcggacggtgtcgcggctcgggggcgccgcggtcgtcgtcgggaccgtggtcgtcgccggggtgggggactggtccggtgtcgcccggctcgggaccggggtcggggaactgctcgtcgtcggggccggggtcggcgcgctcgggctcgtcgccgatctgcggcccgtcccccgggtcgtgcggctggccgggcaggccgccgccgccgcggccgtcgtcccgtacgacgaactcggcgccggcgcggggctgttcgcggccgcctggatcgtcctcgtgaccagtgccttcggctcgctcgaccaggccgacggggtcatgggtaccgtcggcgtcgtcaccgccttcgcgctcggcgggtgtgccgccgccgaggtcatggacggactcgcggcgctgctgagcgtgctggccgccgcgctcaccgggttcctgatgcacaactgggcgcccgcgcggaccgtggccgggcggtgcggggcgctgttcaccgggttcgtgctcgcctcggccgcggtcctcgtgcacgccgggcgggagccgctgggcagcgccggtgccctgttcgcgctgaccgccgtggccaccgccgatggcgtcctcgtgctcgcgggccggctgcgcggtggccgcccgggccctggcgcgggccggcggggcctggcgcaccggctgcgcggactcgggctcaccgcgcgcggggcggcggtcgtcatcggcgccgcctccttcgcctcggccctcgtcgggctcctcatcgacctggggtgggcggggccgggcgccgcgtgctgggtggcgggtgccgcgggggtctcggtcctcgggctgctccgcgttcgggtgccctccgatcgggggtttcgcatgcaccccgatcggggcacccgaccgggagttgtcccgcctcccggcgcttccttgcgtgtaaggagcgga

SEQ ID NO: 4468 - DNA, 1866 bp, Streptomyces avermitilis
  CDS (1)..(1866)
atggcacgtgcggtcggcatcgacctgggcacgactaactccgtcgtcagcgttctggagggcggcgagcccaccgtcatcaccaacgccgagggcgccaggaccacgccgtccgtcgtcgccttcgccaagaacggtgaggtgctcgtcggcgaggtcgccaagcgtcaggcggtcacgaacgtcgacaggacggttcgttcggtcaagcgccacatgggcactgactggaagatcaacctggacggcaaggacttcaacccgcagcagatgagcgccttcatcctgcagaagctgaagcgggacgccgaggcctacctgggcgagaaggtcacggacgcggtcatcaccgtcccggcgtacttcaacgactcggagcgccaggcgacgaaggaggccggcgagatcgccggtctgaacgtcctgcgcatcgtcaacgagccgacggccgccgccctggcctacggcctcgacaaggacgaccagaccatcctcgtcttcgacctcggtggcggcacgttcgacgtgtccctcctggagatcggcgacggcgtcgtcgaggtgaaggccaccaacggtgacaaccacctcggtggcgacgactgggaccagcgtgtcgtcgactacctggtgcagcagttcaaggccggccacggtgtggacctggccaaggacaagatggccctccagcgcctccgcgaggccgccgagaaggccaagatcgagctgtcctcgtccaccgagacctcgatcaacctgccctacatcacggcgtccgccgagggcccgctgcacctggacgagaagctcacgcgcgcccagttccagcagctcaccgctgaccttctggagcgctgcaagacgccgttccacaacgtcatcaaggacgcgggcatcaacctctccgagatcgaccacgtcgttctcgtcggtggctccacccgtatgcccgccgtcgccgagctcgtcaaggagctgaccggcggccaggacgccaacaagggcgtgaacccggacgaggtcgtcgccatcggcgcggccctccaggccggtgtcctcaagggtgaggtcaaggacgtcctgctcctcgacgtgaccccgctgtccctcggtatcgagaccaagggcggcatcatgaccaagctcatcgagcgcaacaccacgatcccgaccaagcggtccgagatcttcacgacggccgaggacaaccagccgtccgtgcagatccaggtctaccagggcgagcgcgagatcgcggcgtacaacaagaagctcgggatgttcgagctgaccggtctgccgccggccccgcgcggggtcccgcagatcgaggtcgccttcgacatcgacgccaacggcatcatgcacgtgaccgcgaaggacctgggcacgggcaaggagcagaagatgaccgtcaccggcggctcctcgctgccgaaggacgaggtcgaccggatgcgccaggaggccgagcagtacgcggacgaggaccaccgtcgccgcgaggccgccgagacccgcaaccagggcgagcagctcgtctaccagacggagaagttcctcaaggacaacgaggacaaggtccccggcgaggtcaagaccgaggtcgaggcgtccatcgaggagctgaaggccgcgctcaagggcgagtccgccgaaggcgacaacaccgccgagatccgtacggccaccgagaaggtcgccgctgtctcgcagaagctgggccaggcgatgtacgccgacgcccaggccgcgcaggcggcgggcggcgccgagggtgccgccggcggcgagcacgccaaggccgctgacgacgacgtcgtcgacgccgagatcgtcgacgaggaccgcaaggacggtgccgcg

SEQ ID NO: 4469 - DNA, 663 bp, Streptomyces avermitilis
  CDS (1)..(663)
gtgacggaggagaccccgggtttcgacgagaagcctgacgtcccctccggcgccacccctgaagacgccgagccgaaggccgccccctccgagggggcggccccggccggggacgcggcagcagcagcccagacggcggcccagacggccggcctgacggcccagctggaccaggtacgcacggcgctcggcgagcgcacggcggacctccagcgactccaggccgagtaccagaactaccgccgccgggtcgagcgcgaccggatcgcggtcaaggagatcgccatcgcgaacctcctgaccgagcttctgcccacgctcgacgacatcggccgcgcgcgggaacacggcgaactggtcggcggcttcaagtcggtggccgagtcgctcgagaccgtcgcggcgaagatggggctccagcagttcggcaaggagggcgagcccttcgacccgacgatccacgaggccctgatgcactcgtacgcgcccgacgtcacggagacgacgtgcgtggcgattctgcagccggggtatcggatcggcgagcggaccatccggcccgcgcgggtggccgtcgccgagccccagccgggcgcgcagacggtcaaggccgacgaggcggaggcggccgacgacaaggagagcggtggcccggaagagggc

SEQ ID NO: 4470 - DNA, 1188 bp, Streptomyces avermitilis
  CDS (1)..(1188)
atgagtaccaaggacttcatcgagaaggactactacaaggtcctcggcgtccccaaggacgccaccgaggccgagatcaagaaggcgtaccggaagctcgcccgcgagttccacccggacgccaacaagggcaacgccaaggcggaggagcgcttcaaggagatctccgaggccaatgacattctcggcgacaccaagaagcgcaaggagtacgacgaggcacgcaccctcttcggcaacggcggcttccgtcccggccccggcgctcagggcggctccttcaacttcgacctgggcgacctcttcggaggcggcgcgcagcagggcggcggcgcggggggcggcttcggcggcgggatcggtgacgtcttcggcggcctgttcaaccgtggcggcgccggccccggcaccggcacgcgtacccagccgaggcgcggccaggacatcgagtccgaggtcacgctgagcttcacggaggcggtggacggtgccacggtgccgctgcgcatgtcctcccaggccccctgcaaggcctgttcgggcaccggcgacgccaacggcacaccgcgcgtgtgcccgacgtgcgtcggcaccggacaggtggcgcggggctcgggcggcggcttctcgctgaccgacccctgcccggactgcaagggccgcggcctgatcgccgagaacccctgcgagatctgcaagggcagcggccgcgccaagtcctcccggacgatgcaggtacgcatccccgcgggggtcagcgacagccagcgcatcaggctccgcggcaagggcgccccgggtgaacggggcggaccggcgggcgatctgtacgtcgtcgtgcatgtcgacgcccacccggtcttcggccgcaagggcgacaacctcacggtgaccgtgcccgtcacgttcgcggaggcggccctcggcggcgaggtgaaggtgcccaccctgggcggccccgccgtcaccctgaagctgccgccgggcacgcccaacggtcgtacgatgcgggcccgcggcaagggcgcggtccgtaaggacggcacccgcggagacctgctggtcacggtcgaggtcaccgtgcccaaggacgtgtcgggcaaggctcgtgacgccctggaggcgtatcgcgaggcgaccgcgggcgaggacccgcgggcggagctgttccaggccgcgaagggagca

SEQ ID NO: 4471 - DNA, 447 bp, Streptomyces avermitilis
  CDS (1)..(447)
atggacggccgtcgtcggaacccctatgaactgaccgaggaaaccccggtctacgtcatctcggtggcggcccagctctccggcctgcacccgcagaccctgcgtcagtacgaccgtctcggcctggtctcccccgaccgcaccgccggccggggccgtcgctactcggcccgcgacatcgaactgctgcgcaccgtccagcagttgtcgcaggacgagggcatcaacctggccggcatcaagcgcatcatcgagctggagaaccaggtcgccgcgctccagtcccgcgtggtggaactggagtcggccctggacggcgcggcggccatgatgcagcagcgcgaggccgcggtccacgcctcgtaccgccgcgacctggtcccgtaccaggaggtccagcagacgagcgcgctggtcgtgtggcggccgaagcgccagtcctcggac

SEQ ID NO: 4472 - DNA, 1134 bp, Streptomyces avermitilis
  CDS (1)..(1134)
gtgaacactcgtaacaccggtatgcgccgtacgcgtcgtaccgtcatagccctggccacctccacggcggccgtctccctgtccgcctgcggggtggtcgacgggatcgggaacgccagcggctcggcgagcccgaagaagggcaacgacatcacggtgggcctgcttctccccgagaaggagaactcgcgctacgagaagttcgactaccccatcatcaaggagcaggtcgccaacctcaccaagggcaagggcgacgtcgcgtacgccaacgccgaccaggacgccgccaagcagagccggcagctcgagcagatgatcaccgacaaggtcgacgtactgctcgtggacgccgtcgactccaaggccatcgcgagcgacatccagaaggccaaggacgcgggcattcccgtgatcgcgtacgaccgcctcgcgcaggggccgatcgacgcgtacatctccttcgacaacgagctcgtcggccaggtgcagggccgcgccctcgtcggcgccctcggcagcgacgccgcgaccgacaaggtcgtcatgatgaacgggtcgcccaccgacccgaacgccgcgcagttcaaggcgggcgcgctcagcgagctccaggacaaggtgaacgtcgcgaagtcgtacgacaccaaggactggaagccggccaacgccaaggccaacatgatggaggcgatccaggccatcgggctgagcaacatcgccggcgtctactccgccaacgacggcatggccggcgcgatcatcgacgcgctgaagacggcgggcgtcagcaaggtcccgccggtgaccgggcaggacgcggagctggacggcgtgcagcggatcgtggcgggcgaccagtacatgagcgtgtacaagtcgtacccccaggaggccaccgccgccgccgagatggccgtggccaaggtgcagggccgctcgatcgagttcgacgcgctgacccgcgacaaggtcgacagcccgacggacaagaagatcccggcccagctcgttcccgtggtcgccctcacgaaggacaacatcgaggacacggtgatccaggacgggatctacaagatcaaggacatctgcacggcgaagtacaagtcggcgtgctcggccatcgggctgaag

SEQ ID NO: 4473 - DNA, 327 bp, Streptomyces avermitilis
  CDS (1)..(327)
gtgcagcccgcgtcgcctcccccgccgccccagccagaaggacgcccaccgatgaccgaaacgaccccgcccgtcagccccgtcgcgcccgccgccgcggaggcgacgggcgcccaggtgcgcgtcttctcccccaacgccgggctgatcgacggcgtcccggtcaccgccccgccctacggggacatccaggacatcgtcatctcgatcctccagcagcgcgcccagcagctgggcgccccgaccccggccgtcatcacggacgaccgctacggcggcgagatccgcctcctcgtccatccggacggctcgacggaacaggtgggc

SEQ ID NO: 4474 - DNA, 1752 bp, Streptomyces avermitilis
  CDS (1)..(1752)
gtgaccgtgccgcgcagccgggcgccaaggccactgaacgggcggacagttgatgtgcgcgtgaatgttgtgagccgtcactgtgtgagagcgcccatggctttgcagatgcgttgcgtgcggttgacagaatgttttaaagtccctcgcgatcaaggatcaccacgggggacaacaaaaatgcgtatggcgagccatacgacgctgcctgcaatgcccgctccacctgcccgcgggcccgtacgggcctatgtgccggacgccgcgctgccctgccggcgccgtccggacgtcttccagcacccgttgctggagaacgcggaggcggtacggggcggtacgccgcagcagcgtcgtcagtacctcatcctgctccgcaccgcgcgcgacctgtgcgcatcctgcccgttgtgggcggaatgcctccaggacgcggtcgcgcacgccgaaccgtccgggtacacggccgcgaccacggcggacgaccgccgtcggctgcgcctggccctcgggctcggcgacgagaacggcgacctgcccgtccgcgaggcggccggacccggctgcatgtcggtgccccgtcggctggcgcgactcaggtcccgtacatccgacgccaccgcactccgcccggccgaccccgcccttcccgaactcgagcgggtcctggacgccttcgacacactccaggaccaactggcctcaggacaggacctgttggcggccggaccatccgacacggacgcaccggaatcgttgcagtcgcatattcgccccggttcgcgaagatcgcggacgccgagggaaagcaggaacgaggaacccatggcagcggccgaggccgggcagcggatcgtcttctcgctcacggatcccgcccaggccgtacggcaggccgtgctcggtccgctcatccggtccgccctgcccgcgctcgtgagcgtggaacagctcgcggcgatgctgctgaccgtgcccgggggcggcatcacccccgagacgctgcgggacatccgcgaggtgcggacggcggtcacctcgatgctcccggacgacgctcccgaccacggcgggacggaagggacggaagggacggaagggacggcaggcacggcagatgcagcgggcccgaacggcgccgtcggcgcggccggtgtcgcgggcggcggtaccgtccccctcgcgctcctgcgccccctcaccggctccgtcagtgtcgagctcgccatgagcgaccccgtggccgcgctgcgccgcgacttcctggagccgctgctgcgcgacctgctctcctcgctggccaacatagagaaggtcgccaccatgctcgcggccacctccgaccgcacggccgggccgggtgacggcgccgacgacgcccctctggagaccgtacgcgcggccttgcgcgagctcacgtcccgcctgccgcacctgggttcgcacaccgcgcccgccgcgctacgccccccgccgcaccccagcgagggcggccacgaccgccgtgccgcgtccgtgcccagcatccgtgccgccgtcgagcgggccgcggagaccttcccgggcgccttctcggcccgcgacgtcctgcgcaccctgccggccggcgtgtacggcgaccccgcgaagaccatcagcaacgtcctgtccgcgatggtcaagtcgggtcacctgcaacggctttcccggggtacgtacactcgcgaccgcggcccgggcccggccgacggtcaggagcgggcgaagagcgcc

SEQ ID NO: 4475 - DNA, 633 bp, Streptomyces avermitilis
  CDS (1)..(633)
gtgaaccgcccccgcatgagcagcagccgactcctccgtctccttcaccaggacaagaccgacccctgggccgtccgcctcctcccccgcctcgtcttcggactcgccgccgcctgcaccctcttcgtcatcgcctcctccagcggctcgaacttcgtcaccctctgcgccctgctgctgttcgggctggccgtctggctgctgcgcgggcgcgggcagttgctgctggccctcggttccacgaccgtcgccgccgcgctcgccggatacttcgccgcggccggtgaggctgcccgctggggacagggactgacggtcagcggtcaggccgtcttcgggtactgggcgctggccggcatggcgctgctcggtgcctggatggtgagggaacatcccggacggcgcggagtcaccgtcgtcctcgccgatgtgattctcgtcatcacctccgtcctaggcatgttcgtgccggaggccggcgtcgccgccggattcctgggcgtggtgggggtgttggccgtccgcggcggcggcaccgccgtggcgcgccggggggtgagcgccctgctcaccggcgtacggcgtgaccgtgccgcgcagccgggcgccaaggccactgaacgggcggacagt

SEQ ID NO: 4476 - DNA, 1230 bp, Streptomyces avermitilis
  CDS (1)..(1230)
atgagccaggagccactgccggtcgagatcctcgacgacgctcgtgcccggcagcgggccggggacggcgagctgacaccggcccaggtcaagaagatcgccaggcaactgcgcgaaggcatcgcccaactcccgcccgaacagtacaaggagaagctccgcgagcggctgcgggagatcgcctcggagcaggacgtcgagctgccccaccccgacaccaggtccgccttctggtcctacaagctggaggagcacccggacatcggcgtgggggaagatctctacagcatgcacgtggccgccgcgtatgccgaggccgaggagtccgtgcgctacctggaggggactccgggcggaaaggccctgggcgagctgcatctgtgggacccggcggtccgtacggcgctgaagctggacaaggacagcggcagggaactggccggcgacgcctggtccgccctctcccagaagtacgccacgcgcaccgagaacgaagccctcttcttcatggccgaactcaatcccgggaccgtcgcctaccagacagaggcgccccagctccgcgaggacggcaagctggacatcatccggttcatgtacccgccgccgtcgacgaagctcgaggggttccctcccgagacgcaggagctgctctcccgcgacgccgtacgcgcgcagctccacaccttcgcctacgacgagaaggccaacgagctgaccaaggccggctatctcaacctggacgtcctgcgctccctgcccactccggaagcccagcgtgccgccgtcctcgagctctgcgcgggggtggcccgcctggacggacgcgaagccgacgtcgagaagctcaccgaggaagtcctggccttgcgggcggagcaggaggcggccgcgcccggcgtcgaggagcaagagcagcagccgcagaaggagcaggctcagcaggtgccgcaggcccaggaggcgcggcagacccaggtggcacaggaagcgcgggaagcacaggaagtgcaggaagtgcgggaagtgcgggagccccagccgacccccgcgggccaccccacccccgcgcccgccaccgtgtccgccgcggcagcaacccccttcatgcccggcgtcaccgtcacgcccaagcaggtcgtcccggcagggcacggcgtgctgcgtcccacggaaccggagcaggcacccccggccgccgccaaggcgcacgacacagacatgggaatg

SEQ ID NO: 4477 - DNA, 714 bp, Streptomyces avermitilis
  CDS (1)..(714)
atgcgaggatcagcctcgcctgccacgaccccgctcacgcggagagtccccggcgggagcggctcggatgacccggggccggcaggagcacgaggaaggcgacatgggatgacgaccctgcggatcgagcggacacccgagcaactggccgaggagctgaagggactcgagcacgtggactggcccgcggtctgggcgggtccgccgagccctgggcaggcgctggacgactggtgcgcgctgttcggctggcagccgacctcggccgagcgcgtgctgagcgtgcgcagctccacgggacagagcatcgaactctcccccgtgcgcagcggcggatgggctcccgtcaagcagctcggctggacgagctggaatctctgggccgacgacccgtccgagaacgacgaggtcctcgcgcgggcggccgaggtgtgggccgcgtacgaggaagccgcgcggacagtgctcggcgaacccaccttctcgggagcctgggacgccccggacttccccgagccgccgcacgagcggcactggctcatgccccgcgatctccggctggaggacatggatccctaccggttggcgatgtggccggaggacggccctgaaggacgcatcaccgtactcacggtcaaccccggcctcgctcccgtcccgggagagagccggggagtactgatcgaggtcaactgctacccaccggaggcccca

SEQ ID NO: 4478 - DNA, 627 bp, Streptomyces avermitilis
  CDS (1)..(627)
atgccggccctgaccaccgaccgcacccccgatcaactggtcgcggagctggagcagctcgtcggggtcgactggcccacggtgtggcggggcgtcccccgggacgccggcaagcgggcccactggtgcgcgggcttcggctggcggcccctgtggttcgaggcgggcctgcgggtgcgcacacccctgggcggccggctgtacctggccgcccaggcaccggagcgcccggtgacccgcgtcgaacacacggtgtgggcggcgcgagggcggcacgcgggggagaacggggtggtcgcggaactggcggaggcccactgggcggcgtatgtgaccgccctgcgcggcttcatgggctggccctcctggaacggcacctgggacgccccggacttccccgaactgcccggttcggcggcatggcccagtgcggagcggcgccggcggcaacgggacccgtaccggctcgcggtgtggcgtttccgtacgcccggagcgcccctgatcgaactgaggacgacgctcgaccagggctcacaggcccggccggcaccggccaatgcgaggatcagcctcgcctgccacgaccccgctcacgcggagagtccccggcgggagcggctcgga

SEQ ID NO: 4479 - DNA, 2268 bp, Streptomyces avermitilis
  CDS (1)..(2268)
atgcccccgcgcaatgcactgcgccgcaggatcggcaggttcggcgccgcagtccgtgccggcctgttcgtggtgctggccctggtggccctcacactggccgtaccgacctcggcgtacgcggatttctcctgcaacttcaccggtgacgagagctatcagatggactcgccgggcagtaacggtgagtccatcattcccgcggtcgcgcagtggcagggagagagcgcccagaacctgagcgaagacacgggaatggtcaccggcgccgtcaagatgccgatcgacaaggcctcgaactacaccctgtacgagctgaacggcatgcggggcctgaactggtccatgaccttcaagggcaagggcaacgcctcccaggacaacggcacgtggggaagcggcgccgactcctgccaggtcatggcctatgtcaacaacggcatcgcggacaccattctcaacggcaccaaggttctcacccggttctccatctccatcaaggaaatggcctccaacccgagcccgttctccggcctctactcgggccgcgacaacgtcgtgaccacgctgcgcgagaacgtgctcaagcccgccgtcgcggtcatgattctgctggtcggactctgggtcttcaccaagtggcgcaagggagacatgcgcgaggtgtggtcgggaatctcctggaccgccctcaccgtcatcgccgtcaccgcgttcctgaccggaaacaactaccaccaggtcgtcgaaagcgcggacaactacatcgcccaggccaattccgcgttcaccgcgaccgtgctcgccggcgcttcgggcgagatgcagagcccgtgcgatctgccgaagggcggcaaggacgacgacggaagacgaggtcttcgcctgtcgagctgcgccatgtacgacacgctcgtcttccggccgtgggccctcgggcagttcggcgacgtgggcaagacctgcatcttcaagaacaagagcgggcgcatatcggcggacggcgtctgcgccccgcagagcgccggcacgtcctgctactggggcaagggcgcgcgctgcgaggacctgcgggtgcgccaggccgcggcccagtcctggaccaacgtcgacgaccagcgcgaccacgtcgacaagttcaaggagtggcaggagatccgcaaggacatcgccgtcggcgagaaggcacccgacaagagcatctaccccgtcgcgttcaacgactgggccggcaagaactccagcaaccgggtgggcatcgccttctactccgtcgtggcggccttcatcgtcggtgtgatggtcctcgtgctcagcgccctcaccctgctctggcacgcggtcaccctgatcctggtcatgctgctgccgctggtcgccacgctcggcatccatccctcccagcagaaactgctgaagagctggctggagaccttcatccacagcttcgtcctgcgcgcgggcttcggggtcatcctcaccgtgctgctcgtcctgtaccagatgatcctgcccgccagggtggccctcggtacgcagttgctgatgctgctcctggtcaccgtcgccgtcgtcatgatgctgaagaagctcctcgccgggaacttcaccccgcaggtcgcgggcggcgaggacgcgctgggcatccgcgaaggagccgacgcgaccttcaacaaggcggccgtcatggccccgggcctggctgtggccggtgccaggaccaccggacgcgtggcgggtaacgccgccaagggcaccggccgcgcggccggcagcacggtgcgcggtacggcctgggcagtggacaagttcgccaacaagggccggggccgagccgccctgcagaagcggggctggctcggccagtcgaagcgcgagcagcggcagaccgcccaccaggcggcggagacggcacgcaggtcgtacgagagcgacgggccgtcggcgaaggagcagccgtcggcgtccgcgcccgagccggcccccaggcgcggccgccgggtcagcggctccagcgggcagcagccggctccgcagtcgtcggcaccggccgagcagcgccccgcggctcctcagccgcagccggcggcaccacgcccgatgccgtccgcacccgcacccgcacccgcaccccagccccgcccgaccatgcccagcccccggaccgccgcccccaagccccccgtcacgcccaagcagtccccggccccggccccggccccggccccggcctcgccgcgggacccccgcggcccgagcggccgtgtc

SEQ ID NO: 4480 - DNA, 516 bp, Streptomyces avermitilis
  CDS (1)..(516)
atgcgacttcagcgagcagtcgtcggcagcgccgctctggtggtcctgagcctcctggccggctgcggcagcgacgacccgatggacgacctcgggctgccctcggccggggacatggcgtcgatcgcgtactacctcaacaagcacacctcgtgcctcgacctgaccgcggaagcggacgcgacggactacctggtcgaggaggccggagaccccgcctggggaatcaaggagcgggcctcctgcgagggcgaggacggcgggaacatcacgctgttcaccctcaaggacatgaagaagttccagaccgccgtcaagaaggacgacgaccgacccgcgttcgcggtcggcagggacttcgcggtggttccggagaacgacaccacggtccagcagctgagttcgtccgaaatgatgttcctgacctgtgacccggacttcaccgtgccgagcggctacaagaaggtctccggactcgtcgacggctgcgtgctgagcgattacttcccgaccgac

SEQ ID NO: 4481 - DNA, 609 bp, Streptomyces avermitilis
  CDS (1)..(609)
atgcgccccaccccgtccctggtcaccgcggccgtttccctggtcctgctctcgacgctgagcgcgtgcgggccggattccggggacgacgcgaaggccctgcccagcgccaagacgctgaaggaggcgcaggagttcatcgccaaggccggacttccctgcaccagcatgaccacggacgagggtgcgcacgggacaccggcggaggggttcctcggcaccaccgacgactacgacagcccacaggagaagcgcgaagcggccgcctggaagatcggcgaggccggcttctgcggtgacacccgggcgaaggccgggggctggatcgtctacctgcccaaggacatgaaggcgttccagcagaactaccgcaagaccgcgctggcagccgacaaggagtacggcgacaagtacagcgacctgcgcacgggccgcttcctcatcggcgcggacttcgtggtcaaccccaccaactcccttcggaccagcggactcctcgaaacgggactgctgatcgagaactgcgaccccgatctgaaggtgcccaccggataccgcaagcaggacgcgtccgccgcgggctgcgtgctgaccgactacgtcccctcc

SEQ ID NO: 4482 - DNA, 2982 bp, Streptomyces avermitilis
  CDS (1)..(2982)
atgttcatgatgatccttctgggcgcggcggtcgccttcttcgtggtcgccatgatcatggccgccggctccgggaagaaggggcagggccagagccagggccggtcccagaaccggagccgctcgtcgagcggcaacggccagtccgcccgccgcgaggacctccgcctgccctaccgctacgccgacgacctgctgttcgtgcacggcgactcggtgtggaccggcctggtgctgcccaccgccatcgacgagtacctgaacgcctccgagctccaggcgatggccgagggcccggcccgaggtctgctcaacctcgcccgcggcgaccgcaacgtcgagtgccactaccgcaagctctaccagcccatcaccgccctgacctgggcggaggacctgaacgccgtcgcctgggaccccaccgacaactacaaggcgtacaacctccgcaaggccgactaccaggagcgcatcggcgccaagcgggagcgcaacatcctgctggtgaagctgggttcgatcaagcgcaacggcggtacgggcgtcctcgccgacggcgccgagccgttcgacgagcccgggctgctgtcgggggcgcgcggcgccgccgaccaggcggtctccaccgccaccggggtcgccgacgagtacctgtccccctccgtcctcgccgagtggacgcaggtcgcgatcgaggtccacgagagcctggagggcctcaagggcaccccgctcacccgtgaggaactggtctggctgatccgcaagccgctccacggcgacctgcccgtgccgcccgagccggtgctcggctcgcgcgcgtgggggcccgaccagttcgacctggtcgtcgacttctccggcgagaaccgcaagacgcacatcgtgctgcaccagtacgacgaggtcaccggcgagcagcagaccagctacaccaccaccctggtcgccgccaactggcccgccgagacccgcttccgccagtcgacggcgtgggcgcgctacgccgcccagcacgtggacttcccggtcgagatcgacatgcggttcacgctcatcccgtacctgaggttcaaggaccgcgccgacaagatccgcggcaacctcgtcgacgagatgaacgacatggccaactccggccgcaccccggacaccaagctggccggtcaggtcacccgcgcccaggagctcgtcgacgacatcgacgagcacaagatgccgggcatggaggcgcagatccgcttcaccgtctccgcccctgacctgaaggagctggagcgccggcgccgcgtcctggagatgcagttcaagcaggacctgaaggtcacgctgctgcgtccgacccgccagcagtggcggctgctgcagtcccagctccccggcgacgcgccgaagctgcccgtcgcgccctacctccggctccaggaggtcgagcagctgggcgccggactccccaccgccggcacggagttgggcgacaacccggagcaccgctccggcaagcgtctcggctgggtcggcaacctggtcggctgggcgggcaagatgccggtgcactactcgctgcacgtgggcccggcccgcaacgacggtggtggcctggcgatcgtgggcgcgtcgggcggtggcaagtcgtccctggccctgcagaagttctacgaagagtcggagtcgggcgtccgctgcctggtcatcgaccccaagaccgacttcgcccagatgtgctactacctggcgttcggcgcccaggtcaacgacccgtcgttcgcgtcggacgccgagcagggcctgctcggcaccgagcacagccggttccacccggtgaaccccgacttctgggcggagacggaggtcgtcgaccttctcaagggccaggcgggcgtcctggacccgtgggtgatcgcccgggacgtcccctcgggccgtctcctcgcggagtcgatgctgcgcggcttcctcggcgacgaggactaccagcgcgtacgcctgcccgtcatcgagggcatggccacggtcatcggccgctacaactccgcgatccgccaggccgtcgaccagggcctgaccgcgcgggaggccgaacagagcgtggcacggccgacgttgtggcaggtcgtcgacgaggtggtggccgcgtacgaccacgccgtggcgaccggcgaccgcgaggccatgaaggacctcaagctcgcgcagatgctcctcaccgagctgcgcaccctcccctacgcacggctctccttcgccgagcacccgcaaccgctgtccagcatgcgcaagcggcgtacggtcatcacgctccgcggcttccagtccccggcgtcctcggacccgcggcactggaacccggcggaacgcctggccgcgaccgcgctgatggcggtcgtggaactcggcagccagatgctggacgtcggctacgagaagaacccggtcacgggtgaggtcggcctgcgccccaaggcgctcttcgtggacgaggcgtacgtcgtcaccgcgaccgagtccgggcgcgacctgatgcgccgtgccctgaagcagggccgctcctatctggccgtgaccgtactgatcacccagcaggccatcgacctggtccagatcgaggactccgaggcccgctccggcggcgccaaccagatccacacggtcttcgccttcaagcagaagtccgcccaggaggcctccctggtggccccgctgctcggccgccccgaggacgacccgaaggtcatcgcggccctccaggagctgcgcaccggtgtctgtctccagcgcgacgcggacaagcgcgtcggcacggtcgccgtcgacctggtcttccaggagatcctcgcggccacggacaccaacggcacgacgcgtccggcccggcagggcgtcaatccgccgctgagcgtgtgggagtggacgttcctccaggaggtgcaggaggacccggcccgggcctcgtcgcagagcaccgcgcagaccaccgccgta

SEQ ID NO: 4483 - DNA, 495 bp, Streptomyces avermitilis
  CDS (1)..(495)
ttgacgcaggaggcgcccgagccgctggtcgcgtacgaccacaccgatctgatgaaccgcccgaagcggatctggaactggggcaacatcccgcttccgggcctgctgctgcccgcgctgggcgcggcgttcggtttcgggctgctctggctcgtcacgctgttcacgctgtccacgttcctccccttcctcgggatgtcgatgtggacgtcggtcctctacttcgggccgccgttcgccgtgtacttcatctggggccgcccgctgccctccgccctgactctcagtcagcagctggtggtgtggggcgactactggttccagccgaagcggctgcaagggctctccgccgaccaggaaccggaggaactgcactggcaggtcatcctctggacccccggttcccaccgctggcagacgcggtacgacaccgcgcggcaggcggcagcccagcacggttccccgttcaccgcccaggaccccgccgcccaggac

SEQ ID NO: 4484 - DNA, 264 bp, Streptomyces avermitilis
  CDS (1)..(264)
atgtacctggccgccgacgaactgggcgagatgttcggaaggatcgaggacatcctccgcaacgcgggcacgatggtcgccgtcatcgccctcctcatccttggcatccggatgctcatgtcgatgaagcgcggcgacggtatgcgcgaggccttccagggcttcggcatgatcgcgctcgccgccctgatcatcggcggcgccacgggcctcgccggcctcctcatcagcctcggaggcgagatcggcggcggcaacggcagc

SEQ ID NO: 4485 - DNA, 1599 bp, Streptomyces avermitilis
  CDS (1)..(1599)
gtgatcagcagggtcgcgcggagggccacgtgcgtacgacggccgccggcggggatacggccgccgggcctggggacgtcgaagtcgcgggcgggcttcgcggaagccggggtggggcgtgcgccggcgggggtggcgcccgcccgggtcgtggtggccgcggagccggtcgtggtggttcccgcgtcgaccgtgtgggcgggggcgggggcggtggcggtggacgggatggtggtagtgggagcggtggccggccggggccggggccggggtgacggcgtggtgaggggcggccgccgcgacggccggggtggccggagcggcggtgtgggcgggggccgtgggggaaccggtgaccgccccgcccctcttgcgctgctccttctccgccttcttctgctcgtacgcggccttgcgcgcggcccgctcccgtttgcgcttctccttcttggagtcactcggcgggcgggtctcacgcggcggcaggctcggtacggcggcctggcccggcgcgcgacggacccaggcggcggcgacctgcgcgcgcgccgcgtcgggggacaggtgctgaggctgcggctgggggtaggagggctgctgggccaccggcgactgcgcctgggcctgctgcccgtgcacctgctgcccctgtgcctgccagacctgctggtgcggctgctggggctgttggggctgctggggaggaccgaaggacccgggctgcccggaaggctggtctccgccgaccgcgccagcagggccgttgtggtctgtcatcgagtcggttactccagcgagtcggttccccgtccgccgccgcgcctacgaccgcgctgcatgacgggccctggcccggccaggtgcgcaggcagtgtgacaaagacaggtgacgggaccggttgtcctttccccgccgggagtacgggcgattcccggccgccgggccgggaggaaagcgctgggaaacggaaggaccccgggccgggaaagcgggcccgtccccgcgccccggcccgggcgcactcggcccacaatgcgcggggcacgtcccgcccgacgtacccccgcagcaccccatgggcccacggatccggcgaaggacgagagttgagcgagcacaacgggcagccgcacgagcccgacccgcgtgactgggacacatcccggcaggcacccgagatccagcaggcccccgccgtactggccccgcaggtcttccagaccgaccgcgcctgggtcgacggctacgagcccggcaacccctggcagtcccggctgtgcgtggagaccccgtacggcacgttcgcgtatcccctcacgccgcacaccatgcccgaactcctcgaggcgctcgtcgtggtggcccaggagcagcagggcctgccggtgggcttcggcgaggaagcggagccggtggcgggcgcgggcgaggaggacgaggaacagcagggcggcggtgcccggctccaggggggccgggccgcgcggatgacggggtgggcggtcgtccatgacctgtgggaacgcgaggatccgacggcgcggatcgtgatgggcgcggtggtcgtggggctgttgctgctcggtatcttcctgacg

SEQ ID NO: 4486 - DNA, 1053 bp, Streptomyces avermitilis
  CDS (1)..(1053)
gtggccctccgcgcgaccctgctgatcaccacctgtctcttcgcactcggctcgtgcggcgtgatgggtctggtcgtcgggaggtcctcgggcgccggaaccgccggcctcgacgccgcggacgccgcccgctaccggctgaccgagttcccgacgcagcaggcggcgacgttcgcggagcagtacgcgatgctctgcctgacgtactcgccggacggcgcgtccaagcggcgggacagtctcgcccggtacgcgtcctcgggcgtcgaccccgagtgcggctggagcggtgaggggaccagcaaggccgtctcggccgtctgggacggcacctccgagaagctcgccgaatacggtgatcacggccgctacctgggcatccaggtccgtacggacgagggcgacctcaccacgctgaccgttcccgtctacgtcaaggacctcgcgtccggcgagggcatgcgcgtcgccggcgacatcggcgagatgccgatgccggggcgggcgaacgtcccggaactcgacaaggacgacgaggtggtggacacctccctgtcgcagcagctccaggagaaggtgctgccgggctatttcgaggcctggggcgcgtcggactcgaccgccatggcccgcttcaccgcacccggcgccacgctctccgcgaccgccggcctcgccggacggctgaccggaccgaaggtcggcacggcggaggcactggtccccgcgaacgtccaggacaccaagccctacgcctaccgggccggtcagtccgtgcaggtgcgagtggtcgtcgactggagcgagggagagagccggatcgtgcgccgcgcgtaccggatgaccgtggtgaacaccgcacagggctggttcatcaaggacatccgcggcggggtgctcgacgcgcagggcggccgggccgactcggacgaggacaaccagcccgccgaggaggaccccggtacgggggccaccgactccgcctccccgtccgcctcagcctcaccctcagcctccacgcagtcgtcgaagggcaagcggccgggcaagccc

SEQ ID NO: 4487 - DNA, 627 bp, Streptomyces avermitilis
  CDS (1)..(627)
atgctgacggagacgacgggccgtaccgcgcaggacctggcggtcgagctggcggtgctgcgggacgcggactgggccgctctgtgggcgggaccgccgcagagcggcatcgccttggagcgctggtgcgggaggtacggctgggagccgctgacctccgaccggcagctggtggtgcgcaccggcaacgggggcgagttgaccttcgattccggtggcatctggggaagcccggtcaccagtgtgtccctcagtgcctgctggcacgtgaaggcttccgctccggcggagaacggtacggttctgaccgctgcggcggagaggtggccgacgtacctggaggcggcgaccggcgcgctgggggcgcccgtctgggccggtccgtgggacgccccggacttccccgagccggaggaccacgcgggtgtctgggagggccgggagtcccggctgaagcaccgcagtccgtaccagctggccttctggggtccgctgggtgaggccccggtagaggcgctcttcgtcctgaatcagtcggtttccttcccgacctggaccccggacatgccgggcgggtccacgatcaggatggccgtgcacaggcccgtcggcttccggagccgccgg

SEQ ID NO: 4488 - DNA, 1023 bp, Streptomyces avermitilis
  CDS (1)..(1023)
gtgagcctgggatccccgcctgccagggacgagatagagcgggcgttggctctgcaggacgcgtacgaggccgcggcgccgcgcgatcgtgacgaggcacgggtggccgtcggtcggatgtacgcggactggcgggtggcgcacgagcaagggcgggagtttccggacctgttctccttcgtccgggatgtcgccggaaacggctccgtcacgcatccggaccggggcgaggtacgggcgttctggtcatggaagtcgcagcccgagggcgcaccgcgtgaggtgggacatcgctatctcgcgcaggcgtgcgggagttcacgtggcatgcaggtgctggaggacagtccggccggccggcagctggactcgtaccacctctggaacaccgaggtgcaacgtgccctggtggacgacttcgagctggacgaagccgcggtgacggccctcgcccccgaagtctggagcaccgtctcccagcgctacgccgaggccgccgaaggcccggtcgtcgcgttcgccgccgacatcggtgccgcgtccgtcctcggcaaggacgaactgccccggctcctcgcgcacacgaacgtgggcaaggagaacatcaagttcccgctgccctcgccccggcatgagcatctccccccggagatcgacggattgatcgcggacgacgccgtacgggcccaggtgcggatggacgacttcgacccggccgggtccccgaaggacttcgcgcggaagctgggcggcgtcgacgtaccggagcggctgcgcgaggaccacgaggccgcgatgtggcggctggggctggccgacacctacgagcagttgcacccgaagcccccgacgcggcagcgtgcgacggcgagcgagttcctgcccggcgtggacgtacgtctcgtcgcccgccccgccgccccccgcggccccaccggccacggcgtcatgaacccggccgcggccctctccgtgccgcccccggccgccgtcccggcccaccagcccacaggaatcgagcga

SEQ ID NO: 4489 - DNA, 378 bp, Streptomyces avermitilis
  CDS (1)..(378)
atgaccaccccccggaccagcagcgagacacaacaggacgcggccgagccggagttctacttcgccgacgtctacctcttcgtctccgactacctctccccgacggtgcgccgccgcatcaacggttccagtgccacctggtgcccgaagtggtgggagcacccggaggccggtgcccggctctccgcgctctggctggcctgggaacatctgcgtcacgacccggcgctcggcatgtccacctggtggctccaccacgccgacccgcacctgcgtgtcctcatggacccggatctgggcccgttcgccgcctgttcaccacgggacggacacacggcgtacccgttcgacccgctgccggtggacgagcgcccggcc

SEQ ID NO: 4490 - DNA, 681 bp, Streptomyces avermitilis
  CDS (1)..(681)
atggagttgcctgcggagaacaagcgtgccgggctgctggccctggcggtgctcggcattctcctggtcgccgtgctcaccgtgttcaccgtgttcgacggggacgacggcggcggcgcggacgaggcggcgccggccggcccttccgggcagtcggacgcgggatcggagccggggccgggcggtcaggacgacgcgaacgccgacgagccggccggcggcgcacccaccccgatcgtcgcgctgtccgaggtggccaaggcgcacaccgtcatggcgaggtacatggccggcctgagcacgtacgaccacacgagcaaggccccggcctggagcgccccgctgctccggctgaccaccgacgacacgcagatgaagcaggcgaccacgctgccgaccggcaaggagtgggcgctctgccgggccgcgaggtgctcgtcgaagggcgcggccgtcgtcgtgcgcgacgcggtgatctcggacgacgtggtgcgcggcagcggccggacgatctccagcgtggtgaaggtgacgtcggcccgcgaggccgacggcaagcagtccaccgagtccaaccggtggctggtgagcgtcaaggagagcggcgacggccagtgggccgtgtcggggttcgacatcttcggcctcggagacgtgggcgcctccgacgagtccgggggc

SEQ ID NO: 4491 - DNA, 2103 bp, Streptomyces avermitilis
  CDS (1)..(2103)
atggtggcacccgctgtactcgcggccgcttccaaggccgcgaaggtcgccaagaaggccaagcaggcaggccgtgccgccgccggtcccggtggcggaaagggcggcgacgacggcaagaagaagaacggcctcaagctgtggctgatcctcggcagcggcggaggcctggccgccggggcggccgtcttcctcgtcctgctgctcatcggcagcatggtgggcggtgtgggcaacggcgccgtcgccgccgcctgcggtgactacgccgacaacgccgaagcgggcaacacgggcgacgccgccgcgacgaacccgatcatgccggccggcaaggtctacatgccgagcgagaccgcccgcaacgagatacccccgaggatgatcctcgcggcgatgcgcggcgccgcccgctacaagggcctcgactggacgctcatcgtcgggcagatgtaccaggagaccaagtacgggcaggacaagtccgcggcgcccggcggcaagaactccctcggctacatgggcatcctccagttcggcccgcccgcctggcacgactacggcgccgacggcaatgccgacggcaccaaggacctctacaacatcgacgacgccgcctgggccgccgccaacttcctgcacgcccagcacgccgagaccaaaccctggaaggcgctccaggtctactccggctccacggcctccaacacgatctacccgcgcgtcgtgctcacccaggccgcccgctaccgcggtgtgctcaccggcgacgaggacctgatcaagcgctggtacgcgcatctgaagaagaccatcgacaagaaccccggcttccccaccctcgggaagcagtcggacatccccgagccggtgggcaacgacgcccagcccggctccgcgctcagcatcgcggccgcgtcgccgcgctcgtggtcgactccggcgctggacggcggcgacgacagcggcgtgaccacggcgatggcaccggccgcctacacggcgagcacggccacgctcgccggtcccgccaccggactcctcgccgccaggaagcacaccgacggcggcaaggactggcagtggccgctgaaggagggcacgtaccagctcggcacccgctaccacgagaacggcaccatgtggagcaccggctaccacacgggcctggacctcgtggcttccacgggcaccccgatctacgccccggccgacggcaaggtcgtccacgcgggccccggcggcgcgtacggcaacgagaccgagatccagcacgcggacggcgtcatcacgctctacgcccaccagaccaccatcaaggtgtcggtgggccagcaggtcaagcgcggcgaccagatcggcacggtcggcgcgaccggcaacgtcaccggcccgcacctgcactgggaggtccggctgccgggtgtggacaatccgttcgtcgcgggccaggaccagggccccggcatggtggaccccgcggcctggatgaagggcaaggtcacggccagcccggactacggcaccgtgcccggctccggcgacaagggcaaggacgcccagtacgccgactgcgccgaggagaacggcagcgccgccgtcgccccggacggcgcgggcgcctccggcgtcatcccggacgccgacgacccggtgatccgggcggtcctcggctgggcgcagcgcggcatcggcgtcccgtacgtgtacggcgcgcagcgtctccagggccagaacccgaccagcttcgactgttccagcttcacgcagtgggcctactacatggccagcgacgggaagatcgacatcgggacgacgaccggtacgcaggagccctatctccgcgcgcacaaggtgtcgctgtccgaggcccagcccggtgacgtgatcttcttccggccggaggccgacggcacgtccggacacgtgggcctggtctgggacgccaagggccacaagatcatccacgcgccgcggccgggcaagaccgtctcgttcagcacctgggacgtccaggacaagatcaccggcgtgtaccgcgtgccgatccccaagggcacggacgcggtcgagggcgacggtacagagaacgcaaagggagca

SEQ ID NO: 4492 - DNA, 1443 bp, Streptomyces avermitilis
  CDS (1)..(1443)
ttgacgaagcgtcatatctggtacgccgccggagccgccgcgctgtcactggggttcgcagcgggctgcggcacgggcgacgacacgcagggggccggtgcgacgaggtcggcgaagccgaggacgtccgcctccgccacatccaccgggcccgcctacaagggggccgcgctgcccgcgctgagcaggcggcccgcgtggagcctgcgagccgacagctcgacaggctgtgccggtgaccccgccagggccgcggcgacctccaccgtcggggacgacccggagacctgtgtgctcggcgacgccgtcgtcgtcacccaggacctgacgaagtaccccggctcgtcctcctccggcgacgagccggacgagtaccacttcagggcccgtctctacgacgcggccacgggcggcgtacgcgcctcggtcgatgtggagatccccgacagctggccgggcaagcgcgagcacaagccctccgcgttcctcacggtctcccagtggacggacggctcgcccgccctcctggtcgtcgacggtgatgtgaccgaggcgagtggcctgaagaaggagtcggtggagacctcgtacaccatgtactccccctccggcaggaagctgggcagttcttccttccagggcgccggccgcacggacctgaccgccgaggcggggcacgtcctgctggacgagggcagcaagagcagcacgtacgccccgataggcggcggcgacacggtgccggtccacaacagggcgtacgggcagcagccgatcgggagcggcttcggctaccgggtcgccacgggcagcgacgtgtgggacacgagcggcacctggctggtcgtcagcgaccggctcaccggcaaggaactgtggaacaccaaggacgacgtcgacgtgcccgcggacatcgcgtcggcgaacgacgacgacgccaagcccgtccgtatctacccgctgtcggccgacaaggccctgctcgcctgggagctgtcggacgacgacccgtacgacgcgctcctcggcgtggtcgacctcaagaccggccgcactctcgcgcagggcccgaaggtggccttcggcgacgtcgcgggcgacgacacggcggacatcgccctgtccccggacggcacaaccgtcgtcacccggttcggcggcggcgcggtcgcctggaacgtgaagaccggcgacgaactgtggcggcaggaggacgacgaacaggacatcacgcccctggcgctcccgtcggccgacgtgctctacgcctccgtcggcgacatgcggctcgcggccctgaacatgcggaccaagaagctgctgtcccccgacctcgctcccgacgtctcgctcgccgaggacggcgacgccctgcagttcacgacggacggctacggcgtgctggcgggacagcatctcttcgtcttcgcgcccggatcggcc

SEQ ID NO: 4493 - DNA, 1728 bp, Streptomyces avermitilis
  CDS (1)..(1728)
gtgaccgcagaacaacagaagaaaccccgcgccgaggacgactggaccttcgagatcgtcgccctcgtcgccgtggtcctcctgggagtcggcggcgcctggctcgccgcgaagctcggtgcgggcttcgccgacgcgcccgggccgccctcgaacccgctgtcgttcctcgtggcctgcgtcaagggcgactacagctggccgggcggtgcggcgagcgccgtcgcggccggtgaggcgctgctgctcggcatcctgggtctggcggcctaccgggtgcgcgagcgtttgcgcaaccggccgaaggtcgacggcgcggcccagcacctggcgcagggcgaggagttgggcaagctcacgatgaagggtgcggcggccaccgcggagcggctcggggtgaggtcgaagacccccggcgtcttcatcggacggtcggtgaagggcagacagcccctgttcggctcgtacgaggacatgcacgtcgacatctggggcccgcgcaccggcaagacgacccggcgcgcgatccccgcgatcctcgacgggcccggcgccgtgctggtcacctccaacaagcgggacatcgtggacgcgacgcgcggcccgcgtaccgcccgcggcccggtctgggtgttcgacccgcagcaggtcgcgcaggagacgccgagctggtggtggaacccgctgtcgtacgtcaccgatgtcgccaaggcccgcaagatggccgaccacttcgcctccggctcgcgggacgcgaacgcgtccacggacgccttcttcgacccggcgggccaggacctgctcgccaacctcctgctggccgccgccaccgccaaggcgccggtcacccagatctacacctggctgtccaacccgaaggacgacactcccgagcgcatcctgcgcggggccggtcacaccatgtccgccgacggcctcagcggcgtcatcagcgcgcccgacaagcagcgcagcggtatctacggcgtcgcccagcagatggcgtcctgcctggtcaacccggaggtcaaccgctgggtgaccccgccggccgacccgtcggctccggagttcgacccgcacgagttcgtccgcaccggcggcacgctctactccctctcccgcgagggccgcgactcggcgggcccgctggtgaccgcgctgacggtggcggtggtcgaggcggcggaggagtacgcgacgacgcagcgcggcggccgcctccccctccccctcgtcggcgtcctcgacgaggccgccaacgtctgccgctggcgcaccctgcccgacctgtactcgcactacggctcgcgcggcatcatcctgatgacgatcctccagtcctgggcgcagggcatcgaggtgtggggcgagcgcggcatggagaagctgtggtcggccgcgaacgtccgcgtctacggcggcggtgtctccgacacccgcttcctgggcgacctgagcgagctggccggcgagttcgaactgcgcgactaccagacgagccgctcctcggagttcggcggctggtccggcaaccggacggtcagcgagtccgtacgccgcgaacgcgtcctccaggtctccgacctgggctccatgccccccggccgcgccctcgtcctggcctccggcaccaagccggtcctggtcgagaccgtgccgtggtgggagggtccgtacgcccgcgaggtccagacgtccctgaagaagtacgaccccggggcgcgc

SEQ ID NO: 4494 - DNA, 1212 bp, Streptomyces avermitilis
  CDS (1)..(1212)
gtggtcgcgccgcgagatcgctggagagctgtgtcgcggacagaccggagcaccccgctccggtcggcggaagacgctggagccaagggttggagccaggggtgggaaatggccgggcacgggacggacgcgcatccgcacggtgctgaccgactgtgcgaggccggggatcgcgtgtattcccgggccgtacgacggggccgcgtgccccgcgaggacgcggaaacggtgccttgtctggtcgacttggcactgctgcacccggaccccgacgacatggcgtggctggtgccgacgtctccgcaggaggtcatgacgcggctgctgcggagcgtgcacgacgaggtcggcgcgagccaggcgcgggtcggggcggcggtcgccgcggtcgagtggtacgccgggctcggcgggcgggaacaggcaccgcaggagggcgtggcgatccgggtcctcgacggactgccccggatccgcgccgcgatggacgaggcgacacaggcgtgcacgagcgaggtgctgacggtgcagccgggcggcatccgccgcgaggacgaactggcggaagggctgcaccgcgccctcgagctgcgccgccggggcgtgcgcatgcgcgacctgtacacccatgtggcgcggcacggacagggtctgcacacctacatggagctgatgggcgacgcggcggaggcacggacgctggacgaggtcgtggagcgcctgatcctcttcgaccgcaaggtcgccttcatccccgcgagcgcggaccgcacgatcgcgctggaactgcgccaccccgccctcgtctcctacctggtgacggtcttcgaacgcctgtggcggctggcgatcccgctggcggcaccgctgccggagaccggcatcgacgggatcacccaccgcgagcgctcgatcgcggcgctcctcgcggagggccaccaggacgcggtggtggcggaacggctgggcatcagcgtccgtacgtgccgcgcgcacatcgcccgtctgtcggagacgctcggcgcggcgagccgtacgcagctgggggtgcgtatcgcccaggcggggctggacgggccaccgcggtcgcccgagctgccgccggccacgcgtgcggcgggctccacgaacgcggcggggcccgcgaacccggcgggcgcggcgagcgccgcgggtgccgcgagtgctcctcgaggctcccggaccgcccga

SEQ ID NO: 4495 - DNA, 981 bp, Streptomyces avermitilis
  CDS (1)..(981)
ttggcaacaaatggggcacaagcggaacatccccacgctgtaacggagctgtgtgatgaaggcggcctcctctacgcgaacgctctgcgtacgggacgcatcgccagagaggacgcggcgggcgttccctgcctgatggagttcgcgctcctccaccccgatcccgacgatcccaactggctccgcccggtacctccgtccgtcgccctggcgcagcggctcaaccccatcgagcgcgagataaccgaacgcagacggctgtcgatcgaactggccgatgctttcgagccgttcatggcggtcagcgcccaggccacggtgtccacgcactccatcaccgtgctggagggcttcgagcggatcaacgcggcgctcaacctcgccacggaccagtgccgcaccgagatgctgaccgtccagccgggcggccgccgccccgagcacagcctgatccaggggctggagcgggaccggccgttgatcgaacgtggtgtgcgcatccggaccctgtatcagcacacggcccgctacagcccggagacgctggcgtacgtggaccagatcgccgacggcaaggtggagatacggaccatcgacgaactggtcgaacgcctcatcatctgtgacgaggccgtcgccttcatccccacccgcgacgaccggcaagtggccctggagctgcgtcacccgggcctcgtccgctatctgatcaaggtcttcgagttcatgtggggccgcgcggtccccctggacgcgggcgccccgtacgaaaccgccgccgacggcatcaccgacatccagcactccatcgcgaagctgctcgtggagggccatgtcgacgaggccatcgcccgacggctcggtatgaacgtccgcacgtgccgcgcccacatcgccaagctggccaccgcactgggcagtggcagccgggcccaactcggcttcctcatcgcccagtcgggaatcctgaaccagaacggc

SEQ ID NO: 4496 - DNA, 333 bp, Streptomyces avermitilis
  CDS (1)..(333)
atgactactccgcccgacgaccgcaccttccgcagagaaatggccaccgcctaccgatccggctggcacttcatcgacctggtcaccgccatcccccaaggtggtgactcgttgatggtgacggtcttcggagagcccgtggtcgtcacccgggacgaggacgaggacgtgcgggcgtaccggtgtctgcggcggcctcggggggcgccgcagcctgtgcggtgcgccgtgcggtacggaatgatctttgtgaacctggaccagcgcgaccaccagctggtggagccggaaaccccggacgtgcggaccatctcagccaccccccgcagtgcc

SEQ ID NO: 4497 - DNA, 414 bp, Streptomyces avermitilis
  CDS (1)..(414)
atggccacgtaccccgtgaatccgcgcgatcccgaccccgcgtatctcgacttctggcgggagcggcacctgtgcaccctgacgacgctccgacccgacggcaccccgcatgtggtgcccgtcggggttacgtacgaccccgaggcgggactcgctcgagtgatcaccaacaagtcgagcacgaaggtggccaacgtcctggccgccgccggtcccgagggggcccgggccgcggtctgccaggtggacgggcggcggtgggcgacgctggagggacgggcgtgcgtgcgcacggagccggcgcggatcgcggaggcggagcgccggtacgcggagcgctacacgcgcgagccgtcgccgaacccgtcacgcgtggtgatcgagatcgaactgacctcggcgatggggagaggc

SEQ ID NO: 4498 - DNA, 2610 bp, Streptomyces avermitilis
  CDS (1)..(2610)
gtggacgccgagctgaccaacaggagccgggacgccatcaacgcggccaccaacagggccgtgtccgaggggcacccggatctcacccccgcgcatttgctgctggcgctgctggggggcaaggacaacgagaacatcacggacctgctggccgcggtcgacgcggaccaggccgccgtgcgcgccggcaccgagcgtgtcctggccaaactgccgagcgtgaccggttccaccgtcgcgcccccgcagcccaaccgcgagctgctcgcggtcgtcgccgacgcgtcgcagagggcacaggacctcggcgacgacttcctgtcgaccgagcatctgctcatcgggatcgccgcgaacggcggcgcggccggcgacgtactctcccagcagggcgccagtgcgaaaaagctgctggaggcgttccagaagaccaggggagggcgccgggtgacgaccccggatcccgagggccagtacaaggcgctcgaaaagttcggtaccgacttcaccgccgccgcgcgggacggcaagctcgaccccgtcatcgggcgggaccaggagatccggcgggtcgtgcaggtgctcagccgccgcaccaagaacaatcccgtcctcatcggtgagcccggcgtcggcaagaccgccgtcgtcgagggactcgcccagcggatcgtgaagggcgacgtcccggagtccctcaagaacaagcggctggtcgcgctcgacctcggcgccatggtggccggggcgaagtaccgcggtgagttcgaggagcggctgaagaccgtgctcgccgagatcaaggactccgacgggcagatcatcaccttcatcgacgagctgcacaccgtcgtgggggccggcgccggcggtgactccgcgatggacgccggcaacatgctcaagcccatgctcgcccgcggcgagctgcgcatggtcggcgccacgacgctcgacgagtaccgcgagcggatcgagaaggacccggcgctggagcggcgcttccagcaggtgctcgtcgccgagccctccgtcgaggacaccatcgcgatcctgcgcgggctcaaggggcgctacgaggcccaccacaaggtgcagatcgcggacagcgccctggtggccgccgcggcgctctccgaccggtacatcacctcccgcttcctgcccgacaaggccatcgacctcgtcgacgaggcggcctcccgcctccgcatggagatcgactcgtccccggtcgagatcgacgaactccagcgtcaggtcgaccggctcaagatggaggagctggcgatcggcaaggagaccgacgccgccagcagggagcgtctggagaagctgcgccgcgacctcgccgacaaggaggaggagctgcgcggactcaccgcccgctgggagaaggagaagcagtccctcaaccgcgtcggtgagctgaaggagaagctcgacgaactgcgcggccaggccgaacgcgcccagcgcgacggcgacttcgacaccgcgtccaagctgctgtacggcgagatcccggccctggaaagggacttggaggaggcctccgaggcggaggaggaagccgcccgggacaccatggtgaaggaggaggtcggccccgacgacatcgcggacgtggtcggctcctggacgggcatcccggccggccggctcctcgagggcgagacgcagaaactcctgcgcatggaggaggagctggggcaccggctcatcgggcagtcggaggccgtgcaggcggtgtccgacgccgtacggcgcacacgagccggaatcgccgacccggaccgcccgaccggttccttcctcttcctcggcccgaccggtgtcggcaagaccgaactcgccaaggccctcgccgacttcctcttcgacgacgagcgggccatggtccgcatcgacatgagcgagtacggcgagaagcacaccgtcgcccggctggtgggcgccccgcccggctatgtcgggtacgaggagggcggccagctcaccgaggccgtgcgccggcgtccgtacagcgtcgtactcctcgacgaggtcgagaaggcgcacccggaggtcttcgacatcctgctccaggtgctggacgacggacgactgacggacggccaggggcggacggtcgacttccgcaacaccatcctgatcctcacctcgaacctgggcagccagttcctgagcgggcacggcccggccgagccgcagacctcggaagaggagaagaagcggcaggtcctggaggtcgtacgggcctccttcaagccggagttcctcaaccggctcgacgacctggtcgtcttctcggcgctgaaccgtcaggagctggagcgcattgccaagctccagatcgaccggctggcccagcggctcgcccagcgtcggctccgcctggaggtcaccgacgcggcgctggcctggctcgcggaggagggcaacgacccggcgtacggcgcccgcccgctgcgccgcctcgtccagaccgccatcggcgaccgcctcgcgaaggagatcctggcgggcgaggtcaaggacggcgacacggtacgggtggacgccttcggtgagggcctgatcgtgggcccggcgaccggcaagacgctg

SEQ ID NO: 4499 - DNA, 525 bp, Streptomyces avermitilis
  CDS (1)..(525)
gtgagcatcgacccgtcctcgattccgaacttcgggggccagcccgagcccgagccgcaaggaccggcgggccccgtggtcccggatcaggacctcgtgaagcagctcctcgaccagatggagctcaagcacctcgtcgacgaagagggagacctcgtcgcgccgtgggagcagttccgtacgtacttcatgttccgcggtgaggacgaccaggccgtcttctcggtgcgcacgttctacgaccggccgcaccagatcgaccagaaggccgcgctgctcgagtcgatcgacgactggaaccggcgcaccctgtggccgaaggtctacagccacacccacgacgacggcaccgtccgcctgatcggcgaggcgcagatgctgatcggcaccggcgtcagcctggagcacttcgtgtcgtcgaccgtcagctgggtccgggccgccatcgagttcgacaagtggctcgtcgagcagctcggcctggagcaggacgtcaacgaggccgagaagcccgaggacgacgag

SEQ ID NO: 4500 - DNA, 1209 bp, Streptomyces avermitilis
  CDS (1)..(1209)
gtgacccacgccttcaccattccggccccgtccgtcgaagaccccgagggtcccccgggcggcggtgcccgccggaccggtgccgcgcgccgtctgcccacgacggccgccgccgctctcgggctgttcgccgccgccaggctctgcgggtttctcgtgctcgccgccgtcgcctgggccagcggcaagagccccctgcggctgctggggcactcctgggactccgtctggtacctgaggatcgccgcccacggctacgtcgggccgcagtacgtccggccggccgtcgtccgcagcgacacggccttcttcccgctgtacccgggactcctgcggtccgtctccgaggtcaccccgctgagcctggagacggcgggcctgctggtctcgtggatcgcggccgcggtcgccgcctacgggatctacctgatcggcaaccggctgtacggccgcgcgatcgccaccgccctcgtgctgctgtggggcctgctaccccactccgtcgtgctgtcgatggcgtacacggaaccggtactcaccgccttcgccgcctggtcgctgtacgcggtgctgaccggccggtgggtgtgggcgggcgtgctcgcggcctgcgcggggctggcccggccgaacggctgcgcggtggctgccgcggtcctcgtgacggccgcgtacgagatctggcggtcgcgcggacggggagtttcccacaggctgtggacgggcgccgcgctcgcgccgctcggctggtgcgggtacgtcgggtgggccgggcaccgccagggcgatctgctcggcggctatttcaccgtgcagcgcctgtggggctcgcgcttcgacctcggctacggctcgctgctcttcgtcaagcgcctgctgctgcacggcggccggttcgtgttccccatctcgctgctgctggtcgcggtcgcggtgctgctgttcgcgctgctgatcgccgaccgcacaccgctgccgctgctcgtccacagcggcgtactgctgctggtcgcgctcggcggggcgggcttcttccagtgcaagccgcgcttcctgctgcccgcgttcccgctgctcatcccgctggcgcgggccctggtgcggacggcgagagcccggccgtcgcacgccgtcctggtggtcggcgccctggccgggctctcgttcgcttacggggcgtatctggtcgcgttcgcccgcacgcctcta

SEQ ID NO: 4501 - DNA, 1194 bp, Streptomyces avermitilis
  CDS (1)..(1194)
atggcggccatgacctccagcgcacgccctctcctcaaccgccggctcgccgagttcgggacgacgatcttcgccgagatgtcggccctggccatgagcaccggggccatcaacctcggccagggcttccccgacaccgacgggcccgaggagatccgcgaggcggcggtgcgggcgctgcgcgacggccgcggcaaccagtacccgccggggcccggcgtccccgagctgcggaccgcgatcgccgcgcaccagcagcgccgctacgggctgacgtacgaccctgacaccgaggtcctggtcaccgcgggcgcgacggaggcgatcgcggccaccttgctcgcgctcctcgaaccgggcgacgaggtgatcgccttcgagccgtactacgactcctacgccgcctgcatcgcgatggccggcggcacccgcgtgccggtcaccctgcgcccgcaccccgaggacggccgcttccgcctcgacctcgacgagctgcgcgacgccgtcaccgaccggacccggctgctgctcgtcaacactccgcacaacccgacgggaaccgtgctcacgcgcgaggagctgacggcgatcgccgagctggccgtcgagcgcgatctgctggtcgtcaccgacgaggtgtacgagcacctggtcttcgacgacgccgagcacctgccgctcgccacgttcccggggatgcgggagcggacggtctcgatcagctccgcgggcaagaccttctccttcacggggtggaaggtcggctgggtgaccggggctccgggcctggtcacggccgtccgctcggccaagcagttcctgacgtatgtcgcctccgggccgttccagtacgccgtcgccgaggcgctcgcgctgccggacacgtacttcgaggcgttccgcgcggacatgctggccaagcgcgacctgctcgcggccgggctcacggcggcggggttcgaggtcttccggccggcgggcacgtacttcatcaccaccgacatccggccgctcggcgagagagacggtttcgccttctgccgcgcgctgcccgagcgggccggcgtggtcgccatcccgaacgcggtcttctacgaccaccgcgaggcgggcgcccccttcgtccgcttcgcgttctgcaagcgcacggacgtactggaggaggcggcgaagcgcctcggcacgctgcgcggc

SEQ ID NO: 4502 - DNA, 516 bp, Streptomyces avermitilis
  CDS (1)..(516)
atgctcacgaccctgaacacctcgtacaccgacacgtgcgcggccgacctcgcctggaccctgggacgcgagccgctgcccgccctcgccaccctcgacctcgaactggcgggtgcgaagctccagatgaggctcctcggcgcctcccaccaggtactcctggaggagaagcggggcaactgttcggagactgtcgcctgcatctccggcagcagtacgccgctgccgctcggcgtggccaagcgggtcggcgactgggagtacgagttcgcggcccgggtggaggtgctgtcccccggctccttcgcgggccgcgcccaggaattgctggccctggtctccgaccacccccacggcctggccggcgtcttccccggcagcccgcacgcgttcacggcactgctcgcccagcaccacgagggccaggtgcactggcgtacgtggcacgcgtatccgcaggacggccagttggtggcgacgcggacgcgggtgggggcgcgggtgagggcgacctcg

SEQ ID NO: 4503 - DNA, 1644 bp, Streptomyces avermitilis
  CDS (1)..(1644)
gtgatcgaaccgcacgcgcctgcaccgcccggcgccgcgcccccgtggggcggccagagccggccgtggctgcccgtacggcccggtgtcggacggttcttcgtcctggccggcgttttcgtctgcgcggcctgtggactcgtgtacgaactcgaactcgtcgcgctcgcctcgtacttgatcggtgactcggtcacccaggcttccgtcgtgctctccgtgatggtcttcgcgatgggcatcggctcgctcgccgcgaagcggctgcgcccgcacgccgccgccggtttcggcgcgatcgaggcggcgctcgcgctggtcggcggctccagcgccatggcgctgtacgcggtgttcgcctggaccggcgactggggcggggtgtgggcgggcggcccccgctgcctcctcgtcgccttctccctcgccatcggcctgctgatcggcgccgaagtccccctgctgatggagctgatccagcgcatccggcgccaggacgcgggcggcgcggtggcggacctgttcgccgcggactacgtgggcgcgctggtgggcggactggcgttcccgttccttctcctgcccctgctcggccagttggagggcgtactgctcaccggcacggtcaacgcgctggccggcggtgcactcgtactggggctgttccggcgggacttgacccggcgcggccgctggctgctgatcgtcgtcaacctggtcgtcctcggcctgctcgccacggcggcggtcctggtcgacgacttcgaacgggcggcacgccaggccgtgtacggcagggacgtccgcgtggccctgcagacgggcgtccaggaggtggtgctgaccggcggcacccgcgggcgccccctcgacctcttcctcgacggccgcctgcgggtcagcggccatgacgagcgccgctatcacgaggcactcgtccaccccgcgatgagcgacggccggcacgcgcgcgtgctcgtcctcggcggcggtgacggcctcgcggcccgcgaggtgctgcggtacgcggacgtggcgcgggtcgacgtggtcgaactggacgcgggcgtcgtacggctggcccgccgcgacccggccctgtccagcctcaacgcacacgcgtacgacgacccgcgggtgcacgtcgtgacggcggacgcgttctgccggctgcggcacacccgttcggcgtacgacgtggtgatctcggacctcccggacccgggcatcacggcgagtacgaagctgtactcgcaggagttctacggcctggtgagccgggtgctggcccccggcggccggctggtggtccacgcgggaccggtcgcctcccgcccccgggcctactggacggtcgaggcgaccgtccgggccgcggggctgcgcaccgtgccgtaccgcgtgggcggccgggacacgggcttcgcggcgggccccgaccgctcgaccgacgcgtcccgggcaccgcgcgactggggcttcgtcctcgcctcccgtacgggcccggccctcagcctcggcccgggcgggccgaggctgcgtacgctcacccgggcgtcgctggccgcggacgcgctggacccgggccgcgcccgtccgccggacgtggcaccgtcgacgctggtgcacccgaggtacgcggac

SEQ ID NO: 4504 - DNA, 930 bp, Streptomyces avermitilis
  CDS (1)..(930)
gtgcggtccgggccgtgctgggtaggctcggctgacatggagcatgaggtgttcgttccggttcctgccgagcggctgcgggagacgttggccgaccccgcccgggtcgcccgggcggtacccgggcttcaacaggacgcggggacgccgcccgtcgcggggcgcctgaaggtgcgcgtcggcggccacacgatcacctaccggggtgcgctgcggatcgcgagccaggaggacggttccttcgcggtcgagggtgacgcgacggaggcgcggggcggcggttccgtgaagctcgccctgacgctgcggctgcggccggcgcaggacggcacgactctcgccttcgacggcacggcgacggcggacggccgggtggcggaactcccaccggagacggtgacctcggcgacgacccgcctgctgacccgcttcgcggagaacgtggcgacggcgacggcgacggcatcgccggaggcggaggcggaggcggaggcggaggcgccggaacccgccggttccgaggtgacgtccgatccggagccggtgcccgaagccgagcctgcgccgcaagccgaagcggagcctgcgccgcaagccgaagccgaggcccccgcgtccccgccgtcgtcccccgaggaattcgacgaggaggacgacctcgtcgccgagggcttcgtgggcgagggggagccgcccaccgatggcttcgtgggggagagcgggccccccgccgaggcggcgcacgcgcggcgcacgatgatcggccgcagcgcggaggaggtggaccacgcgccgccccgcggccgttacgccccggtccccgcgccggagacgaccaccgccggagcgaccctccgctgggcggcccccgcggcggcgctcgtggtggcgtcggcgatcgtcgtgggacgcgtcctgcgccgccgccgc

SEQ ID NO: 4505 - DNA, 786 bp, Streptomyces avermitilis
  CDS (1)..(786)
gtgagtaacgacgagatcacgctgaccgcgggcgacgcggaagtggccctggtaccgggaagcggcggacgcgtgcgcagcctgcgcgtcggcggggtggaactgctgcggcagggcgagcgctacggctgcttcccgatggttccgtggtgcggccggatcagggacggcaagttccgcaacggcgccaccctccaccagatgcccctcaactccccgccgcacgccatccacggcaccgccagggacggcgcctggcgcgtcgcgcgcaccggcaagaacgaggccgtcctcacgtacgacctcgtcgagccgtggccctaccccggccgcgtcacccagatcgccgccctgaccgaggactccctcacgctcaccatgagcgtggaggcgtacgactcctcgttcccggcccagatcggctggcacccctggttcaaccggaacctggggcaggacgacgcacgcgtcgacttcacccccgcctggcaggaggagcgcggcgccgaccacctccccaccggcaaccgcgtcgcccccctccccggcccttgggacgactgcttcggcatgcccgacggcgtccacgtcaccctcagttggcccgggcagctggagctcaccgtcgcctcccgcgaggagtgggtcgtcgtgtacgacgaacagcccgaggccgtctgtgtggagccgcagaccggcccgcccgacggactcaacacccgtccgcgcctggtcacacccatcgagccgctggaagccacgaccacctggacgtggcggacgctg

SEQ ID NO: 4506 - DNA, 546 bp, Streptomyces avermitilis
  CDS (1)..(546)
atggatgacgtacgtggcgcgctgttgcagcagatcaaggacaaggccgtggtgcacggcaaggtgaccctctcctcgggtctcgaggccgactactacgtcgacctgcgccgcatcaccctggacggggaagccgcgccgctcgtcggacaggtgctgctcgacctcaccgccgacctcgacttcgacgcggtcggcggcctgaccatgggcgccgacccggtcgccgcggccatgctgcacgcggccgccgcgcgcggccggcgcctcgacgcgttcgtggtccgcaaggccgccaaggcccacggcttgcagcgccgcgtcgagggccccgagatcaagggccgccgcgtgctcgtcgtcgaggacacgtccaccaccggcggctccccgctcaccgccgtggaggcggtccgggaggccggcgcggaggtcgtgggcgtcgcgacgatcgtcgaccgcgcgaccggcgccgccgagaagatcgaagcgggtgccggagtcccctaccgcttcgcgtacgacaaggacgagctgggcctcgac

SEQ ID NO: 4507 - DNA, 1020 bp, Streptomyces avermitilis
  CDS (1)..(1020)
atgcccatcgcaacccccgaggtctacaacgagatgctcgaccgggcgaaggcaggcaagttcgcctacccggccatcaacgtgacctcgacccagaccctgcacgctgcgctgcgcggcttcgcggaggccgagagcgacggcatcgtccagatctccaccggtggtgcggagttcctgggtggtcagtacaagaaggacatggtcaccggcgccgtggcgctggccgagttcgcgcacatcgtcgccgagaagtacccggtcacggtcgccctgcacacggaccactgcccgaaggacaagctcgacgggtacgtccgtccgctgctcgcgatctccgaggagcgcgtcaaggccggccggaacccgctgttccagtcgcacatgtgggacggctcggcggagaccctcgccgacaacctggccatcgcgcaggagctgctcgagaaggcccgcgccgcgaagatcatcctcgaggtggagatcaccccgaccggcggcgaggaagacggcgtcacccacgagatcaacgactcgctgtacacgacggtcgaggacgcgatccgcacggcggaggcgctgggcctgggcgagaagggccgctacctgctggccgcgtccttcggcaacgtgcacggtgtgtacaagccgggcaacgtcgtgctccgcccggagctcctgaaggagctcaacgagggcgtggccgcgaagttcggcaaggccgacccgttcgacttcgtcttccacggcggctccggctccacggaggccgagatccgcacggccctggagaacggcgtcgtcaagatgaacatcgacaccgacacccagtacgcgttcacgcgtccggtcgccgaccacatgttccgcaactacgacggcgtcctgaaggtcgacggcgaggtcggcgacaagaagacctacgacccgcgtacgtggggcaagctggccgaggcgtcgatggccaagcgcgtcacggaggcctgcgcgaacctgcgctcgacgggcacgaagatcaag

SEQ ID NO: 4508 - DNA, 1587 bp, Streptomyces avermitilis
  CDS (1)..(1587)
atggccgcctccgcgcaggacctccccgccgtcaggatcgccacccccagcggcaagtggatcctgctcaccacggtcctgggctccagcatggccatgctggactcgacggtcgtcaacgtcgcgctgccccgcatcggccgcgatctgaacgcggacctcgcggccctccagtggaccgtcaacgcgtacatgctcaccctcgcgggcctgatcctcctgggcggagccctcggtgaccgcttcggacgccggaagatcttcgtcctcggcgtgatctggttcgccaccgcctcactgctctgcggcctcgccccgaacgccggcgtgctcgtcgccgcccgcgctctgcagggcatcggtggcgccctgctcacccccggctcactcgcgctcatccaggcgtcgttccaccccgacgaccgtgcgagagccgtcggcctgtggtccggcttcggcggcatcggggccgcggtcggcccgttcctgggcggctggctggtggacggcccgggctggcgctgggtcttcctgctgaacgtcccggtggccctgctgtgcgcccccgtcgccctcagacacgtaccggagtcgaaggacgaccgtatccacggccgcggcttcgacgtcctcggcgcggccctcggcgccctctccctcgccctggtcacctacgccctgatcgaggcgcccaccggctccccggccgtcgccgtgacggcggtcgcgggggtggccgccggtgtcgccttcgtgtacgtcgagaagcggcgccccgacccgatgatgccgctggacatcttcgcgtcccgccagttcaccgcggtcaacctggtcaccctgtgcgtgtacgcggcgttcggcggcttcttcttcctgaccgcgctccagctccaggtcgtggccggctactcggccctcggcgccggcacggccctgctccccacgaccgtcatgatgctgttcctgtccgcccgctcgggcgagctgggccagcgcatcggcccgcgcatcccgctcaccgtgggcccgctgctgtgcgcgaccgccatgctgctgatgctgcgggtgggaccgcacgcctcgtacctcaccgacgtcctgcccgcgctcctggtgatggggctgggcatggtcaccctggtcgcgccgctcaccgccaccgtcctcgcctccgtggacagcggccgggccggtctggccagcggcatcaacaacgcggcggcccgcgcggccggcctcatcgccgtggccgcgctgccgctgctcgccgggatgggcccggaggcgtaccgctcggcggagcagttcaacgacgcgttccggcgggcgatgccgctgtgcgcgggtgtgctggtgctgggggcggtgctggccttcacgtccgtacgccgaccggcaccggactgccgacgccccgagtgccacacacacggcgcgctgaccgccccacccctggagccgggccgccccctgccgacggcggcttccggtgccggttcgagcgcgggttccggcgccggttcgagcccgggttccagtgccccttccagccccggtccagacacccccagcccgtccggcgat

SEQ ID NO: 4509 - DNA, 411 bp, Streptomyces avermitilis
  CDS (1)..(411)
atgacgattcacggaaaccttctcgggggcccgcccccgacgcacctccccgacgacccggagccgcgcgagctgctcgcgagcggcacggcgcccgccgacgtcgcggccaagtacccgacctcctcgctcgcctgggcgcagctcgccgacgaggcgttcgagcgcggcagcgtcgtcgagtcgtacgcgtacgcccgtaccggctaccaccgcggcctggacgccctgcgccgcagcggctggaagggccacggcccggtgccgtgggagcacgagccgaaccgcggcttcctgcgcgccctgcacggcctcgcccgcgccgcgcaggcgatcggcgagcaggcggagtacgagcgctgcacgcagttcctccaggactcctccccggcggcggcccagacgctgggc

SEQ ID NO: 4510 - DNA, 843 bp, Streptomyces avermitilis
  CDS (1)..(843)
atgtcccatcaggctcagcccgcagaggcttcggagcccgagaccccgcatctcgacttcgcagggaccaccccgtacgaggactatgtccaggcggacgtcctcacccatctccagcacaccctctccgacgaccccggagagatggtcttcctggtgacgacccaggtcatggagctgtggttcacggtcatcgtgcacgagtgggagaccgcggcgaacgcgctgcgcggcgacgacatcccggtcgcggtggccgcgctgaagcggtcggtccgggagctggaggcgctgaacgcgtcctggcggcccctctcgcagctcacgcccgcccagttcaactcgtaccgctcggccctcggcgagggctcgggcttccagtccgcgatgtaccggcggatggagttcctgctcggcgagaaggccgcgtccatgctggtcccgcaccggggcgcgccgcgcgtgcacgcggagctggagaaggcgctgcacgagccgagcctgtacgacgaggtgctgcggctgctgtcgcggcgcgggtacggggtaccgcgcgccgtgctggagcgtgacgtctcgctgcggtacgagccctcgcccgaggtcgaggccgtgtggacctcgctgtactcggggaagccggacgacgaactcgcccggctcggcgaggcgctcacggacgtcgccgagctggtgtggcgatggcgcaacgaccatctggtggccacgcgccgggccatgggcgcgaagaccggcacgggtggctcggccggggtggcctggctggagaagcgggcgcagaagaacgtgttcccggagctgtggacggcgaggtcccatgtc

SEQ ID NO: 4511 - DNA, 1182 bp, Streptomyces avermitilis
  CDS (1)..(1182)
atgtctgagctggccgtcagggcggagaagtcggacgccgccgacgaactggccgggctgcgtgagcggttcgtcctcgacgaggccgtctacctggacgggaactcgctcggcgcgctgccggcggccgtccccgggcggctggacgacgtcgtacgccgtcagtggggctcgctgcgcatccgttcctgggacgagagcggctggtggacggcgccggagcggatcggcgaccggatcgcgcccctggtgggcgcggcagccgggcagatcgtggtcggtgactccacaagtgtcaacgtgttcaaggcacttgtcggtgcggtgcgtctcgcgggcgaggggcgggacgagatcctcgtcgatgccacgacgttcccgacggacggctacatcgcgcagtcggcggcgcgcatgacggggtgcgaactgcgcccggtcgcgccggacgaggtggccgacgccctcggcccgcgtaccgccgcggtgctgctgaaccacgtcgactaccgcacgggccggctgcacgacctgccgtccctgacggcggcgatccacgccgcgggcgccctggcggtctgggacctgtgccacagcgcgggcgcgctgccggtcgggctcgacgcgcacggggtcgacctggcggtcggctgcacgtacaagtatctgaacgggggcccgggtgcaccggcgtacctgtatgtacgccgtgaccttcaggaccgcttcgactccccgctgcccggctggaactcgcacgccgagcccttcgggatgcgtacggcgtacgaaccggcggccggtgccgtgcgcgggcgcgtcggcacgcccgacatcctctccatgctggccctggaggcggcgctggaggtgtgggacggcgtgtcggtcgaggccgtgcgcgccaagtccctcgccctgacggacttcttcctggagtgcgtcggggcgtacgtgcccgagggcgtggtcgagtccctgactccggccgcgcacgcggagcggggcagtcaggtggcgctgcgctgccgggacgccggtgcggtgatgaagcggctggtcgagcggggcgtggtcggggacttccgttccccggacatcctgcggttcggcttcactccgctgtacgtggggttcgcggatgtggagcgggcggcgcgggtgctcgccgagaccgtgggc

SEQ ID NO: 4512 - DNA, 351 bp, Streptomyces avermitilis
  CDS (1)..(351)
atggcacacggcgacgacaaccgggtctacgccaacgacaaccggggcaccctgtacgcccacaacggaagcgtcacccacaacgccgacccccgggccgccgacgacgcccgcgaactcctgcgccgcctggaggagttgcagggtctgctcgcccagcacgccgccgccctgcccgacgcgcggcggctgcgcgacgtggcgcgggagctgggcaaccagcttcaggacccgcagccgagcaggaccgtcgtacgcagtctgctcgactcgctgacggcgggagccggtggcgtcaccgccgtactcaccgccgtcaacgggctctcccagttcgtctcccggttcctg

SEQ ID NO: 4513 - DNA, 1959 bp, Streptomyces avermitilis
  CDS (1)..(1959)
gtggtggggaacgggggcggtccgccctatctggtagcggctgttccgccgcaactcgcgggtaccacatgggagttgacgcgcgcctcgcatatcgtcgggcggctcggtgacatccggctggcgccttcggacgtgagcaagcgccacgccgagctgcgtctgggcagcgacggagtctggctcagcgacctgggctcccgcaacggcgtcctgcacaacgggcggcgactcgaccccggccgaccggtcagactgagcgagggcgaccacctccacttcggttcggtgcagttggtgttccgcagcaacgccccgcaggctcccggcgccgccggccggacgccacacggccacgaccgcgagcacgacacctcaaccgtcaccgacctgggcgacgcccgtcggcgccgcttcgcgggccggcacggacccgaccccgacctgccgccccctcccccgcgccacgccccgcccccgcccgtcgaggacgacgcccggagcatgaccacccggcatctggcggccgcgacccagttcgacccgtggttcgcggacctggtggtccaccaggtcgtcgacgagccctaccgcgccctcgccccggtcttcggagccgacctcggcaccgtcacccgctgggccctgtccgcgcgccggcgccggctgacccgcgacgccgcgctgtgcgcgctgctgtgctgcctcgtcgcgctgctcgggctcggggcgcgcggcaacgtcgacgcgatcaaggcggccgacctcggcggctggtggcgcccgtacgccgccggcgcgctgctgctgctcgccctcgcctggctggtcctgggcgtggacgtctgggtcaccgagtacctcgtcctgcgccggcggctcgcccctcagcactacgatcccgcgcaggcgccggacgccttgagcgggcgggtccgcgaccggctcgccaccgtggccgagcggcccgcggggaacctggtcgtctgctccgactactggcccttcgcgggcagcggcgaccagatcgaggagtgggaccggcccgtcgacatccgcaagggctcaccccgcgaggacggcggccggcgcaggccacagcccttcaccaaggacgagctgtacgaggtgctcatcgccgcggcctgtcggctcggcctggccaacctgcgtgtggaggaacgtctcttcgtgggcggcaacgacgtcgcccgcgacccccggctgctgcccgaccggttccagccgcccctgacccgcatcccgccgcacctcatccgcggcatgccggacgggctcggcgcggcccggcgctcgtatgtgagcatcgaagtcccggcctggagcggtcagttggtgctgacgatgttcctgcgcgcggtccaggtccaggggacgctctacctggagttctcggcgtacgccctgttgccgatgcgtcccgagtactacgccgtcgacaatctgccccaccggacggcggcgggagcggccgtccgtgcgctggccgcggcgcttccgtggacgccacgcgcgctgctgggatcgccgggagcgctcgcccggcgtgcggccgcctcccgggccgcggcggcggggcggcgccggcagcggcgcacgatcggcggcggctaccggttcgactacggcgcccagctcagcatccgcgagttcgcgcgcggtctggacgagggccactacttcctcggccgcgacctgagccgggtcctcaacacgacccagcagcacctgctgaacacgatcggcgacttcctggaggccaagggcatcgactcggacgacttccagcggttccagcagaacgtggtgcagaacttcggcgacgacaaccgggtctacgccaacaacaaccgcggcaccatgtacgcccacaacaagagggtccggcatccgcagggcggcaaaggccaggcgcccgggccgtccgcccagcgcggc

SEQ ID NO: 4514 - DNA, 603 bp, Streptomyces avermitilis
  CDS (1)..(603)
atgtccgccgaacccggcaccgtacgccccggaggccggaccgcgcgcgtgcgggccgccgtgctgcgggcggccggagacgtgctggccgagcaggggttcgcgcatctcgatctggcggacgtggcccggcgggcggaggtcggcaagaccacggtgtaccggcggtgggggtcggtgacgggcctggtcgccgacctgctggacgacatggccgaacagtcgctgccccgcgcggagaccgggtccgtacgggaggatctgcgggccaacgcgcacctggtgcagcggacgctggcggacgcccgccagggcgcgctgttccgggcggtcatcgccgccgcgacgtgcgacgcccgtacggccgagtcactgcggcggttctacgaggtgcgcgtcgcggagtgggcgccctgcgtggaacggggggtggaacgcggggagctgccggtgggtaccgatgcggcgacggtcgtacgggccgtgtcggcgccgctctactacgcgctgctcaccaccggaaccgccccggagcccgccgacgccgaccgggccgccgacgccgccctcgccgcggcgagggcagaggcgtacgtcgtgggg

SEQ ID NO: 4515 - DNA, 1017 bp, Streptomyces avermitilis
  CDS (1)..(1017)
atgccggacgacgccgcaccccgcgatgccgcagaaccgcgcgatggggcggaacgtgaggtggcgaaacgtgccgccgcggaagaggcgtccgtcttttcgcacccgcccgtcgagcccgactccacggcctcgtacggcgctcaccccgatcaggtgatcgacttctacgctccgcgcggggtcgagccggaggcgccggaggtaccgggagcggcggcgggttccggggtgccgggggctctcgctcccctcgtggtcgttctgcacgggggcgcctggcgggctccgtacgaccggcgccacgtcactcccttcgccggcttcctggcccgccgtggcttcgccgtggccaacgtcgagtaccgcaggggcgccgaccccgtcccggcgcggggcggtgcggatgtcccgacggagggcggtgcggcggccgctcagggcggtgcgggcccggtcgcgggtcgctggcccgacaccttcgacgacgtggcggccgcgctggacgcgctccccgccctcgtacgcgaggcgcttccccaggccgacctgcgccgtacggtgatcaccggccactcggcgggcggccacctggccctgtgggcggcggcccgccatgtcctgccggccggctccccgtggcgcaccgagagcccggccccgctgcgcggcgtcgtggcgctcgccccgatcgcggacttcggtgtcgcgcggaagctggacgtgtgcggcggcgcggccacccaactcctcggtggcgaggccgcgttcaccgaccgtcggccgcacgcggacccggcgctcctgctgcccaccggtatcgccacgaccctggtccagggacgcaccgacatcgtggttccgcacgcggtcgccgaggcgtacgcggacgcggcggcgaaggcgggggaagtcgtcggcctcacgctcctcgagggggtcgggcactttccgctgatcgatccggcggcggacgcgtgcgcggtcgtggccgaggagatcgcgcaactgggctgg

SEQ ID NO: 4516 - DNA, 1089 bp, Streptomyces avermitilis
  CDS (1)..(1089)
gtgcgcgacggaggtcgtggaggcatacgcgtacgcgaccggggtcgtggcggtgtgcgtgaccggggtcgtcgcggcgtgcgtgaccggggtcgtggccgatcgagcggacgcgggttcggccgactgcgccgcactctgctcgcggtgctgatcgcgggcgcggtcgtcgtccccgtgtccgccgcggcagcgcaccccgagatccccgctccggcaccggcgacgctcgcccccgtgacagcggcgacgctggaggcgacgtacgcggccaaccgcgccaacgccgcggaggcgtcccgcatggccggggcccacggcgaccacgcccgcgccgcggccgaccgctccatggccgccccgtcccgggacttcctcaccttcgacggacggggcaggggccgggcggtcgaggtcttcggcgacctggcgacggccgaccgcgtcgccgtcctggtcccgggctccgacacgacgctggacacgtacggccgtttccgcgcgggcgccctcgccctgcaccagaggacgggcccgcgcacggcggtcatcgcctggctcggctacgagacaccccgcaccatcagcaccatcgccctcaccgccacccgggccaaggaagcggccccccaactgcggggccttatcagcgaacttcgcgacctccacgagctctccgagaatcgtggactcaacccctcctcgcaccccgccccgcacatctccctgctctgccactcgtacggcacggtggtctgcgcccgcgccgccggtgacctggacgtcgacgacatagccctgctcggcagccccggcaccggcgcggactccgccgccgccctgcacacgcccgcccgcgtctgggcgtcccgcggcgccgacgactgggtcgaggacgtcccgcacacccacgccgacctcttcggcaccaccgtcggcttcggcaccgacccggtctccccgtccttcggcgcccatgtcttcgccgcgggtgacggcggccacagcgactacttcaggccgggctcggtgtccctggacaacctcgcccgcatcgtcctcggcgacacctcggaggtgacccgtgca

SEQ ID NO: 4517 - DNA, 1293 bp, Streptomyces avermitilis
  CDS (1)..(1293)
gtgcataggccgaccctgcgacaggacgtacggacggacgtacggacggacggacgcgtcgacatgaaggacggcgcacgcacagccgcacgaacagcggtacgcgccatagccaccggcatacgggacggtgcccgccgggtggacaccgcgacgcccgcgcaccgggaccgcgcggtcgacaccctgcgtgcgttcgcgatcctcggggtcgtcctgggccactggctggtgaccgcgctcgtcgcggacggcgggacgctgcacacggcgagcccgttgcagcacatgccgtggctggccccgatctcctgggtcttccagacgctcgccgtgttcttcctggtgggcggtcatgtggcgacgaaggggtacgcctcggcacgcgcgcgtggcacgacgtacgggcggtggctgcgatcccggctggcccgtctgttcaaacccgtggcggcggtactgacgctgtggacgctcgccgtgggcggtctgctcgcggcgggcgcggacttcggcaccgtacacaccctggtgaagctggcactgtccccgctgtggttcctgctggtcttcgcggggctgacggcggcgacaccactgctgacgcgcctcaacccgctgtggccgctggccgtcgttctccatgtggacctcattcgcttcggactcggcgggccctcctggctcggctgggtgaatgtggccgcgggctggctggtgccgtacacgctgggcgcggcctggacgcgcggtgagctggaccgccgtcgcgcgggctgggtgctgctggccggcggcgcggcggcgacggcggggctggtcgcgtgggcgggctacccggcgtcgatggtgggcgtccccggcgccgcggtgtcgaacctcgatccgccgactacggccgccgtcaccttcggcctggcccagtgcggcctcgcgctgctgctgcgcgccccgctgcgccggatcacgcgccgccccctggcctgggcggcggtggcactggtgaacctctccgcgatgacgatcttcctctggcaccagacggccatgatggcgaccaccgccaccggccttctcgcgggccggctccccggactgcacaccaccccggccgggttgagctgggtcgccgcccgtctgctctggctccccgccttcgtcctcgtcctcgcggtgtgctgggcggcctttcgcgtctacgaacagggcggccgtcgcagtggaggccgccgctcccaagtggtccttgtccacaactcgggccgaacgcaagcgcaggcgaccgaccgtgcc

SEQ ID NO: 4518 - DNA, 1452 bp, Streptomyces avermitilis
  CDS (1)..(1452)
gtggacgaggcacggcaggcggaccccggcagtggacccccgcccccttccgcttctccactctccgcctcgacggccctccgccgcccccacgactacttccgtgccctccgcgccgacctgtggacggtcgcggccgacccgctgccacccctgtcgcgcccgcgcaggctgcggtggttgccgcacgtcctggtgtgcgtcgtcgccctgaccctggcactcgcgggcacggaagagatcagaaccggctaccacctggcctccgggctcagtagggtgctcgggtttctgcagggcggagccgtcgttctcgccctgcggcgtccggttcccgcctggtggctgtcgctggcggtcaccgccgtgtccgcggaagccgcgcggatcgcccaggacggcgtcgcgtacggcgtctcggtactgccctcgccctcgcccgtgtcctcgatcaggccatcgtggccctggacgtcgcaagggatcatggcgtgcgccttcgtgctgttcctgctcgccctgcgggttcccgtccgtgcctccatcggggtactggccctgaccaccctggtgacgtacttcctccagggcatccagggtgcgacggcgtactctccgacgggcctgttggcggtgctcgtctttgccaccgtcgtcctcgtcggcgccgcgctgaggggccgccgcgaggcccgtacacaactggtcgagcaggcctcgctgaccgcggaggagcgtgcccgccggaccgttctggaggagcgcagccgcatcgcgcgcgagctgcacgacgtggtcgcgcaccacatgtcggtgatctccatccaggcccaggtcgcgccccacctcgtggagaacccgtccgaggaactgagggagaacctggcgggcatccggcagaacgcgctggaggccctgaccgagctgcgccgcgtcctgggcgtcctgcgctccgaggacccgcaggacccgtacgggatcggcagcggcaccggcgacgcccccgactccccgcagccgaccctcgcccggctggacgccctcgtggagaacacccgggccgccggcctgacggtgctgaccgagatcagcggcgacgcgcgtccgctgccgcccggcgtggagctgtccgcgtaccggatcatccaggaggccctcagcaacgcgctgcggcacgcgcccggttccacggtccgtgtcgaactcacccactttccgcggggtgtgcaggtgcgggtcatcaactcccggccccagcggccagttccgccctcgccgggcgcgggtcacgggctgctgggcatgcgggagcgcgcggcgatgctgggcggcaccctggtcacgtccgagacctcgtgcggcggctacgcggtcgcggcctttctgccccgttcccgggaccagggcccggcgaccggcgacgacctgccgcacccgccaggtccgagagac

SEQ ID NO: 4519 - DNA, 672 bp, Streptomyces avermitilis
  CDS (1)..(672)
atgacgagcagtgccatccgcgtactgatcgccgacgaccagatgatggtccggcagggcttcacggtgctgctcaacacccagcccgacatcgaggtggtcggtcaggcggtcgacggcctggacgcgatcgccaaggtcgccgaactcgccccggacgtcgtgctgatggacatccgcatgcccgaactcggcggcatccaggccaccggccgtatcgccgtcgactttccgcaggtcaaggtcttggtgctcaccaccttcgacctcgacgagcacgtgtacgacgccctgcgcgccggcgcctccggcttcctgctcaaggacgcctccgccgaccagctcgccgaggcggtccgggtggtggcggcgggcgacgcgctgctcgctcccgggatcacccgtcggctcatcgcggagttctcccgcctcgacaccacaccccgcgccccgctcaaggtgcgcgtgggcgagctgaccgagcgcgagacggaggtcctcgccctcatcgcccagggcatgtccaacgcggagatcgcggaccgcctggtggtggccgagcagacggtgaagacccatgtcggccgcatcctcgtcaagctgagcctgcgggaccgtacgcaggcggcggtcttcgcgtacgagtcggggctggtacggccggccggatac

SEQ ID NO: 4520 - DNA, 1377 bp, Streptomyces avermitilis
  CDS (1)..(1377)
gtgacgaccacgaccccgggttcggcctaccttttccatgtgaccgagacgacacagatgcagatgacgccaccggggggcggggccacgcagcgcagcccggaattccggctggccgtggatgccctgcgcggcctgcggcaggacctgatccacgacgccttcgcctaccgcccgctcccgcgcatacgagtggacggaccgcggatccgccgcctgccggaggggatccgggaatacgcgagctggaccccgcacgggatggtggcggcagccggtctgttgtcgatggcgatcggcgtcagctccgccgaaggctcgggcacttcgctcctgttcggtctcctcgcgctgctcccggtcctgctcaccctggtccggccgctcggtgccttctggttctccatggcggcgacagctgtcgtcggcgtgttcgccgacatgtgggacgactggccgtggctgcccagcagcttcgcggcccacctgaccgtcctgacggtcgtggcactgcgcacaaggccgcgcatcgccgcgtggatgtggtttctgaccgcggtgtacgggatcttcgccgagacgttgttcggctcgggtcactacgggacgaacaccctgccgctgctgttcgtctccgcgctcgccctcctggccatcaccgtgctgcacacacgccgcgcggccaagcaggaggtgaccgcccagcagtcggagacggcgcacgagcgttccaagcgcactctcctggaggagcgcaccacgatcgcccgtgagctgcacgacgtggtcgcccaccacatgtccgtggtcgccatccaggcggaggccgcgccctaccgcgtggagaacccgccggaggaactggagaaggccttcgccacgatccgggagaacgcggtggcggcgctgaccgagctgcgccgcgtcctcggcgtggtccgcgcggaggactacgaggcgccggacgccccccagcccaccctcgcggacctcgacgccctcctggcgaacgtgcgggaggcgggcctgaccgtggacaaggcggtgacgggcgcggtccgcgaactcccgcagggcgtcgagctgtcggcgtaccggatagtccaggaggccctcagcaacaccctgcggcacgcgcccggcgcgacggcccgggtggagatcggctacgtcctgggcggcctcggcctgcgcatagtcaacggccgcgcgccgggcctcaccctggtgaagtccacgcacggcgccgggcacggcatcacggggatgcgcgagcgggtctcgatgctgaacggtgagatgacggcggacgagacggaagacgggggctacgaggtgacggtgttcctgccggtgtccatgctggaggactccccg

SEQ ID NO: 4521 - DNA, 672 bp, Streptomyces avermitilis
  CDS (1)..(672)
gtgacgagtgacgcgatccgtgtactgatcgccgacgaccagatgatggtccgggagggcttctcggtgctgctcggggcgatgccggacatcgaggtcgtcggggaggcggtcaacggccgggaggcggtggagcgggtccgtgagctggcgccggacatcgttctgatggacatccgtatgccggagatgaacggcatcgaggccacgcgggagatcgtcgccgcgggcggggcggcgaaggtgctggtgctgacgacgttcgacctggacgagtacgtgtaccaggcgctgcgggcgggggcgtccggtttcctcctcaaggacgcctcggcgcgccagctggccgacggggtgcgggtggtggcggcgggcgaggccctgctggcgccctcggtgacgaagcggctgatcacggagttctcccggctcgcggagacaccccgcctgtcggcctcggtgcacgcggcctacggggaactgacggagcgtgagacggaggtgctggtactgatcgcccagggtctgtcgaacgcggagatcgccgggcgcctggtggtcgccgagtcgacgatcaagacccatgtgagccggatcctggtcaagctgggcctgcgggaccggacgcaggcggcggtgttcgcctacgaggcacggctggtgacgccgggg

SEQ ID NO: 4522 - DNA, 183 bp, Streptomyces avermitilis
  CDS (1)..(183)
atgaactggcggaagtcgacgtactccggcggaggccagggcgacacctgcgtcgagatcgcggcgctgcacccccgaatagccatccgtgactccaaggcccccacccgcgccaccctctccttccccaccgcctccttcaccgccctcatcgagcacctcaaggaacgtaaacccgcaccc

SEQ ID NO: 4523 - DNA, 1215 bp, Streptomyces avermitilis
  CDS (1)..(1215)
atggcagctgcttttgacctcgccttcgacccctgggacccggcgttcctcgccgacccgtaccccgcctacgccgatctgcgcgccaagggccgcgtgcactactacgagcccacgaaccagtggctcgtaccgcaccacgcggacgtctcggcgctgctgcgcgaccggcgcctggggcgggcgtaccagcaccggtacacgcatgaggacttcggccgcaccgcacccccggcggagcacgagccgttccacaccctcaacgaccatgggatgctcgacctggagccgccggaccacacccggatcaggcgcctggtgtcgaaggcgttcacgccgcggaccgtggagcagctcaagccgtacgtggccaagctcgccggcgagctggtggaccggctcgtcgcggcgggcggcggggatctgctcgcggatgtcgccgagcccctccccgtggccgtcatcgccgagatgctgggcatcccggagtccgaccgtgccccgctccgtccctggtcggcggacatctgcgggatgtacgagctgaacccgccgaaggacgtggcggcgaaggcggtgcgggcgtcggtggagttctccgactacctgcgcgagctgatcgccgagcgccgcaaggagcccggcgacgatctcatctcggggctcatcgccgcccatgacgaaggcgaccgcctcaccgagcaggagatgatctccacctgcgtcctgctgctcaacgcgggccacgaggccaccgtcaacgccacggtcaacggctggtacgccttgttccgcaaccccgaccagctggccgccctgcgcgccgaccactcgctcgtgcccgccgccgtggaggagttgatgcgctacgacacgcccctccagctcttcgagcgctgggtcctggacgagatcgagatcgacggcacgacggtcccgaggggcgcggagatcgccatgctttttggctccgccaaccacgaccccgaggtcttccggaatcccgagaaactcgacctcacccgcgaggacaacccccacatttccttcagcgcgggcatccactactgcatcggggcaccgctggcacggatcgagctggcggcttcgatgacggccctcctggagaaggccccgacactgggcctggtggcggagccgaagcggaagccgaacttcgtgatccgggggctggaggggctcagcgtcgcggtc

SEQ ID NO: 4524 - DNA, 1602 bp, Streptomyces avermitilis
  CDS (1)..(1602)
atgaccgccacgacctccgccgtacggtccaaaggcacgcaccaactggccggcaccgcaacgctgttgcgcttcgacttgcgccgcgaccgcgcgacgatcccgatctggatcgggatcaacgcgctcatggtgctctccatgccgaacaccctgaagaacctgtacggcacccaggcccaacgcgacgacctcatgcaccagatggcgaccaactcctccctgcgcgccttggtcggcccggtcttcgacgactcactgggcgcgctgacggcctggcgcgtcggcgtctacgccggtgccctggccgccgtgacgagcctcctcgtcgtcgtacggcacaccagggacgaggaggagagcggccgccaggagctggtggcgtccgggatggtgggccgccgggcctcgctgacggccgcgctgctgacggcggcggtcgcacatgccgtactggcactgctggttgcggccggcctggccggtcacggagtctttggcgccgtggccttcgggctcgggatcgcgggcgtcggcatggtcttcgccacgatggcggcgatcgtcgcccagctgacggagagcgcacggctggcccgcggcctgacggcgggcgttctgggcgccgccttcgtgctgcgcgcggccggcgactcggcgacggacgacggttcctcggtgctgacctggctgtcgccgatcggctggctggagaatctgcggccgtatgccgacgaacggtggtgggtactggcgttgttcgtcgcggcgtccctgatccagggcgcggtcgcctacgaactcgccggccgccgcgacatcggcatgagcttcctgccgacgcggcccggaccggcggtaggacgcctcgggaccgcgggcgccctggcctggcggctgcagcggggcagcgtgttcggctggagcgtcggcttcttcctcgccggggtcgcgtacggcgggatgacggacggtgcggcggatctggtcggcgacaacgagaacgcccgcgagatcttcgagcgcatgggcgggcagtccgggatcacggacgccttcctcgcctcgatggtcgggatgctcgggctggtggccgcgctgtacgtggtcgcgtcggtgctccggctgaacggtgaggagacgtcggggcgggcggaaccggtgctggcgaacgcggtggggcggctgcgatgggccgccgggcacctgacgatcgccttcggcggttcggtgctgatcatgctgctcgccgggctgggcttcgccgtcggctacggcaaggaggccgggccgattctgggcgcctgcctggtacaggtggccggggtgtgggtgatcggcggggccgcggtgctgctgttcggggtgctgcctcgggctgcgggggcggcttggggagtcgcgggcgcggtgctgttgatcgggtgggtcgggcctgcgctggacgctccacaggcggtgctggacgtgtcgccgttcggtcatctgccgaaactgccgggcggcgcgatgaactggccgccggtactgatcctgctcggtctttccgcggtcctagtggccgcgggcctgaccggcctgcggcgccgcgacctcacgacc

SEQ ID NO: 4525 - DNA, 912 bp, Streptomyces avermitilis
  CDS (1)..(912)
atgacgaaggcacaccccgccatcggggtatccggactgcacaagtcgttcggcaggacgcacgccctggacgggctcgacctggaggtcgagagcggtgaggtgcacggcttcctcggccccaacggcgccggcaagtccaccaccatccgcgtcctgctgggcctgctgcgcgccgactccggcacggtgcggctactgggccgtgacccgtggacggacgcggtggaactgcaccgccggatcgcctacgtccccggagacgtcacgctctggcgcaacctctccggcggcgaggtcatcgatctgtacgggcgtctgcgcgggggcctcgaccgggcgcggcgggcggagctgaccgagcggttcgagctggaccccaccaagaaggggcgcacgtactccaagggcaaccggcagaaggtcgcgctggtcgccgccttcgcctcggacgtcgatctgctgatcctggacgaaccgacgtcgggcctcgacccgctgatggaggaggtcttccagcggtgtgtcgaggaggagcgcgaccggggccggaccgtcctgctgtcctcgcacatcctgagcgaggtcgaggagctgtgcgaccgggtgagcatcatccgccagggccggacggtcgagagtggttcgctcgccgagctgcgccatctgacccgcaccagcgtcaccgccgaactcgcgggtccgcccaacgggctggcgcacctgcccggcgtccacgacctcgacgtacagggccaccggatccgcctccaggtcgacaccgacaagctggacgccgtactgcgctcgctgagcgagtcgggcgtacggtccctgacgtcgactccgccgaccctggaggagctgttcctgcggcactaccaggaggaacagccggaggtggcggcccga

SEQ ID NO: 4526 - DNA, 408 bp, Streptomyces avermitilis
  CDS (1)..(408)
atgcagcggatgccggcccgtgtcttcgcggcgctgctcgcctccgactccggcaccctgacctccgccgagctgggcgagcagctccaggtcagccccgccgcggtctccggggcggtgcgctacctcgcgcagcagcacatggtctcccgcgagcgtgaacccggttcgcggcgggagcgctaccgcgtgcacagcgaccagtggtacgagctgctgaccaaccgggaggcggtgctcaagcggtgggagcacgccctgcgcgagggcgtcgacagcctcggtgccgggagcccggccggccgccggctctccgagaccctcgcgttcttcgagttcctggacggcgagatcgcgtcgatgatggaccgctggcgcctccaccgcgaagagcgcttcggccagggc

SEQ ID NO: 4527 - DNA, 1500 bp, Streptomyces avermitilis
  CDS (1)..(1500)
gtggcccccgaggcggcgggcgcaagcgccgaacccggaggggccgttcaccggctcaagcccaacgccatcggcctgctcggcgtggtcttcatggccgtcgccaccgccgcgccgatcaccgccatgaccggcaacgtgcccttcatggtgtcgtcgggcaacggcatcggcgcccccgcgagctacctcgtcgcaatggtcgtactggcaatctttgcggtcggcttcacctcgatggcgaagcacatcacctcgaccggcgccttctacggcttcatctcctacggcctcggccgcaccgcgggtctcgcctccgggctgctcgcgaccttcgcgtacgtcgtcttcgagccggccctgatcgggatcttctcgtccttcgcgaccaccacgctgaaggaccagacgggcctcgacatcccgtggtggctcttcgcgctcctgatgctcgccgtcaacgcgaccggtacctggttcggggtgtccgtcgccgagaagctgctcgtggtgctgctggccaccgaggtcaccgtcctcgcggcgatggccgtctcggtcgccgtgcacggcggcggcccgcacggcttcaccttcggcccggtcaacccggtcaacgccttcaagggcaccagcgccggactcggcctcttcttcgccttctggtcgtgggtcggcttcgagtcgacggcgatgtacggcgaggagtcgcgcgacccgaagaagatcatccccaaggcgacgatgatctccgtcctgggcgtcggcgtcttctacgtcttcgtctcctggatggccatcacgggcaacggcgagacggaggccgtccgggccgcctcctccgccaacccgctcgccctgttcttcaaccccaccgagcactacgtcggccactgggcggtggtcgtcatgcagtggctgatgatcaccggctcgctcgcctgcggcatggccttccacaactgcgccgcccgctacatgtacgcgctcggccgcgagggcgtcctgccctcgcttcagcgcaccgtcgggcgcacgcaccccgagcacggctccccgcacatcgcggggctggtgcagacggtggtcagcgcggtcctgctcggcgcgttctgggccgtcggcaaggacccgtacagcggtacgtacgtcctgctcgcgatcctcggcacgatggcgatcctggtggtccaggcggtgtgctcgttcgcggtgctcgcctacttccgcaagaaccaccccgagagccgccactggttccggacgttcaccgctccgctcatcggcggcctcgcgatgctcgcggtcgtggtgctgctggtgtccaacatgggcgtcgcggccggccccgagtcgggcgcgctgatcctcagggccacgccctggatcgtcgccctgatcgcggtgggcggcgtcggatacgcgcagtacctgaagcggcgcgcgccggaacggtatgcgctgctgggccggacggtgctggaggagacgaaggagcgg

SEQ ID NO: 4528 - DNA, 1392 bp, Streptomyces avermitilis
  CDS (1)..(1392)
atgagcacgtacaccgcccgcctcggcggccgcacccactccttcccctccctcgcggcgctgctcgccgccgcgagccccgagcggtccggggaccggctggccgggctcgccgccgactccgccgaggcgcgggtcgccgcgcggtgggcgctggcggaggtgccgctcgcgcggttcctcgccgagccggtgatcccgtacgaggacgacgacgtgacccggctgatcgtggacacccacgacgcgcgggcgttcgcgccggtggccggtctttgcgtcggcgagttcagggagtggctgctgtcggacgcggcggacgccgggtcgctggccgcgctcgcccccgggctcacgcccgagatggtggcggcggtctccaagctgatgggcaacgcggacctggtcgcggtcgcgcgcaaggcgcgggtggtgacggcgttccgctcgaccatcggcctgccggggcggctggcgacccggttgcagcccaatcaccccacggacgacccggccggtgtcgccgccgccctgctggacggactgctcctcggctccggtgacgcggtgatcggcatcaacccggcgacggacagcccgaaggcggtacgggacctgctggagctgctggacggagtgatccggcgctacgccatccccacccagtcgtgcgtcctgtgccatgtcacgacgagcatcgacctgatggagcgcggcgcccccgtcgacctggtcttccagtccatcgcgggcacgcaggcggcgaacgcgtccttcggggtcacgctgggtctgctcgacgaggcgtacgacgcggcgcgtgggctcggccgggggacggccgggcagaacgcgctgtacttcgagacgggccagggcagcgccctgtcggcgaacgcgcaccacggggtggaccagcagacggtcgaggcacgggcgtacgcggtggcccgccgctacgacccgctcctcgtcaacacggtcgtcggcttcatcggcccggagtacctgtacgacggccggcagatcctgcgggccgcgctggaggaccacttctgcggcaagctgctcggcctgccgatgggcctggacatctgctacacgaaccacgccgacgcggacgacgacgacatcgcgacgatgctgacgatgctcggtgtcgccggggcgtcgttcgtgatctgcacaccgggcggcgacgacatcatgctgaactaccagtcggcctcgtaccacgacgcgctgtatctgcgggaggtgctggggctgcgcccggcaccggagttcgaggactggctgtcgcgcatcggcctgctggacgatgccggggcgatccgggacgtgacgggcacggcgcatccgctgacggcgatcgggcgggagctggccgca

SEQ ID NO: 4529 - DNA, 786 bp, Streptomyces avermitilis
  CDS (1)..(786)
atgacgaaccgtcctcctgccgcgtacgaaggtgaatccgaccgggcgatgtgggcggctctgcgccgccacacccaggcccggatcggcctcggccgcgccggcagcgcgctgcccacccggcaccggctcgaactccaggccgcgcacgcggcggcgcgggacgcggtgcacacgcccttcgcaccggacgtcgtcgcggcggccctgaccggattcccgacgatccgcgtgcgcagcgccgcccccgaccggctcggctacctccagcgccccgacctgggccgccggctggacgccgccgaccgggcccacctgccgcgcgacgactgggacgtggtcttcgtggtcgccgacggtttgtcgagccgggcggtccacgagcacgcggcggcgatggtccacgcgacgacggcgctgctccccgcggacctgcgggtggcgccggtggtcctcgcggagcaggcccgcgtcgccctcggcgacgacatcgcgcacgccatgggcgcccggatgacggtggtcctggtgggggaacgtccgggcatgtcggcggcggactccctgggcgcgtacctgacgtacgcgccgcgcccgggcacgacgacggacgcggaccgcaactgcctgtccaacatccgcccgcccctcggcctggcctacgcgacggcggcggcgagactgacggcactgatgaagcgggcccacgagctgggccgcaccggggtggacctgaaggacgagtcgaccgagtcggccgaggcccctgccctcactccgacgacg

SEQ ID NO: 4530 - DNA, 855 bp, Streptomyces avermitilis
  CDS (1)..(855)
atgaccgaggtggcgacttccgaccagctcctggtggtcatcgacccggtcgcccgtcacagcgacggtgagtcggtacggatcgcaaaagacgtgctcagcgcgggtgcgtccacgaaggtgtgcctcccggaggggcccgaggaattcgcccgcgcactggcccggcgggggtcccggcggccggtggtggtgggcgacgaccgggcgctgctgcgggcggtggcgcatttgcaccggcagcgggagctcggcgcgtgcgcgctgtccctcgtgccggtggggcggacgctgtccctcgcgcggtcgctgggggtgcccacgggcgccgtggcggcggcgcggaccgtgctggacggggcggagcagtggctggacctgctggtggacgacagtgacggggtggtgctcggggatctgcggatcccgtgggcgcgcggcacggccgagctggcggccgagggcgtggtcccggggccggccctggcccacccgtggctgcggacctgtcagtccctcgtacggacgctggcgacccgcccgtcgcggctcgcctccgcgccgcccggccccgggccgtcgcggctgcggatcgaggtcgacggggtgaccctcgtcgacctggaccagccggtggcgggggtgtccgtgacaccgggcgcgtccggcggggcgtgggtggaggtgcggccggtgtcggtgggtgcggaggtggcaccgctgcgggcggcggggcggcgcgtgacggtgtccggggccgacttccggtaccgggcggacgcggcggtcggaggcccggtacgcacccgcacgtggacgctccgggagcgggcctgggggctggtgctgccgggg

SEQ ID NO: 4531 - DNA, 1281 bp, Streptomyces avermitilis
  CDS (1)..(1281)
gtgcccgcacttgtgctgctcggtgctcagtggggtgacgaaggcaagggaaaggccaccgacctgctcggtggttcagtggattatgtggtgcgctaccagggcggcaacaacgccggccacacggtagtcgtgggcgaccagaagtatgccctccacctcctcccttccggaatcctcacaccggagtgcactccggtcatcggaaacggtgtcgtcgtcgacccgtcggtcctgttctccgagctgaacggactgaacgagcgaggcgtcgacacgtccaagctcctgatcagcggaaacgcgcacatcatcacgccttacaacgtgacggtggacaaggtgacggaacgcttcctcgggaagcggaagatcggcacgaccgggcgcggcatcggcccgacctacgccgacaagatcaaccgcgtgggtatccgcatccaggacctgtacgacgagtcgatcctgacgcagaaggtcgaggcggccctcgacggcaagaaccagctcctcaccaaggtcttcaaccggcgcgccatcgaggccggccaggtcgtcgaggagctgctgacgtacgcggaccggctcaagccgtacgtcgcggacacggtgctcgtcctcaacaaggcgctcgacgacgacaaggtcgtgctcttcgagggcggccagggcacgctcctggacatcgaccacggtacgtatcccttcgtcacgtccagcaaccccaccgcgggcggggcgtgcacgggctccggtgtgggcccgacgaagatcagccgggtcatcggcatcctgaaggcgtacacgacccgtgtcggcgccggtcccttcccgaccgagctcctcgacgaggacggcgaggcgctgcgccgcatcggcggcgagcggggcgtcacgaccggccgggaccgccgctgcggctggttcgacgcggtcatcgcccgctacgcgacccgggtgaacggtctgacggacttcttcctcaccaagctcgacgtcctgacgggctgggagcagatcccggtctgcgtggcgtacgagatcgacggcaagcgcgtcgaggagctcccgtactcgcagaccgacttccaccacgcgaagccgatctacgagaacctcccgggctggtcggaggacatcacgaaggccaagaccttcgaggacctcccgaagaacgcccaggcctacgtcagggccctggaggagatgtcgggcgccccgatctccgcgatcggagtgggcccgggccgcgacgagacgatcgagatcaactcgttcatc

SEQ ID NO: 4532 - DNA, 648 bp, Streptomyces avermitilis
  CDS (1)..(648)
ttggcctgtgacctgtggctggtcccgctagtcgacgtgttgtgccacacccccgacaaccccttcgccgaggaactcgccctctacgacaaggtgctgggcgaggccgggctgccgccggtgccggtgtaccagtacatgcccgggctgaccggggaggtcgccccggtcgcgggcttcgactacgacgcgctgcacttcctgcggcgggcgtacctgctccagatgtgcggtctcgcggtgaccccggtggacgaactgggcggggactacgagcagttgctggagatgttcgagacgaacgcccagcagtcccacctggtgtggcactacgaccacgcgggcgcgtacgtcccggtcgacttcccgcacccgctgtccagcgacgaactcctcgcgggcggcggcccgctgggctcgtcccagacactgctgcgcgagctggagttcgtcgccccgtcgatcggcatcgacccggcgaacccgcccgccgcacccgagccgccgggcgcccccacggagttggaggaaccggcggtggccgctccctacgacccgagcccgttcgcgcgcgagcggcacgtgtggctggggctgcatgcggccgccacgcgcagcctcgcccagggatcgatgatcatcttcagc

SEQ ID NO: 4533 - DNA, 2466 bp, Streptomyces avermitilis
  CDS (1)..(2466)
atgagcgcgacgcaggttcccgacgtcatagaggacatgccggccacctccatcgatctctccgtagtcgttcccgcgtacaacgaggagcagcggctcggccccacactcgacgcgatcgtcgaccatctgcgcgagaacgagaaccgctggggcgagtgggagctgatcgtcgtggacgacgggtccacggacgggacgagggacgtggtcgccgccgccaaggcccgtgacacccgcgtccagctcgtcaccagcccccgcaaccgcggcaagggacacgccctgcggctcggcgtcctcgcctcgtacggacgccgggtcctcgtcaccgacgccgacctggccgccccgatcgacgagctggagcagctcgacaaggcgctcaccgacgggcaagcggccgcgatcggctcccgggccacggcgggggcggccatcgagcggcgccagcaccggatgcgcgaactgctcggccgggccggtaacttactgatacgccggatagccgtgcccggcatccgggacacccagtgcggcttcaaactgttcgacggcgaccgcgcccgcgaggcgttcgccgcgtcccggctcaacggctggggcatcgacgtcgaggtgctccagcacttccggcgttcgggatggccggtcgccgaggtgccggtgcgctgggcccaccagtccggctcgaaggtacggcccgccgactacggccgcgtcctcgccgagctgaccctcctcaaggcccgctccgtccgccccgccgacctcctggccgcggccctgttcctgctgctggcggtggccctccagtcgggccgctgggccgaccccggccaccgctatctgccctcctccctccaggaccagaaccagtgggagtggttcttcgcggtcacggccgacaacgtcagccagctgcgcaatcccctcttcaccaccttccagggcttccccgacggcgtgaacctgatggccaacacggtcatgctgggcctgtcggtgcccctcgcgccgctcacgctgctcgccggccccgcgttcaccctcgccctggtcatgaccctcggcctcgccgcgacggccgcggcctggtactggctgatcgtcaaacgggtcgtacggcagcggggcgcggccttcgtcggcgcggcgctcgccgccttcgccccgccgatggtcagccatgccaacgcgcacccgaacttcgtggtcctgttcatggtcccgctgatcatcgaccgcgcgctgcggctgtgtacgggcgcccgggtcgtccgggacggcgtcgtactcgggctgatggtggcgtaccagatcttcctcggcgaggagccgctgctgctcgcctccctggggacggtgctcttcgccggggcgtacgcggccgcgcggcgggaggtcgcgcgggccgcctggcgccccctgctcaagggtctcgggatcggcgcggccgtctgcctcccgatcgtcgccctccccctgtactggcagttcttcgggccgcagagctacaagagcgtgctgcacggcgacaacgcgggcaacagtccgctcgcgctcttgtcgttcgcggagcgctcggcgatcgccggcgacgagctgacggcgaacgcgctgtccctcaacccgaccgagcagaacgccttctacggctggccgctggccgcgctcgccttcgcgatcgtcatccggctgtgggagcacgcggtcgtcaaggcgctggccttcacgacgatcgccgccgccgtcctctccctgggcccgaggttccgcatcccgctgacggacatcaccatgcccggcccgtgggcgctgctggcggacaagccgctgttcgagtcggtcatcgaggggcgggtcgcgatgatctgcgcgcccgcgctgggcatgctgctcgccctcgcgatcgagcggctggtaaggaccccgagccagagcacacggctcctgggactcacggcggtggccctcgcgctgctcccgatcgtcccggcgccgctgaagaccgtggagcgcgccgaggtgcccgccttcatcgcggacgggacctggaagtcgtacgtcgacgtcgacaagggcgagacgctcgtaccggtcccgctccccgactccggcaacgcggaggcgctgcactggcagaccgcggcgggcctcgggttcaagctgcccggtggctacttcaacggcccgtacggcaaggagcgcatcggcatctacggcgcctccccccgctccacctcgagtctcctgagcgacatctactacaagggcgtcgtcccgcagatcggcgaggactggcaggcgcaggcgaaggccgacttcgcctactggaaggcgggcgcgctcgtgctcgccccgcagggccgcgaggacgcgctgcgggcggccgtggagaagctcgtggggcgcccggggaagtgggtcgacggggtgtgggtatgggatctgcacgacgggagc

SEQ ID NO: 4534 - DNA, 702 bp, Streptomyces avermitilis
  CDS (1)..(702)
atgcccggcaccggcggcaatggcgccgtgacccgtagcaccctgcggcagcagatcgcggacgcgctccgcgacgaggtgctggccggccggctccagccggggcaggagttcacggtgaaggagatagccgaccagtacggcgtctccgcgacccccgtccgcgaggccctcgtcgatctgtcggcacagggcctcctggacgcggtgcagcaccgcggcttcgaggtccgcgcgtactccctcgccgactaccgcggcatgatcgaggcccgcagcctcgtgacggacgggatgttccaccagctcaccggcggtgacggacgggacccgtccgacccccgcctcgccgccgacctcgccgtcgtgcgccgccgcggcgaggaggccgagcgggccgcgggcgccggtgacctgaacatcctcatcggctacgacctgcgcttctggcgcgaactgagcgccctgttcggcaacccctatctcgccgacttcctgcaccggctgcgcgtccagtcctgggtctgcgcggtccagcacctgcgcagggtgtccgacctcaagggccgcctctggtcccgccacaccgatctcgtcgacgccctcgcccgccgtgaccccgccggggcgcatgccgtcgtcaccgcgtacaacgcgcactccctcgacctggtcgaacggctggccgccgggagcgccgga

SEQ ID NO: 4535 - DNA, 1353 bp, Streptomyces avermitilis
  CDS (1)..(1353)
atgacccctcagccgaatccccaggtcggtgccgccgtcaaggccgcggaccgtgcgcatgtcttccactcctggtcagcgcaggagctcatcgacccgctcgccgtcgccggtgcggaggggtcgtacttctgggactacgacggcaggcggtacctggacttcaccagcggactcgtcttcaccaacatcgggtaccagcaccccaaggtcgtcgccgccattcaggagcaggccgcgagcctgaccaccttcgcgcccgccttcgccgtcgaggcgcggtccgaggcggcccggctcatcgccgagcggacgcccggagacctcgacaagatcttcttcaccaacggcggggccgacgccatcgagcacgccgtgcgcatggcgcggatacacaccgggcggcccaaggtgctgtccgcctaccgctcctaccacggtggcacccagcaggccgtcaacatcaccggtgatccgcgccgctgggcctccgacagcgcctcggcgggcgtcgtgcacttctgggcgccgtacctctaccggtcgcgcttctacgcggagaccgagcagcaggagtgcgagcgggcgctggagcacctggagacgaccatcgccttcgaggggccgggcacgatcgccgcgatcgtgctggagaccgttccggggaccgcggggatcatggttccgccgcccggatatctcgccggggtgcgtgagctgtgcgacaagtacggcatcgtcttcgtcctggacgaggtgatggccgggttcggacggaccggtgagtggttcgccgcggatctcttcgacgtcacacccgacctgatgaccttcgccaagggcgtgaactccggatatgtgccgctgggcggtgtcgcgatctccgggaagatcgccgagaccttcgggaagcgggcctacccgggcggtctgacctactccgggcatccgctcgcctgcgccgccgccgtcgccacgatcaacgtcatggccgaggagggggtcgtcgagaacgcggcgaacctcggcgcccgggtcatcgagccggggctgcgcgagctggccgagcggcacccgtccgtgggcgaggtgcgcggtgtcggcatgttctgggcgctggagctggtcaaggaccgggagacgcgggagccgctggtgccgtacaacgcggcgggcgaggcgaacgcgccgatggccgccttcggtgccgccgccaaggcgaacggcctgtggccgttcatcaacatgaaccgcacgcacgtcgtgcccccgtgcaacgtcacggaggccgaggccaaggaaggcctggcggccctcgacgcggccctctcggtggcggacgagtacacggtt

SEQ ID NO: 4536 - DNA, 600 bp, Streptomyces avermitilis
  CDS (1)..(600)
atgacccgcaagcccgcccacctcgccgtctacgacaccttcgccgactgggagacggggcacacgaccgcccacctcgcccgcgccggatacgcgatccggaccgtcggccccacccgtgagccggtcaccaccctcggcggcatgcgcatccagcccgacctcgcgctcgacggcctgcgccccgaggacagctccctgctgatcctcaccggcgccgacctgtgggactccggcgacgacctcgcccccttcgcccgcacggcccgtgccttcctcgacgcgggggtgcccgtcgccgccatctgcggtgcgaccgccgggctcgcccgggagggcctgctcgacgaccgcgaccacaccagcgccgtctccttctacctcgccgccaccggatacgggggcggcgagcggtacgtggacgccgacgccgtcaccgacggcaacctcgtcaccgcggggcccaccgagcccgtcgccttcgcacgcgaggtgttccgcctgctcggggtgtacgagggggaggtgctggacgcctggtaccggctgttccacgactcggacgcggcggcgtacgcggtcctggaggaggccgcgcgg

SEQ ID NO: 4537 - DNA, 453 bp, Streptomyces avermitilis
  CDS (1)..(453)
gtgagccgggagcgccaggacctcttcagccgcggtgccctcgccgtcttccggctcaacggccagttcctgggcgtggcggaggagctggcccggcccgccgggctcaccgccgcctggtggcaggtgctcggggcggtgctcggcgagccgctgcccgtgtccgggatcgcccgggccatgggcatcacccggcagagcgtgcagcgcatcgccgacctgctggtggagcggggactcgccgagtaccgccccaaccccgcccaccgccgcgccaagctcctcgccccgacggaggaggggcgcgcggccgtcgccaggatcggtcccggtcacgccgccttcgccggccggctggcgcaggccctgggcgacgccgagctcgccgaggccgtacgcgtgctggaacggctgtcgaacacgctcgacgagatcacgcctgttacggaaccg

SEQ ID NO: 4538 - DNA, 2046 bp, Streptomyces avermitilis
  CDS (1)..(2046)
gtggagaagctgggagcgggggatccgcagcgtatcggggcatatcggctgctggcgcggctcggggccggcgggatggggcaggtgtatctggcccggtccgaccggggacgtaccgtcgccgtgaagctcgtacggcagcagctcgccgaacaggacgagttccgggcgcggttccggcaggaggtgcaggccgcgcggcgcgtcggcgggcactggaccgcgcccgttctggacgcggacaccgaggccgccatcccgtgggtcgccaccgggtacgtcgccgggcccaccctccagaccgtcgtcgggagcgatcacggcgccctgcccgagcggtccgtccggatcctcgcggccgggctcgcccacgccttgcaggacatccacgccgccggactgatccaccgggacctcaaaccgtccaacgtgctcgtcaccatcgacgggccccgggtcatcgacttcggtatcgcccgcgccctggagaccgtcaccgacgtgcgggctcaatcacacaggaaaccggcgcgctcgtcggttcgcaccgggtttcatgggcaccccgaacaggtgcgcggcgaccgcgtcacacccgcgtgcgacgtcttctgcctgggatccgtcctcgcgtacgccgccaccggcgcccttcccttcgggaccgcgagcagcggggtgcacgccctgatgttccgcatcgcccaggaggaacccgacctgaccggcgtccccgaggggctcgccgatctcgtacgggagtgtctgcgcaaggacccggccgcgcggccgccgctggagcggatcctcgagcggaccggcgccgaggacaccgtggcggacgggcggtcccgggacccctggctgccgagcgccctcgtcgcccaactggggcgccacgcggtgcggttgctcgacgcggaggatccggagacggacgaggagccggaacgggagggcgctccgacggcgggcgctccgacggcgggcgctccgacagcgggtgcttcggccgggggtgcttcggccgggggtgctcccgccgcccccgcggacactcccgtgtggcccggcgccgccgccgtgctgtccactccggcggccgcttccggcacccccggcccgccccacgccccgaagcggcccgaggtctcccccgagcacggccccgcctccgacgccggcgccccgaacggcgccgtaccgcccccgcccggcagccccgcccccgtggaccggctgcccacccagatcgtcggcccgggccggacggccccgccggccgccccgcccgcctacggctatccgcagcagcacccgcagcagcacccgcagccctccgcgtacggctatccgcagaacgccggctggggcggtgccccggcgtacggcgggccggggctcggctcgaccccgccgtacgggccggtcgtcggcgcccccgggcagcaggagccgccgcgaagaagcgggcgctccacggcggcgctggtcgtcgtcgcgctggtcgtcgcgctcggggcgggcggttcggtgtacgcgctgatgaagggcggggacagcggcacgaccagtgacggcaagccctcgcccgtcggctccgcgtccacggaccccggccccggcagctccgacccgtccgaccccgccaccccgtccaccggggaccgcaccacgcggtcgaccgcgggcggcgcgatcccggagggctacctcggcacctggacggacggcatcgacaactccaacgggcacagcacccggcgcctggtcatccggcagggcgaggtcggcgacactgtcctgtcactgaccgcggacggtccggccggcagcggcacgtaccactgtgtcttcaaggccgatctggccgagaagccgagcggtgacggcccgctggagatcggcccgtccacggtgaccgtgggcgaaccggcctcttcctgcacaccgggcgacgcctccgagatcaccctcctcccggacggcagcctgcgccgggtgaagaagggcaccagcgaggcgctcacgtacacgaagagcgac

SEQ ID NO: 4539 - DNA, 744 bp, Streptomyces avermitilis
  CDS (1)..(744)
gtgagccagccggagatgcagcccgaggggtcggcccaggacggtcggggcgacggcggcgcggggctgcggtcgggtgacctcatgggacggccgttcccgctcggcgactggggggagcccgcggagcggctcgacgagctgtaccggtgggtggagcgtggggcgctggacaccgccgcctggtatctcgccgaccggaggtggaagcggcggggcgcgcgggccctgcggaccggtgcggcggtgggggccgtgtgcggggccgcgctgccgctgctcgatctcacgggggtcgtcggcggggcgacgccgtgggcgtatctggcgctgctgctcggggtggcgtgcgtggccggggaccggttcttcggcgtgacgtccgggtggatgcgggacgtggccacggcgcaggcggtgcagcgtcggcttcaggcgctccagttcgactgggcgtcggagagcgtgcgggaggtgctggggccggccgaggggaccgccggggaggcgtccgagcggtgcctgggggtgctgcggcggttctcggaggacgtgacggaactggtgcgggcggagacggcggactggatggtggagttccggacgggttccgcgccgctcgggatgcattcggtgggggcgggagccgcgcggatggacggggtggcgccggggaggttcgccgtgccaccgccgcccgggacccggccgaacatgcctcggcagcggccacccgaggcgcgg

SEQ ID NO: 4540 - DNA, 339 bp, Streptomyces avermitilis
  CDS (1)..(339)
gtgattcccggtggtggccagcccaatatgcagcagttgctccagcaggcccagaagatgcagcaggaccttgcgaacgcgcaggaggagctggcgcgtaccgaggtcgaaggccaggcgggcggcgggctggtgaaggccaccgtcaccggctccggcgagctgcgggcgctcgtcatcgacccgaaggcggtcgacccggaggacacggagaccctcgcggacctggtcgtcgcggccgtgcaggcggcgaacgagaacgcgcaggcgctccagcagcagaagctcggcccgctcgcccaggggctgggcggcggcggcatccccggcttgcccttc

SEQ ID NO: 4541 - DNA, 597 bp, Streptomyces avermitilis
  CDS (1)..(597)
ttgtacgaaggcgtggtccaggacctcatcgacgagctggggcggctgcccggcgtcggtcccaagagcgcgcagcggatcgccttccacatccttcaggccgagccgacggacgtccgccgcctcgcgcagtgcctgatggaggtcaaggcgaaggtccgcttctgcgcgacctgcgggaacgtggcgcaggaagagctgtgcaacatctgccgcgacccgcgccgcgacctgtccgtcatctgcgtggtcgaggagcccaaggacgtcgtcgcgatcgagcgcacgcgcgagttccgcggcaagtaccacgtgctcggcggcgcgatcagcccgatcgagggtgtggggccggacgacctgcggataagggagctgctggcgcgtctcgcggacggcacggtgacggagctgatcctggccaccgacccgaacctggagggcgaggccacggcgacgtatctcgcccgcatgatcaagcccatgggcctcaaggtcacccgcctggccagcggcctccctgtgggtggcgacctggaatacgcggacgaggtgaccctcgggcgcgccttcgaggggagacgactcctagatgtc

SEQ ID NO: 4542 - DNA, 657 bp, Streptomyces avermitilis
  CDS (1)..(657)
atgtctgacgccacgctgcacaacacgacgcaggaccccgacgacttcgcggtccagatcgcggatcaggtggagagcttcctcgtcgccgtcacggaagtggcgaagggcgacgagccggactcggccgtccccttcctcctgctggaggtctcccagctgctgctggccggcggccgtctcggcgcgcacgaggacatcgtccccgacgagcgttacgagccggacatgggcccggagccggacgtcgacgaactccgcgagcgcctggccacgatgctggatccggtggacgtctactcggaggtcttcgacccgtacgagccgcgcaaggccccggtgccggcccgcatctcggacgacctggccgatgtgatcgcggacctgcgccacggcatggcccactaccgcgcgggccgcaccaccgaggccctgtggtggtggcagttctcgtacttctcgaactggggctccacggcgtccgcgacgctccgcgccctccagtccctggtcgcccatgtccgcctcaaccagcccctggaggagctggacggcctggacaccgaccaggacctcagcgaggacgccctcgcggaggaggcgggccgggtgatggcgagtgagatcgcgggcccgctggggttgcggacggtcagg

SEQ ID NO: 4543 - DNA, 1290 bp, Streptomyces avermitilis
  CDS (1)..(1290)
gtgggccttgtcgtgcagaagtacggaggctcctccgtagccgatgccgaaggcatcaagcgcgtcgccaagcgaatcgtggaagcgaagaagaacggccaccaggtggtcgtggtcgtttccgcgatgggcgacacgacggacgagctgatcgatctcgccgagcaggtatctccgatgcccagcgggcgagagttcgacatgctgctgaccgccggagagcggatctccatggccttgctggcgatggcgatcaaaaacctgggccacagcgcccagagcttcaccggcagccaggcaggcgtcatcaccgactcggtccacaacaaagcgcggatcatcgatgtcacgccgggccgcatccggaccgcgctcgacgagggcaacatcgccatcgtcgccgggttccagggcgtcagccaggacaagaaggacatcaccacgctcggccgcggcggctccgacacgaccgccgtcgcccttgccgccgccctcgacgccgaggtctgcgagatctacaccgacgtggacggcgtgttcaccgccgacccgcgcgtggtgaagaaggcgaagaagatcgactggatcgccttcgaggacatgctggagctcgccgcctccggctccaaggtgctgctccaccgctgtgtggagtacgcccgccgttacaacatcccgatccacgtgcgctcgtccttcagcggacttcagggcacctgggtcagtaacacgccactcgttcaaaaggcacagcagcaaggggaacagaaggtggagcaggccatcatttccggtgtcgctcacgacacctcagaggccaaggtcacggtcgtcggcgtcccggacaagccgggcgaggccgcctcgatcttccgcgccatcgccgatgccgaagtcaacatcgacatggtcgtgcagaacgtgtccgccgcctccacgggcctgacggacatctccttcacgctcccgaagaccgagggccgcaaggccatcgacgcgctggagaaggccaagtcggtcatcggcttcgactccctgcgctacgacgaccagatcggcaagatctccctggtcggcgccggcatgaagaccaacccgggcgtgaccgccgggttcttcgaggcgctgtccgacgcgggcgtgaacatcgagctgatctcgacctccgagatccgtatctcggtcgtcacgcgtgccgacgacgtccccgaggccgtccgcgccgtgcacaccgccttcgggctggactccgacagtgacgaggccgtggtctacgggggcacgggccgc

SEQ ID NO: 4544 - DNA, 1074 bp, Streptomyces avermitilis
  CDS (1)..(1074)
atggaccgcaccgggccgcgagccgggaggccgacgctcgcggtggtgggagcgaccggcgccgtcggcaccgtcatgctccagatcctgtcgcagcacgcggacatctggggcgagatccgcctgatcgcctccccgcgctcggccggccgcaagctggccgtgcgcggcgaggaggtcgaggtcatggccctgaccgaggccgccttcgacggcgtcgacgtggcgatgttcgacgtgccggacgaggtcgccgcgcagtgggcacccatcgcggcggccaagggcacggtcgtcgtcgacaactccggcgccttccggatggaccccgacgtgcccctcgtcgtacccgaggtcaatccccacgcggtacgtatgcgcccgcgcgggatcatcgccaaccccaactgcacgaccctctcgatgatcgtggcgctcggcgcgctgcacgccgagttcgggctgcgcgaattggtggtgtccagctatcaggcggtgagcggcgccggacgcgcgggcgtcgagacgctgcggcagcagatgtccctggtcgccggtacgcaactggggaccagccccggtgacgtacgacgggccgtgggcgacaacaccggtcccttcccggagccggtcgcgctgaacgtcgtgccgtgggccggatcgctgcgcgaggacggctggtcctcggaggagatgaaggtacgcgacgagtcccgcaagatcctcgggctgccccagctgcgcgtcgccgtcacctgcgtccgggtgccggtggtcaccacgcactcgctcaccgtccacgcccgcttcgagggcgaggtcaccgtcgacaaggcccgcgagatcctcgccaccgcacccggcgtcgtcctcttcgacgacccggccgccggcgagttcccgacccccgccgacgtggtgggcaccgacccgacctgggtgggccgcgtacgccgcgcgctcgacgacccgacggcactcgaactgttcgtctgcggggacaacctgcgcaagggcgccgctctgaacaccgcgcagatcgcggagctggtggcgagggagctgacgggggcg

SEQ ID NO: 4545 - DNA, 573 bp, Streptomyces avermitilis
  CDS (1)..(573)
atgccggtgatcgcccccatgcccgcagcgcggcccgcccgcataccgaaccagcgcgagggcgctgacgagacgatggccgccggtacgacggtcgaccatctgaccgagacctatcgcgcccactaccgctccctcctgggtcttgcggcgctcctgctcgacgacaccgcgtcctgcgaggacgtcgtgcaggaggccttcatccgggtgcactcggcgcgcaagcgcgtccgcgacccggagaagacgctcgcgtatctgcgccagacggtggtgaacctctcgcgctccgcgctgcgccgccgcatcctcggcctgaagctgctgtcgaagccgatgccggacatggcgagcgcggaggaaggcgcgtacgaccagctggagcgcgactccctgatcaaggcgatgaagggcctgcagcgccggcagcgcgaggtcctggtcctgcggtacttcgccgacatgaccgaggcccaggtcgccgagacgctggggatatcgctggggtccgtcaaggcgtacggctcgcgtggcatcgcggcgctccgcatcgccatggaggagccggta

SEQ ID NO: 4546 - DNA, 1200 bp, Streptomyces avermitilis
  CDS (1)..(1200)
atgagcgggtacgacgacaagcccttcgagcccttcgactccatcttcgactccattgactcctacgacgatgaacacgctgggaacggcactgtgaaacacggccccgacggacagggacctgagaacacggacacggacggtcggggtggcggccggggcttcgacgggctcggcccgggcgcggatcccgacggcttcgactcggagcccggcgacgggctcggctcggacgagctggcgctgcgcaggatgctgcaccaggccgtccgggagatcgagccccacgacgccacgctggagcatctgcggcgcgcggtgccggcccggcgggcgcgcaagcggcaggccgtggtgggcatggccgccgccgcgctcttcatcggcacggccatcccggccctcgtgcacgtctcgaacgccaccggctccgacgccgacccgtccatcgccggccaggcctcccaggcgcagggcggcgccggccaggacaagggcccggacggaggctccaacgccgccggctcctcgggctcgtccaagggcaagggcaaggacagccagaagggcaagggcgacaagggcacgggggcgagcggcgggaccaccggcggggtcaacccgccggcctccgcggcgagcgcacccacgtgtacggccacccagttcggcgtggtgtccgcgaacgcgggcacgccggactcgaccggcgccgtctacggcaccttccgcatctccaacatctccgccacgagctgtacggtctccggcacgggcagcgtgaccgcggccgcggcgggcgcggcggaccagtccaagatcaacgtggtgccccatgtcgcgggcgacgcggcggccggcctgccggacccgtcccaggacgtcgcctccctggtgcttcagccgggggcggcgtacgacgtgaagttcgcctgggtgccgtcggagacgtgccccaccacgggtggtcccggtggcccctccccggacccgacgcccagtgacgacaccaccgacagcggcggtacggactcggccggcgccggcacggcgccgcagctgctgagggaggacgggaccgccgacggaagcgtgacggtgtcccacatcacggccgcggggtcacccacggccacgacggcggtgtccaacgcgtgcgccgggacgatctaccggaccgggatactgccggcggtgtcc

SEQ ID NO: 4547 - DNA, 825 bp, Streptomyces avermitilis
  CDS (1)..(825)
gtgtaccggttcctgctgacgccccgatggtgggggatcaacgtcttcgtgctgttggccatccccttctgcgtcttcatggggtcgtggcagttgagcaggttcgaggaccggatacaggaccaccggaccgcgagcgagcaggccgcggcggccaagacggccgcggcccggccgctggccgagctgctgcccgtggacaagaggacgtccggcaggcaggccacggcgaccggccggtacgacagcggcaggcaactgctcgtgccggaccgcgagctggacgacaggcgcgggttctacgtcctgacgatgctgcgcaccgacggcggcaaggcgctgcccgtggtgcggggctggctgcccggcaccgccgacgcggcgaaggcgccggctccgcccaccggcgaggtcacggtgacgggcgcgctccaggcgtccgagagccccgggtcgaacggggtgagcacggtcggcgggctgcccgcgggccagaccggcgcgatcagctcggcggcgctggtgaacctggtgccgtacgacgtgtacaacgcgtggatcacgctcacgaagaccgacagcgggatgaaggcggtgcccgcgacggcggcccagggcaccggcctcgacctgaaggcgttccagaacctcggctacaccggtgagtggttcgtcttcgcgggcttcgtcgtcttcatgtggttccggctgctgcgccgggaggcggaattcgcccgggacgcggaactggggattttcccgcccgagaccgacgcgaccggcgaagccgaggcccgggtcgaggccgaggccgaagcgaagagc

SEQ ID NO: 4548 - DNA, 1839 bp, Streptomyces avermitilis
  CDS (1)..(1839)
atgactgagagcactgggtccacctcgcaggaacagcaggtacgcggcgagaccatgccggactgggagaagcgcttccgggcgccgcgggtgtcgctgccggactgggcggaggacgcgccgcaccgtgcgctgttcgtgtccaacgcgacggggacgtacgagttgtacgcgtgggaccgcacgacgggcgagcaacgccaggtcacggaccggccgaacggcacgacggacggcgtgctctcgccggacggcgagtggatctggtggttcgacgacacggacggggacgagttcgggatctggagaaggcagcggttcaccgggggcggcaccgcggacggccccgacgagcccgcggctgacggcctcgagccctcgtacccggcgggtctcgcgatcgggcgggacggcggcaccgccgtggtggggcggtcgaccgacgaggacgggtccacggtccatgtcgtacgagccggtcaggagccggtggagatctaccgccaccgggagtcggccggcgtcggcgacctctcgcacgacggatcgctgatcgcggtcgagcacaccgagcacggcgacgcgatgcactcggcgctgcgggtgctgcgcctcgacggctccacggtcgccgagctggacgacaccaagggtggctcggtcgagctgggcctggaggtgctgggcttcgctccggtcgacggggacacgcggctgctcatcgggcaccagcggcgcggccgctgggagccgctggtgtgggacgtcgcctccggcgaggagacggacctggcgctggagctgccgggcgacgtgggcgcggagtggtatccggacggttccgcgctgctggtcgcccacagcttcgaggcgcgcagcgagctgttccgctacgacctggcctcgcgcgagctggtccgggtgccgacgcccgcgggcacggtgtcgggggcgacggcccggcccgacggcagcgtggagtacctgtggtcgtcggcggccgagccgtcggtggtgcggtccacctcgggcgggatcgtcctcgatccgcccgggatgaagtcgccgggttcggtgccggtggaggacgtgtgggtggagggtcccggcgggcgagtccacgcgctggtgcagaggccggcgggggcgagcggtccgctgccgacggtgttcgacatccacggcggtccgacctggcacgacagcgactcgttcgcggcgggcccggcggcctggctggaccacgggtacgcggtcgtgcgggtcaactaccgcgggtcgaccggatacgggcgggagtggacggacgcgctcaagcaccgggtgggtctgatcgagctggaggacatcgcggcggtgcgggagtgggcggtgtcgtccgggctcgccgaccccgacaggctgatcctgaccggcggttcctggggcgggtatctcacgctgctcgggctcggcacccagccggacgcgtggacgatcgggatcgccgcggtgccggtggccgactacgtcacggcgtaccacgacgagatggaggcgctgaaggcgatggaccggacgctgctcgggggcacgccggaggaggtgccggagcggttcgaggcgtcgtcgccgctgacctacgtcgacgcggtgaaggcaccggtgtacatctcggcgggcgtcaacgatccgcggtgccccatccggcaggtggagaactatgtggagcggctgaccgcgcgggacgcggtgcacgaggtgtaccggtacgacgcggggcacggctcgctggtcgtggacgagcggatcaagcaggtgcggctggaactggagttcgcggagcggcacctcgggcgg

SEQ ID NO: 4549 - DNA, 2019 bp, Streptomyces avermitilis
  CDS (1)..(2019)
atggtggtgtgcggggacgacgccctcgccctccggctcgccaccgagctgcgaggggtgtacggggaacaggtgaccctggtcgtaccgcccgccgaacgggtcgcgcggcagcccgtggtgggcagggcccggacctccaccctgctcgaccgggtgtccgccgccgtcacccgggcggccggcaacggaaacggcgccggaagcaccacgggaaacagcggcgggaacggcaacagcggcagcggtgacggcgctggagggcgcggcggatccaccggcggtggccggaccaccgaaccccccggcaccgagcggctgttggaggccgtcgaggccaacgaggccgtgctcgccgaggcgggtgtggagcgggcggccgcgctggcgctcgtgtacgacgacgacgagaccaacatccgggccgcgctcaccgcccgccggctcaacccacacctgcggctcgtcctgcggctctacaaccggcggctgggccagcacatcgaggaactcctcgatcaggccgccacgttggccgcggccggagccgacgggccggccgcacagttcgacgcgtccacgaccgtcctgtccgacgccgacaccgccgcacccgcgctggccgcgaccgcggtcaccggcaccagcaaggtcgtacagaccgacggactgatgctgcgggcggtggagcggccgccgccggaaccggggcaggtcgccgatcccggtctgtgcacgctggcgctgctgtccgcgacggccagcgacccggccggggccgacggctccgagagcagcggcgagcaggggccacggctgctgcccgacgaggaagcgatcgcggcggccaccgggcgcggcacggtcgtcctggagaacgtgtcgtactccgggtcctcgctgcccgccgggcgcaacgccttgccgttcgcctcactgctgtcgcggcggctgcggtggtcgttcgccgggctcgtcggctgtgtggtcgggctcgcggtcgcgcagatggcggtcacccgcgaacaccccctgcacgcgacctacttgacgctgctcgacctgttcgccatcaacgaccccgccgtcggacagtccaccggccggcagatcctgcaactcctgtccgggctggtcgggttgctgctgctgcccgtgctgctggcggccgtgctggaagcgctcggcaccttccgcagcgggtccgcgctgcggaagccgccgcgggggctgtccgggcacgtggtgctgctcggggtcggcaagatcggtacgcgcgtgctgacccggctgcgggagctgcgcatccccgtggtgtgcgtcgagggcgaccccgaggcacgcgggctcgccacggcccggcggctgcgcgtgccggtggtgctcggggacgtgacgcaggaaggggtcctggaggccgccaagatccaccgggcgcatgcgctgctcgcgctgaccagcgcggacacgaccaacctggaggccgccctgtacgcgcggtcggtgcggcccgatctgcgggtcgtcctgcgtctgtacgacgacgacttcgcgaccgccgtgtaccgcaccctgcgcgcggcgcacccccatgcgctcacccggagccgcagcgtgtcgcacctggccgcacccgctttcgccggggccatgatggggcggcagattctgggagccatcccggtcgaacggcgggtgctgctgttcgcggccgtggacgtgggcgggcatccgcggctggagggacgcacggtcggcgaggcgttccacgcgggggcgtggcgcgtactggcgctggacacggcggcacgcggtggccggggccaggcccactccccggccccctccccctccccgtccgcgtccgcgtccgcggactctccctaccgtcgctccgggttggtctgggacctgcccgccacctacgtgctgcgcgccgaggaccgagtggtgctggccgccacccgccgcggcctcgcggagctcctcggccggcggccccaggcgcggaccgacgtg

SEQ ID NO: 4550 - DNA, 645 bp, Streptomyces avermitilis
  CDS (1)..(645)
gtggagggtcccgcgcacccgcccgtcggcctgcccccgggccaccccccgggccacccccggcctacccccggcccgcccccggcccgcccccgcctgcaaggtctcaagccgagaccgaccccggggagggaccgtatgctggcaggcatgaggcggacctccttcgcgaactggccctgctccatcgctcgcaccatggatctgctcggggactggtggacaccgctcgtgctgcgcgaggcgttctacggcgtgcgccgcttcgacgcgttccagcagtcgctggggatcgcccgcaacaccctgaccgaccggctgcggcggctcgtggacgaggggctgatggagaagcagccgtaccagaacgagcccgtacgtcatgactacgtcctcaccgacaagggccgggacttctacggtgtgctcatggccatgaacgcctggggcgaccgctggctggccggggaacagggcgcgccggtcgtcttccaccacgaacggtgcgggcggcaggggcacgcggaagtggtctgctccgagtgcggcgagccgatgaccgccaccgacacccggccgcggctcggccccggctacccgccccgcctcgccgaacgccccgacgtgcgggagcggttcgcggac

SEQ ID NO: 4551 - DNA, 768 bp, Streptomyces avermitilis
  CDS (1)..(768)
gtgaaccggcaggcgcaagcggtcgtgctgttcctcgtcggcggggcggtgctgcgggccggctccaccgatctctatctgcgctacgtcaaggccggactgcgcccgctgctgctggtggccggtgccgtactgatcgtcgccgccgtcgccaccgtctggtacgagcttcgacggccgcggggcggacaacacgacgaccatgaggacagtcacgaccacgaccacgatcgcgatcgcgggcacgatcacgggcacgggcatgcgcaccgcgagtcgtggatctcctggcttctcgtgctgcccctgttcgccctcatcctggtcgcgccgcccgccctcggctcctacagcgccgtacgcacgggtacggctctccaggcgccctggggctttcccgccctgccggccggcgaccccatcaagctcagcgtcgacgactacgcgggccgtgcggccttcgaccacggacgttccctgaagggccggaaggtcaccatcaccggcttcatcgccctcgaccgcggtggcgcgccgtatctcacccgcatgatcctcagctgctgcgccgccgacgcccagcccatcaaggtcgggctgaccgggcggaccccgcccgtcctccagcccgacacctggctcgagatcaccggcacctacagcagcaggcggaccaaggacccggtcaacaacggcgtcattccgttcatcgacgtcagtcgggccacgccggtcccggctccgcgcgaccagtacgaaagcccggag

SEQ ID NO: 4552 - DNA, 1008 bp, Streptomyces avermitilis
  CDS (1)..(1008)
gtgaccctcaccaaggcagcgccggacagggccgagcgccccgacgccggcggttcccagggatggcacttcaactcctcgctcggtctgaccatgctgctggtgctggtggtcgcggtgcagggcccgattcggcgggcgttgtccactccggtgatgcagagctggacgaccgtgttcgtcgcggtggtcgtgcaggcgctgcccttcctcgtgctcggcgtgttgttgtcggcggtcatcgcggtgttcgtacccccgtcgttcttcgcccgtgcgctgccgaagcgtcccgccctcgcggtgcccgtcgccgggatggccggggcggtgctgcccggctgcgagtgcgcctccgtgccggtggccggggcgctggtgcgccggggcgtcactcccgcggcggcgctggcgttcctgctgtccgccccggcgatcaacccgatcgtgctgaccgccaccgccgtggcctttccccgcaaccccgagatggtgttcgcccggttcggggcgagcctgctcgtggcgtgcgcgatggggtggctgtggcagcggctggggcgtaccgactggatgcgggcccctgcccacccgtcgttcgaaggcgccggcaagggagccgcgttctgggggtccgtacggcacgacgtgatgcacgccggcgggttcctcgtcatcggggcgatggccgcggccaccctcaaggccgtggtgccggccgcctggctgcacatggccgccaccaaccccgtggtgtcggtcctcgcgctggcgatcctcgcggtgctgttgtcgatctgctccgaggcggacgcgttcgtggtctcgtccctcacccagttctcgctcaccgcccggctcgcgttcctcgtcgtcgggccgatgatcgacctgaagctgttcgccatgcaggccggcacgttcgggcgcgggttcgcgctgcggttcgccccggccaccttcgccatggccgtcctcgtgtcggtcctcgtcggggcggtgctgctg

SEQ ID NO: 4553 - DNA, 1419 bp, Streptomyces avermitilis
  CDS (1)..(1419)
gtgatccgcgatcttctccgggacctggctgccgccctcgtcgccgcactgctcgtcgtgacggccgtgctggtcggcaccgtcatccagcgcgaggacggcacgctgtatgtgggctggccgccgctgtacgccgttgcggagccgcatgtcggcgccggcaccccggccgcgctcgccgtcgcggtcgccgtcgtggcgtacggtcccgccctcgccgcccggctgccctggcgggcgctgctcgccgccgcgtgggccacggccacggcgtggacgttctcgctcgcgctcgtcgacggctggcagcgcggcatcgccgggcggctgaccacccagtacgagtacctccgggtcatcgaccgcttccacgacatccccggcacgctgcgggacttcacccaccacatcctgatcgactcccccggccactggcccgcgcatgtcgcgggtcatcccccggcggcgcccctcaccttcgtcctgctcgaccggatcggcctgggcggcgggggctgggccggggtctggtgcatcaccgtcggtgccacggcctgcgtggccgtgctggtgacggtgcgggtgctggcgggggaggtcctggcacggcgggctgcgccgttcctggtactggcgccggccgcggtgtggatggggacctcggccgacgggtacttcgcggcggtggccgcctgggccgtggcgctgctggcgctcgcggtgacgggcgggacgggacggacgggtggagcgggacggacgggtggggcaggacagacgggtggagcgggacggacggggcaccgggtgtgggccgccgcgttcggctcggggctgttgttcggccttacctgctatctctcgtacgggctcacgctgttcgcggtgatcgcggcgggcgtgctggtgctcgggcgggagcgggtccgggtgcttccccttctgttcgccggactcgccgtcgtcccgctcgtgttcacgctcgccggtttccactggtgggaggcgtaccgcctgttggtcgagcgctactaccaaggagccggcggcctccggccctacggctactgggtgtgggccaatccggcgtgcaccgtgctcgtcgtgggcctcgcgaccgtggcgggcctgcgccgggccggcgtcgcgctggtccggcagcgcggccaggtccttcgcagccgggatgcgcccggccccgccgccgaaccgcgcctcgccctgctcgtgtacgccgccctcctcgcgctgctcgccgccgatctctccgggatgagcaaggcggagacggaacgcatctggctgccgttcgcgatgtggctgctcgccgccggcgcgttcctcccccgaccgcgcgcctggctcgccgcacaggccacgctcgccctgctcctcaaccacctgctgctgaccggctgg

SEQ ID NO: 4554 - DNA, 1302 bp, Streptomyces avermitilis
  CDS (1)..(1302)
atgggttgcggaccctttcgtggggtggtcccggcctaccttcgggacatgcgcgccccacggctcccctcctcacgtgccccatggctcccctcctcacccggcttctggcgcagtcctgtgcgcggcccctggttcacctccgtgctcggtgtcgtgctgctcggcggtatcaccgtgctgttcgtgaccgggctgctgtcgtacgccgcgtacaacccggacctggcaccggtgaacgaccagactccggacaagggtctcctcggcttctacctcttcgcctggccgaccgatccaccgtggctgtaccgcctcacgcagggcctccacgtcacgctcgggctcaccttgatccccgtcctgctcgccaagctgtggtcggtggtgcccaagctgttcgagctgccgccggcccgttcgctcgcccacgcgctggagcgcctctcgctgctcctgctggtgggcggcgcgctcttcgagttcgtgacgggcgtgctcaacgtccagctcgactacgtcttccccggctcgttctatccgctgcacttctacggcgcgtgggtgttcttcgccgcgttcgtcgcgcacgccgtgctgaagacgcccgcggctctgcgcaatctgcgccgaccgcgcaccgaggaagaggagtacgagcccggttccccgccccgcgccgagcccacggtgtcccggcgcggcgccctcggactggtcggcggcggctcactgctcctgttcgggacgacggccgggcacagcttcgacgggccgctgcggcagaccgccgtgctcgcaccgcacggcggccccgagccgggcccgggccccggcggcttccagatcaacaagacggccgcgtacgccgggatcgacgaccgtgagacgagcgcggacgcctggcgactggtcctcgtcgggcgcaccggcacggtccggctgagccgcgccgaactggagcggcttccgtcgcgcagctcggcgctgcccatcgcctgcgtggagggatggtccacctcggaccagcggtggcggggcgtacggctgcgggatctcgcggcgctcgtcggacacgacgaaccgcccgacgtgctggtggagtccctccagcggcacggcgcgttccgccgggccgccctgcgcgccaaccaggtggccgacccgcgctccctgctcgcgctgtacgtcaacggcgaggccctgacccccgaccacggccacccggcgcggatcatcgtgcccgccgcccccggcgtgctcaacaccaagtgggtggcccggatgaccttcggagacctg

SEQ ID NO: 4555 - DNA, 897 bp, Streptomyces avermitilis
  CDS (1)..(897)
atgagcaccgcacgcgaaatggcgcccgagtgggcgaccgaggcggccgaaccgaccagcggcagccacacccgcagcggcagcggcagcggcagcggcagcggcagcatgaccgagaccgagaacgtcggttcgaaccggcggttgcgcggtctgctcgacggtgcgtcgccctcctggtgtgccgacccctacgccgacgccctgcgcgcgggtcgcggccccctctttctgcgccgcgccgacggctggctgctcccgctggaggtggagcgctggtgcgcggaggcggacgcggcggacctggacgtggtggagcggtgcgagggggccgtactcgacgtcgggtgcgggcccggccgactggtcgccgccctgagcgcgcggggcctgcgcgccctcggcatcgacgtcagcgaggccgccgtcgcccacacgcgcggcatcggcggccgggcgctgcgccgttccgtcttcgcgccggtgcccggcgcgggccgctggggcaccgccctcctcatcgacggcaacctcggcatcggcggcgacccggacgccctcctccaccggatcgcccatctcctcgctccgggcggcctgttgatcgccgagaccgtcccgtacgacatcgacgaacgcgtgcacgtccacgtcaccgatgcccgggccaccccaggcgacccgttcccctgggcccgcctcggcaccccggccctgctccagtacgccgcgcgctcgggctggcacgccaccgatcagtggtccaccggcggccgttccttcgtcgccctgcgcagccgcagcaccaacaggagcgccgagccgccgaacagtacggccgtgatcagcagccagcgggcccggaagccgtcgcccggcaggccggcggcggactcg

SEQ ID NO: 4556 - DNA, 615 bp, Streptomyces avermitilis
  CDS (1)..(615)
gtgaccactctgctcgtcatcgccaaggaaccccggccggggcgggtgaaaacgcggctcacgcctccgttcacgccccggcaggccgcggagctcgccgaggccgctctcgtggacacgctgcgcaccgtcgcggcgacgcccgcgcggcggcgcgtgctggtcctcgacgggaccccgggcccctggctgccgccgggtttcgaggtcgtgccgcagtgcgcgggcggcctcgacgaacggctcgccgcggcgttcgccgggtgcgccggtcccgctctgctcgtcggcatggacacgccccaggtgacaccggagctgctcacggtggacttccgcggctgcgacgcgtacttcggaccggctgaggacggcggcttctgggcgctcggcctcgccgatcccgaccccggtcttctgcggggcgtaccgatgtcgacgcccgcgacgggcgccgtacagcgtgagcggctggtcgccgcggggctgcgggtgcgcgatctgccgcggctgcgcgacgtggacacggcccccgacgccgagtcggtcgccgcgtcggcgccccacagccgcttcgccgcggagctggaccggctcagggcggccaccggccga

SEQ ID NO: 4557 - DNA, 795 bp, Streptomyces avermitilis
  CDS (1)..(795)
gtgaaagccgtgacgacctctcccagcgatcctcccgatcccttcgatccgctcgatcccgtcgatcccctggcttcgacgaaacccgaagtcgacgtggtccttccgtgcctcgacgaggccgacgccctcccctgggtgctggcccgcattccgcccggctggcgtgccctcgtcgtggacaacggctccacggacggctcggccgagatcgcccgccgtctcggcgcgaccgtcgtccccgagacgcgccgcgggttcggtgcggcctgccacgccgggctgaccgccgccaccgccgacatcgtgtgcttctgcgactgcgacggctcactcgacccctccctgctcgtccccttcgtccgcgaggtgcgcgacggcgcggccgacctggtactcggccggcgtcgcccgcacggccggggcgcctggcccgcgcacgctcgggccggcaatctcgcgctcgcccggatgctgcgccgtcgcaccgggctgcgtctgcacgacctcggccccctgcgcgcggcccgccgcgagccgctgctcgccctcggcctcacggaccggcgcagcggttatcccctccagatggtggtccgcgccgccgacgccggctggcgcatcgccgaacacgacgtcccctacctcccgcgcaccggcgtctcgaaggtgacgggcacctggcgcggcacctggcaggcggtacgcgacatgagccgcgtcctggccgaaccggcgcaggacggccccccggagagcggttccctctcctcttcccaaggaggaagctcccag

SEQ ID NO: 4558 - DNA, 999 bp, Streptomyces avermitilis
  CDS (1)..(999)
atgcgtgtactggtcaccggcggagccggattcatcgggtcccatgtcgtcgaggcgctcggggcgcgcgggcacgagcccgtcgtgttcgacgtgcgcgaggacgcgggcgcggacgtccgggaccgggacgcggtcgcccgcgccctggccggcgtggacgccgtgtgccatcaggcagccatggtcggactcggcaacggattcaccgacgcggcggagtacgtctcccgcaacgacctcggtaccgcggtgctgctcaccggcatggcggaggcgggcgtacggcggctcgtgctcgccgggtcgatggtggtctatggggaggggcggtacctgtgcgagtggcacggagtggtccggcccggaccgcggaccgtcgccgacctgacggccgggcgcttcgagcccgtctgcccggcctgcggtgaggcgctgtctcccggactggtgggcgaggacgcgccggtggacccgcggaacgtgtacgccacgaccaagctcgcccaggaacacctggcggcggcgtgggcccggtcgacggacggaacggccgtgtcgctgcggtaccacaacgtgtacgggccccggatgccccgcgacaccccgtacgcgggcgtcgcctccttcttccgctcggcgctcgcccggggagaggcaccgcacgtgttcgaggacggcgcgcagcggcgggacttcgtgcacgtacgggatgtggcggcggcgaacgtggccgcgctggaagcgagttcacccgtcggcgcgctcacggtctacaacaccggcagcggcgagccgcacacggtcggcgcgatggcccgggcgttggccgccgcgtacggcgggcccgagcccgtcgtcaccggggagtaccggctgggcgacgtacgccacatcacggccgactcctcccggctgcgggccgagctggggtggaaggcggagaccgggttcgaggacgggatgcgggagttcgcgcgggcgcggttgcgcgacgag

SEQ ID NO: 4559 - DNA, 1263 bp, Streptomyces avermitilis
  CDS (1)..(1263)
atgaccatgcccacccacagcaagcaggccctacggtacggccgggtcgtggcggccgtcgccggcgtcctgttggcgggcgccgccgtgacgcccgcacacgctgacaccgtccgcggccagcagtggcacctggacgccatgcaggccgagcagatgtggaagaccagcacgggcaagggcatcacggtcgccgtcatcgacaccggcatccaggacaacatccccgacctgcgcggccgggtcgtggcgggcaaggacttctccaatcaccccggggacgaacactcggactacgacggccacggcaccagcatggccgtcctcatcgctggcaccggagccaaaggccgagcgacgggttcctacggcctggccccaggagcgaagatcctcccgatccgtatcccggacttcatcgaacagagccgcagcgacggcaacccggacgactaccccacctacatggccaaggccatccggtacgcggccgattcggacgcccaggtcatcaatatctcgctggcgagcaccgcccattcaccggagctgaccgagtccgtcgcctacgctctgtccaagggcaagctgatcttcgcgggtgtgggcaacaccggcggcggcctcaacaaagttgagtacccggcggccactcccggtgtcgtcggcgtcggggcgatcgacagaggcgtcaaggcgacgaaggagtcccagcacggcccccaagtcgacctggtcgcaccgggagaggaaatggtcgccgcctgtctcggcagcacggaactgtgcaagacccacggcaccagcgacgccaccgccatcgcctctgcatcagccgccctgatctggtccaagcacctcgactggacgaacaaccaggttctgcgggtcatggtcaacaccgcgagcaaatccaagagcggcaaggaacgcacggactatctcggctacggcgcggtacgcccccgcatcgcattgacggatcccggcgacccaggtcccgtcgacgggtacccactgcctgacttcgagtacgccgcgtccaggacgccagaggtgtcagcctccgcttcatcgaagcaagagggcgcggcaccagccgcgtcgacgaactccggcagcggagacagttcacccccgtggattctcttgggtgttggcagtggcgtactcatcagcggagcggcgttcgcggggtggtgtgtccgcaagcgtcgccgtgctcaggcgacatcacatgtatatccagggcgcgggtcgtcc

SEQ ID NO: 4560 - DNA, 1674 bp, Streptomyces avermitilis
  CDS (1)..(1674)
atgtctgatctgggcagctcggcgtggcggacggtccggcagtcccggtttctgacccaggatcccgaacagctgtggtccatggtggagggggcggacggtgcgacggccacggagctcggcgtactgctgacccaggccgcgaagacgatcggggaaatcggcaccgatctgcggacccacagcatggcggtcgagtgggagggtgaaggcggcgaggcgttccggaagtggatccaccaggccgcgttggccaccctgggactgggcgattacagcgcgagcgcgggcaaatggctgggccacgcgggggatacgcttcacgaggtcaggccccagctggagattctgcggaatcagagtgccaccgcgcgatcggtgctcgacgcgcacgcggcgaaggcaacggacatcggcgaccacgacggcagtccctcggatgccgcggtggagaaggccaagacgtcgttcgccgatgacagcgctgaagcggccgggctgatgatcaaactggcccagtcgtacaccgcctcgacggaacagatcgacgcgctgaaggcgcccgagtttccggagttgccaaagcggttcgtgccgatcgaacgtgacggtggaacccacatcaccgcgcccaccgccgatggcggtacccaagggacggtggcgcgagcggacgctctggggcgggagacggacgccgactccggtgtgggcggcatgagttcagcaccgagggcgtccgcgccgcaccacctgacggacctggccgtcgggccagatgcgccgccgcgccctcacacagacacgacgaacacggcgatcgacagcgtaagaaccgttccgtccgctccagcagctccttccgccccaccggcgccgcccccggaaccaagcagcccggacggcaggacacagccgacgaccgggttgcttccgcctgcgttcgggggcagagcagtgactccgcaggttcctcgggcaggcggggggcactccgtgtatggaggccggagtgccctgcccacgccgtccggctcaggtacacccggaggatcgcacgtacccgggcgcggacccaccggccccttcggccccggcatgtccggtggtcagccggtcccaggtcgtgagtcggccgttcccggcgcggccagaaacgccaacggagtcactggcggccgcccggtctcgccaccgagcggacgatccgctggtgcgattccacgcggcactgttatcggcggcaccccgcagcagcagcctcccatcggtcgtggcaccgcaccgggaggatccggccttggcgccacgacgccccgcgctaacggccgcacggcgaaccctgaaagcgcgtcgaagagcgcccccctgcctgcgcagtccgatgggatcgtcggtgggcaacccaggacatcccgacagcgcggacgggcggggttcacctcagggggcgccggacttgtacggggaacgggcacagacgacgtactgccgcagagcggcggaacagcccgcggcgcctccgcggtcacccgtgccccatacggtggtgaccgctccgcccatgacgaacggtcgcgctcccgcacgaatcagagggccgaggacgaggaaggccgaccgaccacgccacgtccacccagcgggcccgaccgacacgcaggacaagaagga

SEQ ID NO: 4561 - DNA, 561 bp, Streptomyces avermitilis
  CDS (1)..(561)
gtgatggcggtcgacagcacgggagatccgcaggcaaccggcgctggcctgggggctgctgtgggagggatcgcggcttcgggtatcgggcccttcgcgggtgtcggtgccgccgcggcgcaggttctgcgtgtcgagggcgagacgctgaccgccttcaagaagagggtggatgacctcttgactcagctggaggagtcgaaggccgcgccgcgcaggatcgcggacggcgctctgcccacgggacgtctgggcaacttcgacgaggccgacgcgctgcacgccgcctacacccgagtgcactcccaactggagcagctgtcccagatgctggcgttgcagatcgagggactggtcgtcacggtcgacgcctcgaaggccggctatcacgatctcgacgacgacgttcgcgaccgcctgagccggatccgggtcgaggccgacgaactgctcgccgacaggccggggccgggagcggagaaccgcaccagtcggggggtgggaagaccgagcggtgaccaacagggttcccaaccgccggacgcggaggccggaggtctg

SEQ ID NO: 4562 - DNA, 456 bp, Streptomyces avermitilis
  CDS (1)..(456)
atggcgtgggacgagtgggaacagatcaaggccgcggcggccgagcgccgctccacccagatgcagctcaaccagttgccggctgatcagggcggcagcactcccacgggtgggtcgaagcccggattgaatggcggctcgggcaccctgcggcactcgaacgggccgtggacccacgcggcaggcacagcggacgacctgaggatcagcaccgagtccacgaagaagagcctgcagtccggccatacgggcgtgtcggcgggggctgaaggcctggcgagcctgggtgcgttaaagacggtactcacctcctgggagaagcggctggaggcggtacgggacgagtgcgagtcactggagcccaagctgcgcgccgtcgccaaggacatgggcgagtacgacagtgccgttgccgccaaggcgcgcgctgtgcacgtctcggacgggggcaagggc

SEQ ID NO: 4563 - DNA, 1929 bp, Streptomyces avermitilis
  CDS (1)..(1929)
gtgacctcggcgttgacctggcagcagttgcgggacctgacgctctcggggctggatgacgcggccgacggctgggtcaaggtctcacaccacgcggatgcctcggccgaacgagtggacgccgagatggccggcaagttgtccaagacgcaggagagtgaatcggcgacggcggccatccggcggctgcagcgactgagccgtaactatcactacatccacgccgagtgcggactgatccgctcctcggtgaacggtcttgcctccgaactcaggcctcctcagcggcggctgaaggaggcgctggacgatgccaccgccctgtcgtacgcggtgaacgaggacgggagcatcgggtacccggccggcggcaagaacgagatgaccggggagaagatccccggtggttcggcagtgggccacaacggcatgctcgcgccgggcaacaacgggctgtacccaccgagcgacaaggggctgcacacgcccggcactggtcctggaacccccggcctgatcaaccccaaccctcaccacgccaaggcgcaggacatcgctgaccgcatcgctcacgccctgcgcgaggcccgggagaccgacgaacgttaccgacaggcgctgagcaagctcaaggcaggccccgggctgaaggtcgacacgaaaacctgggccgacgctgccgccgacgtcaaggccgtgggcgatgctgcgacggaatacctgaaggacgacatccctctcgacaagtcccccgccgctcgcaaggactggtgggaccacctcacgcaggagcagcgggaggagtacctggcggtctacccggacgtgatcgggaacctggacggcatcccggcaaccgtgcgggacgaggccaaccgggaaaacgtcgagctcctcatcggcaaactctcggggcaggatgacgagaagtcgaagacgatactggaagggctgaagggaattcaggggaaactgcaggaagcaagcgtgccaccgatgtatcttcttggtatcggcgacgaaggaaatggtcgtgcgatcgtttcctatgggaatcccgacacggcgaataacgtctcggcttatgtccctgggctctcgacgaaactggatggcgaattcgtcggcggctcgatgaaacgagcccaggacactgctcttggcgccaaggaagccgaccctcacagctcaaccgcgtcgatcgtctggctcggctacgacgcgccccagctctctcccacggacctcgccgccaacacagacgtcatgttcagagaaaatgccgaagccggagcaccggcatacaacagctttatggcaggaatctcagcgacgaacgagaacgagaatccgcatatcaccgccattgggcactcatacggttccctcaccgtaggcttggcagctcaggagaagggcggggtccccggagccgacgacatcatcctcgtcggtagccccggcactgatgcaaagaccgccgacgatttgaacgtcggcaagcaccatgtattcgtcggtgcggcagacaacgacatcgtcactaagctccctaatcataatgaggccagtggcatgggagccggggctgctggtggcggatcagcaggtcttgtactgggattggggatgggcggccccgtaggtggagtcgttggtggtgcagccggtaccgtcgtgggtggcatcgccggctatatggctcaggaccagcagacggatcccagtcagatctggttcggaaccgatccggcgaacaaggcgttcggagccacacgcttcttggtcgacgatggccctcctgtgaccgacggtgggtttgacgcacactcgcactatttcacccccacaaaggaccagatgtcagccgacaatattgccaacatcgtggttgggaagtccgacggaatcgtcttggagcagccacga

SEQ ID NO: 4564 - DNA, 783 bp, Streptomyces avermitilis
  CDS (1)..(783)
atgatcgcccgcatacccaaggacataccggacctgcccgccattccggggatgcctgtactgatgccgtccgccgtccccgcggcggcggtggtggcgcccacccgccgtccgctgacgaccgcgttccgcctgctggtcgccctggcggcgacggcgggcgtgaccatcgacctgatcctcggcagcccgctgcgcgtcctcacctacttcacgatccagagcagcgtgctggtggccctgaccttcaccctctcggcctggcgggcctgggcggcccgccgccccctgcccgcgctcctgaccggcggcacactgctctacgccgtgatcaccggcctcgtctaccatctgctcctcgcgcacgagccggcccccttcacgatgaccggccaggcgggcccgctcacgggctggcaggcgctcacgaaccagctcctgcacacggcggtcccggtcgcggtggtactggactggctgctcctgacaggctcgggacgcctgcgcctgcgccaggccagcgcctggctgctctaccccctcgcgtacctggcgctcaccctcgcccggggcgagctgatcctgccgggcacgccgggccgctacctctacccgttcctggacgtcgaacagcacggctacaagagcgtcctcggcaacgcgctcctcctcggcctggcgttctacgccctggcggtcctcctcgtcaccctcgaccgcgtccgcccgaacccgctccgccgccgcgccaaaaacggatttcgtctccagccaccagtgggc

SEQ ID NO: 4565 - DNA, 924 bp, Streptomyces avermitilis
  CDS (1)..(924)
atgcgcgcgcgatacggagtacccctgggaatcgtggcggccggcgccgccggtctcctctactcggcgggtttcgaggcccgttccttccgcttgcgacgggtcacggtccccgtcctgcccccggggatgcgccccctgcgcgtgttgcaggtgtcggacatccacatggtcggcggccagcgcaagaagcagcgctggctgaggtcgctggccggactgcgccccgacttcgtcatcaacaccggggacaacctctccgacccggagggcgtgccggaggtcctcgacgcactgggcccgctgatggagttcccgggggcgtacgtcttcggttcgaacgactactacggccccaaactgcgcaaccccgcccgctacttgctggagaagacccagggccgccacgggctgaacggcaacaagccggccgtcgacgccatccacaacccgtgggaggacctgcgcgacggcttcgacgcggcgggctggctgaacctgacgaacgcgcgcggggccctgaagatcgagggcgccgagatcgagctgaccggcctggacgacccgcacatcaagcgggaccggtacgcgcgcgtggcgggcggcccgtcggtctcggcggacttctcgatgggcgtggtgcacgctccgtatctgcgcaccctggacgccttcaccgcggacggttacccgctgatcctggccgggcacacccacggcggtcagctctgcctccccttctacggggccttcgtcaccaactgcgacctggacacggaccgggtgaagggcctgtcgcggcacacggccgaggggcgggcgtcctacctgcacgtgtcggcgggctgcggcacgaaccgctacacgccggtgcggttcgcctgcccgccggaagcgtcgctgctgacgttggtggagagggag

SEQ ID NO: 4566 - DNA, 465 bp, Streptomyces avermitilis
  CDS (1)..(465)
atgaccacgctcaagtcgaagctgcaggaagacctcaacgccgcaatcaaggagcgcgacgagctccgctcctcgacgctccggctgaccctcgccgcgatcaccaaggaggaggtcgcgggcaagaccaagcgcgagctctccgacgacgaagtgcagaaggtgatcactcgcgaggcgaagaagcggcgcgaggccgccgacgcgttcgcgcagggtggtcgccccgagtcggccgagcgggagaaggcggagggtgaggtgctcgccacgtacctgccccagcagctgtccgacgaggagctccagcagatcgtcggacaggcggtccaggaggcgaaggcggccggcgccgagggcccgcgcgccatgggccaggtcatgaagatcgtgaacccgaaggtggccggccaggccgagggcggccgcgtcgccgcggtggtcaagcagctcctcgcgggcggc

SEQ ID NO: 4567 - DNA, 2289 bp, Streptomyces avermitilis
  CDS (1)..(2289)
atgccaaagaagcgctcgggcgggggactgtcccctgtgcagcaggccgccaagttcctcggagtgagtgtgctcgcgggggcggtgatggccggaatcgcgatgcccgccgccggtgcgctcgggctcgccgccaagggttccgtcaaaggattcgacgacatcccggccaacctgaagagcccgcagctgagccagcgcaccacgatcctggacagtgccggcggccagatcgcctcggtctactcgcgcgaccgcacggtggtggatctcaaggagatctcgccgtacatgcagaaggcgatcgtcgcgatcgaggattcgcggttctaccagcacggcgcggtcgacctgaagggcatcctgcgcgcggtgaaccagaacgcgcagaacggcggagtggcccagggcgcctccaccctcacgcagcagctcgtgaagaactacttcgtggaggaggcgggcgacgacccgacgaaggtcgcccaggccacccagcagaccctcggccgcaagatccgcgagctgaagtacgcgatccagatcgaggagaagctcggcaagaagaagatcctcgagaactacctgaacatcacgttcttcggccagcaggcctacggcgtcgaggccgccgcccaccgctacttctccaagtccgccaaggacctgaacgtccaggagtcggcgctcctcgcgggcatcgtccagtcgcccacccggtacgacccggtgaacgacgaggcggaggccaagaagcgacgcaacgtggtgcttcagcgcatggccgaggtccacgacatctcgcaggcggatgccgacacggccaaggagaagcccctcggactgaacgtgagcaagccgaagaacggctgcatcacggcggtcaagggcgcgggcttcttctgcgactacgtacgcgaggtcttcctgaccgacccggtcttcggcaagaccaaggaggcccgggcgaagatctggaaccggggcggtctgacgatccgtacgacgctcgacccgcaggcgcaggagtcggcgcagacgtcgatcaagcagcacgtcaacaagagcgacggcgtggccacggccgccacggtcgtcgagcccggcaccggcaagatcctcgcgatgggccagtcgcgtccgtacggcttcggcaagaacgagacgcagatcaacctctccgtggacaaggacatgggcggcggcgcgggctaccagcccggttcgacgttcaagccgatcgtggcggcggccgccgtcgagggcggcatgccggccacgcaggcgtacccgtcgccctacgagatgctgtacccgagcccgatctcggcctgtaacggcaagacctggcgcaacgacccgaaccgcccggccaagctgacgaacgagaacgagtctgagcgcggcccgtacgggatgaaggaagcgaccgcgaagtcggtcaacacctactacgtacagctgatcagcgacatcggcatctgcccggtgacgcagatggccaagaagatgggcgtgagccgcgccgacggagcgaagatcacccaggccccgtcgatcgcgctgggcacgcaggagatgtcgcctctgacgatggcgaacgcgtacgcgaccttcgcctcccgcggcatgcactgcacgccggtcgccatcgagtcgatcacccagaccgtcggcgacgagaagaagtccctggaggtcccgaagtcgacgtgctcacgcgcgatgacggagaccaccgcggacacgatcaacacgctgctgaagggcgtggtcgaggacggtacgggtacggaggccggcctcggcagccgtcccagcgcgggcaagaccggtacgacggacggacgctacgcggcctggttcgtcggctacacgccgaacatggcggccgcggtctgggtcggcgacccggcgcacaagcggcgcatggtcaacatcaccatcggcggcaccacctgggccaaggtctacggcggccaggtcccgggcccgatctggcgcgacatgatgtcgggcgcgctccagggcaagccggccccggacttcaacctgatcaacatcccggacagcaacgcggacaaggacaagggcggcgacgaggggaacaacggcggcaacgggaacgggaacggcaacaccggaggcacgaccgtcacgggtggcaccgacggcggtacgaccgtcccgctcccgtccttctcgatcccggatggcttcatccaggggaacgggaacggcggaaacggaaacggcgggaacgggaacggcggcaggaacgggaacggc

SEQ ID NO: 4568 - DNA, 387 bp, Streptomyces avermitilis
  CDS (1)..(387)
atgccgctgccgccgtgggggagcctcgattcgggagaggacggcgccggtatgggctgggtaaccgactggagtgcgcaggcggcctgccgcactaccgatccggatgaactgttcgttcaaggagcagcgcagaacagggccaaggcagtgtgcaccggatgtccggtgcgcacggagtgcctcgccgatgcgctcgacaaccgcgtcgaattcggcgtgtggggtggcatgacggaacgggagcgccgcgcgctgctgcgcaggcggcccaccgtcacctcgtggcgtcacctgctggagaccgcgcgtacggagtacgagcgcggcgcgggtctgctgcccctcgacgaggaagaggtgtacgagaactacgcggcggtgggc

SEQ ID NO: 4569 - DNA, 1422 bp, Streptomyces avermitilis
  CDS (1)..(1422)
atgagtctggacccggcccacacgcccgacccggcccacccccacgaccaggaagcggcccacgccgaggacccggcgcgcgcgatcggctccgcccgcctcctggacgtcgaccccctgctggacgacccgggcacccgcatcgtggtgtgctgcggctcgggcggcgtcggcaagacgaccacggcggcggccctggggctgcgggccgccgagcgcggccgcaaggtggtcgtcctgaccatcgacccggcgcgccggctcgcccagtccatgggcatcgactcgctcgacaacatcccgcggcgggtgaagggcatcgacgactccgcgagcggcgaactgcacgccatgatgctcgacatgaagcgcaccttcgacgagatcgtcgaggcgcacgcggaccgcgagcgggcggccgccatcctgagcaaccccttctaccagtcgctctcggcgggcttcgcgggcacgcaggagtacatggcgatggagaagctggggcagctgcgcgcgcgtgacgagtgggacctgatcatcgtcgacacgccgccctcgcgctcggcgctggacttcctggatgccccgaagcggctcggctcctttctggacggcaagctgatccggctgctgacggcccccgcgaagctgggcggccgggcggggatgaagttcctgaacgtcggtatgtcgatgatgaccggcacgctcggaaagctgctcggcggtcagctcctcaaggacgtacagacgttcgtggccgcgatggacacgacgttcggcggctttcgcacgcgcgcggacgcgacgtacaagctgcttcaggcgcccggtacggcgttcctggtggtggccgccccggagcgggacgcgctgcgcgaggccgcgtacttcgtggagcggctggccgccgaggacatgccgctcgccggtctcgtcctcaaccgggtccacggcagcggagccgctcagctgtccgccgagcgggcgctcgccgccgcggaaaacctggacctcgccgccgatcccggcagcacggaaaatcttgaggagtcccgcattgtcgatcaggagggcgggaaagctggacttcgtaactctcccgacacgtacggaagttcagaatcacccgctgacctgactcccgctgaccagactcccgcttcctccgagggctcccccgccacggacggagcagtcgaacaactcaccgcaggcctgctgatactgcacgccgagcgcatgcaactgctctcccgcgagcagcgcacacgtgaccgcttcgccgcgctccaccccgaggtggccgtggccgaagtggccgcgctgcccggtgacgtccacgacctcacgggactgcgggacatcggggaccggctcgcggccaaccggccggagctgcccacatcccctggcggtgcg

SEQ ID NO: 4570 - DNA, 975 bp, Streptomyces avermitilis
  CDS (1)..(975)
gtgagcaggctccaggtcgtcagtggcaagggcggtaccggcaagaccacggtcgccgcatccctcgcgctcgccctcgcgaccgagggcaaacgcaccctcttggtcgaggtcgagggcagacagggcatcgcgcagctcttcgagacgcaggcgttgccctacgaggaacggaaaatcgcggtcgctccgggcggcggggaggtgtacgcacttgccatcgaccccgagctggcactcctcgactacctccagatgttctacaaactgggcagcgcgggccgcgccttgaagaagctcggcgccatcgacttcgccaccaccgtcgcgcccggactgcgcgacgtactcctcacgggcaaggcctgcgaggccgtgcgccgcaaggacaagagcggacgtttcgcctacgactacgtcgtcatggacgcgccgcccacgggccgcatcacccgcttcctcaacgtgaacgacgaggtggccggcctcgcgaagatcggtccgatacacaaccaggcccaggccgtcatgcgtgtactcaagtcgcccgagacggcggtccacttggtgacgctcctggaggagatgcccgtccaggagaccgcggacggcatcgcggagctgcgggcggcgaagctgccggtgggccggatcatcgtgaacatggtgcggcccgcggtcctggaccaggcggacctggagctggcgcacaccacgccccgtacggccatcgccaagtcgctctccgccgccggcctcggtggcgcccggcgcggcgggctcgcggagcggctggtggacccgctgctcaggcaggccgaggagtacgccgagcggttcgcgttggagcgcgagcagcgggcggtgctcacggagcaggagctgccgctgcacgaactgccactgctcgccgagggaatggacctggcgggcctgtacgagctcgccaaggaactgcggacccaagggatctca

SEQ ID NO: 4571 - DNA, 159 bp, Streptomyces avermitilis
  CDS (1)..(159)
atgaccaagtgggaatacgcaaccgtgccgctgctcgtccacgccacgaagcagattctggacacctggggcgaggacggctgggagctcgtccaggtcgtgcccgggccgaacaaccccgagcagctggtggcctacctgaagcgcgagaggcaggca

SEQ ID NO: 4572 - DNA, 468 bp, Streptomyces avermitilis
  CDS (1)..(468)
atgagcggggcagtcgaggcgaagctggcggaactcgggctgacgctgcccgcggtcgtgccgccgctggccgcgtaccagcccgctgtgcagtccggcgtgtacgtgtacaccgccggccagctgccgatggtggagggcaagcttccggtcaccggcaaggtgggcgccgaggtcacgccggaggaggcgaaggacctggcccgcacctgcgcgttgaacgcgctggccgcggtgaagtcggtgacgggcgacctcgaccgcatcgcgcgtgtcgtgaaggtcgtcgggttcgtggcatcggcctcggacttcaccgggcagccggctgtcttgaacggcgcgagcgagctgctcggcgcggtgctcggcgacaagggcgtgcacgcgcggagcgcggtcggcgtgacggtgctgccgctggacgcgccggtcgaggtcgagatccaggtggagctcacggaggcg

SEQ ID NO: 4573 - DNA, 870 bp, Streptomyces avermitilis
  CDS (1)..(870)
atggtgaatgggcagtggtatccaccggagtggccggtccgcatccgtgcgctggcggaaggcgccctcacccctgtcgcccccaagcgggcggccaccgtcatcctgctcaaggacaccgaccgcgcccccgtcgtccacatgctgcgccgccgcacctccatggccttcgccggaggcgcgtacgcgtacccgggtggcggtgtggacccccgcgacgacgagcgccaggtccgctgggcgggccccacgcgcgcgtggtgggcgaacagactcggtgtcgacgagacctccgcgcaggccatcgtctgcgcggccgtacgggagacgtacgaggaggcgggcgtcctgctcgccgggcccacgccggacaccgtcgtcggcgacaccacgggggacgactgggaggcggaccgggcggccctggtcgcccgtgacctgtccttcgccgagttcctcgaccgcagggggctcgtgctgcggtcggacctgctgggcgcctggacccgctggatcacccccgagttcgagccccgccgctacgacacctggttcttcgtggccgccctccccgaaggacagcgcacccgcaacgcctccacggaggccgaccgtacggtgtggatccggccggcggacgcggcggacgggtacgacaagggcgagctgctgatgatgccgcccaccgtcgcgaccctgcgtcagctcctcccgtacgccgccgccgccgccgacgtcctcgccgccgccccggcccgcgacctgacgccggtgctggccaaggcgcgtctggcggacggggaggtcgtcctgtcctggcccggccacgacgagttcaccaagcacatcccgaccggtggagcccccgca

SEQ ID NO: 4574 - DNA, 828 bp, Streptomyces avermitilis
  CDS (1)..(828)
atgacggacgcagcagcccttcccggccagccacgcggcggagtcctctcgggccccgccacccggcgcgccgtcaacgtcctcgcgcccaacgcctccgcgatgaccctggacggcaccaacacgtggatcgtcgccgagcccgactccgagctcgcggtcgtgatcgaccccggccccctggacgacgtacacctgcggaacgtcgtcgacacggccgagcgggccggccggcggatcgcgctgaccctgctcacgcacgggcacccggatcacgcggagggggccgcgcggttcgccgagctgaccgggacgaacgtgcgtgcgctcgatccggcgctgcggctcggcgacgaagggctggcgcccggcgacgtcgtcaccgtggggggtctggaactgcgggtcgtcccgacgcccggccacaccagtgactccctgtgcttccatctgcccgccgaccgggccgtcctgaccggtgacaccgtcctggggcgcggtacgaccgtcgtggcgcaccccgacggccggctgggcgactatctggactccctgcggcggctgcgctccctgaccgtcgacgacggcgtgcacaccgtcctgcccggccacgggcccgtcctggacgacgcccagggcgccgtcgagttctacctcgcccacagagcccaccggctggcccaggtggagacggcggtcgagaacggctaccgggcgcctgccgaggtcgtcgcccacgtgtacgcggacgtcgaccgctccctgtggccggcagccgagctctccgtacgagcccagatggactacctccgggagcacggcctcatc

SEQ ID NO: 4575 - DNA, 909 bp, Streptomyces avermitilis
  CDS (1)..(909)
ttgaaccggcggggccccatcggcgtaccttctggcgtgctgatccaaaaatcatctgccaccacgctcctgtcggggcacagtgggcgcatggccggacaggggcaccacggagggctcgacgcccagggatacatcgaacgcgagggttcgctcggccggatccaggagacgttctggcccgtggtcgccgcggcgcgcgaccggctgacggacgtcttcggggcgcgcatgacgagcgcgtacctctacgggtcgattccgcgcggcaccgcgcgcgtggggcgcagtgatctcgatctgctcctcgtcctgcgcgacgagcccaccgaggcggaccgggcggaggcgcgtgcgctcggtgactcgctcgacaaggagttcccggggatcgacggcgtcggaacgctcctggtcagccgtacgcggacgctgagcgccctggagacgtacgacctcggctggttcgtcgcctgcctctgcacgcccctgctgggcgaggacctggccgagttcctgccccgctaccgccccgactcccacctcgcccgcgagacgaacggcgacctcgcgctccacctgtcgcgctggcgcgagcggatcgccgggacggccgacacggacgaggcccgccgcccgcttgtccgcttcatgtcccgccacctggtccgcaccggcttcacgctcgtcatgccccgctggaacggctggaccagcgatctcggggagatggccgaggcgttcgccgagtactacccggagcgggcggggcagctgcgggaggcggcgctgctcggatacgacccgaccggcgaccccaccgtcctccgtcggtacgtcgacgatctgggcccctggctggccgaggagtacgcgcgcgtgcacggcgtgaaggagccacgcccggac

SEQ ID NO: 4576 - DNA, 672 bp, Streptomyces avermitilis
  CDS (1)..(672)
gtggacgacgttctgcggcgcgccccgctcttcgcggcgctcgatgacgagcaggccgcggagctccgcgcctccatgagtgaggtgaccctcgcgcgcggcgacgccctgttccatgagggcgaccccggtgaccggctgtatgtggtcaccgagggcaaggtcaagctccaccgcacatcccccgacggccgcgagaacatgctcgccgtcctcggccccggcgagctgatcggcgagctgtcgctgttcgacccgggtccgcgcacggccacggccaccgcgctgaccgaggtcaagctgctcggcctcggccacggcgacctccagccctggctgaacgtgcgccccgaggtggccgccgccctgctgcgcgccgtcgcccggcgcctgcgcaagaccaacgaccagatgtccgacctggtcttctcggacgtgcccggccgggtcgcgcgcgccctgctcgacctctcacgccgcttcggcgtgcagtccgaggaaggcatccacgtggtgcacgacctcacacaggaggagctggcccagctggtcggcgcgtcccgcgagacggtcaacaaggccctcgcggacttcgcgggccgcggctggctgcgcctggaggcgcgcgccgtgatcctgctggacgtggagcgcctcgcgaagcgctcgcgc

SEQ ID NO: 4577 - DNA, 930 bp, Streptomyces avermitilis
  CDS (1)..(930)
gtgaagaaggcagcccggaagacagtcaagaaggcggccaagaaggcgacgacggccgtgaagaaggacgcgtccgcggaccccgtcgccaaggcgcccaagtccgtggccgccaagccgcccaagtccgccgccaagccgcccaggaacgagtcgcgcaccgccctcgtccgccgcgcccgccggatcaaccgcgagctcgccgaggtgtacccgtacgcacacccggagttggacttcgagaactccttccagctgatcttggcgaccgtcctgtccgcgcagaccaccgacctgcgggtgaaccagacgacgccggcgctgttcgccaagtacccgaccccggaggacctggccgcggccaaccccgaggaggtcgaggagatcctccggcccaccggcttcttccgggccaagaccaagtcggtcatagggctgtccaaggccctcgtggaggagttcggcggcgaggtccccgggcgcctcgaagatctcgtcaagctgcccggcgtaggacgcaagacggccttcgtggtgctcggcaacgccttcgggcggcccggcatcaccgtggacacccatttccagcggctcgtccgccgctggcagtggaccgacgagaaggatccggacaagatcgaggcggccgtcggcgcgctcttcccgaagagcgagtggacgatgctctcgcaccatgtgatcttccacggccgccgcatctgtcacgcccgcaagccggcctgcggggcctgccccatcgccccgctctgcccggcgtacggggagggcgagaccgaccccgagaaggcgaagaagctcctgaagtacgagaagggcggcttccccggccagcggctcaatcccccacaggcgtacctggacgcgggcggcatcccggcgccgcccctgggagcgccccagggcacccca

SEQ ID NO: 4578 - DNA, 765 bp, Streptomyces avermitilis
  CDS (1)..(765)
atgacgcacgcgagcaacgcgcaggacagcagggcagcgctgagcggcgacgggcgggctgcgctcggcggtgacgggcgggccgcgttcggcgaggacggccaggtggcgctgcgcaaggacggtatgcccgactggctcgatccggtcgtgcgggccgccgagacggtggagccgctccagctgagccgcttcctgccgcccaaggacggcgcgggacgccagtccgccgtactcatcctgttcggcgagggcgaccgcggccccgagctgttgctcatggagcgcgccggctcgctgcgctcgcacgccggccagccgtccttccccggcggtgccctcgaccccgaggacggcgacccgggggccgacgggccgctgcgggccgctctgcgcgaggccgaggaggagaccgggctcgacccgagcggcgtccagctcttcggcgtgctccccaagctgtacatcccggtgagcgagttcgtcgtcaccccggtgctgggctggtggcgccgccccacgccggtcggagtggtcgatccgaacgagacggcgcgcgtcttcacggtccccgtggcggatctcacggaccccgccaaccgcgccaccaccgtgcaccccagcggccacagaggtccggcatttctggtcgaatcggccctggtgtggggcttcacggcaggcgtcatcgaccggctgctgcactacgcgggctgggagcgcccctgggaccgcgacaagcaggtcccgctcgactggcgcgca

SEQ ID NO: 4579 - DNA, 1197 bp, Streptomyces avermitilis
  CDS (1)..(1197)
gtgaacgtgctggacatcctgttgctggtcgccgcagtgtggttcgcgatcgtgggctatcgccagggcttcgtcgtcggcatcctgtcggtgatcggcttcctgggcggcggcctcgtcgcggtctacctgctccccctcatctggggctgggcgaccgacggcaccaaggtcactacgaccgccgccgtcgtcgcggtcatcgtggtgatcgtctgtgcctccgtcggccaggccctcaccacccacctcggcaacaagctgcgccggtacatcacctggtcgccggcccgcgccctggacgcgaccggcggcgccctcgtcaacgtcgtggcgatgctcctggtcgcctggctgatcggctcggccctcgccggtacgacgctgccgacgctcggcaaggaggtgcggggctccaaggtcctcctcggcgtggcgcgggccctgcccaaccaggccgacacatggttcgcggacttctcctcggtcctcgcgcagaacggcttcccgcaggtcttcagcccgttcgcgaatgagccgatcaccgacgtgcagccccccgacccggcgctcgcgaagagcccggtcgccacgcgcgcgcagaagtccatcgtcaaggtcatgggcaccgcgcagagctgcggcaaggtcctcgaaggcaccggcttcgtcttcggcaaccgccgggtgatgaccaacgcgcacgtggtcggcggggtcgacgagcccaccgtccagatcggcggcgagggcaggaagtacgacgcgaaggtcgtcctctacgactggcggcgcgacatcgccgtactcgacgtgccgaacctgaaggcgcccgcgctgcagttcacttcgacggacgcggccagcggcaacggcgcgatcgtcgccggcttcccggagaacgggtcgtacaacgtccagcccgcgcgcgtgcgcggccgcatcacggccaacggcccggacatctaccaccgcggcaccgtgcgccgcgacgtgtactcgctgtacgcgaccgtccgtcagggcaactccggcggcccgctgctcacccccgaaggcaaggtgtacggcgtggtcttcgcgaagtcgctcgacgacgccaacacggggtacgcgctcaccgcggacgaggtccagaaggacatcacccaggggcgtagggccaaccagcaggtggacagcgacagctgcgcgctc

SEQ ID NO: 4580 - DNA, 948 bp, Streptomyces avermitilis
  CDS (1)..(948)
atgacggacccggccaccccttcggcgcaatccacctcggtcgtacgactcgacctccccggcgggcgcgaggtgacccaccgggacgtcgcggcgaacggggcgcgattccacatcgcggaactgggcgacggaccgctggtcctgctgctgcacggcttcccgcagttctggtggtcctggcgccaccagctggtcgcgctcgccgacgcgggcttccgcgccgtcgcgatggacctgaggggcgtcggcggcagcgaccgcaccccgcgcggctacgaccccgccaacctcgcactcgacatcaccggggtcgtacggtccctcggcgagcccgacgccgcgctggtcgggcacgacctgggcggatatctcgcctggacggcggccgtgatgcgccccaagctcgtacgacgcctcgcggtcgcctcgatgccgcacccccggcgctggcgctcggcgatgctcgccgacgtcaagcagacgaccgcgggttcctacatctgggggttccagcgcccctggatccccgagcgccaactcaccgcggacgacggcgccctggtgggccgtctgatccgggactggtcgggcccgcgtctgccggacgacgaggacgtcgagacgtatcggcgcgcgatgtgcatcccgtcgacggcgcactgctcgatcgagccgtaccgctggatggtccgctcgatggcccgccctgacggcatccagttcaaccggcgcatgaagcggccggtgcgggtgccgacactccatctgcacggctcgctggaccccgtgatgcgtacgcgcagtgcggccggttccggggagtacgtcgaagccccgtaccgctggcggctgttcgacgggctggggcacttcccgcacgaagaggacccggtcgccttctccaccgagctgatcaactggctgaaggaccccgaacccgaccgg

SEQ ID NO: 4581 - DNA, 474 bp, Streptomyces avermitilis
  CDS (1)..(474)
atgagcgcacccgacggcagcccggtcggcgccgaacgcagcatcggccagctggtcgcctcggcgacgaccgagatgtccgcactggtgcacgacgagatcgcgctggccaaggcccagctcaaacaggacgtgaagcgcggcgcggtctccggtggggccttctcggcggccggcgcggtgctgatcttctccctgccgatgctgaatttcgctctggcgtacggcatccggacctggagcaactggaatctcgcggtctgcttcctgctgtccttcgccgcgaacgtgctggtcgccggcgcgctggcgctgctcggcacggtcttcgcgaagaaggccaagaagagccagggcccgcagaaggtcgccgcgtcgatgaaggagacggcgggcgtcctccagcacgccaagccgcacccccggaccgccccggtgagtgacgcggtcgaagctgtggcacgctcgtcctca

SEQ ID NO: 4582 - DNA, 1398 bp, Streptomyces avermitilis
  CDS (1)..(1398)
gtggccgccccccgcaccagcacccgcaagttcctcggacggctctcgctgcccgagcggaacttcgtcgcggaggcgctgcgcaccgagaccgtcggcggcgtcctgctcctcctcgccgcgatcaccgcgctgatctgggcgaacgtacccgcgctgcaccacagctacgagagcgtcagccacttccacttcggccccgcccccctcggcctggacctctccgtccagcactgggccgccgacgggctgctcgcggtcttcttcttcgtcgccggcatcgaactcaagcgcgagctggtcgcaggggacctcaaggaccccaaggcggccgcgctccccgtggccgccgccctgtgcggcatggccgtacccgcgctcgtctacaccctcaccaacctcaccggtggcggctccctccgcggctgggcggtacccacggccaccgacatcgccttcgcgctggccgtcctcgcggtcatcgggacctcgctcccgtccgcgctgcgcgccttcctgctcaccctcgccgtcgtcgacgacctcttcgcgatcctgatcatcgcggtcttcttcaccgccgacctgaacttcgccgccctcgccggcgccgtgatcggcctcgccgtcttctggctgctgctgcgcaagggcgtacgcggctggtacgtgtacgtgccgctcgcgctcgtcatctgggggctgatgtacaacagcggcatccacgccaccatcgccggtgtggcgatgggactgatgctgcgctgccaccgccaccagggtgaggagcacgctcccggtgagcacatcgagcatcttgtacgccccctgtcggccggcctggccgtgcccctgttcgccctgttcagcgcgggtgtcgtgatctccgggggtgcgctcggggacgtgttcaccaggccggagaccctcggggtggtcctcgggctcgtcgtcggcaaggcgatcggcatcttcggcggaacgtggctgacggcccgcttcacccgcgcgtcgctcagcgacgacctcgcctggcccgacgtcttcgcggtggcgtcgctggccggcatcggcttcaccgtctccctgctcatcggcgaactcgcgttcgacggtgatccggtgctgaccgacgaggtcaaggccgccgtcctcaccggttcccttctggcggcgctgatcgcgacgacgctgctgaagctgcgcaacgccaagtaccgtgccctgtgcgaggacgaggagcgcgacgaggacagcgacggcatccccgacatctacgagcaggacaacccggcgtaccacctgcgcatggccgagatctacgagcgcaaggccgccgagcaccgaaggcttgccgaagtgacgggcggggcaggcgcggagaacgatggtccggca

SEQ ID NO: 4583 - DNA, 1956 bp, Streptomyces avermitilis
  CDS (1)..(1956)
gtgagcaacgaaagcctggccaacctgctgaaggaagagcgcaggttcgcgccgcccgccgacctggcggcgaacgccaatgtcaccgcggaggcgtatgagcaggccaaggctgacaggctcggcttctgggccgagcaggcccgccggctgacctgggccaccgagccgaccgaaacgctggactggtcgaacccgccgttcgccaagtggttcaaggacggcaagctcaatgtcgcgtacaactgcgtcgaccgccacgtcgaggcgggccacggcgaccgcgtcgcgatccacttcgagggcgaacccggcgacagccgtgccatcacctacgccgagctcaaggacgaggtctccaaggccgccaacgccctgaccgagctgggagttcagaagggcgaccgggtcgccgtctacctcccgatgatccccgaggcggtcgtcgcgatgctcgcgtgcgcccgcatcggcgccgcgcactccgtcgtcttcggcggattctcggccgacgcgatcgcggcccgtatcaaggacgccgacgccaagctggtcatcaccgccgacggtggctaccggcgcggcaagccctccgcgctcaagcccgccgtcgacgacgccgtcagccgcggggacggggtcgagaaggtgctcgtcgtgcggcgtacgggccaggaagtcgcctggaccgagggccgcgacgtctggtggcacgagatcacggccaagcagtccgccgaacacacgcccgaggccttcgacgccgagcaccccctgttcatcctctacacgtccgggaccacgggtaagccgaagggcatcctgcacacctccggcggctacctcacccagacgtcgtacacccaccacgccgtcttcgacctcaagccggagaccgacgtctactggtgcacggccgacatcggctgggtgaccggccactcgtacatcacgtacgggccgctctcgaacggcgcgacgcaggtcatgtacgagggcacgcccgacaccccgcaccagggccgcttctgggagatcgtccagaagtacggcgtcaccatcctctacaccgcgcccaccgcgatccgtacgttcatgaagtggggcgacgacatccccgcgaagttcgatctgtcctccctccgggttctggggtccgtcggcgagcccatcaaccccgaggcgtggatctggtatcgcaagcacatcggcggcgaccgcacgccgatcgtggacacctggtggcagaccgagaccggcgcgatgatgatctcgccgctgccgggcgtcaccgagaccaagccgggctccgcccagcgcccgctgccgggcatctcggcgacggtggtggacgacgaggcccgggaagtacccaacgggggcggtggctatctcgtcctcaccgaaccgtggccgtcgatgctgcgcaccatctggggcgacgaccagcggttcctcgacacgtactggtcgcgcttcgagggcaagtacttcgccggtgacggcgcgaagaaggacgaggacggcgacatctggctgctcggccgcgtcgacgacgtcatgctcgtgtccgggcacaacatctcgacgaccgaggtcgagtcggcgctcgtctcccacccgtcggtcgccgaggcggccgtggtcggtgccgccgacgagacgaccgggcaggccatcgtcgccttcgtgatcctgcgcgggacggcgaacgccgaggacgacaacctggtcgccgacctgcgcaaccacgtcggcaccacgctcggcccgatcgccaagcccaagcggatcctcccggtggccgagctgccgaagacccgctccggcaagatcatgcggcgcctgctgcgcgacgtcgccgagaaccgggccctcggagacgtcaccaccctgaccgattcctcggtgatggatctgatccagtccaagctcccggcggcgccgagcgaggac

SEQ ID NO: 4584 - DNA, 2373 bp, Streptomyces avermitilis
  CDS (1)..(2373)
atgtccgcctgcgtccccacccgcgccgccgactcgaatcggacgaagcgcatccaccagccccacagccccccgccgccccagccccggcgcttccgcatcgcgggcgccgactggtcggcctccatcgcggtcttcctgatcgccctccccctgtccctcggcatcgccctcgccaccggcgcgccactccagtccggcctggtcgccgccgccgtcggcgggctcctcgccggccgcctcggcggctccccgctccaggtcagcggccccgccgccggactcaccgtcgtcaccgccgaactcatccaccgctacggatggcgcacgacctgcgccatcacggtgctcgccggcgtcgcccagctcggcctcggctgtctgcgcgtggcacgtacggcgctcgcggtcagccccgcgatcgtgcacggcatgctcgccgggatcggcgtcaccatcgccgtcgcccagctgcacatcgtgctcggcggcaccccgcagagctccgttctcgcaaacctccacgcgctgcccgcccagttggcgcacctacagcccgccgcggtgtcgatgagcgcgctgacactggccctgctgctggcctggccgcggctcccggggcgcgtcgggcgactcctgcgcacgatcccggccgcactcgtcgccgtcgccggggccaccacggccgcctcgctcgccgcactgtccctgcccaaggtcgacctgccgtcctggcgcagccatgcgctggcctcactgcccgagggcccggtgctcggtattgccgccgccgtgctcaccaccacgctggtgtgcagcgtgcagtcgctgctcggcgccgtcgccgtggacaagctgaccgccgggcgccccctcccgaacaggcgctccgacctcgaccgggagctgctcggccagggcaccgccaacatcgtctccggcgcgctcggcggacttcccgtggcgggcgtggccgtacggacctcggcgaatgtgcgagccggtgccgtcagtcggaactccacgatgctgcacggcgtttgggtagtagttgccgcgctgctgatggtcccgatcctcgagctgatccccctcgcatcgctcgccgccctggtgatggccgtcggcatccagatggtgtccctgcaccacatccgcacggtcacccgccaccgagaggtgctggtctacgccgtcaccacgctcggcgtcgtcctgctcggcgtcctggaaggcgtgacgctgggggtcgccgtggccgtcgccgtcgctctgaaccgcctcgcccgcacccgcatcacccacgacgaacaggaaggagtccattacgtacaagtacgaggacagttgacgttcctcgccgtgccgcggctgagccgtgcgctgcatctggtgccccatggggcggacgccgtcgtggagttggacgggtcgttcatggaccacgcggcgtacgagtcgttgcaggactggcagaccgcgcacaccgcgcagggcggctccgtcgagttcaccgggcgggcgggcacccgtatctccctgccggccatggaagctccggcggccgagcggagcaccgggctcggggaggcctccgcctgccgctgccgcccctggacgccctggcgcaaccaccagtgcgcgcgcccgcagccagcgccacccggcgaagacccggatgagtcggccgcgaccgggccgagcggacatcaactggcacgtggcatcagtgcgttccagcgcaacaccgctcccctggtgcggggcgagctggcccggctggcgcgcgaggggcagcggccgtcgcagctcttcctgacctgcgccgactcccggctcgtcacgtcgatgatcacctccagtggtcccggcgacctcttcgtcgtgcgcaatgtcggcaacctcgtgccgccgccgggcgaggagagcggggacgactccgtggcggcggcgatcgagtacgcggtcgacgtgctcgaggtgcggtccatcacggtgtgcgggcactccgggtgcggggcgatgcaggccctgctgagcagcgatcccggtagctcacagacgccgctcaagcggtggctgcggtacgggctgccgagcctggagcggatggccgccgaggaccgggcccgactcgccgggcgcgcggcggccgacgccgtcgaggagctgtgtctgaccaacgtggtgcagcagttggcgcatctgcgggcgcacgagtccgtggcgcgggccctgcgcgagggtgcgctcgaactgcacgggatgtacttccacgtgggcgaggcacaggcgtacctcctgtcggaggacccggccgccgacggggtcttcgcccgggtcaccgagacggcccgggacgacatgccggcg

SEQ ID NO: 4585 - DNA, 1269 bp, Streptomyces avermitilis
  CDS (1)..(1269)
atggccgccacccacaagatcgccgcgggcgtcgcactcgccgcggcctgcgccaccgcgctcgccggttgcgcgagcgacaccactggctccaaggaaggcgcgtacggccccgagaaggcgggtgcccccgcaccgaagagcgccgtccgcctgatcggcgacggctccacctcgtacacgggcgcgcagccgcatctgcccaggcccgagcggctcaagcccggccagaagcccccgcagttcgtcgtcttctcctgggacggcgccggagaggacagccagaagctgttctcgcacttccgcaaggtggccaaggccaacaacgcctcgatgacgtacttcctgagcggggtgtacctgctgccggaggagaagcgggacctgtacaagccgcctgagcactcgccgggccgttcggacatcggcttcaacgaccagcacggaatcaaggagaccgcgaagcagctgcgtctggcgtggctggagggcaacgagatcggcacccacttcaacggccacttctgcggcaagggcggcggcgtcggcgagtggtcggtcgaggagtggaaggacgagatcgcccaggcgaagtcgttcgtgaagtcctggaagaccaacgcggacctggcgaaggcggcgccactgcccttcgactacgacaaggagctcatcggcgcccgcacgccctgcctggaggggcaggagaacttcgtgaaggcggcccgtgacctgggcttccgctatgacacctcgggcgtcaacaatcaggtctggcccaagaagagggagggcctgtgggatctgtcgatgcagctcgtgcccttccccgggcactcctacgagcagctcaccatggactacaacttcatggtcaaccagtccggcacccagacccagggcgaccccgccaagcggcagctctggggtgaccagatgcgtgacggactgctcgaaggcttccgccgcgcctacgacggcaaccgtgcgccgctgatcatcggcaaccacttcgagtcctggaacggcggcacgtacatgcgcgccgtccaggaggtcatcgagagcgtctgcaccatggacgaggtgcgctgcgtgtcgttccaccagctcgtcgactggctggacgcgcaggacccgcaggttcttcagaagctgcgcaagctgacggtcggcgaggccccgaggcagggctgggcggccttcctcccgggccggccgcctgctccggccccgaagggggtcccgggcgcgccggcgttcaagccg

SEQ ID NO: 4586 - DNA, 987 bp, Streptomyces avermitilis
  CDS (1)..(987)
ttggtgaacatgaaaattgctttcgtcgggaagggcggcagcggcaagaccacgctgtcctccctgttcatccgccatctcgccgccaccgcggcgcccgtcgtcgccgtcgacgccgacatcaaccagcacctgggggccgcgctcggcctcgacgaggccgaggccgccgggctgcccgccatgggtgagcgactgggcctgatcaaggactatctgcgcggctccaacccgcgtatcgcgtccgccgacacgatgatcaagaccaccccgcccggcgagggctcccggctgctgcgggtgcgcgagagcaatcccgtgtacgaggcatgcgcgcgcaccgtggaactcgacggcggcgccgtccgtttgatggtcaccggccccttcaccgacgccgacctcggggtcgcctgctaccactccaagacgggagcggtggagctgtgcctgaaccatctggtcgacggcccgggtgaatacgtggtggtcgacatgacggcgggctcggactccttcgcgtccggcatgttcacccgcttcgacatcacgttcctcgtcgccgagccgacccggaagggagtctccgtctatcgccagtacaaggagtacgcccgtgacttcggggtcgccctgaaggtcgtcggcaacaaggtgcagggccaggacgacctcgacttcctgcgcgccgaggtcggcgaggacctgctcgtgacggtcgggcactcgaactgggtgcgcgccatggagaaggggcgcccgccccgcttcgagcttctggaggacgccaaccaccgcgcgctgcgcacgctgcaaagcgccgccgacgccacgtacgagctgcgggactgggagtcctacacccgccagatggtgcacttccacctgaagaacgccggcaactggggcaacgagcgcaccgggaccgacctggcggcgcaggtcgaccccggtttcgtgctcagcgagggtctcgtggctacggct

SEQ ID NO: 4587 - DNA, 822 bp, Streptomyces avermitilis
  CDS (1)..(822)
atgagtacgacaggtgcggccgccgatccgctcgcggccctgggggcgctgcccggtgtggccgagtccgtggagtccgtgcgcaaggccgtggaccgggtctacggacaccgggtcatgcggcgccgcagcaacgagatcacctccgaggcggcgctgcgtggcgcccgtggctctgcggcgctgtccggtgccgactgggccctggaggaggtgcgccggcgtaccgacttcagcggtgacgacgaggcccgtacggtcggcgcggccctcaggctgacggccgaggcggggcagctcctgtccatctggcggcagtcgcccctgcgggtgctggctcggctgcacctggtggcggccgcgggcaaggaggacgaggtcggccggccccggcaggacggtgagccggtcgacgagccgctcgtcgaactgccgctgccggacgcgcgggaggtcgcgggccggctcgaagggctctcgcagctgatcatcgcgggcggctcggcgccggccctggtgacggcggccgtcgtgcacggcgaactgctcgcgctgcgccccttcggctcccacaacggcctggtcgcgcgcacggccgaacgcatcgtcctgatcggcagcggcctcgacccgaagtccatctgtccggccgaggtcggtcacgccgaactcggccgtgcggcctatgcggcggccctcgacggctatgtctccggcacgcccgagggcatggcggcgtggatcgcccattgcggcaaggcgatcgagctgggggtccgggagtcgacggcggtgtgcgaggcgcttcagcgcggcgccgcg

SEQ ID NO: 4588 - DNA, 831 bp, Streptomyces avermitilis
  CDS (1)..(831)
atgctcgggcccgtggaaaaccactccttgcctcgcacagcagccttctttgacctggacaagacggtcattgcgaagtcgagcacactcacgttcagcaagtcgttctaccaaggcggcctgatcaaccgcagagccgtgttgcgtaccgcatatgcccagttcgtgttcctcgcgggcggcgccgaccacgaccagatggaacggatgcgcgagtacctctccgcactgtgccgcggctggaacgtccgacaggtcaaggagatcgtcgccgagacgctgcacgacctgatcgacccgatcatctacgacgaggccgcgtccctcatcgaggagcaccacaccgccggacgggacgtcgtgatcgtctccacgtccggcgccgaggtcgtggagccgatcggcgaactgctgggcgctgaccgagtggtggccacccgcatgatcgtgggcgacgacggctgcttcacgggcgaggtggagtactacgcgtacgggccgacgaaggccgaggcgatcaaggagctggccgcgtccgaggggtacgacctcgcacgctgctacgcgtacagcgattcggcgaccgacctcccgatgctggagtccgtcggccatccgcacgccgtgaatccggaccgcgcgctgcgccgcgaggcgatcgcccggcagtggcccattctggacttccaccggccggtccggctgaagcagcggctgcccgcactgtcggtgccgccgcgcccggcgctggtcgcggcggccgcgataggcgccgcggcggccaccgccggccttgtctggtacacgaaccggcggcgcgcgacagcgatg

SEQ ID NO: 4589 - DNA, 1092 bp, Streptomyces avermitilis
  CDS (1)..(1092)
atggcgggagccatcacccacgaccacgcggccgccgcccaggggcggcagggcggaccgctgatcgtcaccgaggacgttgaactcctcgacgacctgctgcgcctgtgcgcggccgcgggcgccagaccggaagtccaccacaccgtgcccgacggcaggggcacctgggaggccgcaccgctggtgctcgtcggagacgacgccgcgcggcgcgtccgcggggccgcgcggcgacgcggagtcgtgctggtggggcgggatcaggacgactccggggtctggcggcgggccgtggagatcggcgcggaccatgtcctgctgctgccggatggcgagcaatggctggtcgaccgcatcgccgacgtggccgaaggagtcggccggcccgcgctcaccgtgggcgtgatcggcggtcgcggcggggccggcgcgtccacgctggcctgcgcgctcgccgtcacctcggcgcgccagggcaggcgcaccctgctcgtggacgcggatccgctgggcggcggactcgacgtactcctcggcggcgagacagccgaagggctgcgctggccggcgttcgccgcctcccgtggccgggtcggcggcggcgccctggaggagtccctgcccgaactgcacgcgttacgggtgctgagctgggaccggggtgacgcggtggctgtcccgccccaggccgtccgtgcggtcctggccgcggccaggcggcgcggcggagccgtcgtcgtcgacctcccgcgccgcgtcgacgagggagccgccgaagcgctcgcccaggtggacctcggcgtgctggttgtccccgccgagctgcgcgcgatcgcggcggcggcacgggtggcgtcggccgccggcatggtcctgggtgatctgcgggtcgcggtacgcgggccgtacgcgcccgggctcgacgaccgcgaggtggctcggctgctcgggctgccgctgctcggtgaggtaccggccgagccaccggtgccggacggcggcgtgccgcccgggggagcggcgcgggggccgctcgcccggttctgcgcggtcttttgggaccgggcgctggtcgaggcgggtggcgta

SEQ ID NO: 4590 - DNA, 1299 bp, Streptomyces avermitilis
  CDS (1)..(1299)
atgagcgggggatgggacgcgggggccggcctggaccgcgcggcgggcctggacggcgccacggggtcggttttcggtgggggcgcgggaggcgtcgtcggacggggtgcgccggccggcgggggatccggtgcccgggacgatctgagcgcggggctgctggagggggtgcggcagtggctggccgagagcggggccgagccgacgcccgcgcgcgtggcgcaggccctgcgggagcggggaagggtgctgggggacgccgaagtcctcggcgcggccgagcggtttcgctcggaactggtgggcagcgggcccctggagccgctgctcgccgacccctcggtcaccgatgtgctggtgtcggcgccggaccgggtgtgggtggaccgaggcggcgggctggagctgacagcggtgtccttcccggatgctgcggccgtacgacgcctggcgcagcggctggccgccgtggccgggcggcgcctcgacgacgcccggccgtgggccgacgcgaggctgccggacggcacccgcctgcacgcggtgctcgaaccggtcgcggtcggctccgcctgtctgtcgctgcgggtcgtacggccacgggcgttcaccctcgccgagttggtggcggcggggacggtgccgcccggcggggaccgggtcctgcgggcgctgctggaggccaggctgtcgtttttgatcagcggcgggacgggatcgggcaagacgaccttgctgagtgcgctccttggcctggtcgggccgggggagcggatcgtgctggcggaggactcggcggagctgcggcccgaccatccgcatgtggtgcgcctcgagggccggcccgccaaccaggagggcgtcgggctggtgacacttcaggaactcgtgcgccaggccctgcggatgagacccgaccggctcgtcgtcggagaggtgcgcggtcccgaggtcgtgtccctgctggccgcgctgaacacgggacatgacggcgggtgcggcaccgtccacgcgaacgcggcggcccaggtgccggcccggctggaggcgctgggcacggccgccggcctggaccgggccgcgctgcacagccagttggcggccgcgctgtcggtggtcctgcatcttgtgcgcgaccgggccgggcggcggcgcatcgccgaggtgcatgtgctggagcgggacgcgtcggggctggtggtgacggtgcccgcgctgcggtggggcgcggagacgttcacgtacgagcggggctgggagcggctgcgggggctgcttcgggaaggaggcgaaccgctg

SEQ ID NO: 4591 - DNA, 627 bp, Streptomyces avermitilis
  CDS (1)..(627)
gtgcgtccgtgctgccactggcggccggggccgtcggggtgccactgctgcgccgggtgcgggctggccgcggaggcgcggcgggcacgggagcggcggggagaggcggtgatcgggctgtgcggggcgctcgccggagaggtgcgcgccggacggcagccgggcgaggcgctgctccacgcggcgggtgactcgggcgggctgggcgacgcgcaggcggcggtgctggcggcggcgcggttcggcggggatgtgcccggggcgctcgccgacgcggccggtcagcccggtgccgaggggctgctggggctcggggcgtgctggcgggtggccgtggaccggggcgcgggcctggcggccgggctggaccggttggaggcggcgctgcgcgccgagcgggaccaacgggccgaactgcgcgcccagttggcgggcgcgcgctccacggcggtgatgctcgccgccctgccggtcctgggtctcctgctgggcacggcactgggcgccgacccgctgcacgtcgtgctccacaccggcgcgggcctggcctgtctgctggccggcgcggtgctggaaggcgcgggtctgtggtgggcgctgcggatcgtacggggagcggaggcggca

SEQ ID NO: 4592 - DNA, 498 bp, Streptomyces avermitilis
  CDS (1)..(498)
atgagcgcggaagttgtccacaggctgggggttgtgtggggagcgtcggcgctgtggtggctggcgcgggcgctcgccgccgctcggcgagagcggcggatgcgccggcggctgggtgtgctgctggtcctgcacggtgcgcctgcacgacggcggttcgaggtgcgggggacggtgctgcggtggcttccgggggcgggggcgctgtgctccggttgggtgctgttcggcggcctgggcggagtggtggtggggctgatcgcgggagccggggtgtcgtggtggcggcttcggcgggagagcggcagcgctgtccccgcggaggagtacgaccctgccgtggccgcccgtcaactcccgctggcggccgatctgctggcggcgtgcatcgcggcgggcgcgagtccggtcacggcggcccagcgcggtcggagaggcgctgcaggggcccgtcggggagcggctggcgacgggggccgccgaggtgcggctcggggg

SEQ ID NO: 4593 - DNA, 303 bp, Streptomyces avermitilis
  CDS (1)..(303)
gtgcggctcgggggtgagccggcggacgcgtggcggaggctggcgtcggtgccgcgcgccggggcgctggccctgctcctggaacgggcgggtgagtcgggcgtaccggcggcaggaccggtcgggcgcctcgcggcggaggcccgcgccgaatgggggcgtacggccacggcacgggcgcgccgggcgggtgtgctgatcactgctccggtggggctgtgcttcctgcccgcgttcatcacggtcggcgtactgcccgtggtgatcggactggcgggcgggctgctggagggagggagcgga

SEQ ID NO: 4594 - DNA, 231 bp, Streptomyces avermitilis
  CDS (1)..(231)
atgggcaggacagtacgagtacgggtgggtgtgctggtgcgcagggtgcgggcagcggtgcatggcgtacgaggcagggcgcgtgaggacgcgggaatggtcacgtccgagtacgcgatggggatcatcgcggcggtggcgttcgcggcggtgctctacaaggtgctgacgagcgggcaggtcagcgcggagttgcaggacatcgtggggcgggcgctcgatgtccggatg

SEQ ID NO: 4595 - DNA, 438 bp, Streptomyces avermitilis
  CDS (1)..(438)
atgtccggatgtgaacggggagcggcgggcgcggcctgcggcccgtgcggtgagcgccgtggggctcgcgggatgcctggccgggacggtgggtttgtcacggcggaggccgcggtcgtcctgcccgctctggtgctcttcgcgatggctctcgtctgggcgctgctggccgcgtccgcgcagattcagtgtgtggacgcggcgcgagcgggggcgcgagcggcggcgcggcaggatccgcccgatgcggtcacggcggtggcccggcaggcggcgccacgcggggcgagggtcacggtgagccgggagggcgacatggtgcgcgtggtggtcgtggcgcatccgcccgggccaagagcgctgactcccgaactcggcgacgcggcggtcgcgttggcggaggagaccgtggaggtggacacggtgggggtgcagccg

SEQ ID NO: 4596 - DNA, 696 bp, Streptomyces avermitilis
  CDS (1)..(696)
gtgtgtggacgcggcgcgagcgggggcgcgagcggcggcgcggcaggatccgcccgatgcggtcacggcggtggcccggcaggcggcgccacgcggggcgagggtcacggtgagccgggagggcgacatggtgcgcgtggtggtcgtggcgcatccgcccgggccaagagcgctgactcccgaactcggcgacgcggcggtcgcgttggcggaggagaccgtggaggtggacacggtgggggtgcagccgtgagggaccggggctcggtgagggaccggggctcggccagcgtctgggtcgtctgcgcgatcgccggcctgtgcgtcgtcttcggcgccgtcctcgcgatgagccaggcggtggtgacccgccatcgggcggcgtccgcggccgacctggcggcgctcgcggccgcggaccactgggcggacgccggcgggggggcgtgcgccatggcggaccgggttgcgcgagcgcagggcggcaggctggtgcggtgcgcggtcgagggagagatctcggacgtgacggcgacgtcggggcgagggcctttcacggcggaggtgagggcgagagcgggaccggctgggccggccgacgcggtggtgccgcccggtccggcaggaccagtcgtcccggtgcccccgggcgccgtctcccggacgtccgctcgtcccggaagggaggcgatgcct

SEQ ID NO: 4597 - DNA, 2505 bp, Streptomyces avermitilis
  CDS (1)..(2505)
atggcattcaatcacttaccggcaggcgtgcacgacgccttgggtccattgtccgtcatgccagtgacacactcgttgccgatggccaagaatcaccgacccgatcgatcctcgtcggacaccgcatccagcccctcgccgggcacggtcctggaccggctcgcctcggggccgagccgagcttcgcgcatcactcatacggagcacttgcccccgcgtgagggtcgccatgccgtgtggcccgaccggatccgttcggaggtcatcgccgcggtgcaggccgcgggcatcgaacacccctgggcccaccaggcacgggcggccgagcacgccctggacggcgagtcggtggtcgtcgccacaggcaccgcctccggcaagtccctggcgtacctcgtaccggccctgtcggccctcctggacggctccgaggcccccaatgggcgtggcgcgacggccctgtacctcgccccgacgaaggccctggcagcggatcagtgccgctctgtgaaggaactttcacaacctctgggcaccgccgtgcgccccgcggtctacgacggcgacacgcccgtcgaggaacgcgaatgggtacgtcagtacgccaactacgtcctgaccaaccccgacatgctgcaccgcggcatattgcccgcacacccgcgctggtcctccttcctgcgtgccctgcgctatgtcgtcatcgacgagtgccacacctaccggggcgtcttcggctcccacgtcgcccaggtactgcgccgattgcgccgtctgtgcgcgcggtacggcgcgtcgccggtgttcctgctggcctccgccaccgccgccgagccctcggtcgccgcgtcccgtctcacgggcctgcgggtcgtggaggtcgcggacgacgcctccccacggggggaactggtgttcgccctctgggagcccccgctcaccgagctgcacggcgagaagggcgcgcccgtccgccgcaccgccaccgccgagaccgccgacctcctgaccgacctgaccctgcaaggcgtgcgctcggtcgccttcgtacgctcccggcgtggcgccgagctgatcgcggtgatcgcccaggaacgcctcgccgagatcgaccgctcactcgcccggcgagtggccgcctaccgcggcggctacctaccggaggaacgccgcgccctcgaacgcgccctgcactccggcgaactcctcggcctcgccgccaccaccgccctcgaactcggcgtcgacgtgtcggggctggacgccgtcgtcatcgccggctacccggggactcgggcatccctctggcagcaggccggccgcgccggacgctcggggcagggggcgctggcgatcctggtcgcgcgcgacgacccgctggacacgttcctcgtccaccaccccgaggccctgttcgaccagccggtggagtccacggtcctcgaccccgacaacccgtacgtcctcgcgccgcacctgtgcgctgcggccgaggaactgcctttggtggaagaggacctggcactgttcggcccgtccaccgcagacctgctgccacagctggaggccgcgaagctgctgcgccgccgcaccaaggcgtggcactggacacgccgggagcgagccgcggacctcacggacatccgcggggagggcgggcggcccgtgcagatcgtcgaggccggcaccgggcggctgctcggcacggtcgacgcgggcgccgcgcacaccaccgtgcacgagggcgcggtccatctgcaccagggccgtacctacctggtgcgtgagctggacctggaggattccgtcgccctggtcgaggaggccaatccgtcgtattcgacggtcgcccgggacacgaccgccatctcggtcctggagacggacgtcgaagttccctggggcgaaggccggttgtgctacggctccgtcgaggtcaccaaccaagtcgtctccttcctgcgtcgcagactcatcaccggcgaagtgctcggcgagaccaaactcgaccttccgccacgtacgctccgcactcgcgccgtgtggtggacggtcaccgaggatcagctggacgcggcgcggatcaccccggagatcctcggcggcgccctgcacgccgccgagcacgcgtcgatcggcatgctcccgctgttcgccacgtgcgaccgctgggacatcggcggcgtctcggtcccactgcacccggacacgctcctgccgacggtcttcgtctacgacggccatccgggtggcgcgggattcgcggagcgcgccttccacacggcccgcgactggctcaccgccacccgccaggccatcgcatcctgcgagtgcgacgccggctgcccgtcctgcatccagtcccccaagtgcggcaacggaaacgatccgctccacaaacggggggccgtgcggctgctgtcggtgctgttgcgaggggcggcggagcaggagaaggcgggtctgccgaaggagcccgcacgggcggcggaatcgtccgcggac

SEQ ID NO: 4598 - DNA, 339 bp, Streptomyces avermitilis
  CDS (1)..(339)
gtggacctgtccctgtcgacccgtaccgtcggcgatcgtacggtcgtcgaggtcggtggcgaaatcgatgtatataccgcgcccaagctgcgcgagcagttggtcgagctggtgaacgacggcaatttccatcttgtcgtcgacatggagggcgtggatttcctcgactccaccggtctcggcgtgctggtcggcggcctgaagcgggtgcgtgcccatgagggctcgctgcgactggtctgcaaccaggagcgcattctgaagatcttccgcatcaccggtctcaccaaggtgttcccgatccacacctcggtcgaggaagcggtggcggccaccgac

SEQ ID NO: 4599 - DNA, 438 bp, Streptomyces avermitilis
  CDS (1)..(438)
atggccaccgttgagctccgcttcagcgcgctgcccgagcacgtcaggaccgcccgactggtggcggcagcggtggcgcgcagggccggagtggacgaggccgtactcgacgaggtcagactcgccgtgggcgaggcctgcacccgagccgtcggactgcaccagagcagcggtgtctcgtccccggtgcgggtgacgctgatcgaggaggagaagcagttctccatcgaggtcggcgacgaagcgccacgttcggcgcccggagagagggtgccgggcacgcgcgccgccgaggatcccgacgcggacggcgacgaggacgacatgggcctcgcggtcatcagcggcctcgtcgacgatgtcgaggtcactgctggagaaaacggtggactgatcaggatgagctggccaaccatgccgccggccacgctccttccc

SEQ ID NO: 4600 - DNA, 2403 bp, Streptomyces avermitilis
  CDS (1)..(2403)
atggcggggctttctacccctcatcagtttgaccaccccactgctctcgcagccgcggtactgaccgacgacaatcgtgtgatcgtgatggtcatcggggtcgtcgcgctcgcggcgctcgtggtcgccgggatcctggtgcgccaggtactcgcggccggcgagggcaccgacagcatgaagaagatcgcagcggcggtccaggaaggtgcgaacgcctatctcggacggcagatgcgcacgctcggcgtattcgccgtcgtcgtgttcttcctgctcatgctgctgcccgcggacgactggaatcagcgcgccggacgatcggtcttcttcttgatcggcgcgttgttctcggcgaccaccggttataccggcatgtggctcgcggtacggagcaacgtgcgtgtggccgccgcggcacgagaagcgactccggcggagggtgagccggaaaaggatctcaccgccgtatcgcacaaagcaatgaagatcgctttccgcacgggcggcgtcgtcggcatgttcacggtggggctcggtctgctgggcgcctcctgtgtggtgctggtctacgcggccgacgcgccgaaggtgctcgagggcttcggcctcggggctgccctgatcgccatgttcatgcgtgtcggcggcggcatcttcaccaaggccgccgacgtcggcgccgacctggtcggcaaggtcgagcagggcattccggaggacgacccgcgcaatgccgcgaccatcgccgacaatgtgggcgacaacgtcggcgactgcgcgggcatggcggccgacctcttcgagtcgtacgccgtgaccctcgtcgccgcgctgatcctcggcaaggcggcgttcggtgactccgggctcgccttcccgctgatcgtgcccgcgatcggcgtactcaccgcgatgatcggcatcttcgccgtggccccgcgccgcgccgaccgcagcggcatgtccgcgatcaaccgtggtttcttcgtctccgcggtgttctcgctggccctggtggccgtggccgtctacgtctatctgccggggaagtacgccgacctcgacggagtcacggacgtggcgatccgggccaaggacggcgatccgcggatcctcgcgatggtcgcggtggcgatcggcatcgtgctggccgccctgatccagcagctgaccggctacttcaccgagacgacccgacgacccgtacgggacatcggcaagagctcgctcaccggcgccgccaccgtcgtcctcgccggtatctccgtcggtctggagtcggccgtctacaccgccctgctgatcggcctcggcgtgtacggggcgtttctgctcggcggtacgtcgatcatgctggcgctgttcgcggtggcgctggccggcaccggtctgctcaccacggtcggcgtgatcgtcgcgatggacaccttcggtccggtctccgacaacgcgcagggcatcgccgagatgtccggtgacgtcacgggcgcgggcgcgcaggtgctcaccgacctggacgccgtgggcaacaccaccaaggccatcaccaagggcatcgccatcgccacggccgtcctcgcggcctcggcgctcttcggctcgtaccgggacgcgatcaccacggcggcgaacgacgtgggcgagaaggtctcgggcgcgggtgctccgatgaacctgatgatggacatctctcagcccaacaacctggtcggcctcatcgcgggcgccgcggtcgtcttcctcttctcggggctggcgatcaacgcggtctcgcggtccgcgggggccgtggtctacgaggtgcggcggcagttccgcgagcaccccgggatcatggactacacggagcagcccgagtacggcagggttgtcgacatctgcaccaaggacgcgttgcgcgagctggccactccgggtctgctcgccgtgctggcgcccatcgccatcgggttcacgctcggtgtcggagcgctcggcgcgtatctggcgggcgcgatcggcaccggcacgctgatggcggtcttcctcgccaactccggcggtgcctgggacaacgcgaagaagctcgtggaggacggccaccacggcggcaagggcagcgaggcccacgccgcgacggtgatcggcgacacggtcggcgacccgttcaaggacaccgcgggacccgcgatcaacccgctcctgaaggtgatgaacctggtcgcgctgctcatcgcgcccgcggtcgtcaagttctcgtacggcgaggacaagaacctcggcgtgcggatcgccatcgccgtgctctcgatccttgtgatcgtgggcgcggtgtacatctccaagcggcgtgggatcgccgtgggtgacgaaggcaacgcggagcgggtgaccaagtcggctgacccagcggtggtttcg

SEQ ID NO: 4601 - DNA, 594 bp, Streptomyces avermitilis
  CDS (1)..(594)
atggaagggaccaatccggtgaacaagaagctcgcggccgcgctgtccggcggtgcggtactggtactggcgctgtcgggatgcagtagtagcgacgacggtggcagcgacaagctgaactcctgggccaagcaggtctgtgacgcggtgcagccacaggcgaagaagatcgaggccgcgaataccgcgatccagaaggagacctcggacaacagcgcgcccgccgacgtccagaagaccgactcgcaggccttccaggacatctccgacgcctacaaggcgatggcgaacgccgtcgacaaggccggggcccccgatgtcgagaacggcaagaccaagcaggcgaacgcggtcaaggaactcgacgacctgtcctccgcctacgccgacctgaagaagcagacggacgagctcgacaccaagaaccaggcgaagttcgccgacggtctcaagggtgtcgccacccagctggagaagctgagcaagagcggcagcgacgccctcaacaacctcgaggagggcgacgtcggcaaggcgatggcccagcaggcgagctgcaagtccgcgtcggcgccggcctcggcgacgaagggc

SEQ ID NO: 4602 - DNA, 1587 bp, Streptomyces avermitilis
  CDS (1)..(1587)
gtgcccacaccgccttcggttgtccacaggagggcgtgcgatgtcggcaggaacggacacaatgggggcgtgagtaactccgccctgtcgcccctgccctccgccgaccgtcccgacgtcgccgcccggctgcgggacgccctgctcggcgcctccttcaccgccgacgggctgctcgagctgctcggcgctcccgcgtacgcggcgctcgcccgcagcgaggtcgtgcccgccctgcgggccacccgtggcgacacgccgctggaaacgctcgtgcggctgtttctgttgcagcagcccgtgccgcacgcgcgcgtggcggacgtcctgcccgtcgacgcctgcctggaagccggctggctgaccggcgtcggcggggacgaggtcgccgccgccgtcgacatccggccgtacggggggcccgacggcgaggactggttcatcgtctccgacctggggtgcgcggtcggcggggcgggcgggatcggcagccgggacgagggcgtcgtcctcggcgtcggcggggcgtccaccacgctcgccgggatcaccgtgcgtacccccgtcgccgccgccctcgacctcggcaccggctccgggatccaggcactgcacgccgcacggcacgccacgcgcgtgaccgcgaccgacctcaacccgcgcgcgctgcacaccaccgcgctcaccctcgcgctctccggcgcaccggccgccgacctgcgtgagggctccctcttcgagccgatcgccgccgacgagacatacgacctgatcgtgtcgaacccgcccttcgtgatctctccgggcgcccggctcacgtaccgcgacggcgggatgggcggggacgacctgtgccgcacactcgtccagcaggcgggcgaccggctgaccgagggcgggtacgcgcagttcctcgccaactggcagcacgttgagggcgaggactggcaggaccggctgcgctcgtgggtgccgcgcggctgcgacgcctggatcgtgcagcgcgaggtgcaggacgtcacgcagtacgccgagttgtggctccgggacgcgggcgaccatcgcagcgacccggtcgagtaccaggcgcggtacgacgcgtggctcgacgagttcgaggcgcgcaaggtcaagtcggtgggcttcggctggatcaccctgcggaagacgggcgcggtcgagccctcggtgacggtcgaggaatggccgcactccatcgaacagccgctcggtgaggccgtgcgcgcgcacttcgaccgcgtcgactatctgcgggcgacggacgacgcggccctgctcgccgggcacttcaagctcgccgccgaggtcgtccaggaacaggtcggcctgcccggtgccgaggaccccgagcacgtggtgctgcgccagcaccgcgggatgcgccgggccaccaaggtggacacggtcggggcgggcttcgccggtgtgtgcgacggcaccctgagcgccgggcgcatcctcgacgccatcgcccaactggtcggcgaggaccccgtgctgctgcgcgaccgcacgcccgcccagatccggctgctggtggagcaggggttcctggatccggtggag

SEQ ID NO: 4603 - DNA, 2226 bp, Streptomyces avermitilis
  CDS (1)..(2226)
atggcgggggagacgccggagcagggcgaaggccggatcatcagcgggcggtaccgcctgctgcggacgctcggcgcgggcggcatgggccgggtctggctcgcgtacgacgcggagctggcctgcgaagtcgcggtgaaggagatcgcgctgccggacctgccgatcgacgcgagcgagcccgtgcagcgcatcgcgcgggcgcggagcgaggcccgcaacgcggcgcggctgcgcggccacccgcacgtggcgacggtgcacgacgtggtggtgcacgaggggctgccgtggatcgtcatggagcacgtgccggacgcgatcgaccttcaggcggtcgtacggcggtcgggacccctcacccccgcgcggaccgcacggatcggggtcgccgtcctcgacgcgctcaccgcgggacaccggatcggcatcctccaccgggatgtgaaaccggccaacatccttctggcgccggacgcgtcgggcgacccctacgcgcgcgtcctgctcaccgactacggcatcgcgctccagcccgagtcccgcgagccccggctgaccgccaccgccggcattctcggcacccccggctatctcgcccccgagcgggcccgcggcgagccgcccaccccggccgccgacctgttctccctgggtgccacgctctacgcgacggtggagggacgcggtcccttcgaccggcacggcgagtacgcgactctgacggccctcctcggcgaggagcccaccccaccggtccgcgccggtgaactgggcgccgtactgcacgggctgctgatcaaggatccggtacggcgtctggcacccgaggccgtcgcgcggggcctggaggcggtggcgcgggcagcgccgggggagggattcgggccaccgccggggtgggggtccgcgccctctgtggggcagggcttcggtccgcctccgcagggtttcggtccgcccccggacggcttcggcccgccgtccggcacgccgtccgtgagtccgccctcggccgagggcgcgaccacggcaccgggggcaccaggagcaccgcaggtttcggctcccgggacgccgcagacaccgggtgcgccgcggaccccgcataccccgcacacaccacagacaccggcgggcggtcctggtacgcctccgggcagcccgtcggcgtacaacccctggcggccgacgcctccgagtggcccgtacgaccccgggaatccgtacgcgagcagcccctcgtcgccctacgcggggacgggtgcccccgcggcgtacgagggtggtccggcgtacttcccaccccggccgtcaccccgcaggaagtcggcggccgccctcgtggccctcgttgtggccgccgccctcgtggtcaccggtggcatctgggccgcgctctcgctgaccggcgggccgacgggcgacgggggcggcacgacgggccagcgggccaagaagtcaccaccggtgtcggggccgcagtccacgaagccggcgggaccggtgctgccgtacggcgaacaggtcggtctcacggagccgttgcaggccggtgactgcgtccgggcggtgtggtcgggggcggccttcaagtccgtgcccaacctcggcgtcgtggactgcgccgacgactggccggacggtcaagtggtcgcggtcgacacggccaccgactacgccgacgcccgcgaccggggtgcccggcgctgcgccggccagagccaggccaccgccgacgcgctgcccgacgcgggtgtctacgccgttgcgccgaccaaggagggcttcaccgcggccagcggcggtacggcatgtctcgtactcggccgccatgccgcgataggcggcgaggtgggccgtttccgcgacacgggcacggacttgtgggtcggtcagatgagcatcggcgactgctggatctacaaggaggagaaggacagttacaaggcgccgctcagcgactgcgcccagccgcacaccgaccaggtcatcggtgccgtgtccgcgccgaagaacatggactacaagaagggcgtcgacaacggcaacaagctctgcggcaacaagttcgagtcgagttgggcgccgggtcccgcgcgtcaggtgttcggctgggtcgccgacaaggaggactggaacgacggattcgacaaggtggtgtgcacggtgcgtcgttccgacggtgccgagacgagcgggaagatatccgcgcccggcgcggta

SEQ ID NO: 4604 - DNA, 339 bp, Streptomyces avermitilis
  CDS (1)..(339)
atgagccgtgacacggtgcgtccgccctgcgttcacccggggttcgcgcgtccgcttcccgcccgtgccagcctcccgttcctgggccgggtttctccgggggacagctcacggagagccggccgggacgggaggaagtggggcatggagagcggaccggcgatcttcgcggggacggtattcgccctgttcggcggcgggctgctgacctggaccgtgagccgggtccggcatcgcgcccctgtcgcccacgatgtgaaccccgtcgcatcggccaccctcgcgggtctcgccgcggtgtccgccctcgtcctcggcgcgtggtgcttcacgcacctc

SEQ ID NO: 4605 - DNA, 2826 bp, Streptomyces avermitilis
  CDS (1)..(2826)
ttgtccccgaccagcgacaccgcacacggcggccgccgactcgtcatcgtcgagtcgcctgccaaggcgaagacgatcaagggctacctcggccccggctatgtcgtcgaagcgagcgtcgggcacatccgcgacctccccaacggtgccgcggaggtgccggagaagtacaccggcgaggtgcgccgcctcggcgtggacgtcgagcacgacttccagcccatctatgtggtcaacgccgacaagaaggcccaggtcaagaagctcaaggacctgctgaaggattccgacgagctcttcctcgccaccgatgaggaccgcgagggcgaagccatcgcgtggcacctcctcgaggtcctgaagcccaaggtcccggtccaccggatggtcttccacgagatcaccaaggacgcgatccgcagcgccgtcgccaacccgcgcgagctcaaccagcgcatggtcgacgcccaggaaacccgccgcatcctcgaccgtctctacggctacgaggtctcgccggtcctgtggaagaaggtcatgccgcgcctgtcggcaggccgggtccagtccgtggcgacccgcctggtcgtcgagcgggagcgcgagcgcatcgccttccgctccgccgagtactgggacctgaccggcaccttcggcaccggccgcgccggcgacgccagtgacccctcgtccctggtcgcccgcctggccacggtcgacggcaagcgggtcgcccagggccgcgacttcgactcgctggggcagctgaagagcgccaacacgctccacctggacgagaccaacgcccgtgcgctggccaccgccctggagaacacgaacttcgcggtccgctcggtcgagtccaagccgtaccgccgctcgccgtacgccccgttccgtacgacgacgctccagcaggaggcctcccgcaagctcggcttcggggcgaaggcgaccatgcaggtggcgcagaagctgtacgagaacggcttcatcacctacatgcgtacggactccacgaccctctcggacacggcggtcgccgcggcccgtgcccaggtcacgcagctgtacggcgccgactacctgccggcgcagccgcgcacgtacgccgggaaggtcaagaacgcgcaggaggcgcacgaggcgatccgcccctcgggtgatcgtttccgcaccccggccgagacgggcctgaccggcgaccagttcaagctctacgagctgatctggaagcggaccgtcgcctcccagatgaaggacgcgaccggaaactcggtcacggtgaagatcgctggcacggcggccgacggccgtgacgtcgagttcagcgcgtccggcaagacgatcaccttccatggcttcctgaaggcatacgtcgagggcgcggacgacccgaacgccgagctcgacgaccgcgagcgccggctgccgcaggtcggcgaaggcgacccgctgtctgccgaggagatctcggtcgacgggcacgccaccaagcccccggcccgctacaccgaggcgtcgttggtcaaggagctggaagagcgcgagatcggccgcccgtcgacgtacgcgtcgatcatcggcacgatcctcgaccgcggttacgtcttcaagaagggcacggccctggtgccgtccttcctgtcgttcgccgtggtcaacctcctggagaagcacttcgggcggctcgtcgactacgacttcaccgccaggatggaggacgacctcgaccgcatcgcgcgcggcgaggcgcaggccgtgccgtggctgaagcggttctacttcggcgagggcgcgggcacgggcggtgccgcggacgccggcaacggcgacggggaccacctcggcggcctcaaggaactggtgaccgacctgggcgcgatcgacgcccgcgaggtgtcgtcgttccccgtgggcaacgacatcgtgctgcgggtcgggcgctacgggccctacatcgagcgcggcgagaaggactccgagaaccaccagcgcgcggatgtgcccgaggacctcgcgcccgacgagctgaccgtcgacctcgcggaggaactgctcgccaagccgagcggcgacttcgagctgggcaccgacccggcgacgggccaccagatcatcgccagggacggccgctacggcccgtacgtcaccgaggtgctccccgagggcaccccgaagaccggcaagaacgcggtcaagccgcgtaccgcctcgctgttcaagtcgatgtccctggacacggtgacgctggacgacgcgctcaagctgatgtccctgccgcgcgtcgtcggcaaggacgccgagggcgtggagatcaccgcgcagaacgggcgctacgggccgtacctgaagaagggcacggactcgcgttcgctgcagtccgaggaccagctcttcaccatcaccctccaagaggcgctggagatctactcccagcccaagcagcgtggccgtgcggccgccaagccgccgctgaaggagctgggcgaggacccggtcagcgggaagcccgtcgtcgtcaaggacggccgtttcgggccgtacgtcaccgacggcgagaccaacgcgacactgcggtccggcgacagcgtcgaggagatcactccggagcgcggctacgagctgctcgccgagaagcgggccaaggcccccgccaagaagacggcgaagaaggcaccggccaagaaggcgccggcgaagaaggcaccggccaagaagacggccgccaagacgaccgcggcgaagaagacggccgccaagaagacgacggccaagaagacggtcgccaagaagacgacggcttccaaggccgcggccgaggac

SEQ ID NO: 4606 - DNA, 3219 bp, Streptomyces avermitilis
  CDS (1)..(3219)
atgacgcgagccgagcagccaacggcccaccatcccgcccccgacgacgccctggtcgcagactcccgcgagcgtgccgtccgctccctgctgcgccggccgcagctgaagcggctatggagcgcgcaactcgtgggaggagtcggcgacgcactggcgttgctcaccctggtcgtcctcgcccttcaggcggcgatcgtcgagggctccttcggcggcgactaccggggagtcgccctggccgtgtccgccgtcttcggggcacgcgtgctggccaccctgctcttcggggccgtactgctcggcccgctcagttcgctgacctcgcaggagggcccgctcgaccgccgctggacgatgatcggcgcggacggggtgcgcgccgcgctcctgatcgtcgcccccctgtggatcgactggacgccggacgacgcgctcgccgtcctcctggtgaccgccttcgtgaccggagtcgccgagcgcttctggacggtgtgccgcgagagcgcggcgcccgcgctgctgcccgcgcccccgctcgagggcgccacggtgcgcccgctgccggaccacatggacgcgctgcgccgcctgtcgctgcgcacgggattcgtcgcggtgccgctcgcggccgccacgctcgtcgtcgtgtcgctgctcaacaatctgctgggcgccgggatcgactggttcgcccagcaccaggcggcgctcgcttcgtatgtcgccgccggcctgttcgcggcctcgctctcggtgatcaccttcgtcgagctgccggacgtacgcaccccgcgcgcgcggtcgccgctcgagggcctgcgccgccccaagacgggcaccggcatcgacaaggggcgcaccggagcgatcccgcatctggtcctggcctgcgcggccgtcgccgcggcgatcgcggccgccgtcgccgtctccgtgctgcaggccaaggacctgggcggcgggccggtgacctacgggctgctggtgctcgcgctgaccggcggtgtcgtcatcggtatccgcaccgcgccctcggtgctcccgtcgctgtcccggcgccggctgctcgccctggcgatcgccttcaccgggatcgcgctgctcgccgccggactcgtcccggacgtcaccaccgtgctgctgatcgtgggcctcgccggtgtcggcgcgggtgtcgccgcgaacaccgggcacaccctgctcgaccaggaggccgaggaataccggcgcgcgcggaccaccgaacacctccacgcggtcgtacgggtcttcgtggcggtcgccgccctggtcgcgcccgttgtggcggcggcgatcgggccgcatcggctggagaacggcaagttcgtgttcgcgcacggcggcgccgccttcacgctgatgctggtcggcgcgctgctgctgccggtcgccgcgctcgtgctggccaaggtcgacgaccgctccggggtgccgctgcggcacgatctgcgggacgcgctgcgcggcggtgacgacccggtgcagacctcggccgcttccggtttcttcatcgccctggagggcggcgacggggccgggaagtcgacgcaggccgaggccctcgccgagtggatcagggccaaggggcacgaggtcgtggtgacccgtgagccgggcgcgacgccggtgggcaagcggctgcggtcgatcctgctggatgtgtcctccgccgggctctcgcaccgggccgaggcgctgctgtacgcggccgaccgcgccgagcacgtggacacggtggtgcggccggcgctggagcggggcgcggtcgtgatctccgaccggtacatcgactcctcggtggcgtaccagggtgcgggccgcgatctctccccgaccgaggtcgcgcggatctcacgatgggcgacgaacggtctcgtaccgcatctgacggtgctgctcgacgtcgcgccggagaccgcgcgggagcgcttcacggaggcgccggaccggctggagtcggagcccgccgagttccacgcgcgcgtgcggtccgggttcctcacgctggccgccgccgacctcgggcgctatctgatcgtcgacgccgggcaggagcccgaggcggtcaccacggtcatccggcaccggctcgacacgctgctgcctctctccgaggccgaggtgcgggcccaggaggaggcccggcgcaaggcggaggaggaagcccggcgcaaggccgaggaggaggccgcgcgcaaggccgaggaggagcggctggagcgcgagcgcctggagcagctcgccaagctcagggccgaggaggaggagcgcaagcagcgcgagctggaggaagcgcagcggcgcgaggccgaacggcaggcggaggaggcccggcagcgggctgaggaagcgcgccggcgtgccgaggaggagcgggtgcggctcctcgcggaggagcaggcgcgggccgccgaggaggagcgcaggcgcgtcgcggaggaacggcggcgcaagcaggccgcggaggaggagcggctgcgggccgaggccgaggaacgccgactggagaagcagcgcaaggccgaggaggcgctgctgcgggcggaggaggcccggagggccgcggcggaggcggcggctgccgccacgacggccgcggcttccgcgtccaccggggtcgcgcctggtaggcccgatgcgccgaaggtcgccggtgccggggtttcgccgtccaggccgtccaggccgtccgagaacgagacgaccgttccgacgccggtggtgacgccgtcgaacgcgacgggtgggccggtggacgagaccgccgtgctgccgccggtgcggccgggtgcggcggactcggagacgacggccacgctgccgaagcctccggagcctcagggcgcggccgatgagaccacggtgctgccgccggtgccgtcgggcgccgccgatgagacggccgtgcttcctcccgtccgggacgcggggccgggcgggcgtgcgggtgacccgtcggaccgggtgccgccgggcttcttccgcgacgagcgtccggccgggcggcccgacgcgggcgacgaccgtacgcgcgagcttccgcaggtcgacagtgagggcgtggcgcggcggcggccccgctcggactgggcggaggagaccccgctggacgatctgcccacgctggcggacgagctgctgggcccgcgcgacgacgacacggacgacgagcgcgggccgggcggccgtcggggc

SEQ ID NO: 4607 - DNA, 1203 bp, Streptomyces avermitilis
  CDS (1)..(1203)
atgcccgtgtgggacgacctggtgggccaggagaagctgagcgagcagctcgccgcggctgcccgtgacgccgacgccctggtcaccgcggccaccgccggcactccgccgcccgaggcgtcgaagatgacgcacgcctggctgttcacgggcccgcccggcgcgggccgcaccacggccgcgcgtgccttcgccgcggcgctccagtgcgtgagccccgaccgcgcgctgggcggcatccccggctgcggcttctgcgacggctgccatacggccctgctcggcacccacgccgacgtcagcacggtcgccgccgtgggcacgcagatcctcgccgacgacatgcgggacaccgtgcgcaagtcgttcacgtctccggccaacggacgctggcaggtgatcctcgtggaggacgccgagcggctgaacgagaagtcggccaacgcggtcctgaaggcagtggaggagcccgccccccgcacggtctggctgctgtgcgccccctccgtggaggacgtcctgccgacgatccgctcccgctgccgccacctgaacctgctcacaccttccgtggacgccgtcgcggacatgctcgtacgccgggacggcatcgagccggaggccgcgtacgccgcggcccgcgccacgcagggccatgtcgaccgtgcccgccgcctggccaccgacccgcgcgcgcgggagcgcagggccgccgtgctgaaaatgccgttgcgggtcgaggacatcggcggctgcctcaaggcggcccaggagctggtcgacgccgccacggccgactccaagcagctcgccgaggaagtcgacgtgaaggagaccgaggagatgagggcggcgctcggcggggcacagggcggtcggatgccgcgcggcaccgcgggcgtgatgaaggacctggaagacaagcagaagcgccggagaacgcgtacgcagcgcgacagcctggacctggccctgaccgagctgacgggcttctatcgcgacgtcctcgccctccagctcggctcccgcctggccctcgccaacacggacgccgaggacgccctggagcgcctcgcccgcggcagctcaccggaggccacactccgccgcatcgacgcgatcgccgcgtgccgggacgccctggaccgcaatgtggcccctctgctggcggtggaggcgatgacgatggcactgcgggcgggg

SEQ ID NO: 4608 - DNA, 1599 bp, Streptomyces avermitilis
  CDS (1)..(1599)
atggacaccaggcgcacttccgggcagtcccgcctcctccggtcccggtccctacgttcgacgcggacggggggcgtgttcctcgccgccgccgcgctgctcctttccgcctgctcctccgggagttcgaccgggacgacggccgaggcggcgctggccgcgttgccccggtccacgccgtcgacgctggcgccgtactacgggcagaagctgacctggcgcagctgcggtgtccccggtttcgagtgcgccacgatgaaggcgcccctcgactacgccaagccggcctcgggcgacgtcagcctggccgtcgcccgcaagaaggccacgggaccgggcgagcgcctcggctcgctgctggtcaacccgggcggcccgggcggctcggcggtcggctacctccagcagtacgcgggcatcggctaccccgctgaggtgcgcgctcgttacgacatggtggccgtcgacccgcggggcgtggcccgcagcgagccggtggaatgcctcaccggccgccagatggacacgttcacgcagacggacatgaccccggacgaccagcgggagacgaaccaactggtcgacgcgtaccagcacttcgcggaggggtgcggccggcgctcgccggagctgctgcgccatgtgtccacggtcgaggcggcccgcgacatggacatcctgcgcgcggcgctgggcgaccagaagctgacgtacgtaggggcgtcgtacgggacgttcctcggggcgacgtacgcgggactgttcccggagcgcgtgggtcggatggtcctggacggtgcgatggacccctccctgtccgcccgcaagctgaacgaggaccagacggcgggcttcgaaacggcgttccagtccttcgcgaaggactgcgtacggcgcacggactgtccgctcggtggtgcgcacaccactcccgagcaggccggcgacaacctcaaggcgttcttccggcagctggacgcgcatcccatcgcgacgggcgacgcggacggccgcaagctgggcgagtccctggcgacgacgggcgtgatcgcggcgatgtacgacgagggggcctgggagcagcttcgcgaggcgctcacctcggcgatgaaggacaaggacggggcgggtctgctcgccctctcggacagctactacgagcgggacccggacggtaaatacaccaacctgatgttcgcgaacgcggcggtgaactgcctggacctgccggcggcgttctcgacgcccgaccaggtggagaaggcgctcccgtcgttcgggaaggcgtcgccggtcttcggcgacgggctggcctgggcctcgctgaactgcgcgtactggccggtgaagccgacgggggcaccgcatcgcatcgaggcgaagggggcggcgccgatcgtggtggtcggcacgacccgggacccggcgaccccctaccgctgggcgcagtcgctggcctcccagctgtcctccgcgaggctgctcacgtacgacggcgacggccacacggcgtacggccgcggcagcacgtgcatcgactccgcgatcgacgcgtacctgctccggggcaccccgccgacagagggaaagcgctgctca

SEQ ID NO: 4609 - DNA, 378 bp, Streptomyces avermitilis
  CDS (1)..(378)
gtgtcctgcgttcacgcaccgtggacggcgtcgagcaggaactctatgcacttgctggtgctctaccaggccagccagcaggccatcgccgaagccgccaccaccgctcacctcgacccggaccggctgtcgttgaccacagccctgcacaccgtccgtctgactgtaatcaccgccagaaccccggacccggccgacctcgtctcagccctggtccacgtccgcaacctcgcacccgtcaggcgccgttcacgcaccagcccacgctgcgtcaaacgaaccctgtcgccctacgcctacaacaagaccaagggcagcgtcgggcacaaaacaaccgtgaccaccgacgtcaccctgctgaccagcaccgccagcccc

SEQ ID NO: 4610 - DNA, 1020 bp, Streptomyces avermitilis
  CDS (1)..(1020)
gtgcgtgaacgcaggacacggtctgctccgcgcagggtcaccttcctgcaccggttcgagccgtgcccgccgacgtgcacgacgcaccggaactacacgcgagggtgcccgcagccctgcacaaaggactgcacgcggcacgcgagcgcgtgcccggaacgcaagggcggaggcctcgccttcacccgccccaagaccaagaagagccggaacgaggtgccgatcccgccgccgttcatcccctacctgcttgagcacaaggctcaacagggcggagcaaggggcgctgcgggtgagttgcggcaagagaacgacgcggtattcacacgcccggacggccgaccactcgacccccgcgccgactgggaggaattcaaggaactgctcgaagaggcgggcatcagcgatcggcgcctgtacgacgggagtcgccacactgcgggcacgatcctgaacgagttgggggtggacatgcctacgatcatggagatcctccggcacacgcagatcagccagacacgccgctacgtgaagggtcggtccaccctctcgaaggacgccatgcgtcgcatcggcgacgtcttcctgcccgagccggaacccactactgagaccagaactgagaccctagacagcaaggcagcccgcgcccgacgtcggcgccgcgtccgccaaaagcaaaagccccagatcacggcgagtgagttctggggcttccacagagccgccttcgggattcgaacccgagacctacgcattacgagtgcgttgctctggccatctgagctaaggcggcgcgctgtccgcactatggtgcgatcagcaacgtcggtaagtctacacagtttcgtggggtgctccgcacaccccccggaggcggcccctccgggggctgcggcagggcctatgagcagcgctttccctctgtcggcggggtgccccggagcaggtacgcgtcgatcgcggagtcgatgcacgtgctgccgcggccgtacgccgtgtggccgtcgccgtcgtacg

SEQ ID NO: 4611 - DNA, 222 bp, Streptomyces avermitilis
  CDS (1)..(222)
atgcgcattcgacgaatcctcgccgcagtcttcgccacggcagccctcgccggactcggcctcacaggcgccgccaccgccaccgccagcgtcaccccggccagcgtcaccccggccagcgtcaccccgggtgagtgcacggacggcggcggaacgatcgatcggtcgacgcccgtgctcccgacctgcagaggcggtatgtacaacgggcagacggtcgac

SEQ ID NO: 4612 - DNA, 714 bp, Streptomyces avermitilis
  CDS (1)..(714)
atgaatcagcaactcctggccaaaaccttcgtcgagttggcggacaacctggtcgccgacttcgacctgatcgacttccttcgcctgctgaccgaccgctgtgtcggcatgctcgacgcgagtgcggccggcgtgctgctcgcggaccggaacggcgaactccgcgtcatggccgcctccgacgaacaggtacgcctcctggaactcttccagctccagaacgacgaaggtccctgtctcgactgcttccgcaccggcgcgcccgtgacagtccccgacctgagcgccgtcaccgcacgctggccgcgcttcgccgtacaggcccgccgcagcgggttcggggcggtccaggccctgccgatgcgcctgcgggacgaggtcgtcggcgccctgaacctcttccgcgccaccccgggccccttcgacccggccgccacacccctcgcccaggccctggccgacgtcgccaccatcagcctgctgcaacagcgcaccgcacaccgcagcaccgtcctcaacgagcagcttcagacggcgctgaacagccgcgtgctgatcgaacaggccaagggaaagctggccgaacgccagggcgtagacatggaacgggccttcaccgcactgcgcacctacgcccgcgcccacaaccgccggttgtccgacgtggcccgcgccttcatcgacaactccgagcccctcaccggcctgggttcc

SEQ ID NO: 4613 - DNA, 873 bp, Streptomyces avermitilis
  CDS (1)..(873)
atgcccgacagccgttcagcccatatccggctgctggtcgccgagcaggcggccgtacgtggtgcgcgggtcggcgtggtggacgtgtgcaccgcggcggtggtcgcgctgccgatcggcggggccggactgtccgcgatgtccaggggcagggcgagccacccgttgtgcagcaccgaccacatcagcgaacaactggaggagctacagctcacgctgggcgaagggccctgcgtggatgcgttcacgcagggctcggccgtcctgacacctgatctgcggaccggggaactccagaaccgctggcccttgttcgtcgacgccgccctgagcgccggagcactcgccgtcttcgcgctcccccttcaggtgggggcgatcagccccggagttctggacctgtacgcccaggtcccagtgcggttggacgcggaagagctggccgacgcgctggcgttcgccgatctcgcgaccctggtgctgctcgacgcgcggatcgacgagacgggcgggccacccggcggacccatcgaggacctcggtgcctaccgggcggagatcgaccaggccaccggcatgctcaccgtccagctcggcgtcggcatcgaagaggccttcgtccgcctccgcgcccacgcctacgcccacgaacgccgcctcgccgaggtggccgccgacctggtcgcccgtcgcctccgcttctcccccggcaccgagccggtccaggaccccgccgatccccatggcgacgacgaaccgttcgacgaccccgatccccgcgcccccgacccccatggcgacgccgatccgcatgatgccgatccgcatgacgacgacgatccccgcgacgacgacgatccccgtgacagtgct

SEQ ID NO: 4614 - DNA, 732 bp, Streptomyces avermitilis
  CDS (1)..(732)
gtgacggcccggcggaggcgtacccaggagcccggtgacagcgagccgtccggcgggggcgcggtgcgcttgcgccgggtgaaccgccggctggtggaggggctgcgcgaggagctggcggatctgtatatgcagtgctgcgcaacggcggccaccgcggaatcgcccggagagagaacacccggagagagaacaccgggagagaaatcgcccggagagaaatcacccaggggcgcataccgccggcccgatcgctcacgcttcctgacccgtctcaccgcggacatgcgccggcccgggttcgccatggtgctcgcggaggtgaacggactggtgggatgcgcctacggatttccggtacgcggcgacggctcatggtggctcgattccgacgacgcgctgccgctcggcatggaacaactcacccggtccggccgcgctttcgcgttcaccgacattctggtccggccgccgccgcaaggccgggagctggcccgtcgattacagaaacggctgctgaccgaccaccgggcgtcgctcggcgtgacatcggtggatcaagcggatgtcacgaccctcgccgtcctccgctcgtggggatggctggacgccggagacgtctggaggccggccggccccacggtgttccgcgtactgatcctccccttcggggaacagacgctcgcacggccggacggactcgcccgccatgcctggacgaggtggcccgac

SEQ ID NO: 4615 - DNA, 282 bp, Streptomyces avermitilis
  CDS (1)..(282)
gtggccgaggtcgccgaactgcgcgccagaaacacgcagttgggccgggcgctggcgagtcggccggtcatcgaccaggcgcggggcatggtgatggccctggcgccgtgttccagtgagcgggcctgggacctgctggtggacgtttcgcaacgctgcaacctcaagctccggtacgtggctgccgccctggtcgccacgacgaagggcgaggtgctcccggaccaggtccagcgggagctcggccgggcactgcggcgccttcatacagcagaccggaga

SEQ ID NO: 4616 - DNA, 336 bp, Streptomyces avermitilis
  CDS (1)..(336)
gtgttcgtcctgcttctcatcctcgtcgtgatcttgttcggtttcctcaatcccatctggtgggtcgtcgcggccgtgttggtcttcggcttcggccggtccggccgaggaagcaaccggagtcctggcggcaattccggttcaggggagtaccgggagtacggggaataccgggagtaccgggaccacagggagcgtcaggaccgctgggaccgtcgctacagccgccggcaccgggcacgctggaaccgcgaggatcgacgggacagtgaggaccggcgggcgcgtgagaaccagcgggcgcgtgagaaccggcgggcgcgcgaagaccgtagg

SEQ ID NO: 4617 - DNA, 342 bp, Streptomyces avermitilis
  CDS (1)..(342)
atgtacgaccagacacgcgctcagcagcccgcggacagcgtcaccggctccgccggacgccgtaccccgggtccggagccgctgctcccgtccgatgaacgggccaagctcgccctgcgcctccagcaggccctcaacaacttcgccgacagcccgcggcagtcgttggaagaggccgagggcgcattcgacgaagccgtcgcccacctcacgaacaccctcgcggaacggcggcgtgccctccatgagggctggcaggaccacgaccccgaaacacagtcggacgcactccggctcgcactgagggagtaccgggagatcacgcaacggctgctgcgcgtg

SEQ ID NO: 4618 - DNA, 933 bp, Streptomyces avermitilis
  CDS (1)..(933)
atgattgtcggccgggatggggtgggtgtggtggagcacgcggagcaaggcccgcggatcgccgtcgccgtggtgaccatggggaatcggcccgccgaggtcgacgcgctgctcgcgtccgtggccaagcaggacctcccgcccgcgcggatcgtcatcgtgggcaacggatgcccgctgcccgaattcgcccggcgcctggacctgcccggcgaggtcaccgggatcgaggtggacgagaacctcggctgcccgggcgggcggaacgtggccctggcgaagctgcgggagttcggggacgtcgacgtggtcgtcgaactcgacgacgacgggctgctcgtcgacgccgacgtactgcggcgcgtacgggatctgtacgccgcagacccgcggctcggcatcgtcggattccgtatcgccgacgagaacggcgagacgcagcggcgccacgtgcccagggtcgggaagtccgaccccctgcgcggtgggcccgtgacgggattcctcggcggtggacacgccctgtccatggcgatgctcgcccggaccggcgactggcccgccgagttcttcttcgcgcacgaggagaccgacctcgcctggcgggccaccgacgccggatggaccatcctctacgcgcccgaactgctccttcagcaccccaagacctcacccgcccggcacgccatctaccaccgcgtgaccgcccgcaaccgggtctggctcgcccgccgccggctgccgctgccgctcatccccgtacacctgggcatctggatcgccgtcacgctcgtacgaacccggtcggccggcggactgcgcgcctggttcggcggtttcatggaaggcgtgcggacgtccggtggggagcggcggcccatgcggtggcgcacggtgtggcggctcacgcggctgggacgaccgcccgtcatc

SEQ ID NO: 4619 - DNA, 3411 bp, Streptomyces avermitilis
  CDS (1)..(3411)
gtgagtctctcggcgagaagtcgccgaaactcggcgcaaaaccgaggtgaggcggggcagttcgctgccgcgcgggaaggcagcgggcggcatatgcggtacgggctgcggtacgaactgcggttcggtctcctgggcccgccggtgctgtacgacgccgacggcgaggtccggccgatcggcagcggcaagatgcgtgccctgctggccgcgctgctgctggagcccggacgggtcgtctcggtcgacgcgctcaaggacgccctgtggggcggtgcgccgccggcgtccgcgcaggcgtccctgcagaaccatgtgacccgcctgcgccgcctcctcggcgacgaccccgagcggctgcgtgcggtaccgcccggctatctgctgcgcgtcggcgagggtgagctggacgtccgcgtcttcgaggaccatgtcgccgccgcgcgcgccgcgcacgccggtggtgactgggagcggacggcgcgtgagtgtgcggcggcgctcgcgctgtggcgcggcaccccgctgagcggcctgccgccggagacgggcgggcacgcgctggtgcaacgtctggaggaggcgcggctgctcgcccgggagtggggcttcgacgccgagctgcacctcggcggggcacgcctggccgccctcgtaccggagttggccgcactcgtcgccgaatacccgctgcgggaggccttccaccggctgctgatgctcgtcctgcacggcaccggccggcaggccgaggcgctggccgtccaccgggacctgcgggcacggctcatcgaggaactcggggtcgagccgggctccgcggtgcgcgaggcgcatctgaagatccttcgggagggtgcctgcggcgccggggagacccaggggtgctcgggcgggggcgcggccctgggcgggcctgccgtggtcccggacccgggcgaggcgggcaaggacgcgggcgcctacgaggcgggggagggctcgggtgagggctcggacgaggcggggaagggtgcgggggaggactccgacgggggtaccgcccgggcggccgtcccagccgtcccagccgtcccagccgtggcgaccccgccccggcccgcccaacttccccccgcgcccgcccacttcaccggccgtggcgacgtacgcgcggaactgctgcgggctctcgacccagagcgcggctcgtgcgccgtcgccgtgctcagcggcatggccggggtcggcaagagcgcgctcgcgctgcacgcggcgcatggtctgcggaaacgtttcactgatgggcagttgtacgtcaacctgcacggcgccacgcccggcatggccccgctcgcgccggggcaggcactcgcctcgctcctgcgggacctcggcgtcgaggcccggcgcatccccgaacatccggacgcggcggccgcgctgctgcgctcgctgctcgcaccgacccgcaccctgatggtgctggacgacgccgcgaacgccgcacagatacggcaactgctgcccggcggcccggagtgcgcggtgatcgtgaccagccgttcgccgctcaccgcgctcgacggcgcccgccgcttcccgctcgcgccgctgtcggaggaggagagcgcacagctgctgcgtgcggtctccgggcggggggacgggctcgacggcgcgcaccgtctcgtcgaactcgcgggccggctgccgctcgccctgcgtatcgtcgccgcgcggctcgcggcccggcgggccctcacccccgacgacctcgccggtcaactcgccgccaccgacgggcgcttgcatcacctcgagtacgacgacctgagcgtgcgcagatcactggccgtcgcgcacgacgcgctgagcgcctccgaccgggaggccgaccgggacgcggcgctcgcgctgtgccgcatcggcgcgctcgacctccccgagtacggggcgcccctcctcgcccgcctcaccggcacggacgaacgccgcgcggaagccgccctcgaccgcctcgtcgacgtcgcgctcctggaggagacggcgttcgggcgctacgccccccacgacctcgtgcgggacttcgcacgggagatcgcggggacggccgggacagctgtgacggccgggacggcggcatccgtcacggattcatacgcccggggtaccggccccgccgctccgggcgctccgggctctgcggtttccgcggattccgcggattccgcggcctctgcgggttccacaggctccacggatgccggtcccggtgagggcgacgccgtccctgacctggccctgcgctggtacgccgccacggctgcccgctcctatcaggcgatcgtcgagccgagcgccgtccggtcggaccggctgcggacgacgccgtcggagccggacgcgcacgcggcggacgtggcggccgcggccgacttcggctctgccgacgaggcccacgcctggatcggcctggaactggcgaacgcggtcgcgctggtcgagcggtacgcgcaggcgtccgcctatgtcccccttctcgcgcgctatctcgccgtgtccctccaacgcggtggccggctgggcgagttggaggtgctcggcgaggccgccctgggcgcggcgcgccggctcggggacgagcccgccgaggcgttcgccctgctggacctggcggggctgcactttctgaaggggcgggcgaacgactcgctcgccctgctcgaccgcgccctggagatctggcgccggctcgacttcctctcgtgcctgtgccgggggctcggcaaccgcgggctgctgctcgaagggctcggccgctacgaggagtccggcgagaccctgcggcagtgcctggagtacgcgcgtgtactgaacgacccgcacagcgaggccatcacgtacagcaatctcggcaacctctacgagcacacggacccgcgcgccgccatcgagcagcaccggcgcagcctggagatcggcgaggccatcggggatgtggtcgtccgccactccgcgcactgcaacatcggctacgcccacctcaccctcggcgaaccggacgccgccgtaccgcacttcgaggagagcctgcgcatcctcggcggccatgacaaccggcactggcagggggagcggcagacccggctcggtctggtgcgcgcgctgcgggggcagggggacgtggcgcgggccgcgcgcgagtgcgacaagctgctgaccctcgcgggccgccgcagcgaccgctactccgaggggctcgcccgccaccagcgggggctgctgcggctcgcggcgggcgacacggacgaggcgctccgtcagtggaagtcggcactggacgccctggacgggacggacacgccggtggtggcggagctgcgggaactcctcatttggcgtcggcatagcactccaccaccgccgtcg

SEQ ID NO: 4620 - DNA, 1692 bp, Streptomyces avermitilis
  CDS (1)..(1692)
atgaccgggcgctgggctctcgcaccggccgaggacggtggcgcggaggtcgtcgccctcggcgacggcgggctgccctccgggcccgtgcgcagggaaccggatctcgtcgaggccgtgcggtcgcggcccgaggcgacccggtgggtctggcggtccacggccgacatggcaccgcgcctgctcgccgcgggggtgcgagtcgagcggtgctacgacatcgaggccgccgagaccctgctcctcggccacgagggccggctcggcgagccccggtcggccgccgccgcgctggccagactgcgcggcggccccgtaccgcccgatccgccgcagcgcgccgccgtgcccggatcgcagtcctccctcttcgaaccgcgcccggtccacctacccgtggacgacctcatcgaggtgtacgcggaccagcagcgccggcacgacgcgaccgcgcacccggaccgcatgcgccttctgaccgccaccgagtcggcgggcatgctcgtggccgccgagatgaacgccgcggggctgccctggcgcgcggacgtgcaccgcgacctgctgaacgaactgctcggcgagcggtacgcgggcgggggcgagccccggcggctggccgagctcaccgacgaggtgtcggccgccttcggccgccgcgtccggcccgatctccccaccgacgtcgtcaaggcgttcgcccaggccgggatcaaggtcaggtccacgcgccggtgggagatcgagtccgtcgaccacccggccgtgaagccactcctcgagtacaagaagctgtaccggatctgggtcgcccacggctggtcgtggctccaggactgggtgcgcgacggccgcttcaggcccgagtacctgccgggcggcacggtcaccggacggtgggtgaccaacgggggcggcgcgctgcagatccccaaggtcatccggcgcgccgtggtcgccgacccgggctggcggctggtcgtggccgacgccgaccagatggagccccgcgtgctggccgcgatctcccgggaccccggcctgatggaggtcgctggccgcgagagcgacctgtaccagtcggtgtcggaccgcgcgttctccggcgaccgcgcccaggcgaaactggcggtgctcggcgcgatctacggacagacgtccggggacggcctcaagaacctcgccgcgctgcgccgccgcttccccaaggccgtcgcgtacgtcgacgacgcggcccgcgcgggcgaggagggccgcctcgtacggacctggctggggcgtacgagcccaccggcggccggagcgtccgaggacagcgcggaggaggcgggcatcccgcaggacgaaccggcgccgtcctcgggcgccgcgcaggagtggatgccgggctacgcctccacgaactcgcgggcccgcggccgcttcgcacgcaacttcgtggtgcagggcagcgcggcggactgggccctgctgctgctcgccgcgctccggcgcgcctgcgccggcctggcggccgagctggtcttcttccagcacgacgaggtgatcgtgcactgcccggccgaggaggcggacacggtggtcgcggcgatccgggaggcggcggacctggcgggccggctgacgttcggcgagacgccggtgcggttctcgttcacgacggcggtggtggagtgctatgccgacgccaaa

SEQ ID NO: 4621 - DNA, 687 bp, Streptomyces avermitilis
  CDS (1)..(687)
gtgatcgccgcggaccacctgggcgacgtggccgaccatctgatcgggcacttcgtggaccaggcccgccgttcgggcgcgtcctggacggacatcggcaagagcatgggcgtgacccggcaggcggcgcagaagcggttcgtgcccaaggcggaggtggacctcgaccccagccagggcttcagccgctacaccgaacgcgcccgcaacgtggtcttggccgcgcacaacgaggccaaggccgcgggcaacgccgagagcctgcccgagcacctggtcctgggcctgctggcggagccggaggcgctcgcggcgaaggcggtcaccgcgcagggggccccgccggactccgtacgccgggcggcgaccgcggcgctgccgccgtcggcggacacggtccccgagctgatcccgtacggcccggccgcgaagaaggccctcgaactcaccttccgcgaggccctgcgcctcggccacaactacatcggcaccgagcgcatcctcctggccttgctggagctggagaacggcaagggcgtcctgaccggcctgggtcgacaaggcggcggaggcccatgtgtcgaaggcactggaggaactggcgaaggcgcacgagcgcggggagtgagcgggcgactcgggcaaggcaagagggatgagcgggcagctcgggcaaggcaagaggga

SEQ ID NO: 4622 - DNA, 1125 bp, Streptomyces avermitilis
  CDS (1)..(1125)
gtgagtacgacgaccaccgtggaccgtgccttcgaggccgccctgtacgccgacaccgacgccaccctcgacgccggcgcctcgctgctcgccgccgaccccgcggccgacgccgaactggctcggcgcggcgaggagttcgtcgccacggcgtggcggcgcggctggcagcccgccgacctcgtacgcgtcgtgcgccgcgagctggacgacgtacacatacgtctggtgtcggcgctgatcctcgcccaggcgccacggcacccgaacccgggaccccgctgggccgcgcagctcggcgaactcgacggcgccgaggccccgcgcaccgaccgcttctcgtacgcgaccgccgtactggagctgtaccggctcctcctgcgcctccccgccatcgagccggtcgagccgctggagcccccggccggacgggccgcgccccgggactcggactcccgcatgctcgccaggatccgcgccctgctcgcgaaggcggaggcgaccgggttccctcaggaggctgaggcgctcagcgccaaggcgcaggagctgatgacgcggcacagcatcgacgaggcgctgctcgcgtcccgcgcgcccggcaagggcgcgcccggcgcctgccggatcggggtggacccgccctacgagacggccaaggcggtgctcctggacgcggtggccggcgcgaaccgctgccgggccgtgtggaacgactccctcggcttctccaccgtcgtcggcttcgaacccgacctcgaggcggtcgaactcctctacacctcgctgctcgtccaggccacggccgcgatgacgaaggcggaggcggcccagcgggcgggcggccggaagcgtacgaagacgttccggcagtcgttcctggccgcgtacgcgcaccggatcggcgaccgccttgcggacgtggcccaggggcaggccacgcaggccgagggggagctgctgccggtgctcgcggcccgcgacgtggcggtcgccgaccacctggagcagatgttccccgagaccgtgaccacccggctgcgcggggtcagcgacgcggccggatgggagcagggggcggccgccgccgaccgggcccaggtcaggggccggcggccgatcccc

SEQ ID NO: 4623 - DNA, 516 bp, Streptomyces avermitilis
  CDS (1)..(516)
atgcgcgccatccccatcgccgtcaccgccctcgcggcggccctcgccctgaccgcctgcgacagcggcggcagcggcagcggcagcagcgaccagagcagcaaggccgcctcctgccggttcggcatcgaggtcgagcccggcaacgccgccaccacggccggcgacaccggcaacgtccctgtcacggtgaccaacctcgactcggccccctgcacgctcaagggcttccccggcatcgagctgaacagcggcgacgcctcctggaccgccgggaggcagccgggcgcgaaggcggcgaaggtcacgctccagccggacaccgcggcgaccttcacgatcacctacgtccgcgggaagtccggcgccaaggacagcgccgccgtgaagaccgtgaagatcacgatccccggcggcggcgacgcgaagagtttcccgtggtcgtacggcgctgtcgcgctgaagaccggggacgacccgaacgcctccgtcagccccttccaggtcgcgggcgac

SEQ ID NO: 4624 - DNA, 507 bp, Streptomyces avermitilis
  CDS (1)..(507)
gtgacttcggcgtcctacgtcccgcaccgtccggcgcgtatcgcggtcgcgtccgcgggtctggcggccgcgctcgcgctgaccgggtgcagcagcggatccggcgacagcgactcctcgaccccgagcgcgtccgcgtcctcgtccgctacggacagcggcggctccggcaaagcctcaccgagcgccgcggccgggaagctcgagggcagctggctggccacctccgacggcaaggccgtggcgttggtgatcaccggcaagcaggccgggctcttctcgaccggcggcacggtgtgcagcgggaccgccggcgaggaggcgggcatgcagatgatccacctgaagtgcagcgacgggaacacggaccgcaagaccggcatggtcgactccgtcgacgccaagtccatgaaggtgacgtggacgggcaagctcggcgcggagacgtacatgaagtccaagggcggggccctgccgagcgggctgcccacggcgagcctgagctcc

SEQ ID NO: 4625 - DNA, 303 bp, Streptomyces avermitilis
  CDS (1)..(303)
atggcgaagaagagcaaaatcgcgaagaacgacaggcgccaggagaccgtcgcgcggtacgccacacggcgggccgaactgacggagatcatccgccggccgtcgacaccggaggccgagcggcgcgccgcccagcaggagttgcgcaggcagccgcgcgacgccagcgccacgcgcgtacgcaaccgggacagcgtggacggccggccacgcggctatcaccgggccttcggcctgtcccgggtgaacctgcgtgagcaagcgcacgcgggatttctcccgggcgttcgtaagtcctcctgg

SEQ ID NO: 4626 - DNA, 219 bp, Streptomyces avermitilis
  CDS (1)..(219)
atgctgaccggcgcccggccgggcttcggcaaccggatctcccactcccaccggcgcacctcgcgccgcttcgaccccaacatccagagcaagcgctactggctggcgagcgagggccgccatgtgcggctgcgactgagcgcgaagggcatcaagaccgtcgacaccctcggcgtcgaagcggccgtcgcccggatccgggcccgcggggtgaaggtc

SEQ ID NO: 4627 - DNA, 162 bp, Streptomyces avermitilis
  CDS (1)..(162)
atggcacgcaacgaactccgtcccgtcatcaaactcaggtccacggccggaaccggtttcacctacgtcacccgcaagaaccgccgcaacgacccggaccgcatgaccctgcgcaagtacgacccgatcgcccgccggcacgtcgacttccgagaggagcgc

SEQ ID NO: 4628 - DNA, 246 bp, Streptomyces avermitilis
  CDS (1)..(246)
atgcgcgaaggaatccacccggcgtacgcgcccgtcgtcttccgggaccgcgccgcgaaccacgccttcctcacccgctcgaccatgacgagcgagaagacggtcgagtggacggacggccacacgtaccccgtggtcgacgtcgagatctcgaacgtcagccaccccttctacacgggcaccgcacgcgtgctggacacggccgggcgcgtggagcgcttcgagcgccggtacggaaaggggagc

SEQ ID NO: 4629 - DNA, 1341 bp, Streptomyces avermitilis
  CDS (1)..(1341)
atgagtcacctctcagtggtgatcgtcggcgggctgcacgccgacgcgcggcgggccgccgtcgcacggttgctcgccgacgtaccgggcagcgtcgcgctccaccacgacctcgcgaccgccgcggcgggcacggtcgtacgcaccgtccgcgacgccaccggcctgctgtcggccggtgaggcccccctcgtcgacgactgcgcgtgctgcgccctgcgcgaggacctggtgccggaactggagcgcctcgcggacgcgggccgcaccaggctggccgtcgtcgagctgtgggactcggtcgagccgaaggcgatggccgaggtggtggcggggagcgggctgcggctcaccggggtgatcaccgcggtcgaccccgcgctgctgctgccctgcctcggcaacggggacgatctcgcggacgccggactcgccgccgccgccacggaccggcggacggtcgccgacacgttcgcccggcaactggagtacgcgcccgtcctggccgtcgccgagtccgagcacgccgacgacgaggaccgggccctgctcgcgcagctgcacccgaccgcccgccaagtccccatcgcgggcgaccggccagagggctcggcgggctcgggccaccagggcggggagcccgccgacgggcacacggtcaacgggcatacggacgacgggcacacggtcaacgggcatacggacgacgggcatacggacgacgggcatacgggcgtcgggcgcacggagggtatgcgtacggagagcgtgcgcgcctcgggacggacacccgcgggcgcgcccctctcggcgctcgcgcacgccgccctcgccgggttcgacgtggaggcggccgccgccgcccagcacccggcgtgcgcgaggctgcccgccgaggccgatgcccacggcgtcgccaccctcgtatggcaccgcaggcgccccttccaccccgagcggctgtacacggccttggaggatctgacctgcgcggcggcccggagccgaggacggttctggctcgccgaccggcccgacacactgctgcactgggacgccgccgggggtgcgctgtgcgtggagaacgcggggccctggctggcctcgctgccggacgcggcctgggacctggtcccaccggtgcgccgggccgccgccgcgctggactggcacccggagcacggggactgctgccagcacctggtcttcacctcgccgggcctggaccgcgacggcctcgaactccttctggagtcctgcctgttgaccgacaccgagtacgccgcgggccgcgccgcctggcaacagctgccgcccgccttcgacaccctcctggaggcc

SEQ ID NO: 4630 - DNA, 234 bp, Streptomyces avermitilis
  CDS (1)..(234)
atgccccgcaagcccgtccgcaaggtcgcgtccacgccgcggccgaaccccctggaccagaacggcatcacctacatcgactacaaggacaccgatctgctgcggaagttcctctccgaccgaggcaagatccgcagccgccgggtcacccgcgtgacggcccagcagcagcggctgctggcgagggccgtcaagaacgcgcgggagatggcgctgctgccgtactccagccgc

SEQ ID NO: 4631 - DNA, 219 bp, Streptomyces avermitilis
  CDS (1)..(219)
atggctgcgacgaggctgcacggggcggcctggcagaagagcaggcacagcaactcgcaggggtcctgcgtggagttcgcccggctgcccgggggtgaggtggcggtgcggaattcgcggttccccgacgggccggcgctcgtctacacccgtgccgagatagaggccatgctcctcggcatcaaggacggcgagttcgatcacctgatcgtcggcggc

SEQ ID NO: 4632 - DNA, 522 bp, Streptomyces avermitilis
  CDS (1)..(522)
atgctcgaacccttacggcaggggcttccgccactcgatcccgcggccgtgtccaacgccgcttcgtgtgccctgcccgcccgctatgaagcggtgcgcgaggcgcggcagttcacccgcagaacgctcgaccagtgggacgccggcgaccgcttcgacgacatatgtctcgtggtctccgaactcgtcaccaacgctctgcggcacgcgctgccctcggacaccccgcgcacgaacgagcaggacccgcccgtgcggctccacttgatgcgctggacctcgcgactggtgtgcgccgtgcgcgaccccagccacgacagtcccgtcgcacgggagtcggaggacttctcggcggagtcgggccgcggcctgttcctggtcgactcgttcgcggacagctggggctggcacccgtcaccgagcccgcaccacgagtcggggcgcggacacgcggtcaccgccgcgttcaacggcaaggtggtctgggcgctgttccggctgacccacaatccggcttccgag

SEQ ID NO: 4633 - DNA, 822 bp, Streptomyces avermitilis
  CDS (1)..(822)
atgctgctgggatcgcacctcaggcgtctgcgggagtcgcgcggcatcacccgggaagcggccggctactcgatccgcgcctccgaatcgaagatcagccgcatggagttgggacgggtgagcttcaagacgcgcgatgtcgaggacctgctgaccttgtacggcatcaccgacgactccgaacgcacctccctcctctcgctcgcgaaggaagccaacgtcgcgggctggtggcacagttactcggacgtcctgccgagctggttcccgacgtacgtcggcctggaaggcgcggcgcacctcatccggtcgtacgaagtccagttcgtgcacggcctgttgcagaccgaggcgtacgcgcacgcggtcgtcgcgcgcggcatgcagggcgcgtccgccgccgacatcgaccggcgggtggcgctgcgtctggagcggcagaagtaccttgccgcgaagtccgcccccgagttccacgtcgtcctcgacgaggccgcgctgcgccgcccgtacggcgaccgcacggtgatgaggggccagctccagcacctgatcgacatctcggagcgccccaacgtacggcttcaggtcacgccgttcagcttcggcgggcactcgggcgagagcggctccttcacgatcctcagcttccccgagtccgatctgtccgacgtggtgtacctggagcagctgaccagcgcgctgtatctggacaagcgcgaggacgtcacccagtacgagggcgcgctgaagcagttgcagcaggacagccccgggccggccgagagccgcgatctcctcaggggactgctccagctttcc

SEQ ID NO: 4634 - DNA, 1458 bp, Streptomyces avermitilis
  CDS (1)..(1458)
atgtcgtcctacttcaccgatctggctcagcagtacatcggtggtgagtggcgcccgggcacagggtcctgggacatcatcgacttcaacccgtacgacggtgagaagctcgcgtcgatcaccatagccacggtcgacgaggtggacgaggcctaccgggcggccgccgcggcccagaaggaatgggcggcgaccaacgcgtatgcccgccgtgccgtgttccagcgggccctgcgcctcatcgaggaccgcgaggccgagataaccgaggccatcatcgccgagctcggcggcacgcatctgaaggccggcttcgagctgcacctcgccaagcagttcctcctggagtcgatcaacctggcgctgcgccccgagggacggatcatcccctcgccggtcgacggcaaggagaaccgcctctaccgcgtgcccgtcggcgtcgtcggcgtgatcagcccgttcaacttccccttcctcctgtcgctgaagtccgtcgccccggccctggccctcggcaacggcgtggtcctcaagccgcaccagaacacaccgatcgtcggcggctcgctgatcgcgaagatcttcgaggacgcgggtctgccgggcggcctcctgaacgtcgtgatcaccgacatcgcggagatcggcgacgcctttctcgagcacccggtcccgaaggtcatctccttcaccggctccgacaaggttggccgccacgtggccaccgtctgcgccgcccagttcaagcgctcggtgctcgaactcggcggcaacagcgccctggtggtcctggaggacgcggacatcgactacgccgtggacgccgcggtcttcagccggtacgtgcaccaggggcaggtctgcatggccgcgaaccgcgttctcgtggaccgctcgatcgaggcggagttcaccgagaagttcgtcgccaaggtgaagacgctgaagtccggtgacccgcgcgacccgcagacgatcatcggcccggtcatcaactcctcgcaggcggacgcgatctcgggcgccgtcgaccaggcgatcgcggacggcgccatcgcgctggtgcacggcaccaccacggacaacctcgtggagccgtccgtcctgaccggcctggccgccgacgcgcccatcctccaggaggagatcttcggcccggtcgcgctcctcatccccttcgagggcgaggaggaggcggtccgtatcgtcaacgacaccccgtacggcctgagcggcgccgtccacacggccgacgtcgagcgcggtgtcgccttcgccaagcagatcgacaccggcatgttccacgtcaacgacggcaccgtccacgacgagccgctggtcgccttcggcggcgagaagtcctcgggcatcggccggctgaacggcgaggcgacggtcgagtcgttcaccacgcagaagtggatctcggtgcagcacgggcggagcttcttcccgttc

SEQ ID NO: 4635 - DNA, 537 bp, Streptomyces avermitilis
  CDS (1)..(537)
atggtcacccacgtatccgcggaagcacccggcgacgagcgcggggcgctgctctccttcctcgagggcgagcgcggaggtatccggcgggcgctgctcggcctgaccgacgagcaggccgcgaccaggccgagcgccagcgaactgtccctgtccgggctggtcaagcatgtcgccgaggtcgagcagagctggatcgcccgcgcccggcaggaggcacccgcggtcaagcgggacgaatcgaactggcacgagtgcttcgtgctcgtcggcgacgagaccgtcgcgtcgcagctcgcgtactgggagaaggtcgcggcacagacggaggcgttcatccgctccgtacccagcctcgacgacaccttcccgctcccgaacgatccctggttccccccggacgagcgggtctcgatgcgctgggtggcgctccacctgatccgcgagacggcccgccacgccggccacgccgacatcatccgggagtccctcgacggcgcgaccgccttcgagctggtggcccgggagcaggccggt

SEQ ID NO: 4636 - DNA, 639 bp, Streptomyces avermitilis
  CDS (1)..(639)
atgtcagcgatccgtctcctggtgctcggcgcggtccgccagcacgggcgggcccacggctaccaggtgcgcaacgacctggagtactggggcgcgcacgagtggtccaacgccaagcccggctcgatctaccacgccctcaagcagatggcgaagcaggggctgctgcacgcccacgagatcgcgccgtccacggtcggcgggccgccgcgcacggagtacgagatcacgcccgagggaaccgaggagttccgctcgctcctgcgtgagtccctggtcgcctacgaccagaagatggacatccagtcggcgggcatcggcttcatcgtcgatctggcgcgggacgaggcggtggcgctcctgaaggagcggatccggcggatcgaggagtggcgggccgccgtcaccgagcactatgtgcccgaggacggccccgaacagctcggccacatcggcgagatcatgaacctttgggtccaccgggccgactccgacgccgcgtggacccgtgggctcatcgagcggatcgagggcggtgcctacaccttcacgggcgagggcgagccgttcgtcggcgtgctgacggagggcgaggagaacccgtacgcgacgggggagcggcatccggaggacgctcgc

SEQ ID NO: 4637 - DNA, 930 bp, Streptomyces avermitilis
  CDS (1)..(930)
atgaccgacgcgatcgtcgtcgaaggcctacggaagcggtacggggacaaggcggccctggacgggctcgatctgacggtggcgcgcggcaccgtccacggtctgctcggcccgaacggcgcgggcaagaccaccgcggtgcgcgtactgaccacgctgctgcggccggacgagggccgcgtcgaggtcgccggacgcgatgtcctgcgccgggcctacgacgtgcgtctgcgcatcggcctcctcggccagcacgccgcgctcgacgaggagctgggcggccggcagaacctggagatgttcgcgcgcctgcaccatctgcgcacccgccacgcgcgcgtgcgggccggcgagctgctggaccgcttcgggctcgcggacaccggacccaaggcggtcaagcactacagcggcggcatgcggcgccgcctcgacctcgccgcgtccctcatcgccgagcccgaggtgctgttcctcgacgagccgaccaccggcctcgacccgcgcggacgcgccgaggtgtgggccgcggtgcgctccctggtcggcggcggcaccaccgtgctgctcaccacccagtacctggaggaggccgatcagctcgccgaccgcatctcggtggtcgaccacgggcgggtcgtcgcggacggtacggcggaccagctgaaggcgcgcaccggcggcgaccgcatcgacgtcgttctgcgggacgccggtcaactgggcgccgcggtcgccctgttgccggtcggtacgtccggggtccgcgtggaccgcgaccgccgtctgctcagcgccccggtcaccgaccgcatggcggcgctctccggggtcgtacgcgccctggaggcggccggcatcgaggcggaggacgtcgcgctgcgcaggccgacgctggacgaggtgttcctgcgcctgaccggacgtgcc

SEQ ID NO: 4638 - DNA, 759 bp, Streptomyces avermitilis
  CDS (1)..(759)
gtgagcacgtatgcgctgatcgattcctggaccatgacccggcgcgaactcgcccactgggcgcggcagccggtccaggcgctcatcggcctggtcttccccgtgatgctgctgctgatgttcggctacctggtcggcggcggccggggcgtcgcgggcgactacgtcgacttcctggtgcccgggatgctcgcgctgaccatggccttcgggctggagggcacgatgctggccgtcacccaggacctcaacaagggcgtgatcgaccggttccgctcgctgccgatggccaacggcgccgtcctggtgggccgcgcggccgccgacatgctccagtcggcgctgggcctggccgtgctgaccggcgtcgggtacgccatcggctggcgggcgcacggcggacccggggccttcctcgcggccgtggcactgctcctgctcctccgtttcgcgatgctctggatcggcatccacctggcgatggtcgccgggcggccggagatggtgcaggccgtgcagatcctggtctggccggtcggcttcctgtccaacgccttcgcgacccccgacgcgatgcccggctggctgggcacggcggtcgagtggaaccccatgtcgcacacggtcacagcggtacgggacctgttcggcggccccggcggcgaaccggggcacatctgggccgccgtggcctggcccctggcactgctggcggtgttcttcccgctggcggtacggaggttcgcgcgcctgagccgc

SEQ ID NO: 4639 - DNA, 1410 bp, Streptomyces avermitilis
  CDS (1)..(1410)
atgccgctccacaaaggccccgtgaagtccgacgaacgcccgatgtccttcaacccgttcttcggggaggccaatccggtcagcgggatgaccgaggccccgcccaagcaccggctcgcggacgggccgctgccgccctcgacggcgtaccagctcgtgcacgacgaactgatgctggacggcaacgcgcgcctcaacctcgccaccttcgtcaccacctggatggagccgcaggccggggtgctgatggcggagtgccaggacaagaacatgatcgacaaggacgagtacccgcgcaccgccgagctggagaagcggtgcgtggcgatgctcgccgatctgtggaacgcgcccgacgcgggggcggccgtgggctgttcgacgaccggttcgagcgaggcgtgcatgctcgccgggctggcgctgaagcgccgctgggcgcggcgcaacgcggaccgctaccccgcgagggacgtccgtccgaacctcgtcatgggcatcaacgtccaggtctgctgggagaagttctgcaacttctgggaggtcgagatgcgccaggtccccttggagggcgagcggtaccacctcgatccgggagccgccgccgagctgtgcgacgagaacaccatcggggtcgtcgggatcctcggctccaccttcgacgggtcgtacgagccgatcgccgaactgtgcgcggccctcgacgccctccaggagcggaccgggctcgacataccggtgcatgtggacggcgcgtccggcgccatgatcgcgcccttcctcgacgaggacctggtctgggacttccggctgccgcgggtcgcgtcgatcaacacgtccgggcacaagtacggcctcgtctccccgggcgtcggctgggcgctgtggcgggacagcgaggcgctgcccgaggaactcgtcttccgcgtcaactacctgggcggcaacatgccgaccttcgcgctcaacttctcccggccgggagcccaggtcgtcgcgcagtactacaccttcctgcggctcggccgggagggcttccgggccgtgcagcagacgacgcggaacgtggcgcgcagcctcgccgagcgtgtggcggcgctgggcgacttccatctgctcacccgcggcgacgagttgcccgtcttcgccttcacgaccgcgccggaggtcgcctcgtacgacgtcttcgacgtgtcccggcggatgcgtgagcacggctggctggtgcccgcgtacacgttcccgccgaaccgggaggacctgtccgtgctgcgggtggtgtgccgcaacggcttctccaccgacctcgccgaactgttcgtcgaggacctgagccgcctcctgcccgacctgcgccgccaggcgcgcccacagacccacgacaaggacgcggcgaccggtttccatcac

SEQ ID NO: 4640 - DNA, 1281 bp, Streptomyces avermitilis
  CDS (1)..(1281)
gtggcccacgacaccgtgcacccggcacccgctccggcgacccccgcgcgtgtcctgctgccgcagatcctcccggcactggtcgtcggggtcgcggccagtctcctgttcgtgggggtgagcgcgctcgccgggaagctccagaacgtcctgtggcaggacctgcccgacgcgctgggcatcgggcggtactcggtgctctggatgatcatcatgctcacctgcacgggtgtgctggtcgggctgatcgtctggaaggtgccgggtcacgcgggacccgacccggcgaccctcggactcggcggggccccgccgctggcgcccgccgtcctgccggggctgctgctggcgaccgggctgatgctggcgggcggtccgagcctcggccccgagaacccgatcatcgcctccaacatcgcgctggcctactggctgggccgcaggttcgtaccccggctgcccggcggcctgtggatcgcgctggccgaggcggcgacgatcggcgcgctgttcgggacgcccgtcgccgcggcactgctcctgtccgaggcgctcgccgggcagcaggccaaggggccgctgtgggacagcgtcttcgccccgctggtcgcggccggcgcgggtgccatcacgaccaccctggtggcccatccgaccctcgacctcggcctgcccccgctggccaggcccggctggaccgacgtcctggccgcgatggtcgtcgccgccgcggccgcggcgctcgggatggtcgcggtctatgccttcccgtacgtccacggcgccttcttacgcctgcggcaccccatggtggcgctgccggccggcgggctcgtcctcggcctgctggccgccctgggcggccatctgaccctcttcaaggggctggacgaggtgggggacctggcgaaggacccggacggctggtcggccgggcagttcctgaccatggcggtggtgaagctggcggcgctgctggtcgccgcgtcctgcgggttccgcggcgggcggatcttcccgtccgtcttcatcggtgcggcgttcggcctgttcgcccatgccctcgtatccgccgttcccccggccctcggtgtcgccgcgggcgtgctggggatgcttctcgccatcacccggcagggctgggtgagcctgttcacggccgccgtgctggtggcctcgcccgcgatcatcgccctgctctgcatcgcgtccctgccggcctggctgctggtgaccggcagaccccagatgcagcttcacgaagacggaaccccggtccgt

SEQ ID NO: 4641 - DNA, 759 bp, Streptomyces avermitilis
  CDS (1)..(759)
gtgagctactccgtgggacaggtcgccggtttcgccggggtcacggtgcgcacgttgcaccactacgacgagatcggactgctcgtacccggcgagcgcagccacgcggggcaccggcgctacaacgacgccgacctcgaccggttgcagcagatcctgttctaccgggaactcggcttcccgctcgaggaggtcgccgccctgctcgacgacccgcaagcggacccgcgcgcgcatctgcgccgccagcacgaactgctgaccgcccggatcgagcagctacagaagatggccgcggccgtggagcacgccatggaggcacgcacgatgggcatcaacctcacacccgaggagaagttcgaggtcttcggggacaaggatccggaggagcacgccgaggaggccgagcgccgctggggcggcaccgaggcgtacgccgagtcgcagcgccgtgcggcccgctacaccaaggacgactggaagcgcatgcaggccgaggtcgccgactggggcgagcgctacgacggcctgatggccgcgggcgagccaccggccggcgcccgcgcgatggacatggccgaggagcaccggctgcacatcgacaagtggttctacgactgctcctacgacatccaccgcggactcggcgagatgtacgtctccgacgagcggttcaaggagttctacgactccatgcgcccgggcctggccgagcacctgagggacgcgatcgcggcgaacgcggaccggcacggggga

SEQ ID NO: 4642 - DNA, 363 bp, Streptomyces avermitilis
  CDS (1)..(363)
atgggcatcgaagagtacggcggtggccagggtccccactcggacgtcctggtcgtgacgacgaacgacgtacccggttaccgcgtccagcacgtcatcggcgaggtcttcggcctcaccgtccgctcacgtcacctgggcagccagatcggcgcgggtctgaagtcgatgatcggcggcgagctgaagggcctcaccaagacgctcgtggagacccgcaaccaggccatggaacggctggtggagcaggcacgcgtgcggggcggcaacggcatcctgatgatgcgcttcgacgtcaccgaggcggcggacgtgggtacggaggtgtgtgcctacggcacggcggtggtgctggtcaaggca

SEQ ID NO: 4643 - DNA, 1017 bp, Streptomyces avermitilis
  CDS (1)..(1017)
gtgacgacgcttgcccttggaccaagctggctggatccgaacacgctcctggacaacttcggcatctggggcctgctgctcatcgtcttcgccgagtcgggcctgctcatcggcttcttcctgccgggtgactcgctgctgttcacctgcggcctgctgatcaccgcgggcacgctggacttcccgttgtgggccgcgatcgccctgatctgcctcgccgcgatcctcggcgaccaggcgggctacatgttcggcaagaaggtcggcccgtcgctgttcaaccgccccgactcccggctgttcaagcaggagaacgtggtcaaggcgcacgacttcttcgagaagtacggcccgaagtccctggtcctggcccgcttcgtgcccatcgtgcgcacgttcacgccgatcatcgccggcgtcagcggcatgaagtaccgctcgttcctcgtcttcaacgtcatcggcggcgtcctgtggggcgccggcgtcacgctgctcggctcctggctcggcaacatcgaggtcgtccacaagaacatcgaggcgatcctgatcctgatcgtcctcgtctcggtggtcccgatcgccatcgagttcctgagggcgcgctccaagtccaagaagaacccgccgcaggaccccaccccggcccggcacccggaccaggaccggcccgcggcacccgtcatggacgacgcgacgaggccgctgcgagtgcccccgatccagcagggccaggaccaggcgtacggcaaccagggccaggaccaggcgtacggcaaccagggccaggaccaggcgtacggcaacggccagtcgtatggcgaccaggctcagggctacccgcaggactacggccagggtcagcagcagtactaccccgaggagcagtacccccagcagtacccccagcagggctacggccagggtcagcagtacccggggcagggctacggccaggaccagaactacggtcaggaccagaaccacccctacggccagggttacccgcagaac

SEQ ID NO: 4644 - DNA, 1659 bp, Streptomyces avermitilis
  CDS (1)..(1659)
gtgaggcaggagcgggtgacggagccggaggcggaggatcgcaaaccgcagtcggacgaggcgaggagtgcgttcgccgctccggtgggcgtcacgtcgagcgacgacgagtcgtccacgacgtccgagttcgcgctccccaaggggctcgacgtaccgcagccgcccaccggcgatgccgaggggtccgcgttcagcaccccgcacacctacagcgccaagcacgcgccgcccgccttcaccccgccgagcggcatccccgtcgtcaaactgaccaaggaagcgccctggcaggaccggatgcgcacgatgctgcgcatgccggtgaccgagcggcccgcgcccgagccggtgcagaaggtggacgaggcggggcccgcggtgccacgcgtgctcgacctgaccctccgtatcggggagctgctgctcgcgggcggtgagggcgccgaggacgtggagacggccatgttcgccgtctgccgctcctacggcctggaccgctgcgagccgaacgtcaccttcaccctgctgtccatctcgcaccagccgtctctggtggacgaccccgtgacggcctcccggacggtacgccgccgggtcaccgactacacccggctcgcggccgtctacgcgctcgtcgacgacctcagcgacccggagacggcgatctccctggaggaggcctaccggaggctcgccgagatccgccgcaaccggcacccgtaccccggctgggtcctgacggcggccggcgggctgctcgccggtgcggcctccgtgctcgtcggcggtgacgcggtcgtgttcgtcgccgccgcgctgggcgcgatgctcggcgaccggctggcgtggctgtgcgcggggcgcggactgccggagttctaccagttcacggtcgccgcgatgcccccggccgcgatcggcatcgcgctcacgctgacgcacgtcgatgtgaaggcgtccgcggtggtcaccggtggactgttcgcgctgctgcccgggcgggccctggtggccggcgtgcaggacggcctcaccggcttctacatcaccgcgtccgcgcgcctgctggaggtcatgtacttcttcgtgggcatcgtcgccggtgtgctggtggtgctctacttcggcgtgaagctgggcgcccagctcaacccggaccaggcgctgggcatctccgagcggccggtactccagatcgtcgcgtccatgctgctgtcgctgaccttcgcgatcctgctccagcaggaacgatccactgtgctggcggtgaccctcaacgggggtgtggcctggtccgtctacggggcgatgcactacgcgggcgacatctccccggttgcctcgacggccgtggcggcgggccttgtgggcctgttcgggcagttgctgtcccgctaccggttcgcgtccgcgctgccgtacacgacggcggcgatcgggccgctgctgcccggttcggcgacgtacttcgggctgctgtcgatcgcccagaacaacgtcgacaagggcctggtgtcgctcaccaaggccgccgcgctcgccatggccatcgcgatcggcgtgaacctggggtcggagatctcccggctgttcctgcgggtgccgggggccgcgagtgcggcggggcgccgcgcggccaagcggacgcgagggttc

SEQ ID NO: 4645 - DNA, 489 bp, Streptomyces avermitilis
  CDS (1)..(489)
gtggagttcgacgtcacgatcgagattccgaagggttcgcggaacaagtacgaggtggaccacgagaccggtcggatccgcttggaccgtcgactcttcacctcgaccagctacccggccgactacggcttcgtcgagaacactctcggcgaggacggcgacccgctggacgcgctggtcatcctggacgagccgaccttccccggctgcctcatcaagtgccgcgccatcggcatgttccggatgacggacgaggccggcggcgacgacaagctgctgtgcgtcccggcgcacgacccgcgcgtggagcacctgcgggacatccaccacgtgtcggagttcgaccgcctggagatccagcacttcttcgaggtctacaaggacctggagcccggcaagtccgtcgagggcgccaactgggtgggccgcacggacgccgaggccgagatcgagcgttcctacaagcgcctgaaggagcagggcggtcac

SEQ ID NO: 4646 - DNA, 1383 bp, Streptomyces avermitilis
  CDS (1)..(1383)
gtgaccgcggccggtccctgggactcctccggtcagcgtacggccgagcgcgagtgggccgcctcccggggcggagagggtggcgcagatcacggacgtgattcccgtacgccggccacggcgcccaggcccgcgccgagcgccgcgtcggtgctgaccgggctcggcggcgccaccggcacggacgtgaccacgaagtcggcgccgaccgagaaggccctggcgggcgttctcgacccgctgctgaaggacggttcgctcggcacccggcgctccgccgccgtcgtcgacgtggccaccggcaggcggctgtacggcaagggagtggacgaggcgctgaccccggcctccaccacgaagatcgccacggcggtggccgtgctctcggcggccggcgccgaccaccgcatcagcacgcgcgcggtgctggagcccgacaccaaggagctcgtcctcgtcggtggcggcgacccgaccctcaccgcccgcaaggagggcgggggaggctgggcaagtctgcgcacgctcgccgaccggacggcggccgcgctgaagaagcgcggcatgacccgggtgacgctgtcgtacgacgtctccctgtacgcgggtcccgtactgcaccccatcggggagaacccgaacctcgccccggtcagccccctgatggtcgacgaagggcgcgtcgacgacacggtcggcggccccgcgacccgcagcaaggagccggcggcggacgcggcgcgcgcgttcggcgcgttgctccgcgccaagggcatcaggacgaccgcgccgggtccctcgaaggcgacgggccggtcacaggcgctggccgaggtcgagtcgccgccgctgtccgcactggtcgagcggatgctgaccaacagcgacaacgacatcgcggaggcgctggcccgtcagacggccctcgccggcggcgagcgggcgagcttcgagggcgggtcgcgggcgatcgccgcccagctgaagaagctcggactgccgctgggcggcgcggagttccgcgacggcagcggactgaaccgcgaggacaggctgacggcgggcctgctgaccgccctcctggccaaggcgggcgaccccgcccacgccgaactccgcccggtcctgacgggcctcccggtggcgggcttcacgggcaccctgagcgaccgctacgaggacggggcgcaacgttccggcacgggcgtcgtacgcgccaagaccggctccctgacgggcgtcaacaccctcgcgggcacggtggtggacacggacggccgtctgctggccttcgccttcctgacgtacgagtcgatggaccaggagacggcgagggcggccctggaccgcacggcggcggcactggcggagtgcggctgccga

SEQ ID NO: 4647 - DNA, 1131 bp, Streptomyces avermitilis
  CDS (1)..(1131)
atgacgagcatcggtggtgctgcttcttctgggatggtcgactggaatctcgcggtggcgaccgcgacccggctcgtgcggccgggcccggaggtgagccgcgacgaggcccgggccgtcgtcgccgagctgcgccggcatgcgaaggcgtcggaggaacacgtccgcggtttcacccggatgggcaccgaggacacccacgacacccccgtactcgtcgtcgaccgccccggctgggtccgggcgaacgtggccgggttccgggagctcctcaagcccctgctggacaagatgcaggagcgcagggggaacaccccgggcggcgccgtgctcggggccgtcggcggcaaggtcaccggcgtcgagctgggcatgctgctgtcgttcctgtcctcccgggtcctcgggcagtacgagaccttcgccccgccgacccgggacctcccggcggccgagaacggcgggggcaggcttctgctggtcgcgcccaacatcgtgcacgtggagcgcgaactcgacgtgcagccccacgacttccgcctctgggtctgtctgcacgaggagacgcaccgcacgcagttcaccgccgtgccctggctgcgcgaccacgtcgggggcgaaatccagtctttcttgggagagaccgaggtggatcccatgaccgtgctggagcggatcagggaagccgcccagtcgctcgccggcggtcgtcccgagggcgaggagggcgacgacggccggtccatcgtggaactcgtgcagacgccggcccagcgggagatcctcggccggctcaccgccgtgatgtccctcctcgaagggcacgcggacttcgtgatggacggagtcggccccgacgtcgtcccgtccgtcggggagatccgcgagaagttccagcagcgacgggcgaagggcgcctcccggctggacctcgccctgcgcaagctgctgggcctggacgccaagctcaggcagtaccgggacggcgagcggttcgtgcgggcggtcgtcgaacaggtcggtatggacggattcaaccgggtgtggacttccccgaacacgctcccgaccaagacggagatcgccaaaccggcggactggatcgcgcgggtgcaccgcaaggcggagtcg

SEQ ID NO: 4648 - DNA, 1035 bp, Streptomyces avermitilis
  CDS (1)..(1035)
atgggtccccatcctgcggtcgcggcgatacgcctggcggtccgccgcgtactccacgacatcctcatcgaacacgcgcccggctctgccgacctgccgcgcgacgtgccgcacgatctgccgcccccgccgctcgtgctcgtcgcctgctccggcggtgccgactccatggcgctcgcctccgccctcgccttcgaagcccccaaactcggcatccgcgccggcggcatcaccgtggaccacggactccagtccggctccgacctgcgcgccgacgaggtcgtcggccgcctggtcgatctgggtctgaccccgaccgagtccatcgccgtcaccgtcggccgtgacggcggccccgaggccgccgcccgcgatgcccggtacgccgccctggatgccgccgcgcggcgccacggagcctgtgcggtcctgctcggccacacccgtgacgaccaggccgagaccgtcctgctgggcctcgccaggggctccggcatccgctccctgtccggaatggccgcggtctcggggaccggcggccgttaccgccgccccttcctccagctcgaccggcagaccgcccgcaaggcctgcatggcccagtcgctgcccgtgtgggacgacccgcacaacgccgacccggcctatacgcggtccaggctgcgccacgagggcctgcccgccctggagaaggcgctcggcaagggtgtcgtggaggccctcgcccggacggcccagctctcccgtgacgacgccgacgccctagacgtgtgggccggccaggccgaggcctccgtacgcgacgccgccggcctcctggagtgcgccaagctctacgcgctgccgcccgccgtgcgccgccgcattctgcgccgcgccgccatcgaggcgggcgccccggccggttcgctgttcgcccgtcacatcgaagaagtcgaccggctgatcaccggctggcgcggtcagggagccatcaatctcccgggcaaagtcgtcgcccagcgacagggtggcagactggtgattcggcaaggc

SEQ ID NO: 4649 - DNA, 558 bp, Streptomyces avermitilis
  CDS (1)..(558)
atgcgggtggacgcgaaagacatgggcaccgacctcaagtcggtgctcatcaccaaggaagagatcgacgcgaagctggccgagctggccgcgaagatcgacgcggagtacgcgggcaaggacctgttgatcgtcggtgtcctcaagggcgccgtgatggtcatggcggacctggcgcgtgcgctgtccacccccgtcacgatggactggatggcggtgtcctcgtacggcgcgggcacccagtcctccggtgtcgtgcggatcctcaaggacctcgacacggacatcaaggggaagcatgtcctgatcgtcgaggacatcatcgactccgggctcaccctgtcctggctgatctccaacctcggctcccgcgagcccgcctccctcaaggtgtgcacgctgctgcgcaagccggaggcggccaaggtcgcgatcgacgtggagtgggtcggcttcgacatccccaacgagttcgtcatcggctacggcctcgactacgccgagaagtaccgaaacctcccgttcgtcggtacgctcgcgccccacgtctacggcggc

SEQ ID NO: 4650 - DNA, 1992 bp, Streptomyces avermitilis
  CDS (1)..(1992)
atgtggatcgtgctggccgtccttgccgtggtcgtgttgatgcaggtcgtcggctcgtccggcggctacaagacagtggacaccggccaggtcgtccaggcgatcaatgagaacaaggtccagcaggccaaaatcaccaccggtgacgagcaggtcatcaaggtcgagctgaaggacggccagaaggtcgacggcagctcgaagatccaggcgagttacatcggcgaccagggcgtgaccctcgcgggcacgctccaggacaagtaccagaacaagcagatcccggacggctatacggtctcgccgtccaagcagaacccgttcgtgggcatcctgctctctctgctccccttcgtcctgatcgtcgtcgtcttcctgttcctgatgaaccagatgcagggcggcggctcccgggtcatgaacttcgggaagtccaaggcgaagctcatcaccaaggacacccccaagacgacgttctcggacgtcgcgggttcggacgaggcggtcgaggagctccacgagatcaaggagttcctccaggagccggcgaagttccaggccgtcggggcgaagatccccaagggcgtgctcctgtacgggcctcccggtaccggcaagacgctgctggcgcgtgccgtcgcgggcgaggccggggtccccttctactcgatctccggttccgacttcgtcgagatgttcgtcggtgtcggtgcctcccgagtccgtgacctcttcgagcaggccaaggcgaacgccccggcgatcgtcttcgtcgacgagatcgacgcggtcggccgccaccgcggcgccggcctcggcggcggtcacgacgagcgcgagcagacgctgaaccagctgctcgtcgagatggacggcttcgacgtgaagggcggcgtcatcctgatcgccgccacgaaccggcccgacatcctcgacccggctctcctgcgccccggccgcttcgaccgccagatcgcggtcgaccgcccggacatgcagggccgtctggagatcctcaaggttcaccagaagggcaagccggtcgccccggacgtcgacctgtcggccgtcgcccgccgcacccccggcttcacgggtgccgacctcgccaacgtgctgaacgaggccgcgctcctcacggcccgcagcgacaagaagctggtcgacaactccatgctggacgaggcgatcgaccgcgtggtcgcgggcccgcagaagcggacccggatcatgtcggacaaggagaagaagatcaccgcgtaccacgagggcggccacgccctggtcgcggcggcgtctccgaactccgacccggtccacaagatcacgatcctgtcgcgcggccgtgccctcggctacacgatggtcctgccggacgaggacaagtactccacgacccgcaacgagatgctcgaccagctggcgtacatgctgggcgggcgcgcggccgaggagctcgtcttccacgacccgacgacgggcgctgcgaacgacatcgagaaggccaccgccacggcccgcgcgatggtcacgcagtacggcatgaccgagcgtctcggcgcgatcaagttcggcggcgacaacaccgagcccttcctgggccgggagatgtcgcatccgcgcgactactcggaagaggtcgccgcgctcgtcgacgaagaggtcaagaagctcatcgagaacgcgcacaacgaggcctgggaaatcctggtcgagaaccgcgacgtcctcgacgccctggtgctccagctgctggagaaggagacgctgagcaaggagcagatcgccgaggtcttcgctcccatcgtcaagcgcccggcccgccccgcgtggaccggctcctcccggcgcaccccgtccacccgcccgccggtgctctcccccaaggagctgtcactgacgaacggggcgaacggcgcgtcgccggcgatcgccaacgcgacggagtcggtgccggccgcggagtcggctccggaggaccgcaccgagggc

SEQ ID NO: 4651 - DNA, 603 bp, Streptomyces avermitilis
  CDS (1)..(603)
atgaccgacccggtgacgctggacggtgagggcaccatcggcgaattcgacgagaagcgtgccgagaacgccgtgcgggagctgctgatcgcggtcggtgaggacccggaccgtgagggtctcagggagactccggggcgggtggcccgggcataccgggagatattcgcggggctgtggcagaagcccgaggacgtgctgacgaccacgttcgacatcggacacgacgagatggtcctggtgaaggacatcgaagtcctgagcagctgtgaacatcacctggtgccgttcgtcggtgtggcccatgtcgggtacatcccgtccaccgacggaaagatcacgggtctctcgaagctggcgcggctcgtggacgtctatgcccgccggccccaggtgcaggagcggctcaccacgcaggtcgccgattccctcatggagatcctggagccgcgcggtgtgatcgtcgtcgtcgagtgcgagcacatgtgcatgtcgatgcgcggggtgcgcaaacccggggcgaagaccatcacgtcggcggtgcgcggtcagctgagggacccggccacgcgcaacgaggccatgagcctgatcatggcgcgc

SEQ ID NO: 4652 - DNA, 486 bp, Streptomyces avermitilis
  CDS (1)..(486)
gtgaaagagctgcgcatcaggacgctggccgcggtgttcgtcgtggcaggagtactgtcctgggccggagcccgcttgtggaactcggtgggcacactgccccgcgtcccgctggccgcccccatcgtcctggctctgatcgcggtcgtccttttggccacggcactctcgctgcgcgcccgcctcaaggcccagcgggagcgccgccccggcgccaagggcgtcgaccccctgatggcggcccgcgcggtggtcttcggccaggcgagcgcgctggtggcggccctggtcgccggtatgtacggcggcaccggcgccttcctcctggaatccctcgacatccccgcccgccgcgaccaggccatctacgccggcttctcggtcctcgccggcgtcggcgtcatagcggcggcgttcttcctggagcgcgtgtgcaaactcccggaggacgacgacaccaacggcggcgggacggctccggcggcg

SEQ ID NO: 4653 - DNA, 609 bp, Streptomyces avermitilis
  CDS (1)..(609)
atgaccgcgttctacaccgagggtcagagcgacccgaccgttcagccggtgcccgcctccgtggtggagcgggtggacgccgccgacacgaccctctccaaccccaagcgcgcggtgatctccctgggctcgaacctgggcaaccgcctggagacgctccagggcgcgatcgacgccctggaggacacgcccggcgtccgcgtcaaggcggtctctcctgtctacgagacggagccgtggggcgtggagcccggcagccagcccgcgtacttcaacgcggtggtgctcctgaagacgaccctgcccccgtcgtccctcctggagcgggcccacgccgtcgaggaggcgttccaccgcgtccgggacgagcactggggcccgcgcacgatcgacgtggacatcgtcgcgtacgccgacgtggtctccgacgatccggtgctcacgcttccccacccccgcgcccaccagcgggcgttcgtcctggccccctggtacgacgtggacccggaggcccagctccccggccgcggccccgtggagcagctgctggcggccgtcacgcgcgacggcatcgtgccgcgcgccgacctggaactccggctgcccgag

SEQ ID NO: 4654 - DNA, 357 bp, Streptomyces avermitilis
  CDS (1)..(357)
gtggatcgtgtcgcgctgcgcggcctgaaggcccgcgggcaccacggggtgttccccaaggagcgcgaagagggccagaccttcatcgtggacctcgtcctcgggctggacacccggcccgccgcggccgacgacgacctgtcgaagaccgtgcactacggcatcgtggcggaggaggtcgtggccgtcgtcgagggcgatcccgtcgacctcatcgagacgctcgccgagcgcatcgcgttctcctgcctcaaacacgcaccggtcctggaggtcgaggtgtgcgtccacaaaccggacgcaccgatcacggtccccttcgacgacgtgaccgtcaccatcaccaggagccgagta

SEQ ID NO: 4655 - DNA, 507 bp, Streptomyces avermitilis
  CDS (1)..(507)
gtgagcacccccacccccgacaccgatgtcgaacaggtaggactcgccaacaccgccttctacgaggcgatggaacgcggcgacttcgagacactgtcctcactctggctgacccccgccgacctcggcgtcgacgaggagtaccacgacccggcggacgccggcgtggtctcctgcgtgcaccccggctggccggtgctgagcggccgcggcgaggtcctcaggtcgtacgcgctgatcatggcgaacaccgagtacatccagttcttcctcaccgacgtgcatgtctccgtcaccggtgacaccgccctggtgacctgcaccgagaacatcctcagcggcggcccgccccccgacgacagcgacgagctcgggccgctcgtcggccagctggtcgtcgccacgaacgtgttccgccgcacccccgacggctggaagctctggtcgcaccacgcgtcccccgtgctggccgaaaccggtgcggaagagggcgacgagtctcccgac

SEQ ID NO: 4656 - DNA, 930 bp, Streptomyces avermitilis
  CDS (1)..(930)
atgagcaagaagagcgggcgcggccgagtggcgggactgcctacatgggaccgctgcgcggtcatgggggtcgtcaacgtgacgcctgattccttctccgacggcggccgctggttcgacaccacgaccgccgtcaagcacggactcgacctggtcaccgagggcgcggacctcgtcgacgtcggcggcgagtccacccgccccggcgccacccgcgtcgacgaggccgaggaactcaagcgcgtcatcccggtcgtccgcggtctcgcctccgaaggcgtcacgatctccgtggacaccatgcgcgcctccgtcgccgagcaggccctcgcggccggcgcggccctcgtcaacgacgtcagcggcggcctcgccgacccggagatgatcccggtcgtcgcggccgcgggcgcccccttcgtggtgatgcactggcgcggcttcctggccggcggcaccatacgagggacgtacgacgacatcgtctccgaagtggtcgacgaactgcacgcacgcgtggaggccgttctggaaggcggcatcgcgcccgaccggatcgtcgtcgacccgggcctcggcttctccaaggaggccgaccacgacctgacgctgctggcccacctcgaccggctgcgcgacctgggccacccgctgctggtcgccgcgtcccggaagcggttcctgggccgcgtactggcaggccccgagggcgccccgccgcccgcccgggagcgcgacgcggccaccgccgcggtctccgcgctcgccgcccaccagggcgcgtgggcggtccgcgtgcacgaggtacgggccacggcggacgccgtacgcgtcgcccgcgccgtggaaggcgcccgctccgagcgcagcgcgcaggcagcccccgcggcggccgccccggacaccgcccaggccgcagagggagcccgg

SEQ ID NO: 4657 - DNA, 1803 bp, Streptomyces avermitilis
  CDS (1)..(1803)
atgtcggacgaggttccggatcgatcgggcgtgctgcggcgcatagtccgcggtccgcgccccgaggccgtccccgccgtggtcgccagtgcctgcacactcgtcggagtcctggacgtcgccgcgggtgtcttcccgcgcttccggcacagccgtatgcacgccatcgccgaggtactgcccggcgcgctgggcccgttcgcggccgccctggccatcagcacgggcatgcttctgctgctcctcgcgcacggcctgcgccggcgcaaacgccgggcgtggcgcgccgccgtggtgctgctgccggccggcgccgtggcgcagttcgcgtaccgtcactcgctcatcggcgtggtcatctcgctggcgctgctcgcgccgctgctgcgccaccgaagcgaattcgaggcccttcccgacccccgcagccgctggcgtgcgctggccaacttcgtcctcgtgggcgccggttccctgctgctcggcctggtcatcgtcagcgcccaccccaaccggctggtcggcgacccgagcctgtccgaccgcatcgagcacgtcctgtacgggctgtgcggcttcgagggcccggtcgactactcgggcaacacgtcctggacggtggccttctcgctcggcgcgctcggcctgctgaccgccgtcacgacgatctatctcgccttccgccccgaacacccggccgcccgcctcacggcgcaggacgaggaggggctgcgggcgctcctggagaagcacggcggccgcgattcactcggccacttcgcgctgcgccgcgacaaggcggtcgtcttctcccccagcggcaaggcggccgtcacgtaccgcgtcgtgtcgggggtgatgctcgcgagcggcgacccgatcggtgacgtcgaggcctggcccggcgcgatcgagcgcttcatggacgaggcccaggcccactcctggacgcccgccgtgatgggctgctccgagacgggcggcgaggtgtggacccgcgagaccggcctcgacgccctcgaactgggtgacgaggcggtggtggacgtcgcggatttctccctggccgggcgcgcgatgcggaatgtgcgccagatggtgaagcgcatcgagcgggccggttacgagacccgggtacggcgtattcgtgacctcagcgagggcgagctggagcgcattcggcgcgctgccgaggactggcgcggcaccgacaccgaacgcggcttctccatggcgctcggccgcatcggcgacccggccgacggcgactgtctgatcgcgaccgcccacaaggcggacgcggatcccggtccgtacggcgatctgaaggccgtactccacttcgtcccgtggggcaccgacggcgtgtcgctcgacctcatgcgccgggaccgctcggcggaccccggcatgaacgaactgctgatcgtggcggcgctccaggccgctccgaagctcggcatcgtgcgcgtctcgctgaacttcgcgatgttccgggcggcactggcacgcggcgagaagatcggcgcgggccccgtgctgagggcgtggcggggactgctggtgttcctctcgcgctggttccagatcgagtccctctacaagttcaacgcgaagttccgtccgcgttgggagccgcgcttcgtggtctacgcgtcgtcgcgcgaccttccgcgcatcggcctcgcggcgatgcaggcggagggcttcgtgaacctggccctgccgcgcctgctgcgccgccggaaggcgatccccaccccgtgcgcccacagggtggcggagaggggcgttcgggccgcg

SEQ ID NO: 4658 - DNA, 1128 bp, Streptomyces avermitilis
  CDS (1)..(1128)
atgggtctgacgagcaacaaggtgctggtgctggccgccttcttcgccgtgctgctgttcatcggcacggtgtggctctggccacggctggcgcggcgcaactggcgggccgtcggcggacgggtcgctctgctgctcgccacccaggtggcgatcttcgcgtcgatcggggtcgccgccaaccaggccttcggcttctacgccagctgggcggacctgttcggccgggagagcggtcagggcgtggtcgtcgaccacaacgccggcggcggttcgggcggcggccccctccagatgctcggcacccagccggtgaacgtcacgggcggcgggcggccgcagctcggcggccagatccagaaggtcggcatcgtgggtcgtacgacgcacatcgccacgcgcgcgtacgtgtatctgccgcccgagtacttccagccgcagtaccgcacgcgcaccttccccgcggccgtcgtcctcaccggctacccgggcaccgccgaggcgctcatcaaagggctgcactatccgcagacggcccatgagctggccaagaacggccaggtgcagccgatgatcctggtgatgctgcggccgacggtggcgccgccgcgcgacacggagtgcgtggacgtcccgggcggcccgcagacggagtcgttcttcgccaaagaccttcccgatgccgtactggcccactacagggtgggcagaaagccgggcagctggggcatcgtcggcgactcgacgggcggctactgcgccctgaagctcgccatgcaccatccgaaggtgtacgccgccggggcgggcctttcgccgtactacaaggcgccgctcgaccccacgaccggagatctcttccgcggcgacaaggggctgcggaaccgggccgatctgttctggtatctcaagaacatgccggccccggacacttcactgctcgtcagcagcagcaggatcggcgaggccaactaccagaacacgctcaagttcatggagcaggtgaaggccaagcgtctgacgagggtctcgtcgatcatcctcgacagcggcggccacaacttcaacacctggcggcgggagatcccggggacgctccagtggatcagcgggcggctcagcgaccgc

SEQ ID NO: 4659 - DNA, 1542 bp, Streptomyces avermitilis
  CDS (1)..(1542)
atgttgcctccttcggtcatcgcgggcgtgtcgctcgtctgcgctctggggccctggctgttcacggagccgatggtgctccgcgggctggccgggggcgccgcggtgaccgcgatcgtcggcgccgtcgtcctgcgccgctgggacacggcggcgggcaaacgcgtcgcggacctcacgcgcgcgcgtgcgagcgacgagtggcgtcacgaggagcgggtcgccaaactggagaccgacctcgaggagtcgcgcgagctgcgcgtcaagctggagcacaagctgcgcgcgaagcgggcggaactggcgggcctacgcaacgaacacgcggcgctgctgcggcggtacgccacggcggagacggagcgggccacagcgctggagggccgccgcctgctcgagatagaggccacgaccccggcccgggcgctgcccgcggccccggtccgcccgcagacgccgggcggctcggagacgccgggcggctcggagacgcagggtcgtacggagacgccgggtggctcggcggattcgggttcagcggacgcgggagtggcggacgcgggagcggcggggacgcccgagacggcgacggtggccgagccggaatcgaccgagccggtcgagtcggcggaggtcgaggcggccgagtcggccgaggcggagaccgacgagtccgtgtcgcccgcttccgcggtcttctccccgtccggctccccgctcttcctgcgggccaactcggcgctggacgcgctcacgaaggccgaggcggccaagaaggccgcggccgacgacacggcaccggcgagcgccgggcccgcgccggaggcttccgcgccggaggccacctccgtacgggacgacgactccgtaggggccgattcggtacaggacgactccgtacagggtgactccgtacaggacgcccccgtacaggagagcgcgcccaaggacgagtcccccaagggcggcaccccgaagagcgaggccccggacgccggctccgtcgaggaggccgtgcgggaggacgaggcggaggggaagcccgaggcggtcgacgggaatgagcgcgcggccgccgtgcccgcacccgccgttcccgtatccgccgtgcccgcgcccgaggagcccgagcactccgccgtggccgccgcatccaccgaggcccacccggcgaagcccgccgagccggcctcgtcggcccggcgctccgggcacttcaccgtgccgaccgcggtggccgtcgtaccggcgtcgccccggcggcggcccacggtcgagggcggtttcgacttcttcggtacgcagaaggggacgtccgcgcaggccctggaggccgtgcagaacgaggacctcgcggacgtggtcggccaggaggcgctcgccctccacaaggccgaggccgagtccggcttcaagccggcgggcgagggctcccggggtgtcggccaggtcatcgacctgaccgcccacgacgagacggaacatatcgacgtacaggaactgcgcatcgacgtgaaggaactgcgcagcgcggtttcc

SEQ ID NO: 4660 - DNA, 1371 bp, Streptomyces avermitilis
  CDS (1)..(1371)
atggccgtgagtgcggacgggccgccggcggcggcgggcggggagaagccggcggcgggcggggagaggccgctggacgaacggcggctgcatcccgtgaccccgttccggcgggcgtgggcgccggtcgccgtgctcgtcggctgggcggtgcacgaccccaacgcggcccaggagcagctgaccagactcaccacgaccatgctgctcatcgggcttgccgtactcatacccgccgcctccctctacggcttcctcacctggtggttcacccacttcgcggtcaccgactccgaactgcgcatccgcaccggcctgttgttccgccgcaccgcgcacatccggctggaccggctccaggccgtcgacgtcacccagccgctgctggcccgggtcgccggcgtcgccaagctgaaactcgacgtcgtcgggacggacaagaaggacgaactggcctacctgggcgagggcgaggcacgtgccctgcgcgccgaactgctcgcccgcgcggccggtttcgcaccggagaccgcgcacgaggtgggcgaggccccggtacgacagctgctgcacgtgccgccgggcaagctcgccgtgtccgtgctgctcaccggcgccacctggggttcgctgctcgccgccgtcgtcgtaccgccgctgctgtggttcggcacccacagcgtgtggacggtcctggcgaccgggctgccgctgctcggcgcggcgggcgcgagcagcgtggggcgcttcctcggggagtacgactggacggtgggcgaatcgccggacgggctgcgcatcgaccacggcctcctcgaccgtacgcacgagacggtgccgccgggacgcgtacagaccgtgcggatcgtggagccgctgctgtggcggcggcgtgggtgggtgcgggtggagctggacgtggcggggtcgtcgaactccgtcctcgtgcccgtcgctccgcgcgaggcggccgaggccgtgatcgcccgggtgctgccgggggtgaccgtgccgcgctcgctgccgcgcccgccgcggcgggcggggtggtgcgtgccgctgtggtggcggggatacgggctcgccgtcacggacacggtcttcgcggcccggcacggcctgctgcgccgcagactggcgctcgtcccgcacgcgaaggtgcagagcgtacggctggaacaggggccgtgggcgcgcttcaagaaggtcgccgacgtgcatgtggacacgggggcgaacaagacggtgacggcgcgcctgcgggacgccggcgaggcggcggcgctgctgcacgcgcaggcggaccggtcccggacggggcgacgggaggcccgaccggaccggtggatggccaagggcgccgaatccgag

SEQ ID NO: 4661 - DNA, 519 bp, Streptomyces avermitilis
  CDS (1)..(519)
atggaaacggggagcgcccaaaacgcggggaacaccgcgaccaccggcggatcggggcccgagccggtctggaccggactgccgccgggcctgctgcggatgcgacggctgttgctggtggtgtggctggggctgctgaccatcggcgtcggcctgctgctgggactgctcgccggacccggctgggcggccttcgcgctgctgccgccggtcctgatggcgtggggctgggtcatgctcggccgtaactggcgctcctggcggtacgccgaacgcgcggacgacctgctgatcagccggggggtgctgttccgcgaggagaccgtggtgccgtacgggcgcatgcagctcgtcgaggtgacctccgggcccgtcgaacggcacttcgggctggcgagcgtgcagctgcacacggccgccgcggcgacggacgcgcgcatcccggggctcgacccggccgaggcggagcggctgcgggaccggctcacggagctgggccaggcccgatcggcggggctg

SEQ ID NO: 4662 - DNA, 1149 bp, Streptomyces avermitilis
  CDS (1)..(1149)
atgactcccacgacggagaccatggtcggtatcggcggcgccgcggagagcaccgacatggtgctcaacatcgggccccagcacccgtccacgcacggcgtgctgcggctgcggctcgtgctcgacggcgagcgcatccagcacgcggagccggtcatcggctatatgcaccgcggcgcggagaagctcttcgaagcgcgcgactaccgccagatcatcatgctcgccaaccgccacgactggctgtccgccttctcgaacgagctgggcgtggtcctcgccgtggagcggatgctcggcatggaggtgcccgagcgcgcggtgtggacgcgtacgctcctcgccgagctgaaccgggtcctgaaccacctgatgttcctggggtcgtaccccctggagctgggcgggatcaccccgatcttctacgccttcacggagcgcgaggagctccagcacgtgatggaggagatctccggcggccgcatgcactacatgttcaaccgggtcggtggcctcaaggaggaccttccggccggatgggccacgcgtgcgcgtgcctgcgtcgccgccctgcgctcgcgcctggacgtgtacgacgacctggtgctcggcaacgagatcttccgcggtcgcacgcggggcgtgggcgtcctcacgccggaggccgtccacgcgtacggggtgagcggaccgatcgcgcgcggctccggggtggacttcgacctgcgccgcgacgagccgtatctcgcttacggggaactccaggacaccctgaaggtcgtcacccggcaggagggcgactgtctcgcccgcttcgagtgcctgctggagcagacgcacaacgcgctcgacctggccgacgcctgcctcgaccggctggccgagctgccgcccggaccgatcaaccagcgcctgccgaaggtcctcaaggcacccgagggccacacgtacgcctggaccgagaacccgctgggcatcaacggctactacctggtcagcaagggcgagaagacgccgtaccggctgaagctgcgctccgcctcgttcaacaacatccaggcgctgaccgaactgctgcccggcacgctggtcgcggacatggtggcgatcctgggctcactgttcttcgtggtcggcgacatcgacaag

SEQ ID NO: 4663 - DNA, 1056 bp, Streptomyces avermitilis
  CDS (1)..(1056)
gtgacagatgagacggacgggggcggccgcgtgccgggcggcgagtggcgcgggtggcgggaggcagcccaggaggcgctgtacggccccgccgggttctatcggcggcccgagggccccgcgggccatttccgcacctcggtgcacgcgtccccgctcttcgccggtgccgtggcccggctgctgcgcgacctcgacgaagccctggggcgcccgtccgagctggccttcgtcgacatggcggcgggccgcggcgagctggtcaccggtgtcctcgccgccctccccccggacatcgcctcccgcgcgcgtgggtacgccgtcgagctcgccggccgccccgaagatcttgaccaccggatcgagtggctcgccgagccgccggaggggatcaccggcctcctgttcgccaacgagtggctggacaacgtgccggtggaggtggcggaggtggactccgcgggcgtagcccggctggttctcgtacgggacgacgggaccgagcgccacggggagcccgtcgcgggggcggagtcgcagtggctgacgcgctggtggccccctgcccccgaggagggcctgcgggccgagatcggtctccccagggacatcgcctgggcctcggccgtcggcaccgtccaccgcggtctggcggtcgccgtcgactacgcccacttcgtggacacgcgcccgcccttcgggacgctgaccggcttccgggagggccgggagaccctccccgtaccggacggctcgtgcgacctcaccgcgcacgtcgccctggacgcgtgcgcgctgccgggggcccggctgctgagccagcgggacgccctgcgcgcgctgggcgtgagcggggagcgcccgccgctgtccctggcgagcacggaccctgcggcgtacgtacgtgccctcgcgggcgccggggcggccgccgagctgaccgcgcccggcggcctgggcgacttcggctggctgcttcagcccgttggcatgtcgaacgggcagatgaggcggctgaggggcctacttgtcgatgtcgccgaccacgaagaacag

SEQ ID NO: 4664 - DNA, 1203 bp, Streptomyces avermitilis
  CDS (1)..(1203)
gtgcagcgcctctatgacttcctccgcaggcacccgacgtgggtcgacagcttctgggccgtcgtcctcttcgggatcaccggcgtgagcatctccagcgtcaatggggcgccggaccagcacggctcactcgccgaggcggtcccgatctccttcgtcctgtctctcgtcgtcgcgctgcggcgccgcatgccggagaagatgctcgtcctggccgccgcgatggggctgctccagctgatcctggacgtccaggtcctggccgccgacttcgccatgctggtgatcatctacacggtggccgcggacggcgcccgctgggcctcccggttcgccctggtcggcgggctgttcgcggcgccggtctcgcagctgcgctggcccgagctgcactccagcaccgcgggcaacgtcctgatagcggtcttccagacggtgcccttcgtgctggcctgggtgctgggtgactccatccgcacccgccgcgcctatctcgcccagctcgaagagcgcgccgcccgcctggagagggagcgcgaggcgcagtccaaggtcgccgtcgccgccgagcgcgcccggatcgcccgcgagctgcacgacgtcgtcgcgcacaacgtgtccgtgatggtggtgcaggcggacggcgccgcctacgtcctcgacaccgcccccgaccaggcgaagaaggctttggagacgatctcctccaccggccgccaggccctcgccgagatgcgccgcctgctcggcgtgctgcgcaccggggagcaccaggagggcggcgagtacgtgccgcagcccgacgtcgagcagctcgacgacctcatcgagcagtgccgcagcagcggcctgcccgtcgacttcaaggtcgagggcaccccccggccgctgcccagcggtgtggagctgacggcgtaccgcatcgtgcaggaggccctcaccaacacccgcaagcacggggggccgaacgcgggggcgagtgtgcgcctggtgtacttcgacgacggactcggactgctcgtcgaggacgacggcaagggcgccccgcacgagctgtacgaggagggcggcgccgacggccggggccacggcctgatcggcatgcgcgagcgggtcggcatggtcggcggcaccctggacgcgggaccgcgtcccggcggcggcttccgcatcagcgccctgctgccgctcaaggccgcccat

SEQ ID NO: 4665 - DNA, 669 bp, Streptomyces avermitilis
  CDS (1)..(669)
atggcgatccgcgtgatgctcgtcgacgaccaggtgctgctgcgcaccgggttccggatggtgctcgccgcccagccggacatggaggtcgtcgccgaggcgggcgacggcgtcgaggccctccaggtgctgcgttccaccgaggtcgacgtggtgctgatggacgtacgcatgccgaaactcgacggcgtggagaccacccgccgcatctgctccgagccgaacccgccgaaggtgctgatactgaccaccttcgacctcgacgagtacgccttctcgggactcaaggcgggcgcctccggtttcatgctgaaggacgtgccgcccggcgagctgctcaccgcgatccgctccgtgcacagcggcgacgcggtggtcgcgccctccaccacccggcggctgctcgaccgcttcgcgccgatgctgcccagcgccggcaaggagccccagttcaaggagctggagcggctcaccgaccgcgagcgcgaggtcatggtgctggtcgcgcagggcctgtcgaacggcgagatcgcggcccggctggtgctgtccgaggcgaccgtgaagacgcacgtcgggcgcatcctgaccaaactgggcctgcgggaccgggtgcaggtggtcgtcctcgcctacgagaccggtctcgtacgggccggcggccagacc

SEQ ID NO: 4666 - DNA, 630 bp, Streptomyces avermitilis
  CDS (1)..(630)
atgctcctgtggatcaacgggcccttcgggggcggcaaaacacagaccgcacacgagatccagcggcgcctgcccggcagtgtcatctgcgatccggaacacgtcggcttcggtctgcgccgcatgctgccgcccggactgcgcgcgaacttccaggacctcgcctcctggcggcagggcgtggtcgaggtcctggacctcgcgctcacccggcacgacggggtcgtgatcgcccctatgacgatcaccgactccggctgcttcgcgcagaccgtcggccggctgcgcgaactgggccacgacgtaaggcacttcgcgcttctcgccgagcgcgagaccgtactgcggcggctgcgcgaacgcggcttcggacacctcctgcggtacgttgccgggaaggacgcccccttgcgcggggagagctgggcggtcgggcagctcgaccactgcctggagcggctgcgcgaaccggagttcggcgagcacctgtggaccgaccagtcgaccgtgccgaagacggccgaccggatcgccgtactggcggggctgacgctcgccccgaacacggagggcgcgctgcggacgcggctgcggcaggtgcgggtcggagtgaagcacatgcggttcgac

SEQ ID NO: 4667 - DNA, 1122 bp, Streptomyces avermitilis
  CDS (1)..(1122)
atgagcgtgtgcatcgacatcacggggctgccggccgagcggatcgtcttcgagacgtcgccgctggccgagctggcggtcgccctgcacgccctcgccgagcccggccatcacccggcgacgcagggctgggcgaccgcgatcagcgccgcgctgaagccggacctggccgaccggctgagcgaggcggacttcctgtggcggagcacgttctcggacatcttcatgcccttcgcgggcgtcgccgggggccacgtccggccgggggcgacgctcgccgaggacctggacatcctggaccggctggacgacgaggagttcgtcacggcggctctggagttcagctgcggctcccagtacgcggccgggctgccctccccgctggtcgaccgcgcgcgccacgccatcgccctggagctggcggccagccgcggccccaggcaactgggcttcacccagcggctgctggcggacccgccgaccgtacgggcctgggtgcgccgtctgttggaggactgcgacgaggcgttcttcgccgacacctggcgccgggtgcacccccaactggccgccgacgcccggcacaagacggagctcctgcgccacaagggactcgaggaggcactcacctcggtctcggccgcgctgtcgctgaacacggccgggggccgcacccgcatcgaggcggacaagctcgcccacggcgcggcgaccgcgacggaccccgccgtcggcccgggcgtcaccttcgtcccgtcgtaccacggctggccgcatctgctggtgctgcacgcctcgggctggcggccggtcgtgcactacccggtcgcggcgcccgagctgccgagcgcggcctcggtggagctgctcaagctgcgcctggaagcgctcgcccatccggtccggctgcgcctgtgccggtacatagccagggcgccgtacaccaccggagagctggcgcacgcgcacgacctgagcgcgccggaggtctcacggcacctcaccgtcctgaagaaggcggggctcctgacgacgcgccgccgcggccggtacgtgctgcatcagctggacgtgacggtggtggcgcgcctggggagcgacttcctggaggggatcctcagg

SEQ ID NO: 4668 - DNA, 126 bp, Streptomyces avermitilis
  CDS (1)..(126)
gtgcgcacccgtccgtgggccggacggcccgccagtaccgcgcggaaccggcggtactcgcgcagctcgcgcgcggtccgccggtcatgggtgcccggcgcgggcggcacgggctcgccgagccgc

SEQ ID NO: 4669 - DNA, 1239 bp, Streptomyces avermitilis
  CDS (1)..(1239)
atgagcgatacggcggagcagggcgaggaacgggcggcggagcgggccggggaggcgtcggcggaggggaccggggagacatctgcggaggggaccggggaggcgtcggctcagctgcggcgcgcgcggcggacggcggcctaccggggggcccggcgcgtcctgtcgcgccccgggttccgggccaccatcagggagcggctggcgctcctggaggacgcgtcgcggctgtacgacctggacgagtccgtggacatgtacggggacgggatcgtcgcggccctggaggagcgggtcgccgggctgctgggcatggaggccgcggcgttcttccccaccgggacgatggcccagcaggtggccctgcgctgctgggcgggtcgtaccggcaacccgaccgtggcgctgcacgcgctgagccaccccgaagtgcacgaacggaacgcgctcggcacggtcggcggactgcgcccggtccgcgtgacggacgagccccggctgccgaccgccgacgaggtgcgcgacttcgaggagcccttcggggccctcatgctcgaactgcccctgcgggacgtcggctacgtcctgccctcctgggaggagctgtccgaggtcgtggcggccgcccgggaacgtgacgcggtggtccacttcgacggcgcacgcctgtgggagtgcacaccccacttcagccgccccctggacgagatcgcgggcctcgcggacagcgtctacgtgtcgttctacaaatcgctcggcgggttcagcggcgcggcactggccggcccgaaaaccctggtcgacgaggcgaagacctggcggcaccggtacggcggcatggtcgtccaacagttcccggcggtgctgtccgcgctggccgggctggaggaggagctgccccggctgccggagtacgtggcgcacgcgcgcgtggtcgccgcggcgctgcgcgaggggttcgcggcggcgggggtgccctggctgcgcgtgcaccccgaggagccgcacacccatgagttccagctctggctgccgtacgaccccgaggtggtgacggaagccgccacgcggcaggccgaggagaccgggaccttcctgttcgccaacgcctggacccgcggcgggccgggcctggcggtcaccgaggtctccgtacgggcgcacggccttcagtggacggccgaagacgtcaaggcggccgtccaggagttcgtgacgcgcctgcccggcgctgccggg

SEQ ID NO: 4670 - DNA, 918 bp, Streptomyces avermitilis
  CDS (1)..(918)
gtgagtacattccaacagccagaccccagggaccgccccgcgcggctcaccgtcggtgtcgtcggagccggccgggtcggccccgccctggcggcgtcgctccagctcgccgggcaccgcccggtggccgtctccggggtctccgacacctccgtgcgccgggccgcggcgatgctgcccgacgtgccgctggtgaccccggcgcaggttctcgagcgcgccgatctcgtcctgctgaccgtcccggacgacgccctgcccggcctggtcgaggggctcgccgagaccggtgccgtacgccccgggcagctgctcgtgcacacctccgggcgctacggcacgaaggtcctggaccccgcgcgcagcgcgggcgccctgccgctcgcgctgcacccggcgatgaccttcaccggcaccgccgtggacgtccagcggctggccggctgctccttcggagtcaccgcgcccgacgagctgcgcctcgccgccgaggccctggtgatcgagatgggcggcgagcccgagtggatcgccgaggagaaccggccgctctaccacgcggctctcgccctcggcgccaaccacctggtcaccctggtcgccgagtccatggaactgctgcgcaccgcgggcgtcgaggcccccgaccacatgctcggcccgctcctcggcgccgctctcgacaacgccctgcgctccggtgacggggccctcaccggccccgtcgcgcgcggggacgcgggcacggtcgccgcgcacgtcgccgagctgcgcaagcacgccccggggaccgtgcccggctatctcgcgatggcccgcgcgaccgccgaccgcgcgctcgcccacgggctgctcaagccggaactcgcagaggacctcctcggggtactcgccaacggcaccgagggagatgccgga

SEQ ID NO: 4671 - DNA, 999 bp, Streptomyces avermitilis
  CDS (1)..(999)
atgaccaccaccctgctgcgcaccgccgacgaactgcacgcgcgtgtgcgccacggccgccgggccgtcgtgatgaccatgggcgccctccatgagggtcacgcgaccctgatccgcaccgcccgcgagatcgccggggccgagggcgaagtcgtcgtcaccgtcttcgtgaaccccctccagttcggccggggcgaagacctcgaccgctacccgcgcaccctcgacgccgacctcaagatcgccgaggcggcgggtgccgacgtcgtgttcgccccgtccgcggacgaggtctaccccggcggcgaaccccaggtgcgcatctccgcgggccccatgggcgagcgcctcgaaggagcctttcgccccggtcacttcgacggcatgctcaccgtcgtcggcaagctgctgcacctcacccgccccgacgtggcgctgtacgggcagaaggacgcccagcagctcgccctgatccgccgcatggcgcgcgacctcaacttcggcgtggagatcgtcggcgtgcccaccgtgcgcgaggacgacggcctggccctgtccagccgcaaccgctacctcgccgccgacgagcgccgcaccgcactcgcgctctcccaggcgctgttcgccggccgcgaccggcacgccgcccaggaggcgctgcgcgcgcgggcccgcgaagtgcccgccacgcgcgcgcgtgccgaggccctcagcgccataggggagtcccgcgccgccgccgacgcgcacgcggtcgccaaggcgacccccgcgggcacctcggggcccgccgccgtccggtgcgccgcccgcctcgtgctggaggaagccgcccggctgcagccgccgctggtcctcgactacctgggcctggtcgacccctcggacttcaccgagattcccgacgacttcaccggcgaggcggtcctcgccgtcgccgcccgggtcgggacgacccggctgatcgacaacattcccctcaccttcggagccgcctcg

SEQ ID NO: 4672 - DNA, 1815 bp, Streptomyces avermitilis
  CDS (1)..(1815)
gtgaccggcacaggtactggcagcacaggcataggaccgcacggcaccggtacgggcatacgcctgcacgcgcccgcccccggctggtccatcgccgccgacgtcgtggtcgtcggctccggcgtggccggcctgaccgcggccctgcgctgcgaggccgcgggcctgacgacggtcgtcgtcaccaaggcccacctcgacgacggctccacccgctgggcccagggcggcatcgccgcggccctcggcgagggcgacacccccgaacagcacctcgacgacacgctggtggcgggcgcgggcctgtgcgacgaggaggccgtacgcatcctcgtcaccgagggccccgacgccgtacgccggctgatcgcgaccggcgcccacttcgacgagtcctccgagggcggcctcgaactcacccgcgagggcggccaccaccgccgccgcatcgcccacgcgggcggcgacgcgaccggcgcggagatctcccgtgccctcgtcgaggcggttcgcgcgcgcggcctgcgcaccgtggagaacgcgctcgtcctggacctcctcacggacgccgagggacgcaccgcgggtgtcaccctgcacgtcatgggagaaggccagcacgacggcgtaggagcggtccacgcccccgccgtggtcctcgccaccggcggcatgggccaggtcttctcggcgaccaccaacccgtccgtgtccaccggcgacggcgtggcgctcgccctgcgcgccggagcggaggtcagcgacctggagttcgtccagttccacccgaccgtgctcttcctgggcgcggacgcggagggccagcagcccctcgtctccgaagcggtacgcggcgagggcgcccacctggtcgacgcggacggcgtgcgcttcatggtggggcagcacgagctggccgaactcgccccccgggacatcgtcgccaagggcatcatgcgccgcatgcaggagcaggacgccgagcacatgttcctggacgcccggcacttcggcgccgccatgtgggaacaccgcttcccgacgatcctggccgcctgccgcgcccacggcatcgacccggtgcacgagcccgtccccgtcgccccggccgcccactacgcctccggaggcgtccgcacggactcccggggccgtacgaccgtgccgggcctgtacgcgtgcggtgaggtcgcctgcaccggcgtccacggtgccaaccgactggcctcgaactccctcctggagggcctggtctacgccgagcgcatcgccgccgacatcgcggcgggccccgcggagaacgcccgccacgcgcgcgtgccgcagccggtcccgcagccggagaagccggcccacccgctgctggcccccgaggcccgtttcgcgatccagcggatcatggcggacggagcgggcgtcctgcgctcggccgagtccctcgcgaaggccgccgaccgcctccagcaactgcacacggacgcccgcgacgccctagacgagaacggcaagacggccgagccgggcgtcgacacctgggaggccaccaacctcctgtgcgtggcccgcgtcctggtcgccgccgcccaggtgcgtgaggagacccgcggctgccactggcgcgaggaccacgccgaccgcgacgacaccacctggcgccgccacatcgtcgtacggctgaatccggatcgcgcactcgccgtacgcaccaccgacacagcagacttccccccgaccctccccccggcgctcggctccgcccgagcgggggaggcccccatggcccgaccggcgcgtccgtcccgtccccaggagcag

SEQ ID NO: 4673 - DNA, 993 bp, Streptomyces avermitilis
  CDS (1)..(993)
gtgacagaagtgagcacccccgaccttcccctcgcccagagcggcggctgcggcgacggctgcgcctgcggcaccggccccggcgaggagcacgaggagtacatggagtgcggcctcgaccccgcgctcgcccagctcctggccgacgccggactcgaccccctggaggtcgaggacatcgccaacgtcgccatccaggaggacctcgaccacggcgtggacgtcacgacggtcgcgacgatctccgaggacgccgtcgccaccgccgacttcaccgcgcgcgaggcgggcgtggtggcgggcctcagggtcgccgaggccgtgatctcggtggtctgcacggacgagttcgaggtggagcgccacgtcgacgacggcgaccgcgtcgaagagggccagaagctcctcaccgtcaccacccgcacccgcgaccttctgacggccgaacgcagcgcactgaacctcctgtgccgcctgtcgggcatcgcgacggccacgcgcgcgtgggcggacgccctggcggccacggacaccaaggtccgtgacacccgcaagacgaccccgggcctgcgctccctggagaagttcgccgtacgctgcggcggcggcgtcaaccaccgcatgtccctgtcggacgcggccctggtcaaggacaaccacgtgatggccgcgggcggggtggcgcaggcattccgggcggtcggcgagatgttcccggacgtaccgatcgaggtcgaggtcgacaccctccaccagctgcgcgaggtggtggacgcgggcgccgacctgatcctcctggacaacttcacgccgaccgagtgcgaagaggccgtggcgatcgtcaacggccgcgccctcctggaggcgtcgggccgcctgaccctcggcaacgcggaggcgtacgcgaagaccggcgtcgacttcctcgccgtcggcgcgctcacccactcctcaccgatcctggacatcggcctcgatctgcgagcggcggag

SEQ ID NO: 4674 - DNA, 795 bp, Streptomyces avermitilis
  CDS (1)..(795)
atgctgctgaccatcgacgtaggcaacacgcacaccgttctgggcctcttcgacggcgaggacatcgtcgaacactggcgcatctccacggacgcccgccgcaccgcggacgaactggcggtactcctccagggcctgatgggcatgcacccgctgctgggcgaggaactcggcgacggcatcgacgggatcgcgatctgctcgacggtcccgtcggtcctgcacgaactccgcgaggtcacccgccgctactacggtgacgtacccgcggtcctcgtggaaccgggcatcaagacgggcgtcccgatcctgatggacaaccccaaggaggtcggggcggaccgcatcatcaacgcggtggcggccgtcgagctctacgggggcccggcgatcgtcgtggacttcggcacggcgacgacgttcgacgcggtgtcggcgcgcggcgagtacgcgggcggcgtgatcgcccccggcatcgagatctcggtcgaggcgctgggggtccgcggcgcccagctccgcaagatcgaactggcccgtccgcgcgcggtgatcggcaagaacacggtcgaggcgatgcaggcgggcatcgtctacggcttcgcgggccaggtggacggcgtggtcacgcgcatggcacgcgaactcgcggacgacccggacgacgtcacggtcatcgcgacgggcggtctggcgccgatggtcctgggcgaggcctcggtgatcgacgagcacgagccgtggctcaccttgatcggcctccgtctcgtgtacgaacgaaacatctcccgcacg

SEQ ID NO: 4675 - DNA, 720 bp, Streptomyces avermitilis
  CDS (1)..(720)
atgcccacgccatacggatcccgcggcggcatggcgttcggtgcggaggagctgcgtgtgctccgccgctccctcgccctcgccctccaccccggctcagcctccgccgaggacgtgcaggactgcctccgcctcgccgagtccgtcgacgaggcggcccgcgagagcgcccgtctcagggccttcctgctcgccgacctcgcccgctaccgcgccgccctgcccggcacggtcagcggcttccttcccctcctccaggacgctctcgacgccggctaccgcccgaccccggacgacctcgccgccctccgcgccctgcgcggcaaccccgccgcagccgccctgctgtaccgctgccgcatcctggccgagcgtggcgtacgcgcccgcccggccacccgcccgacggcgtccacaagccccaccgacgcccgccctgccgccgcccccctctccctctccatccccgcctcccgcacccgcctcctcgccctcccgggcggccgcgcggccgaaggcccggacggaaagccggcggagaagcccgccccggcccccacccccaagcccacgccgcagaagaccccccgacccgaccggcccatccccaccccgggcgaggtcttccctccgaagcgcaagcccggcccgcccgccaccgccgctccacccgtcccccaggtcccacccgcgaaccccccacaccaactcgcggcgggc

SEQ ID NO: 4676 - DNA, 177 bp, Streptomyces avermitilis
  CDS (1)..(177)
atggactacgtctccgcgctcgtgccccccgttgtgatggccgtgttcttcatcggtctgatcgtgacgatcgtgaagagccagggcggtgccaacaaggccaaggaggacgcgttcgtcgacgcgaccctcgcgcgcgcggacagcgcccgccaggcctccggtgacaccggcgtc

SEQ ID NO: 4677 - DNA, 531 bp, Streptomyces avermitilis
  CDS (1)..(531)
atgacgcgggtgtggaagtggaaccgcccggtgaccgttcgagaagtcctggaagatcttcagcgggaacggtccatcgcctacaccacggtgatgaccgttttggacaatctccatcagaagggctgggtacgccgcgaagcggaaggccgggcctatcgatatgaggcggtctccacccgtgccgcctacgcggccgcgctgatgaacgacgcctggtcgcagagcgacaacccggccgccgcactcgtcgccttcttcggcatgatgagcgaggaacagcggcaggcgctccgcgacgccatgcgcatcgcacaaggccccgaagccgccgaatcacacgaaaccttcgcccgcgccactgagaagcaggccgagaacagggacgagaacccggacgagaaggcggccgggaaggccggccggaacccggacgagaaggcggacgagaaggcggacgagaaccagggccggaacccggaggggatcgtcgccgagaaccccgcctccgccgagggcgaccccgggcga

SEQ ID NO: 4678 - DNA, 540 bp, Streptomyces avermitilis
  CDS (1)..(540)
gtggagaagcccgcagagcgcgcccccgaagtcagcgcaaaagccatcaccgtccggcgggccaggaccagcgatgtcccggcggtgcgccgcctcctcgactcgtacgtccgacgcggcatcctgctcgacaaagcgacggtgacgctttacgaggacatccaggagttctgggtcgcggaacgggatgacaacgccgaggtcctcggctgcggcgcgctccatgtgatgtgggaagacctcgcggaagtccgcactcttgcggtgaacccggacgccaaggggctcggcgtcggtcaccagttgctgggcaagttgctgcagaccgcccgctggctgggtgttcgccgtgttttctgtctgaccttcgaagtggacttcttcgggaagcacggcttcgtggagatcggagagacgcccgttgacaccgatgtctacgccgagctgctgcgttcctatgacgagggcgtagcagagttcctcggtctcgaacgagtgaaaccgaacaccttgggcaacagccggatgcttctgcatctg

SEQ ID NO: 4679 - DNA, 333 bp, Streptomyces avermitilis
  CDS (1)..(333)
gtggcacagaaggttcaggtccttcttgtcgacgacctcgacggtggcgaggccgacgagaccgtgacgttcgcgctggacggcaagacgtacgagatcgatctcacgaccgccaatgcggacaagcttcgtggccttctcgagccctacgtgaagggcggccgtcgcaccggaggccgtgcttcgggtggacgtggaaaggcgcgggtcgcttccggcggcagccaggacaccgcgcagatccgcgcttgggcgaaggagaacggttacgaggtcaacgaccgtggccgagttccggcgtccattcgtgaggcctacgagaaggccaacggc

SEQ ID NO: 4680 - DNA, 699 bp, Streptomyces avermitilis
  CDS (1)..(699)
atggtccacaccgtgcctctcccgcgcaggccgttcgccccggttgacccgggtcgtcccgacggtcccgacggccccggggatctcggtggtgcgggggttccgggtggtccaggggttccgggtggcgcggggtttccgggcggtcccggcgggccgggcggtcgcgtgcggcagtggtacgagcacgagctgggctgggtcaccatgcccggcctgccgctgaggctggccacaggcctgcgcttcgacgtcctggacgtgcccgccgcggcgggattcccggcgctgcggcacctggggcccgccaccccggtggctcttcagggagaccggatgcggctgctcgtggccgcgggcagcgcggacgaactaccggggctgctggactggctggagtggggcgcgctgcccctggacctcacggcgatcggtacaggcgggcacatcgaggcgccccggccgtcgggcctcaacgggtcccggccgctccccctgggccgggccggttcacagggggccgccgtctggctgcggccccccgagccggggtgcgaagtggaagcctcgctgccgacgctgtcggccgtggggggcgatggtgatgcccccgacctcgtacgactggtggacacgatggcgacgcaatgccaccggatccggctgcggcgctcgtgcgctcagccgttggccttctcg

SEQ ID NO: 4681 - DNA, 2523 bp, Streptomyces avermitilis
  CDS (1)..(2523)
atgttcgagaggttcaccgaccgcgcgcggcgggttgtcgtcctggctcaggaagaagcccggatgctcaaccacaactacatcggcaccgagcacatcctcctgggcctgatccacgagggtgagggtgtcgccgctaaggccctggagagcctcgggatttcgctcgaggcggtccgccagcaggtggaggagatcatcggccagggccagcaggccccgtccgggcacatccccttcactccccgtgccaagaaggtcctggagctgtcgctccgcgaggcccttcagctgggccacaactacatcggcacggagcacatcctgctcggcctgatccgtgagggcgagggtgtcgccgcccaggtcctggtcaagctgggcgcagacctcaaccgggtgcggcagcaggtcatccagctgctctccggttaccagggcaaggagaccgccgccgccggcggtcctgccgagggcaccccctccacgtccctggtcctcgaccagttcggccggaatctcacccaggccgctcgtgagtccaagctcgacccggtcatcgggcgcgagaaggagatcgagcgggtcatgcaggtgctgtcccgccgtacgaagaacaacccggtcctgatcggtgagcccggtgtcggcaagaccgccgtcgtcgagggcctcgctcaggcgatcgtcaagggcgaggtgcccgagaccctcaaggacaagcacctctacaccctggacctgggtgcgctggtcgccggttcccgctaccgcggtgacttcgaggagcgcctgaagaaggtgctgaaggagatccgcacccgcggcgacatcatcctgttcatcgacgagctgcacacgctcgtcggtgcgggtgccgccgagggcgccatcgacgcggcttcgatcctgaagccgatgctggcccgcggtgagctgcagaccatcggcgccaccacactcgacgaataccgcaagcacctcgagaaggacgcggccctcgagcgccgcttccagccgatccaggtggcggagccttccctcccccacacgatcgagatcctcaagggcctgcgcgaccgttacgaggcacaccaccgcgtctccatcacggacgaggctctcgtccaggccgcgacgctcgcggaccgttacatctcggaccgcttcctcccggacaaggcgatcgacctgatcgacgaggcgggttcccggatgcggatccgccggatgaccgcgccgccggacctgcgcgagttcgacgagaagatcgcgggcgtgcgccgcgacaaggagtccgcgatcgactcgcaggacttcgagaaggcggcttctctccgcgacaaggagaagcagctcctggccgcgaaggccaagcgggagaaggagtggaaggccggcgacatggacgtcgtcgccgaggtcgacggcgagctgatcgccgaggtcctcgcgaccgccaccggcatcccggtcttcaagctgaccgaggaggagtcctcgcgcctgctgcgcatggaggacgagctccacaagcgggtcatcggccagaaggacgccgtcaaggcgctctcgaaggcgatccgtcgtacgcgtgcgggtctgaaggacccgaagcggccgggtggttcgttcatcttcgcgggcccgtccggtgtcggtaagaccgagctgtccaaggcgctcgccgagttcctgttcggtgacgaggacgcgctgatctccctcgacatgtcggagttcagcgagaagcacacggtctcgcgtctgttcggttcgcctcccggctacgtgggctacgaagagggcgggcagctgaccgagaaggtccgccgcaagccgttctccgtcgtcctgttcgacgaggtcgagaaggcccacccggacatcttcaactcgctgctccagatcctggaggacggtcgtctgaccgactcccagggccgggtcgtggacttcaagaacacggtcatcatcatgacgaccaacctcggcacccgggacatctccaagggcttcaacctgggcttcgccgcccagggcgacacgaagtccaactacgagcgcatgaagaacaaggtcgcggacgagctcaagcagcacttccgccccgagttcctcaaccgcgtcgacgacgtggtcgtcttcccgcagctcacccaggacgacatcctccggatcgtcgacctgatgatcaccaaggtcgacgagcgcctcaaggaccgggacatgggcatcgaactcgcccagtccgcgaaggaactgctcgcgaagaagggttacgaccccgttctgggcgcgcggccgctgcgccgcacgatccagcgcgagatcgaggacaccctctccgagaagatcctcttcggggagctgcgtccgggccacatcgtggtcgtcgacacggagggcgagggcgagaccaagaccttcaccttccgtggcgaggagaagtcggccctgcccgacgtccccccgatcgagcaggcggccggcggcgccggtccgaacctgagcaaggacgcg

SEQ ID NO: 4682 - DNA, 3117 bp, Streptomyces avermitilis
  CDS (1)..(3117)
atggaagcagcgtccatcggcgtcaagctggcctcgagcgtggtcaccccgctcgtcaagaagctcttcgtggccgaggggccgggagccgggctcgtcgaaaagcccgtacgcgtatcggagttcgtgtcgttcaagggtgagaaacgcgccctcgccgagaaggaactcaccaagctcgcggccgagttggtccggagagccgtcaagtcggagggcgagcggccgctcccggtggacgaggagcccgccgtcgtgcacgccctcgcccgcaccctgcactccctcggcgacctcgacatgacggacgtacaggccgtgcggctcggtcaccagaccctcgccctgcatctgcgggtcgcgagcgaggcccccgaccgccatctctccctcgacgccaccctcttctacgagcgtctcctcgaaaacgcctgcctgcacatcctgcacttcttcacccagcgctccacctttgtggcccgcacgctcgtcgagcagacccggcggcagagcgaactcatcgcgaagatcgacgagttgatcgcccggactcccccgaccggcggcacggacccctccttcgaggagcgctatctcgcctacgtcgccaccaagcacagccgcctcaccatctacggcatcgacctcgtgaactcccccgagcgctggcccctcgacgccgcctacctcagcatccaggcactgcgtcccgcggaggacaacgacaccaccgccggaatcgccgccccccacaccaccctgcccgccgaacaggcattcgcggagcacgacttggtgctgctgcgcggtgtcgccggttccggcaagaccacgctcgtgcagtggctggccgtgaccacggcccggggggagcgcggcgaccgcgttccgttcgtgctgccgctgcggagcctcgtacggcggcccggcggactgcccgcccccgacggcttcctcgacgccgtccgcgtccccttccacgccacccagccggacggctgggcggaccgggtgctgagcgcccggcgcgggctgctcctcgtcgacgggatcgacgagatacccgagcgggaacgggagcggacccggcgatggctgcgcgagctgctggacgtctaccccggcaaccagtggctggtgacctcccgcccctccgccgtgcgtgagaactggctcaccccggacggcttcaccgaactcatgctctcccccatggaccgcgacgacgtcgccgcgttcgtccgccgctggcacaccgccgcccgcatcgacgcctccgacaccgaacgcctcgacggctacgaacgctcgctcctcgacgccgtcgggaccaagcccgccctcggccgcctcgccaccaaccccctgatgtgcgggctcatctgcgccctgcaccgcgaccggcgcggctatctgccgcacggacggcaggagttgtacgacgccgccctgtcgatgctgctgtcgcgccgcgacgaggagcgggacatgttcctgccgggccaggaccacggcatccacctcaccgagctcccccagatccagctcctccagcgcctcgcctactggctcatccgcaacaaccagtccgagatggaccgggagcgcgcgcagcggatcgtggccgacgtcctgccgtccctgccgtccgccgccgcacagggcgacgccgagcagatcctgcgccacctcctcgtccgcagcggcctgctgcgcgaacccgccctcggcaccgtcgagttcgtccaccgcaccttccaggactatctgggagcgaaggccgcggtcgaggacggcgacttcgggatgctcgtccgcaatgccgtcgacgagcagtgggcggacgtcatccggatggcggtggcgcatgcacggccgcgtgaacgggcccagctgctgggcgacttgagcgagacggcggggcggctcgacgaaccggccggcacccgcgtacggctcctcgcgctcgcctccctggaacacgcgacggaactcgacccgcgtatccgagccgtcgtggaggggaacgccgccccgctcatccctcctcgtacgtcgcaggaggcccgcgcgctcgcccaggccgggccgctcgtcctggaactcctccccgggcccgacggactcaccgacgccgaggcgcgggccgtggtcgtcaccgcctccctggtcggtacggacgccgccatccccgtgctggcccgcttccgctcgcacccctccctgccggtacgggcccagctgacgtggacctggcaccggttcgacacggagcggtacgcggaggaggtcatcgcccatctccggccggaggggctgtacttcaccgcgcagtcggcctccgaactgcgggtactgcgcgaactgggcggaccgtccctgctccagctcgtcggcgacatcgacccggccgacatccgctccgccctccgccccggccagctgcgcgagctcgtcgtacgcgacaatcgtggcctgcgtgacctgcggttcctgtcggaccagggccggctcacccgcctggacctcagcggtctccccctcgacgacctgacaccgctcgccgagctgcccctcacctggctgtcgctcgccctgctgccgggcctcgaagcaccggactccctgagccccctgtccggctcgtccaccctgaactcgctcgacatcggcatccccctgcgcaccgactccctcgacgcggctctccccagggaactgcccctggaatatctacgattcaccaggaacgcgctcgcgttcaccagactgcgcggcctgcgccacaggcactcggtgaagacgctgagcctcgccaaccttccggtaaggctcacccctccggagttcgcggagatcacccggctgcccgcgctggaggaattgcgcgtcaactggaatgcgaccgggtgggaggcgggcccggttctcccacgcgtcacccgtctgcggctcaacaagttctccggcaatgaggacctgacgaaagcacccggtctctttccgggggtgcgtacggtcacccttcacctcgctccggacgtgaccggcgtaccggaccacgtcctcgggctcttcccgagccgtcccgtcatcgagaggaccgacagcgtgctg

SEQ ID NO: 4683 - DNA, 555 bp, Streptomyces avermitilis
  CDS (1)..(555)
atggatcccgtggtcctcggcacgcggccggcctcgagcctcgtcgcaccgctggtgaagaagctcttcgtacgcgaggcgcccggcgcgggcccggtggaccggccggtacgcctgtccgctctggtctccttccgcggcgagcagcggtcgccggcggagaagggcgtggcgaaactcgccgcgcggctcgtccgggaggcggtggactcaccgggcgagcgcccgttcccgccggacgagaagacggcggtcacggacgtccgcagccgcaggctcctcgccctcggggtgcgcaattccggacagcggacggcgccgcgcggcatcgggccacggtccggggccaggttcaacggcgagtacgagacgcacgacatgctgtcggtcctcgccccggaggtgctgaccagccccctccggctgcgggagctgaccccgcggggagtcggcggtctcgccgggctccgcgcgctcaccacgttgcgtctgcacggcgcacgtcaccgtcgccgaaaccgagtgatgcccgcatgccgtcggctgacccacaat

SEQ ID NO: 4684 - DNA, 609 bp, Streptomyces avermitilis
  CDS (1)..(609)
atgtcgaagcgcgtcacgtcccgtctctcccgtacgtccctgatccgtaagcgtgcggccgccctggccgtgggcctgggggcctcggccgtgctgggcgccggggtcgcgtccgccgccgacaccgggctccacgccagtgcggccggtgccgtgcagacccaggccgccgcggccaagaaggcgccctccgcctcctggatcgacccggtcaagaagtacgcgctctccgcgggcttcaaccaggccggcggcatgtgggcccacaagcactccggtcaggacttcgccgtgcccagcggtaccgaggtcctcgccgcgcacggcggcaccgtcgtcaaggccggcggcaacggcgccggtgacggtcccgcgtacggcaacgccatcgtcatcaagcacggcaacggcacctactcccagtacgcccatctgtcgcgcatcgacgtgcggatcgggcaggtcgtcgccaccggtcagcacatcgcgctctccggcaacaccggtaactccagcggcccgcacctgcacttcgagatccgtacgaccccgaactacgggtccggcatcgaccccgtcgccttcctccgggcccacggcgtcaccgtc

SEQ ID NO: 4685 - DNA, 573 bp, Streptomyces avermitilis
  CDS (1)..(573)
atggacggcaccaagcgacagcgccgcggggacacccgccagcgcatccaggacgtggccctcgaactcttctccgagcagggctacgagaagacgtcactgcgcgagatcgcggagcacctcgatgtcacgaaggcggcgctctactaccacttcaagaccaaggaagagatcctcatcagcctcttcgaggacctgacgaggccgctggacgagctgatcgactggggccggcagcagccacacaccctggagaccaagcagcaggtcctgacccgctacagcgaggccctcaccggcgcggcgccgctcttccgtttcatgcaggagaaccaggcgacggtgcgcgaactgagcgtcggcgagacgttcaaggaccgcatgctcagcatgctcgacatcatcagggagccggaggccgcgctgaccgaccaggtccgctgcgtcagcgcgctcttcacgatgcacgcggggatgttcgtcctcaaagacgtcgaaggcgaccccgaggacaagcgcaaggctgtcctggaggtcgcgatcgacttggtgacccaggcgcacggcgccgcc

SEQ ID NO: 4686 - DNA, 1611 bp, Streptomyces avermitilis
  CDS (1)..(1611)
gtggcggacaacacaggagcgggtggcagcggcgacagcgccgtcggcaccgagaaacagccgcgcagcgtacgggtcgtactgctcgcgctcatgatcgcgatgctgctcgcgatgctggacaacatgatcgtcggcaccgcgatgccgaccatcgtgggcgaactgggcgggctccagcacctgtcgtgggtggtcaccgcgtacaccctcgcgaccgccgcctccaccccgctgtggggcaagatcggcgacatgtacgggcgcaagggcgccttcatgacctcgatcgtgatcttcctgatcggctccgcgctgagcggcatggcccaggacatggggcagctcatcgggttccgggccgttcagggcctcggtgccggcgggctcatggtcggcgtcatggccatcatcggggatctcattccgccccgtgagcgcggcaagtaccagggcatgatggccggtgtgatggcgctcgcgatgatcgccggaccgctggtcggcggcaccatcaccgaccacctgggctggcgctggtcgttctacatcaacctgccgctgggcgccgtggcgctggccgccgtcagcgccgtgctgcacctgccgaagaagcgctcgcaggcgcggatcgactacctgggcgccggtctgctgaccgtcggcatcacctccatcgtgctcgtcaccacctggggcggcagcgagtacgcctggggctccgccgtgatcatggagctcatcgggatcggtgtcgccgcgctcgtgggcttcgtcttctggcagaccaaggcggccgagccggtcatgccgctgcacatcttccgcagcctcaacttcacgctgatgtccgtcatcggcttcatcaccggcttcgtgatgttcggcgccgtcctcttcctgccgctgtaccagcagtcggtgcagggcgcgtccgcgaccaactccgggctgctgctcctgccgatgctcggcgcgatgctggccgtctcgatggtcgccggacgggtcaccaccaacagcggcaagtacaaggtcttcccgatcgtcggcagcgtgctgatgacggcggggctgttcctgctcgcccagatggacacggacaccagccggttcacctccggtgtgtacatggcggtgctcggcgcgggcatgggctgcctgatgcagatcaccatgctggtcgcgcagaacagcgtcgagatgaaggacatgggcgtcgcctcgtcctcgaccacgctgttccggaccctcggctcgtccttcggcgtcgcgatcatgggcgcgctgttcaaccagcgggtcgaggacgagatggccgcgcgggccggggcgctgggctccaaggtgaccgagcagtcggcgcagctggacgcggcgagcctggcgaagctgccggtcgcggcccgggaggcgtaccagtacgcggtctccgccggtacgcactccgcgttcctgctgggctcggtggtcgccgtggtcgcgctggtcgcctcggtgttcgtgaaggaggtcccgctcaagggggcggggccgcagaagccggccgaggacgcggctggggacgccgcgagtgacgtgccgccgaagcagacggtggcagagtccgtc

SEQ ID NO: 4687 - DNA, 1461 bp, Streptomyces avermitilis
  CDS (1)..(1461)
atgcgggggaatcttcggcgcccgggtccggccggtacggcgggcccggggcgcacgggcatccgcaccagcgccgacgggggacgcgcgcgcccccggaccggagcgggcaccggcgtgcgcgcgggcgtccggtccggtgtcgtaggggtcggcgcgggcatccgcaccggtgtgaggtggaagatcagcgcggcgatcgcgctggtcggcgcgctggtggcgctcgcactgagcctggtcgtgcacaacgccgcgcgggtgtcgatgctggacaacgcgcgtgacctggcggacgagcgcatccaggtcgccgagcgcatgtacgaggcgggccgggcccagagcttcggggtcaagctcgacgacccggccatcccgagggacctgatgatgaaggtcacgcagggccggcgggcgacgtacgtggccgacgggccgcacggcgtgccggacatctgggccgccgtaccgctcaaggacggccgggttctctcgctgcacacccggttcacggaccgcagcgcggacatcatgaaggacctcgaccaggcgctgatcatcggctcgatcgcggtcgtcttcggcggctccgcgctcggtgtgctcatcggcggccagctgtcgcggcggctgcgcaaggcggcggccgcggcgaaccaggtcgcccagggcgagcgcgacgtacgggtgcgggacgccatcggcggtgtcgtacgcgacgagacggacgatctcgcgcgggccgtggacgcgatggcggacgcgctccagcagcgcatcgaggccgagcgccgggtcaccgccgacatcgcgcacgagctgcgcactccggtgaccggcctgctgacggccgcggagctgctgccgcccggccgccccacggagctcgtccgcgaccgggcgcaggccatgcgcacgctcgtcgaggacgtcctggaggtcgcgcggctcgacggggcgtccgagcgggccgagttgcaggacatcatgctcggcgagttcgtgtcccggcgggtggcggcgaaggacgcggacatcgaggtgcgggtggtccacgagtcggaggtcacgacggacccgcgccgtctggagcgcgtgctgttcaacctgctcgccaacgcggcgcggcacggcaagccgccgatcgaggtctccgtcgagggccgggtgatccgcgtgcgcgaccacggtcccggtttccccgaggaactgctcgccgacggcccccgtcgcttccgtacgggcagcacggaccgtgccggccacgggcacggcctcggactgacgatcgcggcgggccaggcgcgggtgctcggcgcccggctgaccttccgcaacgtacgccccgcgggcgccccgggcgacgtaccggccgagggcgcggtggcggtgctgtggctgccggagcacgcaccgacgaacaccgggagcttcccgatgctgccactgtcgggcggc

SEQ ID NO: 4688 - DNA, 705 bp, Streptomyces avermitilis
  CDS (1)..(705)
atggcagagcagacccacgtcctgttcgtcgaggacgacgacgtcatccgcgaggccacccaactcgcgctggagcgcgacggcttcgcggtcaccgccatgcccgacggcctgtcgggcctggaggcgttccgcgcgaaccgccccgacatcgccctcctcgacgtcatggtccccgggctcgacggcgtctcgctgtgccgccgcatccgggacgagtcgactgtgcccgtgatcatgctgtccgcgcgcgccgactcgatcgatgtcgtgctgggcctggaggcgggcgccgacgactatgtgaccaagcccttcgacggagcggtcctcgtcgcacgcatccgcgcggtgctgcgccgtttcggccacgcgagcgggccgaactcccggccggccgaggactcctcggcaccggacggcggcgtgctcacgttcggcgaactggagatcgacaccgagggcatggaggtacggcggtccggacagccggtggcactgacaccgaccgagatgcgcctgctcctcgagttctcctcggcgcccggcaccgtactgtcccgcgacaagctgctcgaacgtgtgtgggactacggctggggcggtgacacccgggtcgtggacgtccatgtgcagcggctgcggacgaagatcggccaggaccggatcgacacggtccgtggcttcggctacaagttgaaggcc

SEQ ID NO: 4689 - DNA, 588 bp, Streptomyces avermitilis
  CDS (1)..(588)
gtggccgggctcgccgtcctcggcctttctgtctccgcctgcggcaccggcggcaccggcgcccgggacgagggcccggcgggcagcgactcggtggcggcgggcgcggccacccccacggtctcgcccagcaaggcgcccaagtccgtggacgcggtcaagctcgtcaaggacgacccgaaggtcggcgcggcggtcaagcgcgccctgaagccgtgcgtcgccgacgagtacccggtcgacgtgtcgtacggcgatctgaccggagggtccgcggacgacatcgtggtcaacgtgatgacctgcggtgacgcggtcggcatcggctcgtacgtctatcgcgagcagggccactcgtacgagaatgtgttcagggccgaggaaccgccggtgtacgcggagatcgaccggggtgagctggtggtcacccagcagatgtacgagaaggacgacccggtctcctatccgtccagcgaggaagtgatcacctacagctggtcggcgaaccgcttctccgaggagtcccgcacccacaccgagtacagcaacgcggtgggcggcacggactcggccaccccggcccccaac

SEQ ID NO: 4690 - DNA, 537 bp, Streptomyces avermitilis
  CDS (1)..(537)
atggcgcacggcgaggtgctcgagttcgaagagtacgtacgtacccggcaggacgcgctgctgcgcagtgcacgccgcctggtcccggacccggtcgacgcccaggacctgctccagaccgctctcgtacggacgtacggccgctgggacgggatcgcggacaagcggctggcggacgcgtacctgcgccgcgtaatgatcaacacgcggacggagtggtggcgggcccgcaagctcgaggaggtccccaccgagcagctcccggacgcgtccgtcgacgactccaccgagcagcacgcggaccgcgccctgctgatggacatcctgaaggtgctcgctccgaagcaacgcagtgtcgtcgtgctgcgacactgggagcagatgtccacggaggagacggccgccgcgctcggcatgtcggccggaacggtcaagagcacgctgcaccgggcgctcgcccggctccgcgaggagttggagagccgcgacctggacgcacgcgcgctggagcgtgaggagcgggagcgttgcgcggcc

SEQ ID NO: 4691 - DNA, 939 bp, Streptomyces avermitilis
  CDS (1)..(939)
atgactgcacccacgaagcccacgccaagccaaagcccgagccccacctcccccgcccccggcgccccaggcgaggccctgcacgcccaggtcatcgcatggttcgacgagcacgcccgtgacctcccgtggcgccgccccgacgccggcccctggggcgtgatggtcagtgagttcatgttgcagcagacaccggtcaaccgcgtgctgcccgtctacgagcagtggctcgcccgctggccccgccccgccgacctcgccaaggaggcgcccggcgaagccgtccgcgcctggggccgcctcggctacccccggcgcgcgctgcgcctgcacggcgccgccgtcgccataacggaacgccacaacggcgacgtacccacggagcacgcccagctgctcgcgctgcccggcatcggcgaatacaccgccgcggccgtcgcgtcgttcgcctacggccagcgccacgccgttctcgacaccaacgtccgccgtgtcttcgcccgcgccgtcaccggtgtgcagtacccgcccaacgccaccaccgcagccgagcgcaagctcgcccgcgcgctgctccccgaggacgagagcaccgcgtcccgctgggccgccgcgtccatggagctcggcgcgctggtctgcacggcgaagaacgagacctgccaccgctgcccgatcgccggccagtgcgcctggcgactcgcgggcaagcccgagcacgacgggccgccgcgccgcggccagacgtacgccggtacggaccgtcaggtccgcggcaggctcctcgccgtcctgcgggaagccgtgaccccggttccgcagtcggcgctcgaccgcgtgtgggacgagccggtgcagcgcgcccgcgccctggacggcctggtcgccgacggcctcgtcgagcccctccccggcggcctctaccgcctcccccacagc

SEQ ID NO: 4692 - DNA, 372 bp, Streptomyces avermitilis
  CDS (1)..(372)
ttgacgctgcgcagtctccgtaactcgtacgcccccgaccggacgccgacgttcgagctgaccgccaagaactcctcgggcagcgactgcaaggtcgatttcggcccgaagaactcggtattgacgatcacgcaggccgacggcgacaacgacatctggtcctcggccgactgtcccaaggactccggaagcgccctgttccgtgtcccggcgggcgacagcgcgacgtacacggtgaagtgggaccgcaagcccagtgcccccgagtgcgccacgcctccggccggttcggccgcggcgggaacgtacctggtggaggccaaggcgccgggcttcaaaaaggcccagacgtcattcgtcctggcgaaggac

SEQ ID NO: 4693 - DNA, 1122 bp, Streptomyces avermitilis
  CDS (1)..(1122)
gtggcagccaacgaccgggcagcagctcccggaaaatccggcgggagctccggtgccgatggcctgatgcgcgcctcactgagcgccgtggcgcccggcacggcgctgcgcgacgggcttgaacggattctccggggcaacaccggcggactcatcgtgctcgggtccgacaagaccgtcgaagccatgtgtaccggcggcttcgtgctggacgtcgagttcaccgccacgcgcctgcgtgagctgtgcaagctcgacggcggcatcgtgctctcctcggatctctccaagatcctccgggcgggcgtgcagctggtccccgaccccatgatccccaccgaggagacaggcacgcgccaccgcaccgcggaccgggtgagcaagcaggtcggcttccccgtggtctccgtctcccagtccatgcggctcgtcgcgctgtacgtggacggaatgcgccgcgtcctggaggactcggcggcgatcctgtcccgggccaaccaggccctggcgaccctggagcgctacaagctccgtctggacgaggtggcgggcaccctctccgcgctggagatcgaggatctggtcacggtccgggatgtgtcggcggtggcccagcgtctggagatggtgcgccgcatcgccaccgaaatcgccgaatacgtggtcgaactgggcacggacggacgtcttctggccctccagctggacgagctgatcgccggcgtggagcccgagcgcgagctggtggtccgcgactacgtgcccgagccgacggccaagcgctcccgcacggtcgaccaggcgctgtacgagctggacgcgctcactcacgcggagctgctcgagctcgccaccgtggccaaggcactggggtacacgggttcccccgaggcactggactcggcggtctccccgcgcgggttccgtctgctcgcgaaggtgccgcgcctgccgggtgcgatcatcgaccgcctcgtggagcacttcggcggcctgcagaagctgctcgccgcgagcgtcgacgacctgcagacggtcgacggcgtgggcgaggcgcgggcgcgcagcgtccgggaagggctgtcgcggctggcggagtcttcgattctggagcggtacgtc

SEQ ID NO: 4694 - DNA, 1407 bp, Streptomyces avermitilis
  CDS (1)..(1407)
atggctgcccgtacgaagaccgcgaaggatcggccgtcctaccgctgcacggagtgcggctggcagacggccaagtggctcggccgctgccccgaatgccaggcctgggggacggtcgaggagtacggcacgcccgcggtgcggaccacgacgcccggccgggtcaccacgtccgccctgcccatcggccaggtcgacgggcgccaggccaccgcccgctccaccggcgtacccgagctggaccgtgtcctgggcggcgggctcgtccccggcgcggtcgtcctcctcgcgggcgagcccggcgtcggcaagtccacgctcctgctcgacgtcgcggcgaaggcggcgagcgacgagcaccgcacgctgtacgtcacgggcgaggagtcggcgagccaggtgcgcatgcgcgccgaccgcatcaaggccatcgacgaccacctgtatctggcggccgagaccgatctggccgccgtcctcggccacttggacgcggtgaagccgtcgctgctgatcatggattccgtgcagacggtggcgtcgcccgagatcgacggggcgccgggcggcgtggcccaggtccgcgaggtcgccggggcgctcatccgcgcctccaaggagcgcgggatgtccacgctcctggtgggccatgtcaccaaggacggcacgatcgcgggcccccgcctcctcgagcacctggtggacgtcgtcctgcacttcgagggcgaccgccacgcacgcctccgtctcgttcggggcgtcaagaaccgatacggggcgacggacgaggtcggctgcttcgagctgcacgacgaggggatcacgggcctggccgaccccagcggcctgttcctcacccggcgtgccgagcccgttccgggcacctgcctgaccgtgaccctggagggccgccgccccctggtggccgaggtgcaggccctcacggtcgacacccagatcccgaccccgcgccgcacgacgtccggcctggagacctcccgcgtctcgatgatgctggccgtcctggagcagcgcggccggatcagcgccctcggaaaacgggacatctactcggcgacggtcggcggcgtacgcctctcggagccggccgcggacctggcgatcgccctcgcgctggcctccgcggcgagcgacgccccgctgccgaaaaacctggtcgcgatcggcgaggtgggcctcgcgggcgaggtcagacgggtcacgggcgtccagcgccggcttgccgaggcacaccgcctgggcttcactcacgccctggtcccgaccgaccccggcaagatcccttcgggtatgaaggtcctggaagtggcggacatcggggacgccctgcgagtccttccgcgctcccgtcggcgagaggccccacgggacgaggaggaccgccgg

SEQ ID NO: 4695 - DNA, 1746 bp, Streptomyces avermitilis
  CDS (1)..(1746)
gtgatgagcagcagtccggaaaccttcacgcacacaaccggcgcacaccgggcgcacggagatgcacgcaagcgggtgacagcgccccgaggcgcgacggcccgcaccacggcccagcgcccgtccgcgcgctacgagccctatctggacggcctgttcacctactgcctgtcggtgctgtgcgaccacgacgccgcgaccgccgcgctcggcgacgtcctcgcgctcgccgagcgccgtcacccgcgcggcccggcggcgggtgaccgccgggcctggttgtacgccctcgcccgctgggcctgtctgcgcaagctcgccgagaccagacgccaccggcaggccacccacgcggtcggccggcgcgcggcccgcgaggacggcgagaacctctcgacgcggcctgccgccgaccggcgcacggccgagccgaccggttccgtcccggccaccgaggaggaccgggcccggcggcagcgcgaactcgccctgctggcctggccggaggccgccggcaccacccccgagcagcgcgaggcgctcgaactcgccgtacgccaccagctcggcgcccccgaggtcgccgccgtcctcggcatgaatctcaccgcggcgcgcgaactcctcgccgccgcggcctgcgaggtcgaacgcacccgcgcggtcctcgccgtcgtcgagaccggcagctgcccgagcgtcgcccgtctgaccggcgacaaccagctcgtcctcagctccgccctgcgccgcgagctcgtccggcacgtcgacgactgcccgtgctgccgccgcaccgcggaacgcgcgctcccggacgccgcctggcccggcaccagcgtcacgcccgcggagctgcccgtgctggaggccccgcgcgcggccctgcacctggcgatggcgcacgtcccacgcgcgcgtggtggcgccccccgcttcgaccggcggggattcccgatggaccccaaggaccgggcggcccgtcgggaccgcttccgcgcgcgtgccgtcacgacaacggtcgtcgccaccgtcatcgccgcccccgtcctcgccctgtgggccgcctaccggggcgcaccgctcaccggcgagggcgtggacggccgctccgccaccgcgagcgaggcccacgccaccgacaccctcgacggcgaggaggcgagcggctacgagaacgcgggcaacgcgagtgcgcgtcccgtctccggcttcaccaagggcggccgctcgcccgacgtctccgtggaggtcgtcagcgcgaagaccgggggcagggccgcccacctttccgtgacggccggccacaacggcgacacgaccctcgtcaccctgacggcgtccgggagatcaccggtccactggtcggcccgctcaggagcgccctggctctatctgagccggtcctcaggaaccctcgaacccggcgaatcgttcacgatcaaggtgtacgtcgatcatctgcgcgagccggtgggtccctggcacgcgagcgtgtcggtggcacccgcgggcgcggtggtcacgatcgacggatacgggaccgcgggcccgcccgccccgcgtccgacccccagccactggacgccgcccgcccccgacccgagtgccacgagcccggaccccacgcccagcgacccgccccccaccgccgagcccacaccgacgccgaccgacccgaccccctcggatccgcccggctcgacgcctccgtccaccgacggcggtgccccggacccgtcctcg

SEQ ID NO: 4696 - DNA, 867 bp, Streptomyces avermitilis
  CDS (1)..(867)
gtgccaaagacgaaaaaggcgaaggccgacaaatcctccagggcttccaagggttccaagggctctgcgcaggcgaaggcgtccccgtcggccacgaagtcggcgaagcccccgaaggtgagcgacgagaaggggctcgacttcgcgcgtgcgtgggtggagtttccggatcccgccgacgacgagcaggttttccggtgcgatctgacatggctgacctcgcgctggaactgcatcttcggaagcggctgccagggcatccaggcgggccgcgcggacgacgggtgctgcacgctgggggcgcacttctcggacgaggacgacgagaagcgggtggcggagcacgtggcgcggctcacgccggagatctggcagaaccatgacgtgggcctgcgcaccggctgggtgtcggaggacgaggatggggaccggcagacgcggccgtaccaggggtcctgcatcttccagaaccggcccgggttcgcggccggtgcggggtgctcgctgcacatcctcgccctgaaggaggggcgcgagccgctggagaccaagcccgacgtgtgctggcagctgcccgtgcggcggacgtacgagtggatcgaccggcccgacgacacgcgtgtgctccaggtgtccatcggtgagtacgaccgtcggggatggggcccgggtggccatgacctgcactggtggtgcacctcggcgacgtcggcgcacggcgcgggcgacccggtgtacgtctcgtaccggccggagctgatcgagctgatgggcaagccgggatacgaccggctggtcgagctgtgcgaggagcggctggcctcgcagctgccgctgttggcgcctcatccggccgaccctgtgaac

SEQ ID NO: 4697 - DNA, 930 bp, Streptomyces avermitilis
  CDS (1)..(930)
atgagactcggtgtcctcgacgtgggttcgaacacggtgcatctgctggtggtggatgcgcacccgggcgcgcgccccctgcccgcgcattcgcacaaggcggagctgcggctcgcccaactcctcgacgagggcggcgccgtcggccccgaaggcgtggacaaactcatcggcgtcgtccacgaagcgttgcaggcggccgaggacaagggtgtcgaggacctccttccgttcgccacgtccgccgtgcgggaggccaccaacgcggatgacgtactggcccgcgtcaaggccgagacgggcgtcgagctccaggtcctgaccggcgcggaggaggcccgcctgaccttcctggcggcccgccgctggttcggctggtccgccggaaagctgctggtcctggacatcggcgggggctcgctggagatcgcgtacggcatagacgaggagccggacgccgcggtgtcgctgccactgggcgcgggccgtctcaccgcgggctggctcccgaccgaccccgccgacccggacgacgtcagggcgctgcgccgccatgtccgggcccagatcgcccggacggtcggggagttcagccgcttcggcgcgcccgaccatgtcgtcgccacgtccaagaccttcaagcagctggcccgcctcgccggagccgcccgctcggccgagggcctgtacgtccagcgggaactgaagagggagtcgcttgagggctgggtcccgcgcctcgcctcgatgacggcggaggagcgagcggaactccccggcgtctcggacggccgctccagccaactcctcgcgggcgcgctggtcgccgagggagcgatggatctcttcgcagtggaaaccctggaaatctgcccctgggccctacgcgagggcgtgatcctacgacgcctggaccacatgggcccggta

SEQ ID NO: 4698 - DNA, 807 bp, Streptomyces avermitilis
  CDS (1)..(807)
gtgcgcatcccggatgcgaaggtcgcgctgtccacggcctccgtgtacccggagtcgacggcgacggccttcgagatcgccgcgcgtctcggctacgacggcgtagaggtcatggtgtggaccgacccggtcagccaggacatcgaggccctccgccgcctcagcgactaccaccggatcccgatcctcgccgtccacgccccctgcctgctgatcacccagcgcgtctggtccaccgacccctgggtcaagctccagcgcgccaaggcggccgccgagaagctcggtgccaccaccgtcgtcgtacacccccccttccgctggcagcgccagtacgcccgcgacttcgtcagcggaatctggcgcatggccaacgagacggacgtacggttcgccgtcgaaaacatgtacccgtggcgctatcgcgaccgcgagatgctcgcgtacgcccccgactgggacgtcaccaaggacgactaccgtcacttcacgatcgatctcagccataccgccaccgcccgcaccgacgccacgcagatgatcgaccggatgggcgaccgcctcggccacgtccacctcgccgacggcaacggctccaacaaggacgagcacctcgtgcccggccgcggcacccagccctgtgccgaactcctggagcgtctcgcccgcaccggcttcgacggccacgtcgtcatcgaggtcaacacgcgccgcgccatgtccagcgcggagcgcgaggccgacctcgcggaggccctggccttcacccgcctccacctcgcctccgcggtcaaggtgccgcgccga

SEQ ID NO: 4699 - DNA, 615 bp, Streptomyces avermitilis
  CDS (1)..(615)
atgacggaggccgacgccccccgccgccgggggcgcccctcccgtacgcagacggaggcggcccccgccacccgggaccgcatcctggaggcggcccgcgaggagttctccgaacgcggctacgagaagacgtccgtccgcggtatcgccaaggcggccggcgtggactccgcgctcgtgcaccactacttcggcacgaaggaacaggtattcgaggcggccatcgaggtcgccttcgcgcccgccctcaacgccccggacgccgtggcggacggccccctcgacggcgtcggcgaacgcctgacccgcttcatcctcggtgtctgggagaacccggcgacccgtacgcccctgctggcgatcgtccgctccgccgtgaacaacgacaccgcggccgccgtcttccgccgcctcatcgccgcccagctgctgcgccgcatcgccggacagctcgacttcccggacgcggaactccgtgcggagctggcggcggcccagctggtggggacggcgatcctgcgctacgtgatcaaggtggagccgctggcctcggcggacccggaacagatcatcgccaggctggcccccgtggtccaggggcacctgacagccccc

SEQ ID NO: 4700 - DNA, 1851 bp, Streptomyces avermitilis
  CDS (1)..(1851)
atgcccgagctgaggtcccgcacagtcacccacggtcgcaacatggcgggcgcccgcgcccttatgcgcgcctccggtgtaccgggcgcggacatcggccggaagccgatcatcgcggtcgccaactccttcacggagttcgtgcccggccacacccacctccagccggtcggccggatcgtcagcgaggccatcacggccgccggcggcatcgcgcgcgagttcaacacgatcgcggtcgacgacggcatcgcgatgggccacggcggcatgctgtactccctcccgtcccgcgacctgatcgcggactcggtcgagtacatggtcgaggcccactgcgccgacgccctgatctgcatctcgaactgcgacaagatcacgcccggcatgctcatggccgctctgcgcctgaacatcccgacggtcttcgtctccggcggccccatggagtccggccgcgccaccctggtcgacggcacggtccgtacgctcgacctggtcgacgcgatctccgacgccgtgaacgacaagatctcggacgaggacatcctccgtatcgaggagaacgcctgtcccacctgcggctcctgctccggcatgttcaccgccaactcgatgaactgcctgaccgaggccatcggcctgagcctgcccggcaacggctcggtcctcgccacgcacacggcccgcaagggtctgtacgaggacgcggcccgcacggtcgtggacatcacgcgccgttactacgagcaggacgacgagtcggtcctgccccgcaacatcgccacgcacgccgccttcgagaacgccatggccctcgacatcgccatgggcggctccaccaacacgatcctgcacctgctggccgccgcccaggaagcgggcgtccccttcggcctggacgagatcaacgaggtctcgcgccgcgtgccctgcctcgccaaggtcgccccgaacgtcgccaaggaccgtacgtactacatggaggacgtgcaccgcgcgggcggcatcccggccctgctgggcgagctgcaccgggccggcctgctgaacgaggacgtgcactcggtgcacagcccgtccctctccgactggctgaagacgtgggacgtgcgggcgggttccccgtcccccgaggccatcgaactgtggcacgcggcccccggctgcgtccgctcctccgaggccttctcccagtccgagcgctgggaggcgctcgacgaggacgcggagggcggctgcatccgctccgccgaacacgcgtactccaaggacggcggcctcgcggtcctcaagggcaacctggcggtcgacggctgcgtcgtgaagacggcgggcgtcgacgagtcgatctggaccttcgagggcccggcggtcgtctgcgagtcgcaggacgaggccgtcgacaagatcctccgcaaggagatcacccacggcgacgtggtcgtcatccgctacgagggccccaagggcggccccggcatgcaggagatgctctacccgacgtcgttcctgaagggccggggcctcggcaagacctgtgccctgatcacggacggccgtttctccggcggcacctcgggcctgtcgatcggccacgcctcccccgaggcggcgtccggcggcacgatcgcgctggtccaggacggcgaccgcatccgcatcgacatcccgaaccgcacgatcgacctcctggtggacgaggccgaactgtcccgccgcgaccaggccctgaacggcgtctacgcccccgtgaaccgcgagcgcaaggtctccgcggccctgcgcgcgtacgccgcgatggccacgagcgcggacaagggcgcggtccgggacgtgtcgaagctgggc

SEQ ID NO: 4701 - DNA, 2196 bp, Streptomyces avermitilis
  CDS (1)..(2196)
gtgatgccgccacagcgcagcgccggtacggatccggaagcggaacatccgcagtacgccgggcagtacctgttggaggcggcactcggctccggtggcatgggggtcgtacatctggccaggtccgcctccgggttgcgcctcgcggtcaaggtggtgcacgcccagtacgcccaggaccccgagttcagggggcgtttccggcaggaggtcgcggccgcgcggcgggtcagcggcgccttcaccgcgcccgtcgtggacgcggacccgggggccggacgcccttggatggcgacgctgttcatcccgggcccgaccctcgccgaacacgtcaagcggaacggcgccctgcctcctgcccggctgcggcacctgatggcggggctcgccgaggcgctgcgcgacatccaccgcgccggtgtcgtgcaccgcgatctcaagcccagcaacgtcctgctggccgaggacggccccaaagtcatcgacttcggtatttcccggccgtccgacagtgaactgcgcaccgagacgggcaagttgatcggcacgccgccgttcatggcccccgagcagttccgcaggccacgggaggtcgggccggccgccgacgtcttcgcgctcgggtccgtgatcgtgcacgcggcgaccggcagcgggcccttcgattccgacagtccctatctggtggcgtatcaagtcgtccatgacgagccggacttgacgggcgtaccggaggagttggccgaactcgtcgccgggtgcctcgccaaggagccggacgaccggcccacaccggacgagctgatgacggctcttcggtcggtgtccgcctcgtacgacacccaggcgttcatccccgtgcagcgggacgggagttccgggtcggcgtggcgaccgggaccgggaccggggacgggaccagggacgggaccggggccgggaccggggcacggtggcgagcgcgtggtgacccatcaggtgcggcagcccgagccggtcgccgcaccggctgccaggaagcgtctcgggcgtcggctgtggattcccgccgtcgccgtcgccgtgctggcttgcgtcgccggcgccctcgtcctcctcggcccgggtaccggggccccgcgcgaacaggacgcggcgccgtcgaaggccgccttccagccgtgggacatcgggctgagcgcgggcggctcgaaagccaccggcatggcgcagtgcgcgtacgcgccccacaggctgtactgcacccgccccggtgtcctggccgccgccgtcgatcccgccgacgggaaggtcctgtggtcacgcggcgacgcgaagcggcacagcgacggcaccgtgcggccgcccgtgctgtcgggcggactgctgcacgtcgtcagcgaaggcggaaagcggctggcggcgctcgaccccgccaccggcaagacccgttggagtcacgatctcgcggcctacggcggtcgcttcgcccaggtcggcggggtcgtcctgctcaccggcgccgacgcgcgggtgaccgcgctggacgcggccacgggtgaggagaagtggcgccgccggatccccgggcagccacagccggccttcgtgtcgtacggggacgggctcgcgtacgcggtcgcggcggccgggtccgggacgaaggtggccgcggtggacccggagagcggcgccacgcgctggcagcggcggttcgacggtgtgctgagcctggtgggtgcccatgacggggcggtctggttcgcctcgaccaccgccgactcggacacggacgcggtggtgcgctacgacgtcacccgccgtacggtccgccgcgtcggcctgcgtttcccgctccagggagcccaggccgtggtgcggaaggacacggtctacgtcctcgcgaacggcggtgcgctggtcgccgtcgacacccggacgtccaaggagctctggcggctggagacctccgtcagtttcgcctcggcgcccgtcgccgccggggaccgcgtctacttcgcgggcgcggacggacggctccttgccgtcgacgcctcgaagggtgtgctgctcgggcagaccaaggcgcggctgggcggcgcacacggctcactcgtctccgggctgccgtcgccggtcgccgccgacgggaaggtgtactccgcggctcccgacgggtcgttgttcgcggtcgacgcgcgcaggccggggggctgg

SEQ ID NO: 4702 - DNA, 342 bp, Streptomyces avermitilis
  CDS (1)..(342)
gtgaactattcaacgggggaggccgacatggccacggaagacatccagatctcgggtacggaagaggcggccgaagccgactcgagcgcggcggccacccgcacctacccggtcgcaccgggccacagagtcaacgtccgcagcggtccgggcacgcactacagcatcgtccgcaccctgcccgagggcgcgagcgttcccatctactgccagcgctcgggggactcggtcagcggaccgtacggcacgacgagcctctgggactgcatcgccaacgcgcagtacgtctcggacgcgtatgtgaagacgggcagcgacgggtacgtcgctccgcgctgctcc

SEQ ID NO: 4703 - DNA, 582 bp, Streptomyces avermitilis
  CDS (1)..(582)
gtgagcgacgacgagaacggcaccccggccacccccgcgggcccccaccccgaacccctccgcttcttcggcacgacctgggtggaccacgagggcggctacgcggcccgccgcgccggcgtggccgtcggctcgctcgcggcggcggtcgtcggctgcctcgtcctgcggttcgcctaccagggcctggagatcgcggccgtcggcagattcgtgacgctgatggtcgtgggcatgttcgcggtgtgcagtgcgctcgcgttcggtcacacctggggctcgttcggcaagcgccccgaccccgaccgccaggcctccctgcgcggactcctggccatcggcttcatcggctccctcctcgcgtacttcttccggtccctcacggaggcccccggcgagaaactccaccgcgaggagtacgagacggcccgcgagcagtacgcgaagcgcaccgcccgccgcaccccgcaatccgtcccgcatgcagcgcagctcatagcccggggcccggcgtgcggggccgccccaccaccgcaccgaaaccactggcccgcatcccccacccccgccaccatggaggta

SEQ ID NO: 4704 - DNA, 630 bp, Streptomyces avermitilis
  CDS (1)..(630)
gtggacgtaggcgcgggcacgggcatcgcgaccgcactcctcaccgcgcgcggcgccgacgtgatcgcggtggagcccggcgacggcatggccgcccagttccgccgcaccctccccggcgtccccctcctgcgcggcgacggcaatgccctccccctcgccgacgcctccgccgacttcctcacctacgcgcaggcctggcactggaccgacccggcccggtcggtcccggaggcgatgcgcgtcctgcgccccggcggcgcgctcgccctgtggtggaacacggacgccgccgacgtcccgtggatcgcggagcagtcggagcgcgtcaggcggtacttcggcggcgaacacggcagcaagcagggcgggggcggcacccgtggcgacgccgcgttcgggggcgcggtcctgcgccccgaccacacccaccgggtcgtccgctggagccgcacggtccccgtcgacacccatctcgccaacatcggcagccactcgatcttcctgctcctcggcgaggagagcacgaacaccttcctcaccgaggagcgcggacacctcctcgcgaccttcccggacggcctcgtcgaggaggtctacgacgtcgtactcatcgtggcgacgcgcccg

SEQ ID NO: 4705 - DNA, 1473 bp, Streptomyces avermitilis
  CDS (1)..(1473)
atgcgtgtcgtagatgtcgcagatgccgtaggcaagctcgtgaaccggtccggcaaagccgatctgttcgcgtccctcgtcgtgttcctcgtggcgcttccgctgtgcgtgggagtcgccgtggcatccggggtgccggccgaactggggctggtgaccgggatcgtcggcgggctggtcgccggggcgctgcccggcagcagtttgcaggtcagcgggcctgcggctgggctgacggtcctggtgtacgaggccgtgaagacgtacggccctcaggcgctcggcgtgctcgtgctcggcgccgggctggtgcagctggcgctcggggtgctgcggctggggcggtggttccgggccgtgtccgtggccgtggtgcaggggatgctcgccgggatcgggctcgtactggtcgccgggcaggtgtacgcgatgggtgacgttccctcgcccgcgagcggggccgcgaagctggccgggctggtctcgctgccgggggacgtggctccggtggcgctgttgaccggcggtgccaccgtgctcgtcctggtgctgtggccgcgctggcggcgcggggcgcgggccgtgccggcgccgttgctggcggtcgggctcgcgtcggccgcgacggctctgttcgatctgccggtgcggcgggtggaggtgcggggcctgctggatgtcgtacggccgccctcggtcggtgatctggggcggctcacggaagtgggcgtgctcgggacggtggtcgccttcgcgctgatcgcctccgcggagtcgctgttcagcgcggccgcggtggaccggctgcacgggggaaggcggaccgactacgaccgggagctgatcgcgcagggcaccggcaatgccgtgtgcggggtgctgggggcgctgccgatgaccgcggtgatcgtgcggagcgcggcgaatgtgcgggccggggcgcggaccaaggcgtcacgggtgctgcacggggtgtggctgctcgtcttcacggctctgctgccggaagtgctcggggtgattccggtggcggcgctggccgggctgctggtgcacgcgggggccaagctcgtgcccgtacgggagctgggggcgttgtggcgggcgcatcggggggaggccgtggtgctcggtgtgacggcggtggcgatcgtgatcgggaacctgttcgagggcgtactcgtggggctcgcgcttgccgtcgccaagaccgcgtgggacatcagccatgtgcacgtggagacggaggatctgggggcggcggggatcgtcgtgcgggtcgtcggccacgcgacgtttctgcggctgccgaagctgctggacgcgttggaggcgttgccgcacgaccgggaggtacggctggaactcggcgggctgcggcatgtggatcacgcgtgcgcggcggcactggacggatgggccgccgcgcggcaggggggtcaggggcgggtcgcgacgagcagtacgtcgccg

SEQ ID NO: 4706 - DNA, 825 bp, Streptomyces avermitilis
  CDS (1)..(825)
atgaatattcggcgtcctcgcccacccgaccccggcaacccggccactcccgccctcgccgtccgcgccgagggcctcaccgtcgtacgcggcacccgcaaggtcctgaaaggcctcgacttcgccgtcccgcccggtcggatcaccggcctgctcggcccttccggctgtggcaagtcgaccctgatgcgctcgatcgtcggcacccaggccaaggtcaccggcaccctggacgtcctcggcctcccggccggcgaccccgccctgcgctcccgcatcggctacgtcacccaggccccctccgtctacgacgacctcacggtccgccagaacctcgactacttcgccgcgatcctcgacccgggccgagccgccgccgagcgccgccgcgcgcacgtcaccagcgccatcgccgacgtcgacctcgtctcgcacgccgacgccctcgccggcaacctctccggcggccagcgcagccgcgtctccctcgcggtcgctctcctcggcaccccggaactcctcgtcctcgacgaaccgacggtcggcctggaccccgtcctgcgccgcgacctgtggaccctcttccacgccatcgcggccgaccgcggcgccaccctcctcgtgtcctcccatgtcatggacgaggccgagcgctgccaccgcctcctgctcatgcgcgagggcgagatcctcgccgacggcacgccggacgccctccgcacccgtacggcatcggagaccgtcgaagccgccttcctgcgcctggtcgacgaggcgagcgcggcgagccccgccgcgacagcccaaggaaaggagccggtccga

SEQ ID NO: 4707 - DNA, 789 bp, Streptomyces avermitilis
  CDS (1)..(789)
atgaccaccaccgcgaccccgaccaccaccgccggccccttcggcggaagcgcgatcaaccactcccgtacgaccgcgacggcggcccgcgtcctgcgccagctccgccacgacccgcgcacgatcgcgctgatgatcctcatcccgtgcgtgatgctgttcctgctgcgctacgtcttcgacggcagtccgcgcaccttcgactccatcggcgcctcactcctcggcatcttcccgttgatcacgatgttcctcgtgacctcgatcgccaccctgcgcgagcgcacctcgggcaccctggaacgcctcctcgccatgcccctcggcaaaggcgacctgatcgcgggctacgccctcgccttcggcgccctggcgatcatccagtcggccctggccacggggctcgcggtctggttcctgggcctcgacgtcacgggctccccctggctcctgctcctcgtcgccctcctggacgccctgctcggcacggctctcggcctgttcgtctccgccttcgcctcctcggagttccaggccgtccagttcatgccggccgtgatcttcccccaactcctcctctgcggcctgttcaccccccgctccgccatgcacccggccctggaggccatctccgacgtcctccccatgtcgtacgcggtggacggcatgaacgaggtcctgaagcacaccgacatgacggcgaccttcgtacgcgacgcactgatcgtggcgggctgcgccctcctggtcctgaccctgggcgcggcaaccctgcgccgccgcacgcca

SEQ ID NO: 4708 - DNA, 807 bp, Streptomyces avermitilis
  CDS (1)..(807)
atgacccagaaagtcgcagtcctcggcaccggcaagatcggcgaagccctgctcagcggaatgatccgagcgggctgggcccccaccgacctcctggtcaccgcccgccgccccgagcgcgccgaagagctccgcgcgcgccacggcgtcaccccggtcaccaacgcggaggccgccaagaccgccgacaccctgatcctgacggtcaagccgcaggacatgggcaccctcctcaccgagctcgcgccgcacgtccccaccgaccgcctggtcatcagcggcgcggcaggcatccccacctccttcctggaggagcgcctcgctcagggcacccccgtcgtccgggtcatgacgaacacccccgcgctcgtcgacgaggccatgtccgtcatctccgccggcagccacgccaccgccgggcacctcgcgcacgccgaggagatcttcggcgcggtcggcaagaccctgcgcgtcccggaatcccagcaggacgcctgcaccgcactctccggatcgggcccggcgtacttcttctatctggtcgaggccatgacggacgcgggcatcctgctgggactgccccgcgacaaggcgcacgatctgatcgtccagtccgcgatcggcgccgcgatcatgctccgcgacagcggcgagcaccccgtcaagctccgcgagaacgtgacgtcaccggccggcacgacgatcaacgcgatccgcgaactggagaaccacggggtacgcgccgcactgatcgccgccctggaggcagcccgcgaccgcagccgcgaactggcctccggcagcagc

SEQ ID NO: 4709 - DNA, 993 bp, Streptomyces avermitilis
  CDS (1)..(993)
atgaagcggatcttcagcggggtcaagccgaccgggcatctgacgctggggaactacctgggggccgtgcggcggtgggtcgacgtcgatcagcacggggccgacgcgctgttctgcgtcgtcgacctgcacgcgctgaccgtggaccacgatccggcgcgggtgcgccggctcagtaggcaggccgcgacgctgatgctggcggcggggctggatccggagctgtgcaccgtgttcgtccagagtcatgtcgatgagcacgcgcggctgtcgtatctgatggagtgcgtcgccacggacggcgagatgcggcggatgatccagtacagggagaaggccgcgcgggagcagcagcgcggcgggagtgtgcggctgtcgctgctgacgtacccggtactgatggcggcggacatcctggcgtacgggacggacgaggtgccggtcggggacgaccagactcagcatgtggagctgacccgggatctcgcggtgcgcttcaaccagcggtacgggcacaccttcgtcgtgccgcgggccacccgtccggaggtggcggcccgggtgatgaatctgcaggagccgacgtcgaagatgggcaagagcgatgacgtcgggcccgggatcgtctatctgctcgacgagcccgaggccgtacggaagaaggtcatgcgtgcggtgaccgacagtgggcgggacgtggtgtacgaccgggagtcgcggccgggggtgtccaatctgctggagatcctggccgcgtgtgagggtgggagccccgaagccctgagcggtgcgtacgcgtcgtacggagctttgaagaaggacaccgcggaggccgtggtcgagctcctcaggcctctccaggagaggcacaaggcgttgtgcgcggagccgggctacgtggagggcgtgttgcgggacggcgcgcgccgggcccgagagctggcgaggccgagagtcgacgcggcgtaccgggcgatcgggttgctggaggcg

SEQ ID NO: 4710 - DNA, 642 bp, Streptomyces avermitilis
  CDS (1)..(642)
atgcgctatgacctcgtcatcttcgacaacgacggcgtcctcgtcgacagtgagcccctctccaacacgctcctcgccgcctatctcaccgagctcggccatccgacctcgtacgaggagtccctccgcgactacatgggcgccgccatgcatcgcgtacacgacctcgtccaggaacggaccgggcagcggctgcccgacgacttcgacgaggtcttccacggccgggtgttcgccgcgttcgagcgagagctggaacccgtcgccggcgccgtggacatactcgagaagctcaccgccgacggggtgccgtactgcgtcgcctcgtccgggagccatgagcggatccgggtcgggcaccgcaagaccgggctcgaccggtggttcgaggacgggcggatcttcagttcgcaggacgtcgggcgggggaagccggcgccggatctgttcctgtacgcggccgagcgcatgggcgtaccacccaagaggtgtgtcgtcgtcgaggacagtcccctgggcgtgcaggcggcgaacgcggcgggaatggacgtcttcgggtacaccgccatgacccccgccgccaagctcgccggtgccactcaactcctttccgacctgggagagttggctgacctgctcgta

SEQ ID NO: 4711 - DNA, 699 bp, Streptomyces avermitilis
  CDS (1)..(699)
atgagcatcacggccatcgagaccagcaccgaagcgaccgccgccgcggcgaccggcacggccgccgcccggcccagcttcctgccgctgatcctggacgtggcggtgccggtcggggcgtactacctcctgaagaacgggttcggcatgagcaccatggcggcgctcggctggagcaccgtggtgccggccgtccggaccgtgtggagtgcggtgaaggagcgcaaggtcaacgccctcgccgggctgatcctcttcgtcaacgtcgtcgccctggccctcagcctcgtcgccggtgacccgcggctgatgctggccaaggacagcggggccggcagcgccatcggcatcggcatcctggtgtccgtgaagctcggcaagccgatgatgacggcgggcatgaagccgttcctcatcaagggcgacgcggccaagaacgccgcctgggaccggctcatcgccacctccccgcggttccggaaggccgagcggaccttctctctcatctggggcgtggccctgctcggcgagtgcgtcctgcgggtcgtgggcgcgtacacgctgccgatcgacaccatggtcgggctcggcacggtcgtcatgatcaccacgatggtcctggccttcctggtcagcgggcgcttcggcgtcgttccgatggagaagatgctggaggccgagctcgccgagcaggccaag

SEQ ID NO: 4712 - DNA, 1209 bp, Streptomyces avermitilis
  CDS (1)..(1209)
atgacagatgtgctgcggcgcggtagggcctcgttggcgttcggcttcttcgctcagggcgtcgccttcgcgctgctcgtgacgcgcatcccggccatccaggaccggtacggggtctccgacgcactgctccccgccttcctggccgccgtgccgatcctcgccggcgtcgggagcgtgacgaccgagcatctggtgaagcgcataccgcccagccgggtgctgcgctggtcccagcccgtcgtgctccttgcgctgctcggggtcgggtggggggaccggctcgtcgaactggcggtcgcgctgggcgccttcgggctcgcggtcggcgcgctcgacgcctcgatgaacatgctcggggtgagcctgcaacggacgtacggacgcagcatcatgctcggcttccatgccacgtacagcctgggtgggatcgtgggtgcctcgctggcctgggtcggggcgcactggcatatggcgctgtcggtgtcgtatctgccgctcgtgctggtgctgcttccggccacgctggtgggcagccggtggtacgtcgacgggagcgccccctctccgcaggcgcacgaggccgcggccaccccgctcgtgttcaagctgctgctgccgctctgtctggtgatgaccttcgcgtacatcggggactcgaccgtctcgaactggagcgcgaagtacctacaggacgtgttgggcagttcggagcaactggcgaccctgccgtacaacgtctacatggtgaccaccctgctggggcgggccatcggggacttcggggtgcggcggttcggggccgtggccgtcgtacgggtcggcgcgctggtggcggcgctgggtttcgcggtggtggcgggcgcgccgggggcctgggtggggatgctcgggttcaccctgctggggctcgggctgtgtgtgctcgtgccggggaccttcgcggcggccgggcggctgtttcccggggcttcggacgcggccgtcgcgcggctcaatatcttcaactacgtcggtttcctgatcggctcgccgttggtgggggcgctgggggacacctggagctaccggggtgccatgctcgtaccgatggtgctcgtcctggtgacactggtgtacgcccgctcgttcgcgtccggaacggaccgatacggtgacagacatgagcggccgcgcacagctgatgtgggacgaggcagtaacgggcta

SEQ ID NO: 4713 - DNA, 1101 bp, Streptomyces avermitilis
  CDS (1)..(1101)
atggatccggtccggctggcgttgacccgccggctggtcgacgccttcggtctcgaccgggagatcgaggtggtctcggcgaagcccgccggggagtcgacgctgcggctcgtgcaccgcgaggactacatcgaggccgtgaaggccgcgtccgcggagccggacgcggcggacgggaagtacgggctcgggaccctggacgatcccgcgttcgccgggatgcacgaggtgtccgcgctgatcgccggacagtccgtcggggcggccgaggccgtgtggcacggggacgcgctgcacgccgtgaacttcgcgggcgggctgcatcacgcgatgcccgggggcgcctccgggttctgtatctacaacgacgcctcgctcgccatcgcgcggctgctcgagctgggtgccgagcgggtcgcgtacatcgacgtcgacgtgcatcacggggacggcgtgcaggcggccttctgggaggacccgcgggttctgaccatctcgctgcacgagcatccgcagacgctgttcccgcagaccgggtggccgaccgagaccggggccgaccgggcggaggggtcggcggtcaatgtcgccctgcccgccgggaccggggacgccggctggctgcgtgcctttcacgccgtggtgccggaactgatcgccgatttccggccgcaggtgctggtcacccagcacggcgccgacacccacttcgaggacccgctcgcccatctcgccgtgtcgctggacgcccagcgtgccgtgcagctcgcgtgccacgacctggcgcaccagtacgccgacgggcgctgggtggcgctgggcggtggcgggtacgcggtcgtggacgtcgtaccgcggtcctggacgcatctcgtggcgatcgcggcggggcgtccgctggagcccgagtccatgatcccggagagctggcggcaggaagtcttcgcccgtacccggcagttggcgccgatgcggatgacggacgggcggtggccggtgtcctgggcggactgggagtccgggtacgacccggcggaccggctggaccaggcggtgctggcgacccggaaggcggcgtttccgctgcgcgggatgttgccg

SEQ ID NO: 4714 - DNA, 813 bp, Streptomyces avermitilis
  CDS (1)..(813)
gtgttgagcaccggagcattacgtgcgcatttgctggctgcccggctggccgggcccgtggccacttcgcgtgaggagagcctgcgcagctatcggctcttcgcggcgcgcgacccccgtgtcatgatcggactcgatcccgaatggacatgggagccccgggatctgatcgagttgatggcggacaagtgcggggtttcggccgatcccacccacacctccggtcacgatgtgatcgatccggagcggacgctggaagccctggacgccttcgccgcacggctcgggaaagccgcacgggacaaggtgcccgtcctcctcggcaccggccacccgcaccgtctgctcggcttctacgccgccttggcggacgcattgtcggcggcgggatgtacggttctcaccccagcgcagggtcactgtgtcgacataacgacccggttcggtctacgcacgtacaacctggactacgtacgaggagtcgcgctcgtccgcgaacccgatgtgctgaccgccggtcgtgagaccggcgcacacagccattcccccctcccggttcgcaccgcgctggcggctgccgcggaggccggcgaccccctcccggaactggtcgtcggggaccatggatgggtctgcggggcaggtcagctggggttcgaggccataggtctggctgatacggacgatcccgcgctcttcgtcggggaggcagaggggcgggtgtccgtcgtcgttccacttgatgacgctgtgcggtctgattactaccgaccgcttactcgctatgtactcaatcgagcgtgtctgtcacag

SEQ ID NO: 4715 - DNA, 243 bp, Streptomyces avermitilis
  CDS (1)..(243)
gtggccgtcgagtgcggaaggttcaggtgtgtcatggctgcagctggcgagaggcctctgaacgaggttcagttcctgaccgtggcggaagtcgcctcggtgatgcgagtgtcgaagatgaccgtgtaccggttggtgcacagcggtcatctgccggcgatccgggtgggaaggtccttccgggtgccggagcaagcggttcacgagtacctccgcgagagctatgtgggggtggagaccgcc

SEQ ID NO: 4716 - DNA, 1047 bp, Streptomyces avermitilis
  CDS (1)..(1047)
gtgctcgtgaccggagtggcccgtcagttggggggccggttcgtacgacggatccagcgtgacccgaacgtcgaccgggtgatcgccgtcgacgcggtccgtcccgagcatcatctgggcggtgcggacttcatccaggccgacataaggcagcccaccatcgcgcgcgtgctcgccgagcactccgtcgacacggtcgtccacatggacgtgaccggcaccgcgctgggcaccggcagccgggccacggtcaaggagaccaacgtcatcggcaccatgcagctgctgggtgcctgccagaagtccccgacggtcaagcggctcgtcgtgaagtccagtacgaacgtgtacgggtccgcgccgcgcgatccggccgtgttcaccgagacgaccccgcccaagtccctgcccagcggcggcttcgccaaggacaccgtggaggtcgaggggtatgtgcgcggcttcgcccgccgccgccccgacgtggccgtgtgcgtgctcaggttcgcgaacattctcggcccgagcgcggactcgccgctcgcctcgtacttctcgctgccggtgctgccgaccgtgttcggctacgacccgcggctgcagttcgcgcacgaggacgacgtgatcgacgtgctgcgcatcgcctcgtacgagccccggcgcggaactctcaacagcggcacgttcaatgtcgcgggcgacggcgtcctgctgctgtcgcagtgcgcacgcaggctcggccgtccgacggtcccgctgctgctgccggcggtcacctgggtcggctcggcggtgcgtacgctgggcatgacggacttctcgcccgagcagatccggctgttgacgcacggccgggtcgtggcgacgaaccagatgcgcgagacgctgggatacgtgccgaagtacacgaccgcagaaacgttcgcggacttcgcgcgcagccgcggtcccggacttctgccgccggaggccctcgcgggggccgtcgaccggatcgccgcactgcccgcactgggcggtggccaccccccgacgcagagcgccaac

SEQ ID NO: 4717 - DNA, 1044 bp, Streptomyces avermitilis
  CDS (1)..(1044)
atggcggacgccaaggtcattccgttcgacgacgaccggtcccgtggggctgccgtgcagcggccgccgcggcgccggggtgcggggagccggcgaggcggcgagcccgcggtggtacgggaggtccagcccctgcccgggcgggctcttccgcaggatgatgttcccgtgacgcgtgaggaacagccgccgcagcggccgcaggacggcggtctggaacggcggatcgccggagggctggccttcctgcggcggcggctgaccggggactacgaggtcgacgacttcggctacgacgaggagctcaccgaccaggtcctcatgtcgctgctgcggccggtgtacgagaagtacttccgggtcgaggtgaagggcatcgagaacatcccggcgaagggcggggcgctgatcgtcgccaaccactcgggcacgctcccgctggacgggctgatgatgcaggtcgcggtccacgacaaccatccggcgggccgtcacctccggctgctggcggccgacctggtcttcatgctgccggtggtcaacgagctggcccgcaaggccggtcacaccctcgcgtgcgccgaggacgccgaacggctcctggagcgcggtgagctggtcggtgtgatgccggagggcttcaagggcatcggcaagccgttcggcgagcgctacaagctccagcgtttcggccggggcggcttcgtctccacggcgctgcggcagggcacgccgatcgtcccgtgctcgatcgtgggtgcggaggagatctacccgatgatcggcaacgcgaagacgctcgcgcggctgctcggcttcccgtacttcccgatcactccgacgttcccgtggctcggcccgctgggcgccgttcccctgcccacgaagtggacgatccagttcggcgagccgatccccacggacggctacccgccggaggcggcggaggacccgatgctgatgttcaacctgacggaccaggtcagggaacagatccagcacacgctgtacaagctgttggtgcagcgccggtccgtgtttttc

SEQ ID NO: 4718 - DNA, 1233 bp, Streptomyces avermitilis
  CDS (1)..(1233)
gtgccgccagtgatcgcgaacgtatcggcgcaccggcgggcgaacgccttcgcccaggccctggaggagcagtccgaccgggactcggcggccgggcagcccgatggacccgctccgcccccgactgccgcggaacggaccgggcagggccgcatgttggccctcaccaccggtctcggcgagttgccgaagccgaagctggaccccgaggtcaaggtcgtgcagcgggcgcagctcgtggccgcgatggaggccatgctgcgggacggcacggtgccgggaggcgaggcggcggacccttcggtgcccgagcagcggtcccatcgggcccggggcgctcaccgggcgaccggactggggaagttgcgaccgcgtacgcggctcacgaagggcctcgccgcgggtggactcagcgtcggtgtggccgcggcctcgttcggcggagtggccgctgccagttccgacgccctgccgggtgactccctctacggcctcaaacggggcatcgaggacgtcaaactggggctggtccacggcgacagcgaccgcggacagctctacctcgaccaggcctcgacgaggctcagcgaggcccgccggctgatggagcgcgaccgcggcggccccctcgaccacgagtccgtgggcgaggtcaggcgcaccctgtccggcatgcagcacgacgcggccgagggccaccgcctgctgcacgaggcgtacgagcgggacggctcactgggccccatccaggccctctccaccttctcccgctcgcaccgcgaggcctggggcgccctgcgcgaccggctgcccgtgcagctcggcgacgtcagtcagcaggtctcgtcggtcttcgacgccatagaccaagaggtcgctccgctccagtcactgctgccgcagcccccggcccccggcggcaccggcaagcggcatgggtccggcacggagtcctctcgctccgccggcacggaccagcccgagcccagcgccaccggcgactccgccaccggcagcgacagcagcggcaagccccagccgtccacgtcgaagagcggcgaggagggcctcctcggcggcaacacgggcggcctcctggacccgccgaaggacagcacgagcagctcgccggcctcgagcaagcctccgaccagcggcgccccggacgtcaccctgccgcccctgctcccgggcctcctcccgggcctgggcatcgacagcggggagacgaag

SEQ ID NO: 4719 - DNA, 774 bp, Streptomyces avermitilis
  CDS (1)..(774)
gtgtacccacacgtcggggttgacgcctcgggcctggctacgctgcgcacaacggtcctcgacctgttgcgcggcttcgtccccaccgcgtacgccgtccccgccttcgccaccgccgcaccgctcggcccgtgctacgcactggccgagggcagcgccgcggtcggtggcagacggggccgttcgagctcggccgccaccaccgcacgccgtccggccgccgacagtgacagcgcccgcatgatggacctcgtcgagcgcgcccaggccggcgaggccgacgccttcggacgcctctacgaccagtacagcgacaccgtgtaccgctacatctattaccgcgtgggcggcaaggcgaccgcggaggacctcaccagcgagacgttcctgcgcgccctgcgccgcatcggcacgttcacctggcagggccgcgacttcggcgcctggctggtcacgatcgcccgcaacctcgtcgccgaccacttcaagtcgagccgcttccggctggaagtgaccaccggcgagatgctcgacgccaacgaggtcgagcgctcccccgaggactccgtcctggagtccctctccaacgccgccctgctcgacgccgtacggcggctcaatccccagcagcaggagtgcgtgaccctgcgcttcctccagggcctctcggtcgccgagaccgcccgtgtgatgggcaagaacgagggcgcgatcaagaccctccagtaccgggccgtacgcacgctcgcccgactcctccccgacgacgtccgc

SEQ ID NO: 4720 - DNA, 888 bp, Streptomyces avermitilis
  CDS (1)..(888)
gtgttggcaggcgaggcctcggcggaggcagcgcgcaagtcctcccaggagctggaggaactcgcgcacgaagccgcgcccgacgtcacggaccaggaaccggcgttcccggtgctcggcgacgacaaggccgccgccttcttcgacctggacaacaccgtgatgcagggcgccgcgctcttccacttcggccggggcctgtacaagcggaagttcttcgagacccgcgacctcgccaggttcgcctggcagcaggcgtggttcaggctggccggggtcgaggaccccgagcacatgcaggacgcccgcgactccgcgctgtccatcgtcaagggccaccgcgtctccgagctgatgtcgatcggcgaggagatctacgacgagtacatggcggagcggatctggccggggacacgcgcgctggcccaggcacacctggacgccggccagaaggtgtggctggtcacggccgcgccggtggagatcgccacggtcatcgcccgccgcctcggcctgaccggcgcgctgggcacggtcgcggagtcggtcgacggcgtctacacgggcaagctggtgggcgagccgctgcacggcccggccaaggcggaggcggtacgcgcgctggcggcggcggagggcctggacctctcgcgttgcgccgcgtacagcgactcccacaacgacatcccgatgctgtccctggtgggccacccctacgcgatcaacccggacgccaagctccgcaagcacgcccgcaacctggactggcgactgcgcgactaccgcacgggccgcaaggcggcgaaggtcggcattccggcggcggccggcgtgggcgcggtggccggcggcaccgcggcggcgatcgcactgcaccgccgacgccgc

SEQ ID NO: 4721 - DNA, 306 bp, Streptomyces avermitilis
  CDS (1)..(306)
atggccgacatgagtcccatctttcggcgaaaggccgctcagagcgccccccaggaccggctcgtcacgctgatccgcaagccggggtgtcatctgtgcgatgacgcacagcaggtcatcgagaaggtctgcggtgatctcggcgtcccctgggagcagaaggacatcacccaggacgcggagctgcaccgtgagtactgggagcagattccggtcgtcctggtggatggcgcgcagcacaccttctggcgcgtgaacgaggaacgccttcgcaaagccctcacccagggcctgccgggccggtcc

SEQ ID NO: 4722 - DNA, 756 bp, Streptomyces avermitilis
  CDS (1)..(756)
gtggcaactggccgaactcaccgaccggcgacccgcagccgagggattcccgaggccaccgtcgccaggcttccgctgtacctccgagccctcaccgcactgtcggagcgctcggtacccacggtctcctccgaggagctcgcggccgcggcgggggtcaactccgcgaagctgcgcaaggacttctcgtacctcgggtcgtacggcacgcgcggtgtgggctacgacgtcgagtatctcgtgtaccagatctcccgcgaactgggtctgacccaggactggccggttgtgatcgtcggtatcggtaacctcggcgccgcgctggccaattacggcgggttcgcctcccgtggattccgggtcgccgcgctgatcgacgccgatccggcaatggccggaaagcccgtcgccgggatcccggtccagcacacggacgagctggaaaagatcatcgacggcaacggcgtctcgatcggggtcatcgcgactccggccggcgcggcccagcaggtctgcgaccggctcgtcgccgcgggcgtcacctccatcctgaacttcgcgccgaccgtgctgaccgtcccggacggcgtcgacgtgcgcaaggtcgacctctccatcgagctccagatcctcgccttccacgagcagcgcaaggcgggcgaggaggccgcggccgagggcgcgatcccggccgccgcctccaaggagtccgccgacaaggggcctgacggggacgtccccgccgtgatgccggca

SEQ ID NO: 4723 - DNA, 1707 bp, Streptomyces avermitilis
  CDS (1)..(1707)
atgagtctcctcgtcgtcgggctgagccaccgcagcgctccggtcagcgttctggagcgggccacgctgaccgcggacgcccaggtcaagctgctccaggacacggtcgccgcggagcctgccaccgaggccgcggtccttgccacctgcaaccgcatcgagctgtacgccgacgtggacaagttccacgcgggcgtcgccgagctgtccacgctgctcgcccagcacagcggggtcgggctcgaggagctcactccctatctctacgtgcactacgaggaccgggccgtccaccacctcttctcggtggcctgcggcctcgactcgatggtcgtgggcgagggccagatcctcggccagatcaaggacgcgctggccaccgcgcaggaactgcacaccgcgggacggctcctcaacgacctgttccagcaggcactgcggaccggcaagcgggcgcactccgagaccggcatcgaccgcgccggacagtcgctggtcaccttcggcctggagcagctctccgccggtacggcggtcgaggcctgggccaagggcaagcgggccctggtcatcggtgccggctccatgtcctcgctggccgccgcgacgctcgcgcgtgccggggtcgccgaggtcgtgatcgccaaccgcacaccggaccgcgccgagcgcctcgcgcagatcctcacggagggcgacgacacggacgtgctggcccgcgcggtaccgatggacgcggtgccggccgagctgacacgtgccgacgtcgccgtctcctgtaccggcgccacgggtctcgtcctgacggccgaggcggtcgcggcggcggtcgaggggcgtacgggtacgccggtcgccgtgcgtgaggagaccccggcctccgcggcgggcggcctcgcccccgccggtaccgacgagggctgccccctcgacctgtccgcggtccagggcgccacgggcttctccgtgatgggagaggccgcggtcgccgggatggacgcggccaccctggaacagcacgcggcctgggtcgaccggggaaccgtcgaccgccgcgacagccgccgcacgcccgaggtcgaggccgagctgatcaccgcgctcgccgccacggtcgccgccggcggccgtctccccgagcgccgccggcccgagcccgtcgtcgaggccccccggcccgcgcccgcgctcgcactgctcgacctcgcgatgccccgtgacatcgacgccgccgtgcaccggctgctcggggtgcggctcgtcgacatcgagtcgctcgccgaggcctccgcggacgcgccgatggccgccgacgtggacctggtgcgccggatcgtcgccgacgaggtggccgccttcggcgccgcccagcgcgccgcgcacatcacccccaccgtcgtcgccctgcgcacgatggccgccgacgtcgtcgcgaacgagatcgcgcggctcgacggacggctgcccggcctcgacgagaagcagcgcggcgagatcacccagaccgtgcggcgcgtcgtcgacaagctgctgcacgcgccgaccgtacgggtcaagcagctcgcggccgagcccggcggcgccgggtacgcggacgcgctgcggaccctgttcgacctcgaccccgagacggtcgccgccgtctcccgggccgacgacagggacaccagtgacagcaccgagaacgccaagaaccgagggcgagaa

SEQ ID NO: 4724 - DNA, 972 bp, Streptomyces avermitilis
  CDS (1)..(972)
atgagtgagcaggcactgcggctggggaccaggcgcagcaagctggccatggcccagtccgggcaggtggccgacgccgtgaggcaggtgaccggacggcccgtcgagctcgtggagatcacgacctacggcgacacctcgcgcgagcacctggcccagatcggcggcaccggtgtgttcgtgaccgcgctgcgcgacgcgctgctgcgcggcgaggtcgacttcgccgtgcactccctcaaggatctgccgaccgcgcagcccgacgagctggccctggccgccgtaccggtccgcgaggacccgcgcgacgtgctcgtcgcccgcgacggactgacgttcgaagagctgggcgctccttccccgaaggggaccgcgcgggtcggcaccggctcgccgcgccgcatggcccagctgaacgcttacgcgcgcagccacggcctggccgtcgagaccgtcccgatccgcggcaacgtcgactcccggatcgggtacgtccgcagcggtgagctggacggcgtcgtactcgccgccgccgggctccaccggatcggccggatcgacgaagtgaccgagttcctgccggtcgacactgttttgcccgcccccggccagggggccctcgcgatcgaatgtgccgcggacaacgcggacctgatcgctgcgctcgccgagctcgacgacccgttcacccgggccgccgtgaccgccgagcgatccctgctcgccgccctggaggccggctgcagtgcccctgtgggggcgctggccgacctgctggccgacgggcagattgtcactgagatgcgcctgcgcggcgtcgtcggtacaaccgacggctcgacgctggtgcagctgtccaccaccggtcccgtgcccgagacgcacgaccaggcaatggcgctcggtcgcgaactcgctgccgagatgctcgccaagggcgcggccggtctgatgggggagcgagaacat

SEQ ID NO: 4725 - DNA, 1713 bp, Streptomyces avermitilis
  CDS (1)..(1713)
ttgagccccaccacccttcccgccggtccggaacacgggcacgtcaccttcctgggtgccggtcccggagatccgggactgctcacactgcgcgccgtggaggcgctggcgagagcggacgttcttgtcgccgagcatgaggtgctcgacgtggtccgtacgcatgccaggcaaggcgtcgccgtgctgaacacgtcttcggatgcgtattcggatacgtcgtcaggtacgtattcggccacaagcacgcctcaactagcggttgttgacagcacgtcgacgaccgctgggacccccgcgtcgagggatgccgccaatcttgtcatggaggccgcgcggggcggcaggcgggtcgtgcgtgcggtgtccggtgaccccggcctcgacacgtacgcggccgaggagatgctggcgtgcgccgccgcgggcgtgccgttcgaggtggtgcccggcatcgcggccgccgtgggtgtgcccgcttacgcgggtgtgccgctgcgggacgcgcagggcgccgacgtgcggttcgtggacgcccgttcggcgtcggagcggtgctggaccgaggtgggcgcgtccgatgggaccgtcgtcgtctcggccacgctggattccgtggccgcggccgcgggcgagctggtcgccgccggccgtaagcccgacactccgatgtcggtgaccatcgccggtaccaccacacggcagcgcacctggtccgccacgctcgggtccatcgcgcagacgctgaagcaggcgaaggtgctgccctcgcccgacggcggccgaccggtgatagccgtggtcggtgagcgttccgccgccgcccagcgcgaccagctgtcgtggttcgagtccaagccgctgttcggctggaaggtgctcgtgccgcggacgaaggagcaggcggcgtcgctctccgaccagctgcggtcgtacggggccgtgccgcacgaggtgccgacgatcgccgtcgaaccgccgcggacgccccagcagatggagcgcgcggtcaagggcctggtgacgggccggtacgagtggatcgccttcacctcggtgaacgcggtcaaggccgtgcgggagaagttcgaggagtacgggctcgatgcccgggccttcgccgggatcaaggtcgcggcggtgggcgagcagaccgcgaaggcgctggtcgccttcggtgtgaagccggacctggtgccgagcggtgagcagtcggccgccggtctgctggaggactggccgccgtacgacccggtcttcgacccgatcgaccgggtgttcctgccgcgggcggacatcgcgaccgagacgctggtcgccgggctcatcgagctgggctgggaggtcgacgacgtcacggcgtaccggacggtgcgcgcgtcgccgccgccggccgagacgcgggaggccatcaagggcggtggcttcgacgccgtgctgttcacgtcgtcctcgacggtgcgcaacctggtcggcatcgcgggcaagccgcacaacgtgacggtgatcgcgtgcatcggtcccgccacggccaagacggccgaggagcacgggctgcgggtggacgtcatggctcccgagccctcggtgctcaagctggcggaggcgctggcggacttcgggctgcggcgccgtgcgtcggcgctggacgccggggatccggtgacgcggccgagcgagcggcggccggggtcgcggcggcggcgtacgacg

SEQ ID NO: 4726 - DNA, 990 bp, Streptomyces avermitilis
  CDS (1)..(990)
atgacgaagtacggatccttccccggtacgcgtccccggcggctgcgtacgacccccgctctgcggcgcatggtcgccgagacccggctgcacccggccgacttcatcctccccgcgttcgtgcgcgagggcgtgagtgagccggtgccgatcacggccatgcccggcgtcgtgcagcacacgcgcgacagcctgaagaaggcggcgctggaggcgctggaggccggtgtctccgggatcatgctcttcggggtgccggaggacgcgaagaaggacgcccaggggtcggcgggcacggatccggacgggatcctccaggtcgcgctgcgcgatgtgcgggccgaggtcggggacgagctgatcgtcatgtccgacctgtgcctcgacgagttcaccgaccacggccactgcggggtgctcgacgggcagggccgggtcgacaacgacgcgaccctggagcggtacgccgagatggcgcaggtgcaggccgacgcgggcgcgcatgtggtcgggccgagcgggatgatggacggccagatcggtgtcgtccgggacgccctggaccagatcgggcgcgaggacgtctccatcctggcgtacaccgccaagtactcctccgccttctacgggcccttccgggaggccgtcggctcctcgctcaagggtgaccgcaagacgtatcagcaggatcccgccaatgcgcgcgagtcgctgcgggagctggccctcgacctggaggagggcgccgacatggtgatggtcaagccggccggtccctacctcgacatcctcgcgcgggtcgccgacgcggtggacgtaccgctcgcggcgtaccagatctccggcgagtactcgatgatcgaggccgccgcggagaagggctggatcgaccgggacaaggcgatcctggagacgctgaccggcatcaagcgggccggggcacagaacatcctgacgtactgggccaccgaggtggcgcagaagctgcgc

SEQ ID NO: 4727 - DNA, 714 bp, Streptomyces avermitilis
  CDS (1)..(714)
gtggcggccgggacggatcaccccacaagcttgggccatccaagcacgccgctcccggcaaccggtcgagcggccacgccgaccagccacaccagagggggccgacccatgtccgaacgcaccgcccgtacccggctgttcgccgccgccgcggtcgcgctcgcggcgctcgccctcacggcgtgcgagaacggcgagggcgtacgcgacgaggacccgtccgcggcgtccaagtcggcgacccggccgaccggttcgacgccgacgaccgcaccggacacggcggacaccaccccaggcaccaccaccgccggcagccccccgtgcaccgccgacaccaccaggatcatggccacggaggtctcccgccccctgaaccacctgctcctgaccctcaccaacaccggttcgaggacctgcaccctcaccggccacccggtcacccggttcggcgaggcccggtccgtcccggcggcgcgggagaccaggccgcgggcggcggtccggctgtccccccgcgagtccgcctacgcgggcgtgctcctgtcctcgggcgacggcagcggcgcatccggctccacggccaagaccctcacgatcaccttcaaggacggcagcaccgcccgcccggcgctcccgcccaggggggtccacgtcgacgaccggctcacggtgacgtactggcagtcgtccatggacaccgcgctcacgtac

SEQ ID NO: 4728 - DNA, 1353 bp, Streptomyces avermitilis
  CDS (1)..(1353)
atgtcatccctctggaatacggtccgggacgcgggtgagggagagaacgtggccggggacgagttcgcgggactgctgaaggaactcaaggagcggtccggactcagttacgggacgctcgggaagcggctgcacatgagtgcgtcgacgctgcaccggtacgtcaacggggaggccgtaccggcggattacgcgcccgtggagcgcttcgcccgggtgtgccgggcgacgcccgaggagctggtggagctgcaccggcggtgggtgcgggcggacgcgctgcgggggcagaagggggcgcccgagccggcggtggcgtcggcggtggctgtgccggagccggaggtggaggcggcttccgggaccgagggtgcgcctgagccggatgcggcctccggggccgaagatgcgcctgaggtggagtcggacgcaggagccgagcccgaatcgccggtacggcgtcggcgtaccgtcgtgctcgccggtgccgccgtggccgcggccgtcgtggccgccgcgctcgtcgtgaacctcgtgcccggcaagggcgacgaccacggccgcaagcagtcggcgggtgccgccgcctcgtccgccggcgtgacgtccgacggcaccgcgtcggccggtgcgaagagcgcgtcgccctcgccctcgccgtccgcctcgcgcggcgccggtcctgccccgtccggctcccggagtgtcggggcggagcggacgcggggcccggacgacggggccgccgcgccgatcgtcgtcgccaacgcgtacaagtgggacagcccgtgcagccagcactacctggtggaccgggacgccgcgcggatgccgccaccgccgaccgagccggacgcgcgcgggtgggtcaccgcgctcggcggggtgcccgccgggcagcagatgctcgcgctgaccgtgcagggcaccggcaaggccaccgtcgtcctggagtcgctgcatgtgcgggtggccaagaaggacgcgccgctcgcgtggaacgactacgagatgggcgtcggatgcggcggcggcgtggagacgcggtcgttcgaggtggatctcgacgccggccggccggtggccgtgcccaaggccggtcagcgggacttcccctacaaggtcagcgagtccgaccccgaggtgttctatgtgttcgcggacgcgcggacccatgacgtgagctggaacctggagctggagtggtccagcgggacgaagcacgggacggtccgcgtcgacgacaacggcgagctcttccgcaccagcggcaacgtggggcgtcccgcgtacaactacccgctgggttccacagagtggggcaggaacgcgtacgagccgaacgtcaaaggc

SEQ ID NO: 4729 - DNA, 900 bp, Streptomyces avermitilis
  CDS (1)..(900)
atgcccggtgacgccctcagccacgaccccgccgagctgagaaagaggatcgacaccaccaaggcgcatccggcgcgggtctacgacgtgtttctcggtggcaaggacaactacccggtggaccgtgccgcggccgccgcggcgctcgcggcgaacccgcgcggctatctggacgtgcggcacaaccgcgacttcctgcggcgggcggtgacgcggctggcgcaggacgacggcatccggcagttcctggacatcggcaccggtctgccgacgcaggagaacgtgcaccagatcgcccagcggatcaatccggactcacgggtcgtgtacgtcgacaacgaccccgtcgtgctcgcccacgcgcgcgccctgctgaacagcggccccgagggcgccaccgactacatcgacgccgacctcaagagccccgggcagatcctggaggcggccgccaagactctcgacttcgaccagccggtcgcgctcgtgctcgtggcggtcctgcacttcgtggaggacgcggaggcctacccgatcgtgcgcgagctggtggaggcgctgccgtccggcagccggctggtgctcagccatctcaccgaggacctcaacgccgagaacatccgcgcggtccagcggactttcacggagcgcggcttcaccttcgtgctgcgcaccaagggcgaggtcgagcggttcctcacggacaacggcctggagctcgacgacccgggcgtcgttcccgcccatcactggcggcccgacgacgccgctccggtgcccgagcagccggacgcgtcctacctcgcctccctcgacgacatcgagaaggtccgctaccgcgacatcaacgacgtcacggacgccgacatcaacgtgtacgcggtcaccggcaggaaggcg

SEQ ID NO: 4730 - DNA, 951 bp, Streptomyces avermitilis
  CDS (1)..(951)
ttgccccttaggctgccgcccatgctgcccagcgtggacacaagtgaagagttggacgcgatggtcagggacgaggcgctgctgcgaccggcggcccaggacctctgcgcccatctggggctgaccggtgcccggttggtccgtttcgacgatggttcgctgcccgtgtacgcggtcggcgggaccctggtactgaagctgttcccgggcttcgaggcggccgaaggcgtcagagaggcacgggtgttgtcccacctctggggtcaactgcccgtgccgacaccccgcttgcacgccggcgagatgtacaagaacggctggcgctacgtgctgatgtcccggctgcccggagtgagcctctcgacggcctggtcccggatcccggccgtcgagcaggaccggatcgtcgacgaggcggccgagaccctggccgcgctgcactccgtggactggaagccgctggccgacgtcgtcggaccggcggactggggcacgttcctgcgccggcagcgcgccggcgtactggagcaccaccgcgcggccgggctgccgaagccgtggctggaccagatccccggcttcctggacgcggtacggctgccggcgtcgggggaacgcgtcctgctgcacaccgagttcatgcgcgagcacctgacggtggacccgcaggacgggtggcgcctgaccggtctcttcgacttcgagccggccatgatcggcgacccggcgtacgacttcgtgagcgtcggcctgttcatgtcgcgcggtgacccccgcctgctccggaggttctaccaggcgtacggccggccgccgcacgacccgtaccaactgctcgcgtatacgctgctgcatgtgtacagcgatctggcctggtatctgcgggagatgccggccccgccgcacccacgcctcgacgcgctcgccgagacgtggttcggcacggacgga

SEQ ID NO: 4731 - DNA, 909 bp, Streptomyces avermitilis
  CDS (1)..(909)
atggcgacacttcccaatccgctgccgaagctggcggccgacccgagcggacgcacgctcgggctcgaactcccggccgggcgactgatcgacgcgacgcacgacgggccgtggcccgagccgctgctgtggtgcgcggacgggcccgccacccccggcgcctgggccgcgctcacgcccgcccggcggacggcggggctgctgccggtgctcctggacgtgggcggccctcaaggagagccggacgaatgggagttgatgcccgccgaggcgtcctatccgggtgatcacgacgctgaggaggtgctggccgagttctgggaggagtacgcggcggacgagctgtccgacggcgagggccggccgggcgaggagcgggccgaggaggtcttcgggacacccgcgtccggtgacgagacggtggcaccgttcggcccggtatggcccggcctcgcccccgccgcacacctcaccaccgacgccggcgccggccccgacgagagcgccgaccccgacgcccatgccgccgggacggccgactccctcgccgccgacggctcctggctgaaggagccgcggctcgccctggtcccggcccgccgcagcgcggacatcccggcggccctcggctggagcggcccgctgaaccacgagagcgacccggcccgcctgtgtgccgttctgcgctcctgggaggaccgcttcggcatacgggtcgtggccctcaccttcgaccagctggttctctcggtggcggccccgcccaccacaccggccgaggcggaagcggtcgccgccgagcacttcgcgttctgcccggacaacatcacgcggggccaccacaagacgctgcgctcctacgcggcacacgaggtcctcaaccggcggacctggtccttctggtgggac

SEQ ID NO: 4732 - DNA, 1770 bp, Streptomyces avermitilis
  CDS (1)..(1770)
atggcctcggtcacgtccctcaccgcttccgtccatcagcgcctcgcggacgccctctcggcagctctgccggaggccggttccgcggacccgctgctgcgccgaagcgaccgggccgacttccaggccaacgggatcctggctctcgcgaagaaggcgaaggcgaacccgagagacctggcgacgcaggtcgtggcgcgggtcgagtcgggtgaggtgatcaaggacatcgaggtctccggccccggcttcctgaacatcacgatcaccgaccaggccatcacccggaacctggcggcgcggtacgaggacggcgagcgcctcggcgtgccgctcgccgagcacccgggcacgacggtgatcgactacgcgcagccgaacgtggcgaaggagatgcacgtaggccacctgcggtctgccgtcatcggtgacgcggtggtccagatcctggagttcacgggcgagaacgtggtgcggcggcaccacatcggcgactggggcacccagttcggcatgctcatccagtacctgatcgagcacccgcacgagctggaccacaagggcgcggcggaggtctccggcgaggaggccatgtcgaacctgaaccggctctacaaggcggcgcggacgctcttcgactccgacgaggagttcaagacgcgggcgcggcgccgggtggtcgacctccaggcgggcgagcccgagaccctcgccatgtggcagaagttcgtggacgagtcgaagatctacttctactcggtcttcgacaagctggacctggagatccgggatccggacgtggtcggcgagtcgggctacaacgacatgctggacgagacctgccgcctgctggaggagtcgggcgtcgcggtccgctccgacggtgcgctgtgcgtgttcttcgacgacgtgaagggcccggacggcaacccggtcccgctgatcgtgaagaagtcggacggcggctacggctacgcggcgaccgacctgtcggcgatcagggaccgggtcttcaacctgaaggcgaacagcctcatctacgtggtggacgcccgtcagtccctgcacttcaagatggtcttcgagaccgcgcgcagggcgggctggctgaacgacgacgtgcaggcgcagcagctggcgttcggcacggtcctgggcaaggacggcaagccgttcaagacgcgtgagggtgagacgattcggctggtcgacctcctggacgaggcgatcgaccgcgccaccgccgtcgtacgggagaaggccgagaaggtgggcctgagcgagcaggagatcgaggagaacggccggtacgtcggtatcggcgccgtgaagtacgcggacctctccacctccgccgtccgggactacaagttcgacctggaccagatggtgtcgctgaacggcgacacgtccgtgtacctccagtacgcgtacgcccgtatccggtcgatcttcggcaaggccggcgaccgtacgccgctggcccacccggagctcgaactggccccggcggagcgggcgctgggactgcacctggaccggttcggggagacgctggacgaggtcgccgccgagtacgccccgcacaagctggcggcgtacctgtaccaactggcgtcgctctacacgacgttctacgaccagtgcccggtcatcaagccggcgccggcgcaggaggtcgcggagaaccgcctcttcctgtgcgacctcaccgcccgcacgctccaccagggcatggccctcctcggcatcaggacgcccgagcgcctc

SEQ ID NO: 4733 - DNA, 1644 bp, Streptomyces avermitilis
  CDS (1)..(1644)
gtggtcgtcgcgtccggcctctccccgtccggcccgatccacctcggcaacctccgcgaggtcatgaccccgcacctggtcgccgacgaggtccgccgccgcgggcacacggtgcgccacctgatctcctgggacgactacgaccgctaccgcaaggtcccggccggcgtccccggcgtcgacgagtcctgggccgagcacatcggcaagccactgacgtccgtgccggccccgaagggctccgcgtacccgaactgggccgagcacttcaaggccgcgatgatcgaggcgctggccgagctgggcgtcgagtacgacgggatcagccagaccgagcagtacacctcgggcgtctaccgcgagcaggtcctgttcgcgatgaagcaccgcggtgacatcgacgcgatcctcgaccagtaccgcaccaagaaggcccccgccaagaagcagcagggccagaagccggtcgacgaggccgagctggaggccgccgagggctcgggcgccgccgcggaggacgacggcagctccggctccgccggctacttcccgtacaagccgtactgcggccggtgcgagaaggacctcaccacggtcaccgcgtacgacgacgacaccaccgagctgagctacacctgcaccgcctgtggccactccgagaccgtgcggctgagcgagttcaaccgcggcaagctggtctggaaggtcgactggccgatgcgctgggcctacgagggagtggtcttcgagccgagcggtgtcgaccactcgtccccgggctccagcttccaggtgggcggccagatcgtcggcatcttcggcggcaagcagcccatcggacccatgtacgcgttcgtcggcatcagcggcatggcgaagatgtcgtccagcaagggcggcgtccccaccccggccgacgcgctccagatcatggagccgcagctgctgcgctggctgtacgcccgccgccggcccaaccagtcgttcaagatcgccttcgaccaggagatccagcggctctacgacgagtgggacaagctggcggccaaggtcgccgacggggccgtactcccggcggacgccgccgcgtacgcgcgtgccatcggcaccgccgccggggaactgccgaggaccccccgcccgatgccctaccgcaccctcgcctccgtcgccgacatcaccgccggcgccgaggaccagaccctgcggatcctgagcgagctcgaccccgagaacccgctcacgtccctggacgaggtccggccccggctcgacaaggccgagacctggatcaacacgcaggtcccggccgaggagcgcaccgtcgtgcgcgacgagcccgacgccgacctcctgaagtccctcgacgaccagggccgcgagtcgctgcggctgctgctggagggactggactccaactggtccctggacggcctcacccacctcgtgtacggcgtcccgaaggtgcgggccggcttctccgccgacgccacacccaaggagctgccgcaggagatcaaggtcgcccagcggaccttcttcgcgctgctgtaccacctgctggtcggccgtgacaccggaccgcgtctgcccacgctgctcctcgcggtcgggcaggaccgggtgcgcaagctgctcggcgcg

SEQ ID NO: 4734 - DNA, 1317 bp, Streptomyces avermitilis
  CDS (1)..(1317)
gtgtccgcgccactccagctgacacggatgcaccgggttctcatcggcgtggtcgtcaccggtgcggtcatcatcgccggtatcggcttcgccggttcgtacgcggccgtccgtgagctcgcgatcaagaagggcttcgggaacttctcgtacgtcttcccgatcggcatcgacgcggggatctgcgtcctgctcgccatggacctcctcctcacctggatccgcatccccttccccctcctgcgccagacggcgtggctgctcacggcggcgacgatcgcgttcaacggcgcggcggcctggccggaccccctcggggtcgggatgcacgcggtgatccccatcctcttcgtggtcgcggtggaggcggcccggcacgcgatcggccggatcgccgacatcacggccgacaagcacatggagggcgtacgcctcacccgctggctgctctccccggtccccaccttcctgctctggcgccggatgaagctgtgggagctgcgctcctacgagcaggtcatcaagctggagcaggaacgtctcgtctaccaggcgcgcctccactcccgcttcggccgcggctggcgccgcaaggccccggtggagtcgctgatgccgctgcggctggcgcgctacggcgtcccgctggcgcagacggcgccgtcgggcctggcggcggcgggtatcgaaccggtgctgctgccgccggcgccgcagccgcaaccgcagctcgaggccgcggaccccgccgcgggcagccttgccgccgggccggcgcccgccccgcagcaggcggcggcgcctcaggacaaccggcctcccgagcaaccggaataccccgaggagccggggccggaccagagcccgtggttccaggcacctcaacagcaggtcgtctacgggggcggctacgatccgtcgtacgagcctgaggaggcgtacgagcagtggtacgaggagcaggggcccgagcagaatgagccggacccggaagagaccggcaactttccgatcccggcgggccccggccgtacgcgccagctgggcgacggcggcgccccggagccggagccgttgcccatccccgcccagcgggtggagcagtcgccgctctcggacgagaagtcccgcgaggagagcttctaccaggtgttccgccagtcgataatgcctggccaggggctgcccacgaagggtgagttcggcaacaacgtcgaggccacgtatggcgtcacgctcaccgacagcgagctgaagcgctatatgaaccgcttccagaaccgtttcaacacggagctggaggaggaccacatcgcg

SEQ ID NO: 4735 - DNA, 948 bp, Streptomyces avermitilis
  CDS (1)..(948)
atgcaccgacctgcacagcgagaccagcgagaccagtgcgagcagcgccgaccgctcgagcagcgcgaggagccggcgcgccggacctcgcgactccaccgcgtcgcccttgtctgcgcggccgccgtcccggtgatgctcgtcgcctccggctgctcctcggactccggctccggtgacgacgcgcagaaggaagccgcgacgagcagtgcgcagccctcgcagagcgcctcggagaaggccgtgcaggaggccgcgtacgcgacgctgcccaagccctgcgacgcgctggcgaagaagacgctggcggatctcgtcccgaaggcgaacaagtccggcaaagcgggcgcttcgaacgagtcggggacgcggggcagctgctcctgggacagcctcgacaacaacggcgtcaagggctcgcagttccgctggctgaacgtgtcgttgctgcgcttcgactcggacgcggcgcgcggcgagggcaacgagctcgcgcaggagtactacgtgaagcaggtcaaggacgcgcaggcggtggagggcgcgaagaacgccaggacgcagccggtgtccgggacgggcgacgaggcgacggcggtgcggtacgacctgaagaagaaggagggttccttcaagcagcagacggtcgtgacgcggatcgagaacgtggtcgtcacgctcgactacaacggcgccggactcgccggtgagaagacccccgacgccgccgacctgacgaaggcggcggagaaggccgcgaaggagacggtggccgcggtcatcgccgcgaaccagggcgacggcacggcgagcgagagcgcggcgccgtcgaaggaggcctcgaagagcgcctccccgtccaagtcggcctcgaagccggcctccgggtccgcctcgaaggacgcctcgccgtccgcgtcggcgtcggcgtcggcgtccaagaagaac

SEQ ID NO: 4736 - DNA, 873 bp, Streptomyces avermitilis
  CDS (1)..(873)
gtgcagcggaaggcgtacgtacccggcgccgccgtgctcctcgcggcgctgctggccgcctgcaccggcggatccggcagcgacagcccgccggacgacccgaagcccggcgataccggcccgagcgccacggccgcccagcccggcaagtaccgcaccctctccgacgcgtgcagcgccctgagccagggcacgctcgactcgctgctgcccggcatcgagcagctcacggaccaggagcagcgcgaccgggcgtaccagggcgaggccacgcccacctatgacaacgaccgccgctccggctgccgttggaaggccgagtcgaccgacgccacggaccatctgctcgtcgacttcgagcgggtcgtctcgtacgacaacgcggtcagcgacgacacccgcgcccagaaggtgttcgcggccaagcagacggacgcgaaccttccggagccgtccgcgagcggctccggtcccgagggttccgagggttccgagggttccgagtcgtccacgagcacgagcccgtccggctcggcgtcgcccacgccctccggcgacagcagcaggagtgcgggttccggcggcgcctcttcgtccggctccgccaccgcgaccgccggtgccacggccaccggaaccccggccgacctccagccccggaccctcgacgatctcggcgacgcggcgttcctgaacgacgtgctgagcacggccaggcagcgcaccgtgactgtggtgttccgcacgtccaacgtcgtcgtgagcatcgggtacgacgagcagtcggcgcatcccggcacggtccccgacagcgaggaaatgcaggacagggtgcggaaactggcccagcagctcgccgattcgttcgccggg

SEQ ID NO: 4737 - DNA, 1191 bp, Streptomyces avermitilis
  CDS (1)..(1191)
atgtcgtacgtggagatgccgggcgcgaaggttccgatccgtatgtggacggacccggcgacggtcgaggacgtcgccctgcgccagttgcagaacgtcgcgaccctgccctggatcaagggcctcgcggtcatgccggacgtgcactacggaaagggcgcgacggtcggatcggtcatcgcgatgcagggcgcggtgtgtcccgcggcggtgggggtggacatcgggtgcggcatgtccgccgtcaggacgtcactgaccgccaatgacctgccgggggatctttcacggcttcggtcgaagatcgaggaggccattccggtggggcgggggatgcatgagtctccggtcgagccggggcggttccatggcatggccacggctggctgggacgacttctgggggcggttcgacggggttgccgaggctgtgaagttccggcaggggcgggccataaagcagatgggaacgctcggcggagggaatcacctgatcgaaacttgtctcgatgagtcaggttcggtctggttgatgctgcactccggttcccggaacatcggcaaggagctggccgagtaccacatcggcgtcgcgcaggggctcccgcacaaccaggggctcgtcgaccgtgatctggcggtgttcgtctcggacacaccgcagatggcggcctatcgaaatgacctctactgggctcaggagtacgccaagtacaaccgcgcgatcatgatggcactcctgaaggacgtgatccggaaggagttcaagaaggcgaagcccaccttcgaccaggagatctcctgtcaccacaattacgtctcggaggagcggtacgaaggcatggacctgctggtcacccgcaagggcgcgatccgcgcgggttccggtgagtacgggatcatccccggatcgatgggcaccagctcgtacatcgtgaaggggcgtggaaacgaaaaggccttcaactcggcctcgcacggcgcgggccggcgtatgagtcgcaacgcggcgaagcggcgcttcacggtccgggatctggaagagcagacgcggggagtcgagtgccgtaaggactccggcgtgctcgacgagatcccggcggcctacaagaacatcgaccaggtgatggagcagcagcgcgatctcgtcgaggtcgtggcaaagctgaagcagttcatctgtgtaaagggc

SEQ ID NO: 4738 - DNA, 435 bp, Streptomyces avermitilis
  CDS (1)..(435)
gtgggttacacgagccagggctacccgttcgtctctctcaccacgcagagcacggccatcggcgcctacctgtgcttctacgccgggaaggtgacaggagccgagcgcaccctcaagcgcaacgcccgagaccgcatctacaacatcccttacacgaaggagaacgcccaggagctggcggctcacctctactacaaagactgtctgtcgctggcgcgtaagcaaaccgccgccgactcgctgggcgcttgggttcgtccggaaggcatgaaggtcgcgcccgaccgccggcgttggaacggctgggaggaccgcgtactgctgaggctgaacaacgacgcggcagcggcaaaagaactcggccgaaccgagaagagctgctgcatccgtctttggcgcctgcgcaccggccaggtgcccatgccaagcgaccaa

SEQ ID NO: 4739 - DNA, 777 bp, Streptomyces avermitilis
  CDS (1)..(777)
atgaccgcccccgccgccccgtccgccgcctcccgtatcgccgtcgtcaccggcgccagcagcggaatcggtgccgcgacggcccggcagctcgccgaggcgggctatcgcgtcgtcctcaccgcccgccgcacggaccgtatcgaggcgctcgccaaggagctgggcgcggcgggccacgaggcgacggcgtacgcgctggacgtcaccgaccgcgcggcggtcgacgagttcgccacggccttcaagaccatcggcgtcctggtgaacaacgcgggcggcgcactgggcgccgacccggtcgcgagcggcgacccggcggagtggcgccagatgtacgagacgaacgtcatcggcacgctgaacgtcacccaggccctgctccccgcgctcaccgcgagcggcgacggcacggtggtcgtgctcacgtccaccgcggggcacggcacgtacgagggcggcgcgggctatgtcgccgccaagcacgccgagcacgtcctcgccgagaccctccgcctggagatcgtcggcacgcccgtccgcgtcatcgaggtcgcgcccggcatggtcaagacggacgagttcgcgctgacccgcttcggcggcgaccaggagaaggcggccaaggtctacgcgggcgtggccgcaccgctcaccgccgacgatgtcgccgacaccatcacctgggcgatcacccgccccagccacgtcaacatcgacctcctcgtcgtccgcccccgcgcacaggcctcgaacacgaaggtccaccgggagtcg

SEQ ID NO: 4740 - DNA, 336 bp, Streptomyces avermitilis
  CDS (1)..(336)
atgctcgtcctccgctccgccgccctcttcgtcgccgccgccctcttcgagatcggcggcgcctggctcgtctggcagggcgtgcgcgaacaccgcggctggctgtggatcggcgcgggcgtcatggcgctgggcgtgtacggctttgtcgccaccctccagccggacgccgagttcggccgcatcctcgccgcgtacggaggcgtcttcgtggccggctcgctcgcctggggcatggtcgcggacggctaccggcccgaccgctgggacgtcaccggcgcgctcatctgcctcgccggaatgacagtgatcatgtacgcgccgcggggcggcaac

SEQ ID NO: 4741 - DNA, 489 bp, Streptomyces avermitilis
  CDS (1)..(489)
atgtccgggaaggccgacggcggcggaagcgcgcgggagcggctgctcgacgagctgtccgacgtgtcccggcggtacatggcctcgtacgccctgttcaaccaggccatcgccgaccacctgaagctgcatccgaccgatctccagtgcctgaacctgctcggcctggaggccgggcccgtgacgaccgggcggatcgccgagctgacggggctgacgaccggttcggcgacgcggctcgtggaccggctggagaaggcgggctacgtcgtacgggagcgggacgcggccgaccggcggcgggtgctggtggcgaccgtgccggagcggatggccgagttcgggcggctgtgggaccggctgggcccccggtggtacatgctcttcgaggagctggacgcgagtgaactcgccctgatcatcggccatatgcggcgcacggtcgacttcaccgccggacaggtcgcccggctgcgcgagggcgacatc

SEQ ID NO: 4742 - DNA, 408 bp, Streptomyces avermitilis
  CDS (1)..(408)
gtgacccgtatggcgaccatgaccgccgcccagcggcgcgatcaggcgcgacgcgagtacgacgcgttcatccgcagctgccccaccaaccagcttctcgaccgcatcagtgacaagtgggtcagcctcgtcgtcagcgcgctcgccgccggatccatgcgctacagcgacctcggccgcaagatcgcgggcgtcagccccaagatgctgacgcagacgctgcgcgcactggagcgcgacgggatcgtcgcccggaccgtgaccccttccgtaccggtccgcgtcgactacgagctgacacccctcggcaccagcctcagctgcctgctcagcgcggtgaaggactgggcggagctgcacatcgagcaggtcaacgaggcgcgggaacagtacgacgcggaggagcac

SEQ ID NO: 4743 - DNA, 876 bp, Streptomyces avermitilis
  CDS (1)..(876)
atgcgtgctgtagtcgtgacgtccttcggtgggcccgaggccgtcgagatcgtggagaccggggtgccggagccggctgcccggcaggtgcggatcaaggtcgcggccgccgcgctcaaccccgttgacgcgggcgtgcgttcgggtgtcttcggtggcgcgggcaagcggctggggctcggctgggatgtggccgggaccatcgacgcggtgggcgtggccacgggctggaccgtcggcgaggaggtggtggctctggcgtacggcgccgccaagtccctcggtacgcacgccgattacgtggtcgtggatgcggacgcggtcgcgaaggcgccggtctcggtggacgcggtgcacgccgccaccgtgccgctcaacgccctcaccgccgcgcaggccctggacctgctggccctggagccggggcagcgtctgctggtgacgggtgcggcgggcgccgtcggcggttacgccgcccaccgcggcatcgcggtgaccgcgctggcccgcgaggccgacgcggagctcgtacgttccctgggggcggccgagtcggtgaccgggcccgtggcgccggggagtgtggacgcggtgctggacgcggcgatcctgggcgcggcggcgctggagtgggtgcgggacggcggcgcgttcgccggtgtcatcccgcaggcgcagccggcgtcggagcgcggggtgcggacgggcgcggtcgaggtgagccccgacggggcgcggctcgcggagctggtggctctggtcgacgagggcgtgctgaccccgcgggtggccgagacgtacgcgctggccgaggtggccaaggcgcacgcccggctggcggaggggggcctgcgggggcgggtcgtgctgatcccc

SEQ ID NO: 4744 - DNA, 1413 bp, Streptomyces avermitilis
  CDS (1)..(1413)
gtgacgcagatactgcatgacgcaaaagaaaaacagctgcccgcccgcacccgctgggcggtcctcggggtcgttctcgccgccgacgtcctcgacctcctcgacagcaccatcacgaacatcgccgccccgacgatcgccgccgacctcggcggcggcaccgccctcgtccagtggctcggcgcctcctacgcgctcgcgctcggcgtgctgctcgtcctcggcggacggctcggcgaccgccacggccgccgccggctgttcctcgccgggctcagcgggttcaccgccgcctcgctcgtctgcgggctcgcctggaacccgcaggcgctcgtggtcgcccgcctgttccagggcgcgttcggcgcgctcgtcatcccgcagggcttcggcatcctcggcgccacctggccacgcgaccagatacgcaaggcctacagctgcttcggaccggtgatgggcctgtccgccgtcggcggcccggtcctcgccgggttcctcgtcgacgccgacctcgccggactcggctggcgcccgatgttcctcatcaacctggtgctcggcggagccgcgctcctcgccgccgcccggctgctcccccgtgacaccggtgaccgcgcggtcaccgtcgacgggcccggatcggccctcctcggcggcgccatgctcggcctgctcggcgggctgatccagggctcggcacacggctggaccgccacgcccgccctcctcaccgccgccggcctcgtcctgttcgccctcttctgccaccgtcagcgcaccgccgagaaccccctcatccggccctccctcctccgcaaccgcggcttcacctccggactcgctctcggcaccgtcttcttcgccgccgtcgccggactcctctacgtcatctcgctcttcctgcaacagggcctcggccgctcgccctccggggccgcgctcggcctgatgccgctgtccgccggcatcgtcatcgcgtccatcgcctgctaccggctgatcggccggctcggccgccgactggtcctcggcgggctgctcatcaccctcgccggaacggcgtacctgctgaccctcgtcgccctctccggcacggacacgggcgcctggaccctcgtaccgcccctgctcgtcatcggcctcgggatgggcacctgcttcgggagcatgtacgacgtcaccctcggcgacatcacggacgaggaggcgggcagcgccggcggttcgctcggcgcggcccagcagctcgcgggcgccgtcggagcggccgccgtcaccaccgtctacttccacacggccggcggcgcgacccacgccatgaccgtgagcctcaccgtggtcgccgccgtgaccctgctgtgctgctccctcgtacgactgctgccgcgcaaggcgcgcgaagagcaccat

SEQ ID NO: 4745 - DNA, 522 bp, Streptomyces avermitilis
  CDS (1)..(522)
atgtgggtgaggcgcccgggtggtgtcaaggcgaataccgcgaatgccggtacgggacccggcccggaccccggctcgctagggtgccggggtatgaagatcatcgacctggagcccggcgacgcgcggctcgacgccgagatactgcccgtcctgcgcgaactgcgtccgcacctgaccccggagctcttcgcggaggtgtacgccgaggggtacgcgcagggcctgcgcttcaccgccgcctacgccgacgacgggacctgtgccggtgtcgccggctggcgcgtgatcgtcaatacgagcgccctgcgcaagctgtacgtcgacgacctggtgaccgcggagagcgcccgttccggcggggtcggccatgctctcctcgcgcacctggagagccgcgcccgcgtcctcggctgccatgtgctgaacctggactccggcacgaagcgcaccgccgcccaccgcttctatctgcgcgaacgcatggacatcaccgggttccacttcgtgaagcggctcgac

SEQ ID NO: 4746 - DNA, 807 bp, Streptomyces avermitilis
  CDS (1)..(807)
atggccgctccacgccgggacacccaaggcatcgtcgacgccgcggagctcttcgcgcgcgtcgacttccggcgccgcgagcccgccgagccgctgcgcccgtatctggagcactactggctgatcgactgggacctgacgcagccgtacgcctcccatgtcgtcccgcacccgtccgtcaatgtcgtcttccagaagtacgcgggccaggagggcttcggcgaggtcgcgggcatcgggctggagctgttcacacagaagctccaggggcggggccgggtgtgcgggatcaagttccggcccggcggcttccgccccttcgcgccggaccacgcggcgacggagtggaccggtcgccgggtccccctgccggaggtgtccccgggggccgacctcccggccgtcctcaccccggacgacgaggacgcgcgcgtggccgccctggacgccttcctgctgagcatcggcccgcggcccgacccccaggccgacctcgcgatggccctcgtcgaccgcatccgcaccgaccgtacgatccgtcgcgtcggcgacttcgcccgcgcggagggcgtgtccgtacgcgtgatgcagcgcctgttcgccgcgtacgtcggcgtcggcccgaagtggatcatcctccgctaccgcatccaccaggccctggagcacgcggagaactcccgcgaggtggactgggcgggcctcgccgccgacctcggctacgcggaccaggcccatctggtgcgcgacttcaccgcgacggtgggggtgccaccgacggcgtacgcggcgggcccgcacaccggc

SEQ ID NO: 4747 - DNA, 1092 bp, Streptomyces avermitilis
  CDS (1)..(1092)
atgcagttcgggatcttcagcgtcggcgatgtcacaccggacccgaccacgggtcggacgccgaccgagcgcgaccgcatcaaggccatggtcgcgatcgcgctgaaggcggaggaggtcggcctggacgtcttcgcgaccggcgagcaccacaacccgccgttcgtgccgtcgtccccgaccacgatgctcggctacatagccgcgcgcacggagaagctgatcctctccacctccaccaccctcatcaccaccaacgacccggtgaagatcgccgaggactacgcgatgctccagcagctcgcggacggccgggtggacctgatgatgggccgcggcaacaccgggccggtctacccgtggttcgggaaggacatccgccagggcatcaacctcgccatcgagaactacgcgctgctgcaccgcctgtggcgcgaggacgtggtgacgtgggagggccagttccgtacgccgttgcagtcgttcacctcgacgccccggccgctggacggcgtaccgcccttcgtctggcacggctcgatccgctctcccgagatcgcggagcaggccgcgtactacggtgacggcttcttccacaacaacatcttctggccggccgaccacacgaagcagatggtcgagctgtaccgggagcggtacgcgcactacggccacggcacgcccgagcaggcgatcgtcgggctcggcgggcaggtgttcatgcggcacaactcgcaggacgcggtccgcgagttccggccgtacttcgacaacgcgccggtgtacgggcacgggccgtcgctggaggacttcacggaccagacgccgctgacggtcggctcgccgcagcaggtgatcgagaagacgctggccttccgggagtacgcgggcgactaccagcgccagctcttcctgctggaccacgcgggtctgccgctgaagacggtcctggagcagctcgacatcctcggcgaggaggtcgtaccggtgctgcgcgaggagttcgcgaagggacggccggcccaggtgccggacgcgccgacgcacgcgtcgcgcgtgacggcggccgcggccgccaaggaggtgacggtg

SEQ ID NO: 4748 - DNA, 726 bp, Streptomyces avermitilis
  CDS (1)..(726)
atgaagctggtcgtggtctccgcggggctgagtgtgccctcgtccacgcggctgctggccgaccggctggcgaaggcgaccgccgcgagggtcccggcggaggtggaggtcgtcgaactgcgcgacctcgccgtcgagatcgcgcacaacttcaccaacgggttccccggacgcgcgctggccgccgcgatcggggcggtgacggaggcggacggcctgatcgtcgtcacgccggtcttctccgcctcgtacagcggcttgttcaagtcgttcttcgacgtgctcgaacagggcgtgctcgccggaaagccggtgctgatcgcggcgaccggcggttccgcccggcactcgctggtcctggagcacgcgctgcgcccgttgttcgcccacctgcgggccgtggtcgtaccgacgggcgtctacgcggcctcggaggactggggagcggaggggctggccgagcggatcgagcgggcggccggggaactggcggggctcatgacggggctcatgtcaggggtttcggcggtggggccggcgcgtgacgcgcagccgcgggccggggcggaggtctcggccgacggcccggcggcggccccggcggaggggtccgtaccccggccccgggagaccgtcgcgcagtccgcgaccgccggccgcgggtctcgcacggacggtttccaggtggtgcccttcgagcagcagctcgccgccctgcgcacgcgg

SEQ ID NO: 4749 - DNA, 2136 bp, Streptomyces avermitilis
  CDS (1)..(2136)
gtgaccggacggcacgccgggggcggcagggtgtgccggcccggcactggagctccggtccgtccagggtccgaccgccggaccgcagacggagagaggtggcgcatgacggcccatgtgacggacgaggacaccgcggccgatacggccgcgacagcggcgggcggggccacgcgccccgcgagcacggccacgaccgcggcgatccccgtcccggccgcaccggtccccgtcacgtccgtcgcaccgcccgcgcagacccccatggccgggccgggggctccccccacccgggtgcggcctgggcggcggagggggtgggccgcagcgcttcggcggtggcggcccgccccctggcccgcgctccgggccatcgccgaacaaacctttcggcccctcctgctgaccgccttccggcccaccttgctgaccatcgccacggcgggcgcggccgccgggatcgcggtcggccccgcgggccccaccgccacggtccccgcccatgccgcgggcacgaagacgagagcggggaccaccgggaccaagaccaagaccgggaccggggccggggccgggaccgggaccggggccgggaccgggaaccggggccgggaacccgggaccgaaaccgggaccgcgaccggagccgaaacccgcaccgccccccaacgccccgccccccttccccccggcaccgccacggccccctggcgcccgaggttcccccagggccgcgggctcgaagccgtctccctcctctacctcctggtccagctgaccctcgtcgtcccgcacctggcgcacgttctcggctgggacgagaccgtctacgtctcgcaggtcgacccccgcacgcccgccgccttcttcagcgccccccggtcccgcggcatcagcgtcctcgtgtcgcccgtcctcgcggtgaccgactcggtgctcgccctgcggatcgcgctggccctgctgtcgacggccgcgctgtacgccgcgtaccgcgtctggcgcccgctcctcggccccgccacgaccgccctcgccgcgctggtgttctcgggcctgtggatcgcccagatctccggcccggaggcgatgcccaacctgtgggtggcgctgggcgccgtcgcggccaccggcctgttcctgcgcgcgccccgggaaccgaacgcccgctggtggctcgccgcctgcctggccggggtcgccctgatgcgcgtaccggacgcggcctggctcggccttccgctgttcgcgaccgccgggtgcgtacgctcccaccgccgcaccctgccgtacctgctcggcggtctcgcggccggcgccacgcagtggaccgtggaggcgtacagccgtttcggcggcgtaccgcagcggctgcacgtctccggcgccaccgagggaggcatgcacccgcacctcaacctcttcaacgcctggcgcagcctcaacggccccgaactgtgccgcccctgctcgggtccggtccaccaccccgaactcaccctctggtggctggcgctgcccctgctcgcgctggccgcgctggccgtcgccctgcgcgagcggcgcacgggggtcccggccgaccgcacgctcgtcccgctggccgtcgcggtctgcctctccgcgccgtacctgctcctgctcagctactcggcgccgcgcttcctgcttcccgcgtacgccctgctggcgctgccggtcggcgggctgctcacccgtgtcgcacggccgcggcccgccctcgcggtcacggtgggctgtctggtcgccctgcaactcgtcgcgcagtacccggtgctgcaccggatgaccgctcaggtggcgtccttggaccagcgctaccgtgtcgccgccgacgaactgaacgccctcgggctgcgcgcaccctgcctgctcgtgggctcgcacgcgcagccggtggggtacgacgcgggctgcgcctccgccgcgacgaagggcaacaaccgcaacaccacgccgagttccgtactgcggcgggccgagcggatgcccacggccgtcctgacggccgacgcccagcggcccccgcgctacgcccgcgactggacccggcacccgctgccgggcaccgacggctggacggcctggctggcaccggccccgggtgcctcccgc

SEQ ID NO: 4750 - DNA, 1323 bp, Streptomyces avermitilis
  CDS (1)..(1323)
atgaagcggatgacacgcatgacgagccgcgccgggcgcaggaagatcgtgttcctgctgcacaacgcgtatgccatcggcggcaccgtccgcaccaccctcaacctcgcctcggcgctggccgagcggcacgacgtggagatcgtgtcgatgtcccggcaccgcgccgagccgcgcttcgccgtcgacccgcggatcaccctcgtccccctggtggacacccgcgagggcagcgccgacctggcggacccggcgtacgcgcgggaggccgtcgacttcccggtggccgacaagcgccaccaccagtacacgcgcctcaccgacctgcgggcgcgggcgtatctggagagctgcgacgcggacgtcgtcatcggcacccggcccggcatcaacgtgtacatcgccctcgggccgcgccgtgcgctgcgcatcgcacaggagcacctgcggcacgacgcgcacgccaagcggctgcgcactgttctcgcgcgccactaccgggacctcgacgcggtggtgacgatgaccggggcggacgcggaggtgtaccggacgcggatgcccctgcccggcgtccgtgtggtgtcggtgccgaacatcgtgccggaggtcggcgtcgcgccctccgacggcacggcgaaggtgatcgcggccgccggccggctggtccccgggaagcggtacgacgtcctgctggaggcgttctgcgcggtggccgccaaggatccggactgggaactgcgcatctatggaggcggggccgagaaggagcggttgcaggggctgatcgacgggttggggctcgccggtcaggcccggctgatgggggtgcgtacgcccatcgaggcggagttcgcccaggcgtcgctggtggtcagcgcctcggacgcggagtcgttcgggatgacgctggtcgaggcgatgcgctgcggggtgcccgtggtcagcaccgactgccccctcggccccgccgagatcatcacggaccgcgtggacggccggctggtgcccgtgcgcgacacccgcgccctcgccgacgcgatgctcgacctggtcctggacgacgatctgcgcaggtcgatgggcgccgcggcccgcgcgagcgcccaccgctacgaccccgagccgatcgtcgaccactacgagcggctcttcgccgagctgcgggcggcccgccccgggcgggcgtggtcccggcagcgggagcgcgcacggggctgggcccgccgcacggtccgggcggcccggcgccggctgcgcgcctggggtggcggccgccgccctgaactgacgggggcgaggacgcgtacagcacgggagacg

SEQ ID NO: 4751 - DNA, 735 bp, Streptomyces avermitilis
  CDS (1)..(735)
atgccgccgcggccttggcagactggcggggtgacccagacagttctgctcgccgaggacgaccgcgccatccgtcatgccctggaacgcgcgctgacgcttgagggttacgcggtgaccgccgtcgccgacggggtcgaggcgctggcccaggcccaccgcaccccgcccgacgtgctcctgctcgacgtgatgatgccgggcatcgacggcctccaggtgtgccgcgtgctgcgcgccgagggcgaccgcaccccgatcctgatgctcaccgcgctggtggagacggccgaccggatcgcgggtctggacgcgggcgccgacgactacgtggtgaagccgttcgacgtggaggaggtcttcgcacggctgcgggccctgctgcgccgcaccgggaacgcctccctcgacgcgccgaaggaggagccgtcgcccagcgggcaggtgtccgtggcggggctgcggatggacgtgcaggcccggcgcgcctggcgcggggagcgtgaggtggagctcacgcgcaccgagttcgacctcctggaactgctcgtccgcaacgcgggcatcgtcctcgaccacaccaccatctacgaccgcatctggggctacgacttcggcccgggttccaagaacctcgccgtgtacgtgggctatctgcggcgcaagctcgaccagccgggggctccagcgctcatccacacggtgcggggcgtggggtacgtcttgagggaggac

SEQ ID NO: 4752 - DNA, 1653 bp, Streptomyces avermitilis
  CDS (1)..(1653)
gtgcccctggtgtcccggctgccccggagcctgcgcacgcgcttgcgcggcatctcctcactgcgcgccaccttcacgctgtcgttcgcggcggtggccgtcggggtgaccgtcctcgtcggcttcctgagctacgacgccgccgcccggctggtccgcctggaccagcagaccgtgttcgcgcaggtcgtgcacgacctgcgcgaacaggtgcggcacgacgcactggaccccgaggacttcgcctcctccgaccccgaccacgacggcccgctcgacgacatcatccggcccagccgtacggacgtgcaggtgctcggccccggtggcgcggtcgcggaccgggggcacccggtgctgccggtggccgccgcggaccggcaggtcgccgaggcctcctcggccgggaagctggcggagcacaaggaggtcgaggtggccggcgacttctaccgggtggcggccgtctccctcggccacgggcggggcgcggtgcagatcgcgcagcagttcagcgacacggaggatctgctgcgccagcttcagcagcggacgttcctgctggtcggcggcgttgtgatcgcggcgggactgttcggctggtggttggcccggcggataacgcggcggctggtccggctcaccgcggccgccgaggacgtggcccgcacccggcgactgggcattcaggtgccggtcaccgggcgcgacgaggtggcccggctcggccgcgccttcgaccgcatgctgggccgcctggcccagtcggaggaggaccagcgccgcctggtccaggacgcgggccacgaactccgtacgccgctcacctcgctgcgtacgaacatctcgatgctccgccgcatcgacgaactgccacccgccgcccgcgaggaactggtcgccgacctggccctcgagtcgcgggaactgaccgacctggtcaacgagctggtggatctggcggccggccagtcggacacggagccggtgcagcggctggacctgggagacctcgcggaggacgtggcgatcgtggcccgccgccgcacgggccgtgacgtcatcgtccgcgtcaccggcgacccgacggccgacggccgccccgcggcgttgcagcgggcgctgtcgaacctggtggagaacgcggcgaagttcgaccgcgacggcgaggaggcgatcgagatcgtggtgacgggcgcggcgggggccgggacggtgcgcgggcccgggacggcccggccggacacggcccgcgcctcggactcggcccgttcggaggcgctccgtgcctcgggctcgctccgctcggacgtgctccgcgcctcgggctcggctcgttcggaggtgctccgtgcgccgggctcggcccgttcggacggcgcggcgccgtccgaggccgccgtcgggccgggcagcgtgcgcgtcgaggtccgggaccgcggccccggcatcgcggacgccgacctgacgcgcgtcttcgaccgcttctaccgggcggccgacgcccgcagcctgcccggctcggggctgggcctgtcgatcgtgcgcgaggtcgcgatgtcgcacgggggcacaccgttcgcctaccggcgccgcggcggcgggtcggtcatcgggttcaccgtgggtgggggtgcgccgggggagggggag

SEQ ID NO: 4753 - DNA, 1995 bp, Streptomyces avermitilis
  CDS (1)..(1995)
atggccggaaccgttcgcaaagccgtacgtcaggagagcccgcagatggccgccaccgtcccacgcgaccgcacgaagcgactgcgggcgtggatgctggaggggctgtccgacatggccaggcccccgcaggggccgcacgccccgcccgagcccgcgcacaaggggcagcgctggtggcgggtcatgtgcctgaccggtgtcgactacttctccacgctcggctaccagccgggcatcgccgccctggcggccgggctgctgtcgcccgtcgcgacgatcgtgctggtgatcgtcaccctggcgggcgcgctgcccgtgtaccggcgggtcgccgaggagagcccgcgcggtgagggctcgatcgcgatgctggagcggctgctgtcgttctggaagggcaagctcttcgtcctgacgctgctgggcttcgccgccaccgacttcctgatcaccatcaccctttcggcggcggacgcctccacccacctcgtcgagaacccgcatctgacgagcgccctgcacggctaccagatgccgatcaccctgttcctggtggcactgctcggcgcggtgttcctcaagggcttcctggaggcgatcggggtcgcggtcgccctggtgggcctctacctggcgctgaacgtggtggtcgtggtcgccggcctgtggcacgtggtcacggccggccatgtggtcaccgactggtccaccgcgctgaccgccgagcacggaaacgtttttgccatggtcggcgtggccctgctggtcttcccgaagctggcgctcggcctctccggcttcgagaccggcgtcgcggtcatgccgcatgtcgcgggcgacgccggcgacacggaggaccggccggccggccgcatccggggcacgaagaagctgctgaccacggccgccgtcatcatgagcgcgttcctgatctgcacgagcttcatcacgacgctcctcatcccggagagcgagttcgaaaccggcggccaggccaacggccgcgccctcgcgtacctggcccacgagtacctgggcggcgccttcgggacggtgtacgacgtctcgacgatcgccatcctatggttcgccggcgcctccgcgatggccggcctgctcaacctcatgccccgctatctgccccgctacggcatggccccgcactgggcgcgcgccgtccgcccgatggtcatcgtcttcacgctcgtcggcttcctggtgacgtggatcttcgacgcgaacgtcgacgcgcagggcggcgcgtacgccaccggtgtgctggtgctgatcagctccgccgcgatcgcggtgaccatcgcggcgcgcaaggcgggccagcgcaacgcggctatcggcttcgcggtgatctcggcggtcttcctctacacgaccgtcgtcaacgtcatcgaacgcccggacggcgtcaagatcggtgcctgtttcatcgcgggcatcatcctcgtctcactgctgtcccggctggcgcgcgccttcgaactccgcgtcaccagcgtgacgctggacgagctggcgcagcggttcgtacgggacatcgccagccggaagatccggttcatcgccaacgagcccgacaaccgcgacatcgccgagtaccgcgacaagatcgagcagatccggcacgacaacgacattccggcgcaggaggacttcgtcttcgtcgaggtgacggtcctcgacccgtcggagttcgaggcgggtctgagcgtacggggcgaggtcctgcacggccgctaccgcgtactgaccctggagtcgtcctcgatccccaacgcgctggcggccctcctcctgcacgtccgcgacaccaccggcggcaccccgcacatctacttcgagtggaccgagggcagccccttcgccaacttcctgcgcttcttcctcttcggccagggggaggtggcgccggtgacccgggaggtactgcgggaagcggaaccggaccggaggcggcgcccccgggtgcacgtcggc

SEQ ID NO: 4754 - DNA, 483 bp, Streptomyces avermitilis
  CDS (1)..(483)
atggagccaaggacagctactggagcccgccctcaaacgctcaggaacgggccgactggatcgcggcgaacaaggagatcatcaaggctgcggcacggaactcggggctgccgccggacatggtgggcgtgggttcacgaacaatctggacgaggcaaggaacgcactgcgctgatgaccagcccttcccacgtggacgacgaccgcggttgcctccgtctggtcctcgctgtacccctcacccttctcacgctcatcgccgcctacttctgttggaccgcattgaccatcagtccgtccggcacctgggacgacgacgcgtacgccggaatcgttctgtcctgcgtcctcaccatcgcggcagccggtgccgcggcggccctgtggctggtgccttcggtgcggagggccacgccatggtggtggatgcttccggtgctcttgttgggcgtggtcgcaggagtgcgatgggccgtgagcggt

SEQ ID NO: 4755 - DNA, 618 bp, Streptomyces avermitilis
  CDS (1)..(618)
atggaggtcgacccgtggggcgtcgtcgtacgccacggccggtggtacctcctgtgctggtcgcacacctggtcgcacacctggtcgcacacgaggaacgccagacgcgtcctgcgggtggaccgggtcgcctccgtcgacgtactcgaggagacgttcaccccgccggccggtctcgacccggtggagacgctggaggaacactttgccgacggctgcaagtaccaggtggaggtcgtgatcgacgcccccgcggacacggtcgcggagtggctcccgcggaacctgggccgccgggaaccgatcgacgcgcacacgacccgcctcgtggccacgaccgacgaaccggactggtacgccgaacaactcacggtgatcaaggccccgttccgcatcgtcgggccgcgcgaactccgggaggccgccgaggccgtcgggcgacgcctcctcggggccgccggcgccggccgcccgagcccggggaagcagccgccgccgacggctgacgggcccgtccctcgttcgggacgggttctccgctccccgggccggtttctcaggccagcttcttcagcagttccgtggccagcggggcggaagaggccgggttctggccgg

SEQ ID NO: 4756 - DNA, 693 bp, Streptomyces avermitilis
  CDS (1)..(693)
atgtcgaagattctgttcgtcgtcaccggcgccgaccactggaccctggccgacggcaccaagcaccccaccggcttctgggccgaggaggccgccgccccgtacgaggcgttcaaggcggccggtcacgaggtcgtcgtcgccacccccggcggtgtcgcgcccaccgtggaccagggcagcctggcccccgaggtcaacggcggtcaggaaggcgccgaccgggtcgccgccacgctggcctccttctccgagctccagcaccccgtcgcgctggaggacgtcgacctcgacgagtacgccgccgtcttctaccccggtggccacggcccgatggaggatctcgcggtccatgccggctcgggacggctcctgaccctcgccctgcgctccggcaagccgctcggggtcgtctgccacggcccggccgcgctgctcgccgccacggacggggacggcgccaacgccttcgccggctaccgcgtcgccgcgttcaccaacgccgaggagatccaggccgggctcgccgacaaggcgaagtggctcctccaggaccgtctcgtcgaggcgggcgtcgacgtccgggagggcgagccgtgggcgccgcacgtcgtcgtcgaccgcaacctggtcaccggccagaacccggcctcttccgccccgctggccacggaactgctgaagaagctggcc

SEQ ID NO: 4757 - DNA, 954 bp, Streptomyces avermitilis
  CDS (1)..(954)
atgggttctacgctcgctgtcgtgagccatgagattcctgatgggccggccgccgcgcccgcacccgccgacctcaacctcctgcgcacgttcctcgcggtctaccggtccggttccttcaccgccgccgcccacctcctgggactctcccagcccacggtcaccacccagatccggtccctggagcggcagacgcggcgggagttgttcgaacggctgccgcgcggggtcgcgccgaccacggtcgccgacgaactcgccgcccgcgtcgccgccccgctcgacgccctcgcggcggccacgggacagggcaccctcgaggagacgcgggccgaaccggtccatctggccgggcccgccgaatggctcagcacggtcgcgctgcccgccctcggcccgcttctcgcgcagggcgtacggctgcgggtgaccacggggctgaccgacgcgctcctcgacgaactgcgcgcgggccgccacgacctggtcgtcgccaccagcaggccgcgcggccgcaccctgacagcggtgccgctggcggacgaggagttcgtcctggtcgccgctcccgtctgggccgagcggatcggggagcggctcgcggcggacggtccgggtgtgctgcacgaggtgccgttggtgacgtacgccgaggatctgccgatcgtccggcgctactggcggcacgtcttcggccggcgcctcaactgccaggcggccgtcacggtgcccgatctgcgcggggtcagggcggccgtcgcgggcggcgccgggttcagcgtgctgccgcgctatctgtgcgccgacgagctgacctccggcgcgctggtcctcctggccgaccccgaggacccgccgatcaacaccagcttcctcgcgcagcgccccggtgccttcggcaaccctcatgtggcccgggtgcgggaccacttgctggaggcggcgcggtcgtgg

SEQ ID NO: 4758 - DNA, 2034 bp, Streptomyces avermitilis
  CDS (1)..(2034)
gtgttcaacgtgaccgggatcctgaagcgtctggtgatcggccgggccatgcggagcgaggagctgcacgaggccctgctgcccaagcggctcgccctgccggtcttcgcctccgacccgctgtcctcggtggcgtacgcgacccaggagatcctgctcgtcctcaccctcggcggcctcgcctacctccacttcacgccgtggatcgcggcggcggtcgtggccctgatggcggtcgtcgtgctgtcgtaccgccaggtcgtgcacgcgtatccgagcggtggcggctcgttcgaggtcgtgtccacgaacctgggcccctcgaccggtctggtcgtcgcggcctcactgctcgtcgactacgtcatgaccgtggcggtctcggtcgcctccggcgtcgacaacatcatctccgccgttccccggctcgccgagtaccgcgtcccgctggccctcgtcttcgtcgcgctcctgaccgccgtcaacctgcggggcctgcgcgagtcggggcgggccttcgccgcgccgacgtacctcttcatcggcggcgtgctcgtcatggtggtcacggggctgatccggtacgccctcggggacccgccggtcgccgagagcgcgcggtacgggatcacccccgaccccggggacgcccacctcacgggcctggcgctgaccatgctggtgctgcgcgcgttctcctccggctgtacggcgctgaccggcgtggaggcgatctccaacggcgtacccgccttccgcaagcccaagtcgaagaacgccgccgcgaccctggtggccatgggcaccctcgccatcgtcatgttcgtcggcgtcaccgcgctcgcactgatcgccaaggtgcgcatcacgtccgacgcctgccgcctgacggggctgccgggcgactgcgcctcctacacccagcggacggtcatcgcgcagatcgccgccgcggtcttcggcggcgagcacagcgtcggcttctacgtcatccaggccgcgaccgccctcgtcctgatcctggccgccaacacggccttcaacggcttcccgctgctcgcctcgatcctggcccagcaccgctatctgccccaccagttgcacaaccgcggcgaccggctcgccttctccaacggcatcctcgccctggcggtcgtcgccgcactgctgctgtggggcttccgggcgagcgtcaccagcctcatccacctctacatcctgggcgtgttcacctccttcacgctgtcccagctcggcatggtccggcactggaaccgcgagctgcgcgtggagcgcgacggggcgctgcgcagacggcaccacgtcgcgcgggtcatcaacgcggtgggctcggtcgtcaccgggctcgtcctggtgatcgtgctggcgaccaagttcacgcagggcgcgtggctggcggtgctcgcggccgtggtgctgtgggtgatgatgcgcggcatccggcggcactacgacaccacggcggcggagctggcggtgaccgacccgaagatcgaactcaggcccccttcaagggtgttcgggatcgtcctcgtctccaccctgcacaagccgacgctgcgggcgctggcgtacgcgcatgccctcaagcccgaccggctggaggcgctgacggtctccgtcgaccgggactcggcgacggagctggagcggcgctgggaggagtacgacatcgacgtaccgctgaagatcctcgactcgccctaccgcgaggtgacccggccggtcatggagtacgtgcgctccgtccgccgcgagagcccgcgcgatgtcgtcgccgtgttcatccccgagtacgtcgtcggccactggtgggagaacctgctgcacaaccagtcggcgctgtggctcaagagccggctgctgttcaccccgggtgtgatggtcatcagcgtgccgtggcagctcagctcctcggcccgcgcggaccacccgccggcgcgggcgcccgggtcggtgcggcggggggagccgcagggggatcagcgggggccggtgggggtgcgggaccgg

SEQ ID NO: 4759 - DNA, 558 bp, Streptomyces avermitilis
  CDS (1)..(558)
atggcggcggaggtgttcctgcggcggctgagccggtggcaggccgagcagcagcgcaacgacatcggcgacgtccacgtcatggtgtaccgcggtgacgtgggcaccgagtaccgggaccgggaggacttcctcggccggttcgagcaggacgtccggcgtcccgacttcgacatggtcgtcgccggggcggcgcggctcgtcggctgcgcctatggcttccacgcctcccgcaccggggggtggtggtcggggttcgacggagaactcccgccggacatcgaggagttcaccgcctccgggcgggtgttcgtgctggcggagctgatggtgctgcccgccttccggcgccagggcatcgccacccggctgcgggagcggctgctggaacgacggcccgcggacctggtggtgaccaccctggacctcgacggcgacgacgctcccaccgaggccgccggtcacgtgctgcgggcctggggctggtcgcggctgggcaccctggcccccggccccggggccgccccgcgcgaggtgtggatccaccggccgcccggc

SEQ ID NO: 4760 - DNA, 201 bp, Streptomyces avermitilis
  CDS (1)..(201)
atggctactggtaccgtgaagtggttcaacgcggaaaagggtttcggcttcatcgagcaggacggtggcggcgctgacgtcttcgcccactactcgaacatcgccacccagggcttccgcgagctgcaggaaggccagaaggtgacgttcgacgtcacgcagggccagaagggcccgcaggcggagaacatcgtcccggcc

SEQ ID NO: 4761 - DNA, 675 bp, Streptomyces avermitilis
  CDS (1)..(675)
atgttcacttccccgcgttcctccgcaccccggcgtgccctctcggcggccgctacggcggctgttctcgcgctgacgctcgcggcctgtggctccggcgacccgaaggactcgtccatgcccgggatgcaccacggcagcggttccgccgccgcgtcgtcctccgcgtcgtcctcctcgtcgtcctcctccgggcggttcaacggcgcggacgtgacgttcgcgcagcagatgatcccgcaccaccagcaggccgtggagatggcggaactggccgaaggccgcgcctccgaccaggacgtcaaggacctggccgccgcgatcgaaaaggcacaggaccccgagatcagcaccatgcgagggtggctgaagtcctggggcaggccgggttcgtccacggcgagcggcatgcccggtatgcagcacggtgcgggcggcacggacatggccgggatgatgtccgacgagcacatgacggcactgaaggccgcccagggcaccgccttcgacaagatgttcgcccagatgatgatcgaccaccacgagggtgcgatcaccatggccgaggacgaacagaagagcggccgcagcgccgacgccaagaagctggccggcaccgtcatcacgaaccagacggccgagatcgcgaagatgaacaggatcctcggccggctc

SEQ ID NO: 4762 - DNA, 471 bp, Streptomyces avermitilis
  CDS (1)..(471)
gtggacggcaggcggaggcgggggccgggagtggctcggctgctcgtgctgtgcgccgtcctgctggggctgttcttcatgcacggggctccggcgaacgccgccgagggctgccacggctcgacggcgatggtcatgtctccgggcacggggcacggcgaggacgtccgcatggacgctgccgccctgcgtcccccgggtgccacggcaccgggcgcctcggccatggccccgacggctccccctgcccacggcgtcgccatgccggggatgagcggagagctgtgcgtgtccacgccggcccgcgaccggacgcccctgcccgcgacgggcctgctcgcgctcctcggcctggtggccctggtggcgtggcatccgacggggcggtccggtgtcttcggggaaccggccaggcgcggcccgcccctatacgggcgccatctcctcctccaggtgtgcgtcgcgcggacg

SEQ ID NO: 4763 - DNA, 864 bp, Streptomyces avermitilis
  CDS (1)..(864)
atgcctgtacagcacatcctcgactcgaccatgtaccaccgggagtccggcaccggggtgcccatcgtcttcctgcacggcaacccgacgtcgtcctacctgtggcgggacgtcatgccggccgtgggatccggacggctgctggcccccgacctgatcggtatgggcgagtcgggcaaacccgccctcgactacaccttcgccgaccacgcccgttacctggacgcctggttcgacgcgctcgatctgcgcgacgtgatcctggtcgggcacgactggggtggcgcgctggccttcgactgggccgcgcgccacccgcaccgggtgcgcggcatcgcgttcaccgagaccatcgtcaagccgatggcctgggccgagttccccgaaggcggccgggagctgttccgggcgatcaagacgcggggcgtcggcgagtccatgatcctcgacgacaacgccttcatcgagcagggcctgcccggcagctccgccacggcgctcaccgagggcgacctcgatgtctaccgcaagccgtacccgacccgggagagcaggctgccgcttcttcggtggccgcgctcgatgccgctgggcggcgagcctgccgacgtggtggcccggatcgaggcgtacgaccggtggctgaaggccagcgtggacgtgcccaagctgctgctcacgttcgcgcccggaccgggggcgatgatgcacgagggcatcgtcgcgtggtgcgcggcgaacatcgccggcctggagatcgagcactccgaagccgtcgccgggcatcacacgccggaggaccagcccgtgctgatcgccagggccatctcggcctgggcggacagactcggccttcgcctctcg

SEQ ID NO: 4764 - DNA, 450 bp, Streptomyces avermitilis
  CDS (1)..(450)
gtgggcgccgcgatgagcacacgagggcactccggtgagcccgcggggtgcactccgatgagtactcaggtgggcactccggtcggggatttcctcgccgaaccgcaggtggcgaccctgaccaccctgcgtcccgacaactcgccgcacgtcgtcgcggtgcgcttcacctgggagggccggacggggacggcccgggtcctgaccgtggacaccacacgcaaagccaggaacgtcatcgccgggccgggcggtcgcgcggcgctctgccaggcggtggggttccggtgggtgacgttggaaggactcgccatcgtgcacgacgcacccaggcgagtggccgaaggcatacgccgttacaccgcgcgctatggaacgccgcctcccgccccgcccggcctcgtggtcatcgagatcgcggttgatcgcatcacccggctcaacctccga

SEQ ID NO: 4765 - DNA, 819 bp, Streptomyces avermitilis
  CDS (1)..(819)
atgatcgtggtgactggtgcgaccgggaacgtcggacgagcgctggtgcggctgctcaccgaggcgcgggtgccggtgacggccgtggcccggcacatcaccgacgccgacgtcctgccgggggtgcgggcggtgaccgccgacctggccgagccggccggcctgcggtccgcgttcgaaggggcggaggcactgttcctgctggtggcgggcgaggacccgcacggcgtcctgaaggaggcgaagtccgccgggatccgcagggtcgtgctgctgtcctcgcagggagcggggacccgcccggagacctaccggcacccgcgcctcttcgaggaggccgtacgggactccgggctcgcgtggacggtcctgcggtcgggcggcatggcgaccaacgccttcgcctgggccgagtcgatccgcacacggcgggaggccgcggcgcccttcggggacgtcggcctgccgttcatcgatcccgacgacgtggccgcggtcgccgccgtcgccctgcgccgggacgctcacccgggcgccgtctacaccctgaccggtcccgcaccgaccaccccgcgcgagcgtgccgcggccatcgcggccgcgctgggcgagccggtgcggttcaccgaccaggcccgggaggaggcccatgcgctgatggcgcggttcatgccgctgccggtggtcgagggcacgctggcgatcctgggcgaaccgaccgaggacgagcagcgggtgagccccgatgtcgaacgcgtcctgggccgggcgccgggcaccttcgccgcctgggccgaacgcaacaccgcggccttccgg

SEQ ID NO: 4766 - DNA, 591 bp, Streptomyces avermitilis
  CDS (1)..(591)
gtgactgactcagtgaattcccgaagtcctcgggcgaaggacgccggcaaacggcagcggctcatggccgccgccgcccggatcctgcacgagcagggcgtggagcgcacgaccatcgccgacatcgcccgcgccgccgacgtcccggccggaaacgtgtactactacttcaagaccaaggacgagttggtcgaggcggccctctcccagcacaccgagtacctgaaggaactcacgggccggctcgaccggcttccggacccgcgcgaacgcctcaagggcctcgtcacggcctgggtcggcgcgcgtgacgtcgcggcccgctacggctgccccacgggcaccctcgccgtcgaactcgacaaacgcgccgagggcggtctcgatctctcggtcggccaggtcatccggcagctgctggagtgggtggaacagcagtaccgccagatcggggtgcccgaacccgacgggcacgcgctggcgctcgtcggcgcctaccagggcatgtcgctgctctccaacgctctgcgcgacccggaggtcatgacccgcgagggagcccgcctccttcgtgaactcgacagcctggcg

SEQ ID NO: 4767 - DNA, 582 bp, Streptomyces avermitilis
  CDS (1)..(582)
atggacgccaccgtgccgaggacgacgacgagtacgccaccaggcgggccgaaacccgggccgaaacccgggccgaaacccgggccgaaacccgggacggcatcgagggcaccggcggagccgcccgcggaggaggacgaccttcccgctggtgcggtcgaaagccgcgtgttctccgcccagttcacgtcgtcaccccgaggcgcacggctcgcccggcatctcacggcgctctgcatgaccgactggggctacccgccgtcatcggacacgtccggcgtggccgcactgctggtcgccgagctggccgccaacgccgtacggcacggccgggcgcccggccgggactttcacctccgtatcgccctcgacgtgcgaacgcggctgatccgcatcgaagtggcggacgcttccgcgcgacagccccggttcggctcgcagaccgtcgcccggccggaggacgagtccgggcgcggcctgctcctcgtggcggtgctcgccgcgcgctggggaacggaaccccgcacgcccaccggcaagacggtgtgggccgaagtcgttgcggacgcgccggaagccgga

SEQ ID NO: 4768 - DNA, 600 bp, Streptomyces avermitilis
  CDS (1)..(600)
atgactgcgaccgtttcctacccgccgccgacactcgaagaccggacctcgtcctcgtactcctcgtatctccgcctgtcgctggctcccgtcggtcccgcaccggctctgctggacggcgcctggtggccccgttcccgcgatctcgacgcggaacttcccgcgttgacggccgtgctcgatccgctgtgggggcgcatcacccgggtcacggtgaatcccacctactggccggtcttcccgcgcaaggtgcccgtcgccgggcatgtggtgaaggtgggctggttcctggccgaacaggacccgcacgagctgatgctgctctcgtaccaagtgggccgctgggacctcctggtgatcccaccgcggacgcctcccgcctcggccgcctggctgatggccgccgcgagcgaccccctgggcacatcgaccgcgagccggttgatggaggaggcggcacgcctgcggacggtggccgagaccgaccgggccgtggaagcggtctgggactccgaaggagggcatgaggcgcgcgatccggcctcacgtccccgcattccggcagtcgccgccgcgataccgggtcagccgaagtggatg

SEQ ID NO: 4769 - DNA, 237 bp, Streptomyces avermitilis
  CDS (1)..(237)
atggagatctttgtgaacgtgctcgtgctcctggcgatgatcgccctgggcgtgctcctgatccacctgctcaactcgcagcacgacgaccgcatcgccgccttccactacgcggaccgcttcgccgccttccaccaggcccgctcccggccgaccggcccggggaccggcgccgcacccggaagcgagaggggtgagcccgatgctccccgtgaggctgctggcagacaccggcag

SEQ ID NO: 4770 - DNA, 465 bp, Streptomyces avermitilis
  CDS (1)..(465)
atgctccccgtgaggctgctggcagacaccggcagtgagccggtgctccccggcaccgcggtgctgcggatggagacgacacccaagcgcacggggacgttcgacggcgcgtggtggccacattcccgcgacctcgcgagccaactgaccggcctgctcaccgcgttgaccgcccggctcggtcccctcgcccgcgtcggcctcgacgcgagcgcctgggacgagaggccgggccatctggtcgtcgaggggcatacggtgcgcatcgactggtccgccgtcgaggacaacaccatgatcatcacccggggcgaccaggaccacttcctgttcctggtgatccctccgcaggcggctcccgcgtccgcacgcgccgcgatgaccatggcggtacgggacgacaacgacgcgtcggccgaacggatcctcaccgcgaccggcgtcaccccaatcggctcctccgac

SEQ ID NO: 4771 - DNA, 375 bp, Streptomyces avermitilis
  CDS (1)..(375)
atggcccttccccagctgaacgtccaccggcacgaccggaacactcatgctctgctcacccttgcgggagagatcgacctgaccacggcgccgttggtgcgcgcggcgctgaccgagtgcctgcgcgacggcatccgcaccgtcgacgtcgacctcacggcgatcactttctgcgacggcagcgggctcaacgccttcctcacggcgtaccagatcgcccacgaggccggaacgacggtccaactgcaccatccgcctccgcccacggctcgcgtcatagagatcaccggctccggcttcctgctgcacgagctccacgccctccctcggacacccgccgcgcgtcgggttcccgctgcctcgggcggtgcgctg

SEQ ID NO: 4772 - DNA, 708 bp, Streptomyces avermitilis
  CDS (1)..(708)
gtgacggccccgccccggcgggagccgcagccgccgggaggcggaagcgtgccttcccccagggacgcgacggtgcgcctgcgccggctgaaccgctggcaggccgagaccctgcgggaggacctggccgatctgtacgtggagtccttccaggcgcggcccggcgaggagtaccggggccgggaggcgtttctgcgacggctcaccggcgacatccggcggcccgggttcgcgctgctgatcgcggaggacacggccttcgccgggtgcgcctacggattccccgtacgacgcgagggcacatggtggcggggattcgacggccccctcccgcggagcgtcgaacagctcaccgcgtccggacatgtcttcgcgatcaccgagatcgtggtgcacccgcacgcacaggacccggacctcgcccgccgactccaggaacggctgatcaccgaccaccacgcctcgctcggcgccacgatggtggatcaagccgacgccgcgacctgcgacgccttcctgtcgtggggatggcgggacatcggggcggtccgtcgaccgccggacccggtgacgcgtcgtccatcggacccagccgtccgccggccggcggaccccgccgcgctacgggtgctggtcctgcccctcggaccgcgcacggctacccgccccgacgggctcgctcacgaaaaccgcacccaacggcccgac

SEQ ID NO: 4773 - DNA, 852 bp, Streptomyces avermitilis
  CDS (1)..(852)
gtggcggggtacgagtccaggacggagccaggcatcatgacctctcccctcagcggcagcggcgcccagccattgaagatcgacacgagcaagcctcacccggcccggatgtacgactacttcctcggcgggaaggacaactacgaggtcgaccgggaggccgccgagcagttcatcaaggtggccccggaggtgcgggcgggcgtccgcgccaaccggcgcttcatgcaccgcgccgtccggcacgtcgtcgcggagggcggcgtccgacagatcctcgacgtgggcacgggcctgcccacggagcccaacgtgcaccagatcgcgcacgccatcgctcccgagacccgcgtcgtctacgtcgacaacgatccgatcgtcagcgcccactcgatggccctcatggacgacgccaccgacacctccgtcatcctggccgacctgcgtgatccccgggcccttctcgaccaccccgaggtgcgcaagaccatcgacttcgaccagccggtggcgctgctgctggtcgccgtcgtgcacttcatcgccgacgcggaggacccggacggcatcgtcgccaccctccgcgacgcgctgcccaccggctcctacctcgtcctgtcgcacgccacgggcgacgtccacgaggaccggcgcgaggacgcggcgtccgtctacaacgccgctaccgccaccttgaacctccgcccccacgcccgggtcctggacttcttcggcgacttcaccctggtcgacccgggcctggtcccggtcccggactggcaacccgacgaaccgccgaagctcgacgccccaccgatcggcatctacggcggagtggcccgcaggaacagc

SEQ ID NO: 4774 - DNA, 936 bp, Streptomyces avermitilis
  CDS (1)..(936)
atgcttgtcatcgcagccatgaatcagaacgatggccgcgtggatctccagcagatgcgatacgtcgtcgccgtcgccgaaacccgcaacttcacccgcgccgcggagcgctgctccgtggtgcagtcgtcactcagtcaccggatcgccggcctggaacgggagctcggggtcaagctgttcgcccgatccagccgccgcgtcgagctgaccagcgccggagcggcgtttctcgtcggcgcgcgcgagtgcctggccgctgccgaccgcgccgttgccgatgctgcggccgcgaccggcgtggtacgcggccggctcgccgtcggcgtgatcgtgaccacggctgccgttgacgtacccgagttgctgcagcggtaccgcgcccagcacccggacgtccatgtcctgctccgttccgggcgcagcgacgaactggtggcggcgatccggaacggcgaactggacatcgccttcctcgggttgccggagggcgaacggccacccggtgtggaaaccgttgttctcgatcacgacgagcacgtactggtggtgccggccgggcaccggctcgcgggtgtctcccaggtcacgctgcgcgagatcgccgaggagacgtacgtggacttcgtggccgggacacccgcccgggcccagtccgatcaggcgttcgccgctgcgggcctggtccgcgacgtcgcgtacgaggccggtgtcgtcgagctgatcacccggttgatcacgcgcgggctcggcatcgcgctgctgccgtcggcgttcatccgaccgctggccgccgacgaccccgaactggcgctggtcccggtggtcgacgggccgcatcgcatcgagtatctggcgtggagccgattcaaccccagccccgccacccgggcgatgctcgacgtcctcggcgtcagaccgccgtccacagtgtcc

SEQ ID NO: 4775 - DNA, 999 bp, Streptomyces avermitilis
  CDS (1)..(999)
atgcattcctcgaccgagcggtcaccgggctcgctgcggacctcgtacgcgcagcaggtggcgaccgtcgcactgaccgcactcgctcccgcgtcctggggcaccacgtacgccgtgaccacggaactgttaccgccggggcatccgctgttcgccgggttgatgcgcgccttgcccgctgggctgctcggcctggcgatcacccgcgtgcccccgcgcggggactggtggtggaaggccgcagtcctcggcgtgctcaacatcggcgccttgttccccttgttgttcctggcggccgaacgactccccggcggtgtcgccgccaccctcagcgccacgcagccgctgctggtcgccgggctggccatcgcggtgctccgggaccggccgacggcctggcggtggacctggggtgcgatcggcgtgatcggcgtgggactcgtcgtgctcgggccacaggcccggctggacggcgtcggggtgctcgtcggcctcggtggtacggccgccatggtcggtggggtcgtcctcaccaagcgctggggccgtcccgcggaggtcgggccactgaccctggccggctggcaactgacggccggcggcctgctgctgctcccgctcaccctcgcgatcgagggagtgccgcagcggatcgacgccggagcggtcggcggctacctgtggctcggcagcatgggtgggctgatcgcgtacacgctgtggttccgcgggatcggaaagctgccggtcggcgtgtccgcaccgctggtgctgctgtctccgctggtcgcgaccctggtcggcatcgtgctgggcgagtcgctgggcctgccgcagacccttggtttcgtcctcgccctggccgccttgctcgccacgcagctcaatgccccgaacgtcttcggccgcatcgcgcgcggcggcccggcagaagaccccattccagaccgcattccagaccccagtcgagaagaccagattcgaggaggacggattcga

SEQ ID NO: 4776 - DNA, 666 bp, Streptomyces avermitilis
  CDS (1)..(666)
atgacgatcgctgtgctcggcgccaccgggatggtcggcagccgggtgatcaccgaggccggtgcccgcggacaccgggtgcttgctctgtcccggaagcctgcgagcgaggacccgaacgtgacgctgatcgcggccgatgcgaacgacccgtcagccgtacgcgaggcgctcgccggcgtcgcctcgaaccgcgccgcggacgccgtcgtgctgaccgtgcggacccatccggtcgaccaggagttcttgatcggcgccacccgtacggtgctggacatcgccgcacaactcgggattcgcgtcctcgtggtcggcggcgccggcgcattgcgcagcccggacgaccacgatctgctggtcgccgacaacccgacgtatgtgcccgccgaatggaagaccacagccgccgccgggatcgctcagttgcgggcctgccaggcccatgccgatgccgactgggtctacctgagcccgccggccctgctcgagcccggtgaacgaaccggccgctatcggcgcggcaccgacaccttgctcaccagcgcagacggccgatcgtggatcagcgccgaggacctggccgtcgccgtggtcgacgaactcgagacccccggccgcgaacgtctcatcacggtcgcccaccgcgacgaacccccgtcagcg

SEQ ID NO: 4777 - DNA, 435 bp, Streptomyces avermitilis
  CDS (1)..(435)
gtgggggtgacgtacaaatacttcggcgcgcccgacggcgcgaccgcggcccgcgtcccgatctcgatgcgccccgaggagctcggcggggacgagctcggcatgaacggcatgttcacgaagatcaagccggagacgatggccgcgatggtcctcaccggcatcgagggcgtccccctgagcaaggtgcccccactggagctggtcgtcctgcaccccgactacgcggtggtcaaactccccatgacggtcgtggacccactgcgcggcatcggcgaggaggcggtgggcgccgcggcgttcatctggtcgacggtgccggaccggggcggcccacgggacgcgttcaacgtgtaccagctgctgcacgagtggcaggacttctcgcatcgcctgcatgaggcggggcatcagccgtactgcttggtgtggccc

SEQ ID NO: 4778 - DNA, 612 bp, Streptomyces avermitilis
  CDS (1)..(612)
gtgaacccgcagctcccagcggtcctgtcgctcccgaaggtccctgcgggtccgcagctccggaaggcccgaagagtccggaaggtccctgtgaccccggagtggctcccgacggtccggaaggcccctgcggtcccggagcggctcccgaaggtcccgaaggtccttgtgatcccggaggcccggaaggccccgaaggtgcggaagatccctgcggtcccggagttccggaagggccggaaggcccctgcggtcccggagcggctcccgaaggtccggaagatccctgcggtcccgaagcgccggcgggtcccgaagatcccgacgaacccgaggatcccgacgagccctgtgcctgacgtctctcggccgcttcctccgcgtcgcgccggtgccttccccgccgggcacgccgaggaccgaggtcatcggtcccctcgcccagtccgccaccgcgatgcatatctccacccgactgctgttctgggacgcgtggcccccgccgcgcaacccgatcatcgtgtcagtgacctcccccacggcgtcccgccgaaacgtgcggtgaaacacctgtccgcgggatcttggcggcctctgacaccatggcttgtg

SEQ ID NO: 4779 - DNA, 1314 bp, Streptomyces avermitilis
  CDS (1)..(1314)
atggcttgtgtgagctatccgtacgaagccccagtttcgcagactcttttcgagcgcgcggcggccgtcacgcccggcggcgtgaactctccggtgcgcgccttccgcgccgtgggcggtacgccccggttcatggtgtccggtaacggtccatacctgaccgatgccgacggccgtacatatgtcgaccttgtttgttcgtgggggccgatgatcctcggccattcccaccccgaggtcatcgccgccgtccaggaggccgtcgcgcgcggcacctccttcggtacgcccggtgagggcgaggtggcgctcgccgaggagatcgtcgcccgcgtcgagcctgtcgagcaggtgcggctcgtgtccagcgggaccgaggcgaccatgtccgccatccggctcgcccgcggcttcacccggcgggcgaaggtgatcaagttcgccgggtgctaccacgggcacgtcgactcgctcctggccgcggccggcagcggactggcgacgttcgcgctgcccgacaccccgggcgtcaccggcgcccaggccggcgacaccatcgtcctcccctacaacgacctcgatgccgtgcgcgaggccttccgtgcccacccgggcgagatcgcctgcgtcatcaccgaggcctcgcccggcaacatgggcgtcgtcccgccggcgcccgggttcaaccaggggctcaaggacgcgtgcgccgagaacggcgcgctgtacatctccgacgaggtcatgaccggcttccggaccagcaaggccggctggtacggcgtcgacggcgtccggcccgacctcatgaccttcggcaaggtcatgggcggtggcttccccgccgccgccttcggtggccggcgggacgtcatggcgcacctcgcgcccgccgggcccgtctaccaggccggcaccctctccggtaaccccgtggcgaccgccgccgggctcgcccagctgcgactcctcgacgacgcggcctacgcgaaggtcgacgccgtgtcggccgagatccgtacgctcgtcacggacgcgctcaccaaggaaggcgtcgcccaccggctgcagaacgcctccaacatgttctccgtcttcttcaccgaccgacccgtgaacaactacgaggacgccaagggccaggagtccttccggttcaccgcgttcttccactcgctgctggcgcagggcgtctatctgccgccgtcgtccttcgagtcatggttcgtctccaccgcccacgacgagcaggccgtccagcggatcgccgacgccctgcccgccgccgcccgtgccgccgcggaggccaccgca

SEQ ID NO: 4780 - DNA, 690 bp, Streptomyces avermitilis
  CDS (1)..(690)
atgagcatcccctcgtccgaccaggacatcaccgtcgtccacgtcatgcggcacggcgaagtcgccaacccggacggggtcctgtacgggcgcctggccggctaccacctctccgagctcgggcggcagatggccgaccgggtcgccgagcacctcgcctcacgtgacgtgacccacgtcgtggcgtccccgctggagcgggcgcaggagacggccaccccgatcgccaaggcgcacggtctcgacctcgccgtcgacgagcggctgatcgaggcggagaacgtgttccagggcaagaccttcggcgtgggcgacggcgcgctgcggcggcccgagaactggaagcacctcaccaaccccttcaagccgtcctggggcgagccgtacgtggaacaggtcgtacggatgatgggggcgctggacgcggccaaggacgccgcccgcggtcatgaggccgtgtgcgtcagccatcagctgccgatctggaccctgcgcagcttcgtggagaagcggcggctgtggcacgacccgcgcaagcggcagtgcacgctggcgtcgctgacgaccttcacgtaccagggcgacaggatcgtgtccgtcggctacagcgagcccgcccgggaactcgtaccggctcatctcctcgcgggcgccaagccggtgaaggggaaggacaaggcgttcggggcg

SEQ ID NO: 4781 - DNA, 1275 bp, Streptomyces avermitilis
  CDS (1)..(1275)
atgcgggacatcagccggcggggactgatcgggctcggagcgggggccgccgcggcgatgggactggctgcctgcggtacccaggagcaggacggcgggagccactccggcggttccggcaaggggaagccgggtaagcccgaacacaccgcacgtcccctcggtgacggttccacctcgaacaccggcaagcagccgcgccagccgggaaagccggttccgctggagcccggccagaccccgccgcagttcgtgatcttttcctgggacggcgccggagaagtcggcaatggtctgttcccgcgttttctggagcttgcgaaggaacacgacgcgcatatgacgttcttcctctcggggatctatctcctccccgagtcgaaaaagcgcctctatcgtccgccgaacaatgcgccgggcgcctccgacatcggttatctgacggacgaccacatcaaggcgaccctgaagaacgtccgccaggcctggctcgacggccacgagatcggcacgcacttcaacggccacttctgctccggctacggcacggtcgccaactggacgcccaagcagtggcgcagcgagatcgaccaggcgaagtcgttcgtgaaggagtggcgcaccaacaccgggtggaccgacctggcgccgctcccgttcgactacgacaaggagctgatcggcggccgtacgccctgtctcctcggccagaacaacctgctgccgaccgcccgcgacctgggctggcgctacgacgcgtcctcgcccggcggccgtcagcgctggccggagaagaaggcgggcgtgtgggacctgccgcttcaggcgatcccgttccccgggcacaccttcgaggtgctctcgatggactacaacatcctcgccaaccagtcgatcaactcgaccaaggcgccgtcctacaactacccgggctggcgcacccaggcgaccaactcctacatagccggattcaagcgggcatacgagacaaaccgcgcacccttcttcataggcaaccacttcgaggagtggaacggcggcatctacatggacgccgtcgagcgggccttcaaatacatcgcgcgggagaaggagaagggcggcgacgtacgcctcgtctccttccggcagttcgtggactggatggacgtacagccgcccgaggtgctggccaagctccggtccctggacgtggggcagcaaccggccggtggctggaaggcgttcctcggcgaggccggcaagggctcttccgcgggggccggaaacgccgcc

SEQ ID NO: 4782 - DNA, 630 bp, Streptomyces avermitilis
  CDS (1)..(630)
atgagtgccgcctgccgcgtccaccagcgcctgaaccgcacgaaccgcacccgtagccgcgccgccctgctgagcgcgggggcggccgtcgccgccctcgtcctgtccgcgtgcagttccgggggcacgcacgggggagggggcgacaccaacttcgtcgccggcaaggacggcatctccaccgtcgccaagggcagccgggtcgacgcccccgacctgtccggcaagacggtcgacggcaagcagctcgacgtcgccgactacaagggcaaggtcgtcgtcctcaacgtgtggggctcctggtgcccgccgtgccgggccgaggcgccgaacttcgtcaaggtcgccaaggacaccgcggcgcagggcgtgcagttcgtcggcctcaacacccgtgaccccggcaccgctccggccaaggcgttcgagaaggagcaggggatcacgtaccccagcctgtacgatccgacgggcaagctgatgctccgcttcaagaagggcacgctcaacccgcagacgatcccctccacgctcgtcatcgaccgggacgggaagatcgcggcccggacgctccaggctctcaccgaagagaagctgcgcgagatgctcgatccgatcctcgcggagaag

SEQ ID NO: 4783 - DNA, 780 bp, Streptomyces avermitilis
  CDS (1)..(780)
gtgtcccttctcgtcgcgtccacggacctcgccgcggtggccgacaagaacgccacggtctacagcggggccctgctgctcgctctgccggtcgccgtgctcggcggcctcgtctccttcttctcgccgtgcgtgctgccgctcgtacccggctatctgtcgtacgtcaccggggtcaccggtaccgatctggcggaggccagacgggggcggatggtcgcgggcgccagcctgttcgtgctcgggttcaccgccgtgttcgtctccggcggggcgctgttcgggtacttcgggacgaccctgcacgagtaccaggacacgctcagcaaggtcctcggcgtgctgatgatcgcgatgggcgtgttcttcatggggctgatgccctggctcacgcagcgcgagttccgcttccacaagcggccggtgaccggcctggtgggcgcccccgttctcggcgcgctcttcggcatcggctggacgccgtgcctgggcccgacactcacctccgtcatctctctctccatggagcaggcgagcgcgggccgcggggccatactgaccgtcgcgtactgcgtcggtctgggcgtgcccttcgtcttcgccgccgtcgccttccgcaaggcgctcggtgccttcgactgggtcaagcgccactacgcgtgggtgatgcgcatcggcggcggcatgatgatcgtgaccggcctgctgctgctgacgggtgcgtgggacagcatcgtgcagcagatgcagacctggtccgacggcttcacggtagggatc

SEQ ID NO: 4784 - DNA, 1785 bp, Streptomyces avermitilis
  CDS (1)..(1785)
atgagcaccactgacaccggcaagacgacggatccggccgccgccgggcagcccgtcgacggaggagccgacggcgatctcggcgaagccggatcccagctgtccaccgccccggtggagacggccatgcccggctccttcggggggccccgcgcacccggtgccatcggatggctcgcctggacccttcgcgaggtcatcggctggtcccgctggttctggcggcagctgacctccatgcgggtcgcgctgatcctgctcttcctgctgtcgctgggcgcgatccccgggtcgctgatcccgcagtccgggaccgacgcggcgaaggtgcaggagttcaaggacgcgcacaccacgctgggcccggtctacgacaggctcggactgttccacgtctacagctcggtgtggttctcggcgatctacatcctcctgttcgtctcgctcatcggctgcatcgtgccgcggacctggcagttcgtggggcagttgcgcggccgtccgccgggcgcgccgaagcggctgaaccggctgcccgcgtacgcgacctggcgcaccggggccgagccggagcaggtccgtgaggtggcgctcaaggtgctcgagcggcgccggttccgggcgcatgccgccggggacgccgtagccgccgagaagggctatctgcgcgagaccggcaacctgctcttccacatcgcgctgatcgtgatgctggtcgccttcgcctggggccagctcttcaagtccgagggcaacaagctgatcgtcgagggcggcggcttctccaacacgctggcgctgtacgacgacttcaagtccggcagcctcttcagcaccgacgacctcacgccgttcagcttcgacctgaagaacttcaccggcacctacgagctgacgggccccaacaagggcaccccgcgcacgtaccaggcggacgtcacctacagcgtgggcgcctacggcaaggagaagaagaccaccgtcaaggtcaacgagccgctggagatcggcgactcgaaggtctacctcaccgcccacggctacgcgcccgtcgtcaccgtccgggacggcaagggcaacgtcgtcctccatgacgccgtgccgatgctgccgctcgactcgaacgtcacctcgcagggcgcgatcaaggtcatggacggctaccggaacgcgcggggcgtcaaggagcagctcggcttcgcggccttcttcgtgccgtccttcgcgggtgacggcaacggcacgatgttctcccagttccccgcgctgctcaatccgcggctcgcggtgtccgcgtaccacggcagcctgggcgtcgacgcgggcatcccgcagaacgtgtaccagctcgacacctcccggctgaagcagttcaagaccgccaagggcgccatcctcaagcagcggctgaagcccggtcagaccatgaagctgccgaacggcgccggctcgatcaccttcgagaaggacgtcaaggagtgggcgaacttccaggtcacgcagcagcccggcagcgactgggcactggccggagccttcggcgcgatcctcggtctcgccgggtcgctcttcatccagcgccgccgcgtctgggtgcgggccaccacgggcgccgacggtgtcaccgtcgtcgagatggccggcctgggccgcagcgagtccgcgaagctccccgaggaactcggcgacctggccgcgctcgtgcacgagcaggcgcccaccaagaccgacgaacccgaccccgccgtcgcaccccccgtacctgccgaaggggctgagaagcag

SEQ ID NO: 4785 - DNA, 1074 bp, Streptomyces avermitilis
  CDS (1)..(1074)
gtgactctcgccaccgcaaccaacgaacacctcgccaacatcagcaacacgctgatctactccgcgatggccgtctacaccctggccttcttcgcgtacatcgccgagtggctcttcggcagccgcagcaaggtcggccgcacggccgccgcgctcacccacaagaccgcggcgaaggcgcccgcggtcaccgtgaagtcggcgggcggcaccgccgtcctggaccggccgcaggtcgtcacccggtccgcgcccggcgcccgtgacgtgcccgacgggcccggcgcgcacggtggggacgaacagggcgacctctacggccgtatcgccgtgtccctcaccgtgctcgccttcgccgtcgaggcggcgggtgtggtcgcccgcgccctgtcggtgcagcgtgcgccgtggggcaacatgtacgagttcaacatcaccttctccaccgtcgccgtcggggtgtacctcgcgctgctcgcgctgaagaagaacatccgctggctcggcctccccctggtcaccacggtcctcctcgacctcgggctcgccgtcaccgtcctgtacaccgccagcgaccagttggttcccgcactccactcgtactggctgtacatccacgtctcgaccgcgatcctctgcggcgccgtcttctacgtgggcgcggtcggcgcgctgctctacctgttcaaggactcgtacgagaacaagctcgcgaccggcgggcagcccggccgtttcgcgacctccgtcatggagcggctgcccgcctcggcctccctcgacaagttctcctaccgcgtgaacgccgccgtcttcccgctgtggaccttcacgatcatcgcgggcgcgatctgggcgggcgacgcctggggccgctactggggctgggaccccaaggagacctgggcgttcatcacctgggtcgcctacgcctgctacctgcacgcccgggccacggccggctggaagggccgcaaggccgcgtacatcgcgctcatcgcgttcgcctgctggctgttcaactactacggcgtcaacatcttcgtctccggcaagcactcgtacgccggggtc

SEQ ID NO: 4786 - DNA, 483 bp, Streptomyces avermitilis
  CDS (1)..(483)
atgacccatcccctcgatcccctcgatccccgcgatccccgcgatcccgctcatcccgctggtcctaccggtcccattggtcccatcggctccatcggtgccatcgagaaggggcccgtcgagacccgggggaacgcgtacgtacggcactaccggctaagttttccccagcctgtggacaaagtctgggcgacggtggcgacctccgaggggctgcgggcgtggctggccgtcgccgagccgttcgagccgcggctcggcggtgcggtcgggctccagggcgagggccggatcaccgcctgggacgtcgagcgggtcgccgagtacacggtgcaggggcggggccgggtccgcttccacctggaacccgcacaccccaccggcacgacggtccgcttcacccacgagtccgacgaggccacggaccccggctggcacgcccgcttcgagcggctggtccgggcggtcgcggaccaaggccgg

SEQ ID NO: 4787 - DNA, 1545 bp, Streptomyces avermitilis
  CDS (1)..(1545)
atggcacgggtgtggacatggctgcgcgaggacgtctgggagattcgattccgtcggtatgtcgccctggcgctcgcggccgttctcgtgagcctcggggtgtggggcggcatgacggcgacgaaggagaaccgctcctgcgctcccggggtcgtccggccccggggcagccaggagtgcgtgggcgtctcgtggacgacgtacgccttcggacgtccgcagttcgccgacaccgtacgggcgatccaccgcgagaacgcccgcctgaagcccggcagttatgtcaccgtcgcgctgctcgaacccttcaccgcgaccgacgccgacaacctcggcgatgtgctgcacgagctccagggcgcctatctggcccagtaccaggccaaccacgactccaccggcctgaagccgaagatccgcctggtgctggccaaccccggtgccacgggcgcgcactggcggcagacggtcgaccagctggagggcatgacgaaggggcgaaaccggctgcgcgcggtgaccggggtgggcctgagcaccgagaacaacaagaaggccgtcaaggcgctgaccgcgcgcggcatccccgtcgtcggctcgtccatcacggccgacgacctcgccaacgggcagaacggcaaggatcccttccccgggctcgcccgggtctcccccaccaacaccgacgaggcccgcgcgctcgcctccttcgccaaggtctcggccaccagggcgttcctggtgtacgaccggacgggcgacccgtacacgcggacgatccagcggtccttcgagaagatgctcaagggctcgcgctacggggcgcagccgttcacgccgcccacggaccgcagcaaggagggcagcaccgccaacgtgttcgcgcagatcaccaacatcctgtgcgacacgccgaagagcacggacacggtgctgttcgcgggccggcacacccaactgcggcagttcatcaacgcgttgggcgcccgcgggtgcagcgaccgccggttcaccctgctcaccggcgacgagggctcgtacctcaccggcgacaaggacctcgaccccagtgccctcagggacaccctgttgtccgtgcgctacacggccctcgcccatccggacgcctgggcgaaggacgcggcgaggacgggcggcggcgcggcggacgcgaaggtgctcacggacctgctggccctcggcaagcgggacaaggaggtcggcccgatcggttcggtcgacctgtccgacggccagctgatcatcgcgtacgacgccatgcggctcgccgtgcgcggcatccgcggggcctcaccgaccggcgggatcccggcgctcgcggacgtgggcctccagtggccgcaggtcaagggcaagcagctgcgggtgaacggggcgagcggatggatctgcctggacgcccacggcaacccgtacgacaaggccgtgccgatcgtggaactgacccccgacgcccgcgcccgcttcctcaggatggcctggccggagggccggccaccggccaaggagtgcctgccgccgtcc

SEQ ID NO: 4788 - DNA, 2097 bp, Streptomyces avermitilis
  CDS (1)..(2097)
gtgcacagagggctgcacggacgcggggcgctgttcgacagcgatccgcccggtctcgctccacgactcatcggcctgcgcccgtaccagctccgctcgtcgccgtacgagcacgcgggggagctgccgttcgtggtgctcgcgggcggtcgcgggctcggcaagagcgccgcactgcgtgagctgcgggacgcctaccacggccacaccccggtcgcgctgatcgacggcgaggagcagcagttcgccgctccgccgcccgagcggcccgcggaggcctggtcaccggtgggccaggcgctcaccacggtcgccgagcagctcgcggagccggtgcggggcgccggacggatcggttttccacggctcgcgtccgggctgctcgccgtcgcggcgggcggctggagcgaccgggacgtgccgcgcatccggcaggaggccgagcggatcctgctgctgaacgagacggggtccgtgctgtcgggattcgcgggccgctgggtgagcaaggtcgtcgccaagctgatcgcctcgatgagcggtacgggtccggtcgtggcgccgatcatcgaggccaccctggaggcgttcgccgagggcatcggcccggccacccgccggctgcgcagggccgccacctggtaccgcgactatcccaacgcgggcggcaaccccaagctcggactcatcctgctctcccggcacttcagggcgggcggcgactcccgcacgcacgccgagcgccatctcgtacgggccctgctggccgatctcgacgacgcgtacgcgggcgtcatgcagcgctcgcaccgcctgggccgtccggtcgtcctgatcgacaacgtgcagcggccggcgggcctcggcgtcctggagtcggtgctgcgcgaccgtgccgacggcatcgccgaccaggtcgtcttcttcgcggctctccgcgggtacacccacccggcgctgcgcaacgcgggccgccgcgccctgcccgaggtggcccgggggaccggctgggagccgggtgcctcaccgtcctcccgtgcgctgctcgtctcgctgccgccgctgacccccgacgacacactgcacctcgtgggcgccgcctcgcacggcctggacgtgccgccccagctcccgcacgccacccaccggctgaccggcggcagcccgctcggcatcaccctgctcgccgagtcggcgaggcagaacctgccccagggggccgcctccctgggagaactgctcaccgccgatgtcgcgatgcacgaggaccacgacggccgccccgcctaccaggaactcctcgaccggctcgtgcccggcggccggctcgacgagctgaccgtgctcgccgccgcccacgaccgcgactcggcgtgcgcgctcgccgaggcccagctcccggaggacttcggcacctcgggcgtgctcgatctggaggagcggctcggggcggagggctgggcggcggcctccgggcagttcgtcggcgatcccttcctgcgcgcgctgctcctgctgcggctgcaccacggcgacccggaccacgagcggtggcgggccgcgcaccgcacgctcatcgaccactacggcgacgaggacccaccggacagcgcccgctaccgactgcatcacgaactcgccctgggcaaggccgacttcgcggtggcgcacctgcgggacaccttcccgcgcgccgacacccgcagctggctggcgtccctcgtcttcatcgcgtccgcgccctattaccacgcgcacgaccccgacggccgcgacttcgacggccacgaccaccggtcctccgtcgcgctcgggcacacggacgcggaccagcagccgccggacagtgtgaacgccgtactgcatctgcgggtacgacggctgctgcacgccgtctggcagctcaccgacccactggtgctgcccgacccgaaggtgaccgagcggctgcgcttcgagctggagcagctgtcgaatctgcggcccgcgggcaacgccctgctgtggcgggcctcgcgggactggccgtcggacgcgctcgccggccgccccttccgcatcccgggcgacgaccacgacagcggggacgggggccgg

SEQ ID NO: 4789 - DNA, 972 bp, Streptomyces avermitilis
  CDS (1)..(972)
gtgagtgacgcccgtaccccccgcatcccgaccgtcgacctgcgcccctggctctccggcgaccccgacgcccgggcgcggatcgcccgcaccgtcgacgacgcccttcggaccgccggcttcctcctggtcaccggccacggcgtggacccgtccctccgcacccgcatccgggtggccgcccgcgccttcttcacgctgcccgccgagaccaagcagcggtacgccgcccgggtcggcgggcgcggctggctcggtcccggtgccgaggccaacggctactccgagggcaccgagaccccgcccgacctcaaggagtcgctgacgttcgcgacgcacgagccgttcgaggacccggagaccaacgcggagtggtacgcgccgaacgtctggcccgccgaggcacccgagctgcgagaaccgtgcgaggagtatctggcggagatggccgggctggaggaccgcctcctcacgctcctcggcgaggccctcggcctggagccggacttcttcacgaagcacatgacccatccgacctacggcttcaacatcaactggtacccgggcacggaggtgaccggcgacccggcccccggccagttccgcatcggcccgcacaccgacttcggcacggtcacgatcctcgaccgccaggccggcaagggcggtctccaggtgtacacggacgacggcggctgggcggacgcgcccttcgacccggcggcgttcaccatcaacatcggcgatctgatggcccgttggacgggagaccggtggcgctcgggacggcaccgcgtgctgcccccgcccgccgacgcgcccgccgaggagctgatgtcgctggtctacttcggcgagtgcacaccggggacactcgtggagtcggtcccggcgccggtgggccgcgtcgcatacgaaccggtcgactcccacacgtacctacgggagaagctgaattcgatcacagtcgac

SEQ ID NO: 4790 - DNA, 459 bp, Streptomyces avermitilis
  CDS (1)..(459)
atggatcaggtcatggatcaggcacaggcacgcgcatggctcgccacggccgtcgaggaggcccgcgccgggctggccgagggcggcatccccatcggcgccgcgctgtacggcgcggacggcgccctgctcggccgcggccacaaccgccgcgtccaggacgacgacccgtcgatgcacgcggagacggcggcgttccgcagcgccggacggcagcggacgtaccgcggtacgacgatggtgacgaccctctcgccgtgctggtactgctccggcctggtccgccagttcggcatctcgcgggtcgtggtgggcgaggcggccaccttccacggcggccacgactggctggcggagcacggcgtggagatcgtgctcctcgacgatcccgagtgcaccgccctgctgcgcggcttcatcaagaacaacccggcactgtggaacgaggacatcggtgag

SEQ ID NO: 4791 - DNA, 441 bp, Streptomyces avermitilis
  CDS (1)..(441)
gtgggcggcgaggcctctccccggtccctccaggactggcggcacgtccacaacacgatcatccccgcgcatgtcctgtccctcgacgacgtacgtgagcgcgccggccgcaaccgcctggaggtcgcctacctcgacgacgtcctggtcggctgctcgaccgtgcgcccgcccgcggacgccccgaccccggacgccccggccaccgccacggtgatcgcccgcgttctcgccgcccaccgcgggcggggtttcggcggggagatgtacgagcgggggctgaagcacgctcgcgcactcggcgcgcaggtgatcgagaccgtcgtcctgagttccaacccggacggcctgcggttcgccctgaagcacgggttcgccgagaccgagcgctatctgctgccgggcgacaccgtcccctggatcgacctccggctctccgtc

SEQ ID NO: 4792 - DNA, 390 bp, Streptomyces avermitilis
  CDS (1)..(390)
atgctcaggtatctgccgttcctgctggtcctggcgctgtggatctacgccttcatcgactgcctgaacacccccgaggaggaggtgcgggggctgccgaaggtggtgtgggtgatcatcatcctgctcttcggcgaggtgctcgtcggcccgatcgcctggctcgtcgcgggccgggcgcggcgcggcccggcgggcggttcgacgccgtccgaatggcatcgcaaccaccgcgccgagttcgtcgcgcccgacgacaatcccgagttcctccagtccctcaaggccgagagcaagaaggacgaggcactgctgaaggactgggaggccgatctgcgccgccgcgaggaggaactgcgccggcgcgagagcggcgaggactccaaggac

SEQ ID NO: 4793 - DNA, 1449 bp, Streptomyces avermitilis
  CDS (1)..(1449)
atggcttacgacgatcttcgctcgctgctgagggcgctggagcgcgagggcgacctcaagcgcatcaaggccgaggtcgacccgtatctggaggtcggggagatcgtcgaccgggtgcagaaggcgggcggcccggcgctgctgttcgagaacgtgcgcgggtcggcgatgccgctcgcgatgaacgtgttcggcacggaccggcggctgctcaaggccctcgggctgaagtcgtacggcgagatcaccgacaagatcggcggcctgctgaagccggagctgccgcacgggttcgtcggggtgcgcgaggcgttcggcaagctgggcgcgatgacgcacgtgccgccgaggaaggtgaaggacgccccggtccaggaggtcgtcctgcgcggggacgacgtcgacctcgaccagctcccggccctgttcacctggccccaggacggcggctcgttcttcaacctgggcctgacccacaccaaggaccccgagagcggcatccgcaatctcgggctctaccgcctccagcgccacgacaagcgcaccatcggcatgcactggcagatccacaaggacagccggaaccactaccaggtggccgcgcggcggggcgagaggctgcccgtcgcgatcgccttcgggtgcccgcccgcggtgacgtacgcttccacggccccgctgcccggggacatcgacgagtacctcttcgccgggttcatccagggcaagcggatcgagatggtcgactgcaagacggtcccgctccaggtcccggcgcaggccgaggtcgtactggaggggtggctggagccgggcgagatgctccccgaggggccgttcggcgaccacaccggcttctacacgccgcaggagccgttccccgcgctgaagatcgactgtgtgacgatgcggaagcgtccgctgctccagtcgatcgtggtcggccggccgccgacggaggacggaccgctgggccgggcgacggagcgtttcttcctgcccctgttgaagatcatcgtgccggacatcgtggactaccacctgcccgaggcgggcggcttccacaactgcgcgatcgtctccatcgacaagaagtacccgaagcacgcccagaaggtgatgcacgcggtctggggcgcgcacatgatgtccctgaccaagctgatcgtgatcgtcgactccgactgcgacgtgcacgatctgcacgaggtcgcctggcgggcgctcggcaacacggactacgcccgcgacctcacggtcgtcgaaggccccgttgaccatctcgaccacgcctcgtaccagcagttctggggcggcaaggcggggatcgacgcgacgcggaagtggcccgaggagggctacacccgggacggcgggtggcccgagatggtgctctccgacgcggagacggcggcgaaggtcgaccgccgctggaaggagtacggactg

SEQ ID NO: 4794 - DNA, 903 bp, Streptomyces avermitilis
  CDS (1)..(903)
gtgacctccgcatccgcggcgctcccgcagcagcccggccgcaccaaggccttcctgcgcctggtgatgatcgagcactccgtcttcgcgctgcccttcgcctacatcgccgcgctgaccgcgatgttccagtgggacaggaacatccactgggtgaggctgctgctcgtcacggtcgcgatggtcggtctgcgcaccttcgccatggcggccaaccggatcatcgaccgggagatcgacgcccgcaatccccgtacggcccaccgtgagctggtcaccggcgcgatgtcggtgcggcacgcgtggacgggcgcgctggtggcgctggtcttcttcctgggcgcggcggcgctgctgaacccgctgtgcctggccctcgcccccatcgcggtgatcccgatggtggtgtacccgtacggcaagcggttcacgaacttcccgcaggcgatcctgggtctggcccaggcgatgggaccggtcggcggctggctggcgatcagcggcgagtggtcctgggacgcggtgatcctgggtctcgcggtcggcgtctggatcggcggcttcgatctgatctacgcctgccaggacgtcgagacggaccgtgaggtcggggtgatgtcggtgccggcgcgcttcggcatccaggccgcgatctggggcgcccgtgtctgccacgccatcaccacggcgctcctcgtctggtacgccttcgccaccgacgcgggtgcgttcttctggttcggcctggtcatcgtcgcgggcgcgttcctctacgagcactccatcgtcaagccgcacgacctgtcccgcctgaaccgggcgttcttctctacgaacggtttcatcgggatcagcctgttcgtgtgtgcgctgggtgatttgctggtgcgcgggctcaccgtg

SEQ ID NO: 4795 - DNA, 663 bp, Streptomyces avermitilis
  CDS (1)..(663)
gtgccttggatcgtaggggtgtccggtgcatccggtacgccgtacgccgccgcggtgctgcgggcgcttgtggagcggggagagagcgtcgacctggtcgtcagcagggcctcccggctcacgctgctcgacgagaccggtctgcccttccgggacgcccactggcgggacgatctgcgggcgtggctggcgcggggcgccgacgggaagccggacaccttcgacgccttcgaggaccatctcgacgccgtacggcactggagcgccggtgacctggcagcggggccgtcctccggttcgtacccctcgaagggcatgctcatcgtgcccgcctccacggcctgcgtcgccggagtcgccctcggcctgtcgaaggacctgttgcagcgcgccgcgagcgtgacgctcaaggaggggcgcaagctggtcgtcgccgtgcgggagaccccgctgaacgggcagacgctgcggcacctggtctccctggacgaggcgggcgccaccgtgctgcccgcctcgccggcgttctacgcgggggccacgcacatccaggacctggtggacttcgtcgccgggcgggtgctcgacgcggcgggcgtcgagcaccacctgtaccgccggtgggagggcgaactcggcggcggctcccgcggcggcaccacc

SEQ ID NO: 4796 - DNA, 453 bp, Streptomyces avermitilis
  CDS (1)..(453)
atggacgcggtggacaggcagctcatccaggccctcagggagaacggccgggcctcctacgcggagctggggcgcctcgtcggtctgtcgggacccagcgtcaccgaccgcatcaaccggctggaggcggccggggtcatcaccggttaccgcgccaccgtcgactccgcctcgctcggtctcggcgtcacggccctgatcggcatctcgctctccgacgccgccgaccacgaggacgtggcccaccggctgcgggacctcagcgagatcgaggactgctggttcatcgcgggcgacgactcgttcatgctcaaggtgcgctcgagcgacgtggacgagctggagaagaccatccgccggctgtccggaacgaagggtgtctcccggacccgtacgacgatcgtgctctccacgaagtgggagaaccgggtcggagagttgcccgaagagggc

SEQ ID NO: 4797 - DNA, 1161 bp, Streptomyces avermitilis
  CDS (1)..(1161)
atggatgtcgggctcaagcgcgagctggaggacaaggtccgggccggtgagcggctgacccgcgaggacggcatcgcgctctacgagtcggacgacctggcctggctgggcgggctcgcccacgaggtgcggacgcggaagaacggcgacgtcgtccacttcaacgtcaaccgccacctcaacatgacgaacgtgtgcaccgcgtcctgcgcgtactgctcgttccagcgcaagccgggcgagaaggacgcgtacacgatgcgcatcgaggaggccgtccgcctcgccaagacgatggagggcgagaacctcaccgagctgcacatcgtcaacggcctgcacccgaacctgccgtggcgctactacccgcggtccctgagcgagctgaagaaggcgctgccgaacgtctcgctgaaggccttcacggcgacggagatccaccacttcgagacgatctccgggctgtccgcctccgagatcctcgacgagctgatcgaggccggtctggagtcgctgaccggcggcggcgcggagatcttcgactgggaggtccggcagcacatcgtcgaccaccgcacccactgggaagactggtcgcgcatccaccggctggcgcacgagaaggggctcaagaccccgtccaccatgctgtacgggcacatcgaggagccccgccaccgcgtcgaccacgtgctgcggctgcgggaactccaggacgagaccggcggcttccaggtcttcatcccgctgcgctaccagcacgacttcgtcgacatgaaggacggcaaggtccgcaaccggctccaggcgcgcacgcagatggcgaccggcgccgaggccctgaagaccttcgcggtctcccgcctcctcttcgacaacgtcccgcacgtcaaggtcttctgggtgatgcacggcgtgcagaccgcccagctcgcgctccagcacggcgccgacgacatggacggctcggtcgtcgagtacaagatcacgcacgacgcggacaactacggcacgccgaacaagctgacccgtgaggacctgctcgacctgatccgcgacgccggtttccgtccggtcgagcggaacacgcggtacgagatcatccgcgagtacgacggcccggacccggcgcgccgggagtcgccgcagccgatgcgggtc

SEQ ID NO: 4798 - DNA, 534 bp, Streptomyces avermitilis
  CDS (1)..(534)
atggcgcccaccttcgaactggaccccgcgatcacgcccgccctgcgggagggcgtgctcgcgctgtgggcggacgtgtcgaacgcgggcggctccgtcggcttcgtgccgccggtgaccgtggacgacatacggccggaactggtgaagcacttcgtcgccctggcggaggggcggacccggcttctcgtcgggcgggacgacgagggggcggtcgccgcgacggcgttcctcacgcacaacacccaccggctgatgcggcactgggtgtggctctacacggtgatggtgcacccccgccaccagggcaagggctacgggcgggacctgctggccgccgccgaggacgccgcctcgggcctcgacgggatcgaggcgatacggctcacctgccggggcggcgaggggctggagaacttctacgcgtcctgcggctacaaggaggtcggccgcgtgcccggcgcgatacgggtggcgcccggggacgagcgggacgacatcaccatgctgctgccgctggcgcgcaccgggtac

SEQ ID NO: 4799 - DNA, 297 bp, Streptomyces avermitilis
  CDS (1)..(297)
atgctccgctacacactgatgcgcctcgggatcttcgtgggctgcctcgtggtcgtctggggtctcgtctactccggtatcgctccccgcggcctcggtgactccaactacatgtgggtcgtcctgctctcgctcgtgatctccgcgccgatcagcttcgtggtgctgcggggggagcgcgaccgggcgtcggccgaggtgatcgcacgggtcgaccgggcgaaggcgaacctggaggccaaccgcaaccaggaggacgtcgcggacgacgcggcgcgggcacagggccgggcttcc

SEQ ID NO: 4800 - DNA, 639 bp, Streptomyces avermitilis
  CDS (1)..(639)
atgggcgcagtgaagaacaagcggatgcctcgtgcggtacgcgaacagcagatgctggacgccgccgtgcacaccttcggacagcgggggtaccgggccgcctcgatggacgagatcgccgaactggcgggcgtgtccaagccgttggtgtacctgtacctgaactccaaggaagacctcttcaccgcctgcatccggcgtgaggcgaaggcgctgaccgccgcggtgcgcgcgggcgtacggccggggctgcccgccgaccgccagctctgggacgggctgacggcgttcttcacgcacaccgcgcagaaccccgacgcatggtccgtcctgcacctccaggcgcggacgcacggcgagccgttcgccgccgaagtcaccgcgatgcgcgaggagatcgtcgcgttcgtcacccagctgatcgtggtcgccgcgcgtgccgcacaccggaacccgtccctcccggagcgtgaagtggccgggctcgcggaggcgttggtcggtgcggccgagtcgctcgcggcctgggccaacaccgccccgggcgtctccgccaaacaggccgcggccaccttgatgaacttcgcctgggcgggactgggcgacctcatggagggccgcccctgggccccgtcggcc

SEQ ID NO: 4801 - DNA, 924 bp, Streptomyces avermitilis
  CDS (1)..(924)
gtgcagaccctgcttccccttctcgcccgtggtgccgtgctgtcgccgttcaagcggccccggcccgacgcggccttcccgcacagccggctcgtcctgtccggtgtgcggatcgatctcgcgcggctcgccgcctatgagcgcgcctgcggtttccccaccggcgccgacgcgctgcccctcacctatccgcacgtcctcggttttcccctcgccatgcggatcatggcgagccgggccttcccgctgccgctgctcgggctcgtgcacacctcgatcgaggtcacgcggctgcgggagccggccgccaccggggagtacgaactcgccgtgcacgtcgagggactgacgccccaccggcgcggtacggaggcgaccgtggtgaccggggcgcgggtggacggcagcctcgtatgggagtcgaggagcacctatctggcgcggcaccggagggcgacggacgcccgcaccccggcggacgcgcgcaccgcgacggacgcccgcaccccggcggacgcgcgcaccgcgacggacgcccgcaccgcagcggacgcccgcacggccgcacccgtgccgtccgccgagccgaagcccctgcccgtggtcgccgagtggcggctcgccgcggacgtcgggcggcggtacgcggccgtctccggggaccgcaacccgatccacctgcacccgctcaccgcccgcctgttcggcttcccgcgggccatcgcgcacgggatgtggaccgtcgcccgctgcctcgccgagcagccggccgacgcctccgtccaactgcgggccgagttcaagtcgcccgtgctgctgccgggcaccgtgacgtacgcggccgacggggggcggttcgagctgcggggcggggagcgggtgcacctcaccggcgaactgcgcgagtatcgcgcgaactccgcc

SEQ ID NO: 4802 - DNA, 1914 bp, Streptomyces avermitilis
  CDS (1)..(1914)
gtgtccaccccgtacccgacctcgtcgtcgttcgaccccgccgcgcccgcctccgtcgagcccgagatccggcggctggacggggtggtgcgcgaggtggccgtgccgccgctcgtcgggcaggtgacgcacggttcgctcgcggacatcccgttcgacaacgcggacgtggcgcccgaagacgtggtcctcagccggaagacgccggacggcggctggaccgatgtgacggcggccgagttcgccggccaggtgctggccgtggccaaggggctgatcgccgaggggctgatgccgggcgaccgcctcgcgatcatggcgcgtacgacgtacgagtggacgctcctcgacttcgccgcgtgggcggcgggcctggtgaccgtccccgtctaccccacctcctccgtcttccagacccgctggatcctccaggactcgggagccgtcgcgctcgccacggagtccgcgggccaggcggccgccctcggcccggagctctcccgcctgcccgatctgcggcacgtgtgggtcttcgacaagggacatgtggagcgtctggcggaactggggcgcgatgtccaggaccaggaagtcgccgtacgacgcggggtgctgggccccgacaccctggccaccctcgtctacacctcgggcacgacggggacccccaagggctgcgccctcacgcacggcaacttcttcgcggagatcgacaacgcggtcgaactcctctaccccatcttcaagtcgaagacgaaggaggaggcgtcgacgctcctcttcctgcccctgtcgcacgtcttcggccggatggtcgcggtcgcctgcgtccgcgcacgggtgcgcctgggccatgcgccgagcctcacgacggaggatctgctcgcggacctcgcgagcttccggccgacctgtctgctggccatcccgtacatgctggagaaggtcttcaacggggcccgggcgacggccgagaagggcggccgggcgtcttccttcgaccgggcggtctccgtggcccgcaagtacggcgaggcgatggagacccggcagcagggcaccggctccggccccagccggggcctgaaggcgggccgcgccctctacgaccccctggtctaccgccgcatccgcaacgcgctgggcggcagggtgcggtatgtgatctgcggcggctccccgctgggccgcccgctggccgcgttctacgccggtgcgggcatcgagatctacgagggctacggactgacggagacgacgggcgcggccacggtcacgcctccgcacaaaacccgcctgggcacggtgggctggccgctgcccggcacccgggtccggatcgcggccgacggggagatcctgctcagcggcggccaggtgttccgcggctactgggatccgcacgcgggcggggtggtcccggcgacgccggacggctggttcgcgacgggcgacataggccggctggacgacgagggccatctgacgatcacgggccgcaagaaggagatcctgatcaccgcgggcggcaagaacgtggccccggcgccgctggagaactggctccgctcgcatccgctgatctcgcaggccttggtggtgggtgacggccgcccctatgtcacggccctgctcaccctcgatcccgagggcatcacgcactggcgccagatgaacggcaagcacggcgtcccgccggaactcctcatggacgacgaggagttgttctcggtactgcaacgcgcggtggacgaggcgaacaagctcgtctcccgcccggagtcgatccgccgcttcgccgtcctgccggtggacttcacggaggaggcggggcatctgacgccgtcgatgaagctgaggcgggaggcgatcgcccgggacttcgggcgggagatcgaggggatgtacgcgcaa

SEQ ID NO: 4803 - DNA, 495 bp, Streptomyces avermitilis
  CDS (1)..(495)
atgaacccacgacgacgcctcgcggcctacggcgtgcccggcgccctcgcgatcgttctgctgctcgtcgcggcggcgtatctccgccccggcggcgaggtggaggcggcggtccccgccgtggacgcgaagaccggccgcatctgccgggccctggcacacgacctgcccgacaccgtggccggtctgaagcgccgggcgacggacccctcgtcgccgctcaccgcggcatggggggaccccgcgatcgtgctgcgctgcggtgtcccgcgaccggccgagatgaacagcgccggcgcggtgggcgcggacctcaagggggtcggctggatgctgggcagccgcgtcgtggacggccggcacctgtgcaccaccacgctccgcgagatctacgtcgaggtgagcgtccccacgcggtacggcgacgtcttcgccctggagggcctggccgccgccgtgcggaagaacgtccccgagggcatcagcgaccagtcc

SEQ ID NO: 4804 - DNA, 201 bp, Streptomyces avermitilis
  CDS (1)..(201)
atggctaccggaaccgtgaagtggtttaacgccgaaaagggctttggtttcatcgcccaggaaggcggcggcccggacgtcttcgtccactactccgcgatcaacgcgagcggattccgctctctcgaagagaaccagtcggtttccttcgacgtcacgcagggtccgaagggcccgcaggcggagaacgtcaccccgctc

SEQ ID NO: 4805 - DNA, 846 bp, Streptomyces avermitilis
  CDS (1)..(846)
gtggacaattctcgcacccggccgcgcgtcggccacatccagttcctgaactgcctgccgctgtactgggggctcgcgcggaccgggacgctcctcgacttcgagctgaccaaggacactccggagaagctcagcgagaagctggtgcggggtgatctcgacatcggtcccatcacgctcgtcgaattcctcaagcacgccgacgagctggtcgccttcccggacatcgccgtcggctgcgacggcccggtgatgtcctgcgtgatcgtctcccaggtccccctggaccagctcgacggcgcccgcgtcgccctcggctcgacctcgcgcacctccgtgcgcctcgcccagctgctgctggccgagcaggtcggcgtgcagccctcgtactacacctgcccgccggacctccccctgatgatgcgggaggccgacgccgccgtcctcatcggcgacgcggcgctgcgcgccaacctgagcgagggcccgaagttcgggctcgaggtgcacgacctgggcgccatgtggaagaagtggacggggctgccgttcgtcttcgccgtgtgggccgcccgccgcgactacctggagcgcgagccggtcgtcacccgcaaggtgcacgaggccttcctctcgtcccgggacctctccctcgacgaggtcggcaaggtcgccgaacaggccgcgcgctgggaggccttcgaccaggccgtcctggagcggtacttcaccaccctcgacttccgcttcggcgccgcgcagctgaaggcggtcgcggagttcgcgcgccgcgtcggcccgacgaccggcttctccgcggacgtgaacgtggacctgctgacgccc

SEQ ID NO: 4806 - DNA, 1749 bp, Streptomyces avermitilis
  CDS (1)..(1749)
atgcagccgctcgaagtcggcgaacccacggtcgtggggccctaccggctgctcggccggctcggctccggcggtatgggccgcgtctatctggggcgcagtacgggcggccgcacggtcgcggtcaagatcgtgcacccgcacttcgccctcgacgaggagttccgcgcccgcttccggcgcgaggtggaggcggcgcgccgggtcggcggcgcctggaccgcgccggtgctcgacgccgacccggaggcgtccgtgccctgggtcgcgaccgggtacgcggcgggtccctcgctggccgccgccgtcaccgacggcggaccgctgcccacccattccgtacgggccctgggcgccggactcgcggaggcgctgtcggcggtgcacggactgggcctcgtccaccgggacgtgaagccctcgaacgtgctcctcaccctcgacgggcccctgctcatcgacttcggtatcgcccgcgccaccgacggcacggcctccctgacctccacgggcgtctccgtcggctcgcccggctacatgtcgcccgagcagatcctcggcaaggggatcgcgggcgcggcggacgtcttctcgctgggcgcggtcctggcgtacgcgggaaccggcgcacctcccttccccggcgactcctcggcctcgctcctctacaaggtcgtgcacgaggagcccgaactcggctcgctggagggggagttgcgggagctggtcgcccactgcctggccaaggacccggacgggcggcccggccccgccgaggtggccgagcggctcgccccgcagggcgcggcccggctggtcacgggcggctggctgccgggacccctggtggagcaggtcagccgcagcgccgtgcagctgctgaacctggacgtggcgggggcggcggaggcggtgccctcggggcccgtggagttcagcactccttcggtgcggccgccgaccggtgtcttcggaccgccgcccgacctggccacgcccgcctatatgccggcgccccgccccgcggaggcgcagccgcgccccgagccgcagccgcaaccacagccgcaaccgcagtcacagccgcccgcgcagccgcaggacgccgtgccgggagtgccgctggccgtcgcccccgagtccgggccgcccggcagggtctcggtgagcgtggccgcgacctcggcgcccggaaccggtggccgggggcgccgggtgagttgcacggtcgcgctggctgtcgcgggcgcgctggcgaccgtgaccgtggggtccgcgttcctcttcggcctgctggagggcggggattcgagcggcggcgacagcagcgggagcgcggacagtccgcccgccgcgaccgcgagcgccagccggtcggaccccggtgacggggcggacggtgccgtccccaagtcctacctgggcacctgggagggcgacgccctcgccctgggcggcacactgcccgcgggcacgttccgcgtgaccatcggcgaggccgccgtcggcaaggagatcggcaccttccggtcgaccgatcagctcggcggcacctgcgacgacgtactccttctcaagaaggccacggcgcagcagctcgtcgccacgagcgtggccaaggacaccaacccctcgacgtgcacgaccgggaggcacgaggtgcggctgacgcccgtcggggacgacctcagctacgagacggacaatcaggcggccgggaatccgacatcacggatgtcgaaggtcaag

SEQ ID NO: 4807 - DNA, 678 bp, Streptomyces avermitilis
  CDS (1)..(678)
ttgcggggagggcgcggatttcgtcagcatgggtcaccggcggcggccgtcgccgtgggacggggaggggcgggacgcgtgggcggatcggcacggccgaagcggcggaaggcggcgggtgccgcactccgctacgcgcatgtgcgcgaccgcgggcccgtgcgagggtcccgggggtcgaagcgggagacggtactgggctgtgcggtcgctctggccgtggccgcgctgctgatcggattcgccgtcgcggaccgggcctgggggccggacatctggcgcggcacggctcccggctggcccggcggggggtacggcttcgcggccaccgtgggcgtgctgctgccgtgggccgcggccgccgcgctcacgtcgttcggccgggtgaactggcgtcggagcagggcccgttcgctcggctggtccgcgtcggccctggccggtgcggcgctgtcggcgctgctgctcctcgtggtcttcgcggcgttcgtgccgaagaaacgccaccgcgggtacgactgctaccgcgagggcggcgcctgctgggtccacacgcagtacccctacgtgtgggccgtgggcctcgccgcgaccgtgaccggcacggccctgctggccggcggcctggccgcgtacttccgccggcaggccccgaacggccctcccccgccgactact

SEQ ID NO: 4808 - DNA, 741 bp, Streptomyces avermitilis
  CDS (1)..(741)
gtggacgtggacttcgatgtctggctgaccggccctgccgctctgtggggtgcggcggcgggtctgctcgtgccccgggccgcgtatcgcctctgcgtggaacccgacgagccgtggcgcgaccggtgtccgcgggggcacccgatcaccggtggccccggcggctggctcggacgggcgcggtgcccggacggcacggtgtacgggccctccgccgtcctcgtctgcgccgccaccgccctggtctgcgcggccctcgccctcgccaccggcacccgccccgaactggccgtctggctgctgctcgcgcccctcgccgtgctgctgacgatcgtggacttccgggtgcagcggctgccggacgtgctcacgctcccgctcgcgggtgccgcggccgccctgctgggcgtggccgcgctcgcgcccgagcacgcgggggagtggctgaccgcgctgctcggggcgctcgcgctcggcggcgcgtacttcgtcctcttcctcgtcaacccgaacggcatgggcttcggcgacgtcaaactggcgctggggctcggggcggtgctcggctggtacgggtggagcacggtcgtcctgggcacgttcgccgggttcctgttcggcgggctgtacgggctggggctcgtggcctcgcggcgggccgggcgcaggacgtcgatcccgttcgggccgtttctgatcgcgggggcgttcgtggggctgctgatcggggcttacaccagt

SEQ ID NO: 4809 - DNA, 1197 bp, Streptomyces avermitilis
  CDS (1)..(1197)
gtgaccgagaaggccgaccttcagtccgtcctcgaccgtgccgccgcgggcgggcggatcacccccgaggaggcgctcgacctctaccgggacgccccgctgcacgcgctgggcgccgccgccgacgccgtacgccggcggaggtacgcagggaccgagcacatcgccacgtacatcatcgagcggaacatcaactacacgaacgtgtgcgtcacggcgtgcaagttctgcgccttctacgcggcccccaaggacacggccaagggctggacccgcgacctcgacgacatcctgcgccgctgcgcggagaccgtcgaactcggcggcacgcagatcatgttccagggcggacaccaccccgactacggcgtcgagtactacgagaagcacttcgccgcgatcaaggaagccttcccgcagctggtcatccactccctcggcgcgtccgaggtcgagcacatggcccggatctccggcgtctccgtcgaggaggcgatccagcgcatccacaccgccggcctcgactccttcgcgggcgcgggcgcggagctcctgcccgagcggccccgcaaggcgatcgcccccctcaaggagtccggggagcgctggctggagatcatggagacggcgcaccggctgggggtcgagtcgacgtccaccatgctgatgggcacgggcgagaccaacgccgagcgcatcgagcacctgcggatgatccgtgacgtacaggaccggacgggcggcttccgggccttcatcccgtacacgtaccagccggagaacaaccacctcaagggccgtacgcaggccacgctcttcgagtacctgcggatgatcgccatcgcccgcctcttcttcgacaacgtggcccacatccagggctcgtggctgaccaccggcaaggaggtcggccagctctccctgcactacggcgcggacgacctcggctcgatcatgctggaggagaacgtcgtctcctcggccggcgccaagcaccgctcgaaccgcatggagatcatcgacctgatccgcaaggcgggacgggtgccggcccagcgcgcgacgacgtacgagcacctcgtcgtgcacgacgacccggcgaacgacccggtcgacgagcgggtcatgtcccacatctcgtcgacggcgatcgagggcggaacggcgcaccccgagctgaagctcctcacctccaac

SEQ ID NO: 4810 - DNA, 447 bp, Streptomyces avermitilis
  CDS (1)..(447)
gtgctgaccattcacgccgccgacgaactgcggtacacgtgggacgacccggagccggtcaaggacggcgccgtcgccgtgcagggcgtccgggtcgccgccacggggtcactggccgagctccaggagcggttcccgggggctcgtgtacggcgctggcccggtgtcctcgggcccgcccgcgtccacgagggcccgctcccggacgcgccgacaccgcgtgaacgcgttcacgcggtgctgaagctgggcgcggtggccgtgctggaggagtacgccggtacgcccgaactccgggcagccgccgagcggaacgacgtcgtcgtcctgtcccgcggccggcgcacggcgatcgtcgacatgggccgcgccgacctcgcggtcttcgacggggcgggcgcgtgcatcgccacggtgtgcgccgggcgcctggtccaccgccgccgt

SEQ ID NO: 4811 - DNA, 1047 bp, Streptomyces avermitilis
  CDS (1)..(1047)
atgaggagtttcctgaagccggccgccgggattgtttgcctggtgaccatggcctgtgcggggtgctcctcgggcggtgacggctcgtcggacacggcctcctccgagccgtcggggaccagctcaccggccggctcaccgaccggctcaccgacgcggcaggcacagacgtccagcaccgcgtacgccccgtacgtgagtgccacgaccgcctcggacatggacccggccgggtcgccgtcgacgtacaacctggccttcgtgatctcggacggcagcgactgcacgccgaagtggaacgggacgtacgcgatcggcaactcggcggtggcatcgcggatttcggcgctgaaggaatccggtgcgagcgtccgcgtctccttcggcggggcgtccgggaaggaactggccgaaacctgctccagcgcgtcgaagctcgcggaggcctacggtgcggcgctggacgccgccggggcgacgctggccgacttcgacatcgagggcgacacgctcacggactcggcctcggtcgagctgcgttcccaagcgatcgcgctgctgcagaaggaccgctccgacctgagcgtctccttcacgctgccggtcatgcccgcgggcctggacgacgacagcatcgccctgctggagtccgcgaacgacaactccgtacaggtcgccaccgtcaacatcatgacgatgaactacggcagttcgtacgacggcgacatgggcgactacgccctcacctcggccgaggcggcccacgaccaactggcggacgtgttcgggctgtcgagcaagggcgcctggcagggcctcgccctgacctcgatgatcggtgtcaacgacgtcgacaacgagacgttcacgctcgcggacgcggcccaggtgcggtcgttcgcagaggagaagggcgtggcgtgggtgtcgatgtggtcgacgttccgggaccagcagtgtgacgacggctcgaagtcgaacgacgcggcgaccgactgcagcggggtgaagcagacgagcggcgcgttcgccgaggcgttcgcgggg

SEQ ID NO: 4812 - DNA, 390 bp, Streptomyces avermitilis
  CDS (1)..(390)
atgcaatccgagtccgacatcgaaaaccgttcccctgtgcgcggccgcggccgcaaacgcggcaatgggtccgaagagggccccgtattcgttgacaactccgggcgcaggtcacgactgctgcgccggttcgggatcctcgtctgcgtggcctgtctgggctacgtggtcgtgctcggcatggcgttcatggggtggggcacctcgctgagcaactcgatcacgcccttcggcggcggccaggccgcccccggcggcgggggtctcgggccgcagggcggcggcgctcgcaccggcaccccgccctcgggcgtccccaccggagcgcccacgggcgccgccccgtcggcggcagtgacccccggcgcggcctcctccaccggcgccaac

SEQ ID NO: 4813 - DNA, 2370 bp, Streptomyces avermitilis
  CDS (1)..(2370)
atgactaagacgacgccttcgcgcggccgccggcgcgccccttcccggatggaacgggccgccggcaaggccgccgcgctgcagaaaccgcgcgtgatcctcgccctgctgctcctgctgggcctgacgagtgtgatgctccttgacggctacctgcggggcgaggttttcagcgaccagcgcgtacgcgacagcgccgcctacgacaaggtgccgaagaagatcctcgaagcgggcccgatcttcacgtccagcaacggcacggtggacccgaagtcggtaccgaagaagaccatcgtcctgaccttcgacgacggtccgaaccccacgtacaccgagaaggtcctcaagatcctccaggacaacgacgtgcccggcacgttcttcctggtcggctcgatggtcacgcgttacccggacgccgtgaaggacatggtcgaccagggcaacgaggtcggcatccacaccttcacgcacgtcgacctctcgtaccagagcaccgcgcgcgtcgaacgcgagctgaaccagacccagctcgccctcgcgggggcggcgggcatcacgacgacgctgttccgcgcgccgtactcggcggaggccgacgccatcgacaactacagctggccggtctaccagcggatggccaagctgggctacaccagcgtgttcatcgacaccgacagcgacgactggaagcagccgggcgtcgcgagcatcatcaagacggccacgccgaagaagaacaacggcgcctcggtcctgttccacgacgcgggcggcgaccgcgaccagaccctggtggcgttgccgaagtacatcaagaagatgaaggcgaagggctacaccttcaccaccgtcagcggcgccctggccaaggaccgggcgtcgaccgccgccggcagggcgggcgcggggaccgggaccgggcagcagccgatcgatcagacggcgaacggcggggcggcgaacggtgggacggcgaacggtgggacggcgaacggtgggacggcgaacggccggcagcccggcgcggctgccggcacgggcacggccaccggcgcgaccgcgacctcgatcgagcaggccgcccaccggaaggccaccggcgcgaccctgtacgagggcaaggccctggtcgcggcggtcgccctcgccgagtggagcatgccggcgctcgcgtccggtctggtcgtcgtgggcgtcgccgtcatgggccggttcgcgatgatgctcgtcctcgcccgcacccactaccggcagcgcaacaagcgccggttcagctgggggccggagatcaccaggccggtcagcgtgatcgtgcccgcgtacaacgagaaggagtgcatcgagaacacgatcaactccctcgcgcagtccacgcatccgatcgagatcatcgtcgtcgacgacggctcgacggacggcacggccgacatcgtggaggccatgcggatacccaacgtccgggtcctgcgccaggagaacgcgggcaagcctgccgcgctcaacaacggagtgcgcaacgccagttacgacatcgtcgtgatgatggacggcgacaccgtcttcgaagcggacaccgtgcgccggctcgtgcagcccttcgcggacgacgaggtcggcgcggtcgcgggcaacgccaaggtcggcaaccgcgacaccgtcatcggcgcctggcagcacatcgagtacgtgatgggcttcaacctcgaccgccgcatgtacgacctgctgcgctgcatgcccaccattccgggcgccatcggcgcgttccgccgcgaggcggtcctggaggtcggcgggatgagcgaggacacgctcgccgaggacaccgacatcaccatcgccatgcaccggggcggctggcgggtcgtctacgaggagcacgcgcgcgcgtggaccgaggcgcccggctcgctgaagcagctgtggtcccagcgctaccgctggtcgtacggcaccatgcaggcgctgtggaagcaccgcaagtccctgacggaccggggtccatcgggccgcttcggccgggtcgggatgccgctcgtcgtgatcttccagatcgtcacgcccgtcttcgcgccgctgatcgacgtcttcacggtctactcgatgatcttcgtggacttctgggcgtccctgctcgcctggctggcggtgctcgtcgtccaactcgtctgcgccgcctacgcgttccggctcgaccgcgagaagtaccggtatctcctgatgatgccgctgcaacagctcgcgtaccgccagatgatgtacctcgtcctgatccactcctgcatcacggccctcaccggcggccgcctgcgctggcagaagctgaagcgcacgggcgaggtcggcaccccggcgggggtgagc

SEQ ID NO: 4814 - DNA, 1413 bp, Streptomyces avermitilis
  CDS (1)..(1413)
atgagctggggacccgagcagcaacaggggtacggctacgggcagcagccacagccgcagtcacagccgtacgggcagccctcgcagtcacagcctcagccgtacggacagcagcagccactggcacagccgtacgggcagcagtatccgccgccgtacgggcagcagcagccgtacgggcaggggtacgtccagcccggaccgtacgagcagcagtggcagcacgctcccgcgcagccggaggccgcggccgtcaccagcacggtccagatggatccggtcccggcggcacccgaagcggaagcgcccgagggcgcgacatcgggggcggacgccccggcaccgggggcggacgctccggaaccccggccgaaggcgaaagccggcgggcgcgaccgctacttcgacgcgctgcgcgccgtcgcgctggtccgtgtcgtgacgtaccacaccttcggctgggcctgggccggcctggtcttcccgtccatgggtgtgatgttcgcgctcgccggcaccctgatggcgaagtcgctggagcgtcccgcgctcaaggtggtcaagagccggatgcgccggctcctgccccccttctggttctggggagtcttcgtcgtgctggcgatgatgatccatggctggatgccgggctgggagatcgtctactggatcgtgccggtcggcgacccgccgggcaacgcgtggggctcgcaggcgtacgagatcctctggtacctgcgcacgtacctctggttcgtctggctctccccggtgctcctgtgggtgtttcgcaaggcgccgatcccggtgctgctgctctccctcgtcccgatcgtggtcttccagttcggctggcagccgccgtggaaccgcttcggcagcgcgctgacggacatcgccacctatctgttctgctggctcgtcggcttcgcgcaccgcgagggcgtgctccagcggctgaagcccgtcgcggtggtcgcgctgtcgctggccgcgctcgcgtacggcggctggtacgccttcgcgcaccagggggagttcggcacctacgacctggacgagaacccgctcgcccaggccttctggtcggccggcttcgtggcgctgctgatgtacttcaaggcgcactacgacgtcgacttcgcgtggctggcccgcttcaagcggctcgaccggatcgtgacgatcttcaacgggcgagcggtgacgatctatctgtggcacgagatcgcgctgatcctcgcggtcccgctgatcgaccagttctggaaggtgcccgccttcgagaagtggctgccgctggagagccagtggttcatgttcggcatcggctgggcgctgatctggatcgccgtcccgctggtgggctgggtcgaggacgtggccgcgaagaagaagccgaagctgctgccc

SEQ ID NO: 4815 - DNA, 693 bp, Streptomyces avermitilis
  CDS (1)..(693)
gtgacccgcgcatctctggacaagcagccgcacgaagtcgcctcgatgttcgacgacgtggcggaacggtacgacctgacgaacgacctgctgtcgctcggacaggaccgggtgtggcgccgggaggtcgcgaaggcggtcgacgcccggcccgcgcagaagatcctggacctggcggcgggcaccgccacctcctcgctccccttcgcccgtgcgggtgcgtacgtcgtcccctgtgacttctccctcgggatgcttcgcgtcggcaagaagaaccacccctggctgccgctcacggcgggcgacgcgacgaagctgcccttcaaggacgacaccttcgacgcggtgacgatctccttcgggctgcgcaatgtccaggacaccgataccgcgctgagcgagctgtaccgggtgaccaagccgggcggccgcgtcgtgatctgcgagttctcgcacccgacgtgggcgccgttccgcacggtctacaccgagtacctgatgcgcgcgctgccgccggtcgcccgtgccgtctcgtccaaccccgacgcgtacgtctatctcgccgagtcgatccgcgcctggccgacccagcccgagctggccgagcggctgcgcaaggccggctggtcgaaggtggcgtggcggaacctgacgggcggagtcgtggcgctgcaccggggattcaaggccgtc

SEQ ID NO: 4816 - DNA, 2499 bp, Streptomyces avermitilis
  CDS (1)..(2499)
atggcgtcgtactgcccgcactgcggggcaccctctcccgccgaggcccgcttctgcatgcggtgcgggcgcgaacgggtagcggtggcgtccgacgcgtccgacgtatccgacgcgtccgaagcacccgacgcatctgcgcccgaggtgtctgcggcgcccgaggtgcccgaggtgtccgccgtttcgccggtcgcgcctcccgccgtcccgcccgtcgcgcctcccgtcggcccgccgcccccggcgtacgcccccggtcccgcccggccctcgcccgtcggcgccttcctcggccgtaccttccgcggtgactgggccggagccgcacaggccgcgctgtggcccgtaggactgctgctggtctccgccgtggccctgggaatccccaagtacgggcaggactccgaggaattcgtcggcttcggcgaccggctgcggatcgcgctggcgctgctgctccaggcgctcggcggcggcttcgaggtgaaggccgcgtcgggctccggctacggctacggctccggtaccgggttcggcggcggctacgaccagggagcggccggggacgtcacgggcgggggttccttctcgctggtgccgctgacggtcacggtcctgtggatcgccgcgctctgcgtcggcgtacgcctcctgcgcgggcggctcgcggtgcgcgccccgggcagtccgaccgccggactcgaggccgccgtgcgggtggcgctcctggtgaccggagccgtactgctcctcggcctcttcgcccagcccaccatcgcgggcgtcgagatctccgcctccccggcgctctccgcactgggtgccctgctgctctccctcgccgtggcctgcggcgtgctgcaccgcgtcggcccggaccagtggtgggccgctcaccccggcgcccggacgctgctgcgcgccacgggtacggcgctgcgcgccctgaccgtcgtcctcgcgctctgctcggtcgtcgcgttcatcaccgtcgcccggctcgacgacctggaccaggcgtggagcgcggacggcgtctcaccgctcctggtcgcgctcctcgtactgcccaacctcgccgtgctggcgctcggtctttcctggggcgtgcccgtcggggcgcgggcgcaggggagttcgccgtacggcggcggctacgagcaccacgccttcgggctctccgaactggccgacgtcaccaacgcctgggcggtcgtgggcgcgctggcgctcggtgtggtctgcgcgctgatcctgggcgtcgtcgccgcgcgccgctcgacgagccgcggggaacagctgctggcggcgggcgtcttcctcggcctgttcctgatcctggccgggctcggcggcctcggcaccgagatgtcgggcagtacgtcctcggacttcggttcctcgggcctgtccgcgggcggcacgctcgacgcggggctgagcttccccgaggcactgctcttcgggctgctgtggatctccgcggcgacgttcgtggcgccgtatctggtgcgggtggccggcggacggacgggcatgagcgcaccgcccacggttccgccgggcccgccggtttccccggtttccccggtttccccggtttccccggtttccccggttccgccggttccgccggtttccccggttccgcagactccggtgggccggccgatgccgcccgtgccgccggtgccgagcacgcccgcgcacactcccaccgcgtacgacctccacgccttcccactcggcccgcagccgcccgccgccgccccgaagccccgcagccgcgccgtggtctgggctgtgacgctcgccgtcgcgttcgtcgtgggcgggggcgcggcggccggtgtgctggtctggcaggaccaccagaagggcgatacgtcctccggcaaaccgaggacgaagccgacggcgacggcctccgactcgccgtcggcgacgccgttcgcggacccgacgagcggggcgacggacacggccacggacgaagcgacggacagggcgacggacggggccaccggcgaagccactgcctcccccttcgaacttcccgccggctaccaccggttggacgaccccttcggtttctccctcgccgtacccgacgtctgggcgcgcgagggcgtgaagaacggcacgcaggtgacgtacgcgggctcgaccggtctggagcacgtgcaggtcggcgtcatcgcgaacgcgggctacacctcgtacgacaacttcctgaccctggagaagacggcgaagaagaaggacgccggctaccagcggatcaggctggagcggaacaccttccagggccgcgacggcgcgatctgggagtacacgtacaccgacgggtccggccgcaccgtccacgcggcggaccagggctatgtcgccgaggacggcaccgagtacgcgatcatgctcgtcggcaaggacgagctgtgggagggcggcctggccgagacgttccgggtcgccctcgactcctggcagctcacc

SEQ ID NO: 4817 - DNA, 345 bp, Streptomyces avermitilis
  CDS (1)..(345)
gtgacatctgtgcatataccgcccaaaacacccgaagtgcgcgtgccgcggcttgtcggcctgatggccgtggacgcgcgcgagacggccgaggcgggcggcgtgctgctcgccgcgccggaccgccccgactcccctctcacgttcctcgacttcgtcgtgcgccaatatcccccgcccggcacggaggtgccgcgcggtgccgtggtcaccgtgtggttcgacctcggcgagggcgggggcggcgggggcgcgggggtgcacgagccgcgccggcccattccgccaccgggcgggctgcgccgcgagctggacgaaccgggtgaccccttcaaggtcctcagg

SEQ ID NO: 4818 - DNA, 504 bp, Streptomyces avermitilis
  CDS (1)..(504)
gtgaacagagctctccccgacgtacggctgcgcgtccccaccgacgaggacgccttcgcctggcaccggatcttcgccgaccccgaggtcatggagttccacggcggcaaggccgccgaactgtcggtctacgaggagctcaccgcccgtcagcgcaggcacgacgccgagcgcggcttctgtctgtggaccttgctcgacgagtcgggcgaggtcatcggcttcacgggcgcgcagccgtggccgcacgagtggggcccgaagggcgagatcgagatcggctggcggctcgggcgggcccactggggcaaggggtacgtcaccgccgccgcgcacgccaccctcgaacgggtgcgcgcggcgggcgtgtccggcgtcgtcgccatggtcgacgcccgcaacgaacgctccatcgccgtgacccgacgtctcggcatggagctggtggagaccttcaccacgccgaccgcccagcgactcgggcactgctaccgacgcgagctg

SEQ ID NO: 4819 - DNA, 1302 bp, Streptomyces avermitilis
  CDS (1)..(1302)
gtgaccgagccccagcccctctccgaacacaccgccgatgtgatcgtcgtcggggccgggccagccggttcgacgacggcgtactacctggcgaaggccggtctggacgtcctcctgctggagaagaccgccttcccgcgcgagaaggtctgtggcgacggcctgacgccgcgcgccacgaagcagctggtcgcgatgggcatcgacatctccgaggaggcgggctggctcaggaacaagggcctgcgcatcatcggcggcggtgtccggctccagctggactggccggatctcgcctcgttcccggactacggcctcgtccgcaagcgcgacgacttcgacgagcaactggcccgtcaggcacagaaggcgggcgcgcggctgtacgagcgctgcaacgtcggcgcgccgatcatcgacgaccgcacgggccgcatcacaggcgtccacgcgaagctcggtgacgccgactcgaaggagaagcgcgaggtcaccttccacgccccgctggtggtggcggcggacggcaactcgacgcgcctgtccctggcgatgggcctgcatcgccgcgaggaccgcccgatgggcgtggccgtgcgtacgtacttcacgagcccgcggcacgaggacgactacctcgagtcctggctggagctgtgggaccgccgaggccccggcgaggaccggctcctgccgggctacggctggatcttcggcatgggcgacggcacgtccaacgtcggcctcggcgtcctcaacacctccgactccttcaaggaactggactggcgggaagtcctgaaggcgtggtgcgcctcgatgccggaggactggggatacacgcccgagaacatgacgggcccgatccgcggcgccgcgctgccgatggccttcaaccgtcagccccactacacgcgcgggctgctgctcgtcggcgacgccggcggcctggtgaacccgttcaacggcgagggcatcgcgtacgccatggagtccggccagctcgcggccgacgtcatcgtccaggcccacgcccgtgcgacccccgcccagcgtgagatcgcgctccagcgctacccgcgcgtgctcaaggacacgtacggcggctactacacgctgggccgggccttcgtgaagctgatcggcaacccgaaggtcatgaagatcgcggcggagcgcggcctcacgcacccgctcctgatgaagttcaccctgaagatgctcgccaacctgacggaccccacgggcggcgacgcgatggaccggatcatcaacgggctgtcgaaggtggcgccgaaggcg

SEQ ID NO: 4820 - DNA, 816 bp, Streptomyces avermitilis
  CDS (1)..(816)
atgtcccacaccgctcacatacgaagccatcggaagccccgccgcagcaccccgaaaatctcggtgcgcgccggagtcgccggtggcgttctcagcaccctggcagtggccggcgctgccggtgcggcgaacgcggccgaacccgtgacgcagaccgtggaactgcccaccctgacggccgacctggccactcaggtcgcgcagtccgcggacgccacccagcaggcagcggccaactacgagctgcaggccgagcgtgacgcggccgccgccaaggccgcaaagcaggccaagtcggacctggccgacgcgaagaagaaggcggaggccacgaagaaggccgaggccgcacgcagggcagctgccgagcgtgccgcctcgcgcagcgccgagcgggccaccctcagcgcctcggcgagcgcctctacgggcacgtcgacgtccacgtccacgtccacggccaccggttcggccgcggcggtcatcgcgttcgtcaaggcgcagatcggcgacgcgtacgtctccggcggcaccggccccaactcgtgggactgctccggcctcgtccaggccgcgttcaagcaggtcggtgtgagtctgccgcgcgtctcgcaggaccagtcgacggcgggcacccaggtctcgctgagcaacctgcagccgggcgacatcctgtactggggtggcgcgggcagcgcgtaccacgtgggggtgtacgtcggcgacggcatgttcgtcggcgcgcagaacccgtccaccggcgtcgtcgagaagcccctctcgtacgacccgccgaccggtgcggtgcgcgtgctc

SEQ ID NO: 4821 - DNA, 357 bp, Streptomyces avermitilis
  CDS (1)..(357)
gtgaacgcgtatgcgccgatcctcgtactgggagccctcggggcaggctttgcgatcttctccgtggtcatggccacgctgatcggtccgaagcggtacaaccgggccaagctcgaggcgtacgagtgcggtatcgagccgacccccacgccggccggcggcgggcgcttccccatcaagtactacctgacggcgatgctcttcatcgtcttcgacatcgagatcgtcttcctctacccctgggccgtcaccttcgacgccctgggtgttttcgggctcgtggagatgctgctcttcgtgctcaccgtcttcgtcgcgtacgcgtacgtatggcggcgcggcggtctggaatgggac

SEQ ID NO: 4822 - DNA, 552 bp, Streptomyces avermitilis
  CDS (1)..(552)
atgggactcgaagaaaagctgccgagcggattcctgctgacgaccgtcgagcaggccgcgggctgggtgcgcaaggcgtccgtcttccccgccaccttcggcctggcgtgctgcgccatcgagatgatgaccaccggcgccggccgctacgacctcgcgcgcttcggcatggaggtcttccgcggctcaccgcgccaggcggatctgatgatcgtggccggccgggtcagccagaagatggcgccggtgctcaggcaggtctatgaccagatgcccaaccccaagtgggtgatctccatgggggtctgcgcgtcatcgggcggaatgttcaacaactacgcgatcgtccagggcgtcgaccacatcgtgccggtcgacatctatctgcccggctgcccgccgcggcccgagatgctcatcgacgcgatcctcaagctccatcagaagatccagagctccaagctcggcgtgaacgccgaggaggcggcccgcgaggcggaggaagcggcgctcaaggcgctcccgacgatcgagatgaaggggctgctgcgg

SEQ ID NO: 4823 - DNA, 744 bp, Streptomyces avermitilis
  CDS (1)..(744)
gtgagcgacgccaacgccaacggcaacggggtcaaccccgagaaggacctcggcgcctccaacctccccggccagcgtggcgaggggggcgaggagatccgcctccagcgcggcatgttcggcgccaacaacggcggcgacacctccggctacggcggcctggtccgctccatccggctccccggcccggccgcccgcccctacggcggctggttcgacgaggtcgccgacgagctggagggcgccctggaagaacagggactcgtccccgggaacgccatcgagaagacggtcgtcgaccgcgacgagctgacgttccacatcgaacgcgagtacctgctccgcgtcgcccagaccctgcgcgacgacccggccctccgcttcgaactgtgtacgggcgtgagcgcagtgcactacctggaggacaagggccgcgagctgcacgccgtctaccacctgcgctcgatcacccacaacaggttgatccgcctcgaagtcagcgcccccgacgccgacccgcacatcccgtcgctcgtctccgtctatccgacgaacgactggcacgagcgggagacgtacgacttcttcggcctgatcttcgacggtcacccggcgctgacgcggatcatgatgccggacgactggcagggcttcccgcagcgcaaggactaccccctcggcggcatccccgtcgagtacaagggcgcccagatcccggctccggaccagcggaggtcgtactcg

SEQ ID NO: 4824 - DNA, 1329 bp, Streptomyces avermitilis
  CDS (1)..(1329)
gtgagcacttcccacgcatccgccgcttcggcgcgcgagaccacggaagggaccgtctacacggtcaccggcggcgactgggacgaggtcgtccagtccgccgccaagtccgacgacgagcgcatcgtcgtcaacatgggtccgcagcacccgtccacccacggggtgctccgcctcatcctggagatcgacggcgagacggtcaccgaggcccgctgcggcatcggttacctgcacaccggcatcgagaagaacctcgagtaccggacgtggacccagggcaccacgttcgtgacgcgcatggactacctgacgccgttcttcaacgagaccgcgtactgcctcgccgtcgagaaactcctcggcatcgagaacgagatcccggaccgcgcctcgatcatccgggtgctcctgatggagctgaaccggatgtcctcgcacctggtgtgcatcgccaccggcggcatggaactcggcgccaccacgatcatgatctacggcttccgtgatcgtgaactcattctcgacatctacgagctgatcaccggcctgcggatgaaccacgcgtacatccgtcccggcggactcgcccaggacctgccgccgggcgcggtggaccagatccgcgagttcgtgaagaagatgaagaagaacctccccgagtacgacaagctcgccaccgggaaccccatcttcaaggcccgtatgcaggacgtcggctatctcgacctggcgggctgtatggccctcggggccacgggcccgatcctccgctccgccggcctcccgcacgacctgcgcaagtcgcagccctactgcggctacgagacgtacgacttcgacgtcccgaccgccgacacctgcgactcctacgggcgcttcctgatccgcctggaggagatgcgccagtccctgcggatcgtcgagcagtgcctggaccggctcgctcccggaccggtcatggtcgccgacaagaagatcgcctggcccgcccagctcgccctgggacctgacgggctcggcaactccctcgatcacatcaagaagatcatgggcacctccatggaggccctgatccaccacttcaagctggtgaccgagggcttccgcgtcccgccgggacagacgtactcggcggtcgagtcacccaagggcgaactaggggtgcacgccgtgtccgacggcggcacccgcccctaccgggtccacttccgcgacccgtccttcaccaacctgcaggccatggcggcgatgtgcgagggcggccaggtcgccgacgtcatcgtcgccgtcgcgtccatcgaccccgtgatgggaggcgtcgaccgg

SEQ ID NO: 4825 - DNA, 861 bp, Streptomyces avermitilis
  CDS (1)..(861)
gtgaccaccagttcctcggagcagggcgtcagcctgggcatgccccgactgcccgcgcccgactacccggacgacgttcgagcccggctggagcgggacgggcgcgagatcatcgcccgctacccggactcccgctcggcgctcctgccgttgctgcacctcgtgcaggcggaggagggccatgtcacgcgcaccggcatgcagttctgcgccgacatcctcggcctgaccacggcggaggtcaccgcggtcgccaccttctacaccatgtaccggcggcggccgtccggtgactaccaggtgggcgtctgcaccaacaccctgtgcgcggtgatgggcggcgacgcgatcttctccgccctccaggaccacctgggcgtcggcaacggagagaccaccgacgacggcaaggtcaccctggagcacatcgagtgcaacgcggcctgcgacttcgctccggtcgtgatggtcaactgggagttcttcgacaaccagaccgtggccagcgccaagcggctcgtcgacgacctgcgcgcgggagcgccggtcgagcccacgcgcggtgcccccttgtgcacgttcaaggacaccgcccgcatcctggccggcttccccgacgagcgggacggggccgtcgaggcgagcggcagcgcgggacccgcctcgctgaccggcctgcgcctggccaagggagagagcgcccccgcgcgcgtggtccacccgaggggctccggtgccccccaggacgagccgccgcacgaaccgtctccggccgagcacctgagctcgcacgacgcgccgcaggacacgtcggactccgacccgtcccacccggcgggtcctgttgccgaggagggggag

SEQ ID NO: 4826 - DNA, 1347 bp, Streptomyces avermitilis
  CDS (1)..(1347)
gtgatgaccttggcacccgagatcaacgagaccagtcccgagaagctgctcgcacccgtgctgtccgccttctgggacgaggagaagtcctggacgctggacgtctaccgaaggcacgaggggtacgagggcctgcgcaaggcgctcgccatgtcgccggacgacctcatcgcgtacgtcaaggactccggtctgcgcggccgcggcggtgccggattccccacgggaatgaaatggcagttcattcctcagggcgatggaaagccgcactatctagttgtcaacgccgacgaatcggaaccgggaacctgtaaggacatcccgctcctcttcgcgaacccgcatagcctcatcgagggcatggtgatcgcgtgctatgccatccggtcgtcgcatgccttcatctatctgcgcggtgaagtggtccccgtgttgcggcggttgcacgaggccgtacgagaggcctacgcggcgggctacctcggcaagaacatcctgggcagtggcctcgacctcgaaatcaccgtgcacgcgggcgcgggcgcgtacatctgcggtgaggagaccgcactgctcgactcgctcgaaggccgccgtggtcaaccgcggctccgtcccccctttcctgctgtcgcgggcctctatgcgtgcccgactgttgtaaataacgtcgagtcgatcgcgtcagttcccgcaattctgcacaagggcaaggaatggttcaggtcgatgggcagcgagaagtccccgggcttcacgctctactcgctcagcggccacgtcgccagccccggccagtacgaggccccgctcggcatcacactccgccaactcctcgacatgagcggcgggatgcggccgggccaccggctgaagttctggacgccgggcggctcctcgacgccgatgttcaccgacgagcacctcgacgtgccccttgactacgagggcgtgggcgcggccggttccatgctcggcaccaaggcgctccagtgcttcgacgagaccacctgcgtcgtccgggcggtcacccgctggaccgagttctacgcccacgagtcctgcggcaagtgcacgccgtgccgtgaagggacgtactggctcgtgcagttgctgcgcgacatcgaggccggcaagggcgtcatgaccgacctcgacaagctgaacgacatcgccgacaacatcaacggcaagtccttctgcgccctcggcgacggcgccgcctcgccgatcttctcctcgctcaagtacttccgtgaggagtacgagcagcacatcacgggccgcggctgcccctttgacccggccaggtcgacggcctgggccgaccgcacggaggtgaacgca

SEQ ID NO: 4827 - DNA, 2502 bp, Streptomyces avermitilis
  CDS (1)..(2502)
atgactgtgaccaccagcgctccctccggagggggagaggcggcgctcccgccggaagatctcgtctcgctgacgatcgacggcgccgagatcagcgtgcccaagggcaccctggtcatccgggccgccgagcagctcggcatcgagatcccccgcttctgcgaccacccgctcctcgacccggccggcgcctgtcgccagtgcatcgtcgaggtcgagggccagcgcaagcccatggcgtcctgcacgatcacgtgtacggacggaatggtggtgaagactcacctcacttccccggccgccgaaaaggcccagcacggcgtgatggagctgctgctcatcaaccacccgctggactgcccggtctgcgacaagggcggtgagtgcccactgcagaaccaggcgatgtcgcacggcaactccgagtcccgcttcgagggaaagaagcggacgtacgagaagcccgtcgcgatctccacccaggtgctgctcgaccgcgaacggtgtgtgttgtgcgcccggtgcacacggttcagcaaccagatcgcgggcgacccgatgatcgagctgctcgagcggggcgcgctccagcaggtcggcatcggcgacggcgaccccttcgagtcgtacttctccgggaacaccatccagatctgccccgtgggcgcgctgacctcggcggcgtaccgcttccgctcacgcccgttcgacctcgtctcgtcgcactcggtgtgcgagcactgctccggcggctgtgcgacccgcaccgaccaccggcgcggcaaggtcatgcggcgcctggcatcccccgatcccgaggtcaacgaggagtggctctgcgacaaggggcgcttcgggttccggtacgcgcagcagcgggaccggctcgagacgcctctcgtacggggtgaatccggtgaactggaacccgcgtcctggcccgaggcgctggaggccgccgcgcagggactgctggccgctcggggtcgcgcgggcgttctgaccggcggccgcctgaccgtcgaggacgcctacgcgtacagcaagttcgcgcgcgtggcgctcgacacgaacgacatcgacttccgcgcgcgcgtgcacagcagcgaggaggccgacttcctggccgcccggatcgccggacgcggccgcgacctcgacggtacgggcatcacgtacacctcgctggagaaggcgcccgccgtcctgctcgtcggcttcgagtccgaggaggaggcgcccggcgtcttcctgcggctgcgcaaggcctggcagaaacacgggcagcggaccttctcgctcgccacccacgccacccggggcctggcgaaggccggcggcacgctgctgcccgccgcacccggtaccgagcccgagtggctggacgccctggcgagcggggccggcctggagggcgacggcgcgaaggccgccgaggcgctgcgcaccgggggcgcggtgatcgtcgtcggtgagcgactggccggcgtggcgggcgggctcaccgccgccgtacgggcggcgtccgcgaccggcgccgaactggtgtggatcccccgccgggccggggagcgcggcgccatcgaggtgggcgcgctgccgtcgctgctgccgggcggccgtccggccaccgacccgcgcgcgcgggacgaggtcgcggcggcctggggagtctccggactcccgcaccgctacggccgcgacaccggccagatcgtcgaggccgccgccggcggcgaactgcgggccctggtggtggcgggcgtcgaggtcgcggatctgcccgacccggcacgcgcgcgtgccgctctttccgaagtcggcttcctggtgtcgctcgaactgcggcccagcgaggtcaccggactcgcggacgtcgtgctgccggtcgccgcggtggccgagaaggcgggcgccttcctcaactgggagggccgggcccgcttcttcgaggccgcgctcaagcccgaccacatgacccgcaggctggcgcccaccgacgcgcgggtcctgcagatgctggccgacgccatggacgtacacctggggctgcccgatctgcgcaccgcgcgctcggagatcgaccgcctcggcgcctgggacgggctgcgggcgacggacccccgcgagggttccgcgcagctgccgcgtccggccgccggggaggccgtgctggcgggccaccggctgctgctcgaccagggccgtctccaggagggcgacgacgcactcgccgggacccggcacgccgcacgcgcgcgtgtgtcggccgccacggccgccgaggcgggcgtcaaggacggcgacctgctcgccgtcaccggtcccgccgggacggtcgaactcccgctgcagatcaccgagatgcccgaccgcgtggtctggctcccgctgaactccgccgggcaaggcgtggcctccgacaccggggccctgcccggcgcactcgtccgcatcggtgcggcgacactcgccgccgaggctcccaaggaggtgcaggca

SEQ ID NO: 4828 - DNA, 1362 bp, Streptomyces avermitilis
  CDS (1)..(1362)
atgactccgtacctcgccgccgaagacctgtcgatgttcggccgcgacccctggtggctggtcgtcgtcaaagccgtcttctgcttcgccttcctgatgatcaccgtgctgttctccatcgtgtgggagcgcaaggtcgtcgcctggatgcagctgcgcatcggccccaaccggcacggcccctggggcatgctccagtcgctcgccgatggcatcaagctgatgctcaaggaagatctcatcgtcaagcgcgccgacaaggtggtgtacgtcctcgcgccgatcgtcgcggccatcccggccttcatggcgatcgccgtgatccccttcgggccggccgacaacgagatctcgatcttcggccaccgtacggcgatgcagctcaccgacctgccgatcgcgatgctctacatcctcgcggtcgcgtcggtcggcatctacgggatcgtgctcgcgggttggagttccggatccacgtacccgctgctgggcggcctgcgctcctgcgcgcagatgatctcctacgagatcgccatgggcgccgcgttcgcctcggtgttcctctactccgggtcgatgtcgacctcgacgatcgtcgagcagcagcacgaccgctggtacatcgtcctgctgccggtctcgttcgtgatctacatcgtgacgatggtcggcgagaccaaccgcgcccccttcgacatgccggagtccgagggggacctggtcggcggcttcaacaccgagtactcgtccatcaagttcgcgatgttcatgctcgccgagtacgtgaacatggtgacggtctcggccgtgtcgacgacgctcttcctgggcggctggcgggctccctggccgatcagcaccttctgggagggcgccaaccacggctggtggccgatgctctggttcgtggtgaaggtgcagctgctgctgttcttcttcatctggctgcgcggcactctgccccgcgtccgctacgaccagctgatgaagctcggctggaaggtcctcatcccggtctccgtggtctggctgatgctcgtcgcgaccgtgcggaccctgcggaacgagaactacgacttcgccgacatcgcgctgtacgtcggcggcggcgtcctcgtcctcctgctgctgtccttcgtcgccgacatgttccgcgagaagtcgaaggaggccgccgcgcccgccgaggagcccgccgccttcgacccgatggcgggcggcttccccgtaccgccgctgccgggacagacgctcccgccggtgccgcgacgccgcccgcgccgcgatcgcgagttgattgtcagtggcgggccggatactgcgagtgacggacctgcgaacggaaaggaggcgtccgatggc

SEQ ID NO: 4829 - DNA, 600 bp, Streptomyces avermitilis
  CDS (1)..(600)
atggctgaggaacccaaggagaccggtcccggtttccagaaccccgtcgccggcttcggcgtgaccttcaaggccatgttcaagaagcggctgaccgagcagtacccggagcagcagaagaccaccgccccgcggttccacggcaggcatcagctcaaccgccatccggacggcctggagaagtgcgtcggctgcgagctgtgcgcctgggcgtgtcccgccgacgccatctatgtggagggcgccgacaacacggacgaggagcgctactcgccgggcgagcggtacgggcgggtctaccagatcaactacgcccgctgcatcctgtgcggcctgtgcatcgaggcatgccccacgcgcgcgctgacgatgacgaacgagttcgagctggccgactccagccgcgccaacctcatctacaccaaggagcagctgctcgccggactggacgacaacatggtcgacagcccgcacgccatctaccccgggatggacgagcaggactactaccggggtctggtcacggaggccgcccccggcaccgagcgccaggtcgccgtctccaagggcgagaagcctcaggacgagggggtggaggca

SEQ ID NO: 4830 - DNA, 840 bp, Streptomyces avermitilis
  CDS (1)..(840)
atgagcgcgcagctcgccgcctactccacctccaccggtgaggccttccagttctggatcctcggcaccgtcgccgtgatcggcgccctgtgcaccgtcctcatgaagaaggccgtgcacagcgccctctgcctcgccggcaccatgatcatcctggcggtgttctacctcgccaacggcgcctacttcctgggcgtcgtgcagatcgtcgtctacaccggcgcgatcatgatgctgttcctgttcgtggtgatgctcgtcggcgtcaccgcggcggactcgctgaaggagaccatcaagggccagcgctggctggccctggtgtgcgggctcggtttcggcaccctgctgttcgcgggcatcggcaacgcgtccatcaaggagttcgacggcctcggcacggccaatgcgaacggcaacgtggagggcctcgccgccctcatcttcaccaagtacgtgttcgccttcgaaatcaccggcgccctgctcatcacggccgccgtcggcgccatggtgctcacccaccgcgagcgcaccgagcgggccaagacccagcgcgagctgtccgagcagcgcgtacgcgagggcaagcacctgccgccgctgccggcccccggcgtctacgcccggcacaacgcggtggacatcgcgggcctcctcccggacggcaccccgtccgagctgaccgtcaacaagacgctgcgggagcgcggccagatccgtgacgtgtccaccgaggcgctgaacgacctgaaggctctggagcgccgggccgaggagcgcctggagcggaccgacgtcgagccggtgagcccgaagcggaccgaggaggcgtcgaag

SEQ ID NO: 4831 - DNA, 297 bp, Streptomyces avermitilis
  CDS (1)..(297)
gtgaaccccgtcaactacctgtatctcgccgccctgttgttcacgatcggcgccaccggcgtactgatcagacggaacgcgatcgtggtgttcatgtgtgtcgagctgatgctcaacgcctgcaatctcgcgttcgtcgccttctcccggctgcacggcaatctcgacggccagatcatcgccttcttcacgatggtcgtcgccgccgcggaggtcgtggtcgggctcgcgatcatcgtgtcgctgttccgttcccgccactcggcctcggtcgacgacgccagcctgatgaagctg

SEQ ID NO: 4832 - DNA, 1902 bp, Streptomyces avermitilis
  CDS (1)..(1902)
gtgactaaccctgagaacctgatcgcgctgctggtggcggcgcctctgctcggagcggccgtactgctgtgcggtggccggcggctcgatgccgtcggccactggatcggcacggtcctcgcggcggcctccttcgtgatcggcgtggtgctcttcgccgacatgctgggcaagggcgccgaggagcggaccttcacgcagcacctgttcagctggatcccggtcgccggcttcaaggccgacgtcggcttccagctcgaccagctgtcgatgacgttcgtcctgctgatcaccggcgtcggctcactcatccacctgtactcggtcgggtacatggagcacgacgagcgccgccgccggttcttcggctatctgaacctgttcctcgcggcgatgctgctgctcgtcctcgccgacaactacctgctgttgtacgtcggctgggagggcgtcggcctcgcctcctacctgctgatcggcttctggcagcacaagcccagcgccgccaccgccgcgaagaaggccttcctggtcaaccgcgtcggcgacatgggcctgtcgatcgcgatcatgctgatgttcacgacgttcgggacgttcgcgttcggacccgtcttcacccacgtgggtgacaccggcgagggcaagctcaccgccatcggcctgatgctgttgctcgcggcctgcggcaagtccgcccaggtgccgttgcagtcgtggctcggggacgcgatggagggcccgaccccggtctcggccctcatccacgccgcgaccatggtgaccgccggtgtgtatctgatcgtccgctccggcgcgatcttcaacgcggcgcccgacgcacagctcgtcgtcaccgtcgtcggtgcggtgacgctcctgttcggtgcgatcgtcggttgcgcgaaggacgacatcaagaaggcgctcgccgggtcgaccatgtcgcagatcggctacatggtgctggcggcgggtctcggcccgatcggctacgtcttcgcgatcatgcacctggtgacgcacggcttcttcaaggccgggctcttcctcggcgccggttcggtcatgcacggcatgaacgacgaggtggacatgaggaagtacggcggcctcaggaagtacatgccgatcacgttcatcaccttcggcctcggctacctcgccatcatcggcttcccgggtctgtccggcttcttctccaaggacaagatcatcgaggcggccttcgccaagggcggcaccgagggctggatcctcggcggcgcggccctgctcggcgcggccatcaccgcgtactacatgacgcgcgtgatgctgatgaccttcttcggggagaagcgctggcagcccgatgcggagggccatgagccgcatccgcacgagtcgccgagttccatgacgatcccgatgatcgtgctggccttcggatcggtcttcgccggcgggttcttcagcatcggcgaccgtttcctgcactggctggagccggtcaccgggcactcggagggcaactcgcccgtcagcgccctctcggtcacggtggccaccatggtgttgctcgtcgtcggcgccggaatcgcgtacgcccagtacgggcgtcgccccgtcccggtgctcgccccgcgcggctccctgctcaccagggccgcccggcgcgatctgctccaggacgacttcaaccacgtcgtgctcgtccgcggcggggagcacctcacgcgctccctggtgtacgtcgaccacaccctggtcgacggcgtcgtcaacggcacggcggcctcggtcggcgggctctccggacggctccgcaagctccagaacggctatgcgcggtcgtacgcggtctcgatgttcggcggtgtggcggtcctcatcgccttgaccctgctgatgagggcggtc

SEQ ID NO: 4833 - DNA, 1596 bp, Streptomyces avermitilis
  CDS (1)..(1596)
atgtcctttcctctgctgacagcgacggcggtgctcccggccctcggggcgctcgccacggccgccgtgccggccgcgcgacgcaccgccgccaagtggctggcgctggccgtctcactggccacgctggtgctcgccgcggtggtcctggtccgcttcgagccgggcggcgcccgctaccagctcaccgaatcccacccctggatcaaggacttcggggtgcggtacgagctgggcgtggacggcatcggggtggcgctggtcgcgctgaccgcgctgctgatcccgttcatcattctggcggggtggcacgacgccgatccgttggagacccggtcctcacgctggcggccgacccagggcttcttcgctctgatcctggccgtcgaggcgatggtgatcctctccttcgaggccaccgacgtcttcctcttctacatcttcttcgaagccatgctgatcccgatgtacttcctcatcggaggcttcggggaccgcgcccacggcgcgtatcaatccgccgtcaccgcggcgcagcgcgacgaggcggcggcgacgcaacgctcgtacgccgccgtgaagttcctcctctacaacctggtcggcggcctgatcatgctggccgcggtgatcggcctctacgtggtggccgggaacttctcgctccaggagatcgtgcaggcgcgggccaacggctcgctgcacatggcgaccagcaccgagcggtggctgttcctcgggttcttcttcgccttcgcggtgaaggcgccgctgtggccgctgcacacctggctgcccaacgccatgggggaatccaccgccccggtcgccgtactgatcacggcggtcgtcgacaaggtgggcacgttcgcgatgctccgcttctgtctcgggctgttcccggaggcgtcgaagtgggcgacgcccgtcatcctcgtgctcgcactgatcagcatcgtctacggggcgctgctcgcggtcggtcagcgggacatcaagcggctggtggcgtacgcgtcgatctcgcacttcggattcatcgtcctgggcatcttcgcgatgaccagccagggccagtccggcgcgacgctctacatggtcaaccacgggatctcgacggccgccctgatgctggtcgccggcttcctgatctcccggcgcggatcgcggctcatcgccgactacgggggcgtgcagaaggtcgcgccggtgctcgccggcacgttcctgatcgggggcctggccaccctgtcgctccccggcctcgcgccgttcgtgagtgaattcctggtcctggtcggcacgttcacgcgctacccggcggtcgggatcatcgccaccttcggcatcgtcctggccgcgctctacaccctcgtcctctaccagcgcacgatgacgggcccggtgaaggcggaggtcgccgagatgccggacctcagggcgcgggaactcctggtggtcgccccgctgatcgcgctgctgatcttcctgggcgtctacccgaagccggtcaccgacatcgtcaacccagcggtccagcagaccatgtccgacgtacacgagaaggaccccaagcccgaggtggaggcggccaag

SEQ ID NO: 4834 - DNA, 1626 bp, Streptomyces avermitilis
  CDS (1)..(1626)
gtgagcgcatcagccgtccacagcctgtggacaacggcggccgatccgatttccaagatcgacgcacccaagatcgaatacgggcaattgtcgcccaccctgatcgtcatcggggcggctctcgtcggagtgctggtcgaggcgttcgtcccgcgcaagtcccgctactacgcccaggtgttcgtgtccgtcgtcgcgctcgccgccgccttcgcggccgtggtggcgctcgcggcgggcggatacggcaccacgaaggcgcacatcgcggccatgggcgcgatcgccgtcgacggaccggccctgttcctccagggcacgatcctgctcgccggactgctcggcgtgttcaccttcgccgaacggcgcctcgacccggaggtacacggcaaccgggtcgactccttcgccgcgcaggccgcgtccgtgccgggcagcgacagcgagaaagcggcggtcaaggcagggttcaccaccaccgaggtgttcccgctgctcctcttcgccgtcggcggcatgctgatcttcccgtcggccaacgacctgctgacgctcttcgtggccctggaagtcttctcgctgcccctgtacctgctgtgcgccgtggcccgccgcaagcggctcatgtcgcaggaggccgccgtcaagtacttcctgctcggcgccttcgcctccgcgttcaccctcttcggcatcgcgctcctgtacggatacgcgggctcgatgtcgtacgcgacgatcgcgcaggtcgtcgacggcaccgtgcagaacgtcgacccggcgctcgccggcaccatgggcaacgacgcgctgctgctcgtcggcgccgcgatgctggtgatggggctgctgttcaaggtgggcgcggtgccgttccacatgtggacgccggacgtgtaccagggcgcgccgaccccggtcaccggcttcatggcggcggcgaccaaggtggcggcgttcggcgcgctgctgcggctcctgtacgtggtcctgccgggcctgcgctgggactggcggccggtcatgtgggccgtcgcgatcgtcaccatgctcggcggtgcgatcgtcgcgatcacccagaccgacatcaaacggctgctcgcgtactcgtcgatcgcgcacgcgggcttcatcctcgcgggtgtcatcgcgacgaccccggacggtgtctcgtccgtcctcttctacctgggcgcctactcgttcgtgacgatcggggccttcgcggtggtcacactcgtccgggacgcgggcggcgaggccacccacctgtccaagtgggcggggctcgggcgcaggtcgccgctggtggcggccgtgttcgcggtcttcctgctggccttcgcgggcattccgctgacctccgggttcgccggaaagttcgccgtgttcaaggcggcggcggagggcggcgcggccccgctcgtcgtggtcggtgtgatctcgtcggcgatcgccgcgttcttctacatccgggtgatcgtgctgatgttcttcagcgagccgcgtccggaggggccgacggtggccgtgccgtcgccgctgacgacgacggtgatcggggtgggcgtggtggtcacgctggtgctgggggtcgcaccgcagtacttcctggatctggccggt

SEQ ID NO: 4835 - DNA, 1974 bp, Streptomyces avermitilis
  CDS (1)..(1974)
atgagcacggcggaggcactggacgagagcgaggcgctgaccacgcttcaccgcgtcttcgggtacgaggccttccgcggtgagcaggaagcggtcatcgagcacgtggtggccggcggcgacgcggtcgtcctcatgccgaccggcggcggcaagtcgctgtgctaccagatcccggccctggtcagacccggtacgggggtggtcgtctcgcccctcatcgcgctgatgcaggaccaggtggacgcgctgcgggcgctgggcgtgcgcgccgggttcatcaactcgacgcaggacttcgacgagcggcgcacgatggaggccgcgttcctggccggggagctggacctgctctacctggctccggagcgcctgcggctggaagggaccctcgatctgctctcacgcggcaagatctcggtcttcgccatcgacgaggcgcactgtgtgtcgcagtggggtcacgacttccgccccgactatctggcgctgtcgctgctgggcgagcggtggccggacgtgccgcggctcgcgctcacggcgacggccacgcacgcgacgcaccaggagatcacccagcgcctgggcatgccgaccgcccggcacttcgtggcgagcttcgaccgccccaacatccagtaccggatcgtgcccaaggccgaccccaagaagcagctgctgtccttcctgagcgacgagcacgcgggcgacgcgggcatcgtctactgcctctcgcggaactcggtggagaagacggccgagttcctctcccgcaacggtatcgaggcggtgccgtaccacgcgggcctggacgcgggcacccgtgcggcccaccagtcccgcttcctgcgtgaggaaggcctcgtcgtggtcgcgacgatcgccttcggcatgggcatcgacaagccggacgtgcggttcgtcgcccacctcgacctgccgaagtccgtcgagggctactaccaggagacaggccgtgcgggccgcgacggactgccgtccacggcctggatggcctacgggctgaacgacgtcatacaacagcggaagctgatccagggcggcgagggcgacgaggcgttccggcgccgggccgccgcccacctggacgcgatgctggggctgtgcgagacggcacagtgccgccgcggccagctgctcgcctacttcggccaggacccgcagtccggcggctgcggcaactgcgacacatgcctcgtgccgcccgacacctgggacggcacgatcgcggcgcagaaggtgctgtccacggtgtggcgcctggagcgggagcgacgccagaagttcggtgcggtgcagatcatcgacatcctgctggggcggcgcacggcgaaggtgatccagttcgaccacgaccagctgtccgtgttcggcatcggcgaggagctgaccgaaggagaatggcgcggagtcgtacggcagatactggcgcaggggctgctcgcggtcgagggcgagtacgggacgctggtgctgacggaggcgagcgggacggtgctgcggcgcgagcgggaggtgccgctgcgcaaggatccgccgaagccgacggcatcccggtcctcggcgggctccggcgcgggctccgccaagggcgagcgcaagccgaaggcggccgtggccgagctctcgccggaacttcagccggccttcgaggccctgcgcgcctggcgcgccgagcaggcgcgcgagcagggcgtcccggcgtacgtcatcttccacgacgccacgctccgggagatcgtcacggcgtggccgtcctcggtggcggagctgggcaccatcagcggggtgggcgagaagaagctggcgacgtacggggagggcgtgctgggggcactcgccgcgctgggcgggacacccggtgatgacacccagaagtccccgacggccgaagccgagccggctccggactggcccgagatggacgaggaaccggagccggaggagtggatg

SEQ ID NO: 4836 - DNA, 2817 bp, Streptomyces avermitilis
  CDS (1)..(2817)
gtggagatccccgccctcaccgacgccgaagaactcagctgcgacgtcctcgtcatcggcggcggcacggccggcacgatggccgcgctgacggccgccgaacacggcgcggacgtcctcctgctggagaaggcgcacgtccgccactccggcgccctcgccatgggcatggacggcgtcaacaacgccgtcatccccggccgcgccgaacccgacgactacgtcgccgagatcacccgcgccaacgacggcatcgtcgaccagtccaccgtccgccagaccgccacccgcggcttcgcgatggtgcagcggctggagtcgtacggcgtgaagttcgagaaggacgaacacggcgagtacgcggtccgccaggtccaccgctccggttcgtacgtcctgccgatgcccgagggcaaggacgtcaagaaggtcctgtaccggcagctgcggcggcgcgagatgcgcgaacgcatccgcatcgagaaccgtgtgatgccggtgcgcgtactgacggccgaggggcgcgccgtgggggcggcgggcttcaacacccgtacgggacagttcgtctccgtccgggcgggcgccgtgatcctggcgacgggagcctgcggccggctcggtctgcccgcctccggctatctgtacggcacgtacgagaacccgacgaacgcgggcgacggctacgcgatggcgtaccacgcgggcgccgaactgaccggcatcgagtgcttccagatcaacccgctgatcaaggactacaacgggccggcctgcgcctacgtcgccaaccccttcggcggctaccaggtcaaccggcacggcgaacgcttcgtcgactccgactactggtcgggccagatgatggcggagttcgcggccgaggtcgcctccgaccggggaccggtctacctcaagctgagccacctcccggaggagtcgatcaccgcgctggagtcgatcctgcacaccacggaacgccccacgcgcggcaccttccactccggccggggacacgactaccgcacccacgacatcgagatgcacatctccgaaatcggcctgtgcggcggccactcggcctccggcgtacgtgtcgacgagcacgcccgcacgaccgtgccgcgcctgtacgccgccggcgacctggcctgcgtcccgcacaactacatgatcggcgcattcgtcttcggcgacctggcgggcgcggacgcgtcccggttccgggcgtacgagggcgagctgcccgccggccaactccacgaggcccacgagctgatctaccgcccactgcgccacccggacggcccgccgcagccccaggtcgagtacaaactccgccgcttcgtgaacgactacgtggccccgcccaagtccggcgcccgcctgtccctggccctggagtccttcgagcggatgcgcgcggacatcgccgcgatgggcgcccgcaccccgcacgaactgatgcgctgcgccgaagtcaccttcatccgcgactgcgcggaaatggcggcccgcgcctctctcgcccgcacggagtcccgctggggcctgtaccacgaccgcacggaccacccggcccgcgacgacgcgtcctggttccaccacctcgacctgcacaagtccccctccggctccatggagttcacggcccgacccgtggccccgtacctggtcccggtcgacgaattcaccccgaccgggggcgcctcgcgccatctgggcgaggtgcacccggagggagtggccacggcgggggcccgggagacggcaccgatggcctcaccgccggagcccctcacgaccgggataacggacacccccgggatcacggggaccacagggaccacggggatcaccggcgaggacgagagtggcgcgagcgaggtcacctcgccccggctgctcgaactcctcgccctcgcggaggaagacgccgacctcgcgaccgtcgcaccgtacttggcggaccccgaacccgccgtccgccgaacggccgtcacgatcctcaccgaaaccgtgccgcccggcacgggcccggcgctcgccaccgcgctcgccgacctccaccccgccgtacgcaccaccgccgcggcctccctccgtgaactcgtcgagaccctcacccccgaaccggccctgggcgaacccctcacccgcgccgtcacccacgacgatcccgtcgtccgtgccgccgccctcgacgtgctgcgagccctgcggatgggagacaccggcctcttcgccgccgcgctggccgacaccgaggccgcggtccgcatcgaagcggtacgggcactggtctccgtcgacgcggaccgggcgctgctcctcgccgcggccgacccctcccgggaggtccgcgtcgccgtcgccaaagccctggccaccctgggctcgaagcaccccgccggccccaccgcagcggactccaccgacgacggtgtcctggccgccctcgaccggctcacgggagacaccgacgcactcgtccgcgccgccgccttcgaggcgctggccgccaccgggtgcccgccgctgctgaccgcccgggccgtcgccgcccggtccgacgccgcctggcaggtccgctccggcgccgccaccgcactgtccgcggcggccgccgacgctgccgtgcccgccctgtccaagtcgctcgccgacccgaacgccgacgtccgcaaggcggcggtactggcgttggtccgccacgcggaatccgagggacccggctcccccgacgcccgcgcggccctcgccaccgccaccaccgactccgacgcggacgtcagggcgtacgcgtcacgcgccctg

SEQ ID NO: 4837 - DNA, 810 bp, Streptomyces avermitilis
  CDS (1)..(810)
gtgaccagcttgtccgctgatcccggagccggactcggagccaagagcgagaccggggccgaagccgcgcccggagccgcgtccggagccgggctcgtcctgcgctcggccacgctcggccgcccgggcacccccgcgctcagcggggtggacctcgaggtggcccccggcgagatcctcaccgtcgtcgggccctccggctgcggcaagtcgaccctgctgcgcaccttcgccgggctgctgcccgccctcgccggaaccgtggaacaggacggccgccccctcacctcccccggcgccgaacgcgcgctggtcttccaggaggacgccctgctcccctggcgcaccctgcgcgcgaacgtggaactccccttgtccatacggggtgtccggcgtcccgcgcgacgggaacaggccgcggcctggctcgcccgcgtcggactcgccgcacagcaccgacaactgccgcaccacgtgtccggcggccagcgccaacgtgtccagctcgcccgcgccctggccggccggccccgcgccctcctcatggacgaacccttcggcgccctcgacgcccagacccgggccggcatgcaggacctcctcgtcgaggtgctgcacggcaccggcgccaccgtcgtcttcgtcacccacgacgtggacgaagccctgttcctgggcgaccgcgtggccctgctcggcgcgggccgcctcctcggcgtacgggacgtgccgcgcccccgcgaccgctcggcccacgacgacccggcgcggcacgccctgcggcgcgaggtcctcacgtcactcggcccc

SEQ ID NO: 4838 - DNA, 867 bp, Streptomyces avermitilis
  CDS (1)..(867)
atgacccgctatgcgctgcgcatcggctccctggcggccgcgctcgccacctggcagctgctgaccagccggaacgtcgacctgtggctgcgcttctcccagttcccgacggtcgccgacgtggcccgcgccttcgccggccgcctcggcggcgacgactactggacggacctcaccgacagcctcacccgcatcctcaccggctttctgctggcggcggtcctgggcgtggcgacgggcgtcctggtggcgcgctcccgcctcgccgaggacctcctcggccccccgctggaagtgctccgcccgatcccggcgatcgcgctggtcccggtcgcgatcctgctcttcccctccaacgaacagggcatcgtcttcatcacctgcacagccgcgtacttcccggtgctggtctccacccggcacgccgtgcgcgccctgactccggtgtgggaggaggcggttcgcaccatgggcgccggacggtggcgggtcctcggctcggtcgtcctgccgggcgcgctgcccggcatcttcggcggcctctcggtcggcatcggcgtctcgtggatctgtgtgatctccgccgagatgatctccggccagtacggcgtcggctaccgcacctggcaggactacacggtcgtggactaccccggggtgttcgtcggcatggtgacgatcggagtactgggctgggcgacatccaccgccgtggaggtcgcgggccgccggctgacgcgctggctgccccgtacgtcgtacgtccccggcgcacgcgtacgcgccaccgcaccacccgtcgcgcccgccgtcgtcaccgccggtccgaagaccgaggaggaggtgccccgtgaccagcttgtccgc

SEQ ID NO: 4839 - DNA, 1344 bp, Streptomyces avermitilis
  CDS (1)..(1344)
atgaaacgcacgacagttgcagtagcggcgggtgcccttctcctcccgctgaccggctgcggcggtgacacgcgggccggctccggcgacacggtcaccgtcaccgtcggctaccagtccaagaccatcaacaccgtcaccgcgggcaccctgctccgctcgctcggctccttcgagcgggagctgaactccctgggcgacggcgtcacctacaaggtgaagtggcaggactacgccaccggcgcccccatcaccgcccagatgaccgccgggaagatcgacatcggctcgatgggcgacttccccctgctgatcaacgcggcccgcggcacgcagctcggcaagcccacccacctggtctcggtcaccggctacaacctgcgcggcggcctcaacaccatcgtcaccgcgccgaactcgcacctcgcgtccctcaaggacctgcgcggcaaaaaggtgtcgacgagcatcggctcggcggccgacggcaccctcgtacgcgccctgcggcgcgccggaatcgacccggacaagggcatcgagaagctcaaccagcagcccgcggtaggtgcttcggcactctccgcgggcagcgcggacgccctctcccagttcgtcgcctggccgggcctgctcgcctaccagggcaaggccaaggccctgtacgacggcgcggaactgaacctgccgacgttccacggggtcacggcccgcgaggacttcgccaagcgccgccccgccgtactccaagccttcctgaaggcccaggcagaggcgacggactatctgaacgaccaccccgtcaccgccgccgagaaggtcgccgaagccaccggcctgcccgccgaggtcgtctacctctacaacggcgcgcacggcatcgccaccttcgacccggcgctgaagccgcggctgatctcggcgctcaagcaggacgtgtcggtcctgaagtcggcgaaactgatcggaaatgtcgacgtggacgcctttgtcgacgaccggtacgcgaagaaggcgctcggctcgtcgtacaccgcgggactcaccgcggcgcccgccccggccgcgagcgaggtctggccgaagggcgccacccggacccgttccttcgccaccccgaccgcgctgctgcgccatctggccgcacatcgtgacggcatccgcgccgcgtacgtccccgacgccaccaccggcaccccgtggttcgcggacaaggcggtgtgggtggcggacggcgaccggctgctcccgttcgtcgcaccggccaccgctcgggcgtacgtcgccgggcaccagggcgcgcgcaccgtctcgtacgccgcggcgctggcccgggcggcctca

SEQ ID NO: 4840 - DNA, 225 bp, Streptomyces avermitilis
  CDS (1)..(225)
atgcccttggcgccccagcgggccgacgtgcccgtgaccatcgacgagtcgaagtgcatcgacggctgcacgctctgcgtggacatgtgcccgctggactccctcgccatcgacgagagcaacggcaaggcgtacatgcacgtcgacgagtgctggtactgcggcccgtgcgcggcccgctgtcccaccggcgcggtcacggtcaacatgccctatctgctccgg

SEQ ID NO: 4841 - DNA, 777 bp, Streptomyces avermitilis
  CDS (1)..(777)
atgcccgccgaacgcatccgagaccacgccggccagggcgcgaccaccgtcgccgcccaccggcgaaggctgcgcgcggaccgggccaggcaactcgccgacctgctccgtcaccaagtgctgaccggcggtttcccggacggcaccctcccccacgaggccgccctcggcgccgactaccgcgccacgcggggcaccgtccgccaggccctcgacctcctcagggccgagggtctcgtggaacggctccccggcgtcggcacggtcgtcgtcgcccagaagtacccgcacgggctcgaccggctgatgggactcgcggagaccctgcgcgaacacggccaggtcagcaacgagatccgtacggtcggccccgtcgccgcccccgccccggtcgccgaacgcctgcgcgtaccccccggcgccgacgtcctctacatcgagcggctgcgccgcctcgacggcctccccctctccctcgacctcacctacgtcccgctcgacctcggcaccgccctgctcggcgccgacctggagaacaccgacgtcttccggctcctggaagcgatcaccggacagcccctcgggcacgccgagatcaccctggaggcggtgaacgcggacgcgcactcggccgccgtactccaggcaccacgcggcgcggccgtactgatgctggaacggctcacccacctcgccgacggccgccccgtcgacctggagttcatccgcttccgcggcgaccgcatcacgatgagcggcctgctgcaccgctcccgg

SEQ ID NO: 4842 - DNA, 1221 bp, Streptomyces avermitilis
  CDS (1)..(1221)
atgccccccttcgatgtccccgagggcgatcccttcggcccgcacaatcttccgtacggcgtgttctccccggcgggctccggcgagcaggccgaccggagcgtgggcgtccggctcggcgaccacgtgctcgacgcgggcgcggcagcccgcgcactcggctccccgtacgcctccctgctggcgcggccgaccctcaacgcgctcctcgcggcgggccgcacggcatggtcggacgtgcggcgcgcgatcacggcgtgggtgacggtccccgcccaccaggaggccgtcgcaccgttcctgcatccgctctcctcggtgaccctgcacctgcccttcgaggtcgccgactacgtcgacttctacgcctccgagaaccacgcgcgaaacgtcgggcagatcttccgcccggacgcgcccgaccccctgacccccaactggaagcatctgccgatcggctaccacggccgctccggcacggtggtggtgtcgggcacggaggtcgtacgcccgtccggccagcgcaaggcccccacggacgcggcgcccgtcttcggcccttcggtccggctggacatcgaggcggaggtcggcttcgtggtgggtacgccgtcgccgatgggccggtcggtgggcctcggcgacttccgggaccacgtcttcgggctgtgcctgttgaacgactggtcggcgcgcgacatccaggcctgggagtacgtcccgctgggcccgttcctcggcaagtcgttcgccacgtcggtgtcggcgtggatcaccccactggacgcgctggaggacgcgcgggtggcgcccccggcgcgcacctacccgctgctgccctatctggacgacgcggacgaggagccgggcggctacgacctgcgcatctccgtccggatcaacggtcatacggtctcggagccgccgttctccaccatgtactggacggccgcgcagcagctcgcgcacatgacggtgaacggggcgtcgctgcggacgggcgacctgtacggctcgggcacggtgagcggccctcaggagaaccagcgcggctccctcctcgagctgacctggaacggccgggacgccctcgaactccccgacggcaagcggacgttcgtggaggacggggatgtcgtgacgctgacggcgtgggcaccggggccggacgggacgcgggtgggcctcggcgaggtcaccggccgcgtggtgccgaccgtc

SEQ ID NO: 4843 - DNA, 1287 bp, Streptomyces avermitilis
  CDS (1)..(1287)
gtggggggacccgtggccagaagcaccggcagcgtgccgttcgacgcggaccgtgacgtgccggggctgatcgtcaagttcggcgactacccgctgcatcacggcggtgtgggcgccatccgcagcctgggacggctcggcataccgatgtatgcgatgaccgaagaccgttacacgcccgcggcggcctcgcgctatctgcgccgcgccttcgtctggccgaccaccggaacggaggaaccggaacggctcgtggaagggctgctgcgcatcgggcacctgatcggccgtccggccgtcctcatcccgaccgacgaagaggcggccgtcctgatcgccgagcaccaggaggcactggccgaccggggccgcttcctcttcccgcgggtcgacgccaagctcccgcgccggctcgccagcaaacaggggctgcacgaactgtgcgtggagcacggcatccccagcccggcggccgccttcccgcagtcgtacgacgacatcgtgcgcttcgccgagaaggcccgcttcccgctcgtggccaagaaccgcgaagcgttcgtccgccggtcccggcccgcggtgaacggcacgacgcggatcgccacccgcgagggactgctcacgctcgcccgcgactggggcgaccaccccggagtgatcctccaggagtacctgccgagagaggaggccgaagactggatcgtgcacgcctacttcgacgcggactcgaccccgctcgccatgttcaccggcgtgaaggtccgctcctggccgccgcacgccgggatgacggcgaacgcgtacgtcgtggacaatccggaactcgccgacctcgccgcgcgtttcatcaagcagatcggcttcagcggcgtcatcgacctcgacctgcgcttcgaccggcgcgacggccagtacaagctcctcgacttcaacccacggatgggcgcccagttccgcctcttcgagaacgagtcgggggtggacgtcgtccgcgccatgcacctcgacctgaccgggcgcacggttccggagggggaacagcgcgccggccaccgctacatcgtggagaacatcgacctgccggccctgctcgcctaccgccgcagcggctatacgacgccgcacgcgccggcccgcgcgagcggtacggagctggcctggctcgcgggtgacgacctgcggccgttcttcacgatgctcgcgcgcttcgtgcggccgggcgcgaagcacctgtatcagctgtggcggaccaaccgccgcggcggcaccaacagttccactgcgaag

SEQ ID NO: 4844 - DNA, 1200 bp, Streptomyces avermitilis
  CDS (1)..(1200)
gtgattcaaccggtagcagtcatcggtgccgggccgttcggcctgtccaccgcggcccatctgagggcgcgcggtatcccggtccgcgtcttcggtgatcccatggtgagctggcgcgaccacatgcccgccggaatgctgctgaagtcgactccggcggcatccaccatcgacgccccccaacgcggccaccgcctcgtcgactactgcgacgcggccggcatcgcccggctcgtcacggacgaggacatcatccccgtggagacattcatcgggtacgggcggtggttccaggagcagctggtgcccggcctggagcaggtgcgggtcgtctcggtggaccgcaaggcgggcggtggcttcgaactcaagctggactcgggtgagttgttcaccgcgcgggcggtcgtggtggcgacgggcctgtccgggctggcccatctgcccgccgaactcgcgggagcggccgtggacggccccacccccaccggcccggtctcgcacagctcccagcaccacgacctgagccggttcgcgggcaaggaactcgtggtcgtcggcgcgggccagtccgcgctggagaccgccgcgctggccgccgaggcgggtgcgcacgtgcgcgtggtctcccggggccggggcagggtgtccttcggcgcgccgccgtggaagcagccgaggctgcgccccgagtcgcccttcggccgcgcctggtcgctgtgggcgctgagctactacccccacccgtaccggtatctgcccgccgaggcccgccactacctggtacgccgggtgctcggcccgctcggcgcatggtggctgcgggaccgcttcgagggcaaggtggaggtgcgtgaggtggcgtccgtcgcccgcgcccacgcgtccgagggatcaccggtcctcacactccggacacacggcggccgtacgcaggagctgccggccgaccatgtcatcgcggcgaccggctaccgcgtcgacatcgccgcgatggacttcctcgggcacgagctgcgcacggaactggtggtgagccggggcacgccgaaactgggcgcggggttccggtcgtccgtgccgggcctgtacttcacgggcctgccggccgcggcgtcgtacggaccggtgatgcgcttcgtgtgcggtaccgagttcgcgtccccgcgcctggcgaagcacctggcgggggcgcacggc

SEQ ID NO: 4845 - DNA, 810 bp, Streptomyces avermitilis
  CDS (1)..(810)
atggccgctcccaccgcatattcactcatcgccactgacctggacggaacgctgctgcgccgcgacgacacgttctccgaccggtccctcgccgcgctggcgagggcggccggggccggcgcccagcacctcgtggtgacgggacggccggcccccagggtgcgaccactgctcgacgccctcggcaccagggggctcgcggtgtgcggacagggcgcgcagctgtacgacgccggcgcgaaccgtctgctgtggtcggtgaccctggaccgtgagctggccgagaccgcgctcggcaagatcgaggccgaggtcggagaggtgtacgcggccgtcgaccaggacggcgtggacgggctgacgctgatcgagccgggctatctcatgccgcacccgacgcttccggccgtacgggtgccgcggcgggacgacctgtggaccgagcccatcagcaaggtcctgctgcgccatcccctgctctccgacgacgagttggcgtccgaggcccgcggagccgtcggttcgctcgccacggtcaccatgtcgggacccggcaccgtcgaactccagccatgcggcatcaccaaggcgaccgggctcgccctcgccgccgatcacctgggcctcaccccggcgcggaccatcgccttcggcgacatgcccaacgacatccccatgttcgactgggcggcccacggcgtcgccatggccaacgcccatcccgagctcaaggccgtcgccgacgagatcaccacgtcgaacgaggacgacggcatcgccgtcgtcctcgagcggttgttccccggccgg

SEQ ID NO: 4846 - DNA, 474 bp, Streptomyces avermitilis
  CDS (1)..(474)
atgcccgcgttcgccatgcccgcccgattcgcccgcaccctcgccgtcgcgggaacgggtgtcgccgtcctcgccctgccgctcctgggggcgaccggcgcgtccgccgccacccccgccaccaccgcggccgctccgtcctccgccgtgacgtacaccaacaacctcgacggctggatccgtgagtccctggacatcatggcaaagcacaacattccgggcacgtacaacggcatctaccgcaacgtcatccgcgagtcgtccggcaacccgctcgccatcaacaactgggactccaacgccgcgaagggcaccccgtccaagggtctcctccaggtcatcgacccgacgttcgccgcgtaccacgtgcccggcaccgcgttcgacccctacaacccggtggcgaacatcacggcggcgtgcaactacgccgccgcgaggtacggctcgatcgacaacgtcttcggggcgtac

SEQ ID NO: 4847 - DNA, 2052 bp, Streptomyces avermitilis
  CDS (1)..(2052)
atgagcgcgcgcatccggacgtcctttccctacgagaccacccacgacgacctcctcgtcccgctccaggacggaacacggctgtacgcgcgcgtgtggcgcccgctgaccggcgagccggtccccgccctgctggagtacctcccgtaccgcctcacggacgagaccgccgcccgcgactggcagcgccacccctggtacgcgggtcacggctacgcctccgtccgggtggacatccgcgggcacggcaactcggagggcatgccgggcgacacccacgcggaggcggaggcggccgacggggtggaggtgatcgagtggctggcggcccagccctggtgcagcgggcgggtcggcatgttcggcatctcctggggcggcttcgacgccctgcggatcgcggcccgcgcgcccgagccgctcaaggcggtcgtcacggtctgctcgccggacgaccgctacgaccacgacgtccactaccggggaggctccgtcctcgcggtcggcatgcacgcctgggcggcgacgatgctcgcgttcgcctcccgccccccggacccggcgcacgtgggcgcggtgatgtggcgggacatgtggaccgaacgcctggagtcggtgacccccttcatccacacctggctggagcaccagacgcgggacggctactggcgccccggcggcgtccgcgaggactacggcgcgatcagggccgccgtcctcgccgtcggcggctggcacgacccgtaccgcgacacggtgctgcggctggtcgagtgccttccgcccgatcgtgtgcgggggctgatcggcccgtggtcgcaccagtacccggaccgcggcctgccgcccggcccggcgatcggcttcctccaggagacgctgcgctggtgggaccactggctcaaggacacggacacggacacggacacggacacaggcacaggcacgaacggagtgatggccgagccgctgctccgctcgtacatcggcgactcgcatcctccggcgacggtgtacgacgtcctgccgggccgctgggtgggggacgccgcgtggccgtcgcccgccgtgaccccggtgtcgtacgggctccagggcgcgcccgtgctcgtccggtcgccgatgcacacgggggtggacgccggccgcttgctgcccgtggggaacgacgccgacctgccgcccgaccagcgcgacgaggacgcgaagtcggcgtgcttcgagttcgaagtggcggcggagacctgggtgctggggcggccgagggtgcggctgcggctgacctcgtgggcaccccgggggcaggtgatcgcgcggctgtgcgaggtgttccccgacggctcgtcgaccctcctcacccggggcgtcctgaacctgtcggcacgccacggccgtgaccgcgccacggcatggcagccgggcgcgacggaggacgtgaccttcgagctgaacggcatcggacacgccttcccgcccggccaccgcatccgcctcgcggtctcctccgcgtactggccgtggatctggccgcagccgggctcggaggccggcttcacactggacccggcgggcagtgcgctccaactgccggtgcgggcaagggagtcggacccggccattcgcttcgaggagccggagcaggccgagccgctcggtgtcgtcagcccggtcactctcgacgaaccccggccggagcggctggtcgtacgcgatgtggcggccggccggtggcgcctggaggacgacccgcgtttcgaggacgacccgcgtcacggcggtacccgggtgtaccccgacgggctggagctcaccgaggacgcccgggagacctacacggtcgacgcgtccgaccccctgtcggcccgcacccgctcggactggtcgatccggctgcaccgcccggacctggcgtgggacgcgagcgtgcggacgcggtccgaagtcacctgcgacgcggcggacttcatcacctcggacgaggtgatctgcaaggacggtgacgaggtggtgttccaccggacgtggcggaagaggattccccggacagcggga

SEQ ID NO: 4848 - DNA, 1008 bp, Streptomyces avermitilis
  CDS (1)..(1008)
gtgaccgtcgtcgggccgttcgggctgagcgtgcgggaccaggctctcgaagccgatgtccaggccgggttggcggctgtcgaggagggtttgctcgaagccaccaagagcgaggtcccgttcatcacggaggccgcgcagcatctcgtgcgcgcgggcgggaagcggttcaggccgctgctcgtgatgctcgccgcgcggttcggtgatccgtacgcgccggggctcgtgccctcggccgtggtggtggaactgacccacctcgccacgctgtaccacgacgacgtcatggacgaggcggacgtgcgacgcggggtccccagcgcgaacgcccgctggggcaactcggtcgcggtcctcaccggcgacttcctcttcgcccgcgcctcgcacatcctcgccgacctcggcccggaggcggtgcgcgtccaggcggaggcgttcgagcggctggtgaccgggcagatcctggagaccgctgggccgatggacggccgcgaccccgtggagcactacctggaggtgctgagcggcaagaccggggcgctggtggcggtggcgtgccggttcggggcgatgatgtccggggccgacgagacggtcgtggacgtgctcacgcagtacggggagcggctgggcgtggccttccagctcgccgacgacgtgctcgacatcgcctccgactcgcacgagtccgggaagacgcccggcacggatctgcgcgaaggcattccgacgctgccggtgctgcggctgcgggagcgggtggcccggctcgggctggccgaggacatcgccctgtgcgagctgctggactccgacctgacggacgacgcgcggcacgcggaggcgctgacccggctgcgggcgcaccccgcgctggagcaggcccgcaaggacaccgtgcggtacgtggaggacgcgcgggccgccctggcgccgctggcggagtgcaacgcgaaggccgcgctgatcgagctgtgcgacgcggtggtgcaccgggccggg

SEQ ID NO: 4849 - DNA, 1026 bp, Streptomyces avermitilis
  CDS (1)..(1026)
atgggtactgacgctacgttcgcgaagcgccgcaagaacctgatcatcaccggtgtcgcggtggccgccgcggccggagtggccgccgccgtcatcccggcggtcgccgccggcgggaacggcggggcgggccacggcacggcccacaccgggcacgggggccagagcatcgtcacgcagggcggtgccgtcggcggcagcggcggcagtgggggcgccatcctcgccgccagtctccgaggggccaacgaggtcccggtcgccggcggtcccgccgtcggcgacaaggacggcgcggccctggagttcatcagggtcaagggggacaccgtgtccgtcgccgtgacctggcgcggcaccggaaagccgaccctgctccacatccaccagggcgccaaggggaccaacggcggcgtcaagatcgacttcagcgagctcctggagaagggcgtccggcaccacagcgtcgtcgggtccgtcaaggtcaaggacgccgcgctgctctcgcagttgaagaccgacccgggggcgttctacgccaatctgcacaccgcgcagttcccgggcggagccgtccgcggccagctccacaaggtcaccaccgccttcgacttccggcacgccctgaacaacttccaggcatcggtggtcaagggcaagcagatctacgagtgcaagcccgccgagggcggcggctacgcgttcgcccagcgggacgtcgccgcgcggctcggcggcgacatcgcgcactcgttcgtgaagcccaactccggtactccacagtgggtcgcccccgaccgcagcgccgtcaccggcacgctcatcagcaagacggccaacggcgacaagaacatcccggagctcgacctcaaggccacccggtccggcaagcaccgggggctgctggcccacacggccgagatcctgcgtctgaacaccgtgggcggggtagccccggccggctcctgctcgccgggcacggtcgtgggcgtgccgtaccaggccgactacgtgttcgtgcagcgc

SEQ ID NO: 4850 - DNA, 1227 bp, Streptomyces avermitilis
  CDS (1)..(1227)
atggcaccgtacgaatccgacgacagcaccagggccgacgaggccgaggacgtgcgcgccggccgacgcaaggccacgcggtacgtcgtcccggtcacggtggtggggttggcggcggcgaccatcgggctcgtcccggcgctcgccgactccggcgacccggacctgccgaagatcaccgcacagcaactcatcgagaagatcgccaagtcggacgtccagcagctgtccggcacggtgaagatcagcaccgacctgggcctgccggacctgggcgggctggagagcggcttcctgtccggcgcggcccagggctccggcggggacggctcgtccgccgacccctcggccaagctgatggagctggcctccggcacgcacacgctgcgcgtcgcggccgacggcgaggacaagcagaagctctcgctcctggacaaggccgccgagtacagcatcatccgcaacggcgccgacgtctgggcgtacgacagcgcgtcgaacgaggcgtaccacgcgaaggacgcggcgagcggcgagaagtcggacaaggcccggcctgacgacgtgccggccacgccgaaggagatggccgacgaggcgctgaaggcggtcgacgacacgacgtccgtggcggtcgacggcacggcccaggtcgcgggccgcgacgcgtacaagctggtcatcaagccgaagcagtccggctccacggtcggcgcgatcaccatcgcggtggacgcgaagacggggctgccgctgaagttcacgctgaccccggccaagggcggcgcggccgtcgtggacgcgggcttcacccaggtcaccttcgccaagccgtcggcgtcgacgttcgacttcacgccgccgaagggcacgaaggtcacccaggacggtgacggggcgaaggtccccgagcactccgggaagcccggttccggcaaggacctcggcgcgggtctcgacggtctcaagaccatgggcaagggctggagcaccatcgtccggctcgacgacggaggcggctcgggcctgccgaccggctccgactcgtccggcaacagcgacgtctccgggttcctgaactccctcggcgaccacgtcagcggctcgttcggctcgggcacggtcttctcgacccgcctggtcaacgcgctgatcacggacgacggcaaggtgtacgcgggtgcggtcaccaaggacgcgctggtgaaggcggcgaacgccggaaag

SEQ ID NO: 4851 - DNA, 1038 bp, Streptomyces avermitilis
  CDS (1)..(1038)
atggaggaactgtccgccgcggagccgggccccgagccgggcccggagccggagtcggctccggagtcggagtcggagccggggccggcgggtgcgggtgacgccccgggggacggggtgatcgtcacccgcgccctcaccaagcgctaccgcggcggacagctcgccgtcgacgggctcgatctgaccgtcccggcgggcagcgtcttcggcttcctcgggcccaacggctccggcaagaccaccaccatccgcatgctgatgggcctgatcgagccgacctcgggcacggcgcgcgtcctggggcggcccatgccccgctccgcgcgcaccgtgctcccgcacatcggcgccctcatcgagggcccggccctctacggcttcctctcggggcgcgacaacctcctgcggtacgacgccgccgacccgaccgccgacccgcgcacccggcgtacgcgggtcgcggccacgctggaccgggtgggcctgacggccgccgccggcaagaaggcgaaggcgtactcgctgggcatgaagcagcggctcgggctcgcggccgcgctcctccagccccgccgcctcctcgtcctggacgagccgaccaacggcctcgacccgcagggcatgcgcgagatccgttccctggtgcgggagctggcctccgacggcaccaccgtcttcctctcctcccacctgctcgacgagatcgagcaggtgtgcacgcacgcggcggtgatggcgcagggacgtctgatcacccagggcgcggtggcggatctcgccgccggggcgcgcggacgcctggtggtgaccaccccggacgtgacggatgcggcacgggtgctgaaggaacagggcgtggccgacatcgtggtggccgaggaccgggtgaccggggaacccccggacggcgaactcgccgagctgaacgccgcgttggtcacggccgccgtccgcgtacgcggcttcggcgtcgaacgggcctcactggaggacgcgttcgtggcgctgacgggggagggcttcgatgtcgcgggc

SEQ ID NO: 4852 - DNA, 891 bp, Streptomyces avermitilis
  CDS (1)..(891)
atgtcgcgggctgaggcagtgacgaccgcggcggccggagaggtacgccgtccgagcccgctgtggaccctcggcctgctgcgcagcgaactggtcaccaccttccgccgctggcgcacgctcgccctcctcgccgtcctggcggccgtaccggtccttgtcgggatcgcggtcaagatcgagacgaacgacggttccgggcccggcgggggcggcggcgagggcccggcgttcatcacccagatcaccaacaacggactgttcctggtcttcacggcgctggccgcgacactgccgttcttcctgccgatggcgatcggtgtcatcgcgggcgacgcgatcgccggcgaggcgaacgcgggcaccctgcgctacctgctggtcgcccccgcgggccgcacccgcctgctgctcaccaagtacgcgacgacgatggccttctgcgtcgtcgccaccctggtcgtcgcggtctcggcgctcgcggtcggcgcgctgctgttcccgctgggggagctgacgacgatctcgggcacccggatcagcttcggcgaaggactggcccgcgccctgctgatcgccctggtggtcgccgcgtcgctcgtcggtgtggcggcgctcggcctgttcgtctcgacgctgaccaacagcggcatcgcggcgatggcgacgaccgtgggcctgctgatcaccgtccagatcctcgaccagatcccccaactgcacgcactccagccgtacttcttctcgcactactggctgtcgttcgccgacctcatgcgggaccccgtctactgggacgacctgctccacaacctgggcctgcaagccctctacgcggcggtcttcggctcggcggcctgggcgcgcttcacggcgaaggacatcaccgcg

SEQ ID NO: 4853 - DNA, 582 bp, Streptomyces avermitilis
  CDS (1)..(582)
atgcctcgccgcttcctcttcgtcctcggcagcagccgcagcaacggcaacacggagctgctcgcccgcgcggccgccgagcagctgcccggcgatgtggagcagcagtggatcagcctcgccggtcaccgcctgcccgacttcggggatcagcggcacgacaccgaccacggccgccccgcggacgacgaactcgcgctgctgctcgacgccaccgtcgccgcgaccgacgtggtgatcgcctcgccgctctactggtactcggtgtccagccacaccaagcgctacctcgaccactggtccgactggctgcgtgtccccggtctcgacttcaagaagaccatggcgggccggaacctctggggcgtcaccgtgctcgccgccgacgagccctccgtcgccgatcctctcgccggcacgctcaacaacaccgccgcgtacctgggcatgcgcttcggcggcgtcctcctcggcaacggcagcgcccccggcgacgtccgcaaggacaccgaggcgctgacgcgcgcgaagacgttcttcgcgcgggagccggagctcgcccgtttcccgcaccaagctgtc

SEQ ID NO: 4854 - DNA, 696 bp, Streptomyces avermitilis
  CDS (1)..(696)
atgtaccgagtcaagtctcccggttcccgcccgcgtctcgcgtcaccacggcgtcacagactcgtcccaggaaccggcaccccgttggttcggccgttcaccggacccgaagaatgggggacgaccaggaggagagtggtgatgcaggggagcgcgcagccggagcacggaccgggcgggcccgagatctggatccgcgggccggtgggcggcggcgagccgcagccgcgccgggaggccgcccaggtcagcgccagcccgcggcggttctcctgggtcgccacccacggcggggcgggcaccacgacgctcgccaacgtcttcggcggccacgacgccggacggaactggccccggcccgagcgcggcgaaccggcgtcggtactcctggtcgggcgtacgcacgcggccggtcttgacgccgtctcgcacaccgtcgacaccttccggcggggcgaggcgccgccggggctcgacctcgacgccgtcgtcctggtcgcggacgcgccggggcgcctgccgcgtcaactcgcccagcggatcaaggtcatcgaatcggtgatcgatgtgtaccgggtgccgtgggtgcccgcatggcggaccggtgagctggacggtcccccaccgcgcgagtgcgaacaactgggccgcctgaccggcacaccggctccgcagaccgggagaagagcgccgcgc

SEQ ID NO: 4855 - DNA, 1752 bp, Streptomyces avermitilis
  CDS (1)..(1752)
atgtctcgactcagccgcgaacacaggcgggggcgctccgccgcgggatccgggccccggacggacgcggacgccggggtgaccccgatcgaggtccgggtgccggtcgcccaggacggaacgccgggtggcggcgcgacggtcggcggcatgccggtcgtcgcgagagcgggggagacgctccaggaagccgtgctgaactacctccaccgtctcaccctcgccaccggccaccccgtcctcgcgtcggtccacgacgaacggatcgggtgcgtggtgccgatccgggtgcacggggacgggtcgagcgagttcacgggcgagccggtgcgggtgggaacgccggccgggggtacgggagcggccggtggcggggaagccgcggcgcctccgcctccgcctccgcccccgccatcgcccccgcggccggtggtcgagccgcccgtgccgcagcggcctgtcgccggtccggtgggcccgcccgtgccgggtgacgcgccccaggggccgccgccgcgccgtgacaaggccacgcacctgctgcgggcggtggcggagccgacgcccgccgcgcagtggacgcccccgcagcagtccgtcgcaccggcaccggctcccgctcccgctcccgtggagcgtcccgcctcgacgccgacgcatgtgctgcgtgccctgcccgaatcggctgcgacgcaccagcccgagcaggtccaggcccccgaggcgcccaaggggcccaaggtgccggagggggccgaggcggtggcgagcgaggcggaggagacgcccgtacgcgccggaggcaccgtctcgacgttcgttctgcgtgccgtgccggaacaggccccttggatcactgtggcgcccggcctcgcacaggcgctcccgggcgcccccaccggccaaggcgccccggctccggcccccggtaccgtctcgcccccgaccggagcgttcggccccgccccgacgacggccacaccgccgcccgggcccgcgccatgggaaccggcgcccgcaccggaaccggcacctgcacccgcaccggcaccggcacaggggcgtacgcccacccctgacgccggcccgaacatcgactccggctccggatccggcgctgaccccgacctggacccgtacgcggcccccgcctggaagcccacccccgcgccgaggaccgtccccgtggccgaggtcgaggaggtcaaggaacctcccgtgcgggaattcgactcggtggccgaggccgtactggcgccggagtcggggtcagggcccgacggtgccgccgccggaccgctcgccgcacccatggcccggatcaacgaggccgtgaagcagggccggatcgaggaggcggccgcgatggccgaggaggccgtccacggggccgccgccaccctcggcccggagcatccggacgttctgcggctgcgtgaactcaccgcgtacatcgcgtacttggccggagacgccctgcgctccttccacctctccctcgacctggcccggctccgccgccgcgctcgcgacccgcgtggcgcctacggcaacgtccagagcgcggccgccgcctggcgtgccgtccgcgacccggtccagggcctccacctcggccgggacctcatcggcgtgtggaccgaactcgccgccgagccgggccccgccgccgaggatctcgaccagctcgagtcggcccgcaaccgcatgggccgcctcgccgaacgcgcccgcaccctcaccgagaacccg

SEQ ID NO: 4856 - DNA, 945 bp, Streptomyces avermitilis
  CDS (1)..(945)
atgaagctctccgttcctgggcgcgcctcgacggctctcgtcgtcgcggccgccacgctcctcaccggcggcgcgatatccggggccgcaccggccccggtggcggccgccgccgcgcccgatctccccgtggccaacgtgaaggcccatctcgcccagctccagtccatcgccaccgccaacggcggcaaccgcgcgcacggccgcaccggctacaaggcgtccctcgactatgtgaaggccaagctggacgcggccggattcaccacgaccgtccagcagttcacgtcctccagccgcaccgggtacaacctgatcgccgactggcccggcggcaacacaaatcaggttgtcatgtccggctcacacctggacagcgtcacggccgggcccggcatcaacgacaacggttccggctcggcggcggtcctggagaccgcgctggccgtcgcccgcacgaactaccagcccaccaagcacctcagattcgcctggtggggcgccgaggaactgggcatggtcggctcgcgctactacgtcaacagtctctccaccgccaaccgttcggcgatcagcggctatctgaacttcgacatgatcggctcgccgaaccccggctacttcgtctacgacgacgacccgaccatcgagaagaccttcaagacctacttcacgggcctcggcatcgcgacggagccggagaccgagggcgacggccgctccgaccacgctccgttcaagaacgcgggcattcccgtcggcggcctgttcagcggcgcggactacatcaagacggcggcccaggcggcgaagtggggcggtacgtcgggcaaggccttcgacgcctgctaccactcctcgtgcgacacgtcgtcgaacatcaacgacacggcactcgaccggaacgcggacgcgctggcgtacgcggtgtggtcgctgtcctcg

SEQ ID NO: 4857 - DNA, 978 bp, Streptomyces avermitilis
  CDS (1)..(978)
gtgcagtcgaagggcgcgacggggtcgaagagcgagcagcggacaggtctgctgaacggagtcgccgcgtacggcatgtgggggctcgtccccctgtactggccgctgctgaagcccgccggggcggtcgagatcctcgcccaccggatggtctggtccctcgccctcgtcgccgtcgcgctgctggtcatgcggcgctgggcctgggccggcgaactgctgcggcagccgcgcaaactggccctcgtcacggtcgccgcggcggtcatcaccgtcaactggggcgtctacatctgggcggtgaacgccggacacgtggtcgaggcgtcgctcgggtacttcatcaatccgcttgtcaccatcgcgctgggcgtcctgatcctcaaggaacggatgcggccctggcagtgggcggcggtgggcgtcgccttcaccgccgtggtcgtcctcaccgtcggctacggccagccgccgtggatctccctgtgcctcgccttctccttcgggacgtacggcctggtgaagaagaaggtcaacctcggcggcatcgagtcactggccgccgagaccgcgatccagttcctgcccgcgctcgcctatctgctgtggctgacggcgagcggcggctcgaccttcggcacccagggcggcgcgggtcacgcggcgctgctcgcctccaccggcgtggtcaccgcgatccccctcgtctgcttcggcgccgccgcgatccgcgtaccgctctccacgctcggcctgctccagtacctggcgcccgtcttccagttcctgctgggcatcctctacttccacgaagccatgccgccggagcgctgggcgggcttcgcactggtctggctcgcgctgtcgctgctgacctgggacgcgctgcgggcggcccaccgggcgtcgcgcgcgctccggacggcgccgagccgcatcgtcgcggacgagcagatcacgccggtatacgaacacccg

SEQ ID NO: 4858 - DNA, 852 bp, Streptomyces avermitilis
  CDS (1)..(852)
atgagcatcgtcgtcaccggcgccaccggccacctcggcagcctcgtcatcgagcagctgctggagaaggtcccggccgaccagatcaccgcggtcgtccgcagcgcggagaaggccgcccccctcgcggcccgcggtgtgcggatcgcggtcgccgactacaacacccccgagaccttcgacggcctcctcgccgccggcgaccgcgtgctcctcatctccggcaacgagttcgacaagggccgcgtcggccagcacaaggtcgtcctgaacgccgccaaggccgccggcgtggcgctcctcgcgtacaccagcgcccccggcagcctgacggccgccctcgccgacgaccaccgcggcaccgaggaggcgatcttggcctccggagtgccgtacgcgctgctgcgcaacggctggtacaacgagaactacaccgagcagctcgccccggtactggagcacaacgccgtcacccacgccgccggcgagggccggatctcctccgccgcccgcgccgactacgcggccgccgccgtcgccgtactgaccggcgagggccacgagaacaagacgtacgagctgggcggcgacgccgcgtggagcctcgccgagtacgcggccgagctgagccggcagaccggcaaggagatcgccgacaacgccgtctccccggaagccctcgtcggcatcctgaccggcgcgggactgcccgggcccttcgccacgatcctggcgggcgtggacgcgtccatccagaagggcgagctggtcatcgacagcggcgacctctcccgcctgaccggccgtccgaccacgccgatcgccgactcgatcgcggtggccctcaagggc

SEQ ID NO: 4859 - DNA, 471 bp, Streptomyces avermitilis
  CDS (1)..(471)
atgtccgtaagcaccccagcagtcagcggggcgccggccgccacgcagcccgccgccacgccgtccgccggcaagaccgccgccacgcagtccgccggcaagtacgacatcgccgaggcgatgtgcccgtaccgcctggtgctcgagcacgtcaccagccgctggggcgtcctcgtcctcatcgagctgctggagcgctcgtaccgcttcagcgagctgcgccgcgcgatcggccgggtcagcgagaagatgctcacgcagaccctgcagaccctggagcgcgacggactcgtccaccgggacgcgaagcccgtcatcccgccgcgcgtcgactactcgctcaccgacgtcgggcgcgaggcggccacgcaggtgcgggcgctggccgtgtggaccgagaagcggatggacgacgtggagcgggcccgccggtcgtacgacgaggcccgggccgctggggcccgggcctcg

SEQ ID NO: 4860 - DNA, 1077 bp, Streptomyces avermitilis
  CDS (1)..(1077)
atgactgagacgtccacggaaggcacgggcacgatcgaggcgctttccctggtccccaaggccgaggccaggcagtccatgaaggacttcaagtccgatcaggaagtgcgctggtgccccggctgcggtgactacgcggtcctggccgccgtgcagggcttcatgcccgagctcgggctcgccaaggagaacatcgtcttcgtctcgggcatcggctgctcgtcccgcttcccgtactacatgaacacgtacggcatgcactccatccacggccgcgcccccgccatcgccacgggcctcgcctcctcccgccgcgacctgtcggtctgggtggtcacgggtgacggcgacgcgctgtccatcggcggcaaccacctcatccacgccctgcgccgcaatgtgaacctcaagatcctgctgttcaacaaccggatctacggcctcaccaagggccagtactcccccacctcggaggtcggcaagatcaccaagtcgacgccgatgggctcgctggacgcgcccttcaacccggtgtcgctcgccatcggcgcggaggcgtcgttcgtggcgcggacggtggactccgaccgcaagcatctgacggacgtgctgcgccaggcggccgcccaccccggcacggcgctggtggagatctaccagaactgcaacatcttcaacgacggcgccttcgaggtcctcaaggacaaacagcaggccgaagaggccgtgatccggctggagcacgggaagcagatccgcttcggcgcggacgccgccaagggtgtcgtacgcgacccgctgaccggcgacctgaaggtcgtcaccgtgaccccggagaacgaggcgcggatcctggtccacgacgcgcactccgcgtccccgaccacggccttcgccctctcccgcctcgccgacccggacaccctgcaccacaccccgatcggtgtgttccgtgccgcggagcggccggtctacgacgcgcagatgtccgagcagctggacacggcgatcgagcagaacggcaagggcgacctggccgcgctgctcgcgggcggggacacctggacggtcgtcggc

SEQ ID NO: 4861 - DNA, 1926 bp, Streptomyces avermitilis
  CDS (1)..(1926)
gtgaccagccaggtcagcagtacaacggaacaggccgacgaacccgtcgtgggagagcagcgcaaaccggcgggcgcgaaggacgtacgccgactcgatcgcgtgatcatccggttcgccggggactccggtgacggtatgcaactcaccggtgaccgcttcacctcagagacggcgtccttcggaaacgacctctcgaccctgccgaacttccccgccgagatccgggcccccgcgggcacgctgcccggggtctcctccttccagttgcacttcgcggaccacgacatcctgacccccggcgacgcgccgaacgtcctcgtggcgatgaacccggccgccctcaaggcgaacgtgagcgacctgccgcgcggcgcggaggtcatcgtcaacacggacgagttcaccaagcgcgccatgcagaaggtcgggtacggcacgagtccgctggaggacggctcgctggacggctacagcgtccaccccgtccccctgaccaccctcacggtcgaggcgctcaaggagttcgagctctcccgcaaggaggccgagcgcagcaagaacatgttcgcgctggggctgctgtcgtggatgtaccaccggccgaccgagggcaccgagaagttcctgaccaccaagttcgccaagaagccggccatcgcggcggccaatatcgccgcgttccgggccggctggaacttcggcgagacgacggaggacttcgcggtctcctacgaggtcgccccggcccagtccgccttcccggccggcacctaccgcaacatctccgggaacctggccctgtcgtacggcctgatcgcggcctcccgccaggcggatctgccgctgtacctgggctcgtacccgatcaccccggcctccgacatcctgcacgagctgagcaagcacaagaacttcggcgtccgcaccttccaggccgaggacgagatcgcgggcatcggcgcggcgctgggggccgccttcggcggttcgctggcggtcaccacgacctccgggccgggtgtggccctcaagtcggagacgatcgggctggccgtctccctcgagctgccgctgctggtggtcgacatccagcgcggcggcccgtcgaccggcctgccgaccaagaccgagcaggcggacctgctccaggcgatgtacggccgcaacggcgaggcaccggtcccggtggtcgcgccgcgcacgccggccgactgcttcgaggccgccatcgaggcggcgcggatcgcgctgacgtaccgcacgccggtgttcctgctctccgacggctatctggccaacggcagcgagccctggcgcatcccggagaccgacgggctccccgatctgcgcgtgcggttcgcccagggaccgaaccacaccctggacgacggcaccgaggtgttctggccctacaaacgtgacccggggaccctggcccgcccgtgggcgatcccgggcacgccgggtctggagcaccgcatcggcggcatcgagaagcaggacggcacgggcaacatctcgtacgaccccgccaaccacgacttcatggtgcgtacccgccaggcgaagatcgacggcatcgacgtccccgacatcgaggtcgacgacccggacggggcgagcgccctcgtactgggctggggttcgacctacgggcccatcaccgcggccgtacgacggctgcggacggccggggagtccatcgcgcaggcgcatctgcgccacctcaaccccttcccgtcgaacctcggcgcggtgctgaaggggtacgacaaggtggtgatccccgagatgaacctcggtcagctcgccacactcatccgggcgaagtacctggtggacgcccactcgtacaaccaggtcaacggaatgccgttcaaggctgagcaactcgccacggctctgaaggaggccatcgatgac

SEQ ID NO: 4862 - DNA, 669 bp, Streptomyces avermitilis
  CDS (1)..(669)
gtggaggacagggtgcgggtggtcatcgccgaggattcagtgctgctcagggagggcctgacccggttgctgaccgaccgcgggcatgacgtcgtggcgggtgtcggcgacggcgacgcactgatcaagaccatcggcgagctggcggcccaggacgagctgccggacgtggtggtggcggacgtgcgcatgccaccgacacacaccgacgaaggggtcagggcggccgtacagctgcgcaaggcgcaccccgaggtcggggtgctcgtgctgtcgcagtacgtcgaggagcggtacgccaccgagctgctcgccggttccagccgcggtgtcggctatctgctcaaggaccgggtggccgaggtgcgcgagttcgtcgacgcggtcgtccgggtggcccaggggggtaccgcgctggatccggaggtcgtggcgcagctgctcgggcgcagccgtcggcaggatgtgctcacggggctcaccccgagggagcgggaggtgctgggcctgatggccgaggggcggaccaattcggcgatcgcccgacagctggtcgtgagcgacggcgcggtcgaaaaacacgtcagcaatatcttcctgaagctcggattgtccccgagcgacggcgatcaccggcgtgttctggcagtgctcacctatctgaactcc

SEQ ID NO: 4863 - DNA, 1356 bp, Streptomyces avermitilis
  CDS (1)..(1356)
atgacgccgatggccacgcagtacgggcagggatacggagactgggacagccctggatccccgggcgccggggagcgacggcaccggctcccggcaccgttgagggcgccgatcgaggcccgtagctggcgcgagttcggctatctgatgctcggtctgccggtcggcatcgcgatgttcatatacgccgtcacgatgttcgcgctcggcgccggactgctggtcacgttcctggggatcccggtgctggcggcggcactggccggatgccgcggtttcggagtgctggagcgggcgcgggcgcggcggctgctgggccttgaggtggccgatccggagccgctgcggatgaagggccacgggccgatggcgtggatgggggcgatgctcaagagcggggcgtcgtggcggcatctgctgtacgcggtgctccagttcccgtgggccgtgttcgcgttcgtcgtggcgctgaacttctgggcgtacgggtgggcgctgctgacgtacccgctgtggttctgggtctttccgatgtacggcggccagggcggccttcagctgtacggcgaccaggcgcacagcatctacctcgacaacccgttcgagatcacggtgaccgccctggtggggctgttgttcacgatggcgacgccctggatcgtgcgggcgctgaccacggtcgaccggttgctggtgcacgggctgctcggcccttcgcggctggccacacgggtggtggagctggagtcggaccgtggcgtggtgatcgacacggccgccgccgatctgcggcgcatcgaacgcgatctgcacgacggggcgcaggcccgcctggtggctctcgccatggacctcggtctggccaaggagaagctggcggaggatccgcgggaggcggcacggatggtggacgaggcgcacggcgaggtgaagacggcgttgcaggagctgcgggatctggcgcgcgggatccatccggcggtgctgacggaccgggggctggacgcggcgctgtccgccgtggcctcgcgctgcacggtgccggtgcaggtcgaggtggatctgcccgcgcggccggcgccggcgatcgaggggatcgcgtacttcacggtgtccgagctgctccagaacgtcagcaaacacgcccgggcgactcgggcgacggtggatgtgtggcgggtggagaaccggctgctgctccaggtcgtggacaacggggtgggcggtgcggacgtctccggcgggtccgggctggccgggctcgcgggacggctggacgcggtggacgggattctggtggtcgactcgccggtggccgggcccactcggatcaccgcggagctgccctggcggggg

SEQ ID NO: 4864 - DNA, 1239 bp, Streptomyces avermitilis
  CDS (1)..(1239)
atgaccgaacgcatcacaagccccggcctccgggaaggcgagcggctgccgctccctggcagccgggacacccgggacggcgagcggctgccgcccctgcgtctcgccctggacgggcacacctggcgggagatcgcgcatctcctcgcgaacctgccgatggcgctgatcggcttcacctatgtcgtgacggtgctgttcacgggggctgggctgacggtgaccgtgatcggtttcccgttgctcgcggccgggctgttgggggcgcggcagctgggcaaggtggagcgggcccgggccaggctgctgctcgatgtgcgggtggacgagccgagtccgctgccgttgcgcaagggcagtggtgggctgttccagcagttgtggatggggctgaaggacccggtgggctggcggacgttcctgtacgagttcatccggctgccctggggcgtcgtgaccttctcggtcacgttggtgtcgctgttcgtcgcgtggccggtgctgccgttcatcgcgcgcgggctgaccagtgtggaccgggcgatggtgcgcgtgctgctctccccctccgacgaactggagcagcgcatcgccgagttggagtcggaccgcggggtcgtcgtggacacggcggccgccgacctgcggcgcatcgaacgcgatctgcacgacggggcgcaggcgcggctggtgaacctggcgatggggctcggtctggccaaggagaagttgctggagggccaggccgacgaaagcgtcgcggccatggtggacgaggcgcacggcgaggtgaagctcgcgctccaggagctgcgcgacctcgcgcgtggcatccaccccgcggtcctcaccgaccgcggtctcgacgccgcgctgtcgtccgtcgcctctcgctgcacggtgccggtgaaggtgaccgccgacctgccgacgagaccggccgcggccatcgagggcatcgcgtacttcacggtctccgagctgctgcagaacgtcagcaagcacagcggggcccgttcggcgtccgtcgatgtgtggcgggcggaccagcggctgctcatacaggtgtgggacgacgggcggggcggggccgacgtcggaggcggtacggggatggcggggctcgcggaccggctcggcgcggtcgacgggctgttcgtcatcgagtcgccggtgggcggcccgaccacgatcacggcggaactgccgtggcgcgaccggcgggaggaaccccggccg

SEQ ID NO: 4865 - DNA, 438 bp, Streptomyces avermitilis
  CDS (1)..(438)
gtgccggagccgaccgtcgtcacggggaccggggctgggaccgctgggaatgcggtcgcggcggaccacctccagtcctatttccactcctattcggtcgtgggactgctcgccgtcgtcggtgtgctgttcgtcgccgtggccttcggggcgggacacctgctgcggcccgtggtccccacccccgagaaactcctgacctacgagtgcggagtcgatcccgtcggcgagggctgggcccacacccaggtccgctactacgtctacgcgttcctgtacgtgatcttcgcggtcgactcgatcttcctcttcccctgggcgacggtcttcgccgcgcccggctacggcgcggcgacgctcgtggaaatgttcatcttcctgggcttcctggccgtcggcctgctgtacgcatacaagaagggcgtcctggcatggacg

SEQ ID NO: 4866 - DNA, 609 bp, Streptomyces avermitilis
  CDS (1)..(609)
atggacgtgacccccgaacctgttctgctcccggagccgaagcggctgggcgcactcgcccgcctggcacccgagccgatgaaggtggtcctgaactggggccgccgctactcgctctgggtcttcaacttcggcctggcctgctgcgcgatcgagttcatcgccgcgtcgatggcccggcacgacttcatccgcctcggtgtgatcccgttcgcgcccgggccgcgccaggccgacctgatggtcgtctcgggcacggtcacggacaagatggccccggccgtcaagcggctgtacgagcagatgcccgagccgaagtacgtcatctcgttcggcgcctgctcgaactgcggcggcccgtactgggactcgtactccgtgaccaagggcgtcgaccagatcatcccggtcgacgtgtacgtacccggctgcccgccccgccccgaggcactgctccaaggcatcctcaagctccaggagaagatcgcacgggagtcgctgagcgagcggtacggctcgccccgcccttcggcggccgcactccagagcgacctggtccggccgccggccgcgggcacaggcgcgggcacggccgaggggggcgcccga

SEQ ID NO: 4867 - DNA, 1512 bp, Streptomyces avermitilis
  CDS (1)..(1512)
atgactgccgtcggctggctccccgctcccgccgaggagctcttcggtacggaggccacggccgaggcgtcgtacgaggtcctgacggtcgacgtacccccgacctcctggatctccgccctggagacggcacgcgacgctctgggctgcacctacttcgactggctgagcgcggtcgacgaaccgggcaggggattcctggtctcggcccacgtcgtcgccctgccctcacccccgtccccgtctcagcccccgtccccatccccgtctcagcctccgtctccgtcttcggtgcgccgcctcctcgtccgtacgacggtcccgcacgaggcgcccgtcctccccaccgccgtgggggtctacgcgggcgcgggctggcacgagcgcgagacccacgagatgttcggcgtgaccttcgagggccacccggcgctggaccccctgctcctgcccgagggcttcgagggccacccccttcgcaaggacttcgtgctggccgcgcgggtggccaaggcgtggcccggtgcgaaggaaccgggcgagtcggaccacggaggcccgaagcgccgccagatgctccccccgggcgtccccgacccgaacgactggggcccgctgaagggccaactccccccggccccggcccgcccggcgcgcggcgcggcccgggcggcaggcgaacgcccggcccgcgccgcaggcgaacgccccgtccgccgcacgcgtacggcgggggagggctcggcgagccaggcggcggcgcccgcgaccccgccccccacagaggcgccgtccacgccccgccgcgcgcgaaccgtgtccgagggatcggtgagccagacggccacgcccggcaccacccccgacgcctccacggaggttccgactgcaccgcgccgcgcgcgaaccgcttccgagggctcggtgacgcagcgcccgtcggctacggagccgacgccgcccgcggccggcccgcgccgcgcacgcagcgcgagcgagggctcggcgacgcagcgggtgcggcccgatacggccaaggcggccgatacggccaaggcggccgatacggccaaggcggccgatacggccaaggcggccgaggcgactgacgcggccgacgcacccgcaccggccgacacacccgcaccggccggcaccggcgaggacgcgccgacggcggcgcgcaccaccccgaagcccgccccgcgcagctcggacgccccctggcaccacgcccgccccgccttcgacgagcccgaagccgaagccgcacccgaacccaccccgaaacccccgaccgagaccggcgcgggcggggcggatgcagacgcggatgcggatgcgaacgcggatacggccggtgccggttccggcgccgacgcggccgacgccggtgccgaagccggtaccgacgcggccgacgccgactccgaagtccgccccgccggcccccgcccggagacgtccccggacacgacccccacccccgaagaccccacaggaggccggcag

SEQ ID NO: 4868 - DNA, 966 bp, Streptomyces avermitilis
  CDS (1)..(966)
gtgaacgacgctctcgacgtcgccctgcgactcctcgtggtgttcgtcgtgttcctgacgttccccctgatcgtgggtcagacggagcacaaggtgatggcgcacatgcagggccgcctcggcccgatgtacgccggcggcttccacggctgggcccaactcgtcgccgacggtgtgaagttcgcgcagaaggaagacgtcgtaccggccggcgcggaccgccgcatcttccagctcgcccccgccgtggccctccttccgtacctcctggtgctcctcgccatccccatcggaccgggcgaaggcgccgtcggcgaggtcgtcgacgcgggcatcttcttcgtcctcgcggtgatgggcgtaggagtcctcggctccctcatggccggctgggcctccgccaacaagttctccctcctcggcggcctccgcacagccgcccagctcctcgcctacgaactcccgatgctgctcaccgccgcctcggtggcgatggcggccggcacagtctccctcctcggcatcgtcgacgccttccagtggtggtggctgccctggcagatcgtcggcgcgatcgtcttcttcgtagccggcctcgccgagctccaacgaccccccttcgacatgcccgtcgccgactcggagatcatcttcggcgcgtacacggagtacaccggtctccgcttcgcgctgttcctcctcgccgagtacgccggaatcgtcgtcctgtgcggcctgaccaccgtcctcttcctgggcggctggcacggcccctggggtgccgacggcctcggctgggtctggaccctgctgaagaccgcgctcctcgccttcgtcgtgatctggctgcgcgtcacctacccccgcctccgcgaggaccagctccaaaaactctcctggaccctcctcgttccgctctccctcgcccagatcgccctcaccggcatcgtcaaggtggtgatctcg

SEQ ID NO: 4869 - DNA, 648 bp, Streptomyces avermitilis
  CDS (1)..(648)
atggcccccattcctggctccggcctcgccaagggcctggccgtcaccctccgcacgatgacgaagaagaccgtcaccgcgcagtacccggacgcccagcccgaactcccgccccgctcccgcggcgtcatcggcctcttcgaggagaactgcacggtctgcatgctgtgcgcccgcgagtgcccggactggtgcatctacatcgactcccacaaggagacggtcccgcccgccgcccccggcggccgcgagcgcagccgcaacgtcctcgaccgcttcgccatcgacttctccctctgcatgtactgcggtatctgcatcgaggtctgccccttcgacgccctgttctggtcaccggagttcgagtacgccgagaccgacatccacgaactcacccacgagcgcgacaagctccgcgagtggatgtggaccgtcccggccccgccggccctcgaccccgccgccgaggaaccgaaggagatcgccgcagcccgcaaaaccgcggagaagctcgcggcagcacaggccgcggcagcacagactgatgcggcgcaggccgaggcagcgcaggccgaggcagctgccgaggccgggtccgccgccgaaggcgcgcccgacgccgccccgaagccgcaggagggagaagcg

SEQ ID NO: 4870 - DNA, 621 bp, Streptomyces avermitilis
  CDS (1)..(621)
gtgacccccgcagcagctcacgtcgcgaccgcggtcgccgccgaatcccacggcttcctctccccgaccggcatcgagatcgccttcctcctcgtcggcctcgtcaccttcggcgccgcgatcgtcaccgtcaccaccaagcagctcgtacatgccgccctgtggctggtggcgaccctcggcggtctcgccgtggagtacctcctgctcaccgccgagttcatcgcctgggtgcaggtcctcatctacgtcggctccgtcgtcgtcctcctcctgttcggtctgatgctcaccaaggcccccatcggccgctccccggacgccgactccggcaaccgctgggccgccctcaccgtggccgtcgcctccgccgccaccctggtctgggtcgtcgtcgacgccttccgcacgacgtggctcgacctgaacggcgccgccgccggctccaccgccgtcaccggcgcgagcctcttccagaactgggtccttcccttcgaagccctttccgtcctcctcctcgccgccctggtcggcgcgatcgtcctctcccgcaaggcgaaggcggacgcggcgaccaccacgagcctcccgagcgcccggagcgaaaaggaaggggcccgc

SEQ ID NO: 4871 - DNA, 387 bp, Streptomyces avermitilis
  CDS (1)..(387)
atgcacctcgcctatcccgccgtgctctccgccctcctcttctccacgggcctgtacggcgtcctcgcccgccgtaacgcgatcctggtcctgatgtccgtcgagctgatgctcaacgccgtcaacctcaacctcgtcgccttcgacgtctggctgtccaagaccgcccgggacacccttcactccggccaggccctcaccctgttcaccatcgccatcgccgccgccgagatcggcatcggcctggcgatcgtcctcgccgtctaccgaaaccgcggcacctcggacatcgacaagctccgcgacaccgccgagggccccgagcccgacggccccggaaccgacggctccgcacccaccgcggccgagaaggctgaggccaccgcg

SEQ ID NO: 4872 - DNA, 1989 bp, Streptomyces avermitilis
  CDS (1)..(1989)
gtgaccacgaccaccctcgccgtcctcgtccccctccttccgttcctggccgccgcggccggcctcctgctgggccgcacggcacccggcttcgtacgccccctcgccgtcctgccgaccctgacagcgttcgccctcgccgtggtggtcgccgtacgccagggcggcggccaggccatcgacgccgccaccgagctcacgcccaccggctcggtccccatcgagctcgccctgcacatcgacggcttcgccgccctcgtcgccgtcctggtcggcctggtcgcgtcctgcgtgcagatctactcgacgggctatctgcgcgacgacccgcgctacccctcgtactccgctctcgtctccctcttcacctccgcgatgctgctcgtcgtctactccggcgacctgatgctgctcctggtcggctgggagatcatgggcatctgctcgtacttcctggtcggccactactgggagacgtccgaagcacgcgccgcctccatcaaggccttcctggtcaccaagctcggcgacgtccccttcctcatcggcctgttcgccctcgccaccgacgccgggtccttccgcatcacgaaggtcctcggcgccgtcgcgaacggcggactcgaccacccgacgctgatcgccctgctcctcctcgccggtgtggcgggcaagtcggcgcagttcccgctgcacacctggctccccgacgcgatggccggtcccacgcccgtctccgcgctgatccacgccgcgacgatggtcgccgccggtgtctacttcatcgcccggctcctcccggtcttcgccgcctcctcggccgcattggtcgtcctcgccgtcatggccgccgtcacgatgctcggctccgggctcgccgcgctcgcccaggacgacatcaaacgcgtcctcgcgtactcgacgatcggccagctcggctacatgaccggcgctctcgccgtcggcgaccgcggtgccgccgtcttccacctcctgtcccacggcgtcttcaaggcgctgctgttcctcgcggcgggcgtgatcatccacgcggccggtaccaactcgctggcctccatgtcccggatgaaggacctgcgcgcccgcatccccgacgcctactggacgatgaccgtggcgctcctcgcgcttgccgcggtcccgcccttcgcgggcttcttctccaaggagtccgtcctgggcgccgccgagcacgtcgccaccggccacaccgagcacgcccccggcgccgcgggctggatcgtcctcgtcgccgccctgctcaccgccgtactcaccgccgcgtacgcgacccgcctgtggctgctcgccttccgtggccggggcgtcgaagctcccgatcacggcaggcagcccgtggtgatgaccgccgtgctgtgggtgctcgccgtcccgtcactcgccttcggactggcctacgggctgctgcccgactggttcgacggccgcgacctggcgcccaccctcaccacatcggtcctcggcacagggctcgccctgaccggcggactcatcacctacggcgcctggcggcacacctccgcgctggcggtccgcgtcccgctgggtgcggtcgtggcccaccccgagggcgacgccgcgcacgtcgaggccgaggccatcgccattcacgagtcggtgtacggagacgtggcctacgcacccgacccggcggacccgggccggctgctgctcggcccgctgcaccgccacgcggccgtcggcttccacctcgacgccgtgtacgcgacgctcttcgtccgcccggtgcaggcggcggcaagcctcgtccggttcctcgaccgtgaggtcgtcgacacctacgtaagcggcgcgagcgccgtgccccggctgctcggcgcggccgtacggcgcgcccagaccggcaatgtgcagacctatgtgagcgcgctgctcgccggcaccgtcgtcctggcggtcgccgccctcctcgtcgccacaggagcg

SEQ ID NO: 4873 - DNA, 1581 bp, Streptomyces avermitilis
  CDS (1)..(1581)
gtgatcgatatcaacgagtcagtgatgcagatccttctcgcgttcatcgtcgtcggcccgctcatcggggccgccgccgctcttctgccggccccgcccgggctgaaggggaagtcgcccgaccaggccgtgctgcggcacggcgtgaccgtcaccggtgcggtgctcatcgccgcgatcgccctgacgctcggcttcgaccacgaccacccgtcaaagatgcaggccacgacggacatcagctggatccccgcactccatgtgcgcatccacctcggcatcgacggcatttccctcccccttctggtcctgacggcgctgctgaccttcctctgcgcgctgtactcctacttcaaaatgcctgcgggccccacccctaaggccttcgtcgcgctcgtcctcgtcctcgagtccggcaccctcgcgaccttcgccgtcctcgatctgctgctgttcttcctcgcgttcgagatggtgctcatcccgatgtacttcctcatcgcccggtggggcggtgcggaacgccaggccgcggcctggaagttcatcctctacacactgctcggttccgtcgtcatgctgctgggcctgctcctgatcggaatcaaggcgggcacattcgacatggtggcactcgccactgacaacggccggtcgctgaccacatccgtgcaggtcatcgccgttttggcgatcgggatcgggctcgcggtcaagacgccgatgtggccgctgcacagctggctcccggacgcccacaccgccgcgccgacggtcggctccgtcctgctggccggcgtgctgctgaagatgggtacgtacgggttcgtccggattctgctgccgatcgcgcccgacggactccgcaccttcgcgccgtacctcgccgcgttcgccgtggtcggaatcatctacggatccctggcctgcctcgccctcgccaaacagggcgcgaagggcgatctcaagcggctcatcgcctactcctccgtcggccacatgggcttcgtcctgctcggcatcgcgacgatgaccccgaccggcgtgaacggcgcgctcttcgccaacatcgcccacggcctcatcaccggcctcctcttcttcctggtcggcgcgctcaaggaccgcaccggcagcaccgacctcgacaccctcgccgagaagaccggcgccgccctctacgccaaggccccacgcctcggcggtctgctcgccttcggcgccgtcgcctcactcgggctgcccggcctcgccgggttctggggcgaaatgctcgctctgttcggcgcgttcaagcccgccgacgacctcagccgccccgcgttcctgacgttcatggccatcgccgccttcggcaccctgctcaccgccgcgtacatgctcgtcgtcgtgcgccgcgtctgcatgggcgccgtcccacaggagtccggacagatctcgaccctcgccgacgtgcagagctacgagttcgccgcctggacaccgctcgtcgccctcaccgtcgtcgccggactctggcccagggccctcctcggcctgaccgacccggccgtgcagcagctcctcgcaggaggcacccga

SEQ ID NO: 4874 - DNA, 1497 bp, Streptomyces avermitilis
  CDS (1)..(1497)
atgagctccctggtccagtccgtcgactggctcgcgatcgccccgcccacgctcgcggcggtcgtcggactcgtcgtgctcgtcgccgacctcttcatcggcgaccacaagaaggcgctcctcggatgggtgtccgtcgcggggctcgccgcctcggcgctcctgctgctgcccctcctggacggagaccgcgccaccttctgcctgacgggcgacgcgaacacctgcagctacacggcggaccacttcaccctcgccatccagttcctggtcctcggcggggcgctcctcgcggccctcctgtcggtcaccgccctgaaggacgccgacagggaaattcccgaaggggaattctggttcctgctgctctcctcggccgccggcgccgccctgctgcccgcctcccgcgatctggcgaccctcatcgtcgccctggaggtcgcctctctgcccgccttcgcactcgtcggcatcaagcgcggcgacaagaagtcctccgaagcggccctgaagttcttcctctcgtccgtcacggcgaccgcggtcagcctcatgggcgtcagcttcgtgtacgcgtccacgggcacgctctacctcaccgagatcgcccgcaagatccagcacgtcgacggccagctccacacgctcgcccagaccggcgtcgtgctcaccctcgtcggcttcgccttcaagacggccgccgtccccttccacttctgggtgcccgacacctacgtgggggcgcccctgccgatcgccgcctacctgtccgtcgtcggcaaggcggtcggcttctccgggctgatcctcgtcaccgtcgtcgccttcccctcgtacgcggacgtctggggtccggcgctcgccgcgctggccgccctcaccatgaccgtcggcaacgtcggtgccctgcgccagcaggccacgcgcgcgtacagcgcggtacggctgctggcctggtcctccgtcggccaggccggctacctcctggtgccgatcgccgccgcggcgtactcgaaggacgccgagaaggccatcggatcgaccgtggcgtacgccctcatgtacgcggccgtgaacctcggagccttcgccgtggccgccctggtgggccgtacgaaggtgctgaaccgcgtcagcgactaccgcggcctgtacgcctcgaaccccctcgcggccctgctcctgggcttcttcctgctctgtctggccggactgccgccgggcatcatcggcctgttcgcgaaggtcaccgtcttctcggccgccgtcgacgcgggccttggctggctggccgtggtgatggccgtcaacgtagtgatcgcgctcttctactacctccagtggacgacgctgctgttccgcgctcccgagggcgagcccgagaagcaccgcgtcccggcaccgctgacggccgcgatcgccctgaccgccgtgctgggagtcgccctctccggagcgccccagctggtcctgcgcttctcggacaccggcctcttc

SEQ ID NO: 4875 - DNA, 861 bp, Streptomyces avermitilis
  CDS (1)..(861)
gtgcaccgccggcacaacgggctcaagaccgccgtactcctcgggggactgtccgcactcatcatcgtcatcggcagcttcttcgggcgtacgggtctggtcgtcgcactcttcatcgcgatcggcaccaacgcctacgcgtactggaacagcgacaagctggctctacgcgcgatgcgcgcgcgcccggtgagcgagttcgaggcccccacgctgtaccgcatggtccgcgagctctccacccaggcccgccagcccatgccgcgcctgtacatctctcccacggaagcaccgaacgcgttcgcgaccggccgcaacccgcgcaacgcggccgtgtgctgcaccgaggggatcctgcggatcctggacgagcgcgaactgcgcggtgtcatcggccacgaactcagccacgtctacaaccgcgacatcctcatctcctcggtcgccggagccctcgcctcggtgatcatgttcctggtcaacttcgcctggctgatcccggtcggccgctccagcgacgacgacggccccggcctcctgggcatgctcctgatcatgatcctgggcccgctcgccgccacgatcatccagctcgccatcagccgctccagggagtacgaggcggacgcgtccggcgcccagctcaccggcgaccccctcgccctcgccagcgccctccgcaagctcgacgcgggcatcaagcaactgccactgccccccgaaccacgtatcgagaccgcgagccacatgatgatcgcgaatcccttccgcccgggccagggtctctccaagatgttctccacccacccgccgatgacggagcgcatcgcccgtctggagcagatggcaggtcgtcaccag

SEQ ID NO: 4876 - DNA, 390 bp, Streptomyces avermitilis
  CDS (1)..(390)
gtgaagacaatcctgaacgtcatttggctcgtcctgagcggcttctggctgttcctcggctacctgctcgcgggtgtgctcctctgcatcacgatcatcggcatcccgttcggcatcgccgcattccgcatcggcgtatacgccctgtggcccttcggatatacgacggtcgagcgccgcgacgcgggcgcgccctcctgtatcggcaacgtcctgtggctggtcctcgcgggctggtggctggcccttgcccacatcgtcacgggcatcgccctgtgcctcacgatcatcggcatcccgttcggcatcgccaacttcaagctgctccccatttcactgctcccgctgggacgcgaaatcgtacgcacggacgagcccttcgcgacacgc

SEQ ID NO: 4877 - DNA, 564 bp, Streptomyces avermitilis
  CDS (1)..(564)
atgaccgagaccgagcagttgctggagaaggtggcggaagaggcccgcaacacccggccgtggggctggccttcgctccccgagcccgtggacacggccgcgctggcccgcgccgaggccgccctcggcttccccttgcctcccctgctcgccgcgctctacctgcggataggagacggcggattcggcccggagtacggcctgttgcccctgctcgacagcccgccgtcgggcgagccggccgttgtcccgcagtacctcgccaaccgcgagagcggccgcaaggaccccgactggccctggcccgagggaatcctgccgatatcccactggggctgtggaatgtatgcgtgcgtggactgccgcaccccgcagggcacggtcctgctcttcgagccgaacgccgacgacgcccaccacgcctggtacgtggacgcgcccggactcgcggagtggctgcgcacctggctggacggaacaggctggtacgacgagtccaatgacgatatggacctggccccttgggccgacttccatatacgcacggacgccgcgcggacctcc

SEQ ID NO: 4878 - DNA, 1266 bp, Streptomyces avermitilis
  CDS (1)..(1266)
atgacacagtccggggcggggccatccgggggctttgggttgcggcggaccctcggggtcggggacgccgtcgtcgtcgggctcgggtcgatggtcggggccgggatcttcgcggcgctgggtccggcggcacgggccgcggggtccggactgctgctcggtctggcggtcgcggccgtcgtcgcgtactgcaacgcgatgtcctcggcccggctggccgccctgtaccccgcgtcgggcggcacgtatgtctacgggcgcgagcggctcggggccttctggggctacctggcgggctgggcgttcatcgtcgggaagaccgcctcctgcgcggcgatggcgctcaccgtgggggcgtacgtctggccggggcaggcgcacgcggtggcggtcgccgccgtggtggcgctgaccgcggtgaactacggcggcatgcagaagtcggccctgctgacgcgggcgatcgtggcggtggtcctggcggtcctcgcttccgtggtggtcgtctgtctcggctccggggccgcggacgccgggcggctggccgtcgggctctccggcggcgcgggcggggtgcttcaggcggctggtctgctgttcttcgcgttcgccgggtacgcgcggatcgccaccctcggtgaggaggtacgcgatccggagcggaccatcccgcgcgccatcccgctggccctgggcatcgccctggtggtgtacgcggctgtcgccgtcggtgtcctttctgtactgggggccgacgcgctgggacacgcaccggcgccgctggccgacgcggtgcgggcggcgggcgtgcccggtctcgtgccggtggtgcgggtgggcgcggcggtggccgcgctcggctccctgctcgccctcatcctgggcgtctcacggacaacgctggccatggcgcgggaccggcagctgccgggggccctggccgccgtgcaccctcgcttccaggtgccgcaccgggcggagctggccgtgggcgcggtggtcgccgccctggccgcaacggtggatgtgcggggcgcgatcggtttctcctccttcggggtgctggcctactacgcggtcgccaacgcgtccgcctggaccctgagttcggcaccggcgtcgcgcgccgttccggcggtcgggctcctcgggtgcgtgacattggcgttcgcactgccggcggtgtcggtgggcgtgggcgcggctgtactgggtctgggggcggccgcgtacggcatgcggcggtggggggcttcgcggcggccg

SEQ ID NO: 4879 - DNA, 264 bp, Streptomyces avermitilis
  CDS (1)..(264)
atgggtatcgtcggctggatcattctggggctgttggcaggcgccatcgccaaattcctgctcccgggccgtgacccgggcggcttcatcggcacgaccgtcatcggtgtcgcgggggccttcatcgggggctggatatcggcacgttggctggaccacccgatcaccaagcagttctacgacggcgccacctgggcggcggcgatcggcggctcgctggtcctgctgatcatctaccgcctcctgttcggagactcacgccgc

SEQ ID NO: 4880 - DNA, 486 bp, Streptomyces avermitilis
  CDS (1)..(486)
atggccgactccagtttcgacatcgtctcgaaggtcgagcggcaggaggtcgacaacgccctcaaccaggccgccaaggaaatctcgcagcgctacgacttcaagaacgtgggcgcctccatcgcctggtccggcgagaagatcctgatgcaggcgaactccgaggagcgggtgaaggccatcctcgacgtgttcgagaccaagctgatcaagcgtggcatctcgctgaaggcgctggacgccggtgagccgcagctgtccggcaaggagtacaagatcttcgcgtcgatcgaggagggcatctcccaggagaacgcgaagaaggtcgcgaaggtcattcgcgacgagggcccgaagggcgtgaaggcccaggtgcagggcgacgagctgcgcgtcagctcgaagagccgtgacgacctgcaagccgtgcaggcgctgctcaagggccaggacttcgacttcgccctgcagttcgtgaactaccgg

SEQ ID NO: 4881 - DNA, 1179 bp, Streptomyces avermitilis
  CDS (1)..(1179)
atgtccgccaccgcgcccccgctggcagctctctccgccgaactctccttgctgcgcccccggatggaggaggtgagccgtgccatccatgcacggccggagctgaagttcgcggagttccatgccgtggaggtgctgaccggctggctcgccgaggcgggcttcgcggtgcgggcgggagcgggcggcctcgatacggcgttcgtggcggcgcacgaggggagcgagccgggcccgtacgtcgccgtactcgcggagtacgacgcgctgcccggagtcgggcacggctgcggccacaatctcatcgcggccggtggcgcggcggccgcgatcaccgccgtacgcgccctgcctcaccacccgggcacgatcgccgtcatcggtacccccggtgaggagatgggcggcgggggcaaggtcaggctggccgacgccggggtcttcgcgggcgtcgacgccgcggttatgttccacccgggcgaccgctcgctgaccacgcagcacgggttggcggcggcgcatctgagggtcggtttcacgggggtgagcgcgcatgccgcgaggtcaccgtgggaggggcgcagcgcgctggcggccgcgcagctgttcctcaacgcgatcgacgcgatgcgtcagttcgtaccgccgaccgcccgactgcacggcatcgtctcggacggcggccaggccccgaacgtgatcccggcccatgccgcggtggatctgtacgtacgggaccgtacggcggcgtcggccgaggcgctggtcgagcgggtccgcagggcggccgagggcgcggcgctcgccaccgagaccacggcggaggtccacgagacaggcccgctgtacggggagcgccgcgacaacacggtgctcgccgaacgcttcggggacacggtgcgcgcgctgggcctggacatcacggccgccggccccgacagccccgccggttcctccgacatcggcaacctgtcccagctgctgccggtcatccatccgtacatccagatcgccgagttcggtacgccgagtcactccgacgcgatgcgggaggccgcggcgacccctctcgcccacgaccgcgccgaggtcgcggcggcggggctggctcgggtggtcactgacctggtcctggatccgggggtgttggaggcggcgcgggcggagttcgtgggccgc

SEQ ID NO: 4882 - DNA, 654 bp, Streptomyces avermitilis
  CDS (1)..(654)
atgcgcattgtcatcgctggaggtcatggtcagatcgcgctgcggctggagcggctgctcgccgcgcgcggtgacgaggtcgcggggatcatccgccgcgccgaacagggcgacgatctgcgggcggccggcgccgagccggtgctctgcgatctggagtcggcctccgtcgaggaggtcgccgctcatctacagggcgcggacgcggcggtgttcgcggcgggcgcgggcccgggcagcggcgtcacccgcaaggagacggtggacaagggtgcggcgatcctgttcgccgacgcggcggaacgggcgggcgtacgccgccacgtcgtcgtgtcctcgatgggcgcggacccggcgcacccgggcgacgaggtgttcgacgtctatctgcgcgccaagggcgaggcggacgagtacgtacgcagccgtccgtccctggactggacgatcctgcgcccggggatgctgacgaacgacgccggcacgggcctcgtacgcctggaggcgcacacgggccgcggcccgatcccgcgcgacgacgtggccgcgaccctcgcggaactcgtcgacacccccgcgacggccggcctgacactggaagtgatcagcggctccacgccgatcacggtggcggtgaaggcggtggcggggaac

SEQ ID NO: 4883 - DNA, 1239 bp, Streptomyces avermitilis
  CDS (1)..(1239)
atgcccgacagccgaccgcagccgccccactcgtcgtcgggacagaccgacccggccggcctcctgctgtgcggagcgcggctcaccgacggacggaccgtggacgtgcggctgggcggcgggcgtatcgaggcggtcggtaccgccgggagtctggcgacggacgcggtcggcgcgcgcgtggacctcgccggctatctgctcctgccggcccccgtcgagccgcacgcccacggggacacggccctgtcggccgacggcgcgggacctgtgtcgtacggcgctccggaggtccagcgccgcgcgaccgaggccgcgttgctgcaactcggacacggggcgacggctctgcgcgcccacgtacacgtgagtgacgtacagggcctggacgcactgacggcggtgcttcaggcacgacggtcactgcacgggctcgccgagttgtcggcggtggcgatgccacgggtgctgaccggggccgccggggcggacggggtcgcgatgctgcgcgacgcgctgaagatgggcgccgcggtggtgggtggctgtccggacgccgacccggatccgacggggtacgtggagacggttctggaactcgccgccgagcagggctgccccgtcgacctgcacacggacggtgacgatccggcccggctcgcccggctcgcggcgatggccggcgggctgcgtcccggggtcacgctgggcccttgcggggggctgcgccgactgcccgccgaggtcgccgcacgcatcgcggaccaactcgccgcggccggggtgacggtggtgtgcctgccgcagggtggctgcgggggcgccgaccggcccggtacggcgcccgtacggctgctgcggtcggccggcgtgcgggtcgcggccggcagcggcgctctgagggacgtgtcgaacccggtgggccgcggggatccgctggaggccgcgtatctgctggcctcgcgctacgggctgcggcccgaggacgcgtacgacgccgtgagcaccgcagcccgggccgctctcggcctgcccgaagtacgcgtggaggcgggattcccggccgaactgctcgccgtacggggcgaccggctggccggggcgctgtcgctcgcgtacagccggatcgtcgtacaccgggggcgggtcgtggcgcggaccagcgcggtgcgggagtactgcaactcggcggccgcggtggcgctggacctgcctcggcaggggcggggagagccgtcg

SEQ ID NO: 4884 - DNA, 162 bp, Streptomyces avermitilis
  CDS (1)..(162)
gtggctgccaccgacgtccgcccgaagatcacgctggcctgcgtggagtgcaaggagcggaactacatcaccaagaagaaccggcgtaacaacccggaccgactggagatgaagaagcactgcccgcgttgcaacgcgcacaccgcgcaccgcgaaacgcga

SEQ ID NO: 4885 - DNA, 450 bp, Streptomyces avermitilis
  CDS (1)..(450)
atggcgctcgaccagtccttcgtggggcggtcctacccgcccaccgacccctatgaggtcggccgggagaagatccgcgagttcgcggaggccgtcggggaccccaatccggtgtacacggacccggaggccgccaaggcgctcgggtacgccgatgtgatcgccccgcccacctttgtgttcgccattacgttcaaggcggccgggcaggtcgtccaggacccccagctgggcctcgactacagccgcgtggtgcacggtgaccagaagttcgcctacacccggccggtccgcgccggtgaccggctcacggtcacctcgaccatcgagtcgatcaagtccctcgcgggcaacgacgtcgtggacgtccggggcgaggtccacgacgaggcgggcgagcacgtcgtgacggccatcaccaagctggtggcccgcgcggccgaggagggc

SEQ ID NO: 4886 - DNA, 426 bp, Streptomyces avermitilis
  CDS (1)..(426)
atgaccgcgaagatcgcgtacgacgacatcgaggtcggagccgaactgccggcgcagaccttccccgtgacgcgcgccacgctcgtgcagtacgcgggcgcctccggggacttcaacccgatccactggaacgagaagttcgccaaggaggtcgggctgccggacgtcatcgcgcacggcatgttcaccatggccgaggcgatccgcgtcgtcaccgactggaccggcgacccgggcgcggtcgtcgagtacggcgtccgcttcaccaagcccgtcgtcgtcccgaacgacgaccagggcgcgaccatcgaggtcaccggcaaggtcgcggccaagctcgacgacaacacggtccgcgtcgacctcacggcgatgagcgagggcaagaaggtgctgggcatgtcgcgggcggttgtgcggctggcc

SEQ ID NO: 4887 - DNA, 567 bp, Streptomyces avermitilis
  CDS (1)..(567)
atggtcaggatgagcgcagaggagaggcgcgagagcgtcatccgcgcggcgatgagtgagttcggccggggcggctactacggcacgtccaccgaggcgatcgccaagcgtgtgggtgtctcgcagccttatctcttccggctcttcccgagcaagaaggcgatcttcctcgcggcggccgagcgctgcatggaggacacccggcgcaccttcgaggaagccgccgaggggctgcggggcgaggaggctctgcactccatggcgaacgcgtacaccagggtcatcgcggagcgcccggagcagctgctgatgcagatgcagacgtacgtcgcctcggcggccgccgaggaggccggggaccacgaactcgctgaggcggtgcgggcgggctggatgcgcctgtgggacaccgtccatctgccgctcggcggcgacaaggacgagacgacgaccttcatggcgtacggaatgctcgtcaactgcctggtggccatgggttttccgcccgagcaccgagtctgggaagggctctatccgtcggcgcggatcacgggccggctggagaag

SEQ ID NO: 4888 - DNA, 1467 bp, Streptomyces avermitilis
  CDS (1)..(1467)
atgtcacagcagacagcacgtcgcgggggagccgcctgggccctcgtcatcaccagcgtcgccggattcatggcggccctcgacaatctcgtcgtcaccaccgcactgccctccatccgtaaggacctcggaggagggctggacgacctggagtggaccgtgagcgcctacacgctcaccttcgccgtgctgctgatgttcggcgcggcgctcggcgaccggttcggccgccgtcggctcttcctcgccgggatcacggtcttcaccggcgcctccgcagccgcggccatggcacccggcatcgactcgctgatcgccgcccgcgcggtccagggtgtcggcgcggccgtcatgatgccgctgacgctcaccctgctgaccgccgccgtcccggccgccaagcgcggaatggcctacgggatctggggtgccgtcaacggactcgcggtcgcctccgggcccctcatcggcggcagcctcaccgaacacgtgtcctggcactggatcttctggctgaacgtcccgctgggcctggcactcctgccgctcgcccggctgcgcctctccgagtcgcacggcaccggcgcaccgctcgacatccccggcaccctgctcgccagcggcggcctcttcgggatcgtgtacggcctggtccgcgggcccgccgacggctggaccagcccgttcgtcctgaccggcctcttcgcgggtgcggccctgctcaccgcgttcgtcctgcacggcatacgcgccaagaacccgatgctgccgatgcggctcttccgctcccgtgccttcgccgggatcaacgccgcgagtctgctgatgttcctcggaatgttcggctcgatcttcctgctcagccagtacatgcagggcgtcctcggctactcgccgaccgaggcgggcgtgcggatgctgccctggaccggcatgccgatgctcgtcgcgccgatcgccggctacctctccgaccggatcggcggccgcccggtcgtcgccgccgggctcttcctccaggccgccgggcttgcgtactacgccgccgtggtcgccgccgacgccacgtacaccgcccagctgcccgcgctgatcatcagcggcatcgggatgtccctgtacttcgccccggcctccgccctggtcatgtccagcgtccggacgcaggagcagggcatcgcctccggcgccaacaacgccctgcgcgaggtcggcggcgcgctcggcatcgccgtgatgtcgtcgatcttctcggcccagggcggctacgagaccccgcagcacttcgtcgacggcctccggcccgcgctggtggtgggcgcctccatggtggccctcgcggggatcgcggcgctggccatcccgacccggcgcagcgcgcaggcggccgaggccactgcttccgcgtcggacacggccgccgcctccgagccggccgagaaggcggtcctggagacggccggccac

SEQ ID NO: 4889 - DNA, 1092 bp, Streptomyces avermitilis
  CDS (1)..(1092)
gtgccaaagcggccgaccccgtctcgtactctggtgcacgtgcaggaactccacgatgccccgctcgccccgctgaccaccttccggctcgggggtcccgcgacccggctgatcaccgcaacgactgacgccgaagtgatcgcagccgtccgcgaggccgacgactccggtacgccgctgctgctcatcggtggcggatccaacctggtcatcggcgacaagggcttcgccggcaccgccctgcggatcgccacgaccggcttcggactcgacggtacgaaggtggagctggccgccggtgaggtgtggaccgacgcggtcgcccgtaccgtcgaagccgggctcgccgggatcgagtgcctcgccggaatccctggttcagcgggcgcgacgccgatccagaacgtcggtgcgtacggtcaggaggtgtcgtcgacgatcaccgaggtgatcgcctacgaccggaagacccacgagacggtcacgatcccgaacgccgagtgcgcgttctcgtaccgccacagccgcttcaaggccgaccccgagcgctacgtcgtgctgcgtgtccgcttcgagctggaggacgcggacggcctgagcgccccggtcaagtacgccgagacggcccgcgcgctgggcgtggagcccggcgaccgggtgccgctcgccgccgcccgcgagaccgttctggggctgcgctccggcaagggcatggtgctcgaccccgaggaccacgacacctggtcggcggggtccttcttcaccaacccgatcctcacggaggcggagtgcgccgcgttccatgcgcgcgtgcgggagcggctcggcgccgacgccgtgccgcccgcgtacccggcgggcgacgggcgcaccaagacgtccgcggcctggctgatcgacaagtccggcttcaccaaggggtacggcagcggacccgcccgtatctccaccaagcacaccctggccctcaccaaccgcggcgaggccaccaccgaggacctgctcgcgctggcccgcgaggtcgtcgccggagtacgcgacgccttcgggatcacgctggtcaacgagccggtgaccgtcggagtggagctc

SEQ ID NO: 4890 - DNA, 1026 bp, Streptomyces avermitilis
  CDS (1)..(1026)
atggagcacgtacgtgatgtctctgagttgccgaaggcccatctgcacctgcacttcaccggctcgatgcggccgagcaccctgctggagctggccgacaagtacggcgtccggctgcccgacgcgctgaccagcgcagagccgccgaagctgcgggccaccgacgagcggggctggttccgcttccagcggttgtacgacgcggcgcggtcgtgcctcagagagcccgaggacattcggcggctcgtgcgcgaggccgccgaggaggacatcaaggacggctccgggtggctggagatccaggtcgatccgacgtcgtacgcgccccgtctgggcggcctgatccccgcgatggaggtcatcctggacgcggtggactcggcggcgcgggagaccggtctgggcatgcgggtgctggtggcagcgaaccgcatgaagcatccactggacgcgcgcacgctggcccgcctcgccgtgcggtacgcggaccgcggcatcgtcggcttcgggctctccaacgacgagcggcggggcatggcgcgggacttcgaccgggccttcgcgatcgcgcgcgagggcggcctcctcgcggctccgcacggcggcgagctgaccggcccggcgtcggtcagggactgcctggacgacctggacgcctcgcggatcgggcacggagtgcgggcggccgaggacccgcggttgctgaagcggctcgcggaccggggcatcacctgcgaggtctgcccggcctccaacgtcgccctgggggtctacgagaagcccgaggacgtacccctgaggactttgttcgaagccggggtgccgatggcgctcggcgcggacgacccgctgctgttcggctcgcggctcgccgcccagtacgacatcgcgcgccgccaccacggcttcacggacgccgaactggccgagctggcccggcagtcggtgcggggttcggcggcgccggcggacgtcagccggaagctgctgtccgggatcgacgactggctgacgagcccggccgcc

SEQ ID NO: 4891 - DNA, 1224 bp, Streptomyces avermitilis
  CDS (1)..(1224)
atgagcgctgcaacccctcccaccgagcgccgggtctccgcccgagtcggcgcgatctccgagtccgccaccctcgccgtggatgccaaggccaaggccctcaaggccgccggacgtccggtgatcggcttcggcgccggtgagcccgacttcccgaccccggactacatcgtccaggccgccatcgaggcctgctcgaacccgaagtaccaccgctacacgccggccggcggcctgcccgagctgaaggccgccatcgccgcgaagacgctccgcgactcgggctacgaggtggacgcctcgcaggtcctggtcaccaacggcggcaagcaggcgatctacgaggccttcgccgcgatcctcgacccgggcgacgaggtcatcgtccccgcgccgtactggaccacctacccggagtcgatccgtctcgccggcggtgtccccgtcgacgtcgtcgccgacgagaccaccggctaccgcgtctcggtcgagcagctggaggccgcccgcaccgagaacaccaaggtgctgctcttcgtctccccgtccaacccgacgggcgcggtctacacccgcgagcagatcgaggagatcggccgctgggccgccgagaagggcctgtgggtcctgaccgacgagatctacgagcacctcgtctacggggacgccgagttccactccctgccggtggtcgtgcccgagctggccgacaagtgcatcgtggtcaacggtgtcgcgaagacgtacgcgatgaccggctggcgcgtgggctgggtcatcggtcccaaggacgtcatcaaggccgcgacgaacctccagtcgcacgccacgtcgaacgtctccaacgtggcgcaggtcgccgcgctcgccgccgtgtccggcgatctgacggccgtcgccgagatgcgcgaggccttcgaccgccgccgcaagaccatcgtgcggatgctgaacgagatcggcggcgtcctgtgcccggagcccgagggcgcgttctacgcgtacccctcggtgaaggcgctgctcggcaaggagatccgcggcaagcgcccgcaggacacggtcgagctggccgcgctgatcctggaggaggccgaggtcgcggtcgtccccggcgaggccttcggcacgccgggctatctgcggctgtcgtacgccctgggtgacgaggatctggtcgagggcgtcagccggattcagaagctgctgtccgaggcgaaggac

SEQ ID NO: 4892 - DNA, 285 bp, Streptomyces avermitilis
  CDS (1)..(285)
gtgacggacgccgtgggctccatcgacatgcctgatgcccaggatgaggcgccggagtccaagaagaagacccgcaagggcggtaagcgtgccaagaagggcccgctcaagcgccttgccctcttctaccgccagattgtcgcggaactccgcaaggtcgtctggccatctcgaaaccagctgacgacgtacacgacagtggtgattgtcttcgtcgtcatcatgatcgccctggtgaccgtgattgactatgggctcaaccacgcagccaagtacgtcttcggc

SEQ ID NO: 4893 - DNA, 861 bp, Streptomyces avermitilis
  CDS (1)..(861)
gtgtctgacccgaacctgaacgatgccatcgagtcggtcgagtccgttgacgacgagctcgacatcgtcgagggcgcggacgtcgaggacgagtttgaggctgccgacgccgatgccggcgagcccgccgaagaggcggccgtgcacgtcgaggacgagtccggcacggacctcgaggacgacgtggacgcagcggacctggccgtctccgacgaggccgaggaggccgaggaagaggctgagccggtcgaccccgtcaccgctctgcgcgaggaactgcgcacccttcccggcgagtggtacgtgatccacacgtacgccggttacgagaaccgcgtgaagaccaacctcgaacagcgcgccgtctcgctgaacgtcgaggacttcatcttccaggccgaggtgccgcaggaagaggtcgcgcagatcaagaacggcgagcgcaagaccatccgccagaacaagctccccggctacgtgctggtgcgcatggacctgacgaacgagtcctggggcgtcgtccgcaacactcccggtgtcaccggcttcgtgggcaacgcctacgacccgtacccgctgaccctggacgagatcgtcaagatgctcgccccggaggccgaggagaaggccgcccgcgaggccgccgaggccgagggcaagcccgctccgcagcgcaaggtcgaggtccaggtgctggacttcgaggtcggcgactcggtcaccgtcaccgacggcccgttcgcgacgctgcaggcgacgatcaacgagatcaacgccgactcgaagaaggtcaagggcctcgtcgagatcttcggccgcgagaccccggtcgagctctcgttcgaccagatccagaagaac

SEQ ID NO: 4894 - DNA, 432 bp, Streptomyces avermitilis
  CDS (1)..(432)
atgcctcccaagaagaagaaggtcacggggcttatcaagctccagatccaggccggcgccgccaacccggctccgccggtcggcccggcgctgggtcagcacggcgtcaacatcatggagttctgcaaggcctacaacgccgcgaccgagtcgcagcgtggctgggtgatcccggtggagatcacggtctacgaggaccgttccttcaccttcatcaccaagactccgccggccgccaagatgatcctcaaggctgcgggtgtggagaagggctccggcgagccgcacaagaccaaggtcgccaagatcacccaggcgcaggtccgcgagatcgccaccacgaagctgcccgacctcaacgccaacgacctggacgccgcgtcgaagatcatcgccggcaccgcccgttccatgggcatcacggtcgagggc

SEQ ID NO: 4895 - DNA, 723 bp, Streptomyces avermitilis
  CDS (1)..(723)
gtgagcaagcgcagcaaggctctccgcgctgcggacgccaagatcgaccgggagaagctctacgccccgctcgaggccgtccgtctcgccaaggagacctccacgtccaagttcgacggcaccgtcgaggtcgccttccgtctgggtgtcgacccgcgcaaggccgaccagatggtccgtggcaccgtgaacctcccgcacggcaccggtaagaccgcccgggtcctggtcttcgcgaccggtgaccgtgccgaggccgctcgtgccgcgggcgccgacatcgtcggctccgacgagctcatcgacgaggtgtcgaagggccgtctggacttcgacgccgtcgtcgccaccccggacctcatgggcaaggtcggccgcctcggccgcgtgctcggtccccgtggtctcatgccgaaccccaagaccggcaccgtgactccggacgtcgtcaaggccgtcaacgagatcaagggcggcaagatcgagttccgcgtcgacaagcactcgaacctgcacttcatcatcggcaagacgtccttcgacgacacgcagctggtggagaactacggcgcggccctcgacgagatccttcgtctgaagccgtccgccgccaagggtcgctacatcaagaaggccgcgatcagcaccacgatcggccccggcattccgatcgactcgaaccgcacccgcaacctcctcaccgaggaggacccggccgccgtc

SEQ ID NO: 4896 - DNA, 528 bp, Streptomyces avermitilis
  CDS (1)..(528)
atggcaaggcccgacaaggctgccgcggtagccgagctcgcggaccagttccgcagctcgaacgccgctgtgctgaccgagtaccggggtctcactgtggcgcagctcaagacgctgcgccgttcgctcggtgaagacgcccagtacgccgtggtgaagaacacgctgaccaagattgcggccaacgaggccgggatcaacacgctcgacgacctgttcaacggtccgacggcggtcgccttcatcaccggtgacccggtggtgtcggcgaagggtcttcgtgactttgccaaggacaacccgaacctcgtcatcaagggcggtgtccttgatggcaaggcgctgtccgccgacgagatcaagaagcttgcggacctcgagtcccgcgaggttctgctcgccaagctggcgggtgccttcaagggcaagcagtcccaggctgcctcgctcttccaggcgcttccctcgaagttcgtccgcaccgcggaggcgcttcgtgccaagaaggccgagcagggcggtgccgag

SEQ ID NO: 4897 - DNA, 381 bp, Streptomyces avermitilis
  CDS (1)..(381)
atggcgacgaagctgtcccaggaagagctgctcgagcagttcgagtccctcaccctcatcgagctcgccgagttcgtgaaggcgttcgaggagaagttcgacgtcaccgccgccgccgcggtcgccgctgccccggccggccccgtcgccgccgctgaggccgccgaggagcaggacgagttcgacgtcatcctcacgggtgccggcgacaagaagatccaggtcatcaaggtcgtgcgtgagctgacctccctgggtctgaaggaggccaaggacctcgtcgacggcgctccgaagcccgtcctcgagaaggtcgccaaggaggccgccgagaaggctgccgagtccctcaagggcgccggcgcctccgtcgaggtcaag

SEQ ID NO: 4898 - DNA, 3543 bp, Streptomyces avermitilis
  CDS (1)..(3543)
gtgccccagtggggggccggtacgcgcgtagtgagtccgagccctcggaaggaccccctcttggccgcctcgcgcactgcctcgaccgcgaatacgaacaacggcgccagcaccgccccgctgcgcatctcctttgcaaagatcaaggagcccctcgaggttccgaaccttcttgcgctgcaaaccgagagcttcgactggctgctcggcaacgacgcgtggaaggctcgtgtcgaggcggctctggacagcggacaggacgtccccaccaagtccggtctggaggagatcttcgaggagatctctccgatcgaggacttctccgggtcgatgtccctgacgttccgcgaccaccgcttcgagcccccgaagaactccatcgacgagtgcaaggaccgcgacttcacgtacgcggccccgctcttcgtcaccgccgagttcaccaacaacgagaccggcgagatcaagtcccagacggtcttcatgggcgacttcccgctcatgaccaacaagggcaccttcgtcatcaacggcaccgagcgtgtcgtggtgtcgcagctcgtccgctcgccgggtgtctacttcgactcctccatcgacaagacgtccgacaaggacatcttctccgccaaggtcatcccctcccggggcgcctggctggagatggagatcgacaagcgcgacatggtcggtgtccgcatcgaccgcaagcgcaagcagtccgtcaccgttctcctgaaggctctcggttggacgaccgagcagatcctcgaggagttcggcgagtacgagtccatgcgcgccaccctggagaaggaccacacccagggccaggacgacgcgctgctcgacatctaccgcaagctgcgtccgggcgagcccccgacccgcgaggccgcgcagacgcttcttgagaacctctacttcaacccgaagcgctacgacctcgcgaaggtcggccgctacaaggtcaacaagaagctgggcggcgaggcgccgctggacgccgggatcctgaccgtcgaggacatcatctcgtcgatcaagtacctggtgaagctgcacgccggtgagaccgagaccgttggcgacaacggcacctcgatcgtcgtcgagaccgacgacatcgaccacttcggcaaccgtcgtctgcgcaacgtcggcgagctcatccagaaccaggtccgcacgggtctggctcgtatggagcgcgtcgtccgcgagcgcatgacgactcaggacgtcgaggcgatcacgccgcagaccctgatcaacatccggccggtcgtcgcctccatcaaggagttcttcggcaccagccagctgtcgcagttcatggaccagaacaacccgctgtcgggtctcactcacaagcgccgtctgtcggctcttggcccgggtggtctctcccgtgagcgggccggcttcgaggtccgtgacgtgcacccgtcgcactacggccgcatgtgcccgatcgagacccccgaaggcccgaacatcggtctgatcggctcgctcgcctcttacggccgcgtcaacgcgttcggtttcgtcgagacgccgtaccgccgggtcaccgacggtgtcgtcaccgacgaggtcgactacctgacggccgacgaagaggaccgattcgtcatcgcgcaggccaacgcgccgctcggcgacgacttccggttcgaggagacccgcgtcctggtccgccgtcgtggcggagaggtcgactacgtccccggtgacgacgtcgactacatggacgtctcgccgcgccagatggtgtcggtcgcgaccgccatgatcccgttcctcgagcacgacgacgccaaccgtgccctcatgggcgcgaacatgatgcgtcaggccgtgccgctgatcaagtccgaggcgccgctcgtcggcaccggcatggagtaccgctgcgccgtcgacgccggcgacgtgctcaagtcggagaaggacggtgtggtccaggaggtctccgcggactacgtcaccaccgccaacgacgacggcacgtacaccacgtaccgcctgcacaagttctcccgctccaaccagggcacgtccgtcaaccagaaggttgtcgtggacgagggcgcccgggtcatcgccggccaggttctggccgacggcccggcgaccgagaacggcgagatggcgctcggcaagaacctgctcgtggcgttcatgccgtgggagggtcacaactacgaggacgcgatcatcctgtcgcagcgcctcgtgcaggacgacgtcctctcctcgatccacatcgaggagcacgaggtcgacgcccgtgacaccaagctcggccccgaggagatcacccgggacatcccgaacgtctccgaggaggtcctcgccgacctcgacgagcgcggcatcatccgtatcggtgccgaggtcgtcgccggcgacatcctggtcggcaaggtcacgcccaagggtgagaccgagctgaccccggaggagcgcctgctccgcgcgatcttcggtgagaaggcgcgcgaggtgcgcgacacctcgctgaaggtgccgcacggcgagatcggcaaggtcatcggcgtccgcgtcttcgaccgtgaagagggcgacgagctgccgccgggcgtgaaccagctggttcgtgtctacgtggcgcagaagcgcaagatcacggacggtgacaagctcgccggccgccacggcaacaagggtgtcatctcgaagatcctgccgatcgaggacatgccgttcctggaggacggcaccccggtcgacatcatcctcaaccccctcggtgtcccgtcccgaatgaacccgggacaggtcctggagatccacctcggctggctcgccagccgcggctgggacgtctccggactcgccgacgactgggcgcagcgcctgcaggccatcgaggccgaccaggtcgccccgggcaccaacgtcgccacccccgtcttcgacggtgcgcgtgaggacgagctcgcgggtctgctgcagcacacgatcccgaaccgcgacggagagcgcatggtgctcccgaccggcaaggcgccgctgttcgacggccgctccggcgagccgttcccggagccgatctcggtcggctacatgtacatcctgaagctgcaccacctggtcgacgacaagctgcacgcccgctcgaccggtccgtactcgatgatcacccagcagccgctgggtggtaaggcccagttcggtggccagcgcttcggtgagatggaggtgtgggcgcttgaggcttatggcgccgcttacgccctccaggagctgctgaccatcaagtccgacgacgtcaccggccgcgtgaaggtctacgaggccatcgtcaagggcgagaacattcccgagcccggcatccctgagtccttcaaggtgctcatcaaggagatgcagtccctgtgcctcaacgtggaggtgctgtcctcggacggcatgtccatcgagatgcgcgacaccgacgaggacgtcttccgcgcggcggaggagcttggcatcgacctgtcccggcgcgagccgagcagcgtcgaagaggtc

SEQ ID NO: 4899 - DNA, 3897 bp, Streptomyces avermitilis
  CDS (1)..(3897)
gtgctcgacgtcaacttcttcgatgagctccggatcggtctggccaccgctgacgacatccgtcagtggagccacggcgaggtcaagaagcccgagaccatcaactaccgcaccctcaagcccgaaaaggacggactcttctgcgagaagatcttcggtccgacccgggactgggagtgctactgcggtaagtacaagcgtgtccgcttcaagggcatcatctgcgagcgctgcggcgtcgaggtcactcgcgccaaggtgcgtcgtgagcggatgggccacatcgaactggccgctcccgtcacccacatctggtacttcaagggcgtcccgtcgcgcctcggctacctgctcgacctcgccccgaaggacctcgagaaggtcatctacttcgcggcgtacatgatcacgtacgtcgacgacgagcgtcgcacccgcgacctgccctcgctggaggcgcacgtctccgtcgagcgtcagcagatcgagaaccgccgcgactccgacctcgaggcccgcgccaagaagctcgagaccgacctggccgagctggaggccgagggcgccaaggccgacgtgcgccgcaaggtgcgcgagggtgccgagcgtgagatgaagcagctgcgcgaccgtgcgcagcgcgagatcgaccgtctcgacgaggtgtggacccgcttcaagaacctcaaggtccaggacctcgagggcgacgagctcctctaccgcgagctgcgtgaccgcttcggcacgtacttcgacggttcgatgggtgccgcggcgctgcagaagcgtctggagtccttcgacctcgacgaggaggccgagcgcctccgcgagatcatccgtaccggcaagggccagaagaagacccgtgcgctcaagcgcctcaaggtcgtctccgcgttcctgcagaccagcaacagccccaagggcatggtgctcgactgcgtgccggtcatcccgccggacctgcgtccgatggtgcagctggacggtggccgcttcgcgacctccgacctgaacgacctgtaccgccgcgtgatcaaccgcaacaaccgcctgaagcggcttctcgacctcggcgcgcccgagatcatcgtgaacaacgagaagcgcatgctccaggaggcggtcgacgccctcttcgacaacggccgtcgtggtcgcccggtcacgggccccggcaaccgtccgctgaagtccctcagcgacatgctgaagggtaagcagggtcgtttccgtcagaacctgctcggtaagcgtgtggactactccgcgcgttccgtgatcgtcgtcggtccgcagctgaagctgcaccagtgtggtctgcccaaggccatggcgctggagctcttcaagccgttcgtgatgaagcgcctggtcgacctgaaccacgcgcagaacatcaagtcggcgaagcggatggtcgagcgcggccgcacggtcgtgtacgacgtcctggaagaggtcatcgcggagcacccggttctgctgaaccgtgcgcccacgctgcaccgcctcggcatccaggccttcgagccgcagctggtcgagggcaaggccatccagatccacccgctcgtctgcaccgcgttcaacgcggacttcgacggtgaccagatggccgtgcacctgccgctctccgcggaggcgcaggccgaggcccgcatcctgatgctgtcctcgaacaacatcctcaagccggccgacggccgcccggtcacgatgccgacccaggacatggtcctcggtctgttcttcctgaccaccgacggtgcgctgcgcaacgtcaagggcgaggagcgctccttcgcgtccgtcgccgaggcgatcatggcgttcgacgccggcgagctctcgctgcagtcccgcgtggacatccgcttcccggtgggcaccatcccgccgcgcggctggaccccgccggcccgcgaggagggcgagccggagtggcagcagggtgacaccttccgcctgcggacgaccctgggccgcgcgctcttcaacgagctgctgcccgaggactacccgttcgtcgactacgaggtcggcaagaagcagctctccgagatcgtcaacgacctcgccgagcgctaccccaaggtcatcgtggcggcgacgctcgacaacctgaaggcggccggcttctactgggcgacccgctccggcgtcaccgtggccatctccgacatcgtcgttcccgaggcgaagaaggagatcgtcaagggctacgaggcgcaggacgagaaggtccagaagcagtacgagcgcggtctgatcaccaaggacgagcgcacgcaggaactcatcgcgatctggaccaaggcgaccaacgaggttgccgaggcgatgaacgcgaacttcccgaagacgaaccccatcttcatgatggttgactcgggtgcccgaggaaacatgatgcagatgcgtcagatcgccggtatgcgtggtctggtgtcgaacgccaagaacgagacgattccccgtcccatcaaggcgtcgttccgtgagggtctgtccgtgctggagtacttcatctccacgcacggtgcccgtaagggtctggcggacaccgccctgcgtaccgccgactcgggttacctgacccgtcgtctggtggacgtctcgcaggacgtcatcatccgcgaggaggactgcggcaccgagcgcggtctgaagctgaagatcgccgagcgcggcgccgacggcgtgctgcgcaagacggacgacgtcgagaccagcgtctacgcccgcatgctcgccgaggacgtcgtcatcgacggcaaggtgatcgcgccggccaacgtggacctcggcgacgtgctcatcgaccagctggtgcaccacggtgtcgaggaggtcaagacccgttcgatcctgacctgtgagtcccaggtcggcacctgcgccatgtgctacggccgttcgctggccaccggcaagctggtcgacatcggtgaggcggtcggcatcatcgccgcccagtccatcggtgagcccggtacccagctgacgatgcgtaccttccacaccggtggtgtggccggtgacgacatcacccagggtctgccccgtgtcgtcgagctcttcgaagcccgtacgccgaagggtgtcgccccgatctccgaggcctccggccgcgtgcggatcgaggagaccgagaagaccaagaagatcgtcgtcaccccggacgacggcagcgacgagacggcgttcccgatctcgaagcgcgcccgtgtcctggtgaccgagggcgagcacgtcgaggtgggccagaagctcaccgtgggtgccaccaacccgcacgacgtgctgcgcatcctgggtcagcgtgccgtccaggtccacctggtcggcgaggtccagaaggtctacaactcgcagggtgtgtcgatccacgacaagcacatcgagatcatcatccggcagatgctgcgccgggtgacgatcatcgagtcgggcgacgcggagctgctgcccggcgagctggtcgagcgctcgaagttcgagaccgagaaccgtcgtgtggtccaggaaggcggccacccggcctccggccgtccgcagctgatgggtatcaccaaggcctcgctggcgaccgagtcgtggctgtcggcggcgtccttccaggagacgaccagggttctgacggacgcggcgatcaacgccaagtccgactccctgatcggcctcaaggagaacgtcatcatcggtaagctcatcccggccggtacgggtctgtcccgctaccgcaacatccgggtcgagccgaccgaggaggccaaggccgcgatgtactcggccgtcggctacgacgacatcgactactcgccgttcggcacgggctccggccaggccgttccgctggaggactacgactacggtccgtacaaccag

SEQ ID NO: 4900 - DNA, 699 bp, Streptomyces avermitilis
  CDS (1)..(699)
gtggccgcccgtcggcgttcccggggggccgcggaccgccgtgcccacaccgcctgtacggggctgtgggggccctgcagggactggtcgggaacctgtgccggaaatgcctcgttggagcatgatggagggatccagccgtccgggggaggtgtgcccgtgtcgtacccgacgccatggcagccgtggcaggggcagaacggtccgcagccgtggcaggggcaaggcgcgccggcgatgctcgcctcgcatgccgaccgtgagcgtgccgtggatgtgctccgggcgggcttcggggagggacgcctggagcaggccgagttcgagaagcgggtcgcacgggcgtacgcggcccgtacggtgggtgagctggccgtgctggtgggagacctcccgcagggccccgtacccctgtcggcggcctccgggccggtgccgcggacgttcctgcccgccccgcccccggcgacgaacggcaaggcggtcgccgccatggtctgcggtgtcctcaccctgatgacggccggcgtcacgggcgtccccgccgtgatcctgggccatacggcgcgctccgagatgcgtcgcaccggcgagggcggcgagggtttcgcgatggccggtctcgtgctgggctggctgtcggtcgcgggctgggccctgctcctgacggtcctgatagccgcggcgctggcgtccgga

SEQ ID NO: 4901 - DNA, 369 bp, Streptomyces avermitilis
  CDS (1)..(369)
gtgcctacgatccagcagctggtccggaagggccggcaggacaaggtcgagaagaacaagacgcccgcacttgagggttctcctcagcgtcggggcgtctgcacgcgtgtgttcacgaccaccccgaagaagccgaactcggccctgcgtaaggtcgcgcgtgtgcgtctgaccagcgggatcgaggtcactgcttacattccgggtgagggacacaacctgcaggagcactccatcgtgctcgtgcgcggcggccgtgtgaaggacctgccgggtgttcgctacaagatcatccgtggttcgctcgacacccagggtgtcaagaaccgcaagcaggcccgcagccgctacggcgccaagaaggagaag

SEQ ID NO: 4902 - DNA, 468 bp, Streptomyces avermitilis
  CDS (1)..(468)
atgcctcgtaagggccccgccccgaagcgcccggtcatcatcgacccggtctacggttctcctcttgtcacgtcgctcatcaacaaggtgctgctgaacggcaagcgctccaccgccgagcgcatcgtctacggcgccatggagggtctgcgtgagaagacgggcaacgacccgatcatcacgctgaagcgcgcgctggagaacatcaagccgaccctcgaggtcaagtcccgccgtgtcggtggcgcgacgtaccaggttccgatcgaggtcaagcccggtcgtgccaacacgctcgccctgcgctggctcgtcggttactcccgcgcccgtcgcgagaagaccatgaccgagcgtctgctcaacgagcttctcgacgcctccaacggccttggtgccgctgtgaagaagcgcgaggacacccacaagatggccgagtccaacaaggccttcgcgcactaccgctgg

SEQ ID NO: 4903 - DNA, 2127 bp, Streptomyces avermitilis
  CDS (1)..(2127)
atggctaccacttcacttgacctggccaaggtccgcaacatcgggatcatggcccacatcgacgcgggtaagacgaccaccaccgagcggatcctcttctacaccggcgtcagctacaagatcggtgaggtccacgacggcgctgccaccatggactggatggagcaggagcaggagcgtggcatcacgatcacctctgctgccaccacctgtcactggccgctcgaggacaacgactacacgatcaacatcatcgacaccccggggcacgtcgacttcacggtcgaggtggagcgctcgctgcgcgtcctcgacggtgccgtcacggtgttcgacggtgtcgccggtgttgagccgcagtccgagacggtgtggcgtcaggccgaccgttacggcgtgccgcgcatctgcttcgtgaacaagctggaccgtaccggcgccgagttccaccgctgtgtggacatgatcaaggaccggctcggtgccgttccgatcatcatgcagctgccgatcggtgccgagatggacttcaagggcgttgtggacctggtccgcatgaaggcgctcgtgtggtccgccgaggcggcgaagggcgagatgtacgacgtcgtcgacatccccgccacgcacgccgaggctgccgaggagtaccgcggcaagctggtcgagaccgtcgcggagaacgacgacgagatcatggagctgttcctggagggccaggagcccaccgaggagcagctgtacgccgcgatccgtcgcatcaccatcgcgtccggcaagggtgacggcgtcacggtcaccccggtgttctgtggcaccgcgttcaagaacaagggcgttcagcccctgctcgacgcggtcgtgcgctacctcccgaccccgcttgacgtcgaggccatcgagggccacgacgtcaaggaccccgaggtcgtggtcaagcgcaagccgtccgaggacgagccgctgtccgccctcgcgttcaagatcatgagcgacccgcacctcggcaagctcaccttcgtccgggtctactcgggccgcctggagtccggcactgccgtgctgaactccgtcaagggcaagaaggagcgcatcggcaagatctaccgcatgcacgcgaacaagcgtgaggagatcgaggcggtgggcgccggcgacatcgtcgccgtgatgggcctgaagcagaccaccacgggtgagacgctttcggacgacaagaacccggtcatcctggagtccatggacttcccggcgccggtcattcaggtcgccatcgagcccaagtccaagggtgaccaggagaagctgggtgtcgccatccagcgtctcgcggaggaggacccctccttccaggttcactcggacgaggagaccggccagaccatcatcggtggtatgggcgagctgcacctcgaggtgctggtcgaccgtatgcgccgtgagttcaaggtcgaggccaacgtcggtaagccgcaggtcgcctaccgtgagacgatccgcaagaccgtcgagcgcgtggactacacccacaagaagcagaccggtggtaccggtcagttcgccaaggtgcagatcgcgatcgagcccatcaccgagaccgatggtccggcgtacgagttcgtgaacaaggtcaccggtggccgtatcccgcgggagtacatcccgtcggtggacgccggtgcgcaggaggccatgcagttcggcatcctcgcgggctacgagatgacgggcgtccgcgtcacgcttctcgacggtgcctaccacgaggtcgactcctccgagctcgcgttcaagatcgccggttcgcaggccttcaaggaggccgcgcgtaaggccagccccgtgctgctcgagccgatgatggccgtcgaggtcaccacgcccgaggagtcgatgggtgatgtcatcggcgacctcaactcccgccgtggccagatccaggccatggaggagcgcagcggcgcccgcgtcgtgaagggcctcgtgcccctctcggagatgttcggctacgtcggcgacctccgcagcaagacctcgggtcgcgcaagctactcgatgcagttcgactcctacgccgaggttccccggaacgtcgccgaggagatcatcgcgaaggccaagggcgag

SEQ ID NO: 4904 - DNA, 1191 bp, Streptomyces avermitilis
  CDS (1)..(1191)
gtggcgaaggcgaagttcgagcggactaagccgcacgtcaacatcggcaccatcggtcacattgaccacggtaagacgaccctcacggccgccattaccaaggtgctgcacgacgcgtaccccgacctgaacgaggcctcggccttcgaccagatcgacaaggctcctgaggagcgccagcgcggtatcacgatctccatcgcgcacgtcgagtaccagacggagacgcgtcactacgcccacgtcgactgccccggtcacgcggactacatcaagaacatgatcacgggtgcggcgcagatggacggcgccatcctcgtggtcgcggccaccgacggcccgatgccgcagaccaaggagcacgtgctcctggcccgccaggtcggcgtcccctacatcgttgtcgccctgaacaaggccgacatggtggacgacgaggagatcctggagctcgtcgagctcgaggttcgtgagctgctctccgagtacgagttcccgggcgacgaccttccggtcgtcaaggtctcggcgctcaaggcccttgagggcgacaaggagtggggccagtccgtcctcgacctgatgaaggccgtcgacgagaacatcccgcagcccgagcgtgacgtcgacaagccgttcctgatgccgatcgaggacgtcttcacgatcaccggtcgtggcacggtcgtcaccggtcgtatcgagcgtggtgtcctcaaggtcaacgagaccgtcgacatcgtcggtatcaagaccgagaagaccaccaccacggtcaccggcatcgagatgttccgcaagctgctcgacgagggccaggccggtgagaacgtcggtctgctcctccgtggcatcaagcgcgaggacgtcgagcgcggccaggtcatcatcaagcccggttcggtcacgccgcacaccgagttcgaggcccaggcctacatcctgtccaaggacgagggtggccgccacacgccgttcttcaacaactaccgtccgcagttctacttccgtacgactgacgtgaccggtgttgtgaccctccccgagggcacggagatggtcatgcccggcgacaacactgagatgaccgttgagctcatccagcccgtcgccatggaggagggcctgaagttcgccatccgtgagggtggccggaccgtgggcgccggccaggtcaccaagatcaacaag

SEQ ID NO: 4905 - DNA, 111 bp, Streptomyces avermitilis
  CDS (1)..(111)
atgacgacgccggccgacgacgcgacgtgccgggcgacgaccgggcgcgagttcagctcggtgaccgcggagaacgtcatgaagtgggaggtgactacagcgtggagggcg

SEQ ID NO: 4906 - DNA, 603 bp, Streptomyces avermitilis
  CDS (1)..(603)
atgagcacacccccgatcaccggcgagcacggcttcctgctcctccacggctggcagaaccgccgccccgccgcccactggcagagctggctcgccgaccgcctcaccgcccggggccacgcggtcacccacccccagctccccgagcccgacgaccccgacctggacacctggctgggcgaactccgcacccacctcaccgcctcgcggccccgcaccgtcgtctgccacagcctcgcctgcctgctgtggctgcacgcggccgcccgcggtctcgtccccgcccccgtggaccgggtgctgctcgtcgccccgccgtccggcagcgtgctcaaggggtacgcggaggtcgcggccttcgctccccctcccgtgacgcccgcgcacctcgccgccgcggccacgtacacccgtctcgtcgccgccgacaacgacccctactgcccggacggcgccgcggccgtgtacgccgaacccctcggcctgcccgtcgacgtcctgcccggcgaggcccacctcgacctggacgcgggctacggctcctggccctcgctcctcgactggtgcctcgacccgtcgaacagcacgcccgtcacgccccgc

SEQ ID NO: 4907 - DNA, 948 bp, Streptomyces avermitilis
  CDS (1)..(948)
atggaaccggtaaggaactccttcacggtcgatctgcgacggctcggtgtgctgcgggaactggagcggcgcgggagcctggcccgtaccgccgaggcgctgcatctgacgccctccgccgtgtcgcagcagctggcggcgctggcccgggaggtgggggtcccgctgatcgtcaggcaggggcgcggggcgcggctgaccgggcaggcgcgggtgctgctggagcacgccgaggtgatggccgcgcagtgggagcgggcccgtgccgatctcgccgcgtgggaggaggggcgccgtggggcggtgacggtcggggcgttctccagcgccgtcagcgggctgctgccaaacgcgctgggccggttggccgagcatcatccgcgggtgcgggtcgcggtggtcgaggccgaacccccggacctgttcacccggctcgacgccggcgaggtcgacatcgcggtggcggtggacttcgcggccgcgccgccccacacggaccgccgctacgcgcgcaccgacctgtcgaccgacgtcctggacctggcgctgccccgggaccacccctgtgcgggccggccggaggtggggctgcgggagctggcgggcgacgcctggatcgtcggggacgcccgcagctgctgcggggcgatcaccaggtcggtgtgcgcggcgaacggcttcacgccggacatccggcacgccgtcaacgactggcagtcgctcgccgcgctcgtcgaggcgggtctgggtgtcgcgctggtcccgcgcctcgcgcagccactgcaccggccgggtctggtcctgcgcaccccggccgggccgtcgcccacgcggcacgtcttcgcggcggtacgggcgggatcggacgacgatccggtgctgactgcggtactggcgagcctgcgggcggcggcagcggcggcagcggcgggccaagccgacaggccc

SEQ ID NO: 4908 - DNA, 2112 bp, Streptomyces avermitilis
  CDS (1)..(2112)
gtgcgattcagggctgtcccgggccaccccatacacaggacgaccgaccccaagggcgggacggccgacaccgagccagggccgcccggccccctgcgcaggacgactcggcgtgccgtactgctcggcggtgccgtcgccgcggttgccgcggcggtcgggtgcgggccctcgcggtcctccggggcagccaccgccgcgccctcccccgcctccggaaagcccgccgtccagggccggcacgccctgctcatgcaggtcctcgcgcaccccgacgacgacctgtacttcatgaacccggacacccagtacgccgtcgccgcgggcgtccccctcgtctgcgtgtacgtcaccgccggtgaggccgacggcgtcaacaagatccccgggcagccgcatccgcccgccgacaaggccgcctactcctcagcgcgccaccaaggcctgcggcagagctatgccgcacagctcgggctccccctcttcaccccgtggaacaagtccgtcgccgcactgcccggcgggcacctcgccgaggtcaactcccttgagaacgaagggcgtcgcgtcgacctggtccatctcaacctggccatgcacacgcccttcgggcacatgggcgtaccggcgctctggcgggagcggggcctcgcgctcggcacggtcgtcgccgacggttcaccgctgagcacggtccagtcgtacgaccacgacggcctcctcgacgtcctcgtcggcctcttcgagcggtaccgccccacgctcgtgcacacgctcgaccccgacccggacatccagcacagcgaccccgtcacccggatccacgacagcgagcagcccggctactccgaccacgccgaccacaccgccgtcgcctccttcacctgggccgcgatggcccgctgggcccggacctccgccggcggcccgccgccgttcgccaccgtcgccttccgcggctactacaaccaccactggcccgacaacctccccccggccgtcctgcgccccaaggccgcccacctggtcccctacggcgccgccccgcactgggagtgcgggaacccggccggctgcggtgactacaacgtgggcggcgagcggccgctgcgcaaccgcaagggctgggtgcgctccacccactaccgctatcccggcccgcggctcgcgctggccgaggaggcggacggccggctgaccgcgtacggcgtgctcgggatgcgcgcggtgcgctggcgcgagacccccgagggcaccttcggcgacgccgtcgacctgggcggcgggccgctcgcgcccgtgctcggtgccgccgccctcgacgacggacggcagctcctgttcgggctgcggctggccgctgtcgaggggcggggcgggccggacgtccgcgagatcgtgctgctcgaacaggccgcccggggcggcggtttccgggcgtggaccgggctcgggaaccccgaaggcgacgacgaccgcggtcgtcgtatcgggacacccgtcgccgtcaccggccgcgacggacgcgtccacctcttcgtacgcaacgccgatcacggcgtcagcacgcgggtgcgcgggcgggacggccgctggtcgccgtggcgggacctcggcggcgggcagatacaggacgggctgaccgccgtcgtcggctcggacggcgaggtgcgtgtgtacgcgcccgggcgcgacaccgtccaccagtggaccccggacgggccggtgacgcccggcacctcggggaccgggtccctgcccgcgccggccgacgcgatagccgtgtccggcgaccgcctctactaccggccgcccgcctcgacgtccctgatagccacggacggtcccaccgtcgtcttccccggctacggtccggtgagtgccgccggctcctacctcctcggccgcggcgtcgacggcgcgctccggctcctgcacgacggccgggccacccgggcggtgccggcgcggaccaccctggacggccccgccctccgcctcacccgccgcggcccggccgcggcgggcctgtccccggacgcccggccctggctgtggcgggcccgccgctcgggcacgggcacgggcgccggatcctccgctcagaaggtc

SEQ ID NO: 4909 - DNA, 306 bp, Streptomyces avermitilis
  CDS (1)..(306)
atggcgggacagaagatccgcatccggctcaaggcctacgaccacgaggtcatcgattcctcggcgaagaagatcgtcgagacggtgacgcgtactggtgcgtcggtcgcgggcccggtgccgctgcccactgagaagaacgtgtactgcgtcatcaagtcgccgcacaagtacaaggactcgcgcgagcacttcgagatgcgcacgcacaagcgcctgatcgacatcctcgacccgacccccaagaccgttgactctctgatgcgactcgacctcccggccggtgtcgacatcgagatcaagctc

SEQ ID NO: 4910 - DNA, 642 bp, Streptomyces avermitilis
  CDS (1)..(642)
atggctaagcagatcaagggcatcctgggcgagaagctcggcatgacgcaggtgtgggacgagaacaaccgtgttgttccggtcaccgtcgtcaaggccggtccgaacgtcgtgacccaggtccgtacgaatgactccgacggctacgagtcggtccagatcgccttcggcgagatcgacccgcgcaaggtgaacaagcccctcaagggccacttcgccaaggccgacgtcaccccccgccgccacctcgtcgagatccgtaccgctgacgccagcgagtacaccctcggccaggagatcaccgccgagaccttcgaggccggcgtcaaggtggacgtgaccggcaagagcaagggcaagggcttcgccggtgtcatgaagcgtcacaacttcaagggcctcggcgccggtcacggcacccagcgcaagcaccgctctcccggctccatcggtggctgcgccaccccgggccgtgtgttcaagggcctccgcatggcgggtcgcatgggcaacgagcgggtcaccacccagaacctgaccgttcacgccgttgacgcggagaagggcctgctcctcatcaagggcgcggttcctggtccgaacggcggcctcgtcctggtccgcactgcggccaagggggcc

SEQ ID NO: 4911 - DNA, 663 bp, Streptomyces avermitilis
  CDS (1)..(663)
atgagcaccattgacattctgtcgccctccggcgacaacgccgggaccgttgagctcccggccgagatcttcgacgtagagaagatcagcatcccgctgcttcaccaggtcgtcgttgcgcagctggccgctgcccgtcagggcacgcacaaggtcaagcgtcgtggcgaggtccgcggtggtggtaagaagccttaccgccagaagggcaccggccgcgcgcgccagggttcgacccgtgcgccgcagttcgccggcggtggcgtcgtccacggccccacgccgcgtgactactcgcagcggaccccgaagaagatgaaggccgcggccctgcgccacgccctcaccgaccgggcccgcaacgctcgcatccacgtcatcaccggcgtgatcgagggcgagaccccctccaccaaggccgcgaagagcttcctcggcaaggtcagcgagcgcaagaacgtgctcctggtcatcgagcgctccgacgaggccgcgctgctttccgcgcgcaacctgccccaggtccacatcctggagccgggccagctgaacacgtacgacgttctcgtctcggacgacgtggtcttcacccaggccgctttcgagtccttcgtgtctggcgcgccgcagtcgtcggctgctgacaccgaagggagcgaagcc

SEQ ID NO: 4912 - DNA, 414 bp, Streptomyces avermitilis
  CDS (1)..(414)
atggctacgcgtcacccgagcattgcctcgaaggccgccaaggccgccaaggccgcgcgcgtcgccaaggcgaagcgccacgaggccgaaggcaagaacaccgtcgagacgccgctgagcaagagcttcacggacccccgtgacgtcctcgtcaagccggtcgtctccgagaagagttacgcgctcctcgacgagggcaagtacaccttcatcgtcgcgcctggcgccaacaagacccagatcaagcaggccgtccaggcggtcttctcggtcaaggtcaccggggtcaacacgatcaaccgccagggcaagcgcaagcgcaccaagagcggtttcggtaagcgcgctgacaccaagcgcgcgatcgtgaccctcgctgagggcgaccgtatcgacatcttcggccaggcctcc

SEQ ID NO: 4913 - DNA, 834 bp, Streptomyces avermitilis
  CDS (1)..(834)
atgggaatccgcaagtacaagccgactacgccgggccgtcgtggctccagcgtcgccgacttcgtcgaggtcacgcggtccacgccggagaagtcgctggtccgcccgctgcacagcaagggcggccgtaacaacgccggtcgtgtgaccgttcgccaccagggtggcggacacaagcgcgcctaccgagtgatcgacttccgtcgtcacgacaaggacggcgtgccggcgaaggtcgcgcacatcgagtacgaccccaaccgcaccgcgcgcatcgcgctgctgcactacgccgacggcgagaagcgctacatcctcgccccgcgcaacctgcagcagggtgaccgcgtcgagaacggtcctggggccgacatcaagccgggcaacaacctggcgctccgcaacatcccggtcggtaccacggtccacgcgatcgagctccgccccggtggcggtgccaagttcgcccgctccgcaggtgcctccgtgcagctgctggcgcgtgagggtgccatggcgacgctccgtatgccgtccggcgagatccgcatggtggacgcgcgctgccgcgccaccgtcggtgaggtcggcaacgccgagcagtcgaacatcaactggggcaaggccggccgtaagcgctggctgggcgtccgcccgaccgttcgcggtgtggcgatgaacccggttgaccacccgcacggtggtggtgagggcaagacctccggtggtcgccacccggtctccccgtggggtcagaaggagggtcgtactcgctcgccgaagaaggcttcgagcaagtacatcgtccgccgccgcaagacgaacaagaagcgc

SEQ ID NO: 4914 - DNA, 279 bp, Streptomyces avermitilis
  CDS (1)..(279)
atgccgcgcagtctcaagaaggggcccttcgtcgacgaccacctgatcaagaaggtggacgcccagaacgaagctggttccaagaacgtcatcaagacctggtcccgtcgctcgatgatcatcccggccatgctcggccacacgatcgcggtgcacaacggcaagacccacattccggtgtttgtcaccgagtcgatggtcggccacaagctcggcgagttctcgccgacgcgcaccttccggggtcacgtgaaggacgaccggaagtcgaagcgccgc

SEQ ID NO: 4915 - DNA, 345 bp, Streptomyces avermitilis
  CDS (1)..(345)
atggaagccagggcccaggcgcggtacatccgcgtcacgcccatgaaggcccgccgcgtggtggaccttatccgtggcatggatgccacggaggctcaggcggtcctgcgtttcgccccgcaggccgcgagcgtgccggtcggcaaggtgcttgacagcgccattgccaacgccgcgcacaactacgaccacaccgacgccgacagcctcttcatctccgaggcgtacgtcgacgagggtccgaccctgaagcggttccggccgcgcgcccagggccgtgcctaccggatccgcaagcggaccagccacatcactgtggtcgtcagcagcaaggaaggaacccgg

SEQ ID NO: 4916 - DNA, 825 bp, Streptomyces avermitilis
  CDS (1)..(825)
atgggccagaaggttaacccgcatgggttccggctcggcatcaccacggacttcaagtcccgttggtacgccgacaagctgtacaaggactacgtcaaggaagacgtcgccatccgtcggatgatgacgtccggcatggagcgcgccggcatctcgaaggttgagatcgagcgcacccgtgaccgcgtgcgggtggacatccacaccgcgcgtcccggcatcgtcatcggccgccgtggcgccgaggccgaccgcatccgcggtgacctcgagaagctcacgggcaagcaggtccagctgaacatcctcgaggtcaagaaccccgagaccgacgctcagctggttgctcaggccgttgccgagcagctgtcctcccgcgtctccttccgccgtgccatgcgtaagagcatgcagtcggcgatgaaggcgggcgccaagggcatcaagatccagtgtggtggccgtctcggcggcgccgagatgtcccgctcggagttctaccgcgagggtcgtgtgcccctgcacacgcttcgtgcgaacgtcgactacggcttcttcgaggccaagacgaccttcggccgcatcggtgtgaaggtctggatctacaagggcgacgtcaagaacatcgccgaggtccgcgccgagaacgccgctgcccgcgccggcaaccgcccggcccgtggtggcgctgaccgcccggcccgtggtggccgcggtggcgagcgtggcggtcgcggtcgtaagccgcagcaggctcccgctgccgaggcccccaaggccgaggctccggctgccgctccggctgagagcaccggaacggaggcc

SEQ ID NO: 4917 - DNA, 417 bp, Streptomyces avermitilis
  CDS (1)..(417)
atgctgatcccccgtagggtcaagcaccgcaagcagcaccacccgaagcgccgcggtcaggccaagggcggtacgcaggtttcgttcggcgagtacggcattcaggccctcacgccggcgtacgtgacgaaccgccagatcgaggccgcccgtatcgcgatgacccgccacatcaagcgtggcggcaaggtctggatcaacatctacccggaccgcccgctcacgaagaagcctgccgagacccgcatgggttccggtaagggttcgccggagtggtggatcgcgaacgtgcacccgggccgggtcatgttcgaactgtcctaccccaacgagaagatcgcccgtgaggccctcactcgcgcagcccacaagctgccgatgaagtgccggatcgtcaagcgcgaggcaggtgaagcg

SEQ ID NO: 4918 - DNA, 222 bp, Streptomyces avermitilis
  CDS (1)..(222)
atgtcggccggtaccaaggcgtccgagctgcgcgaactgggtgacgaggagcttctcgcgaagcttcgcgaagccaaggaagagctgttcaacctccgcttccaggcggcgaccggtcagctcgagaaccacggtcggctcaaggccgtccgcaaggacatcgcgcggatctacaccctgatgcgtgagcgcgagctgggcatcgagacggtggagagcgcc

SEQ ID NO: 4919 - DNA, 282 bp, Streptomyces avermitilis
  CDS (1)..(282)
atgagcgagagcaacgtgactgagaccaacgagcagcgcggtttccgcaagacccgtgagggtctggtcgtcagcgacaagatggacaagaccgtcgtcgtcgctgtcgaggaccgcgtcaagcacgcgctgtacggcaaggtcatccgccgtacgaacaagctcaaggcccacgacgagcagaacgccgccggcgtcggcgaccgtgtcctcctcatggagacccggccgctgtctgcgacgaagcgctggcgcgtcgtcgagatcctcgagaaggccaag

SEQ ID NO: 4920 - DNA, 366 bp, Streptomyces avermitilis
  CDS (1)..(366)
gtgatccagcaggagtcgcgactgcgtgtcgccgacaacactggtgcgaaggagatcctttgcatccgtgtgctcggtggctccggtcgccgctacgcgggcatcggtgacgtcatcgtcgccaccgtcaaggacgcgatcccgggcggcaacgtgaagaagggtgacgtcgtcaaggctgtcatcgttcgcaccgtcaaggagcgccgccgtccggacggctcgtacatccgcttcgacgagaacgccgccgtcattctgaagaacgacggcgaccctcgcggcacccgtatcttcggccctgtcggccgtgagctgcgcgagaagaagttcatgaagatcatctcgctcgcgccggaggtgctg

SEQ ID NO: 4921 - DNA, 321 bp, Streptomyces avermitilis
  CDS (1)..(321)
atgaagatcaagaagggtgacacggttcaggtcatcaccggcaaggacaagggcaagcagggcaaggtcattgccgcttacccgcgcgacgagcgcgtcctggtcgagggtgtcaaccgggtcaagaagcacacgaaggccggccccaccgccggcggttcgcaggccggcggcatcgtgaccaccgaagcccccattcacgtgagcaacgttcagctcgtcgtggagaaggacggcaacaaggtcgtcacgcgcgtcggttaccgcttcgacgacgagggcaacaagatccgcgttgccaagcggacgggtgaggacatc

SEQ ID NO: 4922 - DNA, 555 bp, Streptomyces avermitilis
  CDS (1)..(555)
atggctaccaccaccactccgcgtctcaagacgaagtaccgcgaggagatcgcgggcaagctgcaggaagagttctcgtacgagaacgtcatgcagaccccgggcctcgtcaagatcgtggtcaacatgggtgtgggcgacgccgcccgcgactccaagctgatcgatggcgcgattcgcgacctcaccacgatcaccggtcagaagccggccgtcaccaaggcccgcaagtccatcgcgcagttcaagctgcgtgagggtcagccgatcggtgcccacgtcacgctccgtggcgaccgcatgtgggagttcctggaccgcaccctgtcgctcgcgctcccgcgcatccgcgacttccgtggtctgtcccccaagcagttcgacggccgtggcaactacaccttcggtctcacggagcaggtcatgttccacgagatcgaccaggacaagatcgaccgcgtccggggtatggacatcaccgtggtgaccacggcgaccaacgacgctgagggccgtgcccttctccgtcacctcggcttccccttcaaggaggcg

SEQ ID NO: 4923 - DNA, 183 bp, Streptomyces avermitilis
  CDS (1)..(183)
atggcgaagaaggctctgattgccaaggctgctcgtaagcccaagttcggtgtgcgtggctacacgcgctgccagcgctgcggtcgtccgcactccgtgtaccgcaagttcggcctgtgccgcgtctgccttcgtgagatggctcaccgtggcgagctgccgggcgtgaccaagagctcctgg

SEQ ID NO: 4924 - DNA, 396 bp, Streptomyces avermitilis
  CDS (1)..(396)
atgaccatgactgatccgatcgcagacatgcttacgcgtctgcgtaacgcgaactcggcgtaccacgacaccgtgggtatgccgcacagcaagatcaagtcgcacatcgcggagatcctccagcaggagggcttcatcacgggctggaaggtcgaggacgccgaggtcggcaagaacctcgtcctcgagctgaagttcggcccgaaccgtgagcgctccatcgcgggcatcaagcggatctccaagcccggtctccgggtgtacgcgaagtccaccaacctgcccaaggtgctgggcggcctcggcgtggcgatcatctccacgtcgcacgggctcctcaccgacaagcaggccggcaagaagggcgtaggcggagaagttctcgcctacgtctgg

SEQ ID NO: 4925 - DNA, 537 bp, Streptomyces avermitilis
  CDS (1)..(537)
atgtcgcgtattggcaagctccccatcacggttcccgccggcgtggacgtcaccatcgacggccgtacggtccaggtgaagggccccaagggctctctctcccacaccattgcggcgccgatcgagatcgctaagggcgaggacggcgttctgaacgtcacccgcccgaacgacgagcgtcagaacaaggccctccacggcctgtcccgcacgctggtggcgaacatgatcaccggcgtgacccagggttacgtgaagaagctcgagatcagcggtgtcggttaccgcgtcctggcgaagggctccaacctggagttctcgctcggctacagccactcgatcaccgtcgaggcccccgagggcatcaccttcaaggtggaggcccccactcgtttctcggtcgagggcatcgacaagcagaaggtcggcgaggttgcggccaacatccgcaagctgcgcaagcccgacccgtacaaggccaagggcgtcaagtacgaaggcgaagtcatccgccgcaaggtcggaaaggcgggtaag

SEQ ID NO: 4926 - DNA, 381 bp, Streptomyces avermitilis
  CDS (1)..(381)
atggcatacggtgtcaagattgctaagggcgacgcttacaagcgtgctgccatcaagcgtcgtcacatccggatccgtaagcacatctcgggtacggctgagcgtcctcgcctggtcgtgacgcgctccaaccgccacatcgtggcccaggtcatcgacgacgttaagggtcacaccctcgcgtcggcgtcgaccctggacacgacgatccgcggcggcgagagcgacaagtcggcgcaggccaagtcggtcggcgccctggtcgccgagcgtgccaaggccgccggtgtcgaggctgtcgtattcgaccgtggtggaaaccagtacgccgggcgcattgccgctctggcggacgccgcccgcgaagccggactcaagttc

SEQ ID NO: 4927 - DNA, 603 bp, Streptomyces avermitilis
  CDS (1)..(603)
atggctggaccccagcgccgcggaagcggtgccggtggcggcgagcggcgggaccggaagggccgtgacggcggcgctgctgccgccgagaagaccgcgtacgttgagcgcgtcgtcgcgatcaaccgcgtcgccaaggttgtgaagggtggtcgtcgcttcagcttcaccgcgctggtcgtggtgggcgacggtgacggcaccgtaggtgtcggttacggcaaggccaaggaggtgccggccgccatcgccaagggtgttgaggaggccaagaagcacttcttcaaggtcccccgtatccagggcaccatcccgcacccgatcacgggcgagaaggccgcgggcgtcgtcctgctcaagcctgcttcccccggtaccggcgttatcgccggtggcccggtgcgtgcggttctcgagtgcgccggcgtgcacgacatcctgtcgaagtcgctcggctcgtccaacgcgatcaacatcgtgcacgcgaccgtggcggccctcaagggtctgcagcgtcccgaggagatcgcggctcgccgtggtctgcccctcgaggacgtcgcccccgcggctctcctgcgtgcacgtgcgggagcgggtgcg

SEQ ID NO: 4928 - DNA, 180 bp, Streptomyces avermitilis
  CDS (1)..(180)
atggctcagctcaagatcacgcagacgaagtcgtacatcggcagcaagcagaaccaccgcgacaccctgcgttcccttggtctcaagggcatcaacacgcaggtcgtcaaggaggaccgccctgagttccgcggcatggtgcacaccgtccgccacctcgtgacggttgaggaggtcgac

SEQ ID NO: 4929 - DNA, 453 bp, Streptomyces avermitilis
  CDS (1)..(453)
atggcggagaacaacccgctcaagatccacaacctccgtcccgccccgggcgccaagaccgcgaagacccgtgtgggccgtggtgaggcgtcgaagggtaagacggccggtcgtggtaccaagggcacgaaggcccgttaccaggttccggagcgcttcgagggtgggcagatgcccctccacatgcgcctcccgaagctgaagggcttcaagaacccgttcaggaccgagtaccaggtcgtgaacctcgacaagctgacggcgctgtacccggagggtggcgaggtcaccgtcgagggtctcgtcgccaagggtgccgttcgcaagaacagcctcgtcaaggtcctcggccagggcgagatctccgtggcgctgcaggtgacggtcgacgccgtctccggctccgccaaggagaagatcaccgccgccggcggtaccgtcaccgagctcgtc

SEQ ID NO: 4930 - DNA, 1314 bp, Streptomyces avermitilis
  CDS (1)..(1314)
gtgctcaccgcgttcgcccgggcgttcaggacgcccgacctgcgcaagaagctgctcttcacgctcgcgatcatcgtcgtgtaccgcctcggtacgcacattccgatcccgggcgtcgactacaagaacgtccagacctgcatcgactcagcgtcgaagggcaaccagggcctgttcggtctggtcaacatgttcagtggtggcgcgctgctgcagatcacgatcttcgcgctcggcatcatgccgtacatcacggcgagcatcattctgcagctgctgaccgtggtgatcccgcgtctcgaagccctcaagaaggagggacaggcgggaaccgcgaagatcacgcagtacacccgttatctgacggtcgccctggccatccttcagggcaccggcctggtggcgaccgctcgcagcggggcgctgttcggcacctgcccggtgggcaaccagatcgtccccgaccaggggatcttcaccaccatcacgatggtcatctgcatgaccgccggtacggctgtcgtgatgtggctcggtgagctcatcaccgaccgcggtatcggcaacggcatgtcgatcctgatgttcatctcgatcgccgcgagcttcccgtccgcgctgtgggcgatcaagcagcagggctcgctggccgacggctggatcgagttcggcaccgtcatcgcggtcggcctggtcatggtcggtctggtggtcttcgtcgagcaggcccagcgccgtatcccggtgcagtacgcgaagcgcatgatcggccgccggtcctacggcggtacgtccacctacatcccgttgaaggtgaaccaggcaggtgtgattcctgtcatcttcgcgtcgtcgctgctctacattcccgccctgatcgcgcagttctccaaggacacctccggctggaagagctggatcgaacagaacctgaccaagggcgaccacccgatttacatcacggcttacttcctgctgatcgttttcttcgcgttcttctacgtggcgatctcgttcaaccccgaggaagtcgcggacaacatgaagaagtatggtggcttcatcccgggcatccgggctggccgaccgaccgctgagtacctcagctacgtgctcaaccggatcacctggccgggttcgctgtatctgggtctgatcgctctcgtaccgacgatggcgttggttggcttcggggcaagccagaacttcccgttcggtggtaccagcatcctgatcatcgtgggtgtgggcctcgagacggtgaagcagattgagagccagcttcagcagcgcaattacgaagggttcctccgc

SEQ ID NO: 4931 - DNA, 660 bp, Streptomyces avermitilis
  CDS (1)..(660)
atgcgaatcgtcctcgtcgggccgccgggtgcagggaagggaacgcaggccgcgttcctcgccaagaacctgggaatcccgcacatctccacgggcgacctcttccgggccaacatcagccagcagaccgagctcggcaagctggccaagtcctacatggacgagggcaacctggtgccggacgaggtcaccatcgcgatggccaaggaccgcatggagcagcccgacgcggtgaacggcttcctcctcgacggcttcccgcgcaacgtcaagcaggccgaggcgctggacgagatgctgaagtccgagggcatgaagctggacgccgtgctggacctggaggtccccgaggacgaggtggtcaagcgcatcgccggccgccgcatctgccgcaacgactcggcgcacgtcttccacgtctcgtacaagccgccgaagcaggaaggcgtctgcgacgtctgtggcggcgagctgtaccagcgtgacgacgactccgaggagaccgtccgccggcggctggaggtctaccacacgcagaccgagccgatcatcgactactaccgggcgcagggcctggtcgtgacgatctcggcgctcggtccggtggaagaggtcacccagcgcgcgatggacgcactcaagcgcgaggacgccagcaag

SEQ ID NO: 4932 - DNA, 834 bp, Streptomyces avermitilis
  CDS (1)..(834)
atggtgcagatcaagacccccgagcagatcgccaagatgcgtgaggcggggctggtcgtggccgccgtccatgcggccaccagtgaggcggccgtgcccggcgccaccacgaaggacctggacgaggtcgcccgcaaggtgctcgcggagcacggtgccaagtcgaacttcctcggctacggcggcttccccgccacgatctgcacctcggtcaacgaggtcgtcgtccatggcatcccggacgacaagaccgtcctgaaggacggcgacgtcatctccatcgacgcgggcgcgatcatcgacggctggcacggcgacgccgcctacaccgccttcgtgggttccggccacgctccggagctggtcgagctctcccgggtggcggaggagtcgatgtgggcgggcatcgcggcgatgaagcagggcaaccgcctggtcgacgtctcccgtgccatcgagacgtacatccgccgccagccgaagccgggcggcggcaagtacgggatcgtcgaggactacggcggccacggcatcggcaccgagatgcacatggacccgcacctgctgaactatgtggagcgccggcgcggcaagggtccgaagctggtgcccggcttctgcctggcgatcgagccgatggtgtccctcggcacaccgaagaccgaggtgctcgaggacgactggaccgtcatcaccaccgacggcacgtggtcctcgcactgggagcactcggtggcgctgacggaggagggcccgctggtcctcaccgcccccgacggcggcaaggccaagctcgcggagtacgggatcacggcggcgccggacccgctcgca

SEQ ID NO: 4933 - DNA, 219 bp, Streptomyces avermitilis
  CDS (1)..(219)
gtggccaagaagcaaggtgccatcgagatcgagggcactgtcgttgagtctctgccgaacgccatgttcaaggttgagctccagaacggccaccaggttctggcacacatcagcggcaagatgcgtatgcactacatccgcatcctccctgacgaccgggtcgtggtggagctgtctccgtacgacctgacgcgtggccggatcgtctaccggtacaag

SEQ ID NO: 4934 - DNA, 111 bp, Streptomyces avermitilis
  CDS (1)..(111)
atgaaggtcaagccgagcgtcaagaagatctgcgacaagtgcagggtgatccgccgtcacggccgggtcatggtcatctgcgacaacccgcgccacaagcagcgccagggc

SEQ ID NO: 4935 - DNA, 378 bp, Streptomyces avermitilis
  CDS (1)..(378)
atggcacgcgtttccggtgttgacatcccgcgtgaaaagcgcgtggaggttgccctcacctacgtgttcggcatcggccggaccctctcgcagaagacgctggccgagaccggcgtcaacccgaacacccgcgtccgtgacctctccgaggaggagctggtccggatccgcgagtacgtggacaacaacttcaagaccgagggtgacctccgtcgcgaggttcaggccgacatccgccgcaaggtggagatcggttgctaccagggtctgcgtcaccgccgtggcctgcccgttcacggtcagcgcaccagcacgaacgcgcgtacccgcaagggcccgcgtcgcgccatcgccggtaagaagaagccgggcaagaag

SEQ ID NO: 4936 - DNA, 402 bp, Streptomyces avermitilis
  CDS (1)..(402)
atgccccccaagggtcgtcagggcgctgccaagaaggtgcgccgcaaggaaaagaagaacgtcgctcacggccacgcgcacatcaagagcacgttcaacaacacgatcgtctcgatcacggacccctcgggcaacgtgatctcctgggcctccgccggccacgtcggcttcaagggctcgcgcaagtccacccccttcgccgcgcagatggccgccgagtcggccgcccgccgcgcgcaggagcacggcatgcgcaaggttgacgtcttcgtcaagggtccgggctccggccgcgagaccgcgatccgttccctccaggccactggcctcgaggtcggctccatccaggacgtcacccccaccccgcacaacggttgccgtccgcccaagcgccgccgcgtc

SEQ ID NO: 4937 - DNA, 1020 bp, Streptomyces avermitilis
  CDS (1)..(1020)
atgctgatcgctcagcgtccctcgttgaccgaagaggtcgtcgacgaattccgctcccggttcgtgatcgagccgctggagccgggcttcggttacaccctcggcaactccctgcgtcgtacgctcctctcctcgatcccgggtgcggcggtcacgtccatccgcatcgacggcgttctgcacgagttcaccaccgtgccgggtgtcaaggaggacgtcaccgacctcatcctcaacatcaagcagctggtcgtctcctcggagcacgacgagccggtcgtgatgtacctgcgcaagcagggtccgggtctggtcaccgccgccgacatcgcgcccccggccggtgtcgaggtgcacaaccccgacctcgtcctcgccacgctcaacggcaagggcaagctggagatggagctgaccgtcgagcgcggtcgcggctacgtctccgccgttcagaacaagcaggtcggtcaggagatcgggcgcatcccggtcgactcgatctactcgccggtgctgaaggtcacgtacaaggtcgaggcgacccgtgtcgagcagcgcaccgacttcgacaagctgatcgtcgacgtcgagaccaagcaggccatgcgtccccgtgacgccatggcgtcggccggtaagaccctggtcgagctgttcggtctggcccgcgagctcaacatcgacgccgagggcatcgacatgggcccgtccccgacggacgccgccctcgccgccgatctggcgctgccgatcgaggagctggagctcaccgttcggtcgtacaactgcctcaagcgtgagggcatccactccgtgggtgagctcgtcgcccgctccgaggccgacctcctggacatccgcaacttcggtgcgaagtccatcgacgaggtcaaggcgaagctggccggcatgggcctggccctcaaggacagcccgcccggattcgacccgaccgccgccgccgacgcctttggcgctgacgacgacgcggacgccgggttcgtcgagaccgagcagtac

SEQ ID NO: 4938 - DNA, 501 bp, Streptomyces avermitilis
  CDS (1)..(501)
atgccgaagcccaccaagggtgcccgtctgggcggcagcgccgcgcacgagaagctgctcctcgcgaacctcgcgaagtcgctcttcgagcacggccgcatcaccaccaccgaggcgaaggcccgccgcctgcgcccgtacgccgagcgtctggtcaccaaggcgaagaagggtgaccttcacaaccgccgccaggtgctccaggtgatcacggacaagagcgtcgtgcacacgctcttcaccgagatcggcccgcgctacgagaaccgtcccggtggctacacccgcatcaccaagatcggtaaccgccgtggcgacaacgcgcccatggctgtcatcgagctggtcgaggcgctgacggtcgctcagcaggccacgggtgaggccgaggccgccaccaagcgttccgccaaggacgccgaggccaagaccgaggctcccgccgaggtcgtcgaggacaccaagccggccgacgaggccgccgaggagtcgaaggacgcc

SEQ ID NO: 4939 - DNA, 855 bp, Streptomyces avermitilis
  CDS (1)..(855)
gtgagtgatgaagtacagcccgggttcgtacgggtgcggctggacctgtcgtacgacgggaccgagttctcggggtgggccaagcaggccgcggggcgccggaccgtacagggcgagatcgaggatgcgctgcggacggtgacgcggtcgggcgagaccacgtacgagctgaccgtcgccggacgcaccgacgccggtgtgcacgcgcgggggcaggtggcgcatgtcgatctgcccggggagctgtgggccgagcatcaggagaagctgctcaagcggctcgcggggcgactgcccaaggatgtgcgggtgtggtcgctgaccgaggcgcccagcgggttcaacgcgcggttctcggccatctggcggcgctacgcctaccgcgtcaccgacaacaccggcggcgtcgacccccttctgcgcagtcacgtcctctggcacgactggccgctcgacgtcgacgccatgaacgaggccgcccgacggctcgtcggggagcacgacttcgccgcctactgcaagaagcgcgagggcgcgaccaccatccgtacgctccaggagctgagcctcgtgcgcggcgacgacggggtcatcaccgccaccgtgtgcgccgacgcgttctgccacaacatggtgcgctcgctgatcggggcgctgctgttcgtgggggacgggcaccgcgggcccgactggccggggaaggtgctcgccgtgggtgtgcgcgactcggccgtgcatgtcgtacggccgcacgggctgacgctcgaagaagtcggctaccccgccgacgagctgctggccgcgcgcaacaaagaggcacggaacaagcggacactgcccgcggcggggtgctgc

SEQ ID NO: 4940 - DNA, 885 bp, Streptomyces avermitilis
  CDS (1)..(885)
atgcggcccatgagctatgggcagggggagcccccgtgggatccctggaaaccgggttcccagcaaccacagtggggcaaccagaccgatcagactccggactgggcggcgctcgccgaagcgtccgagtcgcgcaacaaacgccgtcgactgctgctgatcgtcggcggtgccttcgccacggtcgcgatcggtgccgccgtggcggtggccgtggtgtccgccaatgacggcaccgaggcctcgaacaagcccgccaacctgccggccacggcggacatcccgagcagcagcaccgctccggccccgtcgttcgacccgacgacggccccacccccgctggatccgaaggacttcatctccagcgccaagaaggacacggccccgctcagcccggacatcctcttcccgagcaccgagctgacgatcggcggccgcgcctaccagaagggcgccacggcctccacgacgaactgcgcgtcggccgtgcagggcacgcttccgcaggccctcaccagcaacggctgcacccgcgtcatgcgcgtcacctactccggcaagggcggcgtggcggtgacggtgggcgtggccgtcttcgacaccgaggccaaggcgagcaaggcgaagaccgcggcggacaacaagagcatcatcacctcgctgcccggccagggcgtcgccgccttctgccgtacggcggtctgccgctcgaccaccaatgcctacggccgctacgcctacttcacgctggccggcttcacgaacggcaaggacgtgacggagaaggacgccgcggtcttcacgaccggcgacgacctcgccgagtacacgttccgccagatccgccagcgcggcgaggcccaggcctcggcggccgccaacaag

SEQ ID NO: 4941 - DNA, 441 bp, Streptomyces avermitilis
  CDS (1)..(441)
gtgcgtacgtacagccccaagcccggcgacattactcgccagtggtacgtcatcgacgcccaggatgtcgtcctgggccgtctggcgaccactgccgcgaacattctgcggggcaagcacaagccgatctatgcgccgcacgtcgacgctggtgacttcgtcatcatcatcaacgcggacaaggtccacctctccggcaacaagaagacccagaagctggcgtaccgccactccggttacccgggtggtctgcgctccgtccgttacgacgagctgctggcgaagaaccccgagaaggccgtcgagaaggccatcaagggcatgatccccaagaacaccctgggccgtcaggtgctctcgaagctgaaggtctactcgggcgaccagcacccgcacgctgcccagcagccggtgccgttcgagatcacccaggtcgcgcag

SEQ ID NO: 4942 - DNA, 519 bp, Streptomyces avermitilis
  CDS (1)..(519)
gtggccgagaccaccgttgagcagccggtcgaagagaccgaggttgtcgacatcgagagctacaccaccgagtccgaggtccccgtcgagggcgagtacacctccgagtcggtggcgtcccgcttcggcgagccgcagccggccgccggcctgggccgtcgcaagaacgccatcgcccgcgtccggatcgtcccgggcaccggcaagtggaagatcaacggccgcacccttgaggactacttccccaacaaggtgcaccagcaggaagtcaacgagcccttcaaggtgctcgagctcgagggccgctacgacgtcatcgcccgtatctcgggtggcggtgtctccggtcaggccggtgcgctccgtctgggtgtcgcccgtgcgctgaacgaggccgacgtcgacaacaaccgcggcgcgctcaagaaggccggcttcctcaagcgcgacgaccgtgcggtcgagcgcaagaaggccggtctcaagaaggcccgtaaggccccgcagtacagcaagcgc

SEQ ID NO: 4943 - DNA, 1356 bp, Streptomyces avermitilis
  CDS (1)..(1356)
gtgggacgactcttcggcacggacggcgtgcgcggtgtcgccaacgcggatctgacggctgagctcgcgctcggcctctctgtcgcggcggcacacgtactggccgaggcgggcacgttcgagggccaccggccggtggcggtcgtcgggcgggatccgcgcgcgtccggggagttcctggaggccgccgtggtcgcgggcctggccagcgcgggcgtggacgtcctgcttgtcggtgtgctgcccacccccgcggtggcgcacctcaccggcgcgctgggcgccgacctcggcgtgatgctctccgccagccacaacgccatgccggacaacggcatcaagttcttcgcccgtggtggtcacaagctggccgacgatctcgaggaccggatcgaggccgtctacgaggagcaccgcaccggcgctccctgggaccggcccaccggtgcgggcgtcggccgcgtgacgtcgtacggcgaaggcgccgaccagtacgtcgcccatctgatgagcgtgcttccgaaccggctcgacgggatcaaggtcgtcctcgacgaggcgcacggtgccgccgcccgggtctcgcccgacgcgttcacgcgggccggggccgagatcatcacgatcggtgccgagccggacgggctcaacatcaacgacggctgcggctccacgcacctggcgaagctccgggccgctgtcgtcgagcacggcgccgatctcggtatcgcgcacgacggtgacgccgaccgctgcctcgccgtggaccacactggtgccgaggtggacggcgaccagatcctggccgtactcgcgctggcgatgcgggagcgttccgcactgcgctccgacaccgttgtcgcgacggtcatgtccaacctgggcttcaagctggccatggaacgcgaggggctgtccttcgtgcagaccgcggtcggcgaccgctacgtcctggaggagatgaaggagcacggctacgccctcggcggcgagcagtccgggcacgtcatcatcctggaccacgcgaccaccggtgacggcacgctgaccgggctgctgctggcggcgcgggtcgcgcagacgggccgtacgctccaggacctcgcgtccgtcatggagcggctgccgcaggtgctcgtgaatgttccggacgtcgacagggcgcgggtgaagacctccgccgagctggccaccgcggtggccgaggccgagcgtgaactgggtgccaccgggcgggtgttgctgcgtccgtcggggaccgagccgctggtgcgggtcatggtggaggcggctgacatcgagcaggcgcggtcggtcgcggggcggctcgccgacgcggtgaagtccgcgctcggg

SEQ ID NO: 4944 - DNA, 951 bp, Streptomyces avermitilis
  CDS (1)..(951)
atgctgcacctgcgtctgatcaccccgtccggcacgaccgacgacgtggtccgtctgatcgagagcacggtcggcaccacccacctggtcgtgctgccgggcgccgcccgcaaccccgcgggagatgtcgtgatgtgcgacgtcgcccgcgaggccggcgacgaactgatcgccgggctccgccggttgggcctcgacaggaccggctcgatcgccgtcgagaacatcgacctgtcgctgtcgaagcgcgccgccgacgcggaggacgaggcaccgggcgagggcgcggacgcggtgctgtgggagcacctggagggcgcgacgcacgaggagtcgacgctgtcgataacgtacgtcgccttcctcacgctcgccacgatgatcgcggcctgcggggtcgtcctcgacaacgcgatcctgatcgtgggcgcgatggcggtgggcccggagttcggcccgctggcgggcttctgcacggccctggtccagcgggccccgcgcctcgccctgcgctcgctggtcgcgctcctggtgggcttcgcggtcgccctgctggtaacggtcggcttcacgtacctcatggacgcggtggacctgttcagcgcggtcaagctggacgccgagcgcccgaacaccaacttcatctaccggcccgacgcgttctccttcgtcgtggccgtcctcgcgggcgtcgccggcaccctctccctcacctcggcgaagtcgggggccctggtcggcgtggcgatctcggtgaccacggtcccggccgcctcgaacgccgcggtcgccttcgcgtacggcgagtaccaccaggcctggggctccaccgagcaactgctcctgaacctgctcgggatcgtcctcgcgggcaccctcaccctgctggcccagaagtacttctggaccaggcagcggcagcgccacaacgccggtcggccgagcacccct

SEQ ID NO: 4945 - DNA, 987 bp, Streptomyces avermitilis
  CDS (1)..(987)
gtgatctctccggtctcctcgataccccggagcgcccaccggtccaggccggaggcgactccctacctcgacctcacccgtgccgagtggagcgctctgcgcgaaaagacgccgctcccgctgaacgccgaggaggtcgagaagctgcgcggcctgggcgacgtcatcgacctcgacgaagtacgggacatctatctgccgctgtcgcgcctcctcaatctgtacgtgggagcgaccgacggcctgcgcggcgcgctgaacaccttcctcggcgagcagggctcccagtccggcaccccgttcgtcatcggggtcgccggctcggtggcggtcgggaagtccaccgtcgcccgccttctccaggccctcctgtcccgctggcccgaacacccgcgcgtcgaactggtgacgacggacgggttcctcctccccaccaaggagctcgaggcccgcggcctgatgtcgcggaagggattccccgagtcgtacgaccgccgcgcgctcacccgcttcgtcgccgacatcaaggcgggcaaggacgaggtgacggccccggtctactcccacctgatctacgacatcgtccccggccagaagctcacggtccgccgcccggacatcctgatcgtcgagggcctgaacgtgctccagcccgccctgccgggcaaggacggccgcacccgcgtcggactcgccgactacttcgacttcagcgtgtacgtcgacgcccgccccgaggacatcgagcgctggtacctgaaccgcttccgcaagctgcgcgccaccgccttccagaacccgtcctcgtacttccgcaggtacacccaggtctccgaggacgaggcgctcgactacgcgcgcacgacctggcggaccatcaacaaggtgaacctgctggagaacgtggccccgacccgcggccgggccgccctcgtcgtccgcaagggccccgaccacaaggtgcagcgcctgagcctgcgcaaactg

SEQ ID NO: 4946 - DNA, 255 bp, Streptomyces avermitilis
  CDS (1)..(255)
gtggcttctgccatgcgtatccgtgatgtgcacatccgcgatctgttacgccgtacacccgcgtgcccgcagcccgatctcgccggaaaggtgtgcagcgaactcgccaccgatctgccggacgaggatctcggggaggacctcaacgactgtctcgccctgtacgagctgggcagcaagccgcgctgcgaggaggtcgagtacctcggcatggtgcaggacgcgatcgaccggatcgcgcgtggggaccgggag

SEQ ID NO: 4947 - DNA, 1845 bp, Streptomyces avermitilis
  CDS (1)..(1845)
atgtgcggaatcgtgggatacgtggggtcgcagtcggcgctcgatgtcgtgatggccggactgaagcggctcgagtaccgggggtacgactcggcgggcgtcgccgtgccggcggacggtgggatggcggccgccaagaaggccggcaagctggtcaatctggagaaggaactggtcgaacggccgctgccggccggtacgacgggcatcgggcacacccggtgggccacgcacggggggccgacggacgccaacgcgcatccgcacctcgacaacgcgggccgcgtcgccgtcgtgcacaacgggatcatcgagaacttcgccctgctgcgggccgagttggccgagcggggccacgacctcgcctccgagacggacaccgaggtcgtcgcgcatctgctcgccgaggagttctcggcgagcgccgatctggcggaggcgatgaggctggtgtgccggcgcctggagggcgcgttcacgctggtcgcggtgcacgccgatgagccggacgtggtcgtgggggcccggcggaactcgccgctcgtggtgggcgtcggggacggcgaggccttcctcgcctcggacgtggccgcgttcatcgcccacacgcggtcggcgatcgagctgggccaggaccaggtggtggagctgcgccgggacggggtgacggtcaccggtttcgacggccgacccgccgacgtgcgctcctatcacgtcgactgggacgcctcggcggcggaaaagggcggctacgactacttcatgctcaaggagatcgccgagcagcccaaggcggtcgccgacacgctcctgggccgtatcgacgcggccggctcgctgacgctcgacgagctgcggatctcggccgccgagctgcgcgaggtcgacaaggtcgtgatcgtggcgtgcggtacggccttccacgccgggttgatcgccaagtacgccatcgagcactggacgcggatcccgtgcgaggtcgagctggcgagcgagttccgctaccgggacccgatcctgggcgcgcgctcgctggtcatcgccatctcgcagtccggcgagaccatggacacgctgatggcgctccggcacgcccgcgagcagggctccaaggtgctggcgatctgcaacaccaacggctcgacgatcccgcgcgagtcggacgcggtgctgtacacgcacgccgggcccgaggtcgcggtggcgtccacgaaggcgttcctgacgcagctcgtcgcctgctatctggtggcgctgtacctgggccaggtgcggggcaccaagtggggcgacgagatccaggccgtgatccgcgacctgtcccggatctcgaacgaggtcgagcgggtcctggagaccatggagccggtgcgggagctggcgcgctcgctcgccgacaagaagacggtgctgttcctggggcggcacgtgggttatccggtggccctggagggcgccctgaagctcaaggaactcgcctacatgcatgccgagggcttcgcggcgggcgagctgaagcacgggccgatcgcgctgatcgaggaggatctgccggtggtggtcgtggtgccgtccccgcgcggacggtccgtgctgcacgacaagatcgtctccaatatccaggagatccgggcgcggggtgcgcgcacgatcgtgatcgcggaggagggcgacgagacggtggtgccgtacgccgaccatctgatccggatcccggcgacgcccacgctccttcagccgctcgtcgccacggtgccgctccaggtcttcgcgtgcgagctggcgacggcgcgcggcaacgaggtggaccagccgcggaacctggcgaagtcggtcaccgtggag

SEQ ID NO: 4948 - DNA, 369 bp, Streptomyces avermitilis
  CDS (1)..(369)
atgagcattatcggggtcggtatcgacgtggcggagatcgaccggttccgggcgtcgctggaacggacgcctggactggccgaccgcctgttcctggaacgggagttgctgctcccgaacggcgaacgccggggcatcgcctccctcgcggcccggttcgcggcgaaggaggcggtcgccaaggccctcggcgcccccgggggcctgtactggaccgacgcggaggtctgggtcgaggacagcggccggccgcggctgcgcgtgacgggcacggtcgcggcacgggccgccgaactcggcgtgcagtcctggcacgtgtcgctgagtcatgacgcgggggtggcttcggcggtggtggtggccgagggg

SEQ ID NO: 4949 - DNA, 1428 bp, Streptomyces avermitilis
  CDS (1)..(1428)
atgcgtactgcgtacagcgtggagacggtgaggtcggcggagcgttcgctcatggcgaggcttccggagggggcgctgatgcagcgcgccgccgcgggactggccgcggcctgcgcccagttgctcggccgggtgtacgggcggcggatcgtgctgctggtgggcagcggggacaacggcggggacgccctgtatgccggagcccggctggcccggcgcggagcgggtgtcacggcggtgctgctcgcggccgggcgcgcccacgcctcagggctggcggcgctgcgccgggcgggcggcagcgtgacggggaccggccccgccgaggagctgatccggcgggccgacctcgtggtcgacggcatcgtcggcatcggcggcaagggcggactgcggccggacgccgcgctcctggccgagtccgtcgagcggtccggggcggccgtcgtcgccgtcgacctgcccagtggcgtcgacgccgacaccggcgaggtgccgggcgcggccgtgcgggccgacctgaccgtgaccttcgggacgcacaagccggggctgctcatcgatccggcgcgggagtacgccggttccgtgcggctcgtggacatcgggctcgaactgcccgacgggcccgacctggaggcgttgcagcacgcggacgtggcgcggctgctgccggtgccgggggccgagagcgacaagtaccggcggggtgtcgtcgggatcgcggccgggtcggcgcggtacccgggcgcggccgtgctcgccgtggccggcgcgctgcgcggcggggcgggtgccgtgcggtacgtcgggccggccggggacgccgtgctcgcccgcttcccggagacgctcgtgtccgacaaggggccgaagcaggccgggcgggtgcaggcctgggtcgtggggcccggcgccggggacgacgcgccggtggtcgcggaggtgctggcggcggacgtgcccgtgctggtggacgcggacgggctccggctggccggccgggacgccgtacgcggccgtacggcgcccacgctgatgactccgcacgcgggggaggcggcggcgctgctcggggtgtcgcgcgaggaggtcgagcgggcacggctcgtctcggtacgggaactggcggggcgttatggagcgacggtgctcctcaaggggtccacgacgctggtggcggactcggggggcggggccgtacgggtgaattcgacgggcacgtcctggctggccaccgcggggagcggggacgtgctgtccgggctggcggggtcgctgctggcggcgggactcccggctctggacgcgggaagcgtggcggcgtacctgcacgggctcgcggggcggtacgcggcggacggagccccgatgggggcccacgacctggcggagacgatcccggaggcctggcgcgacgtgcgcgac

SEQ ID NO: 4950 - DNA, 1215 bp, Streptomyces avermitilis
  CDS (1)..(1215)
atgccgctgagcgggcgccctgagcgggggctgagcggtaggcgggcggcctggccggcggttgcggtgccggccgggccgtacgtgcgtggctgggcaggcggttgcggcggtggccgggctgtacgtgcggggccgtgtcgtgcgtgcggggccgtgccgtgcgtgtggccgactcggcggccggggcgtacgtacttggccgcgcaggtcgccgggagcggcgtccggcggggtgtacggctgcgtatgggtgacatcgccgcgcggcttcccccggcgccccgccccgccgcgttcgctgattgcatgatcagcacacgaatggcgtgccgcggtgccgcgggactgctcgcggtggccaccgcgctccccgcactgaccgcgtgcggcgccgtcgcccagccgccgccaccccccgcccccggcccgggcagcgaactcgccgcactcgtcccgggcgtgcccccgggcccccagcagccctggcaggtcgacacgcccgaccaggccctcccgccccaggtgtacacaccccatgccgaagaggacgccggcgagccgcgggacgccgcccgcggggccgacgccctcgtcgagtacgtccccctcggcgacgccgtcgcgcagcaggcgtgcagcaagcgcaccggcccctaccagcgtcaggtcgagcggtggctgaagctcaaggtcgacgggaagcagtccggcgccgactgcgtcgccgtccgcgccttccagacccgctacaagatcaagcccgccatcggctacgccgggcccgtcacctgggcccacatgcagctcctgtccgcccggaagaacccgaacgccgccgggaagtgcccggtgcgcacgtaccgcgtcgcctgcgtcgacctggcgcgtcagctcacctgggtgcagaaggggcagaaggtcgtctacgggcccgtgccgatgcgcagcggacgcgccgggtaccgcaccaggaccgggtggttcacggtctactggaagcacaagaaccacgtgtccacgatctacaacacccccatgccgtacagccagttcttcagcggcggccaggccttccacgccgtctacggcgacatctacaaccccaacggctcctggggctgcgtgaacctgcggctcgccgacgcccgcacgctgtggggcgtgctgaagaagaacgaccgggtgtacgtgtgggggcgcagggccggcaca

SEQ ID NO: 4951 - DNA, 1173 bp, Streptomyces avermitilis
  CDS (1)..(1173)
atgacgacaagagagacagcgcccctgcgcgcccgcgccgagatcgacctggcggccctgcgggccaacgtgcggaccctgcgcgcccacgcgcccgccgcggccctcatggccgtggtgaagtccgacgcgtacggccatggggcgattccgtgtgcccgcgccgccgtcgaggccggtgccacctggctgggcaccgccacgccggaggaggccctcgcactgcgcgcggccgggctgccggggcgcatcatgtgctggctctgggtccccggcggcccctggcgcgaggcgatcgacgccgacatcgacctgggcgtcagcgggctgtgggcgctgcgcgaggtcgtcgaggcggcggccggagcgggcgcgcccgcgcgtgtccagctgaaggccgacaccgggctcgggcgcaacggctgccagccggaggactggccggggctcgtcgccgaggcgctgcgcgccgaggccgcggggctcgtccgggtcaccggcctctggtcgcacctcgcctgcgcggacgagcccgggcacccctccatcgaggcccaactcgccctgttccgccagatggtggcgtacgcggagcggcagggcgtgcgccccgaggtgcggcacatcgccaactcgcccgccacgctgaccctgccggacagtcacttcgacctcgtccgtacggggatcgcggtgtacggcatctcgcccagccccgagctgggcgtccccgccgacttcgggctgcgcccggtcatgacgctcgccgcgtccctcgcgctggtgaagcacgtaccgggcggtcacggcgtcagttacgggcatcactacgtcaccccgggcgccaccaccctcggcctcgtccccgtcggctacgcggacggcatcccgcgccacgcctccggttccgggcccgtcctgatcggcggcaagtggcggacggtcgcggggcggatcgcgatggaccagttcgtggtcgacctgggcggcgacgagcccggggcgggcgcggaggcggtgctcttcggccccggcgaccgcggggagcccacggcggaggactgggcgaaggcggcgggcacgatcgcgtacgaaatcgtgacccggatcggaacccgcgtgccgcgcgtctacgtgaaggtgaataaccaacaagacggggaagcgaacagg

SEQ ID NO: 4952 - DNA, 1248 bp, Streptomyces avermitilis
  CDS (1)..(1248)
gtgagcgagagcagcgcggaggccgtggaggtcgcggcggccgtcgcgagcgcggcctcggccgcctccgccgccgggaactggcgcagggccgggatcgcgggcgccgcgataggcgtggtggccgcgggtgccgccgccggtgtcgccatcgagcggctcaccgtcggccgcggcatgcgccgcaaggccaggctcgcgctcgactcggcggcaccgtacggcacgctgcgcggcacccccgccaaggcgtacgcggacgacggcaccgcgctgtactacgaggtcgacgacgtcgagccggacgccacgctcgcgccgcgccgccgccggctgttcgggcgcaaggccccggccccggtcaccgtcgtcttcagtcacggctactgcctcaaccaggactcgtggcacttccagcgggccgcgttgcagggtgtggtgcgcatggtgcactgggaccagcgcagccacgggcggtccgggcgcggggtcgcccaggtgcaggacgggtcccccgtcaccatcgatcagctcggaaacgacctcaaggccgtcatcgacgcggccgtgcccgaggggccgatcgtgctcgtcgggcactccatgggcggcatgacggtcatggccctcgccgaccggtaccccgagctgatccgcgaccgcgtcgtcggcgtcgctctcgtgggtacgtcgtcggggcggctcggcgaggtcaacttcgggctgcccgtcgcgggcgtcaacgtcgtgcggcgcgtcctgccccaggtgctgaaggcgctggggcagcaggccgagctggtggagcgggggcggcgggcgacggccgacctgttcgcggggatcatcaagcggtactcgttcgcgtcccgggacgtcgatccggcggtcgagcggttcgccgagcggatgatcgagggcacgccgatcgacgtggtcgccgagttctacccggcgttcaccgaccacgacaagacggcggcgctggccagcttcacggagctgccggtgctcgtcctcgccggcgtcaaggacctggtgaccccgagcgagcacagtgaggcgatcgccgacctgctgccggacgcggagctggtgctcgtgccggacgccggacacctcgtgatgctggaacaccccgaggtggtcacggaccgcctcgccgacctcctcatgcgctcgggtgcggtccccgcaggagctaccgtgggtggctatggaagcaccagcagcagcgcgcaacccggg

SEQ ID NO: 4953 - DNA, 525 bp, Streptomyces avermitilis
  CDS (1)..(525)
gtggctatggaagcaccagcagcagcgcgcaacccgggtgagatcgtgtccgtcgaattgatcgtcaacgctcccgaccagatgcgggagctgggccaccggctggccaaactgctgcgcgcgggcgacctcgtgatgctcaacggggagctgggcgccggcaagacgacactgacgcgcggcctcggcgcggggctcggggtccggggcgcggtcacctccccgaccttcgtgatcgcgcgtgtacacccctccctcggtgacggtccgcccctggtccacgtggacgcgtaccgcctgggcggcggactcgacgagatggaggacctcgacctcgacgtctcgctgtccgactcggtgatcgtcgtggagtggggcgagggcaaggtcgaggaactgaccgacgaccggctgaacgtcgtcatccaccgtgccgtcggtgacaccaccgacgaggtacggcatgtcacggtcacggggctcggggagcggtgggcgaccgtggatctgggcgtgctctccgcc

SEQ ID NO: 4954 - DNA, 174 bp, Streptomyces avermitilis
  CDS (1)..(174)
atgccggcttcggaacgagacgaggcgccgccgcgcgcgagcgccggggtgtcgatgcgggacctgctggcgtcgtgcgccgcggcgcgggcggtctccacgccgccacgcgcgcccgcacccgtgtccgtgtccgcggtgaagcccgtggagctccggcgccccgaagcggcc

SEQ ID NO: 4955 - DNA, 552 bp, Streptomyces avermitilis
  CDS (1)..(552)
gtggctaagggcagctcgggattcgtggccgggctcaccgtggcggccgtcgccgtggtcggcttcctcgcctttcaggcgtcggcgaacgtgccggacacactgggcaggtcggccacctccaagtccccctcggcggtgaagtcgaaggcaccccgcgacaagaagaacccggtggcgctgcccgcggactccggcaagggcgagcgggtcgtctactcgatcgacgacgaccgggtgtggctggtgggcgcgaacaacaaggtccagcgcacgttcaaggtcacgccgggcacggtggacccgctgcccgccacctacgcggtgacctcccgttccaacgccgtctccggctccgacggcaccccgatcgagcacgtcgtgcggttcgcttcgaacgagggcgtcacgatcggcttcagcgccgcggtcgacggctcgacacccgcgcccgtgcccaccaagaagctgggcggcatccgcgagtcccgcgcggacggcgacgcgatgtgggagttcgcgacgatcagccagaaggtcgtcgtcatcaac

SEQ ID NO: 4956 - DNA, 645 bp, Streptomyces avermitilis
  CDS (1)..(645)
gtgctcttgctcgctctggataccgccacccccgccgtcaccgtcgccctgcacgacgggacgtccgtcgtcgcctcgtcgagccaggtggacgcgcgtcggcacggggaactgctgctgcccgccgtcgaccgggtcctcgccgaggcgggcacgcggctcgacgccgtcaccggcatcgtcgtcggcgtgggccccggcccctacaccgggctgcgcgtcggcctgatgaccgccgacaccttcgggctcgccctcggggtgcccgtacatggcctgtgcaccctcgacggcctcgcctacgcctccggcctcgacgagcccttcgtcgtggcgacggacgcgcgccgcaaggaggtctactgggcgcgctacgacaacgcccgcacgcgggtcaccgagcccgccgtggaccggccgggggacctggacctgcgtggtctgcccgcggtcggcgccggcgcgctgctctaccccgacgccttcccggacgcccgcgagcccgagcacctgtcggccgccgcgctggcctccctggccgcggagaaactcgccgcgggcgaggagctggaggcgccccgccccctctacctgcgccggccggacgcccaggtgcccaagaactacaaggtggtcaccccgaag

SEQ ID NO: 4957 - DNA, 480 bp, Streptomyces avermitilis
  CDS (1)..(480)
atgcgctggtgggacatcgatcccgtattcgagatggagaaggacctcttccccgaggacgcctggtcccggggcatgttctggtccgagctggcccactcccgaggggccggggcgacccggcggtacgtcgtggccgaggaggacggaaagatcgtcggatacggcggactcgtcgcctccggcgaggtgggcgacgtacagaccatcgccgtcgaccgcgaccactggggcaccggcctcggcgcgaccctgctgaccgagctgctgcgggccgcgaccgcgttcgagtgcgccgaggtcctgctcgagtgccgcgtcgacaacgtccgcgcccagaagctctacgaacgcttcggattcgagcccatcggcttccggcgcggctactaccagccggggaacgtggacgccctggtgatgcggctccaggacccctcgacctccgtacaaggaacacaaggaaccgagatcaatggc

SEQ ID NO: 4958 - DNA, 1122 bp, Streptomyces avermitilis
  CDS (1)..(1122)
atggctgactcacgcgacgagccgctcgtcctgggcatcgagacgtcctgcgacgagaccggcgtcggcattgtccgcggcaccaccctgctcgcggacgccatcgcgtccagcgtcgacgagcacgcccgcttcggcggtgtggtgcccgaggtcgcctcccgtgcgcacctcgaggcgatggtgccgaccatccagcgcgccctgaaggaggcgggcgtctcggcgaaggacctggacggcatcgccgtgaccgccggtcccggcctggccggcgcgctgctcgtcggggtctcggcggcgaaggcgtacgcctacgcgctcggcaagcccctctacggcgtcaaccacctcgcctcccacatctgcgtcgaccagctggagcacgggccgctgccggagccgaccatggcgctgctggtgtccggcgggcattcctcgctgctgctctccacggacatcacctccgatgtgcggccgatgggcgcgaccatcgacgacgcggcgggcgaggccttcgacaagatcgcgcgcgtgctgaacctgggcttcccgggcggtccggtcatcgaccggtacgcgcgcgagggcgacccgaaggcgatcgcgttcccgcgcggtctcaccgggccgcgcgaccccgcgtacgacttctccttctccggtctgaagaccgccgtggcccgctggatcgaggccaagcgggccgccggtgaggaggtgccggtgcgtgacgtctccgcgtccttccaggaggcggtggtggacgtgctgacccgcaaggccgtacgcgcctgcaaggacgagggcgtcgaccacctcatgatcggcggcggcgtcgcggccaactcgcggctgcgcgcgctcgcccaggagcggtgcgaggccgccgggatccggctgcgggtgccccgcccgaagctgtgcacggacaacggggcgatggtcgcggcgctgggcgcggagatggtggcgcgggggcgtgccgcctccgactgggacctgtccgcggactcgtcgctgccggtgacggacccgcacgtgcccgggcgcgcgcacacgcatgcgcacacgcacggccacgatcacgtgcacgaggtcagcaaggagaacctgtactcg

SEQ ID NO: 4959 - DNA, 255 bp, Streptomyces avermitilis
  CDS (1)..(255)
gtgaccgtcgcgctgatgtgggaggcccgggcggtcgagggccgcggcgacgaactgctggcctgggtcgagaagcaggacctcccgggacggcccctgcggcgcgaggtcctgcgggcgccgcaggaccgggtactggtgatcacgtggtgggatgccgcgtacgacgccgaactgccggaactcccggaccccgacggggagttggtgacgcggaccgtgcaccggtggcggttcgagtcggtgggtgtgagc

SEQ ID NO: 4960 - DNA, 840 bp, Streptomyces avermitilis
  CDS (1)..(840)
atggcacatgacatggggtggtcggcgcagggtggtgagccggagtcgtcggacagcatgaagacgttcggcgggttcgtgcaggggctgcgggagcatgcggggctgagccgggaggagttcggggcgcgggttcatctgtccaagcactccgtggcgtccatcgagctggggcgacggctggcggacgagcggttcgtggagctggcggagggggcgctgggggatacgggggcgttgcgcagggcgtttcggttcatggcgcggcagccggggttcgcggcgtggttcaaggcgtgggcgcggcttgagcgggaagcggtgagtctggccacgtacgaatgccgtctggttccggggttgttgcagcccgagccgtacgcgcgcgtggtgttcggcaacagcatcccgccgctgtcggacgagcaggtggaggctcaggccgtcgcccgaatggaacggcagcggatgctccgcgagtgccccaacacctcgttcagcttcgtcatcgacgagcacatcgtgcggcggcgcctcggcggcgtcgaggtcactcggagcttgctggaccacatgcttgggtacgctcaactccgcaacgtggagatccagatcatgccgctggactgcgaggttcacgcggggctggacggtccgctcgccctgttggagactccggacggcaggcgcctcgcctactcggaggggcagaaaaccggccggttgatcaccgacgcgaaagaggccgctgtcctgcaccgcaggtatgcaacactccgctcgcaggctctcagccccctggactccgtcggcctgctggagcgcatcggaggagagcta

SEQ ID NO: 4961 - DNA, 249 bp, Streptomyces avermitilis
  CDS (1)..(249)
atgagcaccacccaactggcgtggttcaagtccagctacagcggcacagagggcgataactgcatcgaagtcgccctgaactggcgcaagtccacgtacagcggcacccagggcgacaactgcatcgaagtcgcccccacccccaccaccatccacatccgcgactcaaaagacctcacccgcccccacctcgctctcacccccaccgcctggggcgctttcgtcacgcacgccgcagcccaggcgaac

SEQ ID NO: 4962 - DNA, 1017 bp, Streptomyces avermitilis
  CDS (1)..(1017)
gtggcccgggagagcatgaagaacaaggtgaccatcaccgagatcgcccggcaggccggcgtctcggtgcccaccgtgtcgcgggtggtcaacggccgctccgacgtgtcgcctcagacccgcgcccgggtcgaggacctgctgcgtcaccacggctaccagcgcaagtcgtccgccccgggcgaccgcgcggccctcatcgacctggtgttcaacgacctcgacagcccctgggccgtggagatcatccggggggtcgaggagatcgcgcacgcctcgggcgtcggcacggtggtgtcggccatccacggcgcgtccggctcggcccggcagtggatgaccaatctccgcgcccgcgcctcggacggcgtgatcctcgtgacgtccgtcctcgaaccccgtatgcacgaggaactgcgcaggctcggcgtcccgctcgtcgtcgtcgacccggccggctcgccctccctggacgcgccgaccgtgggggccaccaactgggcgggcggcctggccgcgaccgaacacctgctcggcctcgggcaccggcggatcgggttcatcgcggggccgccacggctgctgtgctcgcgcgcgcggctcgacggctaccgggccgccctggagggcgcggacatcgcggtcgacgacgccctgatcgtgccgggcgacttctaccacgcgtcgggattcgacggctgcacccgactgctcgacctggccgagccgccgaccgcgctgttcgccgccagtgaccagatggcgctgggggcgatcgaggcgctgcggcgcagggggctgcgggtgccggaggacatgagcgtcgtcgggttcgacgacctgcccgaggtccgctggtcggcgccgccgctgacgaccgtccgtcagccgctggcggagatgggcaagctggcgacgcggacggtgctcaggctcgcggccggtgaggagcccgcgtcgcccagggtcgagctggccaccgagctggtgctgcgggcgagtacggccccgcgcggc

SEQ ID NO: 4963 - DNA, 1302 bp, Streptomyces avermitilis
  CDS (1)..(1302)
atgcgagcgttgggcaacacctctctctcccgccgcggtttcctggcggcctccgcggcgaccggagtgggcgcggccgcgctgagcgcgtgcggctcctccgacagcggaaacagctcgggcaagaccacgatcgagtggtggaacatcaccaccaccgagcccgcgaagaagctgtgggcccagcgcgccaaggagttcgaggccgcgcaccccgacgtgaagatcaagatcgtgacgctggagaacgaggcgtacaagtccaagatgaccgcgcagaccgcctcggggaagctgccggacatctaccacacctggggcggcggggtactcgagcagcagatcgacgcgggcctggtcgaggacctgaccgaccgggtctcctcctggacggacacctacgtgcccgccgcgctcgccgcctaccggttcgacagcaggacgtacgccgttcccttcgacatcggcgcggtcggcttctggtacaacaaggcgctcttcaagcaggcgggcatcgacaccccgcccaccacctggtccggcttcctcgacgccgtcaggtccctcaagtccgccgggatcacgcccatcgccctggccggcaaggagaagtggcccggcatgtactactgggcgtacctctcgatgcgtgtcgcggggctcgacgcgatgcacaaggccgccaccgacgccgacttcaccggcgacggcttcgtcaaggccggccagcacctcaaggacctcgtcgcgctccagcccttccagaaggggttcctcggcgcgggctactccacgcccaccggcgaggcggccgcgatgggcaacggcaaggcggccatggagctgatgggccagtgggcgccggtcgtcgagaaggacgcgggcaagggtctcggcaaggacctcggcttcttctccttccccgccgtcgagggcggaaagggcgcgctcaccgaggtgttcggcgggggcggcggccacgcggtgcgcaagggcgcgcccgaggcggcggtggagttcctgaagttcttcggcgagaaggagttcgccggaaaactggtcaaggagaccggcctgataccggtgtccaaggacgcgcgcggcgcgctgacggaccccaacctcaccgctgtgtcggacgcgctgaacgcggccaccggcttccagctctacctcgaccaggcctacgcccccgccgtcggccaggagatcaacgacagcgtcgccgcgctcgtcgccggctccaagtccccgcagcaggtgacgcgttcggtcacccaggtcgccaagagcgagaagagc

SEQ ID NO: 4964 - DNA, 1050 bp, Streptomyces avermitilis
  CDS (1)..(1050)
atgacgcactcgaccccgtcgccgcactcgacctctaccccgtcgccgcactcgacctctaccccgccggcgtacgtgccggacctcggcaagtccccggaccccgggcccgtctccccccgcgcgggcggccccgcgcccgcatcgcgccggctgcgcgactggctcggcgccttcgtcttcacggtcccggccctcatcctgttcggcctgctcgtgctggtcccgatgggctacgccatctacatcagcttcttcgactggggcggattcggctcgcccacggacgtcacggggttcggcaactacacccggctcctcaaggaccccgtgttcctcggggacctgtggcggggcgggctgctgatcggcttctccgtcgtcctccagctgccgttcgccctcgccatggccgtgctgctcaaccagaagctgcgcgggcgggccgtctaccggatgctgttcttcgccccgtacatcctgtccgaggtcatcaccggcgtgctgttcggcatgatcttcgcgccgggggaggggctcgccgacaaagtcctcggcgcggtcgggctcgacggcctcggcggggactggttcgcgggccggaacacggttctgcccaccctcttcctcgtcatgacctggaagtacttcggcttccacatgatgctccacctggccggcctccagggcatcccggccgaactgcacgaggcggggcgcatcgacggcgcgggcacctggcagcgcttccgccacatcacgctgccgctgctcgcgccgaccctgcggatcagcgcgttcctgtccgtcgtcttctccatccagctcttcgacctggtctgggtgatcaccaccggcggccccgaccacgcctccgagacgatggcgatcagcatggtccagtacggcttcaagcgctatcagatgggctacgcgagcgccatcagcgtcgtgatgttcctgatcagcctggtcttcgccctcgcctaccagcgcttcgtgctgcgccgtgacaccgaaggagccatcaccaccatgcgagcgaaccga

SEQ ID NO: 4965 - DNA, 894 bp, Streptomyces avermitilis
  CDS (1)..(894)
atgagcgcgccgacgggaccgacgacaggaccgacgacaggaccgacgacgggtccgccgacgagcgtcgtacggcgccggaggctgcgcgccctccccgtgtacgcgatcctctgggtggtcggcgtcttcatggtcaccccgctcctgtacgccatcgtctccggcttcaagtccaccgaccagctctccggcaacccgttcgggctgccctcgccctgggtgacctcgaactacacgtccctgctcggctcgggggcgttctggcggtccatcggcagcagcacggtgatcgcggtgggagccaccctggtcacggtggtgaccgcggccctcgccgcgttcgccctggcccggttcgccttccgcgggcgggagttcatgttcaccctgttcacgatggggctgatgttcccgttcgcggtggcgatcctgccgctgttcatcctgctgcgcaccttcgggctcctcgacaacccgtggggcgtgatcctgcccgaggcggccttcgggctgccggtgacgatcatcatcctgcgcggcttcttccgggagatccccggcgagctggaggaggcggcgaccctcgacggctgctcccccttcggcttcttctggcgcgtcctgctgccgctggcccggcccgccctcggcacggtctccgtcctcgccatcgtcagcagctggaaccagttcctgctgccgctgctggtcttcagcgagcccacctggtggacgatcccggtcggcatccagcagttccagggccagtacgcctccgacgtggcccgcatcttcgcgtacctggtgctcgccatggcgcccgccctggccttctacgccgtcgccgaacgacagctgatcggcggcatcacgctcggcgcgaccaagggc

SEQ ID NO: 4966 - DNA, 2226 bp, Streptomyces avermitilis
  CDS (1)..(2226)
atgacccacccctggcaggaccccgctctgcccgcagccgtccgcgccgccgacctgctcgcccggatgaccccccaggagaagaccgcccagctctacggcgtctggcccggctccgacgaggcaccgggcggggacgtggcaccgctccagcacgcgctgtccgagggcgtggacctcgccgggctgctcccgcacggcctcggccagctcacccgccccttcggcacggcgcccgtcgacccggccgagggcgccgcccggctcgggttcctccaggaacgcatccgcgccgcgaaccgcttccggctgcccgccctcgcccacgaggagtgcctcaccggcttcaccgcctggcaggcgaccatctttccgacaccgctcgcctggggcgccagcttcgatccggacctggtgaaggagatggcggccgcgatcggcgcctcgatgcgggccgtgggcgtgcaccaggggctggcccccgtcctcgacgtcgtacgggatccgcgctgggggcgcacggaggagtcgatcggcgaggacccctacctcgtggccaccgtcggcaccgcctacgtgcagggccttcagtcgtccggcgtcgtagccacgctcaagcacctcgcgggctactcggcctcacgcggcgcccgcaaccacgcgcccgcgtcgctcggcccgcgcgaactggccgacgtcatcctgccgcccttcgagatggcggtacgggagggcggcgcccggtcggtgatggcggcgtacaacgacatcgacggactgcccgcgcacgcgcaccaccggctgctcacccacctgctgcgggacgaatggcagttcaccggcaccgtcgtctccgactacttcggggtctccttcctggagtcggcccacgggctcgccgactccccggccggggcggcggcgctcgcgctcgcggccggggtggacgtggagctgcccgcggtgcggtgcttcggggccgggccgttcgacgaggaactggtggaccgggccgcgctgcgggtgctgacgcagaagtgcgagctggggctgctcgacccggactgggcgccgcccgccaccgaggccccggtcgacctggacccgccccatatgcgggcgctggcacgtcagttggcacaggagtcggtcgtcctgctcgccaacgaccggggcctgctgccgctcgctccgggggcccgccggatcgccgtcctcgggccgcacgccgacgacccggcggccatgctcggctgctacaccttcccccgccatgtcctcctggaccgccccggggtcccgatgggggtcgccgtgccgacgctgctggaggcgctgcgcacggagctgccggacgccgagttcgtgaccgacccggcggcggccgaggtgtgtgtggtcgcggtcggcgaccggtcggggctgttcggacgcggcacctcgggggagggctgcgacgcggcggacctcgaacttcccgacggacagggcgaggtggtggaccgggccctcgcctccgggacgccggtcgtcctggtcctgctgtccgggcgcccgtacgcgctcgggcgctgggcggaccggtgcgccgcggtggtgcaggcgttcttcccgggcgaggaaggaggcccggccgtggccggggtgctgtccgggcgggtcaacccgtcgggccggctgccggtgagcgtgccgcgcggcccggcgggacagccgtggacgtacctcgccccgccgctcggccggcacggcgaggcgagcaacctcgacccgacccccctgtaccccttcggacacgggctgtcgtacacgacgtacgactggcaggccccgtcggtcgacgacgcgtcgttccccacggacggcgagacgacgctgcgcctgacggtccgcaacaccggggaacggcccggcacggaggtcgtccagctctacctccacgacccggtcggcaaggtcgcgcggccggtggtccgcttggtggggtacgcccgggtgcccctcgaacccggcgcgtcgggggaggtccacttcacggttccggcggacctggccgcgtacacgggccccgacggcgagcggatcgtcgaacccggggcgctggagctgcggttgggggtgtccagcgcggacggggacgtgcggtacacggtgccggtgacgctgaccgggcccgagcgggtggtgggacgggagcggcggctgcggtgcgaggtgcgggtgaag

SEQ ID NO: 4967 - DNA, 1107 bp, Streptomyces avermitilis
  CDS (1)..(1107)
atgaagccggagaagtccgagaggcccgggaagcccgggaatcccgagaaacccgagaatcccgagaatcccgtgcagacacagtcgatggcccgctcgacccagaccgccacgctcgccgagatcgcccgcgaggccggcgtgtcggcgccgactgtttcgaaggtgctcaacggccgcgccgacgtcgccccggcgacccgcgcccgggtcgaggagctgctccgctcctacggctaccgccgccgccgggccgaggccacccgctcgcccctgatcgacctggtcttccacgagctggagagcgcctgggcgatggaggtcatccgaggggtggagaacgtcgcgcgggacgaggggctgagcgtggtcctgtccgagagcgctggccggctgacccccggccggacctgggccgaccaggtcgccgcccgccgcccgcacggtgtgatcctggtgctgtccgggctcgacgagtcccagcgtgcgctgctgaccagcagatccatcccgttcgtggtgatggacccggccggcgacccgggtgacgacgtgccgtcgatcggcgccaccaactggcacggcgggctggccgcgacccggcatctcgtcgaactcgggcacaccaggatcggcgcgatcagcgggccctcgcggatgatgtgcagccgggcgcgggtggacggctaccgggcggcgctggagacggcggggctgccggtggatccggggctggtcaaggcgggggacttccaccacgaggccggctaccggctgggcctcgaactgctgcggcggccggaccgccccacggccgtgttcgccgggaacgacctccaggcgctgggcctgtacgaggcggcgcgcgaactggggctgcgcatcccgcaggacctgagcgtggtcgggttcgacgatctgccggtggcgcgctgggtggggccgccgctgacgaccgtacggcagccgctgacggagatggcggaggcggccgcgaagctggtgctggaactggggcgggaggcgggggcctcggtggcgaccagggtggaactggcgacgagtctggtggtgcgcagcagtacgggggccgcgccggcgccggtg

SEQ ID NO: 4968 - DNA, 1353 bp, Streptomyces avermitilis
  CDS (1)..(1353)
atgagatctctgaaaagatcaggcttatccccggcgtccttgctcaccggcatcgcggccctggccgccctgctggccgcggcccccgccgcgcacgccgccgacacgccgctccgtgacctcgccgccgccaagggcaaggtcatcggtaccgcggtcaccggctccaagctgaccggcacgtacggcgacatcgccggggcccagttcaactcgctgacccccggcaacgccatgaagtggggctcggtcgagcccacccagggcacgtacaactggaccgaggccgaccagatcgtcgccttcgcgcaggcccacaaccagcaggtacgcgggcacaccctggtctggcacagccagaacccgagctggctgacgaacggcacctggaccccggcccagctcggcacgctgctccagaaccacatcaccaccgaagtcacccgctaccagggcaagctggcggcctgggacgtggtgaacgagccgttcaacgaggacggcacctaccgctcgaccctctggtacaacggcctcggctccgattacatcgcccaggccctgaccgcggcgcgcgcggcggacccgagcgcgaagctctacatcaacgactacaacgtcgagggcgtcaacgcgaagagcaccgcgctctacaacctggtcaagtccctcaaggaccgcggggttccgatcgacggggtcggcctccaggcccacctcgtgctcggccaggtgccgtccacgctccagcagaacatccagcgcttcgccgacctcggggtggacgtggcgatcacggagctggacatccgtatgcagctgcccgccacggacgcgaagctgacgcagcaggcggccgactacaaggccgtgctggacgcgtgcgtggcggtgacccggtgcgtcggcgtcaccgtctggggcttcacggactccgactcctggatcccggacgtcttctccggctacggcgcggcgacgccgtacgacgagaactacgcgccgaaaccggcgtaccacgcgatcgcgacggcactcgggggcacctcgacaccgcccacgggcgcgtgcacggcgacgtacagcgtcacgagccagtggaacgcgggcttcacgggccaggtgcggatcgcctgttccggggcctccctgtcggcgtggaaggtgagctggacgtacggcgcgggccagcagatcacgcaggcgtggaacgcgacgtgcacccagtcggggacggcggtgagttgcgcgaacgcctcctacaacggcaccgtcccgaacggcggttcggtcaccttcggcttcaacgcgtcatggagcggaagcaacccgctgccgacagtgacgctgggg

SEQ ID NO: 4969 - DNA, 1083 bp, Streptomyces avermitilis
  CDS (1)..(1083)
atgttcctccgcgtgactggagaagacgagcgcggggacgacaacgggggcgcggtcagacgtccgggccggcggtcccgcctgctgaagggcgtcggcatcgcgctcgccggcggcctcgtcctcggcgccgccggggcgggctgggcgtactggcgtctgaaccacaacatcaagagcgtcgacatcaacagcgcgctcggcgacgaccgcccggcgcggtcggtgacctccccgtctccggccgcgtcggcgtccgcctcggccacccccctccccagcggcgccctgaacatcctggtcctcggctcggactcgcgcagcggcaaggccaacgcgacgctcggcgggggcgacagctcgggtgcccgctccgacaccgcgatggtcgtccacatcgacgagggccggacggaggcgacggtggtgagcatcccgcgcgacacgctggtcacgcgcccctcgtgcccgctgacgtcgggcggtacgacggcggtggcgtacaacgcgatgttcaacagcgcgtacgcggtgggcggcccggtctgcgcggtgaagacggtcgagtcattgacgaacatccgcatggaccactacctggagatcgacttctccggcttcgccaagctggtgaacgcgctgggcggcgtcacggtgaccacggacgaggacatcgacgacgacaagagccatctgcacctcaaggcgggcgagcaccacctcaccggcaagcaggcgctggccctcgcccgcacccgccacggcataggcgacggcagcgacctgggccgcataggactccagcagaagctcgtgaaggcactcctggaccagatcgcctcgacgaacctcctgaccgaccccaccggcctctacaaggtcgcggacgcgatcacgggcagcctcaccacggacacgggtctcgactccctgggcgaactgatgaacctgggcgagagcctgaagggcctgtcgtcggagcgggtcagcacggtgatgctgccggtggcgacggccccctcggaccccaaccgggtggtggcgaaggaaccggcggcgagcgcgttgtggacgtcgctgcgc

SEQ ID NO: 4970 - DNA, 354 bp, Streptomyces avermitilis
  CDS (1)..(354)
atgccgcgttacctgtcgctcatccagatcgacgagagcaccgcgcccgccgagggaccgagccccgaactgatgcagcgcatgggggagctgctcgaggagatcaccaaggcgggcgtcatgctcgacaccgccgggctgacgccgaccgcccaggggaagcgagtgcactgggccggcggagagctgtccgtcaccgacgggcccttcaccgagtccaaggaggtcgtcggcggttatgcgctcatgcagtgcaaggacatggcggaggccctggagtggaccaagcggttcctgaaggtgcacgaggagcactggaccgtgacctgtgaggtgcgggagatcgccgagggc

SEQ ID NO: 4971 - DNA, 1272 bp, Streptomyces avermitilis
  CDS (1)..(1272)
gtggaacagcagcccaccgccaccgccgccatcgaagccaccgtcgaaaccgtcttccgcatcgagtcgccccgcatcatcgccggcgtcgcccggatcgtgcgggacgtcggtatcgccgaggaactggcgcaggacgcgctggtcgccgccctggagcagtggccgagggacggggtgcccgacaaccccggcgcctggctcacggccaccgccaaacatcgcgccatcgacctcgtacgccgccgggagcgctacgcccgcaagctggaggaggtggggcgggacctctcgtcgaccgccccgcaccacctcgacgagccggccgaccccgacgacatcgacgacgacctgctgcggctcgtcttcaccgcctgccaccccgtgctgtccgccgaggcccgcatcgcgctcaccctgcggctgctcggcgggctgaccacgcccgagatcgcccgcgcgttcctcgcgccggaggcgaccgtcgcccagcgcatcgtgcgcgccaagcggacgctggcgacgaagggggtcgccttcgaggtcccgtacggaccggaacgcgaagcccggctgggctcggtcctggaggtcatctacctcatcttcaacgaggggtacgccgccaccgccggcgacgacctgctgcgccccgccctgtgcgaggacgcgctccgactcgcccgcgtactcgccgagttgatgcccaaggagcccgaggtgcacgggctggcggcgctgctggagcttcaggagtcgcgcgcgggcgcccgcaccggaccgtccggcgagccggtcctcctcaaggaccagaaccggctccgctggaaccggatgctgatccgccggggcttcaccgcgctcggacgcgccaacgccgtcgccaccggcggcctcggcccgtacgccctccaggccgcgatcgccgcctgccacgcccgggcctacgcgtacgaggacaccgactgggcgcagatcgtcacgctctacggactcctcgcggcccgctccccgtcccccgtcgtcgagttgaaccgcgcggtcgccgtctcgatggccgagggccccggccccgccctggagatcgtcgacgccctcgccgccgaaccctccctgcgtgactaccacttgctgcccagtgtccgcggcgacctgctcgcccgcctcggccgtacgacggaggcccgcgccgagttcgcccgtgccgccgccctcacccgcaacgaacgggaacgggagctgttgctggcccgggcggaagggcgcgggcag

SEQ ID NO: 4972 - DNA, 1170 bp, Streptomyces avermitilis
  CDS (1)..(1170)
gtgaacgacctctccttcgcctccctgctcacccctgaaggccgcgccctgctcgacgaggtgcgcgacaccgcgccggcgcgggagctggccgtcgcgacccggctgcgccgcgagcaccccgcggagctggtctcggcggccctcggacaggcgcggctgcggcagcgggcggcggcgaagttcgcggccgaggacgcggcgcggatgttcttcaccccgaacggggtcgagcagtcgacgcgcgcggcggtggcgacgcaccgggcgctgcggcttcgggagctgggggtgacgtccgtggccgatctgtgctgcggcatcggcggcgacgcgatcgcgctggcccgcgccgggatccgggtcctggcggtggaccgcgacccgctcacggcggcggtggcccgcgcgaacgccggggaactgggcctgacggacctgatcgaggtgcgggaggcggatgtcacggaggtcgacccgggcccgtacgacgcggtcttcgtggatccggcgcggcgcggcggccggggccgtgtcttcgacccggaggcgtactcgccgccgctctcctgggcgatcggtacggccctcgcggcaccgcgggccgcgctgaagatcgcgccgggcatcccccacgaggcgatccccgccgaggccgaggcggagtggatctcggacggcggggacgtgaaggaggcggtgctgtggttcggcaccgagccggggctggtgcgggcgaccctgctgccgggcccgcgggtcctgcgcggccgcggcctgccggaccccgcggtgcgcccgctcggccggtatctgtacgagcccgacggcgccgtcatccgggcgcatctcgtcgcggaggtcgcccaggagctggacggcggcctcgtcgacgagacgatcgcctacgtcacggcggacgaactgcgcccgacgccgtatgcgaccgcctacgagatcaccgaccagctccccttcaacgtgaagaagctgagggtgctgctgcgggagcgggaggtcgggatcctgaccgtgaagaagcgcgggtcggccgtcgaaccggaggagctgcgcaagaaggtcaagccgcacggcccgaactcggccaccgtcttcctgacccgggtcgcgggcgccccgacgatgctgatcgggcacccggcggtcccg

SEQ ID NO: 4973 - DNA, 873 bp, Streptomyces avermitilis
  CDS (1)..(873)
gtggcgccccgggctgccgtcgccgtgctcgccctggcggccctcgcctccggctgcgccggcgcggacagccccgtgcggccggcccccggcccgcagccgctcaaggcaccgcccgcccgcgccctcgactcgtacgcctcgaaactgcgcctctcgctcgccgcccgggccgcggccgccaagcgctgggggctgacgaagacgccgctgaccgcgccggcacccccggtcaagaagccggtgatcacgttccgcaagggcttcgaggtcacggacggggaaggcctgccgcccgtcttcacgaccgtcccgaccaaggacaaggtcgtcttcctcaccatcgacgacggcgccgagaaggacccggcgttcctgcggatgatgagcgacctgaagattccgtacaccgccttcctgagcaactacctcgtcgaggacgactacgggtacttccgggagatgcgccgccagggcgtcaccctcaacaaccacaccctcacccacccctacctgcccggactgtcgtacgaggagcaggagcacgagatctgcggcatgcaggacatcatggagaagcggctcggcaagcggcccgcgctcttccggccgccctacggcaactacaacggggacaccctgcgcgccgccaggtcctgcggcatcaagtacgccccgatctggaacgaagaggtcttcgtcgaccactgggagtaccgcgagacggaccagagcctgcaccccggcgacatcgtgctcacccacttccggggcaaggaggactggcagggcacgatgcccgacatgatccgccggttcatggagaaggtcacggacgaggggtacgcggtggcccgcctggaggactacctg

SEQ ID NO: 4974 - DNA, 828 bp, Streptomyces avermitilis
  CDS (1)..(828)
gtgacggcgcggcagctggtcgccgggctgctcgcagccacgctgctgaccggctgcgcccagtccgtcgaccccatcgaacggctgggcaagaaagcggcgcagaaagtgcgccgaccgcaggaacccggcgcgcagacataccgccgctgggggctctccgccccgctcgcccccgctcccgcccccgaccaccccccgttcccggtacgtaccggccaccgcgccctgccgcccgtcgtggaccgcgtcgccacccacgacaaggtggtcttcctgacgtacgacgtgacctacgacggcggctactacggcgccgagaaggacccccggttcaccgacatggtccgtgaactgcggctgccggtcagcgtgttcgtcacggacagtgaggtcggaccggggtacgcacacgtcgcgcgcctcaggtcggtcggcgcgacggtgcagaacggcaccctcggcgccacctcgctgcgcggactgccgtacgcggggcagcgcgccgggatctgcggcgggcgggaccggctcagggcgcgcttcggccggcgcccgtacttcctgcggccgccggccggcgcgtacgaccgtacgacgctgcgcgccgccgcggactgcggggtcacggcggtggtgctgtggcgggcgtcgatgcgggcggacggactttcctaccgcggccgggcccaccggctgcaccgcggtgacatcgtcctcgcccaccccgggaacccggacggcgactccctgacgaccctgacggcacgtctgctgcgacgcgtccaggcacaggggttcacggtggggcggctggaggactatctc

SEQ ID NO: 4975 - DNA, 306 bp, Streptomyces avermitilis
  CDS (1)..(306)
gtgacgaccgccagctccaaggttgccatcaagccgctcgaggaccgcattgtggtccagccgctcgacgccgagcagaccacggcctctggcctggtcatcccggacaccgcgaaggagaagccccaggagggcgtcgtccttgcggtgggcccgggtcgcttcgaggacggtaaccgtcttccgctcgacgtcaccgtcggcgacgtagtgctctacagcaagtacggcggcaccgaggtgaagtacaacggcgaggagtacctcgtcctctcggctcgcgacgtgctcgcgatcgtcgagaag

SEQ ID NO: 4976 - DNA, 1626 bp, Streptomyces avermitilis
  CDS (1)..(1626)
atggcgaagatcctgaagttcgacgaggacgcccgtcgcgccctcgagcgcggcgtcaacaagcttgccgacacggtcaaggtgacgatcggccccaagggccgcaacgtcgtcatcgacaagaagttcggcgcccccaccatcaccaacgacggtgtcaccatcgcccgcgaggtcgaggtcgaggacccgtacgagaacctcggcgcccagctggtgaaggaggtggcgaccaagaccaacgacatcgcgggtgacggtacgaccaccgccaccgtgctggcccaggcgctcgtccgcgagggcctgaagaacgtcgccgccggcgcgtcccccgccctcctgaagaagggcatcgacgccgcggtcaaggctgtgtccgaggagctcctcgcgaccgcccgcccgatcgacgagaagtccgacatcgccgccgtcgccggtctgtccgcccaggacagccaggtcggcgagctcatcgccgaggcgatggacaaggtcggcaaggacggtgtcatcaccgtcgaggagtccaacaccttcggtctggagctggacttcaccgagggcatggccttcgacaagggctacctgtcgccgtacttcgtgacggaccaggagcgcatggaggccgtcctcgaggacccgtacatcctcatccaccagggcaagatctcctccatccaggacctcctgccgctgctggagaaggtcatccaggccaacgcctccaagccgctgctgatcatcgccgaggacgtcgagggcgaggcactgtcgaccctggtcgtgaacaagatccgcggcacgttcaacgcggtcgcggtcaaggcccccggcttcggtgaccgccgcaaggccatgctcggcgacatcgccaccctcaccggcggtcaggtcatcgccgaggaggtcggcctcaagctcgaccaggtcggcctggacgtgctgggcaccgcccgccgcgtgaccgtcaccaaggacgacaccaccatcgtcgacggtggcggcagctccgacgaggtcgccggccggatcaaccagatcaaggccgagatcgagaacaccgactccgactgggaccgcgagaagctccaggagcgcctcgcgaagctggccggcggcgtgtgcgtcatcaaggtcggcgccgccaccgaggtggagctgaaggagaagaagcaccgtctggaggacgccatctccgcgacccgcgccgcggtcgaggagggcatcgtctccggtggtggctccgcgctcgtccacgccgtgaaggtcctggagggcaacctcggcaagaccggcgacgaggccacgggtgtcgcggtcgtccgccgcgccgccgtcgagccgctgcgctggatcgccgagaacgccggcctcgagggctacgtcatcacctccaaggtcgccgagctcgacaagggccagggcttcaacgccgcgaccggcgagtacggcgacctggtcaagtccggtgtcatcgacccggtcaaggtcacccgctccgccctggagaacgccgcgtccatcgcgtccctgctcctgacgaccgagaccctggtcgtcgagaagccggcggaagaggaggccgacgcgggccacggccacggtcacggccactcgcac

SEQ ID NO: 4977 - DNA, 747 bp, Streptomyces avermitilis
  CDS (1)..(747)
atgggggtgttcgaccggacccggggggccggaggtgacgtcatgacatttcttcagctcatcgactgcaagaccagtcggttcgacgagatgaaccggctcatggacacatgggtcgagcggaccaaggggaagcggaccgcgtcgcacagcgtgatcgggaaggaccggtccgacgcgtcgcacatcgtggagatcgtggagttcccgtcgtacgaggaagcggtgcggaactcgaacctcccggagaccgacagcgtcttccgggagatggtggcgctctgcgacgagatgcccacgttcaccgatctggacgtggtgcgggacgagcagctgtacgcggggaccgtccgcaggttcctcctggaggtggccaccgagggcgaactgccgccgctcaacgacgtgatggcggagaactaccacgaccacgaccccgccaacgagcaggacgctatcgggctggacgcgatgcggcgcgagatcgagatgtggcgccgtgggttcgacttcgccttcaccgtcgaggaccagctcgccgagggggaccgggtgtgcacccggtggagctggaagggcgaccacaagggggacttcatggggatcctggcgaccggcaagcaggtcacgatgaccgggacgaccgtcttccggtgcggcgaggacggcaagatcgtcgaggggtggtggcagtacgaccggctggggctgctggcccagttgggcgcgctcgacgagctcgagagc

SEQ ID NO: 4978 - DNA, 771 bp, Streptomyces avermitilis
  CDS (1)..(771)
atgacaacggctctgattacgggatcgaccgcgggaatcggtgccgcgttcgcgcggcggctggcggcggacgggcacaacctcgtcctggtggcacgtgacaccaagcgactgcgtgagcaggccacggagttgcacgaccggcacggcatcgaggcggaggtgctgaccgcggacctggcgacggacgacggcatcgagacggtggccgcccggctgggcgaccgcaagaacgcggtcgatctgctggtcaacaacgcgggcttcggcaacaagggccgctacctcgacgtgtcgatggccgacgagctgaagatgctcaaggtgcactgcgaggcggtgctgcggctgacgagcgcggcggcggagccgatgcgcgagcgggggcgcggcggggtcgtgaacgtcgcctcggtggccgcgttcgtaccgcgcggcacctacggggcgtcgaaggcgtgggtcgtgcagttcacccagggcgcggcgaaggacctggccggctccggcgtccgcctgatggcgctgtgccccggctttgtgcgcaccgagttccaccagcgggccggcatgggcacggacaacatccccaagtggatgtggctggacgcggacaagctggtcgcggcggcgctggcggatctggcccggggcaagtcgctgtcgattccggacccgcgctacaaggcgctgatgggactggtgaaggtgaccccgcgggcgctgctgggcgggatctcctcgaagacggggcggaagtacgggcctcag

SEQ ID NO: 4979 - DNA, 666 bp, Streptomyces avermitilis
  CDS (1)..(666)
atgatgcttctgtcgctgaacgtgggccgggcacgggccgtggagtacacggaccagccggagggcgtgaccggtatcgacaagcgcccggtggacgggccggtgcggatctcggcgcccgggcccaagggggtcggcgcgagcggcgtggccggggacgccgtgtgcgacacccgccaccacggcggggaacaccaggcggtgtacgcggtcgcccgcgaggacctggacggctgggagcgcgagctgggccgcgcgctgcccaacggcgtgttcggcgagaacctcaccaccgaggggctcgacgtgtccggcgcgcggatcggtgagcgctggcgcataggccccgacgtggtcctcgaggtgacctccgggcggattccgtgccggaccttccaggagcatctcggggagcggggctgggtcaagcggttcacgcacaagggcgcgccgggcgcgtatctgcgggtggtcgagccgggtgagatccgggcgggcgacccggtcgagatcgtgcaccggcccggccacgaggtgacggtggcgctccagttccgggccgtcacgacggaacgggagctgctgccgcgactgctggcggcagcggaagcgctgcatccggaggcactcgcgcgggcccgggagtacgtggagaagtacgaggcg

SEQ ID NO: 4980 - DNA, 894 bp, Streptomyces avermitilis
  CDS (1)..(894)
gtgatcgaggcccgacatctccgcgtgctgcgtgccgtggccgccaccggctctttctcggcggcggggcgcgagctgggctgcacccagcccgccgtcagccagcagatgaaggcgctggagtcgtcggtgggcacaccgctgctgatccgcacgggccgcgaaatgcgcctgacccaggccggcgaggccctggtccggcacgccgcgggcatcatcgccggactcacggcggccgaggaagaggtcgccgccatcgcgggactgcgcgccgggcgcgtacgtctcgtctcgttccccagcggcagttcggcgctcgtcccgaccgccctggccgccctgcgcgccgcgcaccccggcacccgggtctccctggaggaggccgaaccgccgcgctcggtcgagatgctgcgcgagggcgactgcgatgtggcgctcgccttccggtacgagggtgcggccggcgccgaggaatgggacgacctggtcgtacgccccctgctcaccgaccgtctcgtcggcctggtccccgaggggcaccggctggcccggaccgagtccgtcgccatcgccgacctcgccgcggacccgtggatcgcgggatgcccgcgctgccgcggtcagctcgtcgaggtgtgcgagagcgccggcttcactccccggatcgacttcgcgaccgacgactacccggcggtggtcggtctggtgagcgccggtctcggcgtggccgtactgccgcagctcgcgatcgagtccgtacgtcccaggggcgcgcgcacggtggcggtggaaccgccggtgcggcgggagatcgtcgcgctgacgctcccggatctggcccaggtgcccgcggtggcggcgacactggaccagctggcagcggccgcaactcgc

SEQ ID NO: 4981 - DNA, 327 bp, Streptomyces avermitilis
  CDS (1)..(327)
atggcagatttctctcgccttcccggtccgaacgcggacctctgggactggcagctcctcgcggcctgccgcggggtcgacagctcgctcttcttccacccggagggtgagcgcggtgcggcacggagcgctcgcgagaactcggccaaagaggtctgcatgagatgtccggtgcgcgcgcagtgcgcggcccacgcgctcgcggtgcgcgagccgtacggcgtgtggggcggactgaccgaggacgagcgcgaagaactcatggggcgggcgcggaaccggctggtgtcggcggcgacgaacagccgcgacaccgcctcgaacaac

SEQ ID NO: 4982 - DNA, 609 bp, Streptomyces avermitilis
  CDS (1)..(609)
atgacatccgtcctcgtctgcgacgactccccgcttgcccgagaggcgctccgccgcgcggtggcgaccgtgcccggcgtcgagcgtgtcacgacggcggccaacggcgaggaagtcctccgccgctggggtgccgaccgttcggacctgattctgatggacgtacgcatgcccggtctgggcggtgtcgagacggtccggcggctgctgtccgccgacccgggtgcgcgcatcatcatgctcaccgtcgccgaggacctggacggggtggcgctcgccgtcgccgccggtgcccgcggctatctacacaaggacgcctcgcgcgccgaactgcgggccacggtgacgcaggcgctcgccgaccccacctggcggctcgcgccacgcagactgcgttccgccgagatgggcgcagcgccgacgctcaccgcgcgtgagatccaggtgctggagggcatgagtcacggccgctccaacgcggagatcggccgtgagctgttcctctccgaggacaccgtcaagacgcacgcccggcggctcttcaagaagctcggcgcctcggaccgcgcgcacgccgtggcgctcggtttccggtggggcctggtccgt

SEQ ID NO: 4983 - DNA, 573 bp, Streptomyces avermitilis
  CDS (1)..(573)
atgcgtgacgacgagacgacggtgatcggtgcgctcgttcatcgcgcggtcgacggcgacgagcaggccacacacgacctgctcgcccgcgttcacccattggcattgcgctactgccgcgcccgtctgtcccggcttccgggcgacgcgcggcacttccaggaggacctggcgcaggaggtgtgcgtcgcggtgctcctggcgctgccgcgctacaaggacaccggccgcccgttcgaggcgttcgtcttcgccatcgccgcgcacaaggtggccgaccttcagcgcgccgcgatgcgccacccgggttcgacggccgtgccgtccgacgagatgcccgagcggccggacgactccctgggcccggaggagcgggccctgctgagcagcgacgccgaatgggccaagaaactgctggccaacctccccgagaaccagcgcgagctgctcctgctgaggatcgcggtgggcctcacggccgaggagacgggccagatgttgggaatgtcacccggtgcggtccgggtcgcgcagcacagggcactgagccgactgcgtgcgctggccgagcag

SEQ ID NO: 4984 - DNA, 1506 bp, Streptomyces avermitilis
  CDS (1)..(1506)
atgactgccaacgtcgacggagtgcccgccaaattcgcgacactcgggctgacctacgacgacgtgctgctgctgccgggcgcgtcggacatggcgcccgaccagatcgacaccgcttcgcacgtctccaagaacgtgcgggtgaacatcccgcttctgtccgccgccatggacaaggtcaccgaggcccgcatggcgatcgcgatggcccgccagggcggcgtcggcgtcctgcaccgcaacctgtccatcgaggaccaggccaaccaggtcgacctggtgaagcgctccgagtccggcatggtcaccgaccccatcaccgtgcacccggacgccacgctcgccgaggccgacgcgatctgcgccaagttccgcatcagcggcgtcccggtcaccgacggcaacggcaagctgctcggcatcgtgaccaaccgcgacatggccttcgagacggaccgctcgcgccaggtccgcgaggtcatgacgccgatgcccctggtcaccggcaaggtcggcatctccggcaacgacgcgatgcagctgctgcgccgccacaagatcgagaagcttccgctggtcgacgacgccggcatcctcaagggcctcatcaccgtcaaggacttcaccaaggcggagaagtacccgaacgccgcgaaggacgccgaggggcgcctgctcgtcggtgcggccgtcggtgtggccggtgacgccttcgagcgcgcccaggccctcatcgaggcgggtgtcgacttcatcgtcgtcgacaccgcgcacggccactcccgactggtcggcgacatggtcgccaagatcaagtccaactccggcggcgtcgacgtcatcggcggcaacatcgccacccgcgacggcgcccaggcgctcatcgactccggtgtcgacggcatcaaggtgggcgtcggccccggctccatctgtacgacccgggtggtcgccggtatcggcgtaccccaggtgacggccatctacgaggcgtcgctcgccgccaaggaggccggcgtcccggtcatcggcgacggtggcctccagtactccggcgacatcgcgaaggccctggtcgcgggcgccgacacggtgatgctcggttcgctgctcgcgggctgcgaggagtcgccgggcgagctgctgttcatcaacggcaagcagttcaagtcgtaccgcggcatgggctccctgggcgccatgcagtcccgtggtgagcagcgctccttctccaaggaccgctacttccaggagggcgtcgcctccgacgagaagctcgtgcccgagggcatcgagggccaggtgccctaccgcggcccgctgtccgcggtcgtccaccagctggtcggcggtctgcgtcagtcgatgttctacgtaggcggccgcaccgtgcccgagctccaggacaacggccggttcgtacgcatcacgtcggcgggtctcaaggagagccacccgcacgacatccagatgacggtcgaggcgccgaactacagccgtagcaag

SEQ ID NO: 4985 - DNA, 1122 bp, Streptomyces avermitilis
  CDS (1)..(1122)
gtgactgagatcgagatcgggcggggcaagcgcggccgccgggcatacgccttcgacgacatcgccgtcgtccccagccgccgtacccgggacccgaaggaggtctcgatcgcctggcagatcgacgcctaccgcttcgagctgcccttcctggccgctcccatggactcggtggtctccccggccacggcgatccgcatcggtgagctgggcggcctgggcgtgctcaacctcgaaggcctgtggacgcggtacgaggacccgcagccgctgctggacgagatcgcggagctggacgcggacaccgcgacccgccgcctccaggagatctacgcggctcccatcaaggaggagctgatcgggcagcgcatcaaggaggtgcgcgactcgggcgtggtcaccgcggcggccctgtccccgcagcgcacggcgcagttctccaaggcggtcgtcgacgcgggcgtggacatcttcgtcatccgcggtacgacggtgtcggccgagcacgtctcgggtgccgccgagccgctgaacctgaagcagttcatctacgagctcgacgtcccggtgatcgtcggcggctgcgccacgtacaccgcggccctgcacctgatgcgcacgggcgcggccggtgtgctggtcggcttcggcggcggcgccgcgcacaccacgcgcaacgtgctgggcatccaggtcccgatggccacggcggtcgccgacgtcgccgctgcccgccgcgactacatggacgagtccggcggccggtacgtgcacgtgatcgcggacggcggcgtcggctggtccggcgatctgcccaaggccatcgcctgtggcgccgactcggtgatgatgggctcgccgctcgcgcgcgccacggacgcgccgggcaggggccaccactggggcatggaggctgtcaacgaggagctgccgcgcggcaagaaggtcgacctcggcaccgtcggcaccatcgaggagatcctcaccgggccctcgcacatcccggacggctccatgaacatcttcggcgccctgcgccgcgccatggccaccaccggctacagcgagctcaaggagttccagcgcgtcgaggtgacggtggcggacgcgcagcacaagcgg

SEQ ID NO: 4986 - DNA, 1206 bp, Streptomyces avermitilis
  CDS (1)..(1206)
atgcccgcagatctcgccgtcatcggactcggtcatctcggcctgcccctggcccaggccgccgtcgcggccggtatccccacggtcgggtacaagaccggccccgaggggggttccctcaccgccgccgaactgcgccggatgctctcggggggcttccggacgacgaccaacccggccgagctcggccgggtacgcaccgccgtcatctgcgcaccgaccccgcgcggcgccgccggcgcgctcgagctgagccaggtggaggccgccgcccgcaccctcgcggcccggttgcgcccgcacaccaccgtgatcctggaatcgcccgtacacccggggacgaccgaggaattcctccgtccgctcctcgaagagggttccggactccgggccggccgtgacttccacctcgcgtactcaccgagccgcgtggatccgggaaaccgtgacttcggctccgccaacacccccaaggtgatcgggggtctgacccccgcgtgcaccgagtcggccgccgcgttctacggccgcctcaccgacaaggtggtacgcgcgcgtggaccccgcgaggcggagaccgtgcagctcctggagaccaactaccggcacgtcaacatcgccctggtcaacgaaatggctgtcctctgcaacgacttgggcgtcgacctgtgggacgtcatccgctgcgccgagaccaagccgttcggcttccaggccttccgcccgggccccggtgtcggcggccacgcggtcccccaggacctgaccggccactcggggcgcaccctccggatggtcgaactggcgcaacaggtcaacaaccacatgccccagtacgtcatccagcgcgcggcgaccctcctcaacgagcacgggaaatcggcccgcggcgcgcgcgtgctgttgctcggcgtcacctacaagcaggacctcgccgaccagcagggctctcccgcccacgagatcgcgctgcgtctgatggaactcggcgcgtccgtcagctaccacgacccgcacgtccctgcctggagcgtcctcgaccgcccgatcccgcgcgccgactccctctacgaggcggcggcagacgcagacctcacgatcctgctccagcagcaccgcacgtacgacctccagggcctgtccgtgaaggcgcagctgctgctggacacgcggggggccactccgacgggggcggcgcaccggttg

SEQ ID NO: 4987 - DNA, 1704 bp, Streptomyces avermitilis
  CDS (1)..(1704)
gtgaggacagcgacactggggccggcggagcgcgccgagtcactggcgggaatggccgagcgcgagctggacgtgctggtcgtgggcggcggcgtggtcggcgcgggtaccgcgctggacgccgtgacacgcggcctgtccacaggcatcgtcgaggcacgggactgggcgtccggcacatccagcaggtccagcaagctgatacacggcggcctgcgctatctggagatgctcgacttcgcccttgtgcgcgaggcactcaaggagcgcgggctgctcctggagcggctggcgccgcacctcgtgaagcccgtcccgttcctctaccccttgcagcacaagggctgggagcggctgtacgcgggcgccggggtcgcgctgtacgacgccatgtcgatggcgcccggacacggccgcggactgcccacgcaccgccatctgacccgcagccacgccctgcgcgtcgcgccggccctgaagaaggaggcgctggtcggcgcgctccagtactacgacgcccagatggacgacgcccgctatgtggcgatgctggtgcgcacggcggcggcgtacggcgcgaaggcggcgaaccgcgcgcgcgtgaccgacttcctgcgcgagggcgagcgcgttgtcggtgccagggtgcaggacgtggaaggcggcggggagtacgagatccatgcccggcaggtcgtcaacgccacgggggtgtggaccgatgacacccaggcgatggtcggggagcgggggcagttccacgtacgggcgtccaagggcatacatctggtcgtgccgaaggaccggatccactccacgaccggtctgatcctgcggaccgagaagtccgtgctgttcgtgatcccgtgggggcgccactggatcgtcggcaccaccgacaccccctgggacctcgacaaggcacacccggccgcctccagcgcggacatcgactacctgctcgaacacgtgaactcagtgctgtcggtgcccctttcgcgcgacgacgtccagggcgtgtacgcgggtctgcggccgctgctcgccggagagtcggacgccaccagcaagctgtcgcgcgagcacaccgtggcccatccggtgccggggctggtggtcgtcgcgggcggcaagtacacgacgtaccgggtcatggccaaggacgcggtcgacgaggcggtgcacggcctcgaccagcgcgtcgccgactgcgtcaccgaggacattccgctgatcggcgccgaggggtaccgggcgctgtggaacgcgcgagcgcggatcgcggcccgcaccgggctccatgtggtgcgcgtggagcacctgctgaaccgttacggctcgctcgcggaggaactgctcgacctggtggcggccgatccctcgctgggcgcgccgctccaggccgccgacgactatctgcgggcggaaatcgtctatgccgcctcgcacgagggcgcgcggcacctggacgacgtactgacccggcgcacccgcatctcgatcgagacgttcgaccgcggcacacgcagcgcccgcgaggccgccgaactgatggcgccggtcctcggctgggacaaggaccagatcgagcgcgagatcgagcactacgagaagcgggtcgaggcggagcgggagtcgcagcgccagccggacgacctgacggcggacgcggcgcggctgggggcgccggacatcgtgccgcgg

SEQ ID NO: 4988 - DNA, 1059 bp, Streptomyces avermitilis
  CDS (1)..(1059)
atgccgaagccccggacagcccggacacctcggacactgctggccatacccgtgtccctggccctcctcggtttcgccccgggcggctttcaggctcccacgactccggccacggacgccctcctccccctgctcgtcactcgaggcggggctcccgctgccgccctgctggcccgcgaggagtccggcatccgcttcgcccgcgccggccggggaatcgaccgggccgaccatttccgcgccggcagcatcaccaagaccttcatcgcgacggtcgtgctgcaactggccgccgaacaccggctgtccctgtcggactccgtggaggatcacctgcccggcctggtgcgcggcgcgggacacgacggccgggccgtgacgctgcgcgccctgctcacccacaccagcggtctggccgacttcaccgcggacaccgcaggcaccgtccccgtgactccgcttcaggccgttcgcatcgctctcacccaccccccggccgaccgcggccgcttcgcctactccaacaccaactacgtcctgctcggcatggtcgtccagcaggtcaccggccactcgtacgccgtcgaggccgagcgccgcatcgtgactcccctccgtctgacgggcacctcgttccccggcgcccgcaccgctcttcccgatccgcacggccgcgcgtacgccgccgacggaaccgacgtcaccgaactcgacccgcgcgtggccggcgcggcgggcgagctcgtgaccaccctcgccgacctggaccgcttctacgcggcgctgctgggcggcgaactgcttcccgcgcatgggctgcgcgagatgctcgacacccgtaccgcacacggctcgtacggcatgggcctctatcccgtgaagctgccgtgcggcaccacggtgtgggggcacaacggccggatctccggcagctacgtgcgcaccgcagccaccgtcgacggccgtcgtgtcctcaccttccgggtgaacacggacggggtctcagaaccgggcctcgaacccgcggtgctcgccgccgagttctgcccccgcacctcg

SEQ ID NO: 4989 - DNA, 2178 bp, Streptomyces avermitilis
  CDS (1)..(2178)
atgtcggaggcggagcgggcgggagcatcccgtcaggacaagagcggacgtctcctcgccgggcggtaccggctgggagacgtactcggccgcggcggcatgggcacggtgtggcgggccgaggacgagaccctgggccgtacggtcgccgtgaaggagctgcggttcccgacgagcatcgacgaggacgagaagcggcggctgatcacgcgcacgttgcgggaggccaaggcgatcgcccggatccgcaacaacagtgcggtgacggtcttcgacgtggtcgacgaggacaaccggccgtggatcgtgatggagctcgtcgagggcaagtcgctcgccgaggccatccgtgaggacgggctgctcgagccgaagcgggctgccgaggtcgggctcgcgatcctcgacgtactgcgggccgcgcaccgcgagggcattctgcaccgtgacgtgaagccgtcgaacgtgctgatcgccgaggacggccgggtcgtgctcaccgacttcggtatcgcacaggtcgagggcgacccgtcgatcacctcgaccggcatgctcgtcggcgcgccctcgtacatctcgccggagcgggcgcgcgggcacaagccgggaccggcggcggacctgtggtcgctgggcggactgctgtacgcgtcggtcgagggtgtgccgccgtacgacaagggttccgcgatcgcgacgctgaccgcggtgatgaccgagccgctggaggagccgaagaacgcgggtccgctgaggagcgtcatctacgggctgctcgccaaggaccccgagcagcggctcgacgacgcgggcgcccgggcgatgctcaacgaggtgctccacgcgccccagcccaaggagccggagccggtggacgcgacgcgggtcgtggcgttgccgccggtgccggaggagggcacgggcaagggaagttcgggcggttccggagccaagcggggcgaggaggccgcggatcggttccgcggtgcgctgcgctcggtccgcaaggcggcgggggcggccacggcttcggccgcggcacgcgccaagtccggcggtacggacgtctccggggggaccggggccgcgggtgccggtacgtcttccgcgggctcctcggcgagcgcaagcgcgcctgcccccggtaagccgggagccgccgcggtcggtaagcccaacccgtcctcggccggtaagcccggctcctccgccgcggcgacgccggcgggcacggggagcggcgtcggccaggggacggccgtggggggcggtgggcgcgaaagtgctgtcgtcgggtcgaactccggtccggtgaaacccagttcgggatggcccgtcgtgccggagccggaccggcccccccggtccgtgcccagggcgccgctcaccgacgtggtgccgcggcggacgctggtgatcgtcgcggtggtcgtggtgctggccgtgctcggagtcgtgctcgccctcaccctcggtggcgacgacggcagttcgaaggacaacaagggcagcagcgacaccaaggccgcggcatccagcgggacgtccagcgggacgaccgcgggcagcagcggcacgcccaaggccggcggcagcggcagcggcagcggcggtacgcacacggacagcggcagcaaggacaacaccgggaccgggtcggacgagcaggagacggacgacagttcgtccgccgggacggccagcgggtccggaggttcggacgactccggcagcgggtcgggcgacagctccgtgaagacgtacaagagcagtcaggggttctcgatcgggctgccgaagggctggaagtaccagtccacgggagccgcgggggcccgtttcaccggtcctgacgggcagaagctgctcgtcggctggacgaccacgcccaaggacgacccggtcgccgactggaagaaccaagagcagtacatggtgcgctcgcagtacaagcggatccgcatagagcaggtggactaccgcggctggaacacggccgactgggagttcacctacacggagggcggcacgaagtaccggtcgatagaccgcggattcgtcgtcaacgcgcatcagggatacgcgctgatgtacaccgcgaaggcgtcggaatgggacagcgatctgcgcaaggacacatggcaaacgcttgccaagacgttccagccgaagtcg

SEQ ID NO: 4990 - DNA, 2679 bp, Streptomyces avermitilis
  CDS (1)..(2679)
gtggacgaatatgcgggacgggtactcgccgaccgttaccgtctgccactgccgccgtccgacgagtacgaactcgccgagacccgggccttcgacacctacagcgggcaggaagtcctcgtacggcaggtgccgttgcccgaggtcgtcgaggcggaggtgctcgacgccgacgggctgcccgcggggttcgtggcgcgcgacggcgggacgcggcgcgcctccgcgcgtacggccacgcgccggcccgccgaaccggccgtgcggcgcgcgatcgaggccgcgcaggccgccgcccagatacccgaccacccccggctcgaccaggtcttcgacgtgttcgccgagggcgggtcgctgtggatagtgagtgagttggtggccgcccggccgctggcggcgctgctcgcggacaaaccgctgagtccctaccgggcggccgaggtcgcctccgatgtcctcatggcgctgcgggtgctgcatgcgcacggctgggtgcaccggaacatcacggtgcgcacggtgctcgtctgcgacgacggccgcgtgatgctgacgggcctggcggccggggcggcggaagaggcgttgtgcgggtacgaccccgtgccggtccgggacttcgagccgcgcggggacgacggaggcgacggcaccggtggcaacggccgtggtgcggtgcgcggcgcggcggcgggcggcacgccaggcatcgggtccggccccggcgccggctccggccgccccggcatcggcgcgggctccggtggtccggtgggcgcggccggaggtgccgtcggcgcggcggccgggggcatgtcggtcgcggaggcggaagccgcgcgacgggccgcgatcgaggcgcgggcgggcggtgtgggcccggtggcgggaacgcccggcggcgaagtacccgcccgaggagcgcgcgccctcgaaggcggcggtgacgcgcgtgcgcagcgggccggggcgatcgccgcgtatcgcgccggggcgcgggccgcggcgcgggtccaggaggcacagcggggcgggcgggcggcgttgcccgcaccccggcccgccgacgccgaaggtcgggcaccgcagtcccccggacacggcgtggagcacctccccggtgcgctgccggggcagatcgccgacccgtacggcgtggcccggacgaactcctggcccggtgggtttccgggcgacgtcggcggagcgaacgtcggcggtgcgtacggaaccccgggcaacggcagcggcacgtacgagaacggcagcgtcccgcacgctcccgccgacgcgcccgtctccacgcccactcccgccgacgcggtgcctcccacccactgggaccacctggtctccggctcgtccgccccctccggcccgtccgccgcctccgtgccccgccggggccccaccaccgcgctcgccgccgagcgggcgcgacaggcgcggatggccgtcatcgggcccgtcaccgagcggtgggcacccgagcaggccgggcccgtgcacgagaactggcagctggcggcgccgatcgggcccgcgaccgatctgtgggcgctcggcgcactgctgttcagggccgtgcaggggcatgcgccgtatcccgaggagaacacggccgagctggtgcagttggtgtgcgccgagccgcccgcgttcgccgaggagtgcgggccgctgcggcccgtcgtggagtccttgctgcgtcaggacccgaccgaacggctcgacttcgaggaggtgcgcggctggctgcgctcgctcgtgcggtccgcccccgagccggaggcgggcgcgcacgtcgtggcggcgccccccgtcgacccccgtcggctgccgatcgtacggcgccgcggcgagctcgtccgcaggcgtcgcgccaggctgcccgcgaccaccccgcacgcccgtcacaagcgcgccaaggacggccgcccgcccaggccgaagaggctcggccggaacctggtcctgctgatactgctcgttctcgccgcggcggtcgcgtacgcgatggtgttcatgccgaaggcctcaccgaacagcgacagcggcagtcgttcggacggcgaccggaccggtgccgccggcggtgtcagccccgcgcccgagcagtcgggcggcggcagcgagccgcggcccgaccagacttccccgggttcgggcaagagcccctccgggtcctcgggttcgacgcgggaacagaccaccgaccccgacgtcgcccagggcttcaccctgcgcaaggaccccgagggcttccgcgtcgcggtcgccaccggctgggaccgcgcgccgaagaacgggcgcggccggatcgtctactcccacggcgacttcgagctcatcgtcgtacccgggcgggacagcacggccgaccacggcagcgatccgctgacgtaccagcgcgagacggagagcgagttacagccgttccgcgactcgacctgggccacgtccagcggtatgcggcgtatcgacgtcggcgggcggaccatggccgaggggcagttcacctggaccgacggtcagggacgcgagttgttcgtacgcaatctcgcgatcgtcgtcggcgggcgctaccacgtggtgcagttacgcggcccggaggccgaacgcgacgaggtgacccggctgtacgagcaggcgtcgcggacgtatcaagtcaccggc

SEQ ID NO: 4991 - DNA, 1641 bp, Streptomyces avermitilis
  CDS (1)..(1641)
gtgaatcagatgcagggcctgctcctcgcgggccgctaccggctcgtcgactcgatcggcagcggtggcatgggccgggtgtggcgcgcccacgacgaggtgctgcaccgcgcggtcgcggtcaaggagctgaccgccgcgttgtacgtctcggagagcgaccggcccaggctgctcgcccggaccaacgccgaggcgcgggcggccgcgcggatcaaccactcggccgtcgtcacggttcacgacgtcctggagcacgacaaccggccgtggatcgtgatggagctggtcgagggcggctcgctggccgacgcggtcaaggagcggggacgggtggagcccgtcgaggcggcccggatcggactgtgggtgctgcgcggactgcgggccgcgcactccgccggcgtactgcaccgcgacgtgaagcccggcaacgtactcctcgccaccgacgggcgcgtgctgctcacggacttcgggatcgcgcaggtcgagggcgacacgaccatcacgcgtaccggggagatcgtcgggtccgtcgactatctggcgcccgagcgggtgcgcggccacgaccccgggccctcctccgacctgtgggcactgggggcgacgctgtacgcggcggtggaggggaagtcgccgttccggcggacctcgccactgtcgaccatgcaggcggtggtgggcgaggagcccggcgcgccgcagtacgccggtgcccttgctcccgtcatcaccgccctgctgcgcaaggaacccgccgagcgccccggttccgacgaggcggagcagatgctcgccgaggccgcggaggggcggcggccgcgggcggcgcaggcatatgtggggacgctccatggggagttgagacaggggaacaccaccacccatgtgccgcggccccagggggcgcagggggtggacccggccgacgccaccccgcgcgagccggtcacgggctccgcgttcgcgaccgcctcggccgcgcccgccgtgccccggaaacggcgccgaggccgtacggccgtcatcgccctcgtgctcgccgcactcgtcggcggtggcggcgcggcggcgatgaaatacgcggacgactggaacaagggcacgggccaggacaagggcagcgccgcggcgagtacgcacccggagaccaccgccggtgccgtccccgacaactgggttccggtgaccgaccccgtgggcttcggcctgtccctgcccaagggctggaagcggcaggtctacggcatccagggcgacctcaagcagatcgactacacgcccgaccgcggcaagcacttcatccgcatcgccatcgacgactccccggacttcagcgacccgtaccagcaccagatcgacctggagcagcagctccagcggctggtcgactacaagcgggtgggcatggaggtcaacacgtaccgtgaccgcaggggttccctctgggagtacacgtggacggcgctggccaaggacatagagtttcccggaccgcgccgcgccatcgaggagacctacgtctcccgggacggggtcgagtacgcgatctacatgtcctcgcccgcggaggactgggcgaccacacgcaagcagttcacgaccgtgctccagagctggcggccgaagagcgcc

SEQ ID NO: 4992 - DNA, 1155 bp, Streptomyces avermitilis
  CDS (1)..(1155)
atgatggggcgcatggggaccgagggggagaacgtccgcgtcatcgcgggccgttaccggctggatgccaggatcggccggggcggcatgggcgtcgtatggcgcgcgaccgaccagctgctcggccggcaggtggcggtcaaggaactcgccttcgacacctcgctctccgatgaggaggcccggctacagcgcgagcgcaccctgcgcgaggcccgcgcggtcgcccagttgagccacccgaacatcatcgtcgtccatgacgtcgtcgtggacgacgaacgcccctacatcgtgatggagctgatcggcggaggctcgctcgccgaccggatctcggcggacggcccggtcgacgcgcgcgaggcggcacgcatcggcatcgacctgctgggcgcgctggggcgggcgcacggcgcgggggtcctgcaccgcgacctcaagcccgccaacgtccttctggaggccgacagcgaccgggtcgtcctcaccgacttcggcatcgcccaggtcgcgggtgccacgacgctcaccgagagcgggtcgttcgtcgggtcgcctgagtacaccgcgcccgagcggatgtccggcgtcaggacagggccggaatccgacctgtggtccctcggcgcgctgctgtgcaccgtcctgagcggtgaatcgcccttccgccgcgactcgttgggcggcatcctgcacgcggtggtcgtcgacgacatccggccgccggcccaggccgaaccgatccttccggtcgtacgagggctgctggagcgcgatccggaccggcgtctggacgcggcggaggcggcccggctgctgcgggagtttctggacacgggccgtacgccacgggtgccgacgggggccgggtacacgccgacacagcgggacgtgccgcgcgcgcaggcactgcacgccgacgcgccgccacggcaggagccggaggccacgcccacggcggccacggcggcgcaagccgcccggcactccaggcgcggggtgctgatcgcggccgcgctggtcgcggcgatggccggggcgggcgtgtcggccgccgcgctgctgatgcacaagggcgtggacggcggcggtcccgggcccacgagttcgcggccgcggacctcggtgagcaccggcccctcgcggtccgcc

SEQ ID NO: 4993 - DNA, 387 bp, Streptomyces avermitilis
  CDS (1)..(387)
gtgcccgagggattcacccgggtaccccagggggagcggatcttctacatgtccccggggcagatcttccgcatcggcatcaggacggcggacccggcggtgggcggaccgctcgcggtgatgcggcacgcggacaccaaggggccgtccacgaaccccggctaccgcgacggccgggtcaccgagaccacgcacggcgaccacccggccgcgctctgggagttcacctggaacggcttcagcacggcggaggggccgcggcacacgtacgacctgtgctgggaggagggcggccggatgtacgacgtgtgggtgtcggcgccggtcggcaaggtgcgagaggcgaaggagtacttcgacgtcgcggtggacacgttcgcagtttcg

SEQ ID NO: 4994 - DNA, 1734 bp, Streptomyces avermitilis
  CDS (1)..(1734)
atgagcaacaacgggggagtctcctacggggccgacgagccgacgagtttcggtctgcaaccaccgcgtccgggtgtcccgcacccgggaaacccgtacgcccagccgcagccgcagccgcagccgcagccgcagccgcagccgcagccgcagccgcagccgcagccgcaaccccagccccagtcgcacgcacacgcgcatgcacaccccacgcagcagatgcccccgcaggcgatgcccgagacgccgcccggcgaacccggcaccggccgcctcatcgccggtcgttaccggctgctcgccaagctcggccacggtggcatgggcacggtgtggcgggccaaggacgagacggtggaccgtgaggtcgcggtcaaggagccgcgcgtcccggaccaccttcccgagcgtgaacgggccaacgtgttcgagcggatgcgccgcgaggcacgcgccgcggcccgcctcgaccacccggcggtcgtgaacgtccatgacgtggcggtcgtggacggccggccgtggatcgtgatggagctggtgcagggccgttcgctgggcgccgcgctccaggagggcacgctcggggcgcgtgagacggcgaaaatcggcctggaggtgctcggcgcgctggaggccgcgcacgcggcgggcatcctgcaccgcgacgtgaagccggacaacgtcctgctcggccggcacgaccgggtcgtcctcaccgacttcggcatcgcccagatcgagggcgagaccaatctgacggacaccggcggcttcgtcggctcgcccgagtacatcgcgccggagcgggtgctgggccagcgccccgggccggcgagcgacctgtggtccctcggcgtggtgctgtacgcggcggcggagggcgtctcgccgttccgccgcagcaacacccccgcgacgctccagtccgtcctcaacgccacgccggctgccccggccgcggcgaagggaaccctggcgcaggtcatcaacggactgctgaacaaggacccggcgcgccgcccgaacgcggccgaggtccgccgcctcctggaggacgccgccaggccgccgcagcagacgcaggtcgtgcagatcgcgggccccggcggcaagggcttccgggtgggccgcaaggcgctgttcggcctcggtgcggcggtcgtcgcggcggcggtggcggcgtacctggtgatcgcggatcccttcgcgggcccgctgccggacacctggaagcagcgcgaggtcccgaggctggacgcgacgctggccgtaccggcggactaccaggtgagcaggccggagaagagcgacaccgacaagaactgggtgacgtacagcgactggagcggcagcatctggatcggcctgcacctggcgaagaagtccgaggacaccagcaaccagatcaaggactccgcggcggccgagatgtacgccgagaacggggagttcaaggagagcggcgcgtacgaactctccatgccggagaaaccgaagacgcgcacggccgagacctcgtaccagggcaagaaggccgccgagaacacggtggtctacacgaccaccgacagccagaacccccgcccgcgcgaggtgcggatcttctactacaagaactccgcgggcaacatgtacaaactcacggtgagttatccgggcaagggcgacttcaccgagcgcggccgcgaggtggcgaagacggcgatcgcgaacctggacgtcgacaagctg

SEQ ID NO: 4995 - DNA, 801 bp, Streptomyces avermitilis
  CDS (1)..(801)
atgcatagacccgctcgctcccgcgccgccgtcgccgtcatcacgtccatactttccctttctctggcgaccggctgttccgggaccaagtcggacagcgctgacgacggctccggcaagggctcccggtcgaccggggcggccaaggccctgagcaagcccgagttggcgaagtcgatcatcgcccagggcgacgtcaaggggtacaaggtcgggtccgccgaccgggccgacgcggccacgacttccaaggacgacatcaaggtcgtcgacgagaagtgcgagccgctcgcgtacgtgctgagtggcttcgctccgggggactcgacggcgtacgtgaaccgccaggtcaccgagaagaaggctgcgccgagcgcggcgtcggacctctccgaagacgcgacggaagaggagttcgaggatgccctcaccgaaggaatgagcgtgtcggtgaccatcgtctcgctctcctcgtacgagggggacggcgccgagaaggccacgacctccgtctccgacgcactcgacgcgtgcgcgaacgggttcaaggtctcctccgacggcgacagccagaagttcaccaaggttgccgaggagaagagctccggcgaaggtgacgattcggtggcgttcgcggtgaccggggacatggacggtgacacgggcacggtgcacggcgaggtcgtccggcgcggcagcgtcgtcgccacgtactacacgctcaacctgggggcgatgatgtccgggaaggcgtacgacatcccggccgagatcatcgcggcccagacctcaaagatcagc

SEQ ID NO: 4996 - DNA, 183 bp, Streptomyces avermitilis
  CDS (1)..(183)
gtgaccgaactcaactggcagaagtccacctacagcgaggaagcctcttcctgcgtctacctcgccaccacccccaccggaacgatcctcctccgcgaaagcgacgaaccggagatcgtccttaacaccggcacccgccagctcagtgccctgatatccgccctgcggaatcgggccgccctg

SEQ ID NO: 4997 - DNA, 849 bp, Streptomyces avermitilis
  CDS (1)..(849)
atgccgccacggcagacacccacggcgcgccagctccgtctgggagttgagctgcgcaagctgcgtgagggcgcgggactcaccgcccgagaggccggcgagatgatcggcgccaaccaggccgggatcagcaacatcgagacaggccgcttcgggctcagcgagcagcgcattcgcaccctcgcccataactacgactgcaccgacgagcctttgatcgatgccctcgtcgccatggcagcccaccgcgaacgcggctggtgggaggagtaccgagacaccctcccgccccgcttcctcgacgtcgcggagatggagcaccacgccagggccctgcgggtggcccaggtcatcaacatccccggcctgctccagaccccggagcatgcccgcactctcttccgccaggtggtcccggccctacgcccgcacgagatcgagtaccgcatctcccaccgcatcaagcgccaggccgtcctttaccgcgagcaggcaccgtcgtacacggcgatcgtccacgaggccgcgctgcgcatgcggttcggaggccccgaggtgtcccgggctcagctggaccacatcatcgaggtgagcgaacagccgcacatcaccgtgcgggtcatccccttcgacggcaccgtgttccccaccgtcggccatggactcgactacgcctccgggcccgttcgcgcactcgacaccgcgcagctcgacgcagcccacggcagcgaactcatcgacgccccggcacagttgaccaagtaccgactgatcctggaccgcatggagaatgccacccttgagccggatgagtcccgcgacctcatccaccgcatcgcccacgccgct

SEQ ID NO: 4998 - DNA, 486 bp, Streptomyces avermitilis
  CDS (1)..(486)
atggtcaccgtatccccgccgaagtccgaagcgtccccatcttgggcgtacgtgcttcagttgccccacgaccgatgtgccccgcgcatcgcccgcgtcactctccgggcggtcctggccgggcacgggctgaccgggctcaccgacaccgccgagctggtgacctcggaactcgtcaccaacgcctaccgccacaccaccggccccgccaccctccgcctccgcgccctggccggcgcccggctccgggtgagcgtctgggacgccaacccccacatcccgccccccttcgacaagcgcccgggcccgccgcaccccgtccaccctgcccccgtcgaggccgacggcgggcgtgggttgttcctcgtatgccactacgcggacgcgtggggtgggtacccgctcgggggcggcctcttcgggcggggcgggaagctgctgtggtgcgagatcggaccgcccgccgccgatcgagtcgccgcggcg

SEQ ID NO: 4999 - DNA, 1371 bp, Streptomyces avermitilis
  CDS (1)..(1371)
gtgggtgtggtgctggaagaacgggaccatgcggcgcagcggtgggcggcccggggctcgttgggcgctgccgtgctcgccgtggtgctgcccgtcgtgaccgccggggtcggcagcctgctgctcgtcggggccgggctgctcggcgcggtggtcaccgcggccgcgctctggtgggtgctcacgcgccggggtgtggtccgggccgcggccgcggtgctggccgtcggctcgcccgtcggcgtcatcgtgctcttccacgcggcgcaactgctgtgggtcgtcgtcgtgtcgctcgtgctgtggagcgtggccgtctgggccgggaagaccgcgctcagcagtacgcgctcgcaccacgtgcgggtgaccgagtacgagacgcccgctcccgagcgggccttcttcctgatgaacccgcgctccggcggcgggaaggtcgaacggttcgggctgcgcgagaaggcggagcggctcggggcgcgcgtccatctgctcgatcccgagaggcccgaacccgaagacgtcgccgcgctcgccagggaagccgtggcgaacggagccgacctgctcggcgtcgcaggcggagacggtacgcaggcgctcgtcgccgccgtcgccgccgagcacgacatccccttcctggtcgtctccgccggtacccgcaaccacttcgccctggacctcgggctcgaccgggacgatccttcgacctgcctggacgcactcgccgacggggtcgaactacgggtggacctcggcttcgccggagagcatccgttcgtgaacaacgcctcgttcggcgcgtacgcggcggtcgtgcagagtcccgcgtaccgcgacgacaaggtgggcaccacgctcgaactgctgccggacctgctgaccgggcagcgcggcccgcagctcaccgcccgtgcgcaggacgccgtgatcgaggcgccccaggccctgctgatcagcaacaacccgtaccgcatggacgaccccgccgggctcggccgacgtgagcgcctggagtccggggtgctcggcgtcctgggcatcaaggtggagagcgctgccgaggccgccgggctgctgctcggccggcacgcgaccggcctcacggtgctcaccgcccgcgaggtcctcgtcgacgccgaccgcccgcagatcgacgtgggcgtcgacggggaggcgctggtcctgcccacgcccgtgcgatgccgtatcgagccgggggccctgcgggtacgggtcccccgtgaccggcccggggtgcccgaggcgaaacccccactggactggcgcagactgcgcaagctcgcggcgacggtggggcgcacggcgctgccgaaggggcgcgcgcggggtgcggggacgcctcgc

SEQ ID NO: 5000 - DNA, 1629 bp, Streptomyces avermitilis
  CDS (1)..(1629)
atgacggactcgcaggccccggaaaagaccggcaccgacgacacgaccggcaccaatcccctcgctcccgcccccgcgggcgcccgtaccgccgccgacgtggtcacgccggagctggtcgcccagctcaccaagggagtggtcggctccggccgtaccgccaaccacacgccgttcaccggcgaaaagctggccgacctgcccgagtccacccccgaggacgtcgcgaccgccttcgagcgggcccgtgccgcgcagatcgcctggggcgcgacgcccgtacggcagcgcgccgccgtcctcctgcgcttccacgacctggtgctggcccggcaggccgaggtcctcgacctcatccagctggagacgggcaaggcccggctgcacgcccacgaagaggtgcaggccgtcgcggtcgccgcccggcactacggccgcaaggcgcccgcgtacctgaagcccaagcggcacgccggtgccatgccgacgctcacgcgcgtcaccgaactccgccacccgcggggggtcgtgggccagatcgccccttggaactacccgctggagctgtcggtcggcgacgcgctgcccgccttcgtcgcgggcaacgccctcgtcatgaagcccgacaccgagacctgcctcaccgccctgtgggcgcgcgacctgctcatcgaggccgggctgcccgccgaggtcttccaggtcgtcatcggcgaaggcccggtcgtggggcccgaggtggtcaagcacgccgactacgtctccttcaccggctccacccgcaccggccgcgaggtcgcccagggcgcggccgcccggctcgtcggcgtctccctcgaactcggcggcaagaacgccatgctggtcctggaggacgccgacatcgacaaggcggccgccggcgccgtccgcgcctgcttctcctccgccgggcaactgtgcatctccatcgagcggctgtacgtccacgagtccgtcgccgacgcgttcgcggagcgcttcgccgcccggaccagggcgatgcggctcggcacgtccctcgcgtacggcgccgacatgggctcgctggtcggcgagcgccagctggagaccgtgacccggcatgtcgacgaggccgtcgcgaagggcgcgaagctcctcgcgggcggcgtcgcgcgcccggacatcggcccctacttctacgagcccaccatcctcgacggtgtcgaggccccgatgtccgtgtgcaccgaggagaccttcggcccggtcgtctccctctaccgcttcaagaccgaggacgaggcggtcgaactcgccaactccacgccgtacggcctcaacgcgtccgtctggacgaaggacggccggcgcggacgcgcggtcgcggcccgcctgcgcaccggcacggtcaacgtcaacgacggctacgcgcccgcgtacggcagcgtccagtcgccgatgggcggcatgaaggactccggcctcggccgccgccacggctccgaaggcatcctcaagtacaccgaggcgcagaccgtcgcccaccagcggctgctgccgatggcgccgtcgctcggcatggacgacgagaagtacgcggagttcatgagccgcagcctcaaggcgatgaaggcgctccggctgcgc

SEQ ID NO: 5001 - DNA, 1803 bp, Streptomyces avermitilis
  CDS (1)..(1803)
gtgccacaggagaactctgcccaaccgccggtgggctacccgtacgactacgacgtcatcgtcgtcggttccggcttcggcgggtcggtcacggccctcaggctcaccgagaagggctaccgcgtaggcgtgctggaggcgggccgccgcttcacgcgcgagtcgctgcccaagaactcctgggacatcaagaactatctgtgggcgcccaggctcggcatgtacggcatccagcgcatccacctcctgggcaacgtcatggtgctggcgggcgccggggtcggcggcggctccctcaactacgcgaacaccctctacgtaccgccgaaggccttcttcgacgacccgcagtggaaggacatcaccgactggcaggaggaactgaagccgtactacgaccaggcgcggcgcatgctgggcgtgcggctcaacccgaccatgacgccgtcggacgtccacctcaaggcggccgccgggcggatgggcgtcggtgacaccttccacatggcgccggtcggtgtcttcttcggcgacgggcaggacgcggacgggacggcgaaggccaagccgggcggcgaagtggaagacccctacttcggcggcgcggggcccgcccgcaaggcgtgcaccgagtgcggggagtgcatgacgggctgtcgccacggggcgaagaacaccctcaacgagaactatctccacctcgccgagcgggccggcgccgtcgtgcacccgatgacgaccgtcgtcgcggtcaccgacgactcgcagggcgggtacgcggtccagaccctgcccaccgacgagaagcgcaagggccggggcaggaccttcaaggcgcggcgggtggtcgtcgccgccggtacgtacggcacgcagaccctgctgcaccggatgaaggagggccgtcaactgccctacctgtccggcaggctgggcgagctgacccgtaccaactccgaggcgctggtcggcgcgcagaccgactcccgccgctaccgcaaggcgcacggcgagcccacggtcgacttcacgcgcggggtcgccatcacgtcctccatccaccccgacgcgaacacccacatcgagccggtccgctacggccggggctcgaacgcgatgggcggcctgtccatcctccaggtcccctacgcggagggctcctcgcggctgctcgcctggctggccaacgcggcgaaacacccgctgctggtggcccgctcgctctccaaccgccgctggtccgagcggaccatcatcggcctggtgatgcagtcgctggacaactccctgacgacgtatctgaaaccgaagggcgcgggcaagggcctgctgacggcacgccaggggcacggcgcgcccaaccccaagcagatcagggcggcttcgcaggccgcgaccgtgatcgccgaggagatcaacggattcccgggcagcaacgtgggcgagctgatgggaacaccgctgaccgcgcacttcctgggtggctgcccgatcggcgactcgccggcgtcgggggtcatcgacccgtaccaccggctgtacggccaccccggtatctcggtcgtcgacggcgccgcggtctccgcgaacctcggcgtgaacccgtcgctcaccatcacggcccaggccgagcgggcgatgtcgtactggcccaacaagggcgaggcggacccgcgtccggcgcagggagcggcgtacgaacgcctgaagccggtggagccgcggcacccggcggtcccggcggacgcgttcggcgcgctcaggctgccgttcctggggatgccgacggtgccgccgaaggag

SEQ ID NO: 5002 - DNA, 759 bp, Streptomyces avermitilis
  CDS (1)..(759)
gtgagggtgggaaacgtgaagtcaaaggtgtcgcggatcgcggtggccgtctcggtggcggccgcgctggggctgaccgcggcgtgcggcgggggcggcggtgacggcggcaagggggcgaagccgtcgaaggccaagggctcggaggcggcccaggccgacccgaaggcatcgcccgcgggcagcggggcgctgacccgggccgagttggagaaggcggccctggcgtccggtgacgtcaagggctacggggtcaagaagacggccgcgtcggacatcggcctcgactccgtaccggcggacccggctgcctgccagcccgtcgcggacatgttcctgttcaccagcgacccggccgcgcgggccgccgtgggccgcagcttcgccgccaaggacgacctcgacgcctcggtcacctccctggcgctcctcgcgtacggctccggcgaggcggagcaggtcctcgacggtctgcgcacgtcgaccggcaagtgcaccaagtacgagcacaccggctaccagtactccggggtcaaggtgctcaaggacccgggtctcggcgacgagtccgtcgcgtaccggctcctcggctcgatcgagggcgcctcggtgccgacgaccttcaccgtcgtacgcgtcggcacgaccgtcgtcaccttcaccgcgatgaacatgctggacggggacaaggtgaaggtcccgtccgcgatcgtcgacgcccagctgaagaagctcaagaagctgaagaaggcgacggcc

SEQ ID NO: 5003 - DNA, 282 bp, Streptomyces avermitilis
  CDS (1)..(282)
atggccgaagtactcgacaggaccggcgcccgtaccgtcgaggccgccgatgtcatcagcggtgcccgtgagcgcatcgactccctcgacgaccggatcatcgggctcgtccaggaacggatggccgtgtccgccgtcatccaggaggcgcggatcgcgtcgggcggccgccgggtgaacctctcccgcgagatggaggtcctcggccacttcagggacgccctcggcaagcccggcacctcgctggccatgacgctgctcgaactgtgccggggccgcatc

SEQ ID NO: 5004 - DNA, 543 bp, Streptomyces avermitilis
  CDS (1)..(543)
atgggcagtggctccacgggcctcaaggacaagccccacggctccgtgcgacggcagttcgaccagctcacgcgcgagatcgcgaagttcggcgcggtaggtggcgcgggcctgctggtcaacctcctcgtgttcaacctggtacgcagtgtcaccggcctccaggtcgtccgcgccagtgtgatcgccacgatcgtcgcgatcatctgcaactacatcggcttccgctacttcacgtaccgggaccgtgacaagagtggccgcaccaaggaactgacgctgttcctgctgttcagcgcggtgggcctggtcatcgagaacggtgtgctgtacgtggcgacgtacagcttcggctgggacagcccgttgcagagcaacatcttcaagttcctcggcatcggcctcgcgacgctcttccgcttctggtcctaccgcacatgggtgttccgcacgctgccggcccgggaggccatagcgagtgcggaatcgttccttgaggaggaacccgagcgaccccggcccgggtccagcccccggatccgc

SEQ ID NO: 5005 - DNA, 1221 bp, Streptomyces avermitilis
  CDS (1)..(1221)
atgggcggccccggaagcggcaccctcaggtaccgaaaccggccactatggcgcggccgatactcttggagcgtgacgttcccggtagtcggcatggtcggcgggggtcagctcgctcgtatgacacacgaggcaggcatcccgctcggcatcaggttcaagctcctcagtgacacccctcaggattccgcggcgcaggtcgtcggcgatgtcgtcataggcgactaccgcgacctcgacacgctgcgcgagttcgcgaaggggtgcgatgtgatcaccttcgatcacgaacacgtacccaccgagcacctacgggccctggaggcggacggcatccccgtccgcccggggcctgacgcgctcgtgcacgcccaggacaagggcgtgatgcgggcgaagctcgacgcgatcggggtgccgtccccgcggcaccggatcgtgcgcgacgtcgacgacgtcgccgccttcgcggccgagggcgacggtttccccgtcatcctcaagaccgtccgcggcggctacgacggcaagggggtgtggttcgtgcgctcggccgaggaggccgaggaccccttccgcgcgggcgtcccggtcctcgccgaggagaaggtcgacttcgtacgggaactcgcggcgaacgtcgtgcgctcgccgcacgggcaggcggtcgcctaccccgtcgtcgagtcccagcaggtcgacggcgtctgcgacacggtgatcgcacccgcgcccggcatctcggacgagctggccctcgaggccgaggcgctggccctgcgcatcgcgaaggaactcggcgtcgtcggtcacctggccgtcgagctcttcgagacggtgaccgccgagggcgaccaccgcatcctcgtcaacgaactggcgatgcgcccgcacaactcgggccactggacccaggacggcgcgatcacgtcccagttcgccaaccacgtccgcgcggtcctcgacctccccctcggcgacccgcgcccgcgcgccacgtggacggtcatggcgaacgtcctcggcggcgactacccggacatgtactccgcgtacctgcactgcatggcccgcgacccccagctcaagatccatatgtatggcaaggacgtgaagcccggccgtaaggtcggccacgtgaacacctacggcgacgacctggacgacgtcctcgagcgcgcccgtcacgcagccggttacctgagaggcacgatcaccgaa

SEQ ID NO: 5006 - DNA, 531 bp, Streptomyces avermitilis
  CDS (1)..(531)
atgaccgcacccgtagttggcatcgtcatggggtcggactccgactggcccgtcatggaggccgcagcgcaggccctcgacgagttcgagatcccgtacgaggtggacgtcgtctccgcgcaccggatgccgcacgagatgatcgcgtacggcgagcaggcggcggagcgcgggctgaaggcgatcatcgcgggtgcgggcggcgccgcccatctgcccggcatgctggcgtccgtgaccccgctgcccgtcatcggcgtgcccgtcccgctgaagtacctcgacggcatggactcgctgctgtcgatcgtgcagatgccggccggtgtcccggtcgcgaccgtctccgtcggcggcgcgcgcaacgcgggcctgctggccgcgcggatgctggccgcgcacgacgcggaactcctcacccgcatgcgggagttccagcaggaactgaacgaccaggccaccgagaagggcaagcggctgcgcgccaaggtcgacggcgcgtcgggcggcttcggcttcggctcggggaag

SEQ ID NO: 5007 - DNA, 1191 bp, Streptomyces avermitilis
  CDS (1)..(1191)
atgtcctcgccggagcaggcctctttggagcgcgcccgcgaactcctcgccgagttccccgtcgtcgacggccacaacgacctgccctgggccctgcgctcccaggtccgctacgacctcgacgcccgcgacatcgccaccgaccagcgcgcccacctgcacaccgacctcccgcggctgcgcgagggcggcgtcggcgcgcagtactggtcggtgtacgtccgctcggacctgcccggcgccctcaccgcgacgctcgaacagatcgactgcgtacggcagttgatcgcccgtcaccccgccgatctgcggggtgcgctgacggcggcggacatggaggcggcgcgcgcggagggccgtatcgcgtcgctgatgggcgccgagggcggccactccatcgacaactccctggccgcgctgcgggggttgtacgcgctgggcgtgcgctacatgacgctgacccacaacgacaacatcgcgtgggcggactcggcgacggacgtgcccgcggtgggcggtctgtcggagttcggccgcgaggtcgtccgggagatgaaccgcgagggcatgctcgtggacctctcgcacgtggcggcgacgaccatgcgggacgcgctggacaccacggccgcgcccgtgatcttctcccactcctccgcgcgggcggtgtgcgaccacccgcgcaacatcccggacgacgtactggagcggctccccggcaacgggggagtggcgatggtgacgttcgtaccgaagttcgtgctccaggcggccgtcgactggacggccgccgcggacgggaacatgcgggcgaacggcttccaccacctggacaccacaccggaggccatgaaggtccaccgcgccttcgaggagacgcacccgcgccccgtggccaccgtgtcgacggtggcggaccacctggaccacatgcgcgaggtggccggcgtcgaccacatcggcatcggcggcgactacgacggcacggccttcaccccggagggcctgagcgacgtctccggctacccgaacctgctcgcggagctgctcgaccgcggctggtcgagcaccgacctggccaagctgacctggcagaacgcggtacgggtgctgggcgcggccgaggacgtggcgcgggacctccaggcgaagcggggaccgtcgaacgcgacgctggggcagctggactgc

SEQ ID NO: 5008 - DNA, 390 bp, Streptomyces avermitilis
  CDS (1)..(390)
atggccgctgtgacccgtttccgctccgtcgtgctggactgccccgatccccgggagctggcccgtttctacgccgggatcgtcggcggctcacccgaggacgaggaccccgactgggtcgtgctccaggtcccgggcggtccgctgctgtccttccagcgggcgcccggacacaccccgcccgagtggccgcgggccgaccggaactcccagcagttccatctcgacctcgacgccggggccacctgggaagaggtcgacgcggcccacgagagggtgctggcgctcggcgcgcggccactggatctggaggacgacgtcaagaaggacttccgggtgtacgcggatccggcggggcatccgttctgcctctgccggatcgaggagtcc

SEQ ID NO: 5009 - DNA, 1341 bp, Streptomyces avermitilis
  CDS (1)..(1341)
atggccctcaagatcaccgtgatcggcaccggctatctcggcgccacacacgccgcggccatggccgagctcggtttcgaggtgctcggtctcgacgtcgtgcccgagaagatcgagatgctccagcggggcgaggtcccgatgtacgagcccggtctcgaggagctgctgcgcaagcacgtcgccgggatcgaggggtccaccgggcggctgcgcttcaccatggacttcgccgaggtcgcggagttcggcgacgtccacttcgtctgtgtgaacacgccgcagaagcacggtgagtacgcgtgcgacatgtcgtacgtcgacagcgccttcgaggcactcgccccgcatctgaaggcccccgccctcgtcgtcggcaagtccaccgtgcccgtcggctcggcggaccggctcgcggcccggctcgcggagctggcgcccgccggtgaggacgccgagctcgcctggaaccccgagttcctgcgcgagggcttcgccgtccaggacaccctgcaccccgaccggatcgtcgtcggcgtgcgcagcgagcgcgccgagaagctgctgcgtgaggtgtacacgactccggtcgccgagggctcgcccttcgtggtgaccgacttcccgaccgccgagctggtgaagacctccgccaactccttcctcgccaccaagatctccttcatcaacgcgatggccgaggtctgcgaggccgcgggcggcgatgtcgtccagctggccgaggcgctcggtcacgacgaccggatcggcaagaagttcctgcgggccgggatcggcttcggtggcgggtgcctgcccaaggacatccgtgccttcatggcgcgcgccggcgagctgggcgccgaccaggcgctgaccttcctgcgcgagatcgactcgatcaacatgcgccgccgtggccagatggtcgagatggcgcgcgaggcgctcggtggcggatcgtttctggggaagcgggtcgccgtcctcggtgccaccttcaagcccgactccgacgacgtacgcgactcgcccgcgctgaacgtcgccgggcagatccacctccagggcggccaggtcacggtgtacgacccgaagggcatggacaacgcccggcggctgttcccgacgctcggctacgccgactcggcggtcggggccgtgcggggcgccgatgtcgtactgcacctgaccgagtggcgcgagttccgtgagctggacccggcggccctcggcgaggccgcctcggcccgcgtcctgctcgacgggcgcaacgccctcgacccgcagctgtggcgccgggcgggctggacgtaccgcgcgatgggccgccccaccgcc

SEQ ID NO: 5010 - DNA, 1155 bp, Streptomyces avermitilis
  CDS (1)..(1155)
ttggccggatcggctgatttcgacctgtaccgcccgtccgaggagcacgacatgctccgggacgcgatccgcgcgctggccgaggcgaagatcgcgccgtacgccgccgcggtggacgaggaggcccgcttcccgcaggaggcgctggacgccctggtcgccaacgacctgcacgccgtgcacgtacccgagagctacggcggcgcgggcgcggacgcgctggccacggtcatcgtgatcgaggaggtggcccgcgtctgcgtgtcgtcctccctgatcccggccgtgaacaagctcggctccctgccggtgatcctctccggctccgaggacctgaagaagaggtacctgtcgccgctggccaagggcgacgcgatgttctcgtacgcgctctccgagccggacgcgggttcggacgcggcggggatgaagacgcgggcggtccgcgacggcgactcctacgtcctcaacggtgtgaagcgctggatcaccaacgcgggcgtgagcgactactacacggtcatggcggtcaccgaccccacgaagcgctccaagggcatcagcgccttcgtggtcgagaaggcggacgagggcgtctccttcggcgccccggagaagaagctcggcatcaagggctcgccgacccgcgaggtctacctcgacaacgtgcgcatcccggcggaccgcatgatcggcgaggagggcacgggcttcgccacggcgatgaagaccctggaccacacccgcatcacgatcgccgcgcaggccctcggtgtcgcccagggcgccctcgactacgccaagggctatgtccaggagcgcaaacagttcggcaaggcgatcgccgacttccagggcatccagttcatgctcgcggacatggcgatgaagatcgaggccgcgcgtcagctgacgtacgcggccgccgccaagtcggagcgcggcgacaaggacctcaccttccagggcgcggcggccaagtgcttcgcgtcggacgtggcgatggaggtcaccacggacgcggtccagctgctcggcggctacggctacacccgtgactacccggtcgagcgcatgatgcgcgacgccaagatcacccagatttatgagggcacgaaccaggtccagcgcatcgtcatggcgaggaacctgccc

SEQ ID NO: 5011 - DNA, 633 bp, Streptomyces avermitilis
  CDS (1)..(633)
atgacacccgccccgacccgagccctcggcgagccgccgttcgacgcggtgctgtgcgacgtcgacaacgtgatccggttctacgacccgtccgggctgaccgctctggaacgcgccgtcgggctggccgagggcaccacggccaaggtggcgttcgccccggaggcggtccggccggtgctgctgggccggatcaccccccaggagtgggtgctgtcgatcgtggacggtctcaccggcctggtgtccgggacacaggcccatgagctggggaaggcgctcatcgagctgccttttggggccgacgggacggtcgtgtcgctcctgcgccgcgcccggacccggatgccgctggtcctcgtcaccaacgcgacggtccagctggaggccgacctggcgtccctcggcctgtccgatctcgcggaccacgtcgtcagcagcgcccgcgtcggcctggtcaagccggatccgcggatcttcgaactcgccgcggcccgggcgggcgtacggctcgaccggtgcctgttcgtcgacgacacccgggagaacgtggacgcggcggccgcccttggcctgcgcgccgtccacttccacgaagcgacggatctggagcgggcgctggcgccgcttctc

SEQ ID NO: 5012 - DNA, 1191 bp, Streptomyces avermitilis
  CDS (1)..(1191)
atgcggcaggtccagcgcggctccggcggaccggggccgtaccagtccgcgccgccgtacggcggcggcgtaccccagcagccgtcgtacgtcgacgggcaggggtacgacgacggatacgacagcggctacaacacgggccatgtctacggcacgccgaacggcggcggcccgcagggaccgggcggcatgggtacgcggggtccgcggcccgcaccgaactggcgccggcggatcaagtggaccgcgatcacgctggtcacgctgatggtcgtggtctccgtcagcacctacttctgggccgactccaagctcaaccgcgaggtcgacctctccaaggtcatcgaccggcccgacacgggcgagggcacgaactacctgatcgtgggctccgacagccgcgcgggcatgtccgccgaggagaagaagaagctgcacaccgggtccgccgaaggcaagcgcacggactcgatgatgatcctgcacaccggggacaacggctccacgctggtctccctgccccgtgactcggacgtggagataccgacgttcaagggctccacgtccggcaagacctacccgggcacgggccgccacgtgaagctgaacgcggcgtacgcggaggacggccccgagctgctcgtccgcacgatcgagtacaacaccggcctgcacatcgaccactacgtggagatcggcttcgccggcttcgcgaacatcgtcgactcggtcggcggcgtggagatgaccctggacaagggcttcaaggacacgttctcgggcgccgacttcaaggcgggcaagcagaccctcaacggtgagcaggcgctggccttcgtccgcacccggcacgccttcgcggcctcggacctggagcgcacgaagaaccagcagaagttcctgtcggccctcgcccaccaggtggcgacgccgtccaccgtcctcaacccgttcaagctgtacccgacgctgagctcgggcctcgacaccctgatcgtcgacaaggacatgggcctgttcgacctggccgacatgttctgggcgatgaagggcgtcacgggcggcgacggcacgtccatgaacatgccgatctcgggctcctcgggcggcaacctcgtctgggacaaggcgaaggtcaaggccctggtgaacgagctgaagaacgacgagaaggtgacggtgtcgggcaac

SEQ ID NO: 5013 - DNA, 621 bp, Streptomyces avermitilis
  CDS (1)..(621)
ttgtcgtcccggcataaggtggaggccatgacacaccaggccaccgctgcggaatcagaaattccgggcgcacatcagggtgcggctccgggcgaaggcccgggcgagatccccgggaagcccacctccgcctcccggaccaccctcagccacatcatgacccacaacgacacgaaccttctggggaccgtgcacggtggcgtgatcatgaaactcgtcgtcgacgcggcgggagccgtggccggacgccactccggcggcccggccgtcaccgcctccatggacgagatggtgttcctggagccggtcagggtcggcgacctcgtgcatgtgaaggcgcaggtcaactggaccggccgcacctccatggaggtcggcgtacgagtcctggccgaacgctggaacgagtccgcgccggccacccaggtcggctccgcctatctcgtcttcgccgccgtcgacgccgacggcaagccccgccgcgtgcccccggtcctgccggagaccgagcgcgacaagcgccgctaccaggaggcccagatccgccgcacccaccgtctcgcccgccgccgcgcgatcatggatctgcgggagaagcgcgcggcggaggggctcgacgac

SEQ ID NO: 5014 - DNA, 1524 bp, Streptomyces avermitilis
  CDS (1)..(1524)
atgggcctacggtgctcacggatccccacccccatgccttcgcggaggtgtccccccatgcccacaccgccccgctcccccgccgcccgccctccacgacggccgcggccctcccccgcccggcggccgcccgtacggcccaggcggcccaggcggcccggctggtccatgcggatggtgacgacgctgtccgtggtggtcctcgcctcggcggggatcggccacgccgtggtcaccagcctcgacgcggacatcgcgcgggtcgaccccttcaaggacatgaagaaccgccccgcggcgggcaccggcatgaacgtcctgctggtcggcacggacggccgggacaagatcagcgcggccgaacggcggaagtaccgcctcggcggcgccccctgccactgcacggacacgatcatgatcgtgcacatctccgaggaccgggagcgggccagcatcgtgagcctgccgcgcgactcgtacgccgagatgccgacgcacaccgacgggatcaccggcaggcggagccgcccgcagccgatcaagctgaacgcggcgtacgcgcaggggggcccgaatctgaccgtacgcaccgtcgagaacatgacgcacgtcaagatcgaccactatctggaggtcgacttcaccagcttcatgaagacggtggatgtgctcggcggcgtacagatctgcacgccggagccgctgaaggactcgtacaccggtctcgacctggcggcgggcacgcaccggctgaggggcggcgaggcgctccagtacgtgcgcgcccggcatgtcgacggcgcctccgacctgggccgcatgcagcgccagcagcgcttcctggcgtcgctggtcgaacagacgacgtcctccggggcgctgctgaacccgctgaagttccgggacgtgacccgggccgtgctcggctcggtccgggccgaccggggcttcggcacggacgaactgctcgacctcgggcgggcgatgcggaacttctcaccctcctccagcgagttcacgacggtgccgatcagggacatgacccacgtcgtcaagggcatcggctccaccctgaagtgggacgacgccaaggcccagaagctcttccagtcgctgcgcgacgaccagccgctcgtccagcaccgcagcaggagcaggaccctgcgggtggacgtcgctccccagcagatccgggtgcaggtggagaacgcgacgcttacggaggggctcggcggccggatggaccgcgcgctggccgcgaccggcttccggacgacgcggcagcccacgaaggcggcccagaccctgaagcgcacggtcgtggcctacgacccccgctgggaccgctccgcgaggtccctcgcggccgccctgcccggctgcgagctgcgcgcggtgcccgggcaggggcccacgctgaaggtgctcgtcggggcggaccacacgaaggtgcagcgggtgaaggcggcggatcagcaccagggggagttcggggtggtcaccggggaccaggtggtgtgcccg

SEQ ID NO: 5015 - DNA, 1026 bp, Streptomyces avermitilis
  CDS (1)..(1026)
atgagcgagaagtctgacgtgcagccccccgccgtatctgtgatcatgcccgtcctcaacgaggagcggcatctgcgcggggccgtccaagcgatcctggcgcaggagtacgacggcgagatggaggtggtgatcgccatcggtccgtcctcggaccggacggaggagatcgccgccgaactcgtacgcgaggacccgagggtccacaccgtgccgaacccgaccggccgcacccccgccgcgctcaacgcggcgatcaaggcgtcccggcaccccgtcgtcgtacgcgtcgacgggcacggcatgctctcgccgaactacatcgcgaccgccgtacgcctcctcgcggagaccggcgcgcagaacgtcggcggcatcatgcacgccgagggcgagaacgactgggagcacgcggtcgccgccgcgatgacctcgaagatcggcgtcggcaacgccgccttccacacgggtggggaggccggtcccgccgagaccgtctacctcggtgtcttccggcgcgaggccctcgaacaacagggcggctacaacgaggagttcatccgcgcccaggactgggagctgaacttccggatccgggaggccggcgggctcatctggttctcgcccgagctgaaggtgtcgtaccggccgcgcccgagcgtgcgggccctcgccaagcagtacaaggactacgggcgctggcggcatgtcgtcgcccgctaccacgagggctccatcaacctgcgctacctcgccccgccgaccgcggtgtgcgcgatagccgcgggggtcgtggtggggctcgccctgactccgtggggtctcgtcgtccccggcggctatctggcggcgatcgccctcggctcgctccccgcgggcaagcggctgccgctgaaggcccgtctgcagatcccggtcgccctcgccaccatgcacatgtcgtggggcttcggcttcctgacgagcccgaaggccctggccaagaaggtcatcgcctcgcgccggcccgcggtgctcggctccaac

SEQ ID NO: 5016 - DNA, 1740 bp, Streptomyces avermitilis
  CDS (1)..(1740)
atggtgcagagcagtgtgcgtcgaaagggggcgcgaccacgtgaccggcagaccggtgaaccgggctgggacgacagtctgtacgacgacaacggcgagcctgttcaggacggccgcggctccggtcgaggcggcggctccgctcagggcggcggcgacggcgacggtccacccgacgaggcgaagggccacagccgccacggcggcgggcgccggcgcggcggcaaaggggacgggggcggggggcgcccacgtcgcagacgccgcgtcctgcgctggtcggcgacggttctggcggtcctgatacttggcaccgcgggtgccggatatctctactaccagcacctcaacgacaacatcaagaaggacgacctgtacctcggcgacgacaaggacagggcggccaaacccaaggcgaacgcggcgggccagaccccgctgaacatcctgctgatcggttcggacgcgcgcgactccgcggcgaaccagaagctcggcggcgccaaggacacctacggcgggacaccgcgcgccgacgtccagatgctgctgcacctgtcggcggaccgcagcaacatgtcggtggtcagcatgccgcgcgacacgctgctcgagatccccaagtgcaccgacccgaagaccagtcacacgtacgcggcgatcacgtatccgacgatgacgaacaactcgctcggccgcggcggacccggctgcaccgtcgccacctgggagaagttcaccgacatccacatcgaccacttcatgatggtcgacttcgcgggtgtggtgtcgatggccgacgcgatcggcggtgtcccggtctgtgtggacgccaacatctactcgcacacctccaccggccacggctcgggcctgaagctgaaggacggcacgacgtccatcaagggcaagcaggcccttcagtggctgcgcacgcggtacgggttcgaggacggcagtgacataggccggaccaaggcccagcaccagtacatgaactcgatggtccgccagctgcgcgagaacgccacactgagcaacccgaacaagctgcgcaagctcgccgagaccgccaccaacgcgctcaccgtcgacgacggcctgggcacggtgtcgaagctctacgacctgagcaaggagctgaagaaggttccgacgagccggatcaccatgaccaccatgccgtgggtgtactcgtccgacggcaaccgcgtcctgcccaagccgaacgacgcggcgaaggtcttccggctcctgcgcgaggacatcgcgctggacggcaaggacaagaagaagtccccggcccagaaggcggtggcccccgcccacgcggacgacaagatcgcggtgcaggtgcagaacggcacccggaccagcgcactggcgccggtgggcggacgggcgaacgcgatggcgcagctcctcgtcggcaagggcttcaccggggcggcggccgactcctcgacggtgctctccgaggacaagacggtcatccgctatccgagcgcggatctgaagggcgacgcccagcgggtggccaagtcgctcggcgtcccgctgagttcggtggagaagtcggcgagcgtctccggggtcacgctgatcgtgggcggcgactggcggtcgggcaccacgtacaaggcggcggaggacgacgacacgacgccggcgtccgcgaagctggacaagggttcggacaccggggcgtgcatgcacgtggacccggactacacctggtca

SEQ ID NO: 5017 - DNA, 1521 bp, Streptomyces avermitilis
  CDS (1)..(1521)
gtgccggggccgcgccgccgtcgaggcgtgccggacgagccgccgccgggccggcgccggggacgtacgaaaccgaagaagtccagaaccaagaagatagtgctgtggacgggcggctccatggccttcgtcctggtcgccgtcacggcggccggctatctctacctcaagcacctcgagggcaacgtccagacgacggacgtcggcgacgcggccaagagcagcttcagcaaggacgacgccttcaacatcctgatcatcggcacggacaagcgcaccggtgcgggcaacgagggttacggcgacaagggcagcgtcgggcacgccgacaccaacatcctgctgcacgtctccaaggaccgtacgaacgcgacggcgctcagcatcccgcgtgacctgatcgtcgacgttccggactgcgagaccaagcaggccgacggctccaagaaggtcatcggcggctcgcagaacgtccgcttcaacacgagcctcggccagggcggccgcgacgcgggctgcaccatgcgcacggtcaaggcggtcaccggaatctcgccggaccacttcatgatggccgacttcaacgcggtcaagacgctgaccagcgcggtggacggcgtcacggtctgcgtgggcaaggcggtcaacgacccggactcgcacctgaagctgcccaagggcgagtccacgctcgagggcgagcaggccctcgccttcctgcgcacccggcacagcttcggcaaccagggggacctcgaccgcatcaaggtgcagcagcagttcctcggcgcgctgtcgcgcaagatgacctccagcgacaccctcaccaaccccaagaaactgctggacctggccgaggccgccaccaaggcgctcaccgtggacaccggcatcggcaaggtcagcacgctcaaggacgtggcgctggagctcaagaaggtgccgccgaagaacatcaccttcaccacggtccccgtcatcgacaaccccgccgagaaggtccacgcgacggtcgtcgtcaaccagacgacggccccccaggtcttcagcatgatcaaggacgacgtctccttcaccgcggtcaagcaggagaagaagaaggagaaggccgcggtcgccgcccggctcaagggctcccgctccgccgcctccgacgtccgcgtcgacatctacaacggcggcgccccctccggtgccgcacaggaaactctcagctggctgcagaacactgagggcgtgacgaagtccagtcagctcggcaacgccggcaagacgctgagcaagacgaccctcgagtactctcccgaccaggccgaccaggcgcgcaagctggccgacctcatggggctgccggcggcgcagatgaagccgggcaagagcgagaagaacgcacagggtctgcccgcgatcgtgctgaccctcggcaaggacttcaagggggccggggagcccctcaccacgccgtcgaaggcgcccgagaacatccagaaggccaccgccgacaagcaagtctgctccacg

SEQ ID NO: 5018 - DNA, 1248 bp, Streptomyces avermitilis
  CDS (1)..(1248)
atgagggggtggacagccgtgaccgacaccgcgggcacgccctccggcgacgggcctgagcaggcggccgtgccgggaccggggggcggagcgtcccccatcggcgccgggctcgtacgccgccggcggcgctggctgcggcacacggccttcggtgtcgcagccttggtgctcggtgccgccggggccgggtgggccgtgtacgagaagctgaactcgaacatcaccgcggacgaggccgccgccgccgaactcgcccggtacgagaaggagcggcccacctcactggtgcgggacgcgcagaacattctgctgatcgggtccgactcgcggtcgggggacggcaacagccagtacgggcgggacaccgggaccgagcggtccgacaccacgatcctgctgcatctgcccgcgaaccggcacagcgcgaccgcggtctccctgccccgcgatctgatggtggacataccgagctgccgccgcccggacggcacccgtaccgcgccgaccttcgcgatgttcaaccaggccttcgagacgggcggttcggcctgcacgatccgtaccgccgagaagctgacgaacgtccggatcgaccaccacatggtcgtcgacttcagcggcttcaaggagatggtcgacgcggtcgacggtgtcgaggtgtgcctgaaggacccgatcgacgacaaggacgccaagctgcgactgccggcgggcaagcagttgctcgacggggagcaggcccttggctatgtgcgggcccgcaagagcatcggcaacggcagcgacaccgaccggatggaccgccagcagcgcttcctcggggcgctcgtcaacaaggtgcagggcaatgacgtcctgctgaacccggtgaagctctatccggtgctcgacgcggcgacctcgtccctcaccacggacccggatctggcgagtctgcgcggactgtacgaactcgtgcgcggtatgcggaacattccccccgaacgcgtgcagttcctgacggtgccgcgcacgtcgtacgtgaacaacgccaatcgcgaccagctcgtggagcccgacgcggagaaactcttcgcccggctgcgggccgacgccccgctggaggtcgccaaggactacgccggttacgacgagcagtcgggcggtgacggaacactgagcggaaagccgctcgacacacccgccggcaccccggatccgacacccactttccgcgggaacacggccgccgaggacggctgcgag

SEQ ID NO: 5019 - DNA, 762 bp, Streptomyces avermitilis
  CDS (1)..(762)
gtgaacgccaccgaccgcacccctgccgacctgctgcgatccgcgctcgccgcggaccccgcgcgccccttggtgaccttctacgacgacgccacgggcgaacgcgtcgaactctctgtcgccaccttcgccaattgggtggccaagacggccaacctgctccagggcgagctgtccgccgaacccggcgaccggctcgcactgctgctgcccgcgcactggcagacggcggtgtggctgctggcgtgcgcctcgacgggcgtcgtcgcggacgtgggcggtgacccggccgccgccgacctcgtcgtcagcggacccgacacgctcgacgcggcccgcgcctgctccggcgagcgcgtcgcgctggcgctgcgcccgctcggcggccggttccccaagaccccggacggtttcgccgactacgccgtcgaggtaccgagccagggcgaccgcttccagccgtacgcgccggtcgacccggaggagcccgcgctgatcgtcgccggggcggagcacacgggcgccgaggtggtcgagcgggcccgcgcggaggccgccggcctggggctgacggggccggggtcacgtctgctgtcggggctgggttacggcacctgggaggggttgagcgcggggctgtacgcgccgctcgccagcggcgggtccgtggtgttgtgccggcatctggagcagttgggtgaggacgcgctggcgaaacggatcgagagtgagcgcgtgacggctacgcgccgccacgcgagc

SEQ ID NO: 5020 - DNA, 1374 bp, Streptomyces avermitilis
  CDS (1)..(1374)
atgcgtgattaccttgcttcctcgatcggcgtcacctgcgcggcggccctggtccttccactcaccctgaccgctccggcccaggcgagaccctcggcgtcggcgaccggctcggaccggacgggggccgcggcggacgtggcgggccccgccgcggaccgtgcgggtcccgccgcggaccccgcgggctccccggtggcgaccgaggccaccgtccccggcagcacccagtccctccccctcgcccccctctccggcacccgggccgtcggtgcggcggccgaacaggggctgaccccccggaacgtacggcgtttctcgctggtcggcgtcgtctggaacgacccggccaccgaactgcacggccgggtccaggtccgtacccgcgccgagggcacgacccactggtccggctggcaggacgtcgagacacacagccacgaacacgcgcccgacccggacaccgcggagggctcctcgcaccgggcgcgcggatccaccgcgccgctgtgggtgggcgactcggacggtgtcgaggtccgggtgcgggcggagggggaccgggccgcggccccggacacccgggcgctccccggcggcctccgcctcgaactggtcgacccgggcgcgcagcccgcggccggcacccccaagggctcctcgcgcgccggtctcgcgccgcaggccgccaccgagattccggccctgtcgaaggagcagaccgagcgggagctgctggccgaacaggggagcgcgccgcgcacacagccgtacatcggcccgcgcccgcgcatcatcacgcgccacggctggggcgccgacgaaagcctgcgtgcgcggagcttcgtctacacgagcaaggtcaaggcggccttcgtgcaccacacggcgtcgggcaacaagtacagctgctcgcaagccccttcagtcatccgcggtatctaccgctaccacgtcctgagcagtggctggcgcgacatcggctacaacttcctcgtcgacaagtgcggaaacatctacgaaggccgggccggcggggtgacaaaggccgtcatgggcgcccacaccctcggcttcaattccaacagcatggggatcgcggtcctcggcacgttcagctccaccaagccggccgccgccgcggtgaatgccatcgccaagctcaccgcctggaagctcggcctcttcggagccaatccgcgcggcaagacatacctgaagtccgctggtggcaatctctaccgaaaaggaaagaacgtacgactgaacgtgatctccggccatcgggacgggttcgccacggagtgcccaggaaagcagctctacggcaagctcggctcggcccgctccacctcggcccgctaccagggccgc

SEQ ID NO: 5021 - DNA, 1080 bp, Streptomyces avermitilis
  CDS (1)..(1080)
gtgacagaagcgatcctcctggtcggcggcagaggcacccggcttcgtccgctcacggtgcacacccccaagcccatggtcccggcggccggggtcccgttcctcacgcatcagctggcgcgggcgagggcggcgggcgtggaccacatcgtcctggcgacctcctatctcgccgaagtcttcgagccgtacttcggcgacggctcggctctcggtctgcacctggagtacgtcacggaggaggagcccctcgggacgggcggcgcgatccgcaacgtggcgtcgcgcctccactccggccccgacgagccggtgctgatcttcaacggcgacatcctgacgggcctggacatccgtgccctggtccacacgcacgagacgacggccgcggatgtctccctgcacctcaccaaggtgacggacccgagggcgtacggcctcgtccccacggacgagacgggccgggtcactgccttcctggagaagccgcagacccccgaggagatcgtcaccgaccagatcaacgcgggggcgtacgtcttccggcgctcggtcatcgacacgatcccggcgggccgcccggtctcggtggagcgcgagacgttccccggcctgctgtccgccggagcacacctccagggcatggtggactcgacgtactggctggacctgggcacccccgcggccttcgtacgcggttcggcggacctggttctgggccgtgccccgtcccccgcggtcccgggccgctgcggcgaccgcctggtgctgccgacggcttcggtcgcctccgacgccaagctgacgggcggcacggtggtcggcgagggcgcgttcgtcggcgagggtgcccgcatcttcggcagcacgctcctgtccggcgcggtcgtcgaaccgggcgcggtcatcacggactccctgctcggcgcccgctcccgggtgggcgagcgctcgatcctgacgggagcggtcatcggcgacggcgcggtgatcggcgcggacaacgaactccgcgacggtgtacgggtgtggtgcgacgcgaggattccggcgggggcggtgcggttctcctcggaccag

SEQ ID NO: 5022 - DNA, 1008 bp, Streptomyces avermitilis
  CDS (1)..(1008)
gtggctggacgcttctcccctcggcccacgcgtacgaccgtgcgcggcgggcatgtcgtggtgcccggggcgtccggtgcggtgccgcggcccgctcccgccaccgggctgcggcgcgggtggaccccgccctggccgctcgacctcgggatcgtgctcgggccgctgcggcgcgggcccggcgatccgacgtttcgtacgacaccggacggggccgtgtggcgggccagccgtacgcccgccgggcccggcaccctgcgggtcgcgctgcggggcggcgcggtcgaggccgaggcgtggggcccgggggcggagtggctgctgcatcagttgccggagatgctgggctcggccgacgacccggacgccttcgagccgcgccaccggctggtcgcggtgacccggcaccggcggcccgggctgcggctcacgcgtacgggactggtgctggagtcgctgatcccgtcggtcctggagcagaaggtcacggccgacgaggcgtaccgggcatggcggctgctcgtacggaagttcggggagccggcgcccgggcccgtggaggggcggatgcatgtgatgcccgagccgcggacgtgggcgttgatcccgtcctgggagtggcatcgggcgggggtcgacaacaagcgggcttcgacgattctgcgggcggtgcgggtcgccgcgcggctggagcaggcgatggggatggagccggcgcaggctcaggcgcggctcgaggtggtgtcggggatcgggccgtggacgtcggcggagaccgtgcagcgcagtcacggggcggcggattcggtgacggtcggggatctgcatctgccccggatcgtggggtacgcgctggcgggcgaccgggacgcggacgacgccgcgatgctggaactgctcgcaccgtatgccgggcagcggcaccgtgcggcccggctgattctgctgtccggccgcacgccgccgcgccggatgccgggtatgccgcgtacggacatcgggaagttg

SEQ ID NO: 5023 - DNA, 1269 bp, Streptomyces avermitilis
  CDS (1)..(1269)
gtgcccggtcttcccgaggtcgcgcccggcgacgatctcgccaagctcatcgccgccgtcgagcccggcctcgtcgacggtgacgttctcctcgtcacctcgaagatcgtgtccaaggccgaggggcggatcgtgcgggcggacgaccgcgaggcggccatcgacgccgagaccgtacgggtcgtggcgcggcggggcgcgctgcggatcgtcgagaaccggcagggtctcgtcatggccgccgccggcgtcgacgcgtccaacaccccttccgggaccgtgctgctgctccccgaggatcccgacgcgtcggcgcgggcgatccgggacgggctgcgggacacgctcggggtcgatgtcggcgtcgtcgtcacggacaccttcggacggccctggcggaccggtctgacggatgtcgccatcggcgccgccggtgtgcgcgtactcgacgatctgcgcggcggcacggacgcgtacggcaatccgctgagcgccaccgtcgtcgccaccgccgacgagctggccgccgccggtgacctggtcaagggcaaggccgccgggctgcccgtcgccgtcgtgcgggggctgccgcacgtgatcgccggggacgacgaagcgggagcgcgcgcgatggtgcgcggcggacgtgacgacatgttccggctcggcacgtcggaggccgtgcgggaggcggtgacccagcggcgtaccgtacgggccttcaccgacgagcccgtcgaccccggtgccgtacggcgtgccgtggccgcggccgtcaccgcgccggcgccgcaccacacgacgccctggcgttttgtgctcctggagtccgcggagtcgcgcacccggctgctggacgccatgcgggacgcgtggatcgcggatctgcgcggggaccggaagaccgaggagtccatcgccaagcgggtcagacgcggggacgtgctgcgcaacgcgccgtatctcgtcgtgccctgcatggtcatggacgggtcccacagctacggcgacgcgcggcgggacgcggccgagcgggagatgttcgtggtcgccaccggcgccggggtgcagaacttcctcgtcgcgctcgccggggagcggctgggctcggcctgggtgtcgtcgacgatgttctgccgggatgtcgtacggcgggcgctggggctgccggagagctgggagccgatgggagccgtggccgtggggcacgcggcggaggaacccagggaccggcccgcgcgcgacgccggggcgttcatcgaggtgcgc

SEQ ID NO: 5024 - DNA, 957 bp, Streptomyces avermitilis
  CDS (1)..(957)
atgcgcattgtggttctggcaggcggcatcggcggtgctcgttttctgcgtggtctccagcgggccgcgcccgacgcggacatcaccgtcatcggcaacaccggggacgacatccacctcttcggtctgaaggtctgtccggacctggacacggtgatgtacaccctcggcggcggcatcaacgaggaacagggctggggtcgggccgacgagaccttccatctcaaggaggagctcgcggcgtacggggtcggccccgagtggttcggtctcggcgaccgggacttcgccacgcacatcgtgcggacgcagatgctcggggcggggtatccgctcagcgccgtcacccaggcgctctgcgaccggtggaagccgggggtgcggctcatcccgatgtccgacgaccggatcgagacccacgtggccgtggacatggacggggagcgcaaggcggtccacttccaggagtactgggtgcggctgcgggcctccgtgccggccgtggccgtcgtcccggtcggcgccgagcaggcgaagcccgcgcccggggtgctggaggccatcgccgaggcggacgtcgtgctcttcccgccgtccaacccggtcgtgtccgtcggcacgatcctcgcggtgcccggcatccgggaggccatcgccgaggccggggtgccggtggtcggtctctcccccatcgtcggggacgcgcccgtgcggggcatggccgacaaggtgctggcggcggtcggcgtcgagtcgacggccgcggcggtcgccgagcactacggctcggggctcctcgacggctggctcgtcgacaccgtggacgcgtccgtggtggagcgggtcgaggcggcgggcatccgctgccgggcggtgccgctgatgatgaccgacctggacgcgacggcgcagatggcacgcgaggcactggcactggcggaggaggtgcggacgcct

SEQ ID NO: 5025 - DNA, 525 bp, Streptomyces avermitilis
  CDS (1)..(525)
atgaacagcgacagcgacctccagatcgccggcgacatcctcgaagtaccgcaccttctccagccgccgcgcgagcaccccgccaccgtggccgagttcgtcggcctcgcccgctccatcgccgccgaccgctcccagtgggagcacctcgtccagtacgacgccacctcccgctggtaccaccggctgcgcaccgggcccggctacgaggtgtggctcctttcctgggtgcccgggcagggcagcgggctgcacgaccacggccgctcctccggcgtactcaccgtcctggagggcgcactgaccgagcggaccgagcgcgggacgcgcgcgttgggcgccggggcgcagcgggtgttcgcgccggggtacgtccacgaggtcgtcaacgacgccctcgaaccggccgtgagcctgcacgtctactacccggggctgaccgagatgccgatgctcccccggtccgagccgagttcggcaggggagacccccatcgctcattgcgcgtccgtcccgacgaccgcg

SEQ ID NO: 5026 - DNA, 261 bp, Streptomyces avermitilis
  CDS (1)..(261)
atgaccgagctggtgcagcaactgctggtcgacgacgcggacgaggaactcggctggcaggagcgcgcactgtgcgcccagaccgaccccgagtccttctttcccgagaagggcggctccacccgcgaggcgaagaaggtctgcctcgcctgcgaggtccgctccgagtgcctcgaatacgcgctcgccaacgacgagcggttcggcatctggggcggtctctccgagcgcgagcggcgtcggctgaagaaggccgcgatc

SEQ ID NO: 5027 - DNA, 3675 bp, Streptomyces avermitilis
  CDS (1)..(3675)
atgtccgtgcacagtcatacggcagcccaatacgacgccgccaccgcgccgttcgacccggccagcccgcccgagtttccgcgccatgtggtgacggcggtgctcgtctcccacgacggcgcccgctggctgcccgacgcgctggcaggcgtgctcggccaggagcgtcccgtgcagaacgccgtcgcggccgacaccggcagcgcggacgcctccgcccagctgctcaccgacgcgctcggcgccgaccgggtgctgcacctggcccggcgcaccggcttcggtcaggccgtcgaggaggccaaccgagccgcggccgtactgaccccggacgacctgccgtacctcaagcgccccagcggctgggaccccgtcacccgcagctggcgcgacgacgcgtacgacctgccggacctcccgcacggcgagcccgaacagtggctctggctgctgcacgacgactgtgcccccgacccggacgccctggcccacctcctgaggatcgtggagaacgagcaggagctgggccgcgaggtcgccgtcgtcggccccaagctccgcggctggtacgaccgcagacaactcctcgaagtcggcgtcaccatcgccaacagcggccgccgctggaccggtctggaccgccgcgaacaggaccagggccagcacgaccacgtacggccggtgctgtccgtctccaccgccggcatgctgatccggcgcgacgtcttcgaagagctcggcggtttcgaccggcggctgcccctgatgcgcgacgacgtggacctgtgctggcgcgccacggccgcgggccaccgcgtcctcgtcgcccccgaagcggtcgtacggcacgccgaggccgcctcccgcgagcgccgcgccgtcgactgcgtgggccgtacctccgcgtccccgcacaaggtggacaaggcgggcgcggtctacaccctcctcgtcaacgcccgtacggcacagctgccctggatcctgatccggctggtgctcggcaccctgctgcgcaccgtcgcctatctcgtcggcaaggtccccggacaggccgtcgacgagatccgcggtctgctgggcaccctgctgcggcccgagcggatcatcgccgggcggcgcaggcgcgggcgcccgcaggtcgacaagggtgaactgcgcccgctgttcccgccgcccggagcgaccgtccgggccaccgtcgagcagttcgccggcaacctgacgggcaactccgaccccgaagcctcctcggccggccggcacggcggcgcggtggagtccggaccgggcggcgacgacgccgacttcctccaggtcgaacagttcgcccggctcaagcgcatcgcccgcaagcccggtccggtgctcttcgtcgtcctcctgctcgtctcgctcgtcgcctgccgcgcactgttcggcggtggcgcgctcgcgggcggcgcactgctgcccgcgcccgccgacgcctccgagctgtggtcgcgctatctcgacggctggcacccggtgggcgtgggcggcacacagtccgcgccgccctatctcgcgctcgtcgccctgctcgcgagcgtcctgttcggctccaccgggctcgcggtcaccgtgctgctcgtctgctcggtgccgctggccggcatcaccgcgtacttcgcctcgcgtccgctcgtcgaatcgcggctgctgcgcgcgtgggtgtccgtcgtgtacgccttcctgcccgccgccaccggcgccctcgccggcggccgcatcggcaccgcggtcctcgcgatcctgctgccgctcatcgcgcgcgcgggcatcgccgccggcggcctcgcgcatgcctcgggcacgcgcggcagctggcgggccacctgggcctacgcactgctgctgacgttcaccacagccttcacaccgatcgtgtggcccatcgcgctggtgctcggtctcgcgctcctcgtggtgcgccgcggcgaaatcaccgcctacgggctgcggttcatcgcccagttcggcaccccgctgctcgtcctcgccccctggtcgctgacgctgctgccgttcggcttcttcacggaggccggactgaagttcggcgcgggcgcggcctccgtgaccgacctgctcggtgcggggcccggcggtccgggcaccgtcagcgggctcatgctcatcggcatcgtgctcgccgcgctggccgccctgctgcgctccgaacgccagccgggaatctggacggcctgggcggtcgccctggtggcgctcgtcttcgcggtcctgtccaaccgctccgcctgggccggccccgccaccctcgtctacgggctcgccctcctggccgccgccgcgctcggcgccgacggggcacgcgcgcgcgtggccgagcagagcttcggctggcggcagccggtggccgcgctcatcgccttctcctcggcggccggcccgctgctcgtcgccgcggggtggatgatcggcggcgccgacggccccgtggagcgccgtgacccggtccaggtgcccgcgttcgtcgccgaggagagcggcacccgcgaccaggctcgcaccctcgtcctcaacagcacctcaccggcccgcgtcggctacaccctggtccgcggctccggcgcccggctgggcgatgccgaactcgcggcggcgggcggcgagaacaagcggctcgacaaggtcgtcgccaacctcgtcgcgggctccggcgccgaccaggccgacgaactcggcggcttcgccgtgcgctacgtcctggtccgcaagggcgcgccccgcgaggtcagccgcgtcctggacgccactcccggcctgagccggctcagccagggggacgggagcgccctgtggcgcgtggaccggcaagtctcccgcgccgccatcgtcaccggctccggcgaaccggagcccgtcgcggccggccccgtcgaactgcacaccacccttcccccgggcgccgcgggccgcgtactgcggatcgccgacaccgccgacgagggctggaccgcgaccctggacggcaagccgctcacccgcaccacggtcgacggctgggcccagggcttcgaactcccggcctccggcggcaagctggacgtcaccttcgacgcgccgctcggccacaccggctggctgtgggcgcagggcgcactcgccgtcgtcctggtggtgctcgccctgccgggccgccgccgtgacgtggacgacgaccttcccgaggaagaggcgatccccgcccaggagaccgcgggcgagggccgccgcgcccgccggctgcgcgcccaggccgaggcggaggccgaacaggccgccgcggacggctccaccgcgcccccttctccggaggaggccccggcccacgccgcgatcccccagcagcagccgtacgacgagtgggacgcggcgagctacgggggcgcggagtacggcacctacggcggcgaccagtaccaggccgccccccagtacccggcgggcacgtacgaacagccgtaccaggcggacccctaccagggcggccagtacgacccgtacgcctacgggggcacgtccacggcgtacgaccagaactacacccagggctacgacccgacggcgtacgacccggcgaaccccccgcacccgccgcatcccccgcaccacggcaccgacagtgagcgccccgacgggagccagcag

SEQ ID NO: 5028 - DNA, 1506 bp, Streptomyces avermitilis
  CDS (1)..(1506)
gtgaaccgcaccaccctgtccctgatcgccggcgcgaccgcgctcgccgccgtcaccggattcgccgcgctcagcacaccggacacgtccggcgacagcaccgcgaaggcggccgcccagctgcccgtggagcgcaccagcctgctgtgccccgagccgagcagctcagacctcgccgagacgtcgtacacggccttcacgcccgtcaccaagggcgccggcggcagcggcaaggccgaactcgccgcggcgaacggacagtcggcggacggttcgaccgcaggcaagagcggcaagagcggcaagaagaacaccggagcgcccgtcgtgcggcccaaggagcccggcaagccggtcaccggcaccgcggagggcgccgagacgcccggcctcatcggcaccgccacgggcaggttcgctcccggctggaccgtccaggagaccacccaggtcgccgcgggcaccggacgcggtctgctcggcaccaactgcaccgccccggactccgagttctggttccccggcgccggcaccgccgacggccgtaccgactacgtgcacctgacgaaccccgacgactccgcggcggtcgtcgacatcgagctgtacgggaaggacggcgccctcaagtcgacgctgggcgagggcatcacggtccagccgcactccagcgagccgatcctgctgtccacgctcaccgacgagacggacaccgacgtcaccgttcacgtgaccgtccgcagcggccgggtcgccgccgccgtccaggccctcgacgacaagctcggcggcgactggctggccgcctccgccgacccggcgggcagtctcgtcctgcccggcatccccaaggacgccacggacgtgcgcctggtcgccttcacccccggggactccgacgccgacctgaagctgcgcctcgcctcgcccaccgggcagatcacccccgcgggcaacgagacgctgcatgtgaaggcgggcatgacggccgccgtcgacctcggcgacgtcacgcgcggcgaggccggctccctgctgctgacgccctcggacacgtcggtccccgtggtggccgccctgcgggtggtgcgcggcaagggggacaagcgggagacggcgttcatcccggcgaccgccccggtgggcacgcgcgcgacggtcgccggcaaccgctccaagggcaccacgctcgcgctgaccgccccggcccgcaccacccaggtcaaggtcaccgcatcggccggcagcgggggcggtacgccggtgacgaagacgtacacgatcaaggccggcacgacccagaacgtggacgcgcccgtcccgagcggcctcaagggcacgtacgcgctcaccgtcgagccggtctccgcaggccccgtctacgccgcccgcaccctcgaggcggccggtgagggcctaccggcgttcacgatccagaccctgccggacgaccgtggggcggtggcggtaccggaggcggagcaggatctttcggtgctgcagaag

SEQ ID NO: 5029 - DNA, 570 bp, Streptomyces avermitilis
  CDS (1)..(570)
gtggacgcaggaccctccgaggtcccgcccaaacctcgcgcgggcggcgtgggcgggcggccgcgcgagccgccgcgtgggggccgggcgcgcggccccggcgaggactacgcttcgtcagtgatggacaaccccgtaccgccccgcgccgcagcacccgggccccgccgccgcgaccgccacggcagaggcatgcgcggccccatcgcgccgccccaggtgccgctcgccgcgagtcgcgccgaggtgttcgccgatctggtgcaggactccgtggagcgtctggagcggcgctgggcgcagctcgccgacatcgacttcctgatcctcgaggtgccgcgtctcgacggcccgggcggaggctggggcgaggactcggtgcccctgggcggcacgatcgccgctcgcgaagggcaccccgcgcgcgtggtggtctaccggcgcccgatcgagatccgtaccaagggccgcgacgaacgcgcggcgctggtccacgaggtcgtcgtcgagcaggttgccgagctgctggggctgaccccggagacggtggatccccggtacggcgaggac

SEQ ID NO: 5030 - DNA, 471 bp, Streptomyces avermitilis
  CDS (1)..(471)
gtgttcggaggggtgtgtggggcgtgtcacagcacgacacggtggagtgacccgggggagagtcgtcgcggcccgctcaagagtgcggtaccgtccaacatcgtgagccctgtacgtcgctgttcgcgcaccgcttgcggccgtccggccgttgcgacgctgacgtacgtctacgccgactcgaccgcggtcctcggcccgctcgccacctacgccgaaccccactgctacgacctgtgtgccgagcactccgagcgcctcaccgcgccgcgtggctgggaggtcgtccggctcctcgacggctcggcgcccgcacgccccagcggtgacgatctggaagccctggccaacgcggtgcgcgaggcggcccgcccgcagcagcgcgcggcggacgcgggcggcgcgcgcagggcggacccgatggaggtcgcacgccgcggccatctgcgggtgctgcgctcgccggacaac

SEQ ID NO: 5031 - DNA, 1614 bp, Streptomyces avermitilis
  CDS (1)..(1614)
gtgtacgtccaggaactggaacccgtcgccggctcactcggcctgtccgcactcgtcgcgaccctgccactcgtcatcgtcctggtgctcctcggcggcgtccgcatgaaggcgcaccgagcgggcctcatcggccaggcggccgccgccctcgtcgcccggctggcgtacggcatgcccctcggccagacgctctccagcgccgcccagggagccgtcttcggcctcttccccatcctgtggatcgtcgtcaacgccctgtgggtgtaccggatgaccgtccgcacccggcacttcgacatcctccgccgctccttcgggcgcctgtccgacgacccgcgcatccaggcgctcgtcgtcgccttctgcttcggcgcgctccttgaggccctcgcgggcttcggcgcgcccgtcgcgatctgctcggtgatgctggtcgcactcggcttcgacccggtgcgtgccgccgtggtcgccctggtcgccaacaccgcgccggtcgccttcggcgcgatgggcacaccggtcgtcacgctcgcccaggtcaccgggctgcccctggacaccgtcgcctccgtggtgggccgccagacgccactgctggccctcgtggtgcccctcgtgctggtcgggctggtggacggacggcgaggcctgcgcgagacctgggtgcccgccctggtgtgcggagtcgccttcgccgccgcccagttcgccgcctccaactacgtgtccgcgcaactcgcggacatcggcgcggccctggcgggagcgggcgccctggtggccgtgccgcacgcgcgcaggcccgccgccgaacccgtacgggcagcggtcctgaccggcgtacgcagtgaggacctcgacgaggaggacccgcgccccgaagtcctgcgggcctacgccccgtacgcgctgatcgtgacgatcttctccgtcgcccagatccccgtgggcaaggactggctggccggggcgacgcgcacgttcgactggccgttcctgaacgtcgtcggccaggacggcaagcccgtcggagggaacgtcttcatctggccgatcgtgtcgaccggcggcacgctcgtgctgctcgccggactgtgcacggtggctgttctcgggatgcacgcgcgcgtggcggtcgaggagtggctggcgacagtgcgcgagttgaggttcgcgatcctcaccgtgacgtcggtgctggccctcgcgtacgtcatgaacctctccgggcaggcggccacgatcggtcacttcgtggcggcggccggcgcgggactcgccttcctgtcaccggtgctcggctggttcggtgtcgccgtctccggttccgacacgtcggccaacgcgcttttcggcgccctccaggtgagcgccgcccatgagtcgggcctctcgccggaactgctcgccgccgccaacagttcgggcggcgtgctcggcaagatgatctcgccgcagaacctgacgatcgcgtgcgcggcggtcggactcgcgggccgggagggcgacctgttgcgcaaggtactgccgtggagtgtggggctgctgttggtgatgtgcctgatcgtggccgggcagagttcaccggtactggactggatgctgccc

SEQ ID NO: 5032 - DNA, 1365 bp, Streptomyces avermitilis
  CDS (1)..(1365)
gtgactgctgatctgtcgcagctcgtaaaggcgtacgacgtccgcggcgtggtcccggaccagtgggacgagtcgctggccgaactgttcggggcggccttcgcccaggtgaccggcgcgcgcgcgatcgtcatcggccacgacatgcggccctcgtcgcccggtctgtcacgtgccttcgcgcgcggggcggcggcgcgcggcgtggacgtcacggagatcggactctgctcgacggaccagctgtactacgcgtcgggcgcgttcgacctgccgggcgcgatgttcaccgcctcgcacaacccggcgcagtacaacggcatcaagatgtgccgcgcgggcgccaccccggtcggccaggacaccggcctggccgagatccgcgagctggtcgagtcctggctggactcgggcgccccggccgcctcggacgccacgccgggcacgatcacgcagcgggacaccctggaggactacgcggcgtatctgcgctccctcgtggacctgacctccatccgccccctgaaggtcgtcgtcgacgcgggcaacggcatgggcggccacaccgtcccgaccgtcttcgccggactgcccctgacgctggtcccgatgtacttcgagctggacggcacgttcccgaaccacgaggcgaacccgctggacccggcgaacctcgtggacctccaggagcgcgtgcgcgaggagggcgccgacatcggcatcgccttcgacggcgacgccgaccgctgcttcgtcgtcgacgagcacggcaagcccgtctcgccgtccgcggtcaccgccctggtcgccgcccgagagctggccaggcacggcggcaagggcacggtcatccacaacctgatcacctcctggtcggtccccgaggtcgtgcgggagaacggcggcacgccggtacgcacgcgcgtgggccactccttcatcaaggccgagatggcccgcaccggcgcgatcttcggcggcgagcactccgcgcactactacttcgccgacttctggaacgcggacacgggcatgctggccgccctgcacgtcctcgcggccctgggcggccaggagggcccgctgccccagctggtcgccgagtacgaccgctacgcgggctccggggagatcaactccacggtcgacgaccagcagggccgcctggccgcgaccaaggccgcgtacgagggccaggacggcgtcgagctggacgagctggacggcctgacggtctcggcggccgactggtggttcaacgtccgcccgtcgaacacggaaccgctgctccgcctgaacgtcgaggcgagggacgagacgaggatggcgaaggtacgcgacgaagtgctcgcgatcatcaggggc

SEQ ID NO: 5033 - DNA, 168 bp, Streptomyces avermitilis
  CDS (1)..(168)
atgccgctcgaagccggcctcctggagatcctcgcctgcccggcgtgccacgcccccctcaaggaggcggagagcgagctgatctgcaccggccaggactgcggcctcgcctaccccgtccgggacggcatccctgtactgctcgtcgacgaggcccgccgccccgcg

SEQ ID NO: 5034 - DNA, 1125 bp, Streptomyces avermitilis
  CDS (1)..(1125)
atgctcgacgaatcgctgctcgacgcccccgaggcgctcgcggaggccgaccggcgcggactgctccgcggcgccgccgaagccggcgcccgggtccgcaccgccgtccggctcgctgccgaggcggggatcaccgagctcaagcccgacggccgcccccgcgccgtcctcatcgcgggccccggcaccgcgcccgcgggcgtcgccgacctgctcggcgccctcgccggcgtcggctgccccgtcacccgtatccatcccaccggcgtcgcccccgccgccggcgccctgcgctgggaactgcccggctgggccggccccgtggacctcctcctggtggccacccccgacggcagcgaacccggcctctcgctcctggtcgaccaggcgtaccgccgaggctgcaccgtcgtcgccgtggcccccgcccgcactccgatcaccgaggcggtggacggcgcccacggcctgttcgcgccgatggcgaccgccccgtacgaccaggacgcacccctcgccgcgtccgcgcccggcgtcctgtgggcgctgctcaccccgctgctcgcgctcctcgaccgggccgggctgctcgccgcaccgcccgaggccctgcagaaggtcgccgaccgcctcgaccacgtggccgaacgctgcggcccggccatcgcgacctacaacaaccccgccaagacgctcgccgccgacctcgccgacgcgctcccggtgatctggaccgagggacccaccgcgggacccgcgggccgccgtttcaccgccgcgctcgcggagctggccggccgccccgcgctcaccgccgaactcccggaggcgctggccgcgcacagcgtcctgctgtccggtgcgctcgccgcgggcgccgacccggacgacttcttccgtgaccgcgtggaggaggcacaggccctccacgcgcgcgtggtgctgctccgcgaccgcccgaccggcggcctcagcgccgcccccgccgcccgtgaactcgccctcagccacgacacggcgatcagcgaactcgaaccggaggagggcggcgagctggagaccctcgcggagatgatcgccatcacggatttcgcggccgtttacctggcgctcgcctcaggagcc

SEQ ID NO: 5035 - DNA, 1149 bp, Streptomyces avermitilis
  CDS (1)..(1149)
atggaccgcctcgacaacaccgtccgcccctacgcctggggttcgaccaccgccatcccgggactgctcggcgtggagccgaccggtgagccgcaggcggagatgtggatgggcgcccacccgggcgcaccctcgggcaccgcgcgcggcccgctcaacgaggtgatcgacgaggcgcccgaacgcgagctgggccccgcggcggttgccaggttcggcccccgcctgcccttcctgctgaagatcctcgccgcgggcgcccccctctccctccaggtgcaccccgatctggagcaggcgagggaggggtacgaggacgaggagcaccgtggcatcccgatcgacgcgggccaccgcaactacaaggacgccaaccacaagcccgaactgatctgcgccctcaccgagttcgacggcctgtgcggtttccgtgcgcccggagcggccgccgagctgctcgcgggcctcgacgtcgactccctcaagccgtacgtcgacctgctgcacgcccaccccgaagaggccgccctgcgcgaggtgctgacggccgtcctctccgcggaccgcgaggagatggcccacacggtcaccgaggccgcggccgcctgcgcccgcctcggcggcgactacgccccgtacgccgacatcgcccaccactaccccggcgaccccggcgtgatcgcggcgatgctcctcaactacgtccaactacagcccggcgaggccctcttcctgggcgccggcgtcccgcacgcctacctcaacggcctcggcgtcgaaatcatggccaactccgacaacgtcctgcgctgcggcctgacccccaagcacgtcgacgtgccggaactcctgcgcatcgtccgcttcgaggcgagcgaccccggcgtactgcgcccggaggcgttccccgacggtgaggaggtctacgagacccccatcgacgagttccgcctgtcccggtacgtcctcccggagggcgcgacgccgcacgacctcacgcgcccgaccccgcagatcctgctctgcacggcgggttcggtgcaggcgggggaacatcagctcgccgccggccagtccgtgttcgtaccggcgggcgaaaaggccgaagtgtccggggacggcacgatcttccgggccacggtcgtcgcg

SEQ ID NO: 5036 - DNA, 981 bp, Streptomyces avermitilis
  CDS (1)..(981)
atgagcgcgtcaggcggcaccagggcgatcgtggcggcactcggcgccaacctcgcgatcgcggtatcgaagttcgtggcgttcctcttcagcggttcgtcgtcgatgctcgcggaggccgtgcactcgctcgccgactcgggcaaccagttcctgctcctgctcggcggcaagaaggcccagcgcgaggcgaccccgcagcacccgttcggctacggccgcgagcgctacatctacgccttcctcgtctccatcgtcctcttctcggtcggcggcatgttcgccgtctacgagggctacgagaagatccggcacccgcacgagctggagcactggtactggccggtgggtgtcctggtgttcgcgatcatcgccgagggcttctccttccgcaccgccatcagggagtccaacgagctgcgcggcaagctgtcctggacgcagttcatccgccgggccaaggcccccgagctgccggtcgtcctcctggaggacttcggcgcgctcatcggtctcgtcctcgcgctcggcggcgtcggcctcgccctgatcacgggcgacggcatctgggacggcatcggcacgctctgcatcggcatcctgctcatcctgatcgcgctcgtcctggccgccgagaccaagtccctcctcctgggcgaggccgcgggcgtcgacgacgtcaagaagatcgaggccgccatcgtcgacggcaacacggtcaccggcatcatccacatgcgcacgctccacctcggccccgaggaactgctgatcgccgcgaagatcgcagtccagcacgacgacacggccgccgaagtcgcgcacgccatcaacgccgccgaagcccgcatccgcgaggcggtcccgatcgcccgcgtgatctacctggagccggacatctacagcgaggccgaagcggcaaagggcccggaccgcgaggcgacgcccgggggaccggcgccgacgcagccgaccgggcac

SEQ ID NO: 5037 - DNA, 1455 bp, Streptomyces avermitilis
  CDS (1)..(1455)
atgacgactgtcgacaaccgacaggacttcaaggtcgccgatctctccctggccgagttcggccgcaaggagatcaccctcgccgagcacgagatgcccggcctgatgtcgatccgcaaggagtacgccgaggcgcagcccctcgcgggcgcccgcgtcaccggctccctgcacatgacggtgcagaccgccgtactcatcgagaccctggtcgccctgggcgccgaggtccgctgggcctcctgcaacatcttctccacccaggaccacgccgcggccgccatcgcggtcggcccgaacggcacgcccgacaacccgcagggcgtcccggtcttcgcctggaagggcgagaccctggaggagtactggtggtgcacggagcaggccctgacctggccgaacacccccaccggcggcccgaacatgatcctggacgacggcggtgacgccaccctcctcgtccacaagggcgtcgagtacgagaaggacggcaaggttccgtccgtcgacaccgcggagtccgacgagcaccgcgtcatcctcgaactcctgcaccgcaccatcaccgacggctcgcagaagtggacccagctcgcctcggagatccgcggcgtgaccgaggagaccacgacgggcgtgcaccgcctgtacgagatgcaccgcgacggcaccctcctgttcccggcgatcaacgtgaacgacgccgtcaccaagtcgaagttcgacaacaagtacggctgccgccactccctgatcgacggcatcaaccgcgccaccgacgtcctgatcggcggcaagaccgcggtcgtctgcggctatggcgacgtgggcaagggctgtgcggagtccctgcgcggccagggcgcccgcgtgatcgtcaccgagatcgacccgatctgcgccctgcaggcggcgatggacggctaccaggtcacgaccctcgacgaggtcatcgacaaggccgacatcttcgtcaccacgacgggcaacaaggacatcatcatggcctcggacatggccaagatgaagcaccaggcgatcgtgggcaacatcggccacttcgacaacgagatcgacatggccggccttgcgcagatcccgggcatcgtcaaggacgaggtcaagccgcaggtccacacctggaagttccccgacggcaaggtcctcatcgtcctctccgagggccgcctgctgaacctgggcaacgccaccggccacccgtcgttcgtgatgtccaactccttcgcggaccagaccctggcccagatcgagctgttcaccaagcccgacgagtacccgaccgacgtctacgtgctgcccaagcacctcgacgagaaggtcgcccgcctccacctcgactcgctcggcgtgaagctgacgacgctccgccccgagcaggccgcgtacatcggcgtcgaggtcgagggcccgttcaagtcggaccactaccgctac

SEQ ID NO: 5038 - DNA, 612 bp, Streptomyces avermitilis
  CDS (1)..(612)
atgccccgcggccgatattcgcttcacgacccgcacgaccacacccccctcggtgaagagcacttccactgcgcgcccggcccctccggctggcgctacgtctcccagctgaccaccccctccggcgaccacgccggctccgtcgacctcgccctcgacgacctcggccgccccatccgccttgaacttcacgccgcgagctggcaggtccgcggcgccgccctcgagggcgtcacctgggtccgcaccgaccccaccggcacgcatgccaccgaaggcaatgtccgcgcccacgccttcaccggcacgtccccggcattcctcgtcgccaccgcccgtctcctgcgcctcaccccctcttccgccgcgacccgcgtacgcctcgtcgccttcacggaccccgtcctcgccccccgcaccgtggaccagtcctgggccttgatctcgagagaagcacacgccactgacaacggccccctgaccgtggacgaataccaggtcacagccctggacacgggggagcagcacactgtccacatctccggcgacgtcgtgctcgcggcacccggcatcgagctggagcacctcgagtcgccgccgtcggcatccgcg

SEQ ID NO: 5039 - DNA, 1005 bp, Streptomyces avermitilis
  CDS (1)..(1005)
gtgagtgagctagtgacaggcgaggcggtggcgctggagctgcgccccgcgaagctgccgagccgggcgctggccgtgttgctcgacctgaccgtggcggtgctcgcctatgtcctcgtgaccatcgccttggtggcttcgacggccgggctggatgaggcggcgcggttcgcggtgtcggccgcggcttttgtgctggtgctggtgggcgggccgatcgcggtggagacgctcagccatgggcgctcgctcgggaagctggcctgtgggctgcgggtggtgcgcgacgacggtgggccgatccggttccggcatgcgctggtgcggggcgcggtcggggtgatcgagattctgatgacgttcgggatcgtcgcgtgcatcgcctccctcgtgtcggcgcgaggacgacggctcggcgatgtcttcgcggggacgttggtcgtacgggagcgggtgccgaccgggcgtgccgccttcgtgcctccgcctcccccctggctggccggacggttctccggcctcgatctgtcggcggtcccggacgggctgtggctcgcgattcgtcagtacctgacgcggatgcaacagctggatccgcaggtcggctggacgatggcggagcggctcgcggccgatctcgcggcgtgcacgggaacgcctgcgcctccggaggttccgccggccgcgtatctggcggccgtggtgcaggaacggcaggcgcgggaggctcggcgcgcgttcggcgctggagcgggcatgggcgaaggcgtcgccggaagtgcggccccggccgtgggagggccggtggctcaggggccgggcgcaggccatacggcggggcgacggctgacggttcccgctgatccgtcctatccgtcgctttcctcggtccagcccgcgacgcctacgcagccgcaggcacacgctcgaccccacgctccgtcctccgacccggctcaggacaagcggccggaccgccccgccaccggattcgcgccgcccgcg

SEQ ID NO: 5040 - DNA, 1005 bp, Streptomyces avermitilis
  CDS (1)..(1005)
atggacctcgacgtctatgtgtccgcccaccgtgccgagtgggaccgtctggatgacctgctgcgccgccgacgtcggctcaccggagcggaggccgacgaactcgtcgccctctaccagcggaccgcgacgcacctctccgtcatccagtccagcgccccggacccccagctcacgggccgtctcagccaactcgtggcacgcgcgcgcagtgcggtgacagggacccgccgggcctcttggcgtgatgtcacacgcttccttgcgtacggattccccgccgcggtctaccgagcgcgccactggtgggttcccaccgcgttgctctccacggtgacagcggtcctcctggggtggtggatcggcacacaccccgaggtccagtcctcgatcgcggcccccagcgaactgcgcgctctcacccgccccggcggcgagtacgagacgtactactccagccaccccgccgcgtccttcgcggcccaggtgtggacgaacaatgctcaggctgccgcgatgtgcctggttctgggcatcttcctgggccttcccgtcctctggatcctgttccagaacatgctcaacctgggtgtgggcctcggcctgatgtcctcggcgggccgcctcgacaccttcctgggtctcgttctcccgcacggccttctggaactgacggccgtcttcgtagccgccggcacaggcctgcgccttggttggaccctcatcgaccccggcccccgctcccgccgcaccgcactcgcggaagaaggccgcgccgccctgggcatggccgtaggtctcgccctggtcctcttcgtctccggcgccatcgaaggcttcgtcactccgtcgggcctgccgacctgggctcgaataggcataggcatcgccgctgaactggcgtttctgacgtacgtctatgtcctgggaggccgcgcgacacgagccggcgacaccggtgacatcgaggcggcggagcgcagcgcgaccgttccgacggccgcg

SEQ ID NO: 5041 - DNA, 1308 bp, Streptomyces avermitilis
  CDS (1)..(1308)
atggcactcacgggacgcgccgccctgctggcggctctcggcaccctccccgtaggcatctgggaacccagctgggccggcatcctcgccgtcaacgctcccctggcactgggctgcgcctgcgacttcgcgctggccgcccccgtacgccgcttgggcctcacccgctccggcgacacatccgtacgtctcggtgaaacggtcgacgtgacgctcaccgtcacgaacccttcgggccgccctttgcgcgcccgtctgcgcgacgcctggccgccgagcagttgggagccgggtaccgaagtagccgcgtcccggcaccgcctgacggtccctccgggcgaacgccgccgtctgacgacccggctgcgccccacccgccgtggcgaccgccaggcggcccgcgtcaccatccgctcatacggcccgctcggcctgttctcccgtcaggggagccacaaagtcccctggacggtacgagtcctgccgcccttcacgagccgcaagcatctcccttccaagctggcgcgcctacgcgaactcgacggccgcaccagcgtgctgatccgcggtcagggcacggagttcgacagcctccgcgagtacgttcctggtgacgacacccgctcgatcgactggcgggcgacagcccgccagtcgacggtcgccgtgcgcacctggcgtcccgaacgtgaccgccacatccttctggccctcgacacgggccgcacctcggccggccgagtcggcgacgcgccgcgcctggatgcttccatggacgcggccctcctcctcgcggccctggcctcccgggccggcgaccgcgtggacctcctcgcctacgaccgccgggtacgcgccctggtccagggccgcgcggcacgcgacgtcctcccgtccctggtcaacgcaatggcgacactggaaccggagctcattgaaacggacgcgcgcggacttacggcgaccgcactgcggacggccccgcgccgctccctgatcgtcctgttgaccagcctcgacgcagcccccatcgaggaggggctcctcccggtgctgcccaggctcacccagcgccatacggtcctggtcgcatcggtggcggacccgtacatcgcccacatggcgacggcacgcggcaacacggacgcggtctacgaggctgccgccgcggctcaggctcagacggaccgccatcgcacggccgaacaactgcgccgtcacggagtcacggtcgtcgacgcgactccggacgacctcgcacctgccctggccgacgcgtatctggcactgaaggccgccggccgccta

SEQ ID NO: 5042 - DNA, 990 bp, Streptomyces avermitilis
  CDS (1)..(990)
atgatggccccgaccactgacaacgccgggttcgccggggatgcgggcaccgcccgctcctccctggaggccctgcgcaccgagatcgccaaagccgtggtcggccaggaccccgccgtgaccggcctcgtcgtcgccctcctctgccgcggacacgttctcctcgaaggagtccccggagtcgccaagacgctgctcgtccgcgccctcgcatccgcgctcgaactggagaccaaacgcgtccagttcacccccgacctgatgccgagtgacatcaccggctccctcgtctacgacgcccgcaccgccgagttctccttccagcccggcccggtcttcaccaacctcctgctcgccgacgagatcaaccggaccccgccgaagacccagtcgtccctcctcgaagcgatggaggaacgccaggtcacggtcgacggcactccgcgcccgctcccggaaccgttcctggtggcagcgacgcagaacccggtcgagtacgagggcacgtaccccctccccgaagcccaactggaccgcttcctcctcaaactgacgatccctctcccttcccgccaggatgagatcgacgtcctcacgcgccacgccgagggtttcaacccgcgcgacctgcgcgccgccggcgtacgccccgtggcgggcccggccgatctggaggccgcccgcgccgcagtcgccaagacggccgtctcccccgaaatcaccggctacgtagtggacatctgccgcgccacccgcgaatccccgtccctcaccctcggtgtgtcgccgcgcggcgcaacggcgctgctggccacctcccgagcctgggcctggctgaccggccgcgactacgtgatccccgacgatgtgaaagccctggccctccccacgctccggcatcgcatccaactccgcccggaggccgagatggagggcgtgacggccgactcggtcatcaacgcgatcctcgcccacgttcccgtcccccgc

SEQ ID NO: 5043 - DNA, 1137 bp, Streptomyces avermitilis
  CDS (1)..(1137)
gtgtggacccgcgcgcgcggtgtcgtgctcgccctcgtgatcctcctggcggccgccgtcgcgatcgccgcgatccgctccggggaccagcacggccgcctcgacccacgctccgccgacccctacggcagccgtgccgtcgccgaactcctcgccgaccggggcgtctccacgcgcgtggtcaccacactcagcgaggcacgcaccgccgccggccccggcacgaccctcctgatcgcggtcccggatctgctgacgcaccgccaacagtccctcctgtacgcggcgacggagagctccggcggccgtacggtcctcatcgccgccaagtccccctcgatcggcaccctcgccccgggcgtcaccgccgaccccgccctcagcttcgattcgaagctcacccccggctgcggactgccggccgcccgccgcgcgggcgccgccgacacgggcggcatccgctacaccacgagcgtctcccacgccgactcgtgctaccccagcgacggtctgcccaccctcgtacgcgtaccggccgcgtccgggaacggcgacaccgtcgtgctcggcgctcccgacatcctctacaacgaccgcctcgacgagcagggcaacgcctcgctcgccctccaactgctcggctcccgctcccacctggtctggtacctcctctcgctctccgacgactcggccaccgacacgggcgaccgcaccttcatggacctgctcccctcgggctggctgtggggcacactgcagctcttcatcgcggcagcgctggccgccctctggcgggcacgccgactcggccccctcgtacccgaacggctccccgtggcgatccgcgcctccgaaaccgtcgaaggccgcgcccgcctctaccgcaaagccaacgcccgcgaccgcgcggccgctgctctgcgctccaccacccgcactcgcctcgcccccctcgtaggcgtccccgtcgcccaggcgcacgcgcccgaagccctgctccccgccctgtccgcccacctccgcgacgacggacaggccctgcacgccctgctcttcgggccgccgccccgcgacgacgcggccctgatcgcactcgccgaccaactcgacgccctcgaaagagaggtacgccgtcca

SEQ ID NO: 5044 - DNA, 717 bp, Streptomyces avermitilis
  CDS (1)..(717)
gtgccggccctgccgcgcgcagccggaacagtcgtacgcacgctgttgccctccggcgacgaaccaccggtgacgatcccgcgcgatcccgcgcgggaggccgcccggcgggaactgtcgaagcggatgtaccacaagaacgatcccagcctgttcgaacgtgccctgaacgccttctgggactgggtcgaccgcctgttcaacgccgcgtccaccgcgacaccgggcggcgcactcggcctcctcgtcatcgtgcttgccgtgctggcggtcggcggcgccctgtggtggcgcctgggcaccccgggcagggccccgctcccggcggccgcgctgttcgaggaccgcccccgcagcgccgccgaacaccgcgcggccgccgaggcccacgccgcccagggccactggaaccaggccgtccaggagcgcatgcgtgccgttgtccgatccctggaggaacgcgccctcctcgacgtgcgcccgggccgcaccgccgacgaggcggcctcggaagcgggccgtacgcttcccgtccacgccgagcgactgcgcgccgcggcccgggacttcgacgacgtcacatacggcggacgggccgcgggagaaggaacgtaccagcgcctcgccgccctcgacgccgacgtggaccggacccggcccgtgctcatgagcaacgcccacagcacggcccacagcgcccgccagggagccgccgaa

SEQ ID NO: 5045 - DNA, 1347 bp, Streptomyces avermitilis
  CDS (1)..(1347)
atgaaagacactccgggctgggcctcgcccggatctgcctcctccgacgggcaggagccggacgcctccggcgccgcgcagcccccggagcagccctcggaccagagcggcgcggaccagtcgcagccgccctcgaactggtccaaggagcagcccccgcccgggcagtggaccgctccccacccccagggcccgggccaggccccgccaccaccaccgcccggcccgggatggggcggccggcatcccggcggcccgggaggtcacggcggccagagcggtgcctggggcggacccggctacggaggtccggggggaccggccggctggggcggcaactggggcggcccgccgcccgcggccaagcccggcgtgatcccgctgcgcccgctcggcgtcggcgagatcctcgacggcgcggtctccaccatgcgcatgtactggcgcacggtcctcggcatctcgctggccgtcgccgtcttcacgcagatcctcgtcatcctgctccaggggctcgtcctggacgacagcgccggcacggacaccctcaacgacccgagcgccaccgtcagcgagctcagccgcgccatgggcgaggccctgctgaactccggcgtcgtcctcctgatcaccctcctcggcaccatcgtcgcgaccgccctgctcacgaccgtgaccagccgggcggtgctcggcaagtcggtgacgaccgccgaggcctggcgcgacgcgcggccccagctgctgaagttgttcggcctgaccttcctgctgccgctcatcggcctcgccatcatcgccgtcggcgcactgcccggggtactcgtcgtcctcgccggcgcgacggacgcgggcgcctcgctggccgtcctcggtggcctcgccgcggcggtgtgcgcgctctgggtgatgatccgcttctcgctcgcctcgcccgccctgatgctcgagaggcagagcatccggaagtcgatgagccgctccgcgaaactcgtgcgcggctcgtggtggcgcgtcttcggcatccagctgctcgccacgatcatcgccaacatcgtcgcgtcgatcgtcgtgatcccgttcgccttcctggccgccgcgctgagcggcgacggcatctccggcatcctcaccagcggcaccggcggcctcggctggacgttcctcatcgtgagcggggtcggctcggtgatcggtgccatgctcacgttccccatcaccgcgggcgtgaccgtgctgctctacatcgaccagcgcatccgccgcgaagccctcgacctcgacctggcccgcgccgccggcgtccaggactacggctccaccgcccccggcaccactgcggggagc

SEQ ID NO: 5046 - DNA, 1146 bp, Streptomyces avermitilis
  CDS (1)..(1146)
atggctgatcagtacgcgcaatcaggcgaggacaaccggccgacggagataccggcgattcgttgggacgaaccgcccgagggacctgtgctggtccttctcgaccagacaaggctgccggccgaggaggtcgagctggtgtgcacggacgcgccggcgctggtggaggcgattcgcacgctcgccgtgcgcggggcaccgctgctcgggatcgccggggcgtacggcgtcgcgctcgccgccgcgcgcggcttcgacgtggacgaggccgcccaggcgctgtccggcgcccggccgaccgcggtgaacctcgctgtcggcgtgcgccgggcccgggccgcgtaccgggacgcgctcgccgggggcggtgatccggagcgggccgcggcggcggcactccaggcggcgcgggcgctgcaccgggaggacgccgaggcgagcgcgcggatggctgagcacggccttgcgctgctcgacgagctgctgccgggcggtgggcaccggctgctgacgcactgcaacaccggggcgctggtgtccgggggtgagggaacggcgttcgcggtggcgttggcggcgcaccgggaggggcggctgcgcaggctgtgggtggacgaaacgcggcctttgctgcaaggtgctcgtctgacggcgtacgaggcggcgcgcaacgggatggcgtacaccttgctcacggacaacgcggccggctcgctgttcgcggcgggggaagtggacgcggtgctgatcggggccgatcgcatcgcggccgacggttcggtggcgaacaaggtggggagctatccgctcgcggtccttgccaggtatcaccatgtgccgttcattgtggtggcgccggtgacgacggtggatccggacaccccggacggggcatccatcgaggtcgaacagcgtgccggtcatgaagtgaccgaggtcacagcaccccaggtgccggtggcgggagcggaagcaggaggcgggataccggtggcaccactggggacccaggcgtacaacccggcgttcgacgtgacgccgcccgagctggtgacggcgatcgtcaccgaagagggcgccgtctcgcccgtcacggcatcggcgctcgccgagctgtgtgccaggtcacgccaggtaacgattagc

SEQ ID NO: 5047 - DNA, 687 bp, Streptomyces avermitilis
  CDS (1)..(687)
atgatgtcgtttatgaagggacgagtccttgtcgtcgatgacgacaccgcactggccgagatgctcggcattgtgttgcgtggtgaaggttttgagccgtcttttgtagccgacggcgacaaggcgctggccgctttccgtgagtccaagcccgatcttgtgctcctggacctgatgctgcccggccgggacggtatcgaggtgtgccgcctgatcagggcggagtccggggtgccgatcgtgatgctcacggccaagagcgacaccgtcgatgtcgtggtgggcctggagtcgggcgcggacgactacatcgtgaagccgttcaagccaaaggagctggtggcccgtatccgggcgcggctgcggaggtccgaggagccggcgcccgagcagctcggcataggtgacctggtcatcgatgtggcgggtcactccgtgaagcgggacgggcagtcgatcgcgctgacgccgctggagttcgatctgctggtggcgctggcccgcaagccgtggcaggtgttcacgcgtgaggtcctgctcgagcaggtctggggctaccggcacgcggcggacacccgcctggtcaacgtgcatgtacagcggctgcgctccaaagtcgagaaggacccggagcggccggagatcgtggtgaccgtccgtggcgtcggttacaaggccggaccgagc

SEQ ID NO: 5048 - DNA, 2076 bp, Streptomyces avermitilis
  CDS (1)..(2076)
atgtcccgggacagtgccgcttcggcacccggacagccgggggcccgttcggggcggcctgtcggccgaaagatgacgggctctcgctggggacggttcatggagggcgggctgctgcagggcggagtccagggcagcccggtcctccggctcgtcatgcgctgggtgcgtcgtccgctgctgcccgtgatgcggctgtggcggcgcaacatccagctcaagatcgtcgtcaccacgttgctgatgtcgctgggcgtggtgctcctgctgggcttcgtggtcatcgggcaggtgcgcaacggtttgctggacgccaaggtgaaggcatcccagagtcaggccgtgggcgggttcaccgtcgccgggcagagggccgacagcacggcgagcgcgagcggcggggacgaaaacgccggagcggccggcacccccgtgcagaacgtcagcggttggatgactgacctggtggcctcgctctccagcggcggccagggcgccttcgacgtcgtgacgctcagcaccagggccgcggacaacgagaacaggggtctggggccgcgcgcgtcgggcggcgtcgaacccagcctcagcgtgccggaaggcctgcggaaacgcgtcgacgccggcttgggcgtggcccagagctacacccgcatcgtctacaccgatcacggccgtgaggcgcagccggcgctgatcatcggcaagcaggtcaacgaccccaacggcgacccttaccagctgtactacctcttcccgctcacccaggaggagaagtcgctcagcctggtcaaggggacactggcgacggcgggcctgttcgtcgtggtgctgctcggggccatcgcctggctggtggtgcgccaggtggtcacgccggtacggatggctgcggggatcgccgagcggctgtccgccgggcacctgcaagaacgtatgaaggtcacgggcgaggacgacatcgcgcgcctcggcgaggctttcaacaagatggcgcagaaccttcagttgaagattcagcagctggaggacctctcgcggatgcagcggcggttcgtgtcggacgtgtcgcacgagctgcgtacgccgttgacgaccgtgcggatggcggccgacgtcatccatgaggcgcgcgtggacttcgatccggtgaccgcgcggtccgcggaactgctcgccgaccagctggaccggttcgagtcgctgctcgcggatctgctggagatcagccgcttcgacgcgggcgcggcggcgctggaggcggacgcgatcgacctgcgggaggtcgtccggcgggtcgtcagcggggccgagccgctcgccgagcggaagggcacgcacatacgtgtcgtcggtgaccagcagcccgtggtggccgaggcggacgcccggcgcgtcgagcgggtgctgcgcaatctcgtggtcaacgccgtggagcacggtgagggcaaggacgtggtggtcaagctcgccgctgcgggcggcgcggtcgctgtcgcggtgcgtgactacggggtggggctcaagcccggcgaggcgacccgggtgttcagccgtttctggcgggcggatccggcacgcgcgcgtaccaccggtggtacgggcctcgggctgtccatcgccttggaggacgcccggctgcacggcggctggttgcaggcatggggtgagccgggcggcggttcgcagttccggctgacgctgccgcggaccgcggacgagccgctgcggggatccccgataccgctggagcccaaggactcgcggcgtaatcgtggacttaatggtgccggtctgccgctcggcggctccggcaagctcgccacggtgcccgtccagcccgccggtgagaacgcgccgccgcagatgcccccgcgcgcgcccatggcgccgcggctggcgacggcgacccccacagccgaccccaccgcgctgcccggtaacggcgcgcgggtggtgccgcggcccgcgggcggcgcacgcaagcagaacgacacgcccccggcgagcgggggacggagcacacaggagccgcccgagagcggcagcgggcaaggggaggcatttcgtgggcgc

SEQ ID NO: 5049 - DNA, 1830 bp, Streptomyces avermitilis
  CDS (1)..(1830)
gtgggcgctgaggggggcggccgacggcgcgcgctgcggctgggggcgtacgtcggctgtggtgccgtgctgctgacggggtgcgcctcgatgccggacagcggggatctgcggggtgtcgagtcgacgccccggcaggacgcgcaggtccgggtgttcgcgatgccgccgcgtgaggatgccgcgcccgctgagatcgtccagggtttcctggaggcgctgaccagcgacgacccgcagtatgagacggcgcgggagtacctcaccggcgatgcctcgaagcagtggcggccctacaagtccaccaccgtgctcgccgacgggccgaatcccgagccggagcgcacgaggaaccgggagaccggcgacgacttcgcgtacacgctgacgggcagcaggctcgccaaggtggacgggcagcacgcgtatgcgccggactcgggtgactacaccgggacggtgcatctcacgctgcagcggaagaccgggcagtggcgcatcgacgcgctcccgcagggcgtggtgatgggcaagtccgacttcgaacgcaactacaagtccgtcaacaagtactacttcgcctcgaacgtgcccgccgggacgagcggtcagctgggcaccgtcgcggacccggtgtacgtacgcggcaaggtggacccggtgacggcgatggtcaccgagctgctgaagggccccacgcgctggctggcgccggtggcgaggtcgagcttccccaccgacacggggctgaagaagggcgtcacgtcgctggcgcccgacgaccagaacaagctgacggtgccgctgaacaagaaggccgaccgcgtcggacgggcgcagtgcaccaagatggcggcccaacttctgttcacgctcaaggatctgacgcccacgggtgtggacgaggtggagctgcagcggtccgacgggtccacgctgtgcgatctcggggaggccgaggccgagagcatcgcctcgcacggcacgggcaagtcgggcgagtacgagtacttcatcgacggcgagcagcggctcgtgcggttgtccggcagcagcaacggcaaggacccggatccggtgcctggggcgctgggtgagggtgccaagaagctgcgcgctgcggcggtctcgcgtgacgaggtcaccgcggccggggtctcgttcgacgggagctcgctgtacgtcgggtcgctggtgtcgggtgcctcgctcggcgaggcggtcgtgcacagtgcgggcacgaccgagaaggaccggctgacgactcccagctgggacggcggaggtgacctgtgggtggccgaccgggacccggcgaagtcccggctgctcctgttgcagaagggctcgggcgaaccgctggaggtgcgcacgcccaggctcgacgggcgcatcgacgccgtacgagtggctgccgacggcgtgcggatcgcgctgatcgtggaacgggacggcaagacgtctctgcagatcggacgtatcgagcgggagaccaaggccgatgagcgcgccgatgtgtcgattctcgaactgcactccgtgacaccgcagctggaggaggtcacggccatgtcgtgggccggggacagccggctcgtggtggtcgggcgcgagaagggcggtgtgcagcagatgcggtacgtccaggtcgacggctccacgccgtcgggctcggcgcccgcctcgctgaccggcgtgcagcagatcgcggcgtccgaggacgagcggctgccgctggtggcgtactcggaggacgggatcgtacggctgtcgtccggagcgcagtggcagaaggtcatgaaggaggggacggctccggtctatccgggc

SEQ ID NO: 5050 - DNA, 1017 bp, Streptomyces avermitilis
  CDS (1)..(1017)
ttgtcccaggtgagaggccattcgaggcttccgcgtcacaggccgtcccccgtgtgggtgacggcctgtggcgatggtggccggttgtccacagggagttgtccacaggtctggcaggacagcgcgggcattggcacagtggtgggcatgcgggggtggtggcaggacctcacggatctggtgctgccggccgagtgcggaggctgcggcaagcctcgtacggtgctctgcccggagtgccgtgccgcccttcacggggccgcgccgtgccgggtgcgaccggagccggagccgtcggggctgcctgtcgtgcacgcgtcggcggcgtacgagggcggggtgcgggcggcgctcctcgcgcacaaggaacgcggtgcgctggcgctggcaggaccgctggggacggctctggcgggggctgtgcgggcggggctggggtctgcgaggccctggtgcggggacgggccggtgcggcccggaggcggcgtcgtgcgggagtccgtgctgctggttccggtgccgtcgtcgcggcgggtggtgcgggcgcgggggcatgatcccgcgcggcggatcgcgctcgcggcggcgggagagctgcggcgggccgggacggtggcgcgggtggcggccgtgctgcggcagcggcggttcgtggcagaccagtcggggctcaacgcccggcagcggctggcgaatctcgcgggcgcgctggaggtggccgccgggggcgcccggctgctggccggtggggggcgggtcgtgctcgtcgacgacctgatgacgaccggcgcttcgctggcggaggcggcccgcgcggtgcgggccgcgatggcggacacgcaggtgtacggagaaggaacgcgggaaacaacgggagaacggatggtgggagcgacagtgacggagccggagcggacagaagccgtacggagaatggcgcgtacgagcgatgccggagacggggtccgagcagccgttgtcgcagcttctccggacgctttcgaaataaactggaac

SEQ ID NO: 5051 - DNA, 858 bp, Streptomyces avermitilis
  CDS (1)..(858)
gtgccgcgggttttctgcaatcacccgcaccggtggggtggagatctcgcccacgggggaggaggaggtggacgtcaccgagtccgaggttccggtgctcaccggggcctggtgcaaaagggagatgctccgccagggatgcggagtgatccgggaacggagttctgcgtggacatcgtcgtcaagggccgcaagaccgaggtgcccgagcggttccgcaagcacgtggccgagaagctgaagctggagaagatccagaagctcgatggcaaggtgatcagcctcgacgtcgaggtgtccaaggagcccaacccccggcaggccgaccgttgcgaccgagtggagatcacgctccgctcccgcggaccggtgatccgggcggaggcagcggccagcgatccgtacgcggcgctcgacctggcggcggacaagctcgaagcccggctgcgcaaggagcacgacaagcgccacacccgccgcggtgcgggcaggctctccgccgcggacgtcgccgacaccgttccgggcgcagcgacgctgaacgggagcggcggcatcgtcagtgaggcggagtcggacggtatcccgaccaagaagatcggctcgctcgaggtcaagggcgaaggccccctcgtggtccgcgagaagacccacgttgcttccccgatgtcgctcgaccaggcgctctacgagatggagctggtcgggcatgacttctatctgttcgtcgactccgagaccaaggagcccagtgtcgtctaccggcggcacgcatacgactacggcgtcatccacctcagcacggacccgatggtcgcccaggcgcagtcggccgacgcgggcggtgcactcggcggc

SEQ ID NO: 5052 - DNA, 744 bp, Streptomyces avermitilis
  CDS (1)..(744)
atggcggacagcttcggaccgatgcgggacgacgatgccgacggcggcgtcgtcggcatgggcccggacgcggactctccgggcaaggagcccatccgagtccttgtcgtggacgaccacgccctcttccgccgcggtctggagatcgtgctcgcggccgaggaggacatccaggtcgtcggagaggccggcgacggcgcggaggccgtggacaaggccgcggatctgctgcccgacatcgtgctgatggacgtacggatgcccaagcgcggcgggatcgaggcgtgcacctccatcaaggaggtggcgcccagcgcgaagatcatcatgttgacgatcagcgacgaagaggccgatctctacgacgcgatcaaggcgggcgcgaccggttatctcctcaaggagatctccacggacgaggtggccacggccattcgcgcggtcgccgacgggcagtcgcagatcagcccttccatggcgtcgaaactcctcaccgagttcaagtcgatgatccagcggacggacgagcgccgtctggtgcccgcgccgcggctcacggaccgcgaactggaagtcctcaagctggtcgccaccgggatgaacaaccgcgatatcgcgaaggagctgttcatctccgagaacaccgtgaagaaccatgtgcgcaacatcctggagaagctgcaactgcactccaggatggaggcggtggtgtacgcgatgcgggagaagatcctcgagatccgg

SEQ ID NO: 5053 - DNA, 1200 bp, Streptomyces avermitilis
  CDS (1)..(1200)
atgccgagcctgccgcgccccaccgccgaactctccgctgacgacgcccgccgcatcgccctgcgcgcgcagggatttttgggcgcccccgaccgtagggcgggcgtgcgcggcgtgctccgccacctcggagcggtccagctcgacacgatctcggtgctcgcccgctcgcacgagctgatcccgtacgcccgcctgggcgcggtgggccgcaaaacggtcgagcgggcgtactggaccaccgcatccgccgacgcctccccggcacacccccacgcgttcgagtactggtcgcacgcggcctgcatcctccccatcgaggagtggccccacttcgccttccgccgccgcgcctaccgcgcccgcccgcactggaaccacgagctgccggacggcacgtacgaccaggtcatcaagcagctccgcacggaaggcccgctcaccgcgaccgagttgggcggcgcgaagaagaccagcgagtggtgggactggtcgggcacgaaggtcgccgtggagcgcgcgctcatgtacggcgaggtggtgtgcgtcgagcgccgcggctggaagcgggtgtacgacctggccgagcgtgccgtcccaaagacgctgctgcacgacgagttggacgacaccgagtgcctgcgccgtctcgtccgcctcgcgggccagtccctgggcgtgggcacacgcgcggacatcgccgactaccaccgtctcaagggcgagcagttcgacgcggtgatcgcggactcgggtctggtgccggtggcggtcgagggctggtccaagccggcctgggcggacccggcggcgctggagacggccccgcgcggccgccaccgcacgacgctcctgtcccccttcgactccctggtctgggagcgggcgcgcacagagcggatcttcggcttcacccaccgcctggaggcatacgtcccgaagccgaagcggatctacggctacttcgcgatgccggtgctcgcgggcgggcagctgatcggccgcgtggaccccgcgcgcgaaggcagcaccctggtcgccaagcaggtgaccctggacggccccacggcggtcccgggagtggcgcaggccctggtggaggccgcgacctgggtggactgcacggacgtacgagtggagcgggtggacatcccggaactgcgcgagcccctcgtcagggaactggcccgcaccctggga

SEQ ID NO: 5054 - DNA, 567 bp, Streptomyces avermitilis
  CDS (1)..(567)
atggaacccgccacgctgaccaccgatcgtcttgtcctgcgcaccgtgggcacccaggacaccgacgccgtgtacgaggcagcccaggaccccgagatccagcgctggaccacgatcccgtcgccctaccttccggagcacgcggcgagcttcacggatcagctggtgcccgaaggctgggcgaacggctccatgttcacgttcggcgtcttcctcccctccggcgaactggccggcatgctcgccctctccatgcgcgccctcggcgtgagcgaggtcggcttctgggcgacgaaggagcaccgcggcaacggctacatcaccgaggccgtcctcgccgcctcccactgggcgttcacccggatgtcgatcgaccgcgtggaatggcgcgcgcaagtgggcaacacgggctcccgcgcagtggccgaacgcgccggcttcacgatcgagggcaccctccgctcagcgatcaacaacaagggagtacggcgggactgctgggtcggctccctgttgccgtcggacctgggactgccgtcgacagcgccgtaccttccgacgccgcgc

SEQ ID NO: 5055 - DNA, 2817 bp, Streptomyces avermitilis
  CDS (1)..(2817)
gtgtccgtcctctcaaagatcatgcgtgcaggcgaaggcaagatcctgcgcaagctgcaccgcatcgcggaccaggtcaactccatcgaagaggacttcgtcgacctctccgacgccgagctgcgggccctcaccgatgagtacaagcagcggtacgccgacggcgagagcctcgacgacctgctgcccgaggcgttcgccaccgtccgcgaggcggccaagcgcgttctgggccagcggcactacgacgtgcagatgatgggcggcgccgcgctccacctcggctatgtcgccgagatgaagaccggtgagggcaagacgctcgtcggcaccctgcccgcgtatctgaacgcgctctccggagacggcgtccacctcatcacggtcaacgactacctggccgagcgcgactccgagatgatgggccgcgtccacaagttcctgggtctgagcgtcggctgcatcctcgccaacatgacgccggcccagcgccgcgagcagtacgggtgcgacatcacgtacggcacgaacaacgagttcggcttcgactacctgcgcgacaacatggcgtggtcccaggacgaactggtgcagcgcggccacaacttcgcggtcgtcgacgaggtcgactccatcctcgtcgacgaggcccgtacgccgctgatcatctccggaccggccgaccaggccaccaagtggtacggcgacttcgccaagctggtcacccgcctgaagaagggcgaggcgggcaacaccctcaagggcatcgaggagaccggggactacgaggtcgacgagaagaagcgcaccgtcgccatccacgagtccggtgtcgccaaggtcgaggactggctgggcatcgacaacctctacgagtcggtgaacacgccgctggtgggctacctgaacaacgccatcaaggccaaggagctcttcaagaaggacaaggactatgtcgtcatcgacggcgaagtcatgatcgtcgacgagcacaccggccgtatcctcgccggccgccgctacaacgagggcatgcaccaggcgatcgaggcgaaggaaggggtggacatcaaggacgagaaccagacgctcgccacgatcaccctgcagaacttcttccgcctctacaacaagctctccggcatgaccggtacggcgatgaccgaggccgccgagttccaccagatctacaagctcggcgtcgtcccgatcccgacgaacaagccgatggtccgcaaggaccagtcggacctgatctaccgcaccgaggtggccaagttcgacgcggtggtcgacgacatcgcggagaagcacgagaagggccagccgatcctcgtcggcaccacctcggtcgagaagtccgagtacctctcgcagcagctctccaagcgcggcatccagcacgaggtgctgaacgcgaagcagcacgaccgtgaggcgacgatcgtcgcccaggccggccgcaagggcgccgtgacggtcgccacgaacatggccggccgtggtacggacatcaagctcggcggcaaccccgatgacctcgccgaggcggagctgcgccagcgcggcctcgaccccgaggagcacatcgaggagtgggccgcggcgctgcccgccgccctggagcgggccgagaaggccgtcaaggccgagttcgaagaggtcaaggaactcggcggtctctacgtgctgggcaccgagcgccatgagtcgcggcgtatcgacaaccagctgcgcggtcgttccggccgccagggcgaccccggtgagtcccgcttctacctctccctgggcgacgacctgatgcggctgttcaaggcccagatggtcgagcgcgtgatgtcgatggcgaacgtccccgacgacgtgccgatcgagaacaagatggtcacgcgcgcgatcgcgtccgcccagtcgcaggtcgagacgcagaacttcgagacccgcaagaacgtcctcaagtacgacgaggtcctcaaccggcagcgcgaggtcatctacggcgagcgccgccgcgtcctggagggcgaggatctgcaggagcagatccaccacttcatggacgacacgatcgacgcctacatcgaggcggagaccgccgagggcttcgccgaggagtgggacctcgaccggctgtggggcgccttcaagcagctctacccggtgaaggtcaccgttgatgagctggaggaggcggccggcgaccgtgccggtctgacggccgagttcatctccgagtccatcaaggacgacatccacgagcagtacgagcagcgtgagacgcagctcggctccgagatcatgcgtgagctggagcgccgggtcgttctgtcggtcctcgaccgcaagtggcgcgagcacctctacgagatggactatctccaggagggcatcggcctgcgcgcgatggcgcagaaggacccgctggtcgagtaccagcgcgagggcttcgacatgttcaccgccatgatggacggcatcaaggaggagtccgtcggctacctgttcaacctggaggtccaggtcgagcagcaggtcgaggaggtcccggtcgaggacgagaagccttcgctggagaaggaggacgcggtgccggcgcaggcgggcgcccgtccggagatccgcgccaaggggctcgaagccccgcagcggccggaccggctgcacttctccgcgccgaccgtggacggcgagggcggcatcatcgagggcgacttcagcagcgacgacgacgaagagcccgtgcggtccgaggcggacggcctcacgcgtgcggagcgccgcaagcagtccaagggcgggcggcgccgcaagaag

SEQ ID NO: 5056 - DNA, 267 bp, Streptomyces avermitilis
  CDS (1)..(267)
atgctccgccacaccgcgggccgcgcctacgacgaactggcctggctggccgaacgcggccccctgcgcgcccgcggcaccaacccggtcgtccgcgacatcggctactacgtcccgcgccccggagcgatcgaggccttcgcgcgcatcggcgctggcgaccagctccgcgcgatggcgttccgcctggagtacgggcccgacaaccgctggcgctgcacggcggtggaactgggcggtccccgcatgccgcacatggacgacgac

SEQ ID NO: 5057 - DNA, 513 bp, Streptomyces avermitilis
  CDS (1)..(513)
atgcgcgtctacgtccccctgaccctctccggtctcgccgaggcgtacaagacgggtgagctgggagcgggaccgttcgtcgcgtacgccgtcacgcccgcgttgcgcgagtggtacctctccgaggacatcgaggagctggagtacgcggcgctgaaccgggccgcgctcgcctccctgcggctgctggcggcggaccccggtgccgtgcggcgccgggtcgtggtcgcggtcgacgtggccgacggcgcggcgagcgccgacccggacctggggctggacccggcggcgctcggcgaggtgcgggtcgccggggccgtaccgctggccaaggcggccgcggtccatgtcgactccggcgacgcggaggcggacgtgaccgccgccgtggaggcgctggccgcggcggacggcggggacgacgccgcgcagttcgtcgtggacggggccgaggaccacgaactgctctggtacgccaggcaggagatcccgaacctcgtggggctggagggc

SEQ ID NO: 5058 - DNA, 672 bp, Streptomyces avermitilis
  CDS (1)..(672)
atggggatgcacggagcagcgcacatcgtctgggactggaacgggaccctgttccatgacaatgcggcgatcatcggggcgacgaacgcggcgttcgcggagttggggctcgagccgatcacgctcgagcggtacagggcgctctattgcgtgccggtgccgaagttctacgagcggctgatcgggcgcctgccgacggacgccgagtgggagatcatggacgagatcttccaccggtactacgcggagcacagggtcggttgcgggctcaccgagggagcggcggagctgctcgtggagtggcagtcggcggggcacagccagtcgatcctcagcatgtacgtccatgacgaactggtcccgctggtacggggattcgggatcgagccgcacttcatacgcgtcgacgggcggaccggcccctccggcggcagcaaggccgagcacatggtgcggcacataggcgcgctcgcgggcgtcgcgggcgtcgatccggcgcgcacggtggtgatcggggacgcggccgacgacgcggtcgccgctctgcacgtcggtgcgcaggcagtcctctacacgggcggctcccacagccgcgccagcctcgaaggagtcggtgtgcccgtggtggacacgctggcggaggcggtcgaggaggccggccgactggcggcg

SEQ ID NO: 5059 - DNA, 4935 bp, Streptomyces avermitilis
  CDS (1)..(4935)
atgcagaccaagctggacgaagcaaaggccgagctgctcgagagggctgctcgcgtagctgagaacagtccggtcggggggcacctaccgactggaacgacgggcgacggaatcccggaccgggacaccgtgctcgcgttcctccggcgctactacctgcacaccgccccggaggaccttgccgaccgcgacccggtcgatgtcttcggagccgccttctcgcactacaggctggccgagaaccgcccacagggcacggccaacgtgcgggtccacacgccgaccgtcgaggagaacggctggacgtgcagccactccgtcgtcgaggtcgtgaccgacgacatgcccttcctcgtcgactcggtcaccaacgagctgtcgcggcaggggcgcggcatccacgtcgtcatccacccccaggtcgtcgtacgccgcgacctcaccggcaagctgatcgacgtcctcgccccgccgcccgccggggagctgccgcacgacgcggcgctcgagtcctggatccatgtcgagatcgaccgcgagaccgaccgcgccgatctgaagcagatcaccgccgacctgctgcgcgtcctgtccgacgttcgtgaggccgtcgaggactgggagaagatgcgcgacgcggcgctgcgcatggccgaggagctgcccaaggagccgaccgccgacgacctgcgtgaccaggaggtcgaagaggcccgcgagctgctgcgctggctgtcggccgaccacttcaccttcctcggctaccgcgagtacgagctgcggggcgacgactcgctggccgccgtacccggcaccgggctcggcatcctgcgctccgacccgcaccacgccggtgacgacagccaccccgtgagcccctccttcgagcggctgcccgccgacgcccgcgccaaggcccgcgagcacaagctgctcatcctcaccaaggccaacagccggtcgaccgtgcaccgcccgtcctacctcgactacgtcggcgtgaagaagttcgacgagaacggcgaggtcatcggggagcggcggttcctcggactgttctcgtccgccgcctacaccgagtccgtgcggcgcgtgccggtcatccggcgcaaggtcgaggaggtcctcaagggggccggcttctcgcccaacagccacgacggccgcgacctgctccagatcctggagacctacccgcgcgacgagctgttccagacgcccgtggacgagctgcgttccatcgtcacctccgtgctgtacctccaggagcgtcggcggctgcggctctacctgcgccaggacgagtacgggcgctactactcggccctcgtctacctgccccgcgaccgctacaccaccggcgtgcgcctgcggatcatcgacatcctcaaggaggagctcggcggcaccagcgtcgacttcacggcctggaacaccgagtcgatcctgtcccggctgcacttcgtggtccgggtcccgcagggcaccgagctgccgcagctgtccgacgccgacaaggagcgcatcgaggcgcggctcgtggaggccgcccgttcctgggccgacgccttcgccgaggcactgaacgcggagtgcggcgaggagcgcgccgccgagctgctgcgtcgctacggcaacgccttccccgagggctacaaggccgaccacacgccgcgcgccgccgtcgccgacctggtgcacctgcaaaagctcacgagcgaccagagcaaagacttcgcgctcagcctgtacgagccggtgggcgcctcgccctccgagcgccgcttcaagatctaccgcacgggtgagcaggtctcgctgtccgcggtcctgcccgcactcaaccggatgggcgtcgaggtcaccgacgagcgcccgtacgagctgcgctgctcggaccgtacgaccgcctggatctacgacttcgggctgcgtctgcccaagtccgcgagcggcaacggggactccctcggcgacgacggccgtgagcggttccaggaggcgttcgccgccacctggaccggcgaggccgagatcgacggcttcaacgccctcgtcctgagcgccgggctcaactggcggcaggcgatggtgctgcgcgcgtacgccaagtacctgcgccaggccggttccaccttcagccaggactacatggaggacaccctccgtaacaacgtccacaccacccggctgctggtgagcctcttcgaggcgcggatgtccccggaccgccagcgggccggcgtcgagctgaccgacgccctgctggaggagctggacgccgccctcgaccaggtcgcctcgctggacgaggaccggatcctgcggtccttcctcacggtgatcaaggcgaccctgcggaccaacttcttccaggaggcgctcggcggcaagccgcacgaatacgtctccatgaagttcgacccgcaggccatcccggacctcccggcgccgcgtccggcgtacgagatctgggtgtactcgccgcgcgtcgagggtgtgcacctcaggttcggcaaggtcgcgcgcggtggtctgcgctggtccgaccggcgtgaggacttccgcaccgagatcctcggcctggtcaaggcgcagatggtgaagaacaccgtcatcgtgccggtcggcgcgaagggcggcttcgtcgccaagcagctgcccgatccgtccgtggaccgggacgcgtggctcgcggagggcatccgcagctaccagaccttcatctccgcactgctcgacatcacggacaacctggtcgccggcgaggtcgtgcccccggcggacgtcgtacggcacgacgaggacgacacctacctcgtggtcgccgcagacaagggcacggcgacgttctcggacatcgccaacgaggtcgccgagtcgtacaacttctggctcggggacgccttcgcctccggcggctcggcggggtacgaccacaagaagatgggcatcacggcgcgcggtgcctgggagtccgtgaagcggcacttccgggagctgggcgtgaacacccagaccgaggacttcacggtcgtcggcgtgggcgacatgtccggtgacgtgttcggcaacggcatgctgctgtccgagcacatccggctggtggcggccttcgaccaccggcacatcttcatcgacccgaagccggacgcggcgacgtcgtacgccgagcggcgccggctgttcgagctgccgcgctcgtcgtgggccgactacaacaccgagctgctgtcgggcgggggcgggatcttcccccgtaccgcgaaggcgatcccggtcaacgcgcacatccgtgaggccctcggcatcgaggccggcatcaccaagatgaccccggccgacctgatgaaggcgatcctcaaggcgccggtcgacctgctgtggaacggcggcatcggcacatacgtcaaggcgagcacggagtcgcacgcggacgtcggcgacaaggccaacgacgccatccgcgtggacggcgccgacctgcgcgtcgacgtcgtcggcgagggcggcaacctcggactgacccagctcggccggatcgagttcgcgcgcagcggcgggcggatcaacaccgacgccatcgacaacagcgcgggcgtggacacctccgaccacgaggtgaacatcaagatcctgctcaacgccctggtcacggagggcgacctcaccgtcaagcagcgcaacaaggtgctcgccgagatgaccgacgaggtcggccacctggtgctgcgcaacaactacgcgcagaacgtggcgatcgccaacgcgctcgcccagtccccggacatgctccacgcccagcagcgcttcatgcgtcacctggtgcgcgagaagcacctcgaccgggccctggagttcctgcccagcgaccggcagatccgtgagcggctgaacgcgagccagggcctgaccggtccggagacggccgtcctgctcgcgtacacgaagatcacggtctccgacgagctgctcggcacctcgctgcccgacgacccgtatctgcagagcctgctgcacgcgtacttcccgacggcgctgcgcacgaagttccgcgagcagatcgacacgcacgcgctgcgccgcgagatcgtgacgaccgtcctggtcaacgacacggtcaacacgggcggtacgagcttcctgcaccggctgcgggaggagaccggcgcctcgctggaggagatcgtcagggcgcagaccgcggcccgtgcgatcttcgagtcgagcgcggtgtgggacgcggtcgaggcgctcgacagccaggtcgacgcggacgtccagacccggatccgcctgcactcgcgtcgcctcgtcgagcgcggtacgcgctggctgctcaacaaccggccgcagccgctccagctcaccgagacgatcgcgttcttcaaggacggggtcaagcaggtctgggacgagctgcccaagctgctgcgcggcgcggaccaggagtggtggcagaagatctacgacgagctgacggcggccggcgtgccggacgagctcgccacgcgcgtggccggcttctcctccgccttcccggcgctcgacatcgtctcggtggccgaccgcatgggcaagaacccgatggccgtcgccgaggtgtactacgacctcggcgaccgtctgagcatcacccagctcatggaccgcatcatcgaactgccgcgctccgaccgctggcagtccatggcccgcgcggcgatccgcgaggacctgtacgcggcccacgcgtcgctcaccgccgacgtcctggcggtcggcaacggcacctccacgcccgagcagcgcttcaaggcgtgggaggagaagaacgcggcgatcctgggccgcgcgcggacgacgctggaggagatccagggctcggacgcgttcgacctggcgaacctgtcggtggcgatgcggacgatgcggacgctgctgcggacgcattcg

SEQ ID NO: 5060 - DNA, 486 bp, Streptomyces avermitilis
  CDS (1)..(486)
gtgaacctctccgagcggcggccccaggtcgcccaccgggccgccgtgatccccgcgccccctccggcaagcgcccggctccggaagctcgcgctcgaagtggccaggttcggggtcgtcggcggcagtggtgtcgcggtgaacttcctcgtcttcaacctcgcgctgcacggcatgaagtgggcgccgatggcggccacggtgctcgccagcgtcatcgccatgggcaccaattacatcggcttccgctgctacgcctaccgcgaccgcgcctcccgcacccgccgccagatcgcgctcttcttcgccttcagcgggctcggcgtcgtcatggagagcgtgctcttctacgtcggctaccacggcctcggcatgagcgggccgatcggctccaacctggcgaaggcactgtccatcgtcctggcctcggcgttccgcttcctggtgtatcggacgtgggtgttccagcacgatgcgcgtcgcggt

SEQ ID NO: 5061 - DNA, 1494 bp, Streptomyces avermitilis
  CDS (1)..(1494)
atgcgcgtcgcggttagggcatccctcggagcggtccggacctctctgtgggccgcggtgccgctgctggtcgtcctgctgctgctcgtcatcgtccggctgccctggaacggcgacctcggcatgcacgcggcgaccgtggaacggctgcggcaccacctcctcgaccccggcaatcccctggtcgacgcggacacgccgagtccgtactactcgccgtggaccgtgctgctcggctgtgtcgcgaaggtgaccggcctgtccgtcttcgtggtgctgcgcctcggcgcggtggtcggcctcgggctgctggtgacgggcatctggcggtacgcccgtacgctgagcggccaccggttcgcgccgccgctcgccgtgctgtgcgtgctcttcctgtggggcacgcagctgttcaactggagcggtttcctcgggctcaactccctcgcgctgacggtcgcctatccgagcgtgttcgccctggggctcgccttccacttctgggcgctgctgacccgggcgctgaaggcctcgccggacgctggatgggaggtctacctcgggctcggtctgctgtgggcggtgattctgctcagccaccagttcaccggggtggtggcatcgctcggcgcgctggcgaccgtgatcggggcgcgcgtggggcggcacgtgtggctgcggctcggggccgccgccgccgtgggggtgctgctgctcgtcgtatggccttactacgacttcttcgcgctcttccgggtgggcggcctcgaggacatccaccgggcgctgtaccgggatctgctcgcgcggtacgggctggcgctggtgggggtggtggcgctcggggtgcgggcccgccgggatccgcgggatccgctcgtcgtgttcttcctgctgggtgcggccgtgttcgcgctgggcgggctgaccgggcactactcatgggggcgcgtactgccggccgcgctgatcccggcgcaggtcgcggcggccgtggaggtggccggggcgtcccggggggccgtgcgggccgcgggggcggtggtgctcgcctgcgctctggccgtgggggtgtggacgcagatcgggacgctggggtacgtggtggggcggggggcgctgccggaggcggtggcggcgaagtaccgggagccctgggcggggtaccactggatcacgccgtgggtgcggtacggggatgtggtgctggccaagacgtttccgtcccggcagatcccggcgtacggggcgtacacggtggctcccgggtatccggacttcttcctgtccgacgaggcccggcgggaggccgcggtgcggcggtacttcgccgcggggtcgtcccgggacgagcggctgggggtgctgcgggagtacggggtgcggtgggtggtgcagcggcccggggacgggggactcgcggccggcgggggtccggggctgcggcgggtggccgcggggccgggcggacaggtgctctacgcggtggtgcga

SEQ ID NO: 5062 - DNA, 1698 bp, Streptomyces avermitilis
  CDS (1)..(1698)
atgacaacaacgcccactacgcccgcaacgccgacaacacccaatgcgccgacgccggacgtgacgatcacggtcatcgtctacaacgacgcggaacgcctgccgcgcgcggtcgcctccctgctgcgccagacgcaccccgccatcgagatcatcatcagtgacgaccactcgacggacgcgacgccttccgtggcaagggagttggaggcgtcggacccgcgcatccgctatctgcgcctgccggagaacagcggcggttgcagcgccccgcgcaaccgggccctggagatcgcccgggcgccgtacctgatgttcctggacagcgacgacgaactccccgagaacgccgtcgcattgctcctggccgcccaccgcgagcgggaggtcgacttcgcgatgggcgcggtggagcggatacgcgtcgacacgggccaccgctccacctggatggctcacctggtcgacgagcgccgcacggtcgacggcatcgaggccgaaccgggcctgctcttcgagcacctggcgacgagcaagatgtacacgcgtgacttcctggaccgccacgccctgcgcttcccggagggcatccactacgaggaccagctgttctcggcgcaggcgtactgcctggcgaagtcgttcacggtgatcccgcagccggtgtaccgctggtacatagcgccgtacgtggctcaggacgcggcgtcgatctccaaccagcgccacaagctcagcaacgtcagtgaccgcatccacgtccagacgctgatcgacgacttcctcgccgagagcgggcacgagtcgctcaggcaggacaaggactacaagttcctcaagcacgacttccggatgtacgcgggcgacctcccgtaccgggacgaggactggctgacgggcttcgcgcggatcgtgaccccgtacctggaaaccctttcccccggcgcgtacgcccttctcccccgtgccgagcgcgtggtgctccagctggtccgcgacggccggctgtccgaggcccagctcgcggcgcgcggcctcggccacagtgtggcccctcgggagacgacggccgacgattccggctgcctgtactggggccctcggctcccgtcctccgactgggcccgccgggagctcgacgtcacggaactggggctggactcgcgcccgttcccgagcgcccagttccgtcacgagatcacgtccgtgacccccggccggggcatgacggtcgacctgaccatccgcacgtacgaccccggcctgcgcctcccggtcggcccgcagcgggcgagcgtggtcgtcgcccccggcagacggcgcctcatggttcccttccgccttgacccggtacgccctggggtcttcgagggccgggtccgggtggacctggcggccgccccgctgcccgtccagggcttcgacggcgtccgccatccgctgctccgcctggaacagcagggcctggcgaacacgggcgtgctcctggcccccctgaccttcccgaccctgcgggcgacccgccccggctcccttcggcacgaggtgacggtggaaccggagggcaaggccgccggccgtctccagatccgctggcgcccggtgggggtcacggcgcgggtggcgggaccggtggcccggaaggtggcgggaccaagggtgcgcagggcggcgcggctggtgcgcagcgcgttgcgg

SEQ ID NO: 5063 - DNA, 2220 bp, Streptomyces avermitilis
  CDS (1)..(2220)
gtgcagccaggactgagtgtcatagtccacggccccaacgagcagggccatctcggcgaactcctggactccctcggcgcgcagccgttcgccgcggccgaggtggtcgtcgcggccgtcggcgactgggcccggcaggaggccgagcggcacgcggcacgcgacccccggatcgtcccgctggcactgccggagggcaccggcgagggcgcggcccgtgcggcgggcgccgcccgggccaccggccgctggctgcacttcgtgcacgccagggacggtctgcccgcgggcgccctgcgcatggtcgccgacgccacggcggacgccccggacacggcggacctcgtggtgttcgaccacatccgctcgtcctggaacaagaccggcgcgccgagcggcgacggctggatcttcgcccgcaccggccgccgctccctggacctggcgggcttccccaacctgctgcacctcgccccgctgctgggcaaccgcgcgatccgcgcggacttctggcgcgaccacgacctcgcggacgaggccttcgcgcacgacgagtcgtacctcgcccaggccacgctcctgcacgcccgacaggtggcctgcctggaccaggtcgcgtacgaggtacggcagttgcgggcgcagagcctgccgccggtcggcgccgaggagcggtacgcggtcgtctcacggcacgaggcgctccagcggctcgcggccgggcgggacctggcggagcggccgcgcgcggtgctgtacgaggtgatggtccgcgagtgcctgcggaccttcgcccgcagcgggatgccggagccggtggcccgggagttcttccgccgggcgtcgcgggcggccgtgcagtggcggcccaggaaccaccggcgcccggccggcttcgagggcatccgccgctcgctcctggaggagaacgcgtacgcgaagtaccgggcgttccaggccgccaaccacaagcggcgcgacctgaagtcggcggtcgtggcgcgcaagcgccgggtcggcgcgaagctcagcgaccaccattaccgccgggcgctgagcggcccggtcgaccccggcctcgcggtgttctcggcgtactgggaccgcggggtgtcctgcaacccggccgcgatcgccgcgaagctcgccgaactcgccccgcacatccacccggtgtgggtggtcgcccggaacaaggcggcgctgctgcccccgggcaccgaccacatcgtcccgggcacccgccgctactgggaggtgatggcgagggcgaagtacctggtcaacaacgtcaacttcccgaactccgtggtgaagcgcccggacgcgatccacctccagacccaccacggcaccccgctcaagcgcatgggcctcgaccagcgggagttccccgccgcgtccaagggcctggacttcggcgccctgctggcccgcatcgacaagtgggactacagcgtctcggcgaacagccactccacccgtatgtgggaacgcgcgtacccctcgcactacatatcgctggaccacggctatccgcgcaacgacgtcttctactcggcgaccgcggacgacatccgcgcgatccgcgaccgcctgggcataccccccggccgccgggccatcctctacgcccccacccaccgcgactacgaggccggctggaccccgcgcctggacctggcgtccctggccgaccgcctcggcgaggagacggtgctcctggtgcgcggccactacttctacggcggtgcggcctccccgctggccggtctgcgcaggtcgggccgggtcatcgacgtgtcgacgtacgacccggtcgaggagctgtgcctggcggccgacgccctggtcacggactactcgtccatcatgttcgactacgccaacctgaaccgccccatcgtcatctacgccgacgactgggagacgtacgccaagacgcgcggcgtctacttcgacctgatggcggaggggcccggccaggtgacgcgtacgcaggacgagcttgcggccgtgttcgagtcgggcgcctggcgggacgagggcgcgcgcaaggcgctgtccgcgttccggcgccgcttctgcgagttcgacgacggacgggcggccgaacgcgtcgtacgccgggtgttcctgggacagagcgaagaggccctgccgtcggtgattcccgtggacgagcgaacgcccgcgccgagcccggaggaggcggcccga

SEQ ID NO: 5064 - DNA, 987 bp, Streptomyces avermitilis
  CDS (1)..(987)
gtggctgagaacaccgagaacacgacgagcaccgcgagcaccgcgaccaccgcgaccaccgagaagatccccaccgtcatcgcggacggcgtcgacgtcgtctaccgcgtcaacggcaccggcgcggggcgcggtaccgccaccgccgccctgaaccgcatgctgcgccgcgggcaggccgagaaggcggcgggcgtgcgcaaggtgcacgcggtcaggaacgtctccttcaccgcgtaccggggcgaggccatcggtctgatcggcacgaacggctccggcaagtccaccctcctcaaggccgtcgccggactgctccccgtggagaacggcaggatctacaccgacggccagccctcactgctcggcgtcaacgcggccctgatgagcgacctcaccggtgaacgcaacgtccacctcggcggcctcgccatggggatgtcccgcgagcagatcagggagcggtaccaggagatcgtcgacttctccggcatcaacgagaagggcgacttcatcacgctccccatgcggacgtattcgtccggcatggcggcccggctgcgcttctccatcgccgccgccaaggaccacgacgtgctgatgatcgacgaggccctcgccaccggcgaccgctccttccagaagcggtccgaggcccgcatccgcgagctgcgcaagcacgcgggcacggtcttcctggtcagccacaacaacaagtcgatccgcgacacctgcgaccgggtgctgtggctggagcgcggcgagttgcgcatggacggaccgacgaacgacgtcctccgggagtacgaggccttcaccggcggcacggacaagaccaccaagaccaccaggaccgccaagaccccgaagctgccgaatccgacgaaggagccgaaggagtcgatgcagccggagagtccgaagagcctgaagagcccgaagcaggagcaaacgcaaccaaaggcagaaaatgcctctcttccctcc

SEQ ID NO: 5065 - DNA, 957 bp, Streptomyces avermitilis
  CDS (1)..(957)
gtgagccaggccctccacacaccgccctccccgccctccactggcgccacaacccccacgggcgccacgggcgccacggccgccgcgccggccgagaccccggcgcagctcgccgcgcggtacggcctcgcggtcagcggcgcccgcccctccctgcccgggtacctccgccggctgtgggcgcggcgccacttcatcaccgccttcgccaccgccaagctcaccgcccagtacagccaggccaggctgggccagctctggcaggtggcgaacccgctgctgaacgcggcggtctactacttcatcttcggcatcctgctgagcaccaagaagggcgtgccggactacgtcccgttcctggtcaccggcgttttcgtgtggacgttcacgcagagctcgatcatggcgggcacccgcgcgatctccggcaacctgggcctcgtacgggccctgcacttcccacgggccgcgctgcccatctccttcgcgctccagcagctccagcagctgctgttctcgatgtgcgcgctggtcgtgatcctgctctgcttcggcgtgccgctcagcttctcctggctgctggtcgtgcccgcgctggcgctccagttcatgttcaacgcgggcgtcgcgatgatcgtggcccggatgggcgccaagacgccggacatcgcccagctgatgccgttcctgctccgtacctggatgtacgtctcgggcgtgatgtggagcatcgagaaggtcatgcacaacaaggacctgccgcacgccgtgctgctcgccctccagtgcaacccggccgccgtctacatcgacctgatgcggttcgcgctgatcgacagcttccacgcggaccagctgccgccgcacgtgtgggcggtggcgacgggctgggcgctgctcgccggcgtcggcggtttcatctacttctggaaggctgaggagacgtacggccgtggc

SEQ ID NO: 5066 - DNA, 636 bp, Streptomyces avermitilis
  CDS (1)..(636)
atgctggtgcgcatgacgacgaacgccgacgcttcccaggtgaccccgcggcgcagggcccccgccggggcggccgtactccgcgaggacgtgacggaggccatccgggcggcggtcttcgaggagctggcggccgtcggctacgcccggatgtccatcgaggggatcgcgcgccgggcgggtgtcggcaagacggcggtgtaccggcgctggcgttcgaagctgcacctggtcctggacctggtctcggcggtcgcggtgcaggggctgcccgcgcccgacacgggctccctggagggggacctgcggctgctgtacgaggtgacgtcccgcgccctgcgccacccggtcgccgggcagatcattccggatctccaggcggaggcggcccgcaacccggacatcgccgaggccatgcagaaggcgctgcgggaggggcagcagagcgtcgcgagcggcatcgtcgccgcggccgccgagcgcggcgagatccgggagggcatcgacaccgagctggcgctggatgtgatctccggtccgctgtactggcgggcggtggtggtacgggggccgaagctgccgatgggctacttgccgagcctggcgcgggccacggcggcggcgctgaaggcgttg

SEQ ID NO: 5067 - DNA, 1053 bp, Streptomyces avermitilis
  CDS (1)..(1053)
atgaccgccgccgacgcccacccaccccacaacgtccgcgcacccgggcccaccgcgcacgacgccaccgcgcccgccccgccccgcgtcaccgcggccggaccggccccgcacgacatcaccgcccccgacttcaccccgcacgcggtcgccaccgtcctcggctccgccgtcggggacgcgctcggtgcgcccttcgagttcgggcccgggggcgccttctccgcgcgcttcccgagggccgggcacgggagcgagatgtgcgggggcggcggctgggacccgggcgaggcgaccgacgacacgcagatggccgtactcgtcggggagtcgctgctggagtgcggcggactggaactccccgacatcttccggcggttccagcggtgggccgccgcccggcccaaggacatcgggctgcagaccgaggacgtcctcaccaacggcgagccctgggaccgcgccgccgccctgcacttccaggtcaaccaacgggccgcgggcaacggcgcgttgatgcgcgccgcgacctccgccgtgcacttcgcgggccgtggccgggacgccaccatggacgccggccgccgtatcgccgcgctcacccacggggaccgcgccgcctgggaaggcaccgcgatcttccacgaggtagtccgcgtcgccctcgccgggggcgatccgctcaccgccctcccggacaccctggccgccgtccacccggaccaccgcgcccgctacgcgaccgtcctcgccccggactggcaccccgaccaggccacggagttcaacggcgcggtctggccctgcctcggctccgccgtctgggcgctacgcaccaccgactcgtacgaggaagccctgcgcgccgcggtcgatatcggcggtgacacggacaccgtggcggcggtgaccggcggcctggccggggccgtgtacgggccggacgcgatcccgcgtcgctggaccgaaccgctccacgtaccgcttccgggcttcggcgaccgggttctgggggccgccgaactggctggactggcccgccggctggccgca

SEQ ID NO: 5068 - DNA, 621 bp, Streptomyces avermitilis
  CDS (1)..(621)
atggctacgcagacccgccgttaccaccacggagaccttcgcgccgcgctgctcacccgggccgaggagacgctcagggagaggggcccggccgccctgtccctgcgcgagctcgctcgcgacctgggcgtcagccatgccgcaccgagtcgccacttcaaggacaagcaggccctgctggacgcactggcactgacgggcttcggccggctggccgcgtccatggcggcgtcgcgggagtcggcgggcgagacgttcgccgagcggctggccaccatgtcccgcgcctacgtggacttcgcgacggccaacgccgagctgctcgacctgatgtactcgatcaagcacgatccacaggcgtccgaggccctggtcaccgcgtcccagcagtgggccgagcagctggtggagctgatcggggcgggtcagcgccggggcgaggtacgggagggcccgttggaacgcgtcgggctgccgatcttcgcgacgctgcacggctacgccagcctggcggtgagcggcatgctgcccgccgacgcggtcgaacacggcctggccgacgtgatcgcacacatgctgcgggggtgcgcacccgaccaggccgccgcccccctcgtaccc

SEQ ID NO: 5069 - DNA, 966 bp, Streptomyces avermitilis
  CDS (1)..(966)
atgcctaagacacagagcgggacatcgaacaggacgcggagcacgactgcgggcggtagtgcgcgcggcaagtggaacgccggtgacatccccgaccagaccggccgtaccgccgtcgtcaccggcgccaacagcgggctcgggatcgccaccgtcgaggccctcgcccgggcgggcgcccatgtcgtcctcgccgtacgggatctcgagcgtggtgaggcggccgcggccggcgtccacggcagcgtcgaggtgcgccgcctggacctggccgacctcgcctccgtgcgcgagttcgccgccggctggcagggcgacctgcatctgctgatcaacaacgccggcgtcatgaacatccccgaggccagtaccaaggacggcttcgagatgcagttcgggacgaaccatctggggcacttcgccctgaccaacctgctgctgccgcgcatcaaggaccgcgtcgtgaccgtgtcgtcgggcgcgcaccggatgccgggcagcccctacatccacttcgacaacctcaacctgaccggcgagtacgcccccctcaccgcttacagccagtccaagctggccaacctgctgttcacgctggaactccagcgccggctggccgaggcggcctcgcccgtacgggccctcgccgcgcaccccggctgggccgccaccaacctgcagagccacgacggcagcgccctgcgccgcgccctcatgcgggtgggcaaccgcttcatcgcccaggacaacagggcgggcgcgctgcccaccctgtacgccgccgtccaggacctccccggcgcgagctacgtcggtcccgacggcttcggcgagatgcgcggtggcccgacgctggtcggccgttcggccgcggccggcgacccggtctcggcccgccgcctgtggacggcgtccgaggatctgaccggtgtcacgtttccccggctgacggcagccgtgagcgca

SEQ ID NO: 5070 - DNA, 978 bp, Streptomyces avermitilis
  CDS (1)..(978)
atgacctggctgatcaccggcggcgccggttacatcggggcgcatgtcgtgcgagcgatgcgcgaagcgggcgaccgggcgatggtgtacgacgacttgtccacgggcatcgcggagcgcgtccccgacggcgtgccgctggtggtgggctcgacgctggacggcggcctgctgcgccgcacgctcgcggagcacgcggtgaccggtgtcgtgcatctggcggcgaagaagcaggtcggcgagtcggtggagctgcccctgcactactaccgggagaacgtggagggcctgcgggtactgctggaggccgtcacggacgcctcggtcccctccttcgtgttctcgtcctccgcggccgtgtacggcatgccggacgtggacctggtgcgggaggagacgccgtgcgtgccgatgtcgccgtacggcgagacgaagctcgccggtgagtggctggtgcgcgcgacaggccgggcgacgggcctgtccacggcatcgctgcgctatttcaacgtggcgggggcggcgacgccggagctggccgacgccggggtcttcaacctggtccccatggtcttcgagaagctcacggagggcgccgcgccccgcatcttcggcgacgactatccgacgccggacggcacctgcgtacgcgactacatccatgtggtcgacctggcggaggcccatgtggccgcggcccgtgcgctggaggcgtcgccgggcgcgggcctgacgctcaacatcggccgcggcgagggtgtttcggtgcgcgagatggtcgaccgcatcaacgcgctcacgggctacgacaccccgccgaccgtcgtggcgcgccgccccggcgacccggcccgggtggtggcctcggcggaccgtatcgccgtggagctgggctggaaggcgaagtacgacgtccaggacatgatcacgtcggcatgggagggctgggtgcggctgcatccgggggcgacgcgggga

SEQ ID NO: 5071 - DNA, 1593 bp, Streptomyces avermitilis
  CDS (1)..(1593)
atgccgcctcacgcttcacaggtcagcgtcgtcgtcatcggatacgacgacgctgcgcacgtgacggacgccgtgcgctcggcgctggcccagggtccggccgtccgcgaggtgatcgccgtcgacgactgctcgtccgacggcagccccgggctgctggacgcgctggccgtcgaggacacgcgggtgcgggtgctccgccgcgaggtcaacagcggcggctgcggcaccccgcgcaacgacgggatcgacgccgcgaccgccccgtacacgatgttcctggacagcgacgacatgctgccgccgggtgccgtggaagcgctgctcgcggcggccgaccggcacggcgcacaggtcgcggcgggcctgtgcgtgcgccgtgagctgccgtcgggccgcgaggtcccctggcagcccgagctgtacacagagccggcgctggtcccgcaccccgcccggctgcggcgcctggtccacgacacgctctgcgtcaacaagctctaccgcacggacttcctgcgcgagcacgccatccgcttccccgacggccgcttcccttacgaggacttcgtgttctccgcgcgcgtgctggcggcgggaccgcgtatggcgctcgtcccggacacggtgtacgtctggcacgtacgcaggtccgccgagcggctgtccatctcgctggaccgcgcgggcatcgacaactggcaggcccgtatggcggccgcggcgcaggcgtacgacatcctgctgggcgccggtgagaagcgcctcgcgcgggcggcgcgcgccaagttcctcgaccacgagctgcggatgtacacgcgggagctcgatctgcgcggcacggagtaccggcgcgagtggtggacgctcacgcgcgcgtacctgtcggcgttcgacgcggccgagttcgcgctggcgccggcgcccgggcgggtcatcgcacgcgtggtgctcgccgccgaggagccccgcgacctgccccggctcaaggagctggcggcacgcccggcccggctgcacccgccgtacgcgcgcgcggcggacggcactccggtgtggtcggcggacctgcctcaggtcccgctggaccacgtactcgtccggcccatgcacctgctgcccgtcgccgtcgacgcggaactgcggccacgcgcgcgtggcacccggctgcggctgcgtctgcacgagctgtacgggcgggtggcggacgcgggaccggcctcggtgaacctggagttcgtgcaccgggagggcggccgggtgggtacggcggccacggccccgctgctcgcggacccggagttcgacacctggtctgcggaggtgccggtggacctggcggcgctcgggtcgggcacctgggacctgcggctgacgctgcgcttccacgacggcacgagccgcgacaccaccgcccacgcggtcgcgggccccggcctgctgcgccgcggcgtggtgccgagcgggcggcacggggtgctgctggtccagccgtacgcgacacactcgggagccctggcactgcgtgtggcgaccgggatacaaggagtgacatccgtcatgggtcgaaggctccggcgcctgcttcactgg

SEQ ID NO: 5072 - DNA, 1266 bp, Streptomyces avermitilis
  CDS (1)..(1266)
atgaggaccttgaaacgccaccccctgctcctcctcggcgcggcctggctggccacccgcgccctgatgctgtggctgctcacccacgagcgcctcgccctgctgggccggggcggggtgtcgagcgaggtacgcaacctgtacttccgctggtacggcgtcctgtcgcacggcacctatccggccggcgaccacctgtggcagtacccgccgggcgcgggtccggtgctgctctcccccgcgctgctgccggccctgacctacttccaggcgttcgtggtgctcacgctcctcacggacgccgtgatcatgctcttcctcgcgcgcgcggggacccggccgggcggccgcagcctgcacggtgcggcgctgtggacggcgggcctgccgctgctcctgcaccttccgctcgcacgctacgacgtgcaggtcacggcgttcgccgtcatctccctgttgacgttgtcgcgctccccgcgcgcgtgcggcgcgttcgcggcgatcggcgccctggtgaaggtctggccggccctggcactcatcggcacgccgacgggccggaccacccgtcgggcgtggacgtcggccgcggtcaccggggccgccctgctgacgctgctgaccgccctgttccgcaaccccttcgacttcctgctccagcagggcggccggggcgtgcagatcgagtcgctcggcggcacggccctcgccttcgcccgccgggccggctggccggggcgcgcgcggtatcagttcggcgcgatggagttcgcgggcccgcatgtgcgcgcggtggccgcggtctcgctcgggctcaccgtcgccgcgttcgggctgctgctgctgtggcggctgcgggcgcgccgctggacgccggccaccccgtacgacgcggcgctcgcggcggtcctgctgttcacggtgacgagccgggtgatcagccctcagtacatggtgtggctgatcggcctggccgccgtctgcctgacctcccggcacaccacacaacggcccgtcgccctgctggtcctggcggcctccgcggccagcactgtggcgtaccccgcctattacggggaggtcatcaactccacctggacgggctgtctgctgatgctcctgcgcaacggcctgctggccacggccgcgggcctgtcgttcgtgcgcctgtggcgagccaccacaaaagaccccgaatccggcaccccccgtccggaactccgccccgatcctgtccgtcttccccacaagacactaactgcctct

SEQ ID NO: 5073 - DNA, 1560 bp, Streptomyces avermitilis
  CDS (1)..(1560)
atgtcgagcttgtgcaaggaccggccacccgtcgcccgtacctgtacccgcacccgtgcggaggtcgcgtccgcgcttctgcccgtgccggtgcatgtgctcgtatccgtcctcgcccccgtcctcgtcatgctcgcgctcgggctgtgggggctcgaccgcggcggcatgtggcgcgacgaggcggtcaccttcgaggtcgcgcaccgttcggtgccgcagatctggcggctgctgcacggtgtggacgcggtgcacggcctgtactacctggtgatgcgcacggtcctgtccgggtgggccgccttcgctcgccccgacgaggtggtgctgcgccttccgtcggtcctcggggcggcggcgacggcgggcctggtggccgcgctgggcgtccgcctgtgtcgtccgcgggtcggcctgtgggcggggctgctgtacgccgtcacgccgatggccgggcactacgcgcaggagggccgttcgtacgcgctggtctcggccggggtggcggggtcgacgctgttgctggtcagggccgtgcgcggcgggggctggtggccgtacggggcggtcgccggtgtcacgtgtgtgctgcacgagttcgcggtgctggctctgctcgcccacgcctgtgcgctggcgctcgcccgggtgcgcgggagggtgtggcgggcgtgggggtgtgcggtggggggtgtggccgtggtgctgctgccggtggtggtcgtctcgcaggggcaggcagcgcaggtggcgtggctcgcggtgccggacctgggggcggcggggcggttgctggaggggttcgcgggggcgccgggtctgttgctggtgccgtgtctggtgctcgccggcgtgggcgtacggagaggtccgcgcggggagttgtccctggggggtgtcgcgctgccgctggtggccgttccgccggtggtcctgctggcggtgtcgcaggttcggcccctctacgacgagcggtacgtgctgtacgcgctcgcgggcatgccgctgctggtcgcgagcggcgcggatcgggtggcgggggtcatgggacggctacgggccgggggtcacttcgcgcccgcccgcacccctctcctcggcgttctcgccatcgccctcgtcctcgcctcccggctccccgttctccaggccgaccgcagcgccgaccgccgccccgacaacctcgccgccgtctcccgcgtggccgggcgggagacgcggcccggcgaccccctgctgttcctgcccgccttcggacgccgggccgctctcacgtatcccgacgacttccgccggacgcgggacgtcgcgctgagcgtgcccgcgcccgtggacgggagcctctacgggcgggaggtcggggccgatgagctgcggcgccggctcggacggctcgaccggctctgggtggtcgcccagacctacgcgctgcgccccggctggtcctcgcgcagtccggtcgagcgcctcaaacgggcggtgctggacgaggagttcgtgccgcgcgcggagttcgtgcagaagggttcgaccgtgcgcctgtacgtacgccgtccc

SEQ ID NO: 5074 - DNA, 501 bp, Streptomyces avermitilis
  CDS (1)..(501)
atgagcgccatcccgacccccagcaccgaggcccccgccgacgagaactacctccgcctcgaccgccagatctgcttctccctcaacgcggcctcgcgcgccttcaacggcgtctaccgcgtcgtcctcaaggacctggggctcacctacccccagtacctggtgatgatggtgctgtgggagcacggcgcgctgcccgtgaagaaggtcggcgagcatctgcgcctcgactccggcacgctgtcgccgctgctcaagcgtcttgagacggccgggctcgtacggcgcgagcgcagcgcgaaggacgagcggtcggtgtacgtccacctcacggaggagggcacggcgctgcgcgagcgggccctgctggtgccggtcaggatcgccacggcgacgggcctcggcctgggggagatcgaggacctgcggacccgcctcgaccgcctcacgacggcactggacgaggcggcgctggaggagacaccgggctgcgcccagggt

SEQ ID NO: 5075 - DNA, 411 bp, Streptomyces avermitilis
  CDS (1)..(411)
atggacgcgctctacaccgctgttgccaccgccacccacgggcgcgaggggcgcgccatcagctccgacggcaagctcgacgtccagctggccccgccggccgagctgggcggcaacggtcagggcaccaacccggagcagctgttcgccggcggttacgcggcctgcttcgccagcgccctcggtctcgtcggccggcaggcgaaggtcgatgtgagcgacgccgccgtgaccgccgaggtcggcatcggcaagcagggtgagggcttcggcctcaaggtcaccctgcgtatcgagctgccggactccgtggacgaggcgaccggccgcaagctggtcgagaccgcccaccaggtctgcccctactccaacgccacccgcggcaacatcgaggtcgagctcgtcgtcgag

SEQ ID NO: 5076 - DNA, 1320 bp, Streptomyces avermitilis
  CDS (1)..(1320)
gtgcgggccctgccgcggccgacacgcacgaacgcccgtacctgggtggtcgtcctcgccgccgtgttcgccgtcctgcaactcgccaacgtcaccgggcgggacactcccgacaccaagaactacctgtcgtacgcgctgagtctgcgcggcgacagcaagcgggagtcggccgccaccgccatcgactacgtgtgcgcgggccgggcgtccgcggcacgccgcgagcagagcgtcgacgtgaaccgcttccaggctccgaaccccacccggcgggtcaccgagaagtgccggcgcgacctgtgggcgggggtggacaggcggctgcgcgccggacagacctccgggcacatcgcgccgttcacgtccgagcggttcatgcggatcttcgaggcgcggcccggatatccgatgctgctgctgccgttcgtgacggtgttcggcgtgacgtggggcatctggctgtcgagtgtgctcgtcacggtggccgggggcgtgctggccttcctgatcctgcgcaccctgcgcgctcccaccggcgtggcgctgaccggccaggccctcttctacgtcctgccgtgcggcaccaccgccatgcgccccatgaccgagggcctgctgctggcgctgacactggtggcgctgtggggctgtgcgctgacactgcggggcaaccggccggggaccggtgtgctgctggtcaccgcggcgctcgtactgctgttcgcggtgaagcactcgcaggccctgtttctcgcgctgtgcctggcgggggcgtgcgcggtggtcggcgtacggcggcgcgggcgcgggcgcctgccggggcaaccgctggtggtcctgggcgcggtggcgggctgcgcggtcgccggcatcctgctggcggcgcaggcactgcactacccgtccgagtccgagagcgtccaggacctgttgaccgaccacttcgcccggcccgaccgcgcccggccgtggccggagttcctcggtctggagggcaacttctggctggagtggctgcgccgccagttctgggagccgctgttcctgacctcgctggtggcgtcggcctggggagcgctgaagcagcgcccggccttcggggtgttcctgctggcggccgcgttcaccggcctcgtcacccacgcggcccacccggacatcaccgtctacggcggccggctgatcgtgatggcgtggctgctgccggtggtcgggctgccgctgctgctggagcgggcggtgcgggtgtgggcaccaccgggcgcggtgccggtgccacggcccctgatgcacgagagcggcacgcactcgatgcgg

SEQ ID NO: 5077 - DNA, 2196 bp, Streptomyces avermitilis
  CDS (1)..(2196)
gtgccccgcttcagcatcatcgtccccgtcttcaaggtgcagggctatctgcgcgagtgcctcgactcggtcctcgggcagtcgtaccgggatctggaagtgatcgccgtcgacgactgctcgccggacggctgcggcgccatcctcgacgcgtacgcggcccgcgacccgcgcgtacgcgtgctgcacctgccggagaacgtcggcctgggccgggcacgcaacgccggaatgccgcacgccaccggggactacctcttcttcctcgacagcgacgacaccctcaccccgggcgccctgcgcgcgctggccgaccgcctcgacgagctccccggcccggacggccccgatgtgctcgtcttcgactacgcgcgcacctattggtggggcggcacccgcagaaacgtcctggcgcgggtgctggccgaggcgggcgcgggcaccttcacggccgccgagcgtcccgagatcctcgacctgctgatggtggtctggaacaaggtctaccgccgcgacttcgtggagaagcacggcttccggttccctcccggctactacgaggacacgccctggacgttccccacgctgctcggcgcggagcggatcgccgtgctcgaccggatctgcgtcgcctaccggcagcgccgcacgggcagcatcctgtccaccaccagccgcaagcacttcgacatccacgaccagtacgagcgggtcttcgcgtacgtcgactcccgcccggagctgtcgagttggcggccctgtctgtgtcacaagatgggtgagcactgcctggacgtcctcgccaagccggaccggctgcccgagtcggacaaggaggagttcttccggcgcacggccgagctgttccgcaagcacaagggcggtccgacgccgcccggactccgcgtcctggagggcggtttcacccgctaccgggccgtgcgggcggccaggtcgctcgacctgcgcgcccgccaggtccgtgccgcggccgtcgtacggctcaagcgcggctggtcaaacgtgcacggacaccggccgctggacccgcatctcgcggtgtactcggcgttctcgcaccgcggggtgctcggcgacccggccgccgtgcaccgcgcggcccgggagctcgccccgcacatcaggggcgtgtgggtggtccgcgcggaccaggtgccctcgcttccgccgggcgtcgagtacgtcgtcccggactccctgcgctatcaccaggtcaccgcccgggccacgtacttcgtcaacaacgtcaactggcccggcaccctggccaagcgccccggcagcgtgcacatccacacccaccagggcaccccgctcaagtacatgggcgccgatctgctgcacaagccgggcgcccggcacggcctcgacgtgccgcagatgctgcgccgggccgaccgctgggactacagcctggtcgccaaccgccactccgagctggtctgggaccgcgcctatccgtgccgcttcacctcggtgcgcaccggcagcccccgcaacgacgtcctcgtccgggcgcgccccggcgacggcgccgacgtccgcgcccgcctcggcatcccggccggtcacacggtcgtgctgtacgcgccgacgcgccgcgactacgtcaggggcggccacgtcgaccggatcgacctggcccggttcgcggaggatctgggcgagggacactcactcgtcgtacggctgcatccctcgctcgcggacggtccggcgcgcgggatggggctggccgagctgcaccggcggggcgtcctggtcgacgcgacgaccgagccgcacgtcgaggagctgatgctcgcctcggacgtcctggtcacggactactcggccctgatgttcgactacgccaacctggaccggccgatcgtgatccacgccgacgactgggggacctataccgcgagccggggcgcctacttcgatctcaccgccgacgcgccgggtcatgtgacgcgtacccaccgggagctggcgtggctgttcgcctgcggtgggtggcgggacgaggagtcggcggcgctgcgggccgggttccgggcgcggttctgcgagttcgacgacgggcgggcggccgagcgggtggtgcggacgctgatgctcggcgaacaggacctgcccctgccggtgccggcgcccgcacaggccgcccgcgacctgctcgcttcgtca

SEQ ID NO: 5078 - DNA, 2187 bp, Streptomyces avermitilis
  CDS (1)..(2187)
atgccccgcttcagcatcatcgtccccacccatgacgtagccggccgtctgtcccggtcgctggactcggtcctcacccagtccttcggcgacttcgagctgatcccggtccgcgacgcccccggttccccggcgggtgcggtcgtggccgagtacaccgggcgggacgcccgcgtggtcccggtcgtgtcaccgccctccggcgggctgagcgcggcgcgcaacaccggcctcgcggcggcgaccggcacgtatctgctgttcctcgacggcgacgacgtcctcgcgccgggcgcactggccgcgctcgacgcgcgcctgaaggagaccggcgaggtggacgccgtgtacttcggccacgagcgggtccactggtgggaggccgagaagacgaacacgcccccgctcggccgggccccgcacggcgccttcgcccccgccgaggccccgcacctgaccggcgtcaccctcccggcctggagcgccgcctaccgccgcgcgttcgtcacggagcaccggctcgccttccccgcgggcctgttcaccgacatcggctggggcggcctggtcacgctcgccgccgagcgggtcgccctgctgcgctcggtgtgcgtacggcatctgctgcgacggcagggcagccggctcgccgtgccgggtgagcaccagctcgaactcctcgaccagatcgacctggtgctcacccgtgccgccgaactgggcctgccggcctaccggtcggggccgctgttcggacagctgttcgccgcggtcctgaagacggccgcccgtcccgagcggctgcccgcccgtcgccggcgtgccttcttccggcgggcggggcggctctaccggcggcatcgcccggccgccttccagccgccgccgggcagcgtcggggtgcagcaccggctgctggcggccggtgcgtacagcgcgttctgggccctgcgcggcgccaaccggagcgtggcgaaggcagcggaacggatcccgcgcccgcggatgccgcgcacccgcacccggtacgccctggggctgcgccgcccgctcgacgagaacctcgccgtgtactgcgcgtactggggccgcggctacgcctgcaacccggccgcgatccacgccaaggcccgcgaactcgccccgcatctgcggtcggtgttcctggtcgaggcggacgcggtgggcgagctgccgcccggtgtcgagcacgcggtcatcgggagccaggggtactgggacgtgctggcgcgcgccaagtacctgatcaacaacgccaacttcgccgacggggtcgtcaagcgccccggcagcgtgcacctccagacccagcacggcaccccgctgaagaagatgggcgtcgaccagtcgacgtacccggtggtggcggcggcgaccggcagcttcgccaagctgctgacccgcgtggaccgctgggactacaacctctccgccaaccgccactccaccgagatgtgggaacgggcctttcccggcacctgggaagccctcgaatacggctatccgcgcaacgacgtctactacacggcgaccgccgacgacgtcgcccgcgtccggcgcgaactcggcgtcccggacggcaagacggccctcctgtacgcgcccacccaccgcgaccacagcgcgggcttcgaggcgcggctggacctggaggcgttctgcgaggcgctcggcgaggacttcgtcgtactgctgcgcgcccactacttctacgacgagggcgaccgcgggggcggcggccggatcatcgacgtcacccggcaccgttcctccgaggacgtctgtctggccgccgacgcgctgatcacggactactcgtcgatcatgttcgactacgccaacctggaccgcccgatcgtcgtgtacgcggacgactgggaggtctaccgggagacgcggggcgtctacttcgacctgctggagggcccgcccgggcacgtggcgcgtacccccgaggagttggccggcctgttcgccgacggatcgtacgcggacgccgggtcggccgtgctgcgcgcccggttccgtgagcgcttctgccagttcgacgacggccgggccgccgaacgggtcgtacggcgggtgctgctcggccagccgccgcaggcgatcccgcccgtcgtcccgctcgccgagcgcaccccggccccggccctcgtgaggagc

SEQ ID NO: 5079 - DNA, 2334 bp, Streptomyces avermitilis
  CDS (1)..(2334)
atgcccgcgccgacccatggatgtccgttgcccaggttcagtgtcatcgtccccgcgtacaaggttcaggcgtacctgcatgagtgcctcgaatccgtgctggagcagtccttcccggacctcgaactgatcgcggtcgacgactgctcacccgacgcctgcggcgcgatcatcgacgagttcgcggcccgtgacacccgggtacggcccgtccacctgccacagaacacgggtctgggccgggcccgcaacgcggccctggccgaggccaccggcgactacctgatcttcctggacgccgacgacagcctgacgccgggcgcactccaggccgtcgccgaccggatcaaggagacctccgaaccggacgtcctggtctacgactacgcgcgcacgttctggtcgggcgagaccgtccgcaaccgggaggcggggcagctcaccgagcagggtccggcgccgttccgcctcgacgaccgtccgggcctgctcaacgtcctgatggtggtctggaacaaggcgtaccgccgggagttcgtcgagcgcgagggcttcacgttcccgcccggcctctacgaggacacgccctggacgtatccggcgctgatggccgcggagacggtcgccaccctcgaccgggtctgcgtccactaccgccagcgccgccggggcaacatcctcggcaccaccggccgggggcacttcgacatcttcggccagtacgaccgggtcttcgcgtatctcgacgggcatcccgaactggcgcactggcggccggtgctgttccgccgcatggtcgaccatgtggcgacggtgttcacccggcgcggccggctgccgcgcggcagccacgccgagttcctgcgccgggcccgcgcccactaccgccgccaccgcaccccgggtcccccggcccgtccccggttccggctgcggcacgtcctcgtccgcctgggcagccaccgcacctaccgtctgctgtccctggcctcccgcacccgcgtccgcaccgcgcggtcggccaccgccgtcctcggccgcctggccggcgtcgcgctccaggcgcactaccgcctccagcgccggctgcccgtgcgcgccgaccgtgccgtcttcgccagccaccaggggcagggtcacggctgcaacccgggcgccttggaggccgcgttccgcacgctcgcgccgcacatccgcacggcgtggatcgcgcgccccgagcaccaccacaccgtcccggccgcgacgcgccgggtgcggcccggctcggccgcgtactggacggcgctcgcccgctccaagtacctggtcagcaacgccgacttcgaccgccggctgcgcaagcgccccggccagatcgtgatccagacgcacgccgggaccccgctcaagcgcatgggtctcgacctccaggaccggccggcggcggcccgcgacacggacttcgcccaggtgctgcgcggcgccgaccagtgggactactgcctgtccgccaaccgccactccacccttgtatgggagcgcgtcttcccgtccgggttcaccacgctggagtacggccagccccgtaacgaccgcttccagcaggcgacttcggcggacgtgacccggctgcgcgagtcgctcggcatcccgcacggctcggtggcgatcctgtacgcgccgacgtaccgcgactaccgccgctcccagcgccacctcctcgacctggaacgcgtcctgcggcagctcggcccgcgctatgtggtgctgacccgcgcgcacccctcgtacggcgcgcccctcacccgctccgacggcgcccgtctgatcgacgtgagcggccatccgagcgtcgagtccctgtgcctggcctcggacgcgctggtcaccgactactcgtccctgatgttcgactacgccaatctggaccgcccgatcgtcgtgtacgcggacgactgggaggcgtacgaggcggcccgcggcacctacttcgacctgcgcgccttcccgccgggcgcggtcgcccgcaccgaggaggagctgatcgacatcttcgccaccggccactggcgcggctcgcgtgcggcgcagctgcgtgccgcgttccgcgcgcgtttctgcccgtacgacgacgggcgcgccgccgagcgggtggtgcgccggatcgtgctcggcgaaggcgcaagggaaggcgaaaggaacagcgagggcgacggcggggcgacgggtctgccgccggtcgtgccgctggccgggcgccatcccgtcccgtcggccgcggcggctctggcgaggccgccgctcgcgacggtgccgcacccggccggtcccgtccccgtcgtcgacagtccg

SEQ ID NO: 5080 - DNA, 879 bp, Streptomyces avermitilis
  CDS (1)..(879)
gtgagcgccctcgacacctccgtacgtgccaagcggtccctggccgcccgggtggcgagcggtgcggcgggcggcgtgctgcgcgtcttcctcctgctggtcgccctgttctggctggtgcccgcgttcggtctgctggtctcgtcgttccgggaaccgaccgacatcgccgcctcgggctggtggaaggtcttcacggccccctctcagctgaccgcgaagagctaccggtcgctcctggagaacggtgacgtcacgcacgccctgttcaacaccgtctggatcacggtgccggcgaccctgctcgtcgtcgtcatcggcgcgatggccggctacgccttcgcgtggatggacttcaagggccgcgactggtggttcatggtggtggtggcgctgctcgtggtgccggtgcaggtggcgctgatcccgctctccgatctcttcggcaaggtcgggatcttcggcgacatcatcggcgtggtcctcttccatgtcggcttcgggctcccgttcgccatcttcctgctgcgcaacttcttcgcggagatcccgcgggagctgctggaggcggcgcgtctcgacggggcgggcgaggcacggctgttcgcgaccgtggtgctgccgctgggcgcgccggccatcgcgtccctggggatcttccagttcctgtgggtgtggaacgacatgctggtcgccctggtcttctcggactccagctcgcagccgctgacggtcgccctccagcagcaggtgcggcagttcggcagcaacatcgagatcctggcgccgggcgcgttcatctcgatggtgatcccgctggccgtgttcttcgcgttccagcggcagttcgtgtccggggtgatggcgggcgcggtgaag

SEQ ID NO: 5081 - DNA, 1278 bp, Streptomyces avermitilis
  CDS (1)..(1278)
gtgaccgggaccaggctgtgggtggcggtgctgttcctgctgcccgcgctggtgctgctcggcgcgctcgtggtctacccgatcgggtactcggtctggcgcagcctgtacgacgccgacggctcgggcttcgtaggcctccagaactacggcgagatcttcaccgacagccggaccctgaccgcggtccgcaacaccgcgatctgggtggcggtcgccccggcgatcgtcacggtcctcggcctgatcttcgccgtgctgaccgaacgggtgcgctggggaacggcgttcaagctgatcgtcttcatgccgatggcgatctccatgctcgccgccggcatcatcttccggctggtgtacgagcaggatccgaaccagggcgtcgccaacgcggtcgtcacctccgtgcacgacgcgttcgtggactcctccgtctatccgaaggcccgcccgaacgcccaggtcagcgacttgaaggcgtccagcggcggctccttcaccacgacggggacggtccacgcgggcaccccggccctgctccccctcgtcggcatagcgccgaacaggctccccggcactcccgcggacgccgaggagccgtcgggcagcggcgtcaccggcaccgtctggctggacttcaagctcggcgggggcggcaccaagggcaaggtcgacccgggcgagaaggcgctgaagggggtcacggtcgaggcggtcaaggacggcacggtggtcgcctccgcgcggagcggcgccgacggcacgttcagcctgccggaccgggccgacggagcccggctgcgcctgcccggctcgaacttcgccgcgccctacaacggcgtcgactggctcggcccgaccctggtcaccccggccatcatcggctcgtacgtgtggatgtgggcgggcttcgcgatggtgctgatcgcggcgggcctggccggggtggaccgcaatctcctggaggccgcccgggtggacggcgccaacgagtggcaggtgttccggaaggtcacggtgccgctgctcgcgccggtcctggtcgtcgtcctcgtcacgctgatgatcaacgtgatgaagatcttcgacctggtctacatcatcgcgccgcagcccacccaggacgacgccaacgtcctcgccctgcaactgttcctgtcgtccttcggcggcggcggcaactacggcgtgggcagcgcgatcggcgtcatcctgctgctgctcgtcctgccggtgatgttcgtcaacctccgccgtctgaggaaggagcgcgagcgg

SEQ ID NO: 5082 - DNA, 1389 bp, Streptomyces avermitilis
  CDS (1)..(1389)
atgaacggggcaatcatgcgcagcacagctcgtacccgcaggtccgcccaagccgcagcagccgtcgtatccgccgcactcgcgctcacgctcaccggatgcggcagcagcgacaagaagagcgacgacaccaccgagagcagcggcggcaaagaaagcggcgccaccgttcagctgcccaagctcgacggacagacgctggaagtggccgccgtctggaccggcccggagcagaagaacttcaccaaggtgctggacgagttcgagaagcgcaccggcgccaaggtcaacttcgtacccaccggcaacaacacctccaccttcctcggtaccaagatcgagggcggcaagccgccggacgtcgcgttcctcccccaggtgggcgtgctgcaccagttcgccgacaagggctggctcaagcccctcggcgccgacgcccaggcccagctcgacaagaacttctccaccggctggaaggacctcggggcgtacaagggcaagcagtacggcgcctatgtgaaggccgccaacaagtccctcgtctggtacaacacccaggccttcgacgcggcgggcatcaccaggatgcccaagacgtggaaggacttcctcgccacggcccagaccctgtccgacgcgggctctcccgccgtctccatcggcggcgccgacggctggacgctcaccgactggttcgagaacatctacctctcccaggccggtccggagaagtacgaccagctcgccgcccacaagatcaagtggacggatccctcggtcaaggaggcgctcaccacgctcgcccagctgtggggcaaggacgacctgatcgcgggcggccgctccggcgcgctccagacggagttcccgaagtcggtcacccagacgttctccggtgacaccccggccgcgatggtcttcgagggcgacttcgtgacggcgaacatcaacgccgacaccaaggcgaaggtcggcacggacgcgaaggtcttcccgttcccggcggccggcgcgaaggcgccggtggtcagcggcggtgacgtggccgtggcgctgaagggcggtgcgggcgcccaggcgctgatgaccttcctcgcctcgaccgacgcggccgagatctgggcggcgcagggcggcgtcatctcgcccaacaaggcgatggacacggccacgtacaaggacgccgtgacgcgggacatcgcgaaggcgctgctcgcggcgggcgacgacttccggttcgacatgtccgaccaggccccggccgcgttcggcggcacccagggcgtcggcgagtggaaggacctccaggacttcctgaagaacccgaaggacgtcgcgggcacccagcgcaagctggaggccgacgccgccaaggcgtacaagaacagc

SEQ ID NO: 5083 - DNA, 4266 bp, Streptomyces avermitilis
  CDS (1)..(4266)
atgcagatccggctgaccgtcgtagatccgctggggccgccctcggagccgcgggcgcgtgccgcgagctgcgatgtgctggtcaccgcgcccgccgggacggcgctggccgcggtggcgtcgggcctggcctcggcggtcgcgggcgacgggggtgccgcccagcccgagcggagccgcgagagcgggggcggtccggtggtgctgtacgcgggagccgagcggctcgacgcgcagcgctgcacgctgggcgagccgccgctgacggacggtgcggtgctgtcgctgggcgcgcccgtggagccgggtcccgacgtggccgctgtcacggccgagctgcatgtggtggcggggcccgacgcgggcggggtccatctgctgcacggggggcagatccagatcggccggtccgccgacgcggatgtcccgctggacgacccggacgtctcccggctgcactgcgcggtcacggtcgccgaggacggccgtgtctcggtcgccgacctcggctcgacgaacggtacgacgctggacggcaggcgggtgggcgaccgcgcggtgcggttcgcaccgggggcgctgctgcggctcggcgaatcggcgctgcggctggctccgccgggcggtgtggaagcggtcggtacggccccggacggcgaggggcatgtccgggtgaccgacgggggtgcgcctggtctcggtgggttccggctcgcgtgggggccgggcggggcgcgggggcttccggaggtacggcgcccggtgtgggccgttccgcacgcgcgcgggggtggcggggcggggcggggcgcgccatccggcggcgcgtcggccgccgcctccggggacggccgcccctcgggtgagacgcaccacgccttcggggcctcggcatggggtgccgcggggggcgcccctagcgcccccgcgggaggtgccccgggcgcccaggagcacggccccgtggagccccgttttcccgcaccggtcgtgccggggcagggcggcgccccccggatcgagagcaggcggacgccggagtcgggcggcacgggcccggacgggcggcccgtcgccgggcccggcggggcttctgccggaaggccccgtgacgttcccggcgcggacacccgtgacctgcgcgggggaaacgcccgggacgtacccggccgagacccccgtgaccttcccggccaaggccccggcgaggggcgcgaccggggccgccgcgaggtgccgggccaaggccccggtggggttccgggccatggacacggtgaagcacacggccggggtcccggtgaggggcacggccgaggtcccggtgaagcacacggccgaggccgccgcgacgcgccggatcgcggtcccggcgacgttcccggccgaggttccggccacgattccggcggcgttcccggacagggccccggtgacgggcatcctctaggttccgctgaggggcccgaccgtggcccccgcgaggggtacggcgcgcgtcccggtgaggtgccgggaccggatgacctacgtggtgggatccctggtgcgggcccccgcaaagggaccccgctgcggggcaccgacgtgccgcagggcgcgcgcaggcgcggggggttctccgcgtgggcgcggcggctgaccggcgggcgcggggagccggccggggacgggcctcaggcgtacgacgaggacacggcccgggtgccggagcctgcggtcaccggggcgcaggcgccggagaagtggccggacccggcggccctgctgctgacggcgctcgggccgggcccgcggctgtgggagcgcgggccgggacacccggaggcgctcacggtgcggctgggcacggccgaccggacggcgccggacggttcgggactgctgcccgcggtgcccgtgaccgccgggctgcgcgaggccggcgcgctgggcctggccggcccgcgggcgcgtctcgccgggctggcccgcgccgtcgtggcgcagctcgccgcgctgcactcccccgacaccctggagatcgtgctgatcagcggggaccggtcccgtccggtggaggagcgcaccgccgagtggtcctggctcggctggctgccccatctcaaaccggcccacggccaggactgccgcctgctgctggcgtacgaccgcgaccagaccgccgcccgcacggacgaactgctgcgccgcctggaggaccacctggcggacacggaccacacgcgtaacgcaccccaggacctcccccgtccggcggacacaccggacaccgccctgcgcggcggggcccgtcgtccctcctgggcgcgggacgaccagcaggacggcgacgacacgttcacgggcccgtacaccgtggtgatcgtggacggcgatcccggcggcgccgatgtgcgggaggccgtggtgcgcctcgtgcaggacggagcgcaggccgggatacatgtcatctgcctggccgagacggcggccgcctcgccctcgtcgccggtgacggagacgtacgaggcggcgtgcgcggtctcgccggcgttccgggagtgcggggccgtggccctgctcagcggtgacgtggccacggcgctgcgcctgctgcgggtcgcgccgggcgaaccgccccgtcacgcacaggagcaaggccaggagcaaggccaggagcagggacagaggcagggacagaggccgaccacagatcatgcgcggggcccggccacgggtcagagccaggggccggacgccggacacacccgggacacggccgccacgcgcggccgccacggctccgccggtgccggtgcgcctcgtccgcgctccggcccgggcgcggacgagcggacgcatcacgaccacaccggacgggcgctgcgcgactccctggaccgtgccccggccgggcgcgccgaccacggttccgcgacccgcgcgcaccggggccccgtgggacacggcacggtggccgccgtcgacgccgtctcctcggcgtgggccgagcggttcgcgcgggcgctggctcccctgcgtacggacggcagcggggaccggcacgcgcgcgtgtccgcgccgctgccccaggcggcgcggctgctggacgagctgggactcgcccgcgccaccccggcttcgctgatggcacgctgggcggacgcggcggacgacccggagacgcgcggcgggcgggcggcggcggtgctgggcgcggggccgcgtggaccggtgggcgtggacctcgtcgccgagggcccgcatctgctgatcgagggaccggcgggcagcgggcgtacggagctgctgcgggccctggccgcgtcgctggccgcggcggagcgtcccgaccggctggggatcgtcctcatagacgggcgggaccgcggtgcgcacggggcgggcgccggcgacgggctgcgcgtctgtacggacctgccgcatgtcaccacgcacctcgccgccaacgacccggttcgcatgcgggagttcgcccagtcgctgagcgccgagctgaagcggcgggccgagctgctcgggcggctcggcttcgcggagtggcatgcgcagcgcgcggtgccggcccggatcgtcccgcagcggacgtcgcgcatacggcccgcgcccagggacccgggcacgtccggtgccccaggcgcgcccggcgcccccggcacgtccgacccggccggcgccgcggacctggacacgcccccgagttcgacgctgcggctgcgcccggcggcgacccgggagcgtacggaatccgggccgccggcccggctcgtcgtggtggtcgacgacctggacgcgctgctgtcgcccgccctcgggtcaccgggacggcccgcggccggttcggtcgtacgggcgctggaggcggtggcccgggagggcgagcggctcggggtgcatctggtcaccgcatcgagcctcgaggggcgtacggctcagacggagccggcccgggcggccgcgctgcggatcaccctggaggcggtgtcgccgggcgtcgacgaaccggcgccggggcggggccagttgaccttcgcggacggccgggtgatccccttccaggggggccgggtcacgggccgcatcccccgcacggccaccctccgccccacggtcgtccccctcgaatggcatcgcatgggcgacccgcccgcccgccgccccgtccgcgagctcggcaacggcccgacggacctggccctgctggccagcgccctggagcgcgcggcacgctcggtatcggccacggaggtgccgtcgctgctg

SEQ ID NO: 5084 - DNA, 1719 bp, Streptomyces avermitilis
  CDS (1)..(1719)
gtgcggccagtagggagcaagtacctccttgaggagccgcttggacggggcgccacgggcaccgtctggcgggctcgtcagcgcgagaccgcgggcgccgaggccgccgtcgcgggccagccgggcgagaccgtggcgatcaaggtcctcaaggaggagctcgcgagcgacgcggacgtcgtcatgcggttcctgcgggagcgttccgtcctgctgcgcctgacccacccgaacatcgtgcgggtgcgggacctcgtggtcgagggcgacctgctggcgctcgtcatggacctcgtggacgggcccgacctgcaccgctacctccgcgagaacgggcccttcacgcccgtcgccgccgccctgctgaccgcccaggtcgccgacgcgctcgccgccagccacgccgacggggtcgtgcaccgcgacctcaagcccgcgaacgtcctgctcaagcaggacggcggccagatgcacccgatgctcaccgacttcggcatcgcccgactggccgattcccccggactcacccggacgcacgagttcgtgggcacgcccgcgtacgtcgcgcccgagtcggccgaggggcgcccgcagacctccgccgtcgacatctacggcgccggcatcctgctgtacgagctgatcacggggcgtccgccgttcgccggcgggtccgccctcgaagtgctgcaccagcacctgagcgccgagccccgccggccctcgaccgttcccgacccgctgtggacggtcatagagcgctgcctgagcaagaaccccgaccggcggcccagcgccgagaacctcgcgcgcgcactgcgcgtcgtcgccgggggcgtcggcgtgcacgcgagtgccgcgcagatcgccgccgcggagggcgtcggggcgctgctggcccccgatccgacacccgccacggtgcccggcgtgcccggcgcggccgaccccacgcaggtgctgccccagggcgcgggcgcgtacgacccgaacgcggcgaccagcttcctgccgcacacctcgggcgacgccgaccccacctccgtcctgccgcaccgcggcgccgccgatccgaccgccgtcatgccgccggtgccgcagcaccagcccggcgggccgaacgggcagtccgggcccgaggagccgcacccctggcagaaccagctgcgcgcggcccgcgatcgcaacgagcagacgcaggtccagtcgtatctcgacccgagtgaggacccgctgcgccgccggccccagcggcaggtcgcgcggccgcagcagcagccccagcagcagcccgggcccgggtacgggtatccgcagcagcagccccagcagtacgcgcctcaggggcagccgcagcggcagccccgacgccagccccagccccagcagtacgcccccgcgccgcagcagcagccgcagcggcagcctcagcggcaccagccgcagccgcggcagcccgcgccgcggcctgagcccgagccgcgacagccgcgccagcgcggtgccaacccgatgaagatcccggggctcggctgcctcaagggatgcctgttcaccgtcatcatcctgttcgtcgccgggtggctggtctgggagctgagtccccttcaggagtggatcgggacgggcagggggtactggagtgagctcagccactggttcaacaaggtgagcgggtggatcggcgatctgggcgggggctcggacaaaaccagcaac

SEQ ID NO: 5085 - DNA, 1239 bp, Streptomyces avermitilis
  CDS (1)..(1239)
ttggcacggaagatcggtagccggtacaccgcgaaccagatcctggggcggggcagcgccggcacggtgtggctgggcgagggacccgaagggcccgtcgccatcaagctgctgcgtgaggacctcgcgtccgaccaggagctcgtagggcgtttcgtccaggagcggaccgcgctgctcggcctcgaccatccgaacgtggtctcggtgcgcgatctcgtcgtcgacggcaatgacctcgcgctcgtcatggatctcgtccgcggtacggatctgcggacccggctcgaccgggagcggcggctggcccccgaggcggcggtcgcgatcgtggccgacgtcgcggacggcctggcggcggcgcacgcggcgggtgtggtgcaccgggacgtgaagccggagaacgtgctgctcgacatgcaggggccgctcggacccgggggctcgcaccccgcgctgctgaccgacttcggggtcgcgaagctgatcgactcaccgcggcggacccgggcgacgaagatcatcggcactccggactatctcgcgccggagatcatcgagggcctgccgccgcgggcgtcggtggacatctacgcgctggcgacggtgctgtacgagctgctggccgggttcacgccgttcggcggcggacacccgggggccgtactgcggcggcacgtcacggagaccgtggtgccgttgccgggtatccccgaggagctgtggcaactgctcgtgcagtgcctggcgaaggcaccggcgtcgcgcctgcgggcctcggagctgggggcgcggctgcgggagcagctgccgttgctggccgggatgccgccgctggatgtggacgagccggacacggagccggaggaagagtcgccggaggcggaggacccgccgggcgagacggtgacgggagcgcgggtccggcgggggtccgtgccgctggtaccgggagccaagccggactccaaccgggacacgcacacgtcgatgcgggtgccggggcccgatgaactggcgggcggggcgcggggcacggctcgcgcgccgcgcacgcccggcgcgccgcgaccggggtcggcccggcaccgggcgaccgcgcggcggcggcggatcacgctgggggtggccgcggtcgtgctggtggtcgcggcggcggtcggcacgtgggccgccacatccggggacgacgcgggggcgactccgtcggacacgaggaattcggcgccggagtctccg

SEQ ID NO: 5086 - DNA, 1104 bp, Streptomyces avermitilis
  CDS (1)..(1104)
gtggcagtcgtcgatgtatccgaagagctcaagtccctctcctcgaccatggagtcgatcgaggccgttttggacctcgacaagctgagggcagacatcgccgtgctcgaggagcaggcggccgcgccgtccctgtgggacgaccccgaggcggcgcagaagatcaccagcaagctctcccacctccaggcggaggtgcggaaggccgaggccctgcgcggccggatcgacgacctcagcgtcctcttcgagatggccgaggaggaggacgacccggacacccgcgccgaggccgagtccgagctcaccgccgtcaagaaggcactggacgagatggaggtccggacgctgctctccggggagtacgactcccgcgaggccctcgtgaacatccgggcggaggccggtggcgtcgacgccgccgacttcgccgagaagctgcagcgcatgtatctgcgctgggccgagcagcgcgggtacaagaccgagatctacgagacgtcgtacgccgaagaggccggcatcaagtccacgaccttcgccgtccaggtgccgtacgcgtacgggacgctgtcggtggagcagggcacgcaccggctcgtgcggatctcccccttcgacaaccaggggcgtcggcagacctccttcgcgggtgtcgagatccttcccgtggtggagaccaccgaccacatcgagatcgacgagtccgagctgcgggtggacgtctaccggtcctccggccccggcggccagggcgtgaacaccaccgactccgcggtgcgcctcacccacctgcccaccggcatcgtcgtctcctgccagaacgagcggtcgcagatccagaacaaggcgtccgcgatgaacgtcctccaggccaagctgctcgaccggcgccggcaggaggagcaggccaagatggacgccctcaagggcgacggcggcaattcctggggcaaccagatgcggtcgtacgtcctgcacccgtaccagatggtcaaggatctgcggaccgagtacgaggtcggcaatccggaggccgttttcaacggtgagatcgaagggttcctcgaggccgggattcgctggcgcaagcagcaggagaag

SEQ ID NO: 5087 - DNA, 828 bp, Streptomyces avermitilis
  CDS (1)..(828)
atgacgaagaagacgcggatccgcgtcgcgcgaatagccgcgggtgccgtgatcgccgcgggtgcctcactgaccgccgcaggtgccgcttccgctctcggcgtcggtgtcggcgtcggtatcggtgagggcggggtgtccgccgatgtcagcgtgacgaccgcgggcgacgccgacggcggcacctccgacggtggcacctcggtgggtgtgaccgacggcggtacctcggccggtacgaccgacggcggcaccacggacggcggcaccaccgacggtggtacgaccgacggcggcaccacggtgggtgcgaccgacggcggcggcgtcagcatcggtggcaccactgacggtggtacgacggacggcggcaccactgacggtggtacgaccgacggcggcaccactgacggtggtacgacggacggcggcacgaccgatggtggtacgacggacggcggcaccactgacggtggcagcaccgacggcggcagcaccgacggcggcagcaccgatggtggcagcaccgatggtggcagcaccgacggtggcaacaccgacggtggcaacacctccggtggttcctccaccggcggtaccgacaccgacggcggcggcaacaagccggtcgagcagggcaagggctcctcggccctgaccgacaccggctcggacacgtccgcccagggcaagagcgacggtgagctggcggagaccggtgccggcgagaccgcgttcctgctgatcggcgccgccacgatgatcgccggcggtatcggcttccggatgctgccgcgcctcgtgaacggtcgcggcgcagctgccgcc

SEQ ID NO: 5088 - DNA, 687 bp, Streptomyces avermitilis
  CDS (1)..(687)
gtgatccgattcgacaacgtctccaaggtctaccccaagcagacccgccccgctctcagggatgtctccctggaggtcgagcgcggcgagttcgtgttcctcgtggggtcctccggctccggaaagtccaccttcctgcggctgatcctccgcgaggagcggtgcagtcacggtcaggtgcacgtcctgggcaaggacctcgcgcgcctctccaactggaaggtgccgcagatgcggcggcagctggggaccgtcttccaggacttccgtctcctgcccaacaagacggtcgccgagaacgtcgccttcgcccaggaggtcatcggcaagtcgaagggcgagatccgcaagtccgtgccccaggtgctcgacctcgtcgggctcggcggcaaggaggaccggatgcccggcgagctgtccggcggtgagcagcagcgcgtcgcgatcgcccgggccttcgtcaaccggcccaagctcctcatcgccgacgagccgaccggcaacctcgacccgcagacctccgtcggcatcatgaagctgctcgaccgcatcaaccgcacgggcacgaccgtggtgatggcgacccacgaccagaacatcgtggaccagatgcgcaagcgcgtcatcgagctggagaagggccgactcgtccgcgaccaggcgcgcggcgtgtacggctaccagcac

SEQ ID NO: 5089 - DNA, 915 bp, Streptomyces avermitilis
  CDS (1)..(915)
atgcgcgcccagttcgttctgtcggagatcggtgtcggtctccgtcgcaatctgacgatgaccttcgcggtcgtcgtctcggtggccctctccctcgccctgttcggcggttcgctcctgatgagcgaccaggtgagcacgatgaagggctactggtacgacaaggtcaacgtctcgatcttcctctgcaacaagagcgacgcggagtccgaccccaactgtgccaagggggcggtcaccaccgagcagaagaagcagatcaagagcgacctcgacaagatgcccgtcgtcgagaaggtgacgcccgagtcggccgacgacgcgtacaagcactacaaggagcagttcggcgactccccgctggccagctcgctcaccccggaccagatgcaggagtccttccgcatcaagctgaaggaccccgagaagtaccaggtcatcgcgaccgccttcgacggccgtgacggtgtgcagtcggtgcaggaccagaagggcattctcgacaacctcttcggactgctgaacctgatgaaccgggcggcgctcgcgctgatggcgctcatgctgatcgtcgccctgctgctgatcgtcaacaccgtgcgcgtctcggcgttcagccgccgccgggagaccggcatcatgcggctcgtgggcgcctccggcttctacatccaggcgccgttcatcatggaggcggccgtcgcgggtctgatcggcggtggtgtggcctgcctcttcctggtcgtcggccgctacttcaccatcgaccacggcatggctctgtccgagaagctgaacctgatcaacttcgtgggctgggacgccgtgctgaccaagctgccgctgatcctcgccgcgagtgtgctgatgcccgggctcgccgcgttcttcgcgttgcgcaagtacttgaaggtg

SEQ ID NO: 5090 - DNA, 1167 bp, Streptomyces avermitilis
  CDS (1)..(1167)
atgtcaggccccgacccgttctgtgaaccccgccgcttcggccgcggggcggccctgacgttgctcttcgcgagcgtcctcgtggcgggcgccgcgaccggctcgttcgacgaaccggacgactccggccggaaagcctcctccgcccgcccggccccggcgagccaccgcgaggacgtcgccgaggcggccgccgaggccgcggccgacggcaagtcccccgtggaggccgccgagcgcgcggtcagccgcagcggcgaccgctggggcgccgtctactcccagggcgagtacgaggagttcgaggaggccctcgacggccagtacaccggcgtgggcctgtgggcccggcgcgaacgtgacggccgtatcgaggtgagccgggtgcagtccggctcgcccgcggccgccgccgggatccgcgagggtgaccggctgcgcaccgtcgacggcgagaacgtcgcgggcaagcccgtcaccgatgtcgtctccttactgcgcggcgacgccggcgacgcggccgccggcacccgggtccggctcggcctggcgcgcggcacgcacgcgtgggacgagaccgtgcgccgcgcccgcctgtccaccgaccccgtcaccgtgcgcaggctcgccgacgacgtcaccgtgatcaaggtcgccgcgttcaccaagggctccggcgaccgcgtacgggccgccgtggccgacgcgccccacgccgacgggatcgtcctcgacctgcggggcaactccggcggactggtcaccgaggcggtcaccgccgcgtccgccttcctcgacggcggcctggtggcgacgtacgacgtcaacggtgagcagtgcgccctgcacgccgactccggcgccgacaccacgcggcccctggtcgcactggtcgacggcggcacgatgagcgcggccgagctgctcaccggcgctctccaggaccgcgggcgcgcggtcgtcgtgggcaccaggaccttcggcaagggctcggtccagatgccgagccggctgcccggcggctccgtcgccgagctgaccgtggggcactatcgcaccccctccggccacagtgtcgacggccgcggcatcacccccgacctggaggcggacacggaggcgctggagcgggccgggaccgtgctgagcggtctcggagatccttcg

SEQ ID NO: 5091 - DNA, 531 bp, Streptomyces avermitilis
  CDS (1)..(531)
atgtacgtaccgaaagagtcccagccgaagcagggcgggggagcctccggcaaggtcaaggacggcaagcgcaagatcgtcgcgcagaacaagaaggcgcgccacgactacgcgatcatcgacacctatgaggccgggctcgtgctcaccggcacggaggtgaagtcgctgcgtcagggacgcgcctcgctgaccgacggcttcgtccagatcgacgggaacgaggcgtggctgcacaacgcccacatccccgaatacagccagggcacgtggaccaaccacaccgtgcgccgcaagcggaagctgctcctgcaccgcgaggagatcgacaagctggcgtcgaagtccgaggagacgggtcacacgatcgtgcccctcgccctgtacttcaaggacggtcgcgcgaaggccgagatcgcgctggcacggggtaagaaggagtacgacaagcggcagaccctgcgggagaagcaggaccggcgggagtcggaccgggcgatcgcggcggccaagcgcaagcagcggggcgag

SEQ ID NO: 5092 - DNA, 627 bp, Streptomyces avermitilis
  CDS (1)..(627)
gtggagcgcttcaccgcattcgatttcggtgcctcgtgggtgatgagtttcttccaccaggactggacctacgacgggcccacggccgccgacgtcgtcgcgaaacacctctcggaatcggccgacgagctggcactggcagtccgtcgcgatgcacggacactcctcgacaacctcccttcggagacgctcgaggtgctgtggaacgccggagcgcagtacatggcgagcttcgaggggacctcaggatcggagtggacgcggacggtcatcggcctgtgtgatgcccggctggccgcgaaggcggacgtacgcccgctcaccggagccgatacggaggacggctgggcgtgccaggacgccgtcatcgctgaggtcgagcgggcggagttcctggacaccgaggtgcgcgaggcgctcgtcgactgcgctcgccgctgcactccggacctggcgttccgggtgctgctcagcaccatagtcaacgcctctgaccgatcattgtctccgcaccagtacacaaggatgcaggccatcggatccgccctccactacggtgagttcttggtggactccgtcgagttcctggtcgaagaggagccgccgccggcgtcggtgccgtctcac

SEQ ID NO: 5093 - DNA, 294 bp, Streptomyces avermitilis
  CDS (1)..(294)
gtggtgcaggggttcacggcagccgccgaccggcacgacctgtcgtcctcggtgcacccccgcgaggccgcgcccgccgccgcccgccgggtcgccgagcagccgctgcgggagcggcccgcgctcaccggggtcgtcgtgcacaacgagcccgtcctgaagccgctgatcgacgcctcgaacaactcggcctgggcgttccgggcgacctctccatcacggcaatctgccccgacgaactggcggagagcgcccgcatcccgctcacctcggtcgctctcccgtccgcggagg

SEQ ID NO: 5094 - DNA, 909 bp, Streptomyces avermitilis
  CDS (1)..(909)
atgggcgagcggtccgacagtaggctcgccgcgatgcgtaccgacgaactgaatatcgacgtagtcctcgtgcagcggctggtcgccgggcagtttccgcggtgggcgggccttggcgtcgaggcggtcgattccggtggcacctccaatgccatgtaccggctcggcgcggacctggtcgtacggctgccgcgccgtgcgggggccgagggcgacgtggcgaaggagcaccgttggctgccgtggctcgccccgcggcttccggtcgccgtgcccgtaccgctgggccaggggctgcccgccgggaactaccccttccggtggtccgtctaccgctggctggacggtgcgacaccggacgtcgggcacctcgtcgcacccggcctgctggccgaggacctggccgggttcatcgatgcgctgcaccgggtcgaccccgcgggcgggcccgattcctaccgcagcgagcatctggcggtgcgggacaccgtgacgcgcgaggcgatcgaggagctgcgcggggtcgtcgacgccgacgcggcgagagccgtctgggagacggctctgcgggccccggtgtgggcgggcccgccggtctggatccacgcggacctgcaaccgggaaacgtgctggtcgaccgcgggcggctcggcgccgtcatcgacttcgggtgcctggggctgggcgatcccgccgtcgacctgatcgtggcgtggtacgtgctgccgggcgacgtacgggaggccttccgcgcagccgtggcggccgacgacgcgtcctgggcgcgcggccgcggctgggcgctgtcgatcgccctcgtcgaactgcgctactaccgggacacgaacccggtcatggcgggccatgcgcggcgggtgatccgggaggttctcgacgggcgcgagcgg

SEQ ID NO: 5095 - DNA, 1419 bp, Streptomyces avermitilis
  CDS (1)..(1419)
atggcagcagtgacggccgccggtgcggcgcaggcgccgatcgtggcgggacacccgctgctgggctccatgaacgacctgctgaacgaccccctcgccacctatctgcgggcccgccgcgaccacggcgacgtggtgcggttccgggccggcccgccggggctgcgggccgacatctacgccgtgttctcggccgagggcgcccagcaggtcctggcgacggaatccggcaacttccgcaaggacaacgtcttctacggggaactgcgcgactcggtcggcaacggactgctcaccagccaggacgccacctacctccgccagcgccgcctcgtccagccgctgttcacccgccgccgcgtggacggctacgcggggcaggtcgccgacgaggcggccggtctggccgaggcctggcgcgggattccgggcggcggcgtcgaactggtcggtgagatgcaccggttcgccctgcgcgtcgtcggccggatcctgttcgggacggacatggagacgacgttcgaggtgatcgagcgcacgctgcccctgctccaggagtacgcgctgaaacgtggactcgcgcccgtcaggacgcctcgcacgtggcccacgcccgccaaccgccgtgcggcgcgcacccaggcggagctgttcgcgctctgcgacggcatcatcgacagccgccgtaaccggaagaacgagggggacggcggggaggagagcggcgaggacctcgtcacccttctcgtccgggccgggaacgccgaggacggcagcctcgacgccgccgaactccgcgagcaggtgctcatcttcctgctggccggccacgagaccaccgcgaccgcgctggccttcgccctgcacctgctcgcccgccaccccgagcagcagcggcgggtacgggacgaggccgaccgcgtcctgggcggacccggcggacgggcgcccaccgcggcggacatggaggcgctgccgtatctgacgatggtgctgaaggaagcgatgcggctgtacccgtccgcgcccgtcatcggccgccgcgcggtcgcggacgcggaggtcgacggggtacgcattccggccggcgccgaccttttcgtcagcccgtgggtcacgcaccgccaccccgattactggccggacccggagcggttcgaccccgagcgcttcaccccggaggcggaggcgggccgtccgcggtacgcctggttcccgttcggcggcggtccgcgcgcctgcatcggacagcatctgtcgatgctggagtcggtcctggggctcgcggtgctgatccgggagttcgagttcgaggcggtgggcgaggaagaggtaccgctgggggcggggatcaccctgctggccaagggaccggcccggtgccgggtcatcccccggtcgtcgggcccgcggtcctct

SEQ ID NO: 5096 - DNA, 1254 bp, Streptomyces avermitilis
  CDS (1)..(1254)
atgggcatgttcagcgtgagcgcggtcgtcatgatcgccggttcgcggggttcgtacgcgctcgccggtgccgtcacggcgacgggtctggcggcgacggccctggtcgcccccttgatcgccaggctgatcgaccgccatggtcaggcgcggatcgcggtaccggcgacggcggtcgccgcgctcggctcgctcgcgctcctgctgtgcgtgcgctacgggaccccggactggaccctcttcgccgcgtacgccgccaccgccacgacgccgaacaccgggggcatgtcacgcgcccgctgggcccatctcttcaagggcgacccggcggccgtacacaccgcgaactccttcgaacaggccgcggacgagctgtgcttcatgctgggtccggtgctcgcggccttcctgtgcgggacgttcttcccggaggcggggacgctggtgggcgccgtcctgctgatgtcgggcgtcctggtcttcgcggcgcagcgttcgactcagccgccaccggggggacgtacgaaggccaggtcccccctgcggtcccccggaatgcccccgctcctcctcggcttcctcgccatcggcgcggtcttcggggcgatggaggtcgtcacgatcgcgtacgcggacgcgcggggccacaagtcggcggcgggtgtcgtcctcgcgctccaggcggccggttcgtgtgcggcgggactgctgtacggggcgctgaagccggccggtcccgccgagcggcgctatccgtggtgcctgaccgcgatggcggcactgctgatcctgccgctgctcgcggcgcggctcaccggctcgctgctcgcgctggcgggcgcgctgctcctcgccgggatggcgaccgccccgaccatggtcaccgccatgacgctggtgcaacagcgcacccctgaaagccggttgaacgagggcatgacgctcgccgtgaccgggctcctcggcgggatagcctgcggttcggcgaccggcgggtgggtggtggagcaggtgtcggcgacagcggggtacggcgtgccggtcgcggcggccgcgctggcactgctgatctgcctcgcgtctcctgcggtgcgcgccagacggaccatgcgcgtcagacgggcagtacgtaccaagcgggcagtacgtaccaagcggaccgaacgtgccaagcggaccgaacgtgccaagcggaccgaacgtgtcaggcgaaccgtgcgcgtcaagaggaccgcgggcccgacgaccggggga

SEQ ID NO: 5097 - DNA, 963 bp, Streptomyces avermitilis
  CDS (1)..(963)
atgtccgtcgacccccgccttctgtgcgccttcgtcgccgtcgccgaggagctgcacttcacccgcgccgccgtccgtctgtacgtcgctcagcaggccctcagccgggacatccggcgactggagcgcgagctcggcaccgagctgttcctgcggacgacgcgccaggtcaccctcaccgccgacggcacccgcctgctgccgtacgcgcgccgcgtgctggccgcacaggacgcgctgctcgccgcgttcggccggggcgaggccgggcggccgctgttcgtcgacgtcaacagcccggggctcttcagcacccgcatcctggcccgggcccgcgaactcgcccccgacagtgagctgatggcccgcttcgagagcggtctgaccggcgccgccgccgagatcctcgcggggcggatcgacgcgtcgttcgggcggttcgccggactcgacccggcgctccggtcccggctcgaacaacagcccgtacggtacgagccgatggcggtcatcctgcccgaggaccaccggctcgccgggctggacgaggtgccgctggacgcgctcgcgggcgagacggtgtacgcgggtgccggaaatccccggacgccggaatggaccgacctcgcccgtctgctcttcgaggggcgcggcatcgaggtcgcgccgcccgctccgctcgcgctcgggcccgaggagttcgagcggatcatggccaagacgcggtgcccggtcctcgccgtggtggacttcccggccatgccgcacgcggtgctgcggcccctcgtcgaccccgtcccgctgtcgcccgtgtcgctcgtgtggcgcaagggggtgacgcatcccggcatcgatgcgctccggtgtgcggcgaccgaattggcgaccgaggaaggatggttgctgcggcccgcggaagggtggattccggccagggatgcactcatcatgatgaaccgcagc

SEQ ID NO: 5098 - DNA, 1518 bp, Streptomyces avermitilis
  CDS (1)..(1518)
atgaaatgtacgcaggcccggaggcgtgcgcgcgcccgctatttgtcccgtggggggatgtacgtgcgcgtgaagaactggcggaaaggcgcccaacgtgatcgccggggcgtcgaccagccgctcgggcccgagaccgatccgtcgcccggacgtgaagccgattcgccgcccggcggtgaaaccggtccgtcgggcggacgggaatcccatcggtcgggcggacgggaatccggtccgtcgggcggacgtgagaccgacccaacgggtggacgtgagaccgacccgtcgggcggacggggaaccgacccgctcgatcgggtggtcgcgggccgggccgccgggcccgagccggtcgtctggccggaagccggtggcgcaacggcggcctggctgacggccggggcgagcggtcggtcgaacgccgggtcggggacagggcggagcgtcgggtcggggacagggcggagcgtcgggtcggtgaccgggcggagtgccgggtccgtgatcgcgcggagtgtcgggtccgtcatcgggcggagcgccggcgcaagcgccggttccgcggccgggccccgcccccgaacggccgccgagcccgaccgcgatcgcgtcctggaccccggccgggagcccgagcgcgttcccacgcccccttcgggccacgtggaccaggtggatcacgtgcccgtcgccccatcgcggcccacggtcccgtcgaccgtctgggaacggtccggtgcccccgggcacagccacgacccccatgaggtcaccgtccaactcgacggcagcggacgacagttggacgaaccgttggtcgagcggggcggcggtctggtcggcgatggtggccaggactccgacgggccggtgttcgtcgacgagtccggtcgccgcaggcgccgcttacgcaggctcggcatggtcgtcggcatcgcctgcgccgtctacgccgtggtcatcgtcgccacgctcctgtcgggcaactccaacgcgccctggctgccggtgccccgccagaaggacgacacaccggccgcccgggtcgacacctccccgccgccgagccaccgggcgcacccgtccgcgccggcggccttccctccgagcgccggcgcgacgggcgacgcgggcaagaggccgtcgaagggcggtgccggttcgacgcacggaccctcggcccgagtctcggccccggccgcctcgaccgacccccggccgtcggcgagcaccgccaagccgaagccgggcagcagcagcaccaagaatccggcccccggaccgtccgacccggtcgacggctcatcgccggcccccacaccctcgggcggggtcacccccgacccgtccccgtccacggcgaccggcggcccaggccccgtcgcgaacggctccgccgggaatgtccccgtcgcgaacggctccgtcgagaacgcccccgtcgcgaacggccccgtcggacagccgtcaggggagccccccgccgccggcccctcaccctcggagtccgtgctc

SEQ ID NO: 5099 - DNA, 2250 bp, Streptomyces avermitilis
  CDS (1)..(2250)
atggcaccccgtaccaaccggccccgcaccaaccggccccgcaccggccgtcctcccgcgcccgacgcaccggccgcccccgacgccccgaccgccccggacgcccgccgccgtcggctgcccatgcggttcctgctgccctcgctcctcctgctcgccgtcatggcgatgctgatgctccgcggcttcgtgcacagcgagatcctcgccgaccaccgcatccggcccccggccgccaccgaccaggtgccggagaagatcctcgacggcggaccggtcatcgacacccgcggcggccgtacgaccagcctgagcctccccgaccaccggctcgtcctcaccttcgacgacggccccgacccccagtggacgcccaaggtcctcgacgtcctcaagaagcaccacgcgcacgcggtcttcttcgtcaccggcaccatgacctcacgccatccggacctcgtacggcgcctggtggccgagggccacgaggtcggcgtgcacaccttcaaccaccccgacctcgcctaccagtccaagaagcgcatcgactgggagctgtcccagaaccagctcgcgctcgccggcgccgccggcatccgcacctccctcttccgcccgccgtactcgtccttcgccgacgccatggacaacgagtcctggccggtgaccgagtacatcggcacccgcggctacatcaccgtcgtcaacaacaccgacagcgaggactggcagaagcccggcgtcgacgagatcatccgccgcgccactccccggggcggcaagggcgccgtcgtcctgatgcacgactccggcggcgaccgccaccagaccgtgcaggcactcgaccggttcctgcccgaactccagcgacggggctacgagttcgagaacctgtccgaggcgctcggcgctcccagcgcgcacaccccggtcaccggcgtcgaccggtggaagggcaacgcgtggatcttcctggtccaggcagccgaccgcatcaccggcatgctggtcgtcgggctcgccgtgatcggggggctcgtcctcacccgcttcggcctgatgctcctcctgtcgggcacgcacgcccgcagggtgcgccgcccggacttccgctggggaccggccccggtcaccgaaccggtgtcggtgctggtcccggcgtacaacgaggccaagtgcatcgagaacaccgtccgctccctcacggcgagcgaacacccggtcgaggtgatcgtcgtcgacgacggttcgagcgacggcacggcacggctcgtggagagcctgcggctgccggacgtacgggtggtcagacagcacaacgcgggcaagcccgccgccctcaaccgaggcctggccaacgcccggcacgacctgatcgtgatgatggacggcgacacggtcttcgaaccggcgacggtccgcgagctggtccagcccttcgccgacccccgggtgggcgcggtcgccggcaacgcgaaggtgggcaaccgggattccctcatcggcgcctggcagcacatcgagtacgtgatgggcttcaacctcgaccgccggatgtacgacctcctgcgctgcatgccgacgatcccgggagccgtcggcgccttccgccgcagcgccctcgaacgcgtcggcggcatgagcgacgacacgctcgccgaggacaccgacatcacgatggcactgcaccgcgacggctggcgggtggtgtacgcggagaaggcccgcgcgtggaccgaagccccggaatccgtgcagcagttgtggtcgcagcgctaccgctggtcgtacggcaccatgcaggcgatctggaagcaccgccgcgcgctcgtcgaacggggcccgtcgggccgcttcggccgggtggggctgccgctggtggccctgttcatggtggtggccccgctgctggcgccgctgatcgacgtcttcctgctgtacggagtgatcttcgggcccacccagaagacggtcctcgcctggctcggcgtcctggcggtccaggcggtctgcgcggcgtacgcgttccggctcgaccgcgagcggatgacccacctggtgtcgcttccgctccagcagatcctctaccggcagctgatgtacgtcgtcctgctccagtcctggatcaccgcgctcgtcggcggccggctgcgctggcagaagctgcggcgcacgggcgtggtggaggcgccgggatccattccgcagcagcggacggcggggagcgagagcgaacggaggccggtcgga

SEQ ID NO: 5100 - DNA, 1254 bp, Streptomyces avermitilis
  CDS (1)..(1254)
atgacggcgcacgaatacccggcgacatcggcatcggcatcggtaccggcttcggtaccggtaccggctcccgccccggctcccgccccgtcccccgaggccgctccccaaaggccaggccgggaccgctacttcgacctgttgcgctccttggcgctggtccgcgtggtggtgtaccacctgttcggctgggcatggctgaccatcctgttcccgtccatgggcgtgatgttcgcgctggcgggatccctgatggcgcgctcgctcaaacgcccggcaccgagcgtgatcagggggcggatccgacgactcctgcctcccctgtgggcgttcagcgcggtgctgctgaccctgatgttcgcgggcggctggaacccggcgaaggacccggacctcggcggcacctggggtgtggtcgaactgttcgactatctcgtcccggtcggcgccccgccctacccctggtccctcggctccgattccgggctgctggagagcacctgggcggagcaggcggtgggcccgctctggtacctgcgcgcgtatctgtggttcgtcgtcgcctccccgctgctgctgtgggcgctgcgccgcgtgccgtgggcgacgctgctcgccccgctcgctctgaccgcggtgctcggcacgggcctggtcaccatccccggtgaaacgggcaacgcggtcaccgacttcgccgtgtacggcggctgctgggtcctgggtctggcccaccaggagggggtgctccggcggatcccgcgctatgcggcggtctcctgcgccaccctcctgatggcgttcgggctgtggtgggcgtccggtcaccagggccccgagggctgggacctgaacgacatccccctggcccaggcgacctggtccttcggcttcgtggcgatcctgctccagtactccccgtcgtggcaggaactgccgggccggctcgcccggtgggacaggctggtcaccctgtccaacaaccgcgcggtcacgatctacctgtggcacaacatgctgatcatggccacgggtccgctcatcgaccgggcctacgaccttcccttcatgcagaacgagcaggcggtggccgcactcgactcgacctacacgttctggatgttcgtgctggtctggccactgatcggcctcgcgatcctcgcgttcggctggatcgaggacatcgcggcgaaacgcggcccacggctgtggccgaacgggaagaagcgcggcaggccccgggcccgccaggtc

SEQ ID NO: 5101 - DNA, 546 bp, Streptomyces avermitilis
  CDS (1)..(546)
atgatccgatccccggattgtgtcgagaattcgaagctcgtggaatatctcccttccgaggtggaaacggtccggcagtgccccagcacttccctgcccacccgtctcaactgccggtcgacccatagcggtatcaagccgaaccagaagaggaaggggaccgggaaggcaaccagaaacaagcacacccatgccagagcgtccatccgaaaatcatggcacgccccaccagcctcaaggaggcctacatcgcgggtcgttccgttcggcgcggtgcggttctcaactacgggccagtccttcgactacgtcgatggccccgttccgcagcggctcgacacagtgcggttggactcgcaactccggcaggccgaccctcaccatgttgacgatcagccaggcctcccgccggcggaaaggagtgccggcgcacccatgaaaacgcgccatccgacgggaggttcggccaggaagaccgaacgcgcgaaaactacggcggatcccacgaggacggactggaaaatcgacatgaaggcggacggcccc

SEQ ID NO: 5102 - DNA, 444 bp, Streptomyces avermitilis
  CDS (1)..(444)
atggccggtcagttcgaggcaaccgtcgagatcagccgccccgtcgaggaggttttcgccttcctcgccgacggcaggaacgaccccgagttcagcccccgggtgcaggagatcacgaagacgccggacggcccgaccgccgtgggcacggtcttcacgagcacggtcaaggacgccggtatgaagacgggccggaaattccggatcaccgagttcgaggcgccccgcaggatccgctggacggagatctcgaagaacgtcgtcacggcggacgagggcggctacgacctggagtccaccggcgcgggcacgacccgcgtgcggatcttcaacgtcctggaaggccacggcgtcggcaagctcctggtgggcttcgccctgggcgcggcccgcaaggacgcgaacgcgttcggacagcggatcaaggcggcggtggaggcgtcc

SEQ ID NO: 5103 - DNA, 1389 bp, Streptomyces avermitilis
  CDS (1)..(1389)
atgacagccccgagcacagcccccgcagcgagtccgccgagcaggaaaggccgctggatcgaggagtgggatccggaggacgaggccttctgggaggagaagggggagaagaccgcgcggcggaatctgctcttctccgtgctgtccgagcacgtcgggttctccatctggaccctgtggtccgtgatggtgctgttcatgggacccgagtacgggctcacccccgccgacaagttcttcatcgtgtcgatggcgacgctggtcggcgcgatcgtccgcgtcccctacaccttcgccgtcgccctgttcggcgggcggaactggaccatcgtctccgcgagcctcctgctcatccccaccatcgcggccttcgtggtgatggagccgggcacctcgttcaccaccttcctggtgtgcgccatgctcgccggtatcggcggcggcaacttcgcctccagcatgaccaacatcaacgccttcttcccgctcaggaagaagggatgggcgctcgggctcaacgcgggcggcggcaacatcggggtgccggtggtgcagctggtcgggctcgccgtcatcggggccagtggcggcccgcgcgtactgctgggcatctacatcccgttcatcgtgctcgccgccggcctcgccgccgtgaagatggacaacatcgcgtccctcaagaacgacaccggcgcggcccgggaagccgtcaaggacgcccacacctggatcatgtcgttcctgtacgtcgggacgttcgggtccttcatcgggtacagcttcgcgttcggtctcgtcctgcagacgcagttcggccgtacgccgttgcagtccgcgtacgtcaccttcatcggcccgctgctgggctccctcatccggcccgtgggcggctggctcgccgaccgctacggcggcgcgaagatcacgctgtggaacttcgtcggcatggcggcggccaccggtgtcatcgtgatcgcgtccatgcagaagtcgctgccgctgttcaccaccgcgttcatcgcgctgttcgtgctcagcggcctcggcaacgggtccacgtacaagatgattcccgggatcttccacgccaaggccgtcgccaagggactcgaaggggaggaggcggccgcctacggacgccggctgtccggcgcctccatggggctcatcggagccgtcggcgcgctcggcgggctcggcatcaacctcgccttccggcagtcgttcctgagcgtgggctccggcaccggcgccttcgtctccttcctcgccttctacgcggcctgcttcgcggtcacctgggccgtataccttcgccgccaggccggggccgaagcccatgccaccgccgcctccggggcgaagccgcagctcagctatgtcgaggtg

SEQ ID NO: 5104 - DNA, 1158 bp, Streptomyces avermitilis
  CDS (1)..(1158)
atgtacgacgaacagcagctaccggctcaacaagatcacggaccgctcgccgggttcaccgtgggcgtgacggccgcacgtcgggccgacgagctcggcgcgctgctccagcggcgcggtgcctccgtcgtgcacgcccccgccctgcggatcgtgccgctcgccgacgacagcgaactgctcgccgccaccaagggactcatcgaacaggccccggacgtcgtggtggcgacgaccgcgatcgggttccgggggtggatcgaggccgccgacgggtggggtctcggcgaggatctgatcgagcggctgcggggggtcgaactgctggcccgcgggcccaaggtcaagggcgccgtacgcgccgcggggctgacggaggagtggtcgccctcctccgagtccatggccgaggtgctcgaccggctgctcgaagaaggcgtcgacggtcgccgtgtcgccatccagctgcacggcgagccgctgcccggcttcgtggaggcgctgcgggccgggggagcggaggtcgtcggcgtacccgtgtaccggtggatgccgccggaggacatcacgcccgtcgaccggctgctcgacgcgaccgtcacccgaggcctcgacgcgatcaccttcaccagcgcgcccgccgccgcgtccctgctgtcccgggcggaggagcgggggctgctgtccgacgtcctcgccgccctccaccacgacgtgctgcccgcctgtgtcggcccggtcaccgcgctgccgctccaggcccggggcgtcgacaccgtccagcccgaacgcttccggctcggccccctcgtacaactgctgtgcaaggagctgcccgggcgggcccgtacactccccatcgccggccaccgcgtcgagatccgcggccacgcggtcatggtcgacggagcgctgcggcccgtaccgcccgccgggatgtccctgctgcgggccctggcgcgccggccgggctgggtggtggcgcgggccgagctgctgcgggcgctgccgggggccggccgggacgagcacgccgtcgagacggcgatggcccggctgcgcacggcactcggcgcgcccaagctgatccagacggtggtcaaacgcggctaccggctcgccctcgacccggcggcggacgccaagtacgccgacgcg

SEQ ID NO: 5105 - DNA, 552 bp, Streptomyces avermitilis
  CDS (1)..(552)
atgacacagaacagcacggggcggcgtacgaccgccggaggtgtactgggtgcggccacggtcgcgacgggcctgatcgccggggtcttctacgtgttcgcctgcgccgtgatgccggccctggcccgcagcgacgaccgcgtctacatcgaggtcatgcagaacatcaacgacgtgatccagaacccggtgttcttcctgagcttcctcggcgcgctcgtgctctcggcgctctccgcctggcagttgcgcggctcgccgggccgctggtgggtgttcgcggcgctcatcgcgtacgcgctcgtgttcctgttcaccgtcgtcgtgaacatcccgctcaacaacgacctcgcgcacgccggcgccccggcgggggtcgccgatccggccgccgtacgcgcgaggttcgagggcccgtgggtggcgtggaacgtcgtacgggcgctgctgtccacgctcgcgctggccctcctcgtccgcgcgctgttcctgcgcggcagggctcacgcgtcggcgtacttggcgtccgccgccgggtcgagggcgagccgg

SEQ ID NO: 5106 - DNA, 585 bp, Streptomyces avermitilis
  CDS (1)..(585)
atggcatcgggcacggccacggcctcgtacgagctgcggttcgactccgggcggatctgcctggacctgctggcgaccacgcaccccgaggaacggctcgactcggcggaccggctgcgtgcgtgggccaccggatccgggctcgtaccaccgggcacgccactgccggaggcggacgcctcctggcccgtccggttccgcgaactgcgcggacagatcggacagttggtgcacggggagctggaagggcggccggtggacgcggcgttggcgcgcgtcaacgcggtcgcgctcggttcgccgcctccgctgtgcgcggtgcgcgcggacgacggggtgctggtacggcgactgccggccgcgcccgggtgcggggaactcctcgccgcgatcgcccgcgacacggtcgagctgctcacggacccggccgcccgggcaagcctgcgccactgcgaaggggacaactgccccctcgtgtacctcgatacgtcccgtggccgacgccgccgctggtgctcgagcgagacctgcggaaaccgcgaacgagtggcccgccaccgccgccgcgcggcactggcccgggcc

SEQ ID NO: 5107 - DNA, 594 bp, Streptomyces avermitilis
  CDS (1)..(594)
gtgggcgtgcgtaaggattccgccgtggctgatgaacgaaggtccagggcccgacatcgcatgtctccgtcctcttcctctccgtctcccgagccggacgaggagctgatgcgtgcgctgtaccgggaacacgcgggtcccctccttgcttatgtgttgcgactggttgccggagaccggcagcgcgccgaggacgttgtacaggaaacactcatccgtgcctggaagaacgccggccagctcaatcgagcgaccggttcggtacgcccctggctggtgacggtcgcccggcgcatcgtcatcgacggccaccgcagccggcaggcccggccgcaggaggtggacccgtcgccgctggaggtcatccccgcggaggacgagatcgacaaggcgttgtggctgatgacactctcggacgcgctggacgacctgacccctgctcacagggaagtcctggtcgaaacgtacttcaaagggcgtacggtcaatgaggcggccgagacgcttggcatccccagtggaacggtgcgctcgcgggtcttctatgccctgcggtcgatgaagctggctctggaggagcggggggtgacggca

SEQ ID NO: 5108 - DNA, 816 bp, Streptomyces avermitilis
  CDS (1)..(816)
atgtacgggggatatggaagcggaaccggaggtccggggtccgcgcgcggaacagcgggagcacaggggccgggcgacgtgcatgaaacagtcggcgcctacgccctcggcatcctcgacgacgccgaggcgaccgccttcgaagcgcatctcgccacctgcgactggtgcgcccagcaactcgacgacctcgccggaatggaaccgatgctggccgcgctcgcggacctgccgagttcccagggcacccctgccatcggcgagtccctgtccgccaggcccagcccacggctggccgagcggctggtcgacgaggtgtccgagcggcgcgccctgaagcgcaggcgcagcttcttcatgctggcggcggcggccgcgatgatcatcggcggtccgctggtcgtcatggcggtcaacggcgacggcggcggcaaggagccggtggccagtgccaccagccccgccaaggacgccttcatgcacatgtccaagaagatctcggcgacggactcgagcaccaaggtcaacgccgtgatcgcgatggactccaaggactggggcacccactccgtcctccagctgaagaacgtcaagggcccgctcaagtgctccctgatcgccgtcggcaagaacggcgagcgtgagacggtcacgtcctgggcggtcccgaagtggggctacggcatcaaggacgccaagaccgaacaggccaagaacccgctctacgtccacggcggcgcggccttcaagcccaacgagatcgaccacttcgaggtcatgaccttcgacggcaagcggctcgtcgaagtgaacgtg

SEQ ID NO: 5109 - DNA, 2508 bp, Streptomyces avermitilis
  CDS (1)..(2508)
gtggccgctcaggttcaacaggaaaccgcgttcggcccggtcgacgagtcctccgtccaggactcggcatcggactccgctcaggattccgtacgagaccgggaaatcagcgtcgaacaggagcacctggaccgggtgtaccgccgtctcgaggagaagatccacgaggcggagttcctgatgcaggacgcagctcagcgcggccaggtcggtacgccgggggcgctcgccgagcgcgacgcccaggtgttccgggcggggatccacctcaaccgcctgaacaacgagttcgaggacttcctcttcggccgtatcgacctgctgctcggcaaggacggcaagaagggcccggacggggcgtacacggccgtcgagcccgccgagggcgtcgtccgggacgacaacacggcggacatcgccgagaccctgcacatcggccgcatcggcgtcctcgacgcggagtacgcgccgctggtcatcgactggcgggcacccgccgcggcccccttctaccgctccacgccggtcgaccccgggcgcgtcgtacgccgccgggtcatccgctccaaggggcgcaaggtcctcggcgtcgaggacgacctgatgcgccccgagctgacggcgtcgctgaacgacgagcccctggccgtcatcggtgacggcgccctgatggccgccctgggccaggcccgcagccacaccatgcgggacatcgtggcgtcgatccaggcggagcaggacctggtgatccgcgcccccgccgcctccgtgacgtacgtcgagggcggccccggcaccggcaagaccgcggtggccctgcaccgcgccgcctacctcctctaccaggaccgccgcagatacgcgggcggcatcctgatcgtctccccgaccccgctcctggtcgcctacaccgagggcgtcctgccgtcgctcggcgaggagggccaggtcgccatccgcgcgatcggctccctggtcgacggcgcggaggcgaccctgtacgactccccgtcggtggcccgcgccaagggctcgcaccgcatgctgaaggtgctgcggaaggccgcccggggcgcgctggagctgggtccgtccgtcgctgggccggccacccgtgggcagttcgccggtgggtcctccgccggtgccaacggctcgcggacgggcggcgccggccggtcctccgcgagcgcggagcgccccctcgccgacgccgagcagctcgccttcggcgacgacgacaccggccaccaggcccccgccgagccgcccacccggctccgcgtcgtcgccttcgggcgccggctggagctggaggcccgcgagctggaccggatccgggagaccgccctcagcggtaccgctccggtcaacctgctgcgtccgcgcgcccgcaaactgctcctggacgccctctgggcgcactccggcgccggcacccggcacaacgaccccgagctggccgccgaactgcgctcgtccttcgacgaggacgtcacctccgaggactccttcatcgggttcctcgacgcctggtggcccgagctgaccccgcggggcgtgctggccgccatggccgacgagcggcgcctcggccgctgggcccggcgcatcctcaaccccggcgaggtgcgccgagtggcccgctccctccggcgcgacgggctgtccgtgcacgacgtggccatgctcgacgaactgcaggcgatcctcggccagcccgcccgcccccggaagaggcgcgaactcgaccccctcgaccacctcaccgggctcgaggagctgatgcccgtacgcgaggagtcgcagcgcgaacgtgccgagcgcctcgcgcaggagcgcaccgagtacgcgcatgtgatcgtcgacgaggcgcaggacctcacgccgatgcagtggcggatggtcgggcgccggggccggcacgccacgtggaccgtggtcggcgaccccgcccagtcgtcctggtccgacccggacgaggccgccgaggcccgcgacgaggcgctcggcagccgtccccgccgccgcttcaccctcaccgtcaactaccgcaaccccgccgagatcgcggagctggcggcgaaggtgctggcgctcgcgatgccgggctccgagtcgccggccgccgtgcgctccacgggcgtggagccgcgcttcggggtcgtacggggctcgctggcgcagacggtccgggaggaggccgcacggctgctcgaccgcgtcgacggcaccgtgggcgtcgtcgtcgccatgaaccgtcgcgaggaggcggcccgctggctcgccgggctcggcgaccgggtggtggcgctcggcagcctggaggcgaagggcctggagtacgacgcgacggtcgtcgtctcgccggcggagatcgccgacgagtccccggccggactgcgcgtcctgtacgtcgccctgacccgcgcgacgcagcagctgacggtggtctcgggagaccgggacgagccggacgcgagcggggtgccggacctgctgcgggac

SEQ ID NO: 5110 - DNA, 1431 bp, Streptomyces avermitilis
  CDS (1)..(1431)
atggcaacggcgcccagcgtctcctactcgatgacggtccggctggaggtgcccgcgagcggaacagcggtctcccagctcaccacggccgtcgagtcccacggaggctcggtgaccggcctcgacgtcaccgcgtccgggcacgagaagctccggatcgacgtcacgatcgcggcgacctccacctcgcacgccgacgagatcgtcgcgcagctgcgcaccatcgagggcgtcaccctcggcaaggtctccgaccgtacgttcctgatgcacctcggcggcaagatcgagatgcagtccaagcaccccatccgcaaccgtgacgatctctcgatgatctacacgccgggtgtcgcccgcgtctgcatggcgatcgccgagaaccccgaggacgcccgtcgcctcaccatcaagcgcaactccgttgcggtcgtgacggacggctcggccgtgctgggcctcggcaacatcggtccgaaggccgccctcccggtcatggagggcaaggcggccctcttcaagcgcttcgccggcatcgacgcctggccgctgtgcctggacacccaggacaccgacgccatcgtcgagatcgtgaaggcgatcgctcccggcttcgccggcatcaacctcgaggacatctcggcgccccgttgcttcgagatcgaggcccggctgcgcgaggccctcgacatccccgtcttccacgacgaccagcacggcaccgcgatcgtcgtgctcgccgccctcacgaacgccctgcgtgtggcgggtaaggcgatcggcgacatccgcgtcgtcatgtccggcgcgggcgcggccggcacggccatcctcaagctgctgatcgcggccggcgtcaagaacgccgtcgtcgcggacatccacggggtcgtgcacgccgaccgcgaggacctggtgaacgccgcggccgactcgccgctgcgctggatcgccgacaacaccaaccccgagggcctgacgggcacgctcaaggaggccgtgcgcggcgccgacgtgttcgtcggcgtctcggcccccaacgtcctcgacggggacgacgtggccgccatggccgaggacgccatcgtgttcgcgctcgcgaacccggaccccgaggtcgagccggcggtggcccgtcagacggcggccgtggtcgccacgggacgctccgacttcccgaaccagatcaacaacgtgctggtcttcccgggcgtcttccgtggcctcctggacgcccagtcgcgtaccgtcaacacggagatgatgctggccgccgcggccgctctcgcggacgtggtgaccgaggacgagctgaacccgaactacatcatcccgagcgtcttcaacgagaaggttgcgggcgcggtcgccggagcggtgcgcactgccgcgaaggcggccggggtgacggagtcggacagcaaggacgcg

SEQ ID NO: 5111 - DNA, 279 bp, Streptomyces avermitilis
  CDS (1)..(279)
atgaaccgcagtgagctggtggccgcgctggccgaccgcgccgaggtgacccgcaaggacgccgacgccgttctggccgcgttcgccgagaccgtcggcgagatcgttgccaagggcgacgagaaggtcaccatccccggcttcctgaccttcgagcgcacccaccgtgccgctcgcaccgcgcgtaacccgcagaccggcgacccgatccagatcccggcgggctacagcgtcaaggtctccgcgggctcgaagctcaaggaagccgccaagggcaag

SEQ ID NO: 5112 - DNA, 1344 bp, Streptomyces avermitilis
  CDS (1)..(1344)
atgaccgtcaacggctcagacgatgtactgcttgtccacggcggaaccccgctcgagggcgagatccgggtccgcggtgcgaagaacctcgtgccgaaggccatggtcgccgccctgctgggcagcgagccgagccggctgcgcaacgtccccgacatccgcgacgtgcgcgtcgtgcgcggactgcttcagctgcacggggtgacggtccgcccgggagaggagccgggcgaactggtcctggacccgtcgcacgtcgagagcgcgaacgtcgcggacatcgacgcgcacgcgggttcgtcccgtatcccgatcctcttctgcggcccgctgctgcaccgcctcgggcacgcgttcattccgggcctgggcggctgtgacatcggcggccggccgatcgacttccacttcgaggtgctgcggcagttcggcgcgaagatcgagaagcgggcggacggccagtacctggaggctccgcagcggctgcgtggcaccaagatccagctgccgtacccctccgtgggcgccaccgagcaggtgctgctgacggccgtcctcgcggagggcgtcaccgagctggccaacgcggcggtcgagccggagatcgaggacctgatctgcgttctgcagaaaatgggcgcgatcatcgcgatggacaccgaccgcaccatccggatcacgggtgtcgactcgctcggcggctacacccacgcggccctcccggaccgcctggaggccgcctcctgggcgtccgcggcgctggcgaccgaaggcaacatctacatccgcggcgcccagcagcgctcgatgatgacgttcctgaacacctaccgcaaggtcggcggcgccttcgagatcgacgacgagggcatccgcttctggcaccccggcggccagctgaagtcgatcgcgctggagacggacgtgcaccccggcttccagacggactggcagcagcccctggtcgtggccctcacccaggccacgggcctgtcgatcatccacgagacggtgtacgagtcccggctcggcttcacctccgcgctcaaccagatgggcgcgcacatccagctctaccgcgagtgcctcggcggctccgactgccgcttcggccagcgcaacttcctgcactcggcggtcgtctccggccccaccaagctccagggcgccgacctggtcatccccgacctccgcggcggcttctcgtacctgatcgcggccctcgcggcccagggaacctcgcgggtgcacggcatcgacctgatcaaccgcggctacgagaacttcatggagaagctcgtggaactcggcgcgaaggtcgaactgcccggcaaggcactcgcc

SEQ ID NO: 5113 - DNA, 579 bp, Streptomyces avermitilis
  CDS (1)..(579)
atgtctggcatgaccgaggtgtcctcgctcacagggcggctgctcgtggccacgcccgccctggcggacccgaacttcgaccgcgcggtggtgctcctcctcgaccacgacgaggagggctcgctgggtgtcgtcctcaaccggcccacgccggtcgacgtcagcgacatcctggagggctgggcggacctcgcgggcgaacccggcgtcgtcttccagggcggcccggtctccctcgactcggcgctgggtgtcgcggtgatccccggcggcgcctccgtcgacggggcgcccctcggctggcggcgtgtgcacggcgcgatcggcctggtcgacctggaggcaccgcccgaactgctcgccaaggccctcggcagcctgcggatcttcgcggggtacgcgggctggggcccgggccagctggaggacgagctggtggaaggcgcctggtacgtcgtggagtcggagccgggcgacgtctcctccccgtcgcccgaacgcctgtggcgcgaggtgctccgccgccagcgcaacgagctggcgatggtggccacgtatccggacgacccgtcgctcaac

SEQ ID NO: 5114 - DNA, 294 bp, Streptomyces avermitilis
  CDS (1)..(294)
atgagcactcttgagcctgagacccagccccagcgaggcactgggacggggaccctcgtagagccgacaccgcaggtgtcgcacggcgacggggaccacgagcgcttcgcccactatgtccagaaggacaagatcatggcgagcgccctcgacggcacacccgtcgtggccctctgcggcaaggtgtgggtcccgggccgggacccgaagaagtaccccgtatgccccatgtgcaaggagatctacgagtccatgggcgccggcggggacaaggacaagggcggcgacaagaag

SEQ ID NO: 5115 - DNA, 1338 bp, Streptomyces avermitilis
  CDS (1)..(1338)
gtgcccctggcccgcaccgcccgtacgcctcgcccgccccgaacggccgtctccctcgcggcgcttgccgtcgccgcggtcctgaccgtcaccgccaccgcctgcgccccgcagagctccggcaactcctcctccggcaaggacgagaagaccggcaccctgcgggtctggctcttccaggaggtcgacaacaagccgaagcagcaggtcgtcgacgagacggtcgccgctttccggaaggcccacaagggcaccgaggtcaacgtcgagtacatccccgtcgagacccgcgcccagcgcgtcaaggccgccttcaacgaccccaagagcgcgcccgacgtcatcgagtacggcaacacggacaccgccggctacgtcagggacggcgggctcgcggacgtcacccgggacttcaccggctggagcgagtccaaggacaccgacccgacggccaagcagtcggtgacggtcgacggcaggatctacggcgccccctacttcgtcggcgtacgcgccctctactaccgcaccgacatcttcaaggagcttggactcgaagtacccaggacgcaggccgagttgatcgcgaccgcgaagcagatccgggcggcgaagccggacctgtacggactcgccgtcggcggcgcgtacacgtacggcgcgatgcccttcatctggtcccacggcggtgaactcgcgcagggcaagggcggctcgtactcctcgaccatcgacagcgcggccgcccggaagggcatcaaggcgtacacctccctcttcggcgacgacaactgccccgccgccaagtgcgcgggcatgggcggcaacgacacggtgaccgcgttcgcctccggcaaggcggccatggcgatcggcggcgacttcagccaccaggcgatcgaggcgggcaaggtcaagggcgcgtacgcggtcgtgccgctgccggggctgaagccgggtgacatcgcgccggcgttcgcgggcggcaacaacatcggtgtcctgaagagcacgacacaccgcacactcgccgtcgacctgatgaagcggctcgcgtcgaagaagacgcagagcgaactcttcgacgccatgggcttcctgccgacgttctcggacgtgcgggagcaggtcgcggcgaaggaaccgttcgtcaagcccttcgtccggaccctcgccgcgggcgcgaagttcgtgccggcctcgcccgcctgggcggggatcgactcgtcgctggtgctgccgacgatgttccagcaggtcatcagcggcaagaaggacgtggcggccgcctcggaggaagccgccaagaagatgaacgacgcgttcagctccgcgggt

SEQ ID NO: 5116 - DNA, 960 bp, Streptomyces avermitilis
  CDS (1)..(960)
atgacgacgcacaacaccgccctcggtgaacgcaccgggggcgcggtggccgacaaggccgtcggggctcaccccggaaggcgcccccggggcgcggcccggacgccctggatctatctcgcccccgccctggtcgtcctcggcgggctgctcgtctaccccgtctaccagctcggcctgatctcgttcctggagtacacgcaggcccaggtcagcggcggggagccgaccaccttccaggggttcgggaactacgcgacgctcttcggggacgagcagttctggcaggtgctgctggccacggtggtgttcgcggcggcctgcgtggtctccaccctggccgtcggatgcgcgctcgccgtgctgctgacccgggtccgcgccctgccgcgcctcgcgctgatgctggccgcgctcggcgcctgggcgaccccggcgatcaccggctcgacggtctggctgctcctcttcgaccccgacttcgggcccgtcgaccggatgctcggcctcggcgaccactcgtggacgtacggccgttacagcgccttcgcgctcgtcctcctggaagtcgtctggtgctccttcccgttcgtgatggtcacggtgtacgccgggatccgcgccgtacccgccgaggtcctggaggccgccgccctggacggcgcctcgcagtggcgcatctggcgctcggtactggcgccgatgctccggccgatcctggtggtcgtcaccatccagtcggtcatctgggacttcaaggtcttcacgcagatctacgtgatgacgaacgggggcggcatcgcgggccagaacctcgtcctgaacgtgtacgcgtaccagaaggcgttcgcgtcgtcccagtacagcctcggctcggcgatcggcgtggtgatgctggtgatcctgctggccgtcaccctcgtccatctgcggctgttgcgcgggcagggggaggaactg

SEQ ID NO: 5117 - DNA, 843 bp, Streptomyces avermitilis
  CDS (1)..(843)
gtgacctcgatacgagggctggtgcgccggccctggcggctcgccgccgaggcgtccgcgctgctgatcgcggtcgtcgtcgcgttcccgctctactggatggtgctgagcgccctcaaaccggcgggcgagatcgagtcgacgcggccgcggccctggacgctgtccccctcgctggattccttccggcgcgtcttcgaacagcaggaattcggccgctacttcctcaacagcctggtggtggcgtgctccgtggtcgtcgtctccgcattgatcgcctttctcgcggcgaccgcggtgacccgattccgcttccgattccggaccaccctgctgatcatgttcctggtcgcccagatggtgcccgtggaagccctgacgatccccctcttcttcctgatgcgggacttcggtcagctgaacacgctcggctcgctgatcctgccccacatcgccttctcgctgccgttcgcgatctggatgctgcggggctttgtgaaggccgttccggacgcgctggaggaggccgcgtacatcgacggggcgagccgggcgagattcctctggcagatccttttccccttggtcttcccggggctggtggccacgagtgtcttttccttcatctcggcctggaacgacttcctgttcgccaagtccttcatcatcagcgacacgtcccagtcgacgctgccgatggctctcctcgtcttctacaaaccggacgagcccgactggggcggtgtgatggcggcgtccacggtgatgacgattccggtgctggtcttcttcgtactcgtgcaacggcggctcgtgtcgggcctcggcggagcggtaaaggac

SEQ ID NO: 5118 - DNA, 1731 bp, Streptomyces avermitilis
  CDS (1)..(1731)
gtgaccgacgtgaccgacgtgatggcactgattcccgcgccccggcacgtgggggcgtgcggcgaaggcttcttcgagttgggcccggacacccggctggcggcgggtgccgggaccgaacggaccgcgcgatggctgcgcggcacgatcggggcggccaccggcttcccgctcgcaccgggcgacggcgggatcaggctgtccgtccacccgacggtgaccagggacctcggcgaggagggctaccggctcgcggtcacgccggacgcggtgcacctggtcggcggcggccccgccgggctcttctggggcgcccagaccctgcggcagctgctcggtcccggcgcccaccggcgggcgccgctgcccggcgggcagtggcggctgccgctgacgcacattcaggattcgccccggttcccctggcgcggcgtcatgctcgacgtctcccggcacttcatgcccaaggacggcgtcctgcgccacctggatctgatggccgcccacaaactcaacgtcttccacttccacctcaccgacgaccagggctggcgcatcgagatcaagcggtacccgaagctcacggaggtcggatcctggcgggcgcgcaccaaattcggccaccgcgcttcacaacggtgggaggagaagccgcacggcggcttctacacgcaggacgacatccgcgagatcgtcgcctacgcggccgagcggcacatcaccgtcgtccccgagatcgatatcccgggccactcgcaggccgccatcgccgcgtatccggaactcggcaactccgacgtcatcgacacgacctccctgacggtctgggacgactggggcgtctccaaaaacgtactcgcccccactgacaacaccctgcgcttctacgagggcgtgttcgaggaactcctggagctgttcccggccgacgccgccgcgttctcggccttcgtccacatcggcggcgacgagtgcgccaaggaccagtggaagcagtcgcccgccgtccaggcccgcatcgaggagctggggctcacgggcgaggacgcgctccaggcgtggttcgtccggcacttcggcacctggctcgccgcgcgcgggcgccggctcatcggctgggacgagatcctggagggcgggagccgcgccgcagggacacgtgccgaagcgacacgcgccgcagggacacgcgcgcccggaggtgagacggcggacatcggcctcccggaaggggccgccgtctcctcgtggcgcggctaccagggcggcatcacggccgcccgcgcgggccacgacgtcgtcatgtgccccgaacagcaggtctacttggaccaccgccaggacggcggcgcggacgagccggtgcccatcgggtacgtgcgcaccctggaggacgtctaccgcttcgagcccgttccgccgcagctcaccgaggacgaggcgcgccatgtgctgggcacccaggccaatctgtggaccgaggtgatggaggaccacgcacgcgtggactaccaggcgttcccgcggctcgcggccttcgccgaggtcgcctggagcgcgctgcccgcccccgccgaacgggacttcgccgacttcgagcggcggatgaccgcccactacggacggctcgacgccctgggagtggcctaccgcccgcccacgggaccgctgccctggcagcggcggccgggtgtgctcggacgcccgatcgaggggccgcccccgaacgcg

SEQ ID NO: 5119 - DNA, 918 bp, Streptomyces avermitilis
  CDS (1)..(918)
gtggggcagcgggaaggggcagccggtttgaccacgcacgcaccgcaggcggcgcaggccgtgacgctgcccggttcactggacgaggccgtggcggccctggccgccatgccgaccgccgttccggtggcgggcggcaccgacctcatggccgccgtcaactccgggcagctgcggcccgccgccctcgtcgggctcggccgcatcaacgagatccgcggctggcagtaccaggacggccacgccctgctcggcgcgggcctcacccacgcacgcatgggacgccccgacttcgcggccctcatccccgccctcgcggcggcggccagggccgcgggcccgccgcagatccgcaacgcgggcaccctgggcggcaacatcgcgtcggccgcccccacgggggacgcgctgcccgtgctggccgccctcgaagccacgctgatcatcgcgggcccgggcggcgcccgccgcgagatcccggtctcgcacctgctcgccggcatggagatgctccgcggcggcgaactcatcggctacgtgcgcgtcccgctgctgcacgccccgcaggtcttcctgaaggcgaccggacggaccgggcccgggcgcgccaccgcctcggtggcgctcgtcctcgaccccgcccggcgcggggtgcgctgcgcggtgggggccatagcgccgatgccgctgcgcccgctggaggccgaacagtgggtcgcccagctgatcgactgggacaacagccgcacgatcgtgccggaggccctcacggccttcggggactacgtcgccgcggcctgcatcccggatcccgtaccggccgaggacggctccgtggagcagttgccggccgccgtactgcacctgcggcgcaccgtcgccgcgctggcccgacgagcactggggagggcactgtcg

SEQ ID NO: 5120 - DNA, 1560 bp, Streptomyces avermitilis
  CDS (1)..(1560)
gtgaccgacgaccagcacggagagggcacccctcaggggcgcacccacggagcctgggagcggctgccgcaaggggactacgacgacggggcgaccaccttcgtccagcttcccgagggcggcatcgacgcactcctggcgtcggacaccccgctggccgcccccggccacggctacgtgcccccgccgatcacggccgcgcccggcgccgacgccgacccgtcggccccgggagcctggggcgcgcccgtcgagggcgtccagtggcccgacccggggcccgcgtccccggacgtcgcccaggacgccttcatgtacaaccccggcggcaccgggcagtgggccttcgaggagtcggcgcggggtgacgccgcctccgggcacgacgtgaccgggcagtggtcgatccccgtggccgacggtgatctaccggacgaatcgggtgagttcagcgcctcgtcgctggtcgagcagtggggcggcaccccgcccgccacgctccccggcggcgcggccgcgccgtgggcgacggagcccgccgggcagctgtggtccccggagtcggaggaagcggcgggtcacccgggcccggaattgcccgccgaagcccctgtggagccctccggcgggccgtacacgggtttcggggcgggagccgatcccggggcgcccgaggccgcccaggaggctcctgagccctccggcgccctcgatgcgacggagacccacgagacggctggggcggcggaggccgcggacgctcccgacgccgagccggccgccgaggaaccgcccgtcgccggggacccgcaggccgccgtcgaacccccggccgcggagccgtccggttccggccccgacccgtccgcggcttcgcaggcgcagggcgcgtccgccgaggagaccggcgccgacgaccccgcttccgcgcaccaccacgacgaacaccccgtggcctcctacgtcctgcgtgtcaacggcgccgaccggcccgtcaccgacgcctggatcggcgagtcgctgctctacgtgctgcgcgagcggctcggtctcgcgggcgccaaggacggctgctcgcagggcgagtgcggggcctgcaacgtccaggtcgacgggcggctcgtggcgtcctgcctggtgcccgccgtcaccgccgcgggcagcgaggtgcgcaccgtcgaggggctcgccgtcgacgggcggccctcggacgtgcagcgggcgctcgccaagtgcggcgccgtgcagtgcggtttctgcgtacccggcatggcgatgaccgtgcacgacctcctggagggcaatcccgcgcccaccgagctggaggcccgccaggcgctgtgcggcaacctgtgccgctgctccggctaccgcggggtcctggacgccgtgcgcgaggtcgtcgccgaacgtgaggcgcacaccgaggccgagtcggcgcaggacgccgacgaggcccgtatcccgcaccaggcgggccccggagcgggcggcgtcaacccctcggcgttcgaccccccggacgcgcaccaccggtacggccaggacggaggccaggcg

SEQ ID NO: 5121 - DNA, 2304 bp, Streptomyces avermitilis
  CDS (1)..(2304)
gtgagcaacgaagccgccaccgcgaccacggcggccgccgcggccgcccccgaaccgctgccgcacggcctcggcgtctccctgccgtccgccgacgcccgcgccaagacggagggcaccttcccgtacgcggccgacctgtgggccgagggcctgctgtgggccgccgtactgcgctccccgcacccgcacgcccgcatcctctccatcgacaccacccacgcgcgcgagatgcccggtgttcgggccgtcgtcacccacgaggacgtgccgggccaggtgccgcacggccgcggcacagccgaccgcccggtgttcgcctccgaggtcgtacgccaccacggagagcccctcgcggccgtcgccgccgaccacccggacaccgcgcgcatggccgcggccgccgtcatcgtcgagtacgaggtgctcgacccggtgaccgacccggaacaggccttcgaggccgaacccctgcaccccgacggcaacctgatccggcacatcccgctgcggcacggcgacccggacgcggccggcgaggtcgtggtcgagggcctgtaccgcatcggccgccaggaccccgccccgatcggcgcggaggccggtctcgccgtgccccgccccgacggcggggtcgagctgtacgtggcctccaccgacccgcacgccgaccgcgactcggccgccgcctgctacggcctcgaacccgaccgcgtgaaggtcgtcgtcaccggagtgcccggtgccaccgccgaccgcgaggaccagggcttccagatcccgctcgggctgctggccctgaagacgggctgcccggtcaaactcaccgcaacgcgcgaagagtccttcctggggcacgtccaccggcaccccaccctgttgcgctaccgccaccacgcggacgccgacggcaggctggtgaaggtcgaggcgcagatcctgctggacgcgggcgcgtacgcggacacctccgcggaggcgctggcggcggccgtctccttcgcctgcggcccgtacgtcgtcccccacgcgttcatcgagggctgggcggtacgcacgaacaacccgccctccgggcacgtacgcggcgagggcgccatgcaggtgtgcgccgcgtacgaggcgcagatggacaagctcgccaagaagctcggcatcgacccggcggaactgcggatgcgcaacgtgatggccaccggggacgtcctcccgacgggccagacggtgacgtgcccggccccggtcgccgaactgctccaggccgtgagggacttccccctgcccgcgctccccaaggacacgcccgaggaggagtggctgctcccgggcggccccgagggcgcgggcgaacccggcgccgtacgccgtggcgtgggctacgggctcggcatggtgcacatgctcggcgccgagggcgcggacgaggtatccacggcgacggtgaaggtgcacgacggcgtcgccaccgtcctgtgcgcggcggtggagacgggccagggcttcacgaccctcgcccggcagatcgtccaggagacgctgggcatcgacgaggtgcacgtggcgccggtcgacacggaccagccgccggccggcgcgggctgccggggccgccacacctgggtgtcgggcggagccgtggaacgcgccgcgaagatggtgcgcacccagctgctccagcccctggcgcacaagttcggcatgtccacggagctgctgcagatcacggacggcaagatcacgtcgtacgacggggtgctgtcgacgaccgtcacggaggcgctggacggcaaggagctctgggccaccgcccagtgccggccgcatccgaccgagccgctggacgcggtcggccagggcgacgccttcgtgggcctcgcgttctgcgcgatccgcgcggtggtggacgtcgacatcgaactgggctccgtacgggtcgtggaactcgccctcgcccaggacgtgggccgggtgctcaaccccgcgcagctcgccgcgcgcatcgaggcgggcgtcacccagggcgtcggcatcgcgttgacggaaaacctgcgcaccgcgcgcgggctggtgcgccaccccgacctcaccgggtacgcgctgccgacctcgctggacgcgcccgacatccgcatcgtcaagctcgtcgaggaacgggacgtcgtcgcccccttcggcgcgaaggcggccagcgcggtgccggtggtgacgtcaccggcggcggtcgccgcggcggtacgggcggcgaccggccggccggtgaaccgtctgccgatccgcccgcaggcggcggtggtgacggcgcca

SEQ ID NO: 5122 - DNA, 1188 bp, Streptomyces avermitilis
  CDS (1)..(1188)
atgagcacgactgaagcgggtggcgtgatcacgctgaccgaggcggatctggacccgtacgtcacgcacgcgcggacgcggcagtggctcacgggacccgggctgccggccgacagcgcgctgctgggattcgacgccctgcgcgaggcgacgacgccgccgcggcccgggctgcgccgcgtggcggacctggtggacgacgcggagaagctcgccggggagctgcgggaccaactggtcataggggcgctgcggaccttcgaccgggacctggagtcggtcgtgctcgacggcgcgacgggcgcggtctcgacgacgtacttccacgggagcgcgagtctgatggaccgctccccgctggccccctccctggaggcgctggtgcggttcgcggcggccacggaggaactggcgggctcccgcgggcagttcgccgcgtacgaggggcgccatggcccgaaggcggtggcggcggcgtcggagcagctgtcggcggtcttcacctcgacggcgggcgacgacgtggcgccgtactggcggatggcggccctgatccgccccctcgcccggatcgccggccccggcgcgggcctcgccctcgacctgccgccgcgcctgctggacgaggagttcggtgccttcgggatcgtgcgcttcgaggacgtcgacttcccggccgcgctcacgcacgagccgacccggcgcttcctgcgcgaggtgggcctgccggagaacggctactggttcgaagtcgacacggacgtaccgctgccgacgctggccgagcactacgcggacgagctctccggcgccttcacggacggcgagctccccgccggggcggaccacctgatacgcctcggccacctcctggaggacacgagcctggtcgtcgacggcgccacgggagcggtcctgtgctggagcgagcccgacggcatgctgcgcccgctcaacaccgacatctccacgctcgcgttcacggcgtggctgctgcaccgcgagaaggcgctcgacgcggaccacgacctgacggggtcctacgagcagctggcggccacgatggcccagaccctggccctggtcgaccccatggcctgcgaccccaccccggtgaccccgcaggacgacggcctgcgctactggccggacgcgttcgaggaccaggcgggcggcgggctctacgcc

SEQ ID NO: 5123 - DNA, 1452 bp, Streptomyces avermitilis
  CDS (1)..(1452)
atgagtgccctggaaccccgcgacgccgccgtcgcagacacctccgccgcagacgcctccgccgtcccgcccgcgcccgacggagaaggtgtgctggggcggtcgtaccgggcgctgagcatcgggatcgtctccgtcgtgctgctcatcgccttcgaggcgacggcggtcgggacggcgatgccggtcgcggcgcgtgagctggacggggtctcgctgtacgccttcgccttctccgggtacttcaccacgagcctcttcgggatggtgctcgccgggcagtggtccgaccggggcggtccgctcggctcgctgaccgccggcatcgccgccttcgccgccgggctgctgctgtccgggaccgccgggacgatgtggctgttcgtcctggggcgggccgtgcaggggctcggcggcggcctggtgatcgtcgcgctgtacgtggtcgtcgggcgggcctatccggggcggctgcggccggcgatcatggcggcgttcgcggcgtgctgggtgatcccgtcgatcgtgggcccgctggcgtcgggcgcggtgaccgaacacctgggctggcggtgggtgttcgtcggcatcccggtgctcgtcgtctttccgctcgcgctcgcgctgccccggatacggcggcgggcgggccgtccggccgccggcgtggcggcacccttcgacgcccaccgcatccgcctcgccctcggtatctcgctgggcgccgcactccttcagtacgccgcccaggacctgcgcgcgctgtcactcgtcccggccgtcgcgggcgccgcgctgctcgttccggccgccctcggcctgctgccccgcggcacctaccgggcggcgcgcgggctgccgtccgtcgtgctgctgcgcggggtcgcggcggggtccttcgtcgccgccgagtccttcgtgccgctgatgctggtcacccagcgcgggctgtcgccgacgctcgccgggttctcgctcgcggcgggcggcggcacgtgggcgctcggctccttcgtgcaggcgcgggcgcgcgtggagccgtaccgggaccggctgatgacgctcgggatggtgctggtcgccgccgccatcgccgccgcgcccagcgtgctgatcgacgcggtgccggtgtggacggtcgccgtcgcctgggcgttcggctgcttcggcatggggctggtcatctcctccagcagcgtcctcctgctccacctctccgcccccgaggaggccggcgccaactccgccgcgctacagatctccgacggcctgtccaacgtgctcctgctgtccgcgggcggtgccgccttcgcggcgctgggcggcggtaccgtcaccgatgccgccacggcggcgtccggctcccatcccgccgccttcgccgccgtgttcctgccgatggcggcggtggcgctggtgggggcgtgggtgacgacacggctgcgggagcgg

SEQ ID NO: 5124 - DNA, 1794 bp, Streptomyces avermitilis
  CDS (1)..(1794)
gtgactaccaccgccgccagcgcctcctcgcaccacctctctcccgccttccccggccgtgccccctggggtaccgccagcaagctgcgtgcctggcagcaaggggcgatggagaggtacctccaggagcagccgcgtgacttcctcgccgtcgccacgcccggcgccggcaagacgaccttcgcgctgacgctcgcttcctggctgctgcaccaccacgtcgtgcagcaggtgaccgtggtcgcgccgaccgagcatctgaagaagcagtgggcggaggccgccgcacgggtcgggatcaaactcgatcccgagtacagcgcgggaccgctcagcaaggagtacgacggcgtcgccatcacgtacgccggtgtcggggtgcgcccgatgctgcaccggaaccgggccgagcagcgcaagaccctcgtcatcctcgacgagatccaccacgccggtgactccaagtcgtggggcgaggcctgcctggaggccttcgaaccggccacccgccggctcgccctcaccggtacgcccttccggtccgacaccaaccccatccccttcgtcacatatgaagaggggaacgacgggatccggcggtccgccgccgactacacgtacggatacgggtccgccctcggcgacggggtcgtgcggcccgtcatcttcctgagctacagcggcaacatgcggtggcgcaccaaggccggcgacgagatcgccgcccggctcggcgagcccatgaccaaggacgcgatcagccaggcctggcgtacggcactggatccgcgcggcgagtggatgcccagcgtgctgcgcgccgccgaccgccggctcaccgaggtccgcaaggccatcccggacgccggcgccctcgtcatcgcctccgaccaggaatcggcccgcgcctacgccaagctgatccgcgagatcaccgggaccaaggcgaccctcgtcctgtccgacgacaccggcgcctcgagccgcatcgacgagttcagccacagcgacgaccgctggatggtcgccgtccgcatggtgtccgagggcgtcgacgtgccccggctcgccgtcggggtgtacgccaccaccatctccacccccctcttcttcgcgcaggccgtcggccgtttcgtacggtcccggcgccgcggcgagaccgcctccgtcttcctccccaccgtccccgacctcctcaccttcgccaacgagatggaggtcgagcgcgaccacgccctcgacaagcccaagaaggagggcgaggaggacccgtacgccgagtccgagaaggagatggaggaggcgaaccgggaggaggacgaggacaccggggagcaggaacagttctccttcgaggcgctggagtccgaggccgtcttcgaccgggtcctctacgacggtgccgaattcggcatgcaggcccacccggggagcgaggaggagcaggactacctgggaattccggggctgctggagcccgaccaggtgcaactcctgctccagaagcggcaggcccggcagatcgcgcacagccgcaagaagccggacgaggaggccgacctcgtcgaactccccgccgaacggcgtcccgtcgtcacgcacaaggagctgctggagctccggaagcagctcaacacgatggtgggcgcgtacgtgcaccagagcggcaagccgcacggagtgatccacaccgagctgcggcgcgtgtgcggcggcccgccgagcgcggaggcgacggcggggcagctgcggcagcggatcgccaaggtgcaggagtgggccacccggatgcgc

SEQ ID NO: 5125 - DNA, 639 bp, Streptomyces avermitilis
  CDS (1)..(639)
gtgaccgcggagacctcccagacgctcgaccggggcctcagggtcctcaagttgctcgccgacacggatcacgggctgaccgtcaccgagctttccaacaaactcggcgtgaaccggaccgttgtgtaccggttgctcgccacgctggaacagcacgctctcgtacgccgtgatctgggcggccgtgcccgggtcgggctgggagtgctgcggctcggccgccaggtgcatccgctggtgcgcgaggcggcactgcccgcactgcgtgcgctggccgaagacataggggccacggcccatctcaccctcgtggacgggacggaggcgcttgccgtcgccgtggtcgagccgacgtggacggactaccacgtggcgtatcgcgccgggttccggcatccgctggaccgcggggccgccggacgggcgatactcgccgcccggcaggcgccggtcaccgagcccggatacaccctgacgcacggggaactggaggcgggggcgagcggtgccgcggcgccgctcctcggtgtgaccggggtcgagggcagcgtcggcgtcgtcatgctcgtggacgccgtgccggagagggtggggccgcgggtcgtggacgcggcccgggaagtggccgaggcgctgcgc

SEQ ID NO: 5126 - DNA, 792 bp, Streptomyces avermitilis
  CDS (1)..(792)
gtgctctctcgcctctctcgcctctcgcgtcccaaggccgtcgccgtctgcgccgtccccgtcgtggcgctgctcgccacggcggtgttcgcgccgctgccgttctccgtggcgcagcccggcatgacggcgaacgtcctcggagagaaccagggcgacgcggtgatcacgatcagcggcgcggcgacccggaagacgaccgggcagctgcggatgacgacgatcgaggcgacgggcccggacgccgacgtgtttctcggcgatgtgctggacgggtggttccgtacggaccgggcggtgatgccgcgcgactcggtctacccgagcgggaacagcgtcaaggagatcgagcagcacaacgcggcggagatgcagcagtcgcaggacacggccgcccaggcggcgctgtcctacctgaacgagaagaacgtgaaggtcacgctcaagctggccgacgtcggcggccccagcgcgggactgctgttctccctcgggatcatcgacaagctggacggcgacggcagcggcggcgatctcacgggcggccgcaccatcgcgggtacgggcacgatcgacgcgaacggaaaggtcggcgcggtcggcggggtcgccctgaagacccaggccgcccggcgtgacggggcgacggtcttcctggtgccgaaggcggagtgcgcggacgcgaagtcggaactgccgaagggcctgcgactggttccggtgaccacgctgaagggcgcggtcgacgccctgacgaacctggagaaggggaaggactcggtccccgcctgc

SEQ ID NO: 5127 - DNA, 636 bp, Streptomyces avermitilis
  CDS (1)..(636)
ttgcaacagagtctttgcaacgctatctttgtacgcatgacggaggagcaggaacggcctcagaagccgcagcagcagtaccgcaccctcgacgcccgctcactgcgcggcctcgcccaccccctgcgtatgcagctgctgagcgcgttgcggcagcgagggccggccaccgcgtcgcagctcgccgagcgcctcggcgagtccagcggggcgaccagctatcacctgcgacagctcgccgcccacggcttcgtcgtggacgcccccgagcacggcaaggggcgggagcgctggtggaaggcggccgacgagggcctggacttcgacgacgcgctgctcaaggaccccgacccggccgtgcgcggcgccgccgacgtgttcctgcatgaggtcgcgacgacacacgccagggagctgtcgacctggctgggcacccgcaacgactggtcccggcagtggatcagggccaccgacatgagcgacatgacgctacggctgacacccgacctcgcccgcgaactgatccgcgagatgcacgacctggtcgagagttaccgcgcgctggctcccgccgagggcacccccgacgccgagcaggtgcgcatccacacgcacgccttccccttcaccacgaac

SEQ ID NO: 5128 - DNA, 960 bp, Streptomyces avermitilis
  CDS (1)..(960)
atgaggcgcgggtgtctgctgctggccggggttctggtggccgccgccggctgcgggctgaccagcggctccccgatggtcgacgacgtcaggcccggctcgatcggcaagggcgagccattgaagggcgcgcatctcacggtcacgtcgaaggagttcaccgagcagctgattctcggcgcgatcatgggcatcgcgttccaggcggccggcgcggacgtcctcgaccgcaccgggatccaggggtccgtcggcgcgcgcgaggcggtcaagaacggggacgcggacggcatgtacgagtacacgggcaccgcctggatcacgtacctgggcaacagcgagcccatcaccgacccgctgaagcagtggcaggcggtgcgtgacgcggacctgaagaacggggtgacctggctggcgccgtccaccctcaacaatacgtacgcgctcgccatgaaccaggccaacttcaagaagtacggcacgaagacgctgtccgacgtggcggcgctcgccaagcgggacccgaaggccgtcacgctgtgcgtggagagcgagttcgccaaccgcgcggacggactgccgggcatggagaaggcgtacggcatgaagctgcccgcggccgacatcacgcagatggacaccgggatcatctacacccaggtggcgaaggggagttgcacgtacggggaggtgttcaccaccgacgggcgcatcaagtcgatgaacctggtggtgatgcgggacgacaagaagttcttccccaactacaacgtggcgcccgagatcaacacgaaggcgctgaagaagtatccggcgatcgccgaggtcctcgaccccgtcacgaggaaactcgacaacacggtggcccaggacctgaacgccaaggtggacgtggacggacaggacccgcaccaggtggcgttggactggatgaaggaggaggggttcgtcaagggaggg

SEQ ID NO: 5129 - DNA, 828 bp, Streptomyces avermitilis
  CDS (1)..(828)
gtgacgactccccggctggacgaggacgggaccgcgcggcgggaggaggacggagccgaggccgctccggctcccccggcaaagccccgcaccgctcggctcacctggcagaagctcaccgttctgcccaccgtcctcacggccttgctgctcgccacctgggtgtggttccagcaggcgcgcctggacccgctctccgagaacgcgctgtcgaacgggcaggtgtcgaaggccctgtggcagcacatccagctcaccgcgatctccacgttcttcgtgctgatcatcgcgatcccgctgggcatcctgctcacccgcagggccttccgcaaggcgaccccgatcgcgatgaccatcgcgaacatggggcaggcgacccccgccatcggtctgctggcgctgctggtgatctggctgggcaccggccagaaggcggccctgatcggcatcatcatctacgcgatcctgccggtcctggccaacacgatcgccggtctgaaggcgaacgatcccacggtcctggaggcggcgcgcggcatcggcatgtcctcgccgggggtgctcacccggatcgaactcccgctggccgtaccgctgatcctcgcgggcgtacgcaccgccctcgtcctgaacgtcggcacggcgaccctcgccaccttcggcggaggcggcggactcggggtgctgatcaccaccggcatcacgaaccagcggatgccggtactggtcctcgggtcgatcctcacggtctcgctggccctgctggtcgactggctcgcctcgctggcggaagtgctgctgcggccgcgcgggctggaggtggagaca

SEQ ID NO: 5130 - DNA, 1311 bp, Streptomyces avermitilis
  CDS (1)..(1311)
gtgcctgacgtgtccgggacgtccaccgaaacccctgccgacgagggtccgaccgccggcgccccggccaccggggccccggccccgacctccggcgccaccatcgagctggagaacctgaccaagcgctatccgggcagccacgagcccgcggtggacagcgtcaacatgcacatcaaggccggcgagctggtcgtcttcgtgggcccttcggggtgcgggaagtccacgaccctcaaaatgatcaaccggctgatcgaaccgaccggcggccgcatccgcatcggcggcgaggacgtcaccgacatggacccggtgaagctgcgccgcaagatcgggtacgcgatccagtcctccgggctgttcccgcacatgacggtcgcccagaacatcgcgctcgttccgaagatggccggctggccgggctcgcggatcaaggcgcgggtcgaggagatgctggacctggtcggcctcgacccggcggagttccacgggcgctatccacgtcagctctccggcggccagcagcaacgcgtgggggtggcgcgggcgctcgcggccgatccgccggtgctgctgatggacgagccgttcggcgcggtggacccgatcacccgcgatcacctccaggacgagctgatccgcctccagtacgagctgcacaagacgatcgtcttcgtcacccacgacttcgacgaggcgatcaaactgggcgaccggatcgccgtcctgcgcgaacggtcgcacatcgcccagttcgacaccccggaggcgatcctcaccaaccccgccgacgacttcgtgtccgggttcgtgggtgcgggcgccgcgctgaagcggctgaacctcacccgcgtacgggacgtggagatccacgactacccggccgtgaccgtcgacgatccgctccaggagatcttcggcaagctccggtcgtccggtacgaacgagatcctgctgctcgaccggcggcgccgcccgtacaagtggctcaggcgcggtgacctcatgcgcgccaaagggtcgctggcccgcgcgggcaccctggtgtccgacacggtgaccagggacgccacgctgcgggacgccctggaggcggtgctcacggacaacgcggggcgggtcgcggtgaccgggcggcgcggggagtacacgggcgtggtggacatggagacgctcatcaactccgtgcacgagatgctggaggccgaccggctcgacgcgatggagcaccagcacgagctggaggaggcacgggcccagcagacgcacgcggagcaggagggcgtcgacgccggggaggagaaggcg

SEQ ID NO: 5131 - DNA, 645 bp, Streptomyces avermitilis
  CDS (1)..(645)
gtgaacttcctggagtacctcggcagccaccgccaacagttgctcacggatgcctaccagcacgccagcgccgtcttccagtgcatggtcgtcgcgaccgccatcggtgtggtggtcggcgtcgtcacttatcgcagcgaatgggccggaaacctggcgaccacgaccacgtcgaccattctgaccatgccgtcgctcgccatgatcggtctgctgatcccggtcgtgggtctcggcgtcccgccgaccgtcatcgcgctcacgctgtacgggctgctgccgatcgtccgcaacgcgatcgtgggcctgcgcggggtcgatccgtcgctggtcgacgcggcgacgggcatcggcatgtcccgtgccgcccggctgctgcgggtcgagctgccgctcgcctggccgccggtcctcaccgggatccgggtctccacgcagatgctgatgggcatcgccgccatcgccgcgtacgcctcgggacccgggctcggcaacgagatcttccgcggcctcgcctccctgggcagcaagaacgcgctcaaccaggtgctcgccggcacgatcgggatcatcatcctcgcactgctgttcgatgccgcgtacgtcctcatcggacggctgaccatcccgagggggatccgtgcc

SEQ ID NO: 5132 - DNA, 510 bp, Streptomyces avermitilis
  CDS (1)..(510)
atgtacaggatgaccactggaggggctgccgtggcgatcgatcatctggacggccggctcctggtgctgctggcgcgggagccgcgcatcggagtgctcgagatgtcccggcggctcggggtcgcgcgcggcaccgtgcaggcgcggctcgaccggcttcagtcgaatggagtcatccgcggcttcggaccgcaggtggacccggcggcgctcggatatccggtgacggccttcgcgacgctcgagatccggcaggggcaagggcccgacgtacgggcgcacttgacgaccgtgccggaggtgctggagctgcatacgaccacgggcagcggcgacatgctgtgccggctggtggcccgctcgaacgccgatctccagcgtgtgatcgaccgggttgtcggctttgatggcatcgtccgggccgccacggcgatcgtcatggagaaccccgttccgctgcggatcatcccgctggtggagcaggccgcggaggaccgcgaccgacgggag

SEQ ID NO: 5133 - DNA, 1143 bp, Streptomyces avermitilis
  CDS (1)..(1143)
atgacgcagaccacacaccacactcccgacaccgcccggcaggccgaccccttcccggtgaagggaatggacgcggtcgtcttcgccgtaggcaacgccaagcaggccgcgcactactactccaccgccttcggcatgcagcttgtggcgtactccggaccggagaacggcagccgcgagaccgcttcgtacgtcctcaccaacggctcggcacgcttcgtcctcacctccgtcatcaagcccgccaccccctggggccacttcctcgccgaccatgtggccgagcacggcgacggcgtcgtcgacctcgccatcgaggtcccggacgcccgcgccgcccacgcgtacgcgatcgagcacggcgcccgctcggtcgccgagccgtacgagctgaaggacgagcacggcacggtcgtcctcgccgcgatcgccacctacggcaagacccgccacaccctcgtcgaccggaccggctacgacggcccctacctccccggctacgtggccgccgccccgatcgtcgaaccgcccgcccaccgcaccttccaggccatcgaccactgcgtcggcaacgtcgagctcggccggatgaacgaatgggtcggcttctacaacaaggtcatgggcttcacgaacatgaaggagttcgtgggcgacgacatcgcgaccgagtactcggcgctgatgtcgaaggtcgtggccgacggcacgctcaaggtcaagttcccgatcaacgagcccgccctcgccaagaagaagtcccagatcgacgagtacctggagttctacggcggcgcgggcgtccagcacatcgcgctgaacacgggtgacatcgtcgagacggtacgcacgatgcgcgccgccggcgtccagttcctggacacgcccgactcgtactacgacaccctcggggagtgggtgggcgacacccgcgtccccgtcgacaccctgcgcgagctgaagatcctcgcggaccgcgacgaggacggctatctgctccagatcttcaccaagccggtccaggaccgcccgacggtcttcttcgagatcatcgaacgccacggctcgatgggattcggcaagggcaacttcaaggccctgttcgaggcgatcgagcgggagcaggagaagcggggcaacctg

SEQ ID NO: 5134 - DNA, 1587 bp, Streptomyces avermitilis
  CDS (1)..(1587)
atggagatcgaacagcaacagccgttgccctccgagcggggcctgtcccctgttgccaggcgtgccctgatcggcgcgatcaccgggtgtttcgtcctcggcggggtgctgatgctgctgccgccggccgggcgggaacccgcggcgccgccggcgcctgcggcgggcccgatggcggggccggtggcgcaggcgaaggcggccgtgggggccggggtgcccgtcgcgctgcccgcgctggcggcgctcgtcacggatcacgagacacatctgcgggcccatccgcgggacgcgcggtcgtgggcggtgctcggggccgcgtacgtcgcgcaggggaaggggacggccgacgccgcgtacttcccgaaggccgaggaggcgctgcgtacgtcactgaacgtggcgccgcgccggaacgccgaggcgctgggcgctctcgccgcgctggcgaacgcgcgcggggactaccgcgaggcgaagcagtggggggaggcggcggtgaagatggcgccgaagcagtggccggcgtacgcgcagctgatcgacgcgtacgacggcctcggcgactacaaggccacggggaagacgctggacaagctgctcggcctgcgcgcggggccggcggcggcggcgcgggccgctcaggtgtaccgggcgcggggctggcgcgaggacgcggcggcggcgatcgcggacgcgacggcgcgggcgggcagtccggcggagcaggccgtgtactggcagcaggcgggcgagctggcgtgggagcgcggggagccggagcaggcgctgcggtacttcgagacggcgttgcggacggatcccgaccggcacgcggcgctggccgggcaggggcgggcgctggccgcgctggggcggacgtcggacgcggtgaacgcgtaccgggccgctctcgcgaagcagccgttggccgcgtacgcggtggagctgggcgagctgtacgagtcgcaggggctcgggggtgcggcgcaggtgcagtactacctggtgcgggagcgggtgcggcaggacgcggcgggcggcgtgaacaaccgcctggtggtcgggcagttcgaggccgaccacggggatgcggaggtggcggtacgggagttgcgggaggagtggaagcggcagccgagcatccgggtggcggacgcgctggggtgggcgctgcaccgggcggggcaggaccaggaggcgctcggcttcgccacgaaggcgatggacaaggagcacgggggcggggtgcgcagcgccctgtacgcgtaccaccgcggcgagatcgaacgggcgctcgaccagctggcaccggcgcggcgccatctggccgaggcgctgcggatcaaccctcacttctcgccctggttcgctccgatggcgaaggagacactagccgaactcggggagccgcccgcggaggggctgccgggtgacgaggaagtggaggccgctgaggccgaggccgccgaggccgcggaggccgcgcagacgccggaggccgcggagtcggtggatcccgcgcagacggagcaggtgccgcccccgggcgcgtcgacgccggttccgcaggagccggaggcccgc

SEQ ID NO: 5135 - DNA, 1413 bp, Streptomyces avermitilis
  CDS (1)..(1413)
gtgatcatgagccgtagcgaaacgtcgcccgacgaagatccaccagcgaccggcaacctcgtggaccgcctgctgagcggtctgcccgcagaggccctcctcaccgacccggacgtcacggcctcctacgcgaacgacatggcgagcttctgcgcggcgggcaccccggccgtcgtggtcctgccccgcacggtggaacaggtccagcacgtcatgcgcaccgccaccgagctgcgcgtcccggtcgtcccgcaaggcgcccgcaccggcctgtcgggcgccgccaacgcctcggacggctgcatcgtgctgtccctcaccaagatggaccacatcctcgagatcagtcccgtcgaccggatcgccgtcgtcgaaccgggcgtgatcaacgcgacgctctcccgcgccgtgggcgaacacggcctgtactacccgccggacccgtcgagctgggagatgtgcaccatcggcggcaacatcggcacggcctccggcggcctgtgctgcgtgaagtacggggtgaccgccgagtacgtcctcggcctggacgtcgtcctggcggacgggcggctgatgagcaccggccgccgtaccgcgaagggcgtcgccgggtacgacctcacccgcctcttcgtcggctccgagggctccctcggcatcgtcgtacgggccaccctggcactgaggccgcagccgccccagcagctggtgctggccgccgagttcgcgtcgaccgccgccgcctgcgacgcggtctgccggatcatggcgggcggacacgtaccgtccctcctcgaactgatggaccgtacgacagtgaaggccgtcaacgccatggcgcacatgggcctccccgagaccaccgaggcgctgctgctcgccgccttcgacaccctcgacccggccgccgacctcgccgcggtcggcgcgctctgcgaggccgcgggcgccacccaggtcgtccccgccgacgacgccgccgagtccgaactcctgctccaggcgcggcggttgtccctcaccgcactcgaagcggtcaagggcacgacgatgatcgacgacgtgtgcgtaccacgctcgcggctcggggccatgctcgagggcgtcgagcggatcgccgagaagtacgccctgaccatcggggtctgcgcccacgcgggcgacggcaacacgcaccccaccgtctgcttcgacgccgccgaccccgaggagtcccggcgcgcccgcgagtccttcgacgagatcatggccctcggcctggagctcggcggcacgatcaccggggagcacggcgtgggcgtcctgaagaaggagtggctggcccgcgagatcggcccggtgggagtggagatgcagcgggcgatcaagacgacgttcgacccgctgggcatcctcaacccgggcaagctgttc

SEQ ID NO: 5136 - DNA, 1608 bp, Streptomyces avermitilis
  CDS (1)..(1608)
atgagcgccccaaccccggcccccggtgacgacaggccccgcgaagggtattacccggacccgtccattcctggatatgtccgttactggaacggcaccgcctgggtgccgggttcgagccgtccggcgccgtcggacggcgaaccgctcgcgcccccgcccggcgcgcggcacgccccggcctccgtcgaggagaccgggccgcacttcttcgacgaggaccccgagcccgccgccgactcccggcgggtgagcccggccgaggcccagcacggcagcaggcccgagcccgcctccgcctggggcgccgagcgcgcccggcagaccggcttcggcggcgacccggaccgccgggtctcctggggcgcgccgcagggcgccgacccgcgcgtcccgcgggccgcggacccggccgacgcggcgccccgccccgacggccgggcgggacacccggacggcaccgcacgtacggacgggacggcgacgattccgcccgcggaagccgatggttccggttccgcgcagccgccggcctccgccggcacggtggtcttccggcggcccggccacggcgacggtgacgcgggcccgcgtgacacctccggccaccagggcaccggccccgccgagggcaccatgacgttccgcgcgcggtccccgcgcacgggggagcaggacgggagcacgccgccggccgccgccgaacagcccttcgccgcgtccccgccgagcgctcaggccgcggcacggcaggccctgggcctggaccccgaggcgccgcccgcaggcccgcagcaggccggaccgcccccgcagcgggccgcctcggccccgcgcccgggcggcccccagccgtccgcgccgcagcccgcgctgccgccgcagcaggccggctcccactcccagcaacccgccggctccctctccccgcagccgtctcccaccgtcccgccacaggccggcggcggggccttctcggcgacgcccatgacgagtggcgacggtggcggccagccctcctgggcgcagcaggtgcaccgactggcggggcccgagggcgagcagcccgtcgccccgtggaagccgccggtcgacgacatcttccaggcggccgcacgcgcccacgcggcggcgcggcccgccgggctcggcaagcggctggcggcacggctggtggacaccctggtcctggcgacggtcacgggcgtggccgcggtaccgctcggcaccaaggcgatcgaccacatcaacgacaaggtcgacgcggccaagctctccggcgagaccgtcacggtctggctgctcgacggcacgaccgcggtctacctcggcatcgtgctgggcgtgctgctcctgttcggcgtcctctacgaggcgctgcccaccgccaagtggggccgcacgctcggcaagaagctgtgcggtctggaggtccgggacatcgagggccacgaaccgccgtccttcggcctggccctgcgccgctggctcgtctacagcgttcccggactgctcggcatcggtgtcgtgggcgtcctgtggtgcctgttcgaccgcccctggcggcagtgctggcacgacaaggcggcccatacgttcgtggcggga

SEQ ID NO: 5137 - DNA, 444 bp, Streptomyces avermitilis
  CDS (1)..(444)
atgcccccgctcgccgacagcggcaagcgggtgctcgccaggatcatcgacatgatcctcgtgggcatcgtggtggtgctgctgtcctgggcgttcggcttcagcccgtactcgctgaacgcggacaggatgacgtccgccggcgcgttcgggcgggaggtgatcgccgccgtcctctacatcgcgtacgacaccttcctgatctccaagtcggggcagacgctcggcaagaagctgctgaatctgcgcgtcgccaatctcgacaacggcgccacgccctccatgcagacctccctgatccgcgcggccgtcctgtggatcccgttcgcgttctgctgcgcctgcatctggaccgcgatcgcgggtggttggagcttcttcgacaagccctacaagcagggcctgcacgacaaggcggcgaagacggtggtggtcagcaccggt

SEQ ID NO: 5138 - DNA, 282 bp, Streptomyces avermitilis
  CDS (1)..(282)
atggccatgcctcgtccgaccgccgcacagctcgcctacggttcctgcaccgtgatcttctccaccctcgccatgctgctgctgtcacagacgagttcgggcctggggatcgccgtgatcgccctcgccgcgctcgccctcggactgctcgtggccctgacggttcccgtaccgaagccggcgcccgccgccgtcgtctcgcggccggccacaccggaagaacgtgttccggtccagcgcgagacagcttccgtcgccgccggggccgagccgacgggttcc

SEQ ID NO: 5139 - DNA, 2343 bp, Streptomyces avermitilis
  CDS (1)..(2343)
gtgaccagcagaccctggacgttcagagcgaccgcgatcggtgtcgcactcgcggcggccaccgccacgttctcgacgttcgccgtggctcaggccgacgacgccaaagccacgaccagcgtggaccggcgcgacccgcagccggccaagaccaaggtcgaccacgacctcgacggcccgctgagcaagacccgggcggcccagcgccaagaggctctgaaccaggtcatatccggcgacgccaaggtgcagaaccgcggcggctcgcaggtcgtgaagctcaagagcaagaagggcgacagcaagtacgtcgagctgggccgggagcagacggaccagatcttcaccgtcctggtcgagttcggcgacaagatcgacagcacgtacggcggcaccgccggcccgctgcacaacaagatcgccgcgcccgaccgcaagaaggacaacagcacggcctggcaggcggactacaaccagaagcacttccaggacctctacttcggcaccggcaagaagaccgagtcgctgaagaagtactacgagaagcagtcctcgggccgctactcggtcaacggcaaggtcagcgactgggtcaaggtcccctacaacgaggcccgttacggctccaacaagtgcgacacctgcgcgtggaacgccgtcgccgacggtgtcaccgcctgggtcgccgcccagaaggcggccggcaagtccgacgcggccatcaaggcgaccctggcgcagtacgaccagtgggaccgctacgacttcgacggcgacggcaacttcaacgagcccgacggctacatcgaccacttccagatcgtgcacgccggcgaggacgagtccgcgggcggcggcgcccagggcgaggacgcgatctgggcccaccgctggtacgcgttcggcaccgacgcgggcgccacgggcccggccggaaacaagctcggtggcacgcagatcggcgacagcggcatctgggtcggcgactacaccatccagccggagaacggcggactcggcgtctacgcccacgagtacggccacgacctgggcctgccggacgagtacgacacctccggtggcggcgagaacggcaccggcttctggacgctgatgtcggccggctcctggctcggcaccggcaagaacgccatcggcgacctgcccggtgacatgggcgcctgggacaagctccagctgggctggctgaactacgccaaggcgaaggcggcgacgaagtcgacgcacaagctgggtgtcgccgagtacaacaccaggaacaagcaggcgctggtggtctcgctgcccgacaaggcggtcaagaccgaggtcgtcgccccggcgcagggcgccacccagtggtggagcggcagcggcaacaacctcaagaacacgctgacccgttcggtcgacctgaccggcaagtcgaaggccacgctggacctcgacggctggtgggacatcgagagcggctacgactacctctacgccgaggcgtccaccgacggcggcgccaactggaccgcgctcgacggcacggcgaacggcaccgccatcccgcgtgacggcagcgacaagcccgccctcaccggttcgaccgacgcgtacaagaagctgtcgtactcgctggacgcctacgcgggccagaaggtcgacgtccgtttccgctaccagacggacggcggcgcggcgcagaagggcttcgccgccgacgagatctccgtgaccgccgacggcacggctctcttctccgacaacgcggagaccgcggacgcggcgtggacggcctccggcttctcccgcatcggcgcgtccttcacgaaggactacgcgcagtactacctcgccgagaaccgccagtacgtctcgtacgacaagaccctcaaggtcggcccgtacaacttcggcttctcgacgacgcgtccggactgggtcgagcactacccgtaccagaacggtctgctggtctggctgtgggacacctcgcaggcggacgacaacaccagcgtccacccgggtcagggtctgatcctgccggtcgacgcgcacgccaaggcgctgaagtgggccaacggcacggtcctgcggaacaagatccaggccttcgactcgaccttcagcacgtacaagaccgacgcgttcacgctccacaacgccgacgtcgcgctgaagatcaagtcgcacaagggcgtgccggccttcgacgaccggaagggctcgtactacgacgcggcgaacccgttcggcagcgtcaaggtcactgacaccaacaccaagatcaagattgtgaaggagccgaaggatggctcgacgatcacggtccaggtgggcaagtcgacgaag

SEQ ID NO: 5140 - DNA, 381 bp, Streptomyces avermitilis
  CDS (1)..(381)
atggccgcaggaggcttctgcaagctgccgaacggaagcgtggtggtggcactgaacctgcccagcccgcccggctcgggcacggccgtcgccctcggcgccggtgccgccatgggcaccgccacggactgcgtccgcgtcctcgtactcgcccagaaccgggcccgcgcgctgacccgcctgcgcaacctgggcatgcgcgcggtctacctgcgaggcaacgcggcacccccgaccccggacgaaatcacggcggtcctgcaccatcccgacggcctgctgtggcgcacggccccggacagcggcgtcacacccccgggaccgaccacagaactctggcacccgatcagagcgctcctgcgccgcccggcaccgcaggcg

SEQ ID NO: 5141 - DNA, 582 bp, Streptomyces avermitilis
  CDS (1)..(582)
atgcgccgcgccttgatcgtcgtagacgtgcagaacgacttctgtgaggggggcagcctcgcggtggccggaggtgccgatgtggctgccgcgatcaccgagctgattgggcaggcgcccgccgggtaccgccatgtcgtcgccacccgcgaccaccacgtcgcgcccggcggccacttcgccgacaaccccgacttcgtccactcctggcccgcgcactgtgtggcgggcacggagggggtcggcttccacccgaacttcgcacccgccgtcgcctccggcgcgatcgacgccgtgttcgacaagggcgcgtacgcggcggcgtacagcgggttcgagggcgtcgacgagaacggggtgtcgctgggcgactggctgcgggcccgggagatcggcgaggtggacgtggtggggatcgccacggaccactgcgtgcgcgctaccgcgctggacgccgcgagagaggggttccgcacccaggtgctgctggacctcacggccggcgtggccgaggaatccacggagcgggcactggaggaactgcgctcggcgggcgtggaactctcgggcaagccggtggtg

SEQ ID NO: 5142 - DNA, 1326 bp, Streptomyces avermitilis
  CDS (1)..(1326)
gtgaacccagcggaccttgggctgccggtggatgttccgtcgacggcactcttcaccgaccagtacgaactgacgatgctccaggccgcactggccgccgggaccgccgaacggcgctcggtcttcgaggtcttcacccgacggctgcccgaggggcggcggtacggcgtcgtggccgggaccgggcgcgtcctggacgcggtcgagaacttccgcttcgacgccgccctcctcggcttcctgcgcgagcggcggatcgtggacgagccgaccctggagtggctcgcctcgtaccgcttccggggggacatctggggctaccccgagggcgaggtctacttcccgggctcgcccctgctgcgggtcgagggctcgttcgcggagtgcgtgctcctggagaccgtgatcctgtccatcctcaaccacgactcggccatcgcggccgccgcctcccgcatgtcctccgccgccggtgcgcgcccgctgatcgagatgggcgcccggcgcacccacgagctggccgccgtcgccgccgcgcgggccgcgtacgtcggcggcttcgcgaccacgtccgacctggccgcgggcttccggtacgggattccgacggtcggtaccagcgcgcacgcgttcacgttgctgcacgacaccgagcgggacgccttccgggcccaggtggactcgctgggccggggcacgacgctgctcgtggacacgtacgacgtcgccgaggccgtacgcatggccgtcgagatcgccgggcccgagctcggtgccgtgcgcatcgactccggggacctgctgctcgtcgcgcaccgggtgcggcagcagctggacgacctgggcgcgaccgaaacgaagatcgtggtgacctcggacctggacgagtacgcgatcgcctcgctggccgcggcgcccgtggacgcgtacggcgtcggcacccagctggtgacgggatccggccatccgacatgttcgatggtctacaaactggtggcccgcgcccactcggcggacccggcggctccgctggagccggtggcgaagaagtcgaccggcgggaagacctccatcggcgggcggaagtgggcagcgcgccggctcgacgagcacggggtggccgaggccgaggtgatcgggacggggcccgtgccggccggtctggagggccgtcagctgctcgtggagctgataaagggcggccaggtcgtcgcccgcgagtccctcgacgtcgtacgggaccggcacgcggccgcccgtgccggtctgccgttgtcggcgaaccagctgtcgcgcggggagccggtgatcccgacggagtacgtg

SEQ ID NO: 5143 - DNA, 315 bp, Streptomyces avermitilis
  CDS (1)..(315)
atgggccgtgtgacggctcccgcacccctagagatcgaaaagaccgagtcggcagaggaggtcttcgccgtacctgagccggatgtcccctgggtgacgatcgtccacaacgaccccgtcaacctcatgagctatgtgacgtatgtcttccagacgtacttcggctactccaaggacaaggccaccaagctcatgctcgacgtccaccacaagggccgcgcggtcgtgtccagcgggacgcgtgaggagatggagcgcgacgtgcaggcgatgcacggctacggtctgtgggccacccttcagcaggaccggaag

SEQ ID NO: 5144 - DNA, 603 bp, Streptomyces avermitilis
  CDS (1)..(603)
atgccaggacacttcgaaccgctccccggcggcggcgcggccgtcgcactcgacgaggtcgagatctccatcatccgctcgctcgcggtccagctcctggagctgatcggcccgggccccgcggaggacgccgccgccgacccgctcgccgaactgttcgccgaggggccgagcgagccgccctccgaccccgtcctccagcgcctcttcccggacgcctacggcggccccggcggcgagggaggctcgcccgaggaggccgaggagcagcgtgcgcactcctcggagttccgccgcttcacggagaacgacctgcgcgcaggcaagcgcgagaacgccctcgtggtgatccgcaccctggacgggatgacggtcgcgggggagggcggcgcggtcctcaagctgtcgccggaggagtcccggcagtggctgggctcgctcaacgacctgcggctggcgatcggctcccggctcgacgtcgtcgacgaggaggacaccgacctcctctaccggctgccggacgaggacccgcgcaagccgatggtgatggcgtatctctggctcggcgggttgcaggagaccctgatcgagacccttatgtcc

SEQ ID NO: 5145 - DNA, 1449 bp, Streptomyces avermitilis
  CDS (1)..(1449)
atgacctcatcgcaggtcgacaagcagtacgacggcaatggggccgtgggcggcgacgcccccgaagaggggtacgagcgcgggctcggcagccgccaggtccagatgatcgcgatcggcggcgccatcggcgtcggcctgttcctgggcgccggggcgaacatcgccaaggccgggcccagcctgatcctcatgtacgccctcgcgggcgtgatcatcttcttcatcatgcgggcgctcggcgagctgctcctgtaccgcccggtgtcgggttccttcgcggagtactcccgcgagttcctcggcccgttcttcggctacttcaccggctggacgtactggctgatgtgggtggtgaccggcatggcggaactgaccgccgccgcgatctacgtccactactggttcccggccgtcccacagtgggtgacggccctggtcttcctggtcgtcctgttcgtggccaacctgatctcggtgaagctcttcggcgagatcgagttctggttctcgatggtcaaggtcaccgcgctcatcggcatgatcgtgatcggcctcggtgtgctcaccttcggcttcagctcggccggtgacaccgcctccgtcgccaacctctggcagttcgacggcttcttccccaagggcatcggctcgtccctgatgaccctccagggcgtcatgttcgcctacctggccgtcgagctggtcggtgtgacggcgggcgagtccgaggacccggagaagaccctcccgaaggcgatcaacaccctgccctggcgcatcgccctcttctacgtgggtgccctcaccgtcatcctctgcgtcgtgaagtggaccgagttcgcgcccggcgtgagcccgttcgtcaaggccttcgcgatgatcggcatcccggccggcgcgggcatcgtcaacttcgtcgtcctcaccgcggccctgtcctcgtgcaactccggcatgtactccacgggccgcatgctgcgcacgctcgcggacaacggcgaggccccgagggtcttcagcaagctctccgcctcgaagacgcccgccttcggcatcacgatctcggtcctcttcatgggcatcggcgtgatcctcaactacgtcgtcccggagaaggccttcggctacgtcacctcggtggccaccgcggccggcatctggacctggctgatgatcctggtcagccacgtcctgtaccgccgcgcggtcgacgcgggccgactgcccgcgtcctccttcccggcaccgggcggcgcgaagtgcagctgggtcgcgatcgtgttcctgctcttcgtgaccggcctgatcgcgtacgacgccgactcccgggtctgcctctacgtgatggccgtctgggccgccgcgctggccatcggctggtacgtcctcaaggcccgcaacccgcaggtcgccgagcgccacgagccgaagttcgagaaggtcggc

SEQ ID NO: 5146 - DNA, 420 bp, Streptomyces avermitilis
  CDS (1)..(420)
atgctgaccatcacccaggccctcgtcgaccagatcgtcgcgcacgcgcgccaggaccaccccgacgaggcgtgcggcgtcgtcgcgggcccggagggctccggccgccccgagcgcttcatccccatgctcaacgcggcccgctcgcccacgttctacgagttcgactcgggcgacctgctcaagctctaccgcgagatggacgaccgcgacgaggagccggtgatcatctaccactcccacaccgcgaccgaggcgtacccgtcccgcaccgacatctcgtacgcgaacgagccgggcgcccactacgtcctcgtctcgacggcggacgcggacgacgcggggccgttccagttccgctcgttccagatcgtggcgggcgaggtgacggaggaggaggtcaaggtcgtcgaggcctac

SEQ ID NO: 5147 - DNA, 285 bp, Streptomyces avermitilis
  CDS (1)..(285)
atggccatcgaggtccgcatccccaccatcctccgcacctacaccgacggtgcgaaggccgtagacggcaccggtgagaccctcgccgagctgttcaccgacctcgacacccgccacgcgggcatcagggcccgcatcgtcgacgaggagaagggcggcgagctgcgccgcttcgtcaacgtctacctgaacgacgaggacgtccgcttcctggacggcatcagcaccaagctcaccgacggcgacaacgtgacgatcctgccggccgtggccggcggcatggtc

SEQ ID NO: 5148 - DNA, 948 bp, Streptomyces avermitilis
  CDS (1)..(948)
atgcgctacgactccccgctcgccgcggtgggcaacacccctctggtgcgcctgccgcggctctcgccgtccgaggacgtgcggatctgggccaagctggaggaccgcaacccgacgggctcggtcaaggaccgccccgcgctccacatgatcgaacaggccgagaaggacgggcggctgacaccgggctgcacgatcctggagccgacgagcggcaacacgggcatctcgctcgccatggcggccaagctcaagggctaccgcatcgtgtgcgtgatgccggagaacacctcgcaggagcgccgtgacctgctgggcatgtggggcgccgagatcgtctccagcccggcggccggcggctccaacacggcggtccgtgtcgccaaggaactggcggccgagcacccggactgggtgatgctctaccagtacggcaacccggacaacgcgggcgcgcactacgcgaccaccgggcccgagatcctcgccgacctgccctccgtcacccacttcgtcgccggcctcggcaccaccggcacgctgatgggcgtgggccgttacctgcgcgagcagaagccggacatcaagatcgtcgccgccgagccgcgctacgacgacctggtgtacggcctgcggaacctggacgagggcttcgtccccgagctgtacgacgcgtcggtgctgaccacccgcttctccgtcggctccgcggacgcggtgacccgcacccgggagctgctccagcaggagggcatcttcgcgggcgtctccacgggcgcggcgctgcacgcggcgatcggcgtgggcaacaaggcggtcaaggcgggggagacggcggacatcgtcttcgtggtcgcggacggcggctggaagtacctgtcgacgggcgtctacaccgcggccacgacagaagaggcgatcgcgacgcttcagggacaactctgggcg

SEQ ID NO: 5149 - DNA, 444 bp, Streptomyces avermitilis
  CDS (1)..(444)
atggacacgtcatggtggctggcgctggcggcggtggtgctgctcgcgctcgtcgcgacgctcgtcgacggctgggggcgccgcgggcgcaggccgtccgggcgtacgcgtccgccggggcatccgggcgcgcccgggcggccgcagcccgccgagatctggtgggcgaacgtgccctacgaggaaggggccggcgtcaaggaccggccctgtctggtgctggcggtgcggggcggccgggcgacggtcgcgaagatcaccagcaagtaccacgacgagcgggcgggcgtgatcccgctgccaccgggggccgtgggcgacgcccatgggagggcgagcttcctggagacggacgagctgcgggacgttccgctgcgggagttccgccggcgggtgggggtggtggatccggtgctgtgggatcaggtgcggtatttggcgggg

SEQ ID NO: 5150 - DNA, 750 bp, Streptomyces avermitilis
  CDS (1)..(750)
atgaagctcaccgtcgtcggctgctcggggtcgttcccgtccgcggaatcggcctgctcgagctacctcgtagaggccgacggcttccggctgctcctcgacatgggcaacggcgccctcggcgagttgcagcgccactgcggtctctacgacctcgacgcgatcttcctcagccatctgcacgccgaccactgcatcgacatgtgcgcgtacttcgtcgcgcgctactaccgtcacgacggcggccgctgcgccccgatcccggtctacggacccgagggcacggaacagcggctgaccaccgcgtacgcggacactccttccgcctcctcgatgagcgaggtcttcgacttccacacggtgaagccgagcacgttcgacatcggccccttcaccgtgcacaccgagaaggtgcggcaccccgtggaggcgtacgccatccgcatcgaacacggcggccgctccctgacctactccggggacacgggcgtgaccggggccctcgacgaactcgcccgggacaccgacctgttcctgtgcgaggccgcgttcacgcacggcaaggagagcatcccggacctgcacctcaacggccgcgaggcaggcgagaccgccacccgcgccggtgcccgccgcctggtcctgacccacatccccccgtggacggacccccaggtgaacctcgccgacgcccgcgagacgttcaccggtcctgtggagctggcggcgccccggctgtcgtacgagatc

SEQ ID NO: 5151 - DNA, 1266 bp, Streptomyces avermitilis
  CDS (1)..(1266)
gtgtccacggccagcgccgctcccgcggccgagcagaagaagaagggctccggcgcgatggctgtcctgcagcgcatcggccgcagcctgatgctgccggtcgctgtcctgcccgccgccgccctcctggtgcggctcggcaacgccgacatgctcgggcgcccgtccttcccctcgttcttcaccaagatcgccggattcatgtcggcgggcggcaacgcgatcctcgacaacatggcgctgctgttcgccgtgggcatcgccatcggcttcgcgaagaagtcggacggctcgaccgccctcgcggccgtggtcggctacctggtcttcaagaacgtgctcgccacgttcaccgacaagaacctgccgaaggtcgccacggccgtcgacggcaaggtggtcatggtggacgcgcccgtggacgccaaggtcctcggtggtgtggtgatgggcatagtcgtcgccctgctgtaccagaagttctaccggaccaagctgcccgactgggccgggttcttcggcggccgccgtctcgtcccgatcctctccgccttcgcgggcctgctgatcggcatcgtcttcggctacatctggccggtcctcggcacgggtctgcacaacttcggtgagtggctggtcggttcgggcgccgtcggtgccggcatcttcggtgtcgccaaccgtgcgctgatcccgatcggcatgcaccacctgctgaactcgttcccgtggttccaggcgggcgagtaccacggcaagagcggtgacatcgggcgcttcctggcgggtgacccgaccgccggacagttcatgaccggcttcttcccgatcatgatgttcgccctgccggccgcctgcctggcgatcgtgcactgtgcccgccccgagcgccgcaaggtcgtcggcggcatgatgttctccctggcgctgacctccttcttcacgggcgtgaccgagccgatcgagttcacgttcatgttcatcgcgccggtcctctacgccatccacgcggtcctcaccggtgtctccatggcgctgacctgggccctcggcatgaaggacggcttcggcttctcggccggcgcggtcgacttcggcctgaacctcggcatcgcgacgaacccgtggggcctggtcctggtgggcctgtgcttcgcggccgtctactacgccgtcttccgcttcgcgatcaccaggttcaacctcccgaccccgggccgcgagtcggacgaggaactggcggagctgcagaaggccgaggccaag

SEQ ID NO: 5152 - DNA, 1284 bp, Streptomyces avermitilis
  CDS (1)..(1284)
atgagtgccgacagcgccgccgcgcccgcccggccccgctggagccacctgttccagggcctgcagaagatgggccgcagccttcagctgccgatcgccgtgctgccggccgcgggtctcctcgtccagctgggacagccgaacgtgttcgggcccgaggggctgggctggaccgatgtctccaaggtgatgatgggcgcgggcagtgcgctgctcgacggttcgctcggcctgccgctgctgttctgcgtcggcgtcgccatcggcatggcgaagaagtcggacggttccacggcgctcgccgcggtcgccggcttcctcgtctactacaacgtgctgcgccagttcccgcaggactgcgcgagcggggcgaaggcggtggtcaccggctgccgggcggccgacggcacgatggtggcgttcacgtaccagaatccgggtgtcttcggcggcatcgtgatggggctgctcgccgcgttcctctggcagcgttaccaccgtacgaagctggtggactggctcggcttcttcaacggccggcggctcgtgccgatcatcatggcgttcgtcgccgtcgccttcgccgtggtgtgcctgtgggtctggccgccgatcggtgcggcgctggagcacttcagcgactggctggacggcctggacgcctggggcgcgggcgtgttcggcgtcgccaaccgcgcactgctggtcgtggggctgcaccagttcctgaacgtgcccatctggttccagttcggcagttacaccaagccggacgggcaggtcgtgcacggtgacatcaacatgttcctggcgggcgacccgaacgcgggccagttcacctcgggcttcttcccgatcatgatgttcgcgctgccggccgccgcgctggcgatcacgcactgcgcccggccgaaccgtcgcaaggaggtcggcggtctgatgctgtcggtggctctgacctccttcgtcacgggcatcacggaaccgctcgagtactccttcctgttcgccgccccgctgctctacgcggtccacgccctgctgaccggtgtctcgatggcggtgacgtggggcctgggtgtgcacgacggcttcagtttctcggcggggctgatcgactacgtcctcaactggaacctggcgaccaagccgtgggcgatcgttccgatcggactgtgcttcgcggccgtgtactacgcgatcttccgtttcgcgatcacgaagttcgacctcaccactccggggcgggagccggaggaggaggtcgaggacatcacgaaggcg

SEQ ID NO: 5153 - DNA, 231 bp, Streptomyces avermitilis
  CDS (1)..(231)
atggccaccaaggctgagaagatcgttgccgggctcggcgggatcgacaacatcgaagaggtcgagggctgcatcacccggctgcgtaccgaggtcgtcgacccgagcctggtcgacgaggccgcactcaaggcagccggcgcgcacggcgtggtcaagatgggcacggccatccaggtcgtcatcggcacggacgcggacccggtcgccgcggacatcgaagacatgatg

SEQ ID NO: 5154 - DNA, 732 bp, Streptomyces avermitilis
  CDS (1)..(732)
atgtctcgaatcgacggccgcacgcccgaacagctccgccccatcaccatcgagcgcggctggagcaagcacgccgagggctccgtcctcgtctccttcggcgacacgaaggtcttctgcaccgcctccgtcaccgaaggcgtcccgcgctggcgcaagggcagcggcgaaggctgggtcaccgccgagtactccatgctcccgcgcgccaccaacacccgcggcgaccgcgagtcggtccggggcaagatcggcggccgtacgcacgagatcagccgtctgatcggccgctccctgcgcgcggtcatcgactacaaggcgctcggcgagaacacgatcgtcctcgactgcgacgtcctccaggccgacggcggcacccgcacggccgcgatcacgggcgcgtacgtcgccctcgccgacgcggtcgcctgggcccagggccgcaagctcgtgaaggcgggccgaaagccgctcaccggcacggtcagcgcggtctcggtgggcatcgtgggcggggtgccgttgctggacctctgctacgaggaggacgtgaaggccgacaccgacatgaacgtcgtctgcaccggcgacggccgcttcgtcgaggtccagggcaccgccgaggcggaacccttcgaccgcaaggagctcaacgcccttctcgacctggcggtttcgggctgcgacgaactggcggtgatccaacgtgcggccctggaggcaaccacacgc

SEQ ID NO: 5155 - DNA, 414 bp, Streptomyces avermitilis
  CDS (1)..(414)
atgtccagggggaggaaccgttccatggccgcgcgccaccgccgccgcaccgccgcattcgccgtagtcgccgcactcgtcgccgttccggcggtcgtcggctgcgacgccgtcagcaaggctctcgactgcgtccaggccgccgactccatcgccgacagcgtcaccgacctccagcaggcggtggagaacgcggccgacgatccgacacagaccgaccagtccctcgacgccatagagaagaacctcgacaagatcggcgacaagaccgacaacgccgacgtcaacaaggcggtcgacgacctcgagaaggcggtctccaacgtccgtgacgccgtcaagaacggcgacgagaccccggacatcagcccggtcaccgacgcggcgggcgaactgacgaaggtgtgcacgccg

SEQ ID NO: 5156 - DNA, 600 bp, Streptomyces avermitilis
  CDS (1)..(600)
atgacccgtctgatcctcgccacccgcaacgccggaaagatcaccgaactgagggcgatcctcgccgacgccggtctcacccacgacctcgtcggcgcggacgcgtaccccgacatccccgacgtcaaggaaacgggcgtcacgttcgcggagaacgccctcctgaaggcgcacgccctcgcccgggccaccggactcccggcggtcgccgacgactcgggcctgtgcgtggatgtcctgggcggcgcccccggcatcttctcggcccgctggtccggccgccacggcgacgaccgggccaacctggacctgctcctggcccagctgtccgacatctccgaggcgcacaggggcgcccacttcgcgtgcgcggcggccctggccctgccggacgggaccgagcgcgtggtcgagggccaactgaggggcacgctccgccacaccccgacgggcacgaacggcttcggctacgacccggtcctccagccggagggcgagacgcgcacctgcgcggagctgtcggcggaggagaagaacgcgatcagccaccgcggcaaggcgttccgggagttggtgccggtggtgcgggagttgttgggc

SEQ ID NO: 5157 - DNA, 981 bp, Streptomyces avermitilis
  CDS (1)..(981)
atgaatctgccgcccacccacctgcccacgcccgaaggccccggttccgtctctcaggtgccgaacctcccggcgcgattcaccgaaaccttcaccagccggtacgtcgacaccggtgaactgcgcctgcacgccgtcaccggcggccaaggacctgcgctgctgttgctggccggctggccccagacgtggtacgcctggcgcctcctgatgccggcgctggctcaggacttccaggtcgtcgcggtcgatccgcgcggtgtcgggctgtcagacaagcccctgggcgggtacgacaccggcacgctcgcacgcgacatggtggcgctgatggacgcgctcgggcatcagcgcttcgccatggtgggtcacgacgtcgggatgtggaccggctatgccctggccgcggaccaccccgaccggctcgaccgcctggccgtcgccgaggccgcgatcccgggactgtccccctcaccgcccctcttcggcagccgggtggccaacgaccgcctgtggcactttgccttcaaccgcctcaccgacgtcaacgagcagttggtcagcggacgggaacatctctacttcggccgccagttcgccacgaagtccgcgaagccgctgcccgaccacgccgtccagcactacgtcggcatcctcgccgccgacccggaagccctgcggtccagcttcgagttctaccgcgcgctcgatacgaccatcgcgcagaaccagcggcgccaggcccgacggctgtccctccccgtcctggcgatcgggggagcggagaacatgggcgcatcggtcagcgaaacgatgaagcttgccgccgacgacgtggagagccttgtcctccccgagtgcggccactaccccgccgaggagaccccggaggcgatgctggccgcgctgaccgcgttcctggccccgtaccgggacgggcggaccgcggcggacatccccacggcacggggtaccgacgcc

SEQ ID NO: 5158 - DNA, 609 bp, Streptomyces avermitilis
  CDS (1)..(609)
gtgtccggccggaagcagttcgatgtcagcgcggccctggaccaggccatgcgggtgttctggcagcgcgggtacgcggacgcctcactcgatgccctcggtgcggccacgggcctcggccgcggctccctctacggcgccttcggcaacaaggacgccctgttcggccagtgcctcgaccgctacgcgtcgatctacggcgcgcagtacgagcaggcgctcgcggcgcaccccggtgatccggtgcgcgcggtcgaggcgttcttcgacgtcatcctgggccgtatcgccgacccgtcggtccccgtggggtgcctcatcgcccagtccgccgcgcagtcactgacgctgaaggaggagagcggcgttcacgtgcgtggcctgctcgacacgcagcgccagcgggtccgcgcggcactggcggactcctcggccgccccccggacgctcgacgagctcgccacgttcgtcatcgctgtcaaccagtcgctggccgtactgagccgggccggcacctcggacgccgagctgcgctccgtgacccggctcgcctgcacaacggtggcggacaccctcgcccgggtggcgtccgagaacgtcgcccaagcc

SEQ ID NO: 5159 - DNA, 1506 bp, Streptomyces avermitilis
  CDS (1)..(1506)
atggcggccaccgagcccggccccgtcgaggccgctgccggccctgaggcggtcaaacgccaccgcagactcttccgtgccgtcgcccgccgcagaaaccctcccctgcggcgcaccgacatcacggtgaccgacgagcgggcggtgaagcgtgccgtcaaggcggcttcgctgggcaatgccatggagtggttcgacttcggcatctacagctacctggccgtcaccatcggccatgtcttcttcccgtccgggaacggcaccgtccagctgctgtcctcgttcgcgaccttcgcggtctcgttcctggtgcggccgctcggcggcatggtcttcggcccgatgggcgacaaggtgggccgtaagaaggtcctcgccctgacgatgatcctgatggccatcggcaccttcgccatcgggctgatcccgccgtacgccaccatcggcttctggtccccggtcctgctgatcctcttccgcctcgtccagggcttctccacgggcggggagtacggcggggcgtcgaccttcatcgccgagtacgcccccgacaagcgccggggcttcttcgggagcttcctggagttcggcacgctcgccgggtacgtcggcgcggcggggctcgtgacggtgctgacgacggtcctcggcagcggcggcatggagtcctggggctggcgcgtcccgttcctcgtggcgggccccatcggtctcgtcggcctctacctccggctcaagctggacgagacgcccgcgttccagaagctggaggacaactccgcacgcaaggcgaccgacgcggcctccaccgtggagaccaccgccaagggcgacctggcgaagatcttccggaaccactggccgacgctgatcctgtgcgtctgcctggtcggcgcgtacaacatcaccgactacatgctgctgtcgtacatgccgacgtacctgtccgacgagatgggctacagcgagacccacggcctcctcgtcctcatcgtcaccatgctgctcctgatgctggtcatcagccaggtgggcaagctctcggaccgctacggccgcaagccgctgctgatggccggcatgctgggcttcctcgtcctgtcgatcccggccttcctgctggtcaagcagggcagcctggtcgcggtctcggcgggcatgctgatgctcggcctctccctggtctgcatgctcggcaccatgtccgcggcgctcccggccctgttcccgacacaggtccgctacggctccctctcggtcggctacaacctctccgcgtccctcttcggcggtacgaccccgctggtgatcaccgccctgatcagcgccaccggcaccgacatgatgcccgcgtactacgcgatggcggcggccctggtcggcatcatcacggtggcctgcatgaaggaaacggcccaacagccgctggccgggtcacccccctcggtggagaccccggaggaggcggcggaactggtggagagccgcaccccgatgcctaggccc

SEQ ID NO: 5160 - DNA, 465 bp, Streptomyces avermitilis
  CDS (1)..(465)
atgagcgagcgactccagcccggcgacaccgcccccgccttcaccctgccggacgccgacggcaacgaggtctccctggccgaccacaagggccgcaaggtcatcgtctacttctacccggccgccctgacccccggctgcaccaagcaggcctgcgacttcacggacaacctggagctgctggcgggcgccggttacgacgtcatcggcgtctcccccgacaagcccgagaagctcgcgaagttccgcgagcaggagaacctgaaggtcacgctggtcggcgacccggacaagcaggtcctggaggcgtacggcgccttcggcgagaagaagctgtacggcaagacggtcgtcggcgtcatccgctccacggtggtcgtggacgaggagggcaaggtcgagcgggcgctgtacaacgtgaaggccaccggccatgtggcgaagatcatcaaggatctgggcatc

SEQ ID NO: 5161 - DNA, 336 bp, Streptomyces avermitilis
  CDS (1)..(336)
gtggcggacacgtcgagcacgccggataccagaactccggcgcagatcgaggcggacatcaggcgccgccgcgacacgctggccgagacgctcgacgagatcggcgtccgggtgcacccgaagacgatcgtcggcgacgccaaggccaaggtcgtctcccacatcgacaacacgctcggacgcgcgtacgtcggcgtcaaccgggccgtcagcgatgtgaagggccagctggtcaccaaggagggcgcgccgcgcctggagcgcatcgtgcccgtggcgctcgtcgtggtcggggtcgtcgggctggtcgccgtcggctcccgtcggcgcaagcgc

SEQ ID NO: 5162 - DNA, 354 bp, Streptomyces avermitilis
  CDS (1)..(354)
gtgagcgccaaactgcacaagcacagcacccatgacgacaagctgccgatccggatgctgcacgaccgcgttctcgtgcggcaggacaccagcgagggcgaacgccggtccggcggcggcatcctgatccccgcgacggcggcggtcggccggcgcctggcctgggccgaggtcgtcgcggtcggacagaacgtacggaccgtggagacgggcgaccgggtgctctacgaccccgaggaccgcgccgaggtcgaggtacgcggcaccgcgtacgtcctgatgcgcgagcgcgacctgcacgccgtggccgcggaccgcttcgaggggtccgaggactcgacgggcctgtacctg

SEQ ID NO: 5163 - DNA, 2244 bp, Streptomyces avermitilis
  CDS (1)..(2244)
gtgctcggtaccttcgtcggcgtggtcctgatcctggtcggcctgttcgtgctcggctacaacctggtcaagatcccgccggcgaacacgaccgcgaccaagcagagcaatgtgtacctgtacgcggacggcagccagctcgcccgcgacggcgaggtcaaccgggagatcgtgacgctcgcgcagatgtccaagggtgcccagcacgcggcgctcgccgccgaggaccgcgacttctacaccgagtcggccgtcgacccgaaggcgatgatccgggccgcctggaacacggccaccggcaagggcaagcagtccggctcgacgatcacccagcagtacgtgaagaactactacctggcccaggagcagaccgtctcgcggaaggtgaaggagttcttcatctccatcaagctggaccgcgagaagagcaaggacgccatcctcgagggctacctcaacaccagctacttcggccgcaacgcgtacggcatccaggccgccgcccaggcgtactacggcgtcgacgcgaaggacctgaccgtcggccagggcgcctacctcgcggcactgctcaacgcgccgagcgagtacgacgtggtcgcgcaccccgagaacaagtccgcggccctcgcccgctggaactacgtcctcgacggcatggtgaagaagaactgggtgacgcagtcggcccgggacaaggtgaagttcccgcagcccaagcaggccgtggtcgcggccggcatgtccggccagcgcggctatctggtgcgggcggtgaaggactacctgaccgagcacaagatcatcgccgaggacaccctggacaccggcggctaccgcatcacgacgaccctgcaaaagcccaagcaggacgccttcgtgaaggccgtcgacgaccaggtgatggacaagctcgacaagaagaaccgcaaggtcgacaactacgtccgcgcgggcggcgtctccatcgacccggccaccggcaaggtcatcgcgatgtacggcgggatcgactacaccaagcagtacgtcaacaacgccacccgccgcgactaccaggtcggctccaccttcaagccgttcgtcctcacctcggccgtgcagaacggctcagttacccaggacggccgcacgatcaccccgaacaccggctacgacggcaccaacaggcgtcccgtgcagggctggaccggcggcacgtacgcgcccgagaacgaggacggcgtctcgtacggcccgatctcggtccgcgaggcgacggacaagtccgtgaactcggtgtacgcgcagatggccgtggacgtgggcccgtccaaggtcaagcagacggcgctgaaactggggctgcccgagaacacacccgacctgaacccgtacccctcggtcgcgctcggcacggccaccgccagcgtgctggacatggcggaggcgtacgccacgctcgccaaccacggcaagcacggcacgtacacgctcgtcgagaagatcaccaaggacggcgagggcgtacagctgccgaagcaggccgccaaggcggccgtcagccgcgaggccgccgacaccaccacgtcggtcctccagagcgtcgtccagaacggcacggccacggccgcgctggccgcgggccggcccgcggccggcaagaccggcaccgcggaggaggaccaggcggcctggttcgcgggctacacgccccatctcgcgactgtcgtcgccgtgatgggccaggacccggagtccggcaagcacaaggcgctgtacggcgcgatgggcctgccccggatcaacggcggcggcgcgcccgcgcagatctgggcgcagttcacgaaggccgccctgaagggcaagccggtcgccgacttcgacctccggctccaggccggcgcgcaggagcagcagcccctgccgaccggacccggtgacgagccgggcacgggcggccaggacaacggcggtacgacctcggacggcggccagacctccgagcccacgaccgagggccagacggacggcggcacccccacgacgggcggcacgaccgacggcggcacgcccacgacaggcggcacgacggacggcgggaccaccgacgacggcggcacgacggacggcggcaccaccgacgacggcggcacgaccgacggcggcaccactgacggcggcggcacgacaggcgccggggggacgacggacggcggcgacgcgacgggagccgggggtacgacggcgggcctgttcggccgg

SEQ ID NO: 5164 - DNA, 798 bp, Streptomyces avermitilis
  CDS (1)..(798)
gtggggacagggcggttgtacgccgccgtggccgccggtggtttcaggcggtacgcgacctaccggacggccaccgcggccggggtgttcaccaacacagtcttcggattgatcttggcatacacctacatcgccctgtgggacgagcgaccccatctgggagggtacgaccaggcgcaggcgctcacgtacgtgtggatcggccaggcgctcctgatgacgctggccatcgggggcggtggcttcgaggacgagctgatggagcgcattcgtacgggtgacatcgcgatcgacctctaccggcccgccgaccttcaactgtggtggctggcgggggatctggggcgggcgctgttccagcttctggggcggggggtgatcccgatggtgctgggcgcgttcttcttcgaactggccctgcccgccgacccgttgcgctgggcggcggccctggtcgcggtcttcctcgcgatgctcgtcagcttcgcgatccgctacctggtcgccctgaccgcgttctggctgctggacggggcgggtgtcaccaacatggcctggatcacggggatgttctgctcggggatggtgctgccgctcaacgccttccccggcgcgctcggcgaggtggtccgcgcgctgccctgggcctcgctgctccaggcccccgcggacgccctgatgggccgcgccggactgccggccacgtacgccttccagggcgcctgggcggtggcgctcctcgcggccgggcgcctgctccagtcggtggcgacccggcgggtggtggtccagggtggc

SEQ ID NO: 5165 - DNA, 897 bp, Streptomyces avermitilis
  CDS (1)..(897)
gtggctaggtccagggtggctgggtccaaggaggctgggcccaaggtggctgggtccaggagccgcgcggcggggcagggacgggtcggggcgcggctggcggacggtctgcgcgcctaccgcatgatcgccggcatgtggatccgctccacgatggcctaccgcgcctccttcgtgatgaccaccttcggcaacttcggggcgaccgccctcgacttcgtggccatcctgctgatgttctcgcaggtcgacgcgctcggcggctacaccctgcccgagatcgccttcctgtatggcgtcgcgggcatcgccttcggactcgccgacctcgcgatcggctcgatggaccggctggggcggcgggtgcgcgacggcacgctcgacaccctcctggtgcgcccggcgccggtgctcgcgcaggtcgccgccgaccgcttcgcgctgcgccgcctcggccggatcacccaggggctgctggtcttcgggtacgccgtcgccgcactcgacatcgcctggaccccgctgaaggtgctgatggtcccgttcatgatgctcagcggcggtgcgatcttcgcggcggtgttcgtggcgggcggcgccttccagttcgtcgcgcaggacgcctccgaggtgcagaactccttcacgtacggcggccagacgctgctccagtacccgccgaccgtcttcgccgccgacctggtgcgcggagtgaccttcgtcgtgccgatcgccttcgtcaactggctgcccgcgctgtatgtgctggggcggccgtatccgctcgacctgccgacgtgggtggccttcaccccgcccctggtcgcggcggcctgctgcgcgctggcggggctcgcctggcgtgcgggactgcgttcgtaccggagtacagggagt

SEQ ID NO: 5166 - DNA, 1005 bp, Streptomyces avermitilis
  CDS (1)..(1005)
atgccagacggtgacttcatcacgctcgaccgcgtcgagaaggtcttcgacgtgcgccgcaagaccggcttcctgcgcagcgagcggcggcgggtgcgggcggtggactccctctccttcaccgtggcgcgcggcgagatggtcggctacatcggcccgaacggcgccggcaagtcgaccaccatcaagatgctgaccgggatcctgacgccgagcggcggccggctgcgggtcgccggcatcgacccgtcccgcgagcggacccggctcgcggcccgtatcggggtcgtgttcgggcagcgtacgacgctgtggtgggacctgccgctgatcgactcgtaccggctgatgcaccgcatgtaccgcatcccggacgggcgttatcgcgagaacctcgaccgctgtgtcgaactcctcgaactgggcgatctgttggacgttccggtccgtcagctctccctcggccagcggatgcgcggcgacatcgcggcggccctgctgcacgatcccgaggtgctgtacctggacgagccgacgatcggcctcgacgtcatcagcaaggccagggtccgggagttcctgcgggagctgaacgccgagcggggcacgacggtgctgctcaccacgcacgacctccaggacatcgagcagttgtgcggacgcgtgatggtcatcgaccacgggcggctcatgtacgacggtcccctggccgggctgcacgaggtgggcgacagcgagcgcacgctcgtggtcgacctggcgcgtgagctgccgccgatcgaggcggcgcccgcgcgcgtggtgaaggtcgaggggccccggcagtggctggccttccccgcctcggagtcggcggccccgctggtggccaggatcgcggcggcgtatccgctggtggacctgtcggtgcgggagccggacatcgaggccgtgatcgcgaagatgcttcagtccatgggcgacactccccaacccccgccggagcaggcggagcacgtggtctcg

SEQ ID NO: 5167 - DNA, 900 bp, Streptomyces avermitilis
  CDS (1)..(900)
atgaccgacgaggaaccctcggagctgcgtgcctccgacgccgatcgtgaacgagtcgccgaacagctgcgggacgccgtcgcggagggccgtctcgacatggaggagttcgaggagcggctggaggcgacctacaaggcgcgcacctacggggagctgacgccgatcacccgtgacctgccggccgccggtgtcggcgcacccccggtctcgatggtcaagcagcccgcgccgagcgggagttgggccgagcggatcgtcgggggcgacggctcgtccagctgggccgtggcgatcatggcggggttccagcgcaaggggcgctggacggtgcccaagcggttcaactccttcgccttctggggcggcggtgagatcgatctgcgcgaggcgtacttcgcggaccgcgaggtcgtcgtcaactgcgtggcgatcatgggcgggatgaacgtcgtcgtaccgccgggcgtcgaggtcgtcgtccgcggcatcggcgtcatgggcggcttcgaccaccgtgaggagggcgtcccgggcgagcccggcgccccccgcgtgatcgtcaccgggttcgccttctggggcggcgtcggcgtggagcgcaagctgacccgggccgagcggctgcggctgaaggaacagcgccggcaggagaagctggagcgcagggccgcccgcaaggagcttcaggggtccgggagcgacggccgtgacgtccgcgacaccctcgatgagctggacgacgtgtacgacaccgcccgcgaggcgctggaggagcaccgcgacctggtgcgcgagcgccacgaggagcgccgggagcggcacgcgcagcgccacgaactgcaccgggagcgccgggaggcccgccgggaggaccgggaccgccgccgccaccgggac

SEQ ID NO: 5168 - DNA, 1392 bp, Streptomyces avermitilis
  CDS (1)..(1392)
atgacgcatcatggggtcatcacatcggagcctcgggctcccattgcccgaggagacacgcaccgcatgaccaagcgtcacggttatgccttgctggccgcgatatgcacactcatcgtggccatctcagccgccatatacataggcgccggggcggacgacggccaggaccagagcgccctcgccgacgaccgccccccacgcaactccgccgccccggcctccaccggcacctgggtcggcgcctggtcggcctcccccgcgggggccgagccgggcaccgagacggacggcctggcgggccggtccgtgcgcaacgtcgtccacgccggcatcggcggtacgggtgcccgcgtcacgctttccaatctcttcggccagcagccgctgaccatcacccacgccacgatcgcggtcgccgccacggcgaacagcgcggccgccagcaccggcaccatgcgccggctcaccttcgacggcgccacctcggtgatcgtgcccgcgggtcagcaggtgctcagcgacgccgtgcgcgtcacgatcccgcacgacagcgacgtcctggtgaccacctactccccgaccccgtcgggcccggtcacctaccacccgcaggcgcggcagatctcgtacgcggcccagggcgaccgcgtggaggacgtcaccgcgacggcgtacaccgagcagacgacgtactggcgttacctcaccgcgctggacgtgctgagcaacgagtcgagcggcaccctcgtggcgatcggcgactccctcaccgacggcgtgacctcgaccgtgggcaccaacagccgctggacggacatcctttcggaccggctgcgggcctccgccggcaccggcgacgtgccccgctacagcgtcgtcaaccagggcatcagcggcaaccaggtgctggccgcgggcctcggccgccccgccgagaacccgagcgggctgtcccgcttcggacgtgacgtgctcgaccgtacgaacgtcaaggcggtcgtcatcgacctcggcgtcaacgacatcctgcggaacccgggccgggccgaccccgaccggatcgtggccgggctgcgcaccctggtccggcaggcgcacgcgcgcggactgcgggtcgtcggcgcgacgctgatgccgttccagggccaccgcggctacaccccttaccgcgagacggtgcgccaggccatcaacgcgcagatccgcgcgggccaggtgtacgacgccgtcgtcgacttcgacaaggcgctgcgcgacccgtacaacccgcgcaagctgcgctccgactacgactcgggcgaccatctccacccgagcgacaagggctaccgcacgatggcggacgcgatcgacctggcggacctgacgggcgcggtcccggccgagctg

SEQ ID NO: 5169 - DNA, 1365 bp, Streptomyces avermitilis
  CDS (1)..(1365)
gtgtacaaggtcaccgaacgggtggagcggatggaacgtacgaacacggaagaactgggcgccgcagggcagcatgcccggcccggcgccgccacgaaccgcgcgatgacctccttcagccccgccgacgaggagaagcgcaggggcgtgcgccggatgaaggccacggcgaccgcgatgctgctcttcgtcgcgctcgtgtacgtcgtcgccaagtgggcgtcccaccagggcgccggcccctgggcgggctatgtcgcggccgcggccgaggcgggcatggtcggcgcgctggccgactggttcgcggtcacggccctcttcaggcaccccctcggcctgcccatcccgcacaccgcgatcatccccaccaagaaggaccagctcggcgtctccctgggcgagttcgtcggtgagaactttctctcctccgacgtggtgcggagccggctgcgcgccgtcggcatcggcagccgcctcggcgcctggctcgcggaacccgagcacgccgaccgtgtcaccgccgagctggccaccgcgctcaggggcgccctcacggtcctgcgtgactccgatgtgcaggcggtggtcggcgaggccatcacacggcgcgccgacgcccaggaggtggcgcccggcatagggaagatgctggagcggatcgtcgcggacggcggccaccggcgggtcgtcgacctggtctgcgcccgcgcgcacgactggctcgtcctgcacgacgagcaggtcatggacgcggtgcagggcggcgcccccggctggaccccgcggttcgtcgacaagaaggtcggcgagcgcgtctacaaggagctgctccgcttcgtcacggagatgcgcgacgcccccgcgcacccggcccgtggcaccctcgaccgtttcctcaccgacttcgcctccgacctccagtccgacacggacacccgcgtccgcgtggagcgcctcaagggcgaggtgctcggccgcggcgaggtccaggacctgatcgcgtccgcctggacggccgtacgctccatgatcgtgtcggccgccgaggacgagcgcagcgagctgcggctgcgcgtgcgggcctcgctgctgaagctgggtgcccggttggccacggagtcgaagtaccagaccaaggtggacggctggctggagggcgcggcggtgtacgtggtgacgacgtaccgggacgagatcacctccctgatcacggacacggtcgcgagctgggacgccgagcacacgacgaagaagatcgaggcgcacatcggccgtgacctgcagttcatccggatcaacggcacggtggtgggatcgctcgcgggactgctgatctatacggtgtcgcgccttctgggggcg

SEQ ID NO: 5170 - DNA, 1503 bp, Streptomyces avermitilis
  CDS (1)..(1503)
atgtcggcttcagcgccacaggcccatggtccggccgccaccggaaccgtcacgacggacgtaccggcccgcttggaccggctgccgtggtcccgctggcactggatgatcgtcatcggcctgggaaccgtatggatcctggacggcctggaggtcaccacggtcggcaacatcgcgggcaggttgtccgaggacggcagcggcctgtccatcacctcggcccaggtcaccggtgtcgctgcggcgctctatgtggcgggcgcctgcgcgggcgccctgttcttcggctggctgaccgaccgcttcggccgcaagaagctcttcatggtcactctcgtggtctacctctcggcgaccgcgctgaccgcgctgtccttcaattcctggtggttcttcaccttccggtttctgaccggcttcggcatcggcggcgagtacgcggccatcaactcggcgatcgacgaactcatccccgccaagtaccgcggccgcgtcgacctgatcatcaatggcagctactggctgggcgcgatcggcggagcgctgttgtccatcgtgatgctggacacgtcgatcttccccaaggacctcggctggcggctcaccttcgccctcggcgtcgtcctcgggctggtgatcctgctggtcaggcggcatgtgccggagagcccgcggtggcagttcatccacggccgcggcgaggacgccgaggcgctggtgtcctccgtggagcgggagatcgagcaggagaagggggagccgctgccccgcgcggagagcgagatcaccatcgagcagcgcaagagcatcggcttcggcctcatcgcgaagacggtcttcgggcgctatccgaagcgtgcggtgctcggcctcgccctcttcatcggacaggcgttcctctacaacgcgatcaccttcggcttcggcgccatcctcaccacgttctacgacgtgccgaccggcggcaccggctactacttcgccgtcatcgcggccggcaacttcatcggcccgctgctgctcggcaagctcttcgacacggtcggccgccggatcatgatcgcgtcgacgtacctgctctccggtctcctcctgttcggcacggcctggctcttcgaccggggctcgctgagcgcgatgacgctgacggcctgctggtgcgccgtgctgttcttcgcctcggcgggcgcctccagcgcctatctgacggtctccgaggtcttcccgatggagacccgcgcgatggccatcgccttcttctacgcgctcggcacggccgccggcggcatcagcggcccgctggtcttcgcggacctcacggagtccggcgtggtcggcgacacggtgctcgccttccagatcggtgcggggctgatgtgtgcggcgggcctggtcgccgcgttcctcgcggtgaacgcggaacggcgctcgctggaggacatcgcggagccgctgtcggtggcgcagacgacggcgcccgcgcccgcgtcggcgtcggggacc

SEQ ID NO: 5171 - DNA, 477 bp, Streptomyces avermitilis
  CDS (1)..(477)
gtgaccctcgtacgtatgaccgagaagctgttgagccctctgcacacgcgcccctggcccgagcgctggctgacccgcgtgctcggcgccgccctcgcctcggcggcgtatcttctctgcctgccatgggacctgaacaaccgggccccgtcaccgggggccgtcgaggagacgaccccggtgacgggtgtgggcgtcgtcgcgctcgccgtgatcctgctggccctggcggcctacttcggccaccgggactcgctgggctggccggtgctgctggtggccgtaccgccggcggcactgctgtacgtctccctgcgcacgcacccggggccgccggacgggttcgcgggtgtgtggccgctggtctgggggttcttcacgctgctgatcggggtcggagtgctggtcgcggcggcggtggcgcgggagttcagggcagacttggtggacgaggagctgagcctcgctcaccgccgg

SEQ ID NO: 5172 - DNA, 507 bp, Streptomyces avermitilis
  CDS (1)..(507)
atgtacgcacagcaagagcagtcgacgccgggggcctacctgacgttcgtggagcgccagttgtcggccgacggatgtaccacccggtgggaggactgggccggggtgcccgtcctggtggggcggcgggccgacttccggctgagctggatggcgacgaggctgcacctgttcaccgtcgccgcggcggtcccggaggtgaccgttcccgtcatctccaccttcaccgaccaggtgatgaagtacgccaaggacaccaagggcggtctccccgtcggcctgcagaacggggtcggcgccttccccgtgctggtcagcgaccggatcgacccggccgccgtccagtgggcggaggagcagcagcgcctcaagttcgcctgcatgacacggcccgtcgtggtcgacagcgcgcgccggtacgtggcgatgtaccgcggcaagccggccctcggacgcgtctacgcctcgcacttcatcgagaaggggtcgcagtacttctacggccag

SEQ ID NO: 5173 - DNA, 447 bp, Streptomyces avermitilis
  CDS (1)..(447)
gtgaccaagttcctcctcgccgtccacgtcatcgccgcgatcgtcgccatcgggcccgtcacggtcgccgcgagcatgttcccgccgaccgcgcgcaaggccctcgccgcgccggacgacgcgcaagctctcgcgaccacccggctgctgcacagcatctgccgcgtgtacgccaccgtcggcgtcgtcgtccccgtcttcggattcgccacggcgagcagcatgggtgtgctcggggacgcctggctgatcgtctcgatcgcgctgaccgcgctcgcggccgtggtcctcggcgcgctggtgctgccccggcagagcgcgatcatggagggcgcgggagaccgcgcggcgacggttcagctggccatgttcaccggaatcttcaaccttctgtgggccaccgtcaccatcctgatgatcattcgaccggggtccaccacgggcgca

SEQ ID NO: 5174 - DNA, 1023 bp, Streptomyces avermitilis
  CDS (1)..(1023)
atgcacaccgtggccgtactggcgctcgaccaggtcatcccgttcgacctctccgccccgatcgacaccttcggctgggcccggctgccggacggccgggcggcgtaccggatccgggtctgctcggcttcggcggacgacgaggtgagcgcgggcctgttcgcgctgcgtgccccgtacggtctggaggcgctggccgaagcggacacgatcatcctgccgggcgtcgccgacccgaccgtcccgctcccgccgggcgtggcggaggcgctgtgcgcggcggccgcgaacggcacgcgtatcgcctcggtctgcgtcggcgccttcgtcttcgccgccaccggcctgttggacgggctgcgcgcgaccacccactgggtcgcggcccaggacctggcggccaggtaccccgccgtgaccgtcgacccgaacgtcctctacgtcgacaacggccagttcctcacctcggcgggcgcggccgcggccctcgacatgtgtctgcacatgatccgcatggatcacggttccgccgtcgccgcgcatgccgcccggatgtccgtcatgccgctcgaacgggagggcggacaggcccagttcatcgtccacgaccagccgccggtaccggccggcacgaccatggagccgctcctcggctggctggaggagaacgcgggccgtgatctgaccctggacgacatcgccgcccacgccggcatgagcacccgtacgctcaaccgccgcttccgcgagcagaccggcacgactccgttgcagtggctgcacctggcgcgggtgcggcgggcgcagtatctgctggaggcgacgacgtacccggtcgaacggatcgcgtcgcaggcggggttcggctcaccgacggcgttccgggaacggttccggcgggtggtggggacgagtccgtacgcgtaccgcaaggccttccggggagccgacgacggccggcccggaccgcggggcgcgctcgcggcccccggcgcccactcgtcgtccggcagctcctcgacg

SEQ ID NO: 5175 - DNA, 303 bp, Streptomyces avermitilis
  CDS (1)..(303)
gtgatggcgaaggttcctacggcagtggtcgccgcgagcgggctcgtcggcgggtacggggtggcccgttggaccaagaagcggcagctgggcggagtcgtcctggccaccgccggggccgcggccgcgcagcagtggcggcggcaggccggcgggaaggccgccggggcgctcaccgccgcgtatgtcgccgccttcgccgggtcccacccgctcgccaagaaggtgggcgcgtggcccgccgtgttcggggtggccggagccgtggcgctggcctcctgggccgtcgcggaccggcgcgcc

SEQ ID NO: 5176 - DNA, 726 bp, Streptomyces avermitilis
  CDS (1)..(726)
atggcggcgcgcggtcagcgttacacgccgcagccccgggtcgcctccgcgcggagcgaggagacgaatccgtacgggctgctggggccgcgcaaggcggccgccgacgggtacggcatcgtgggcgagtacctgtacctccggtcctccccgcctccctccggcgacgagtcccgcgcccccgcgtggcgacgggcgctgaccggcaccgcgaagcaccgggtgtcggtccggctgccggacggctcccgcgtcgagtacttcgcggacggctgcgtggcccgggcgcgcgccgaggtgtacggcgcggactgggaccggaccgaacctgtggtcgcggcactgtcgacccgggttctggccgccgtcgagaaggaccccgactaccgtgcggcgatccggcgttggtccgcctgcatggcggagacgggacaccccgccgacgatccgcaggcatcgcgggcccggctgaacggtcgtctggcgaaggccgctgccgacccgacgtcgctgcgggcactcggccgcgaggagatccgtacggcgacggcggacgcccggtgccaggcgcgggcggagctcgcgaagaccatcggcagggtgcagcggtcggtggagaagcgcgtgctcagcgcggccgagaggggtgtcgtcgcacgccatgtcgccgcgaaacgcgacgtgctcaaggcctcgatgacatcgggggcgtccaggtcaggccga

SEQ ID NO: 5177 - DNA, 372 bp, Streptomyces avermitilis
  CDS (1)..(372)
atgcatcggattctcgtgcggagcggtattgccctcggaggtgcggcgctggccgctgtcggggccctcgcgacggccggccccgcgaacgcggcgtggtcggactgtcccgccgggtcgctgtgcgcctacctcggcaccaacggctcgggggaccccggaaccgtgtccggcgacaacaacaacctcctccagtacaacaagttcaacaacgccgagtcgctctacaaccacggcaacagctgcaacgtgcgcatcttctccggcctcaacaagaccggatccagctacgttctcgaccgcggctacacgaatcccaccctggccgggacggtgtactggcacaacgtggcctcgaacgactggtgcgtg

SEQ ID NO: 5178 - DNA, 471 bp, Streptomyces avermitilis
  CDS (1)..(471)
atgcgccggctcaaggaggtgtccggcctcagtttcagcaagctcgccgcgagaacgcactacagccggtcgtcgtgggagcggttcctcaacgggaagaagccggtgccccgcgcggcggtggagcagttcgcctccgcgctgggggacgaggcgggcagcctgttgctgagcggaggcagtgccccggaggcggcccccgagtccgcggtggccgggcgcggcctcaccgccgacagccccgccgacgagggccccgcccacgaccgcggacgcaaccgcggcggtgcgcgcggtcggccggtcacgctcggcgccttcgtcgccggggtggccgtgggcgcgctggccgcggctgtcaccggcctcctgtcggaacggggtgccgcggcgcgcagaccgtgcgacgggtgtatctgtccctccgccgtcccccgcttcccgatctggcagtcgcgtacgtaccacgtc

SEQ ID NO: 5179 - DNA, 192 bp, Streptomyces avermitilis
  CDS (1)..(192)
gtggacctggcgaacgccgacatcgtgctgcagagctacattgccgacgaccggacacgaaccgagtgcgtggggaacaccgctccggggcacgacaagggcatccccgagcacgagacagtgatccgccttcccgtgcatctggtgccgctgctgagggaggcctgcgatgccgcagaacgagctgcgctt

SEQ ID NO: 5180 - DNA, 531 bp, Streptomyces avermitilis
  CDS (1)..(531)
atgccgcagaacgagctgcgctttgacgatctcctcgaagcggcccggcactcagccgtccacctggaaatgcgagacgcgtatggagtcggcgatgaggacgccgatttcaacgagtggcagcgcagcggcaaccgagactccgaccccagctccccatactgggcgccctgggttgacctgatctcccgcgcaagggaccgcggagtcaccgtccgcagggcgcgtatcgtctccgaacccgtaacggactacatccgttacgagcacgccggaacccccgtcaacattcaggcaggcgagcaggtccgctggctgtcgaggcgaaacgccagcgacctgatgcttcccggctgtgacctatggatcttcgacggcgcgcaggtgctgttcaaccacttcaccggcagcggagactgggcggacccgccgctcgagctgcgcaccgagccaggcatagtcaaacaatgcgcggacgccttcgaggcggtgtgggagcgcgccatcccgcacgatcagtacgagatccac

SEQ ID NO: 5181 - DNA, 849 bp, Streptomyces avermitilis
  CDS (1)..(849)
atgcccatctccccctcgtcatcggctcaagaggctcgcaagaacgtcgcgagccgactgcgcgagctgcggaaggaggcggggctcacggtcgtagagctggccggccggtgcggctggcaccacgccaagacgtcacgcatcgagaacgccaagacgcctccgtcaccgatggacatccgccgatggtgctccgcctgccgagccgagaaccgcgcggacgacttgatcgccgcatcgcgggacgcggagtccatgtacatggagtggcagcggcaggtccgtcaggggctgcggcaactgcaggacagctacgtaaagctgtaccgctcgacccacctcttccgtgtctactcgcccaccctggtcccgggcctcctgcaaaccgagggatacgcgcaagccgtactcagcaccaacgcccaactgctcgacgtccccaacgacgccgagcaggccgcagccgcccgcctcgaacgctcccagatcatccacgaaccaggccgtcggttcgtgatgctgatcgaagaagccgtcctctactaccagttgggcgacggtgacgcgatggcggcccagctcggctacctgctcaccgccggagccctccccgcggtctcgctcggcatcatccccagggccacgccggcccgtgccctgtggccacaggaactgttccacgtgtacgacgacagcctcgtatccgtggaactcctctccgcccaggtcaacatcacccaaccatccgaagtcgagctgtacttgaaggccttcgagcggctgcgcggcatggcggtctacggagcagacgcacgcgccttgatcttgcaggcgatagaggcactgcag

SEQ ID NO: 5182 - DNA, 474 bp, Streptomyces avermitilis
  CDS (1)..(474)
atgggtgccagtggttgggagtacgtcactgcgtacgaaggcagtgtcgaggagtctctggaggctctgcacgcgcaggtcttcgaggagctgtacggggacgacgacgattaccggagccttgcggagttgtgggaggacgaggagttcatgggcgaggaggggacccactcgatcctcgacatcgaccgcgtcgtccacacgaccgccgccccctcggagcacagcgacaaggactacggaaccctgcgcccgttggggcgcgaacgtctcgtgcatcacttcgggaccgaccggccgtcgcccgcccggttccaggagctgctcgaacaggccgaggcggctctcaccggtccgtccagctctgaggagacgcttctcgacgagtgccgcatgcggtggaccggcgtgtacgtcgttctgtacaccgatgaaaagccgacccacttgggcatcttcgggtgctccggcgac

SEQ ID NO: 5183 - DNA, 210 bp, Streptomyces avermitilis
  CDS (1)..(210)
gtgagcattgcagagtccaaggtcgacgacagctcgatgtggttcacgtcgtcgtacagcaacggcgccggtggtgaatgcgtcgagtgtgccagttccgatgacaacgccctcatacgcgactcaaagcgcctcggagggccggtcgtcggtgttccaggactggcctggcacgcctttgtacgggcgttgaagcggggggagctgggc

SEQ ID NO: 5184 - DNA, 846 bp, Streptomyces avermitilis
  CDS (1)..(846)
atggccggttcaccgacggcacgacgtcgccgtctctcgatcgagctgaagaagctccgcgagaagggcgcgctgacctgcgcccaggtcggcgaggcgctggactggagcggctccaaggtcaaccggatggaaacgggcagcggccgggtccaaccgtccgacatcgacgccttgtgtcggttctacgacacgagtgacgagctgcgcgaattcctcatgtcgctggcccgacaggccaagacgcgcggctggtggcaggtgcacggtgccggtgttccggaatggttcaacatctacatcggcctggagcaggacgcttccacgtttcgccagtaccagtgcgagttgctgcccggcctcatgcagactgcggcctacgccggtgaactccacaagaccggtgcgcacctgtccgccgaggtcatcgaccgggcggtacgggtacgcatggagcgccaggccatgctgacgcgatcagacgccccggacgcctggttcgtggtgaacgagggcgcgctgcgcaatgtcatcggggacagctctctcatgcgggaacagctcgaacgcgtgctggatgcagctgatttgccgagcgtgaccctgcaagtactccccttcgactcgggcacctatccggccaccggctcgttcaccatgcttggcttccctgatcaggaagacccggacatcgtgtaccgggacggcatcaccgatgccgtctatctggaaggcgagcaccatgtacgtgagtacaccagggccttcgacggtctgcgggcagcggccctgagtcctcaacgttccagccggctgatcaaatctgttctgaaggaatacgccagg

SEQ ID NO: 5185 - DNA, 660 bp, Streptomyces avermitilis
  CDS (1)..(660)
gtgatccaggaagcgtgtatgtcacgaaagccgtgggacttggccttcacggctgaacctgaggaagtagccggcctgcgccgcgtcatgcggctacacctgagggcctggggcctgtatgagctcatcgacgaggctcaactctgcgtgagcgaactcgtgtcgaacgtcatcactcacgtcggccgcggcacccctgcaacgctcgccgtgtccatgaacggcacccacctgcgcatcgaagtccacgacccagacacgcgtgccctgccgaccctcgtccaggccgaagccgactctgaaggcggacgtggcatggctctcgttgaggctgtcgcggaccgctggggcgtccaactccaacccgaccgcaaggtcacctggtgcgagctgtccaccaacctgagctcgccgcatggccatagtgggggtgttcgcgtggcaagagcaggagcgatgctcggtctctaccgggcagcgcagttgccgcgcatcacggggtcgagcgcgttaggggtgggtgtggccgtagcggaggagacggcgatcaacgtcattgccgacgtcctccgctggcttcaagctcatggccgtgacgtggatgaggcgttggaccgtgctcagatgcactgtgaggctgagccgggcgggggcgcagag

SEQ ID NO: 5186 - DNA, 2919 bp, Streptomyces avermitilis
  CDS (1)..(2919)
atggcgtcactcgctgccgacacggccgcccctccctggcccaacaccagcgacgctgtcgagctcatcgctgacggacctcgccagctcctggctgtggccgagcaggaagctcctggtgtctacgccgtacgaccactgacaccgctctccgagactgccctgatcaccaactcgccggaggatcccagtcttggaagcgagttgcgcgctgaactggctacggccgaccggattgacctgctctgcgccttcgtgaagtggtacggcctgcgcgtgctggaagattcgctccgcgctgccaaagaacgtggcgtgcccatccgtgtcatcacgaccacgtacatcggcgccaccgatcggcatgcccttgaccgcctggtgcgtgacttcggtgctgaggtaaaggtcaactacgaaatccggtccacgcggctgcatgcgaaggcgtggctcttccggcggaacagcggcttcgacaccgcgtatgtcggcagctccaacctttccaaggccgcattgctcgatggcctggagtggaacgtacgcctgtcgtcggtcgccactcccgccgtactcaataagttcgaggcgaccttcgatgcgtactggaatgacagtgcgtttgaggcatacaaccctgatgacgacggtgagcggctcgaccaagccctgtcgcaggcagggggtaccagcagcacggcggacctgaggatcaacctgtccggccttgaggtacgcccgtttccgcaccagcgcgacatgctcgaacggttgcgtgtcgagcgtgaaatccgcggccggaaccacaacctcttggtcgcggccactggcaccggcaagacggtcatggcggccctggactatcgggccctgtgccagaaacacgacggcggcgccccgcggctgctcttcgtggcgcaccgcaaggagatcctcaatcagtcgttgcgcatgtaccaagaggtgctcgacgacgcgtccttcggagagctgctctacacaggcgaggatcctcgtcgctggcagcatgtgttcgccagcgtccagtcgttgaacgtccagcggctggagcagctcgctcccgatcacttcgacatcatcgtcatcgacgagttccaccacgctacggcggccacctaccggcgggtcatcaagcacttcaagccgaagcaactgttgggccttactgccacccctgagcggatggacggcctcaacgtgcaggacgagttctttgaagggcgcatcgcagccgaactgcggctgtgggaagccctagagaacgacctgctgtgccccttccactacttcggcatcccggacggaactgacctcacaagcattggatggaagcagggcgcgtacgccgatcgcgaccttggcaacctctatacgggcaaccatgcgcgcgctcgcatcgtggtcaagcagatccaggacaaggtctccaacccgggggcgatgcgtgccctcggcttctgcgtgaacaaggctcacgcgcacttcatggctgacttcttccgggaggccggcttccaggcagcggcactggacagcgactcacccgccggtgtgcgggcgcaggctctgtccgacctgcgcaacggaaagctccaagtcatcttctccgtcgacctgttcaacgaaggtctcgacatacctgacgtcgacaccttgctgcttctgcgccccacaggcagcgccacggtcttcctacagcagctggggcggggcctccgccgcaccgagtcgaagcctgtgctcaccgtcctcgacttcattggccaacacagagcggagttccgcttcgaggagcagttccgggccttgacgaacctctcccgcaatcgactcgtcgaccacatcgagcacgactttccacagctcccctccggttgccagatcatcttggagggcaagtccaaggacctcgtcctcgacaacatccgcacccagctgggcgcgactgtcaagacgctggtaaaggaggtgaaggactacggcacgccccgtctatcggattaccttcgcgagagtcgccgagagatcaaggagctctacaagagcgacaactcctggacgacgattctccgcagggcaggcctgattgatgcagcagcaccgtctggcgagacggagctactcaagcgcgtccactcgtttctccatgtcgatgacccagaccgcgcccgcgcctaccttcgcctactcgcggacgacgctcccccgtacgagtcgctcactccgaccgagcagacgtacgccgccatgctcttcttcaacctctgggataacgccggaggcttcaccagcttccagcagggtcttgaatcgttgcgcgctcagcgggtgttccgcgacgagctccgacaggtgctgtcgtacgtcatggagcagtccgaccacttcccgatcccgctgtcgggtccgcacagcagcgtccctctgaaggtccacagctcttacaaccgatcggagatcctggccgcccttggtgttgcgcgtttcggcggccagatgcctcggtcgtttgcgcaaggagtccaatgggtcgaggagattaagacagacgccctgttgatcacctcggagaagaacgagaaggacttctctcccaccattcgctacaaggattacgcattgagccccacgctcttccactgggagtcgcagaacgcgatcgccgcgaactcccgcacgggattgcgctaccaacagcacgagcaacaaggcagccacgtcctgttgttcatgcgccgctacaagagcaccgatatcggtaagtctcagccatggatgcttctaggcccggcaacgtacgtggagcacaccggcagcaagccgatggccatcacctggcgtcttcagcatgagctcccagccgacgtgtggacgtactcggccattactcctgga

SEQ ID NO: 5187 - DNA, 531 bp, Streptomyces avermitilis
  CDS (1)..(531)
gtggagcaacagatcgccgacttgttggacgagcaggaagagctggacctgccgcaagagcaactggaagcggctgaaggcgagtccgaggaggaatcggaggaagagtcctcacaaggggagaagttccccaagacacgtgctgcgcggatccagcgactggtgcgtgacgctgcggtgtcaaggaacgtcaaggacctctatggcggggagtgccaggcgtgcggtctgcgattggtgggtccggacgggcggccgtatagcgagggcgctcatatccgaccccttggcaagccgcactgtggccctgacgtggagcccaacgtcctctgcctctgccccaactgccatgtgcgccttgatatcggggccatcatcatcgaagacgactggtcgatcatcgtgcgtgccggggagctcggcggaaacgttctgtcaaagctcaagaggaagaaagagcaccacgtccacttggactacgtccgctatcaccgcgagtggtggctggagaagggtgaccccagccaggag

SEQ ID NO: 5188 - DNA, 1011 bp, Streptomyces avermitilis
  CDS (1)..(1011)
atgcgccccgacacgcctgccgagaacgtcgaccaccacgccgaagcggcacgcctggagcggaccgccggcctgtatcccgaggacgcggaacacctgctgttgcaggccgcggcccatctggaactggccggccaccgcccacgcgccacgtcgctgtacgacagcctgctctcctcttccacacccctggagaacccccacctggtacgagccctgaaggcgtcgaacctgtgggagtacggccacgaggccgaggcgcgagcgatcatcgacggaatccgcgccgcgtccccgcgggacccggccccgtgggtgatcgtggccgaggcgctggagcagcacgacgagctggaggcggcgcaagaaacgttcacgcagggggtgaccctcctgctgacggacgtaccggaacccccgtactcgaccctccccctcctcttcggccgccaccgggtccgccgcatgctgggcgcaccgcacgacgagtgggacacccgggcggacacgctcaactcgtcctcggtctccctggacgaactccacgacccgaagcggatctggtccctgggctcgaacaacccggcggaactggaggcggagatcagccgcctccgagcggaactgggcgtgtaccgggaggccctctcccgcccgttcccggtggccgtcctgcactggccggcccaggaactcacggaactgctggcggcgttcccgtccctgtccgccgagtacccgtcccacgagcagcacctcgcgacgatagaagcgtccctgagggaactgtccgcctccggcaccccgaacctgggcatcgtcacgggcacggtcccgtcgtacgaggcgttcgcggcctcggaggcctcgtccccggcagacggctcactcctaccgcagtacgcgacgacactggcggcgcgcggactggcagtggcttggccgccgcagcggacgggtgagtgttggtgtgggtctgggcgggtttatggggagtgtcacggggcggag

SEQ ID NO: 5189 - DNA, 1473 bp, Streptomyces avermitilis
  CDS (1)..(1473)
atgatccgacgcaggacactgctggccgcggccggcggtacgttcctcggcagcgcactggcgacaggcaccgcacgggccgacgcgacgatcgccgtcaacccctcgacgacgtacgggaagtgggagggctggggcacgtcgctggcgtggtgggcgaacgtcttcggggcgcgggacgacttcgccgacctcttcttcaccaccaagtcggtcacgtacaacggcaggacgctcccgggcctcggcctgaacatcgcccgctacaacctgggcgcgtgcagctggaacagcgtgagcggcgaaagcatggtcgcctccgccaacatcccggccttcaagcagatcgagggctactggcaggactggaacaacgaggacccgacgtcctcggcctggaagtggacggcggacgcggcgcaacgcaccatgctggtcaaggcgacggcgcggggcgcgaccaccgaactgttcgcgaactccccgatgtggtggatgtgcctgaaccacaacccgtcgggcgcgtccggcggcggcaacaacctccagtcctggaactaccgccagcacgcctcgcacctggccgccgtggccctgtacgcgaagtcgaactggggcgtgaacttcgcgacggtcgaccccttcaacgaaccctcctccagttggtggacggcgaccggcacccaggagggctgccacatggacgcgtcggtccaggcggccgtactcccgtatctgcgcagcgagttggacaggcggggcctgacgggtacgaagatctcggcatcggacgagacgagctacgacctggcccgcacgacctggggttcgttcggctcgtcgacgaaggcgctggtcaaccgggtcaacgtgcacggttaccagggctcgggcggccgccgcgacctcctgtacacggacgtggtgacgacggcgggcaaggccctgtggaactcggagacgggcgacagcgacgggaccggcctgaccctggcgagcaacctgtgcctggacttccgctggctgcacccgacggcctgggtctactggcaggtgatggaccccagctccggctgggcgatgatcgcgtacgacgcgagcacgctccagccgggcgcggtgcagacgaagtactacgtgatggcccagttcagccgccacatccgcgccgggatgacgatcgtcgacacgggggtcggctacgcggcggcggcgtacgacgcgacggccagacgcctggtgatcgtggccgtgaacacctcgacgtcggcccagaccctgaccttcgacctctcccgcttcagcacggtgacgggcggcacgggcggcctggtccgccgctggaacacggtcacgggcggcggtggcgacctctacgccgcgcactcggacacctacctgagcggaaagtcactgagcgtgccgttcgcggcgggcgcggtgcagacgctggaggtggacggagtgacggta

SEQ ID NO: 5190 - DNA, 816 bp, Streptomyces avermitilis
  CDS (1)..(816)
atgcgggctcccggtgtgccggtggtgcagcagcgcactcggcggcgacgtgacctccgccggcgcacgctctggaccggcggggaactcctcgtcaccgtaggggtcgtcctcctgctcctcgtcgtccaccagttgtggtggaccaaccggcaggcccagcgggacgccgagcgcggggtgcgggcgctggagcgggagtggggcagtccgtcggcaccggagtccgcgagcacggcggcggcggacggcgacaggtccgggcgcgacgggggcgacgggggcgacgggtccgcgagcgccggcccgtcccgggacggaaacgcggcccacgcgaccccggccccccagccccgtccctcccaggcgtacgccgtcctcaccatcccccgcctctccctccgggtccccgtcgccgaaggcatcggcaaggcgagcgtgctcaaccacgggtacgtcggccactacccgaagacggcgcagccgggccgggccgggaacttcgccctcgccgggcaccgcaacacccacggcgagcccttccggtatctcaaccggctccgccgcggtgacaccgtcgaggtggagaccaggacggccacctacacgtacgtcgtcgaccggaccctcccgcagacctcggcgagcgacgggggcgtcatcgcgcgggtgccccgcagcaccgtccggcccgcgtacggctaccgcagccccggctactacctcacgctcaccacctgtacccccgagttcacctcccgctaccgcctggtggtgtggggcaagctcgcctccatgcgtcctcgggctcctcgc

SEQ ID NO: 5191 - DNA, 333 bp, Streptomyces avermitilis
  CDS (1)..(333)
gtgcgagcaggaggggaggggcagttcatgatccggacctgggtcgccatgcgccccgccgccgtgctgctcgtgctcctcctcgagctggccgtcctcgacgccggcagtctctccgccgccgtcgccttcgccgcgaccgccgcggccggctccgcgctcgccgcctgcgcgctgatcgccgcgcgctgcgcgcccgccgtcccgcgtacgcgcgtacggacggccatccgcgaccgcgagcagcgcacggcgttcctgccccaacgcgatcccgacgcatcggggcgtacgcgcccccgagcgcccggacacgccctcctgacggccgcg

SEQ ID NO: 5192 - DNA, 729 bp, Streptomyces avermitilis
  CDS (1)..(729)
atgtccgttttcgccggcttggtcgagcaactcgccgacgtgctccagccgctgttccacgcctccgccgcggcggccgcgatcgtcctgttcaccgcgctcgtacggctcctggtgcacccgctgtcccgggcgtcggcgcgtgggcagcgggcgcgggcgaggctccagccgcaggtcgcggagctgcgcaagaagcacggcaagaaccccgagaagctccagaaggcgctgctggaactgcatgccgaggagaaggtctcgccgctgtccgggtgtctgcccgggctcttccagctccccgccttcttcctcctctaccacctgttctcgaacacgacgatcggcggcgaaggcaacgaactgctgacccacaccctgttcaccgcgcccctcggcgaccgctgggcggacgcgctgggcgacggcgggccgttcgggacgcaggggctggtctacctcggcctcttcgcgatcgtcgcggcggtcgcgaccttcaactaccgccgtacgaagcggacgatggcggcgaacccgctcccggtgggcgacggcgagcagcaggtgccggggctgggcgcgatcaacaggttcatgccgctgatgtccttcttcacgctcttcaccgtggcgttcgtgccgctggccgccgcgctgtacgtggtgaccagcacgacgtggagcgcggtcgagcgggcggcgctgtacccggtaccggagcggtcctcc

SEQ ID NO: 5193 - DNA, 855 bp, Streptomyces avermitilis
  CDS (1)..(855)
atgaagctgctgcgagtcggtacggccggggcggagcggcccgcgctgctcgacgccgaggggaccctgcgggacctgtcgggcatcgtcccggacatcgacggtgcgctgctcgccgacgacgcggcgctcggccggatccggtccgccgcacaggccggtgagctgcccgcgctggacgcggccgggctgcgcgtcggaccgccgctcgcccggatcggcaaggtcgtctgcatcggtctgaactaccacgaccacgcccgcgagaccggcgccgagccgcccaccgagccggtgatcttcttcaaggcggcggacacggtggtcggcccgcaggacacggtgctcgtgccgcgcgggtcggccaagaccgactgggaggtcgaactcgcggtcgtcatcggacgtacggcccgctacctggagtcgcacgaggaggcgctcgcgcatgtcgccgggtacgcggtggcgcacgacgtctccgagcgcgcgttccagatcgagcgcggcggtacctgggacaagggcaagaactgcgagacgttcaacccgctgggcccctggctcgtgacggcggacgaggtccccgacccgcaggacctcgcgctcaggctctgggtcaacggcgagctgaagcaggacggcacgacggccgagcagatcttcccggtcgccgaagtggtgcggtacgtcagccagttcatgaccctgtacccgggtgacgtcatcaacaccggtacgccggccggggtcgcgatgggacggcccgagccgaagccgtacctgcgggcgggtgacgtggtcgagctggagatcgaggggctcgggcgtcagcggcaggagttcaaggatgcg

SEQ ID NO: 5194 - DNA, 489 bp, Streptomyces avermitilis
  CDS (1)..(489)
gtgaccgaggcggccaagcccccgacgatccccgaactcgaagcccaggagcgccgtttgacgctcccgcacttcacatacgacgacgcgtgggcattcggcaacctgctggtggagctggcacggcggcgctgcgcccccgtggccgtcgacatccgccgcggcggacagcagctcttccacgcggcactgcccggctcgaccccggacaacgacgcctggatcgaccgcaaacgccgcgtcgtcgagcgctacggcagttcgtcctacctcgtcggctgccgcttccgcgccaagggcacgacgttcgaggaatcctcgcgcctggacccggacaagtacgcggcgcacggcggcgcgttcccgatcacggtggagggcgcgggcgtcgtcggcacggtggtggtctccggactcccgcaggtggaagaccacgcactggtggtggaggccctggagcagttcatgaccaggccctggagcagttcc

SEQ ID NO: 5195 - DNA, 1092 bp, Streptomyces avermitilis
  CDS (1)..(1092)
atgactggcacagcttccggctccggcacccccctccgcgtggccctggtcggctacgggctcgcgggctccgtcttccatgccccgctgatcgccgccaccgagggcctcgcgctcgacacggtggtcacgaccagcccggagcggcaggagcaggcccgcgccgagttcggcgacagcctcaggttcgccgcgacccccgacgacctctggtcccgcgccgacgagctggacctggtcgtcatcgcgtccccgaacaagacgcacgtcccgatcgcgaccgccgccctcaaggccggcctccccgtcgtcgtggacaagcccatcgcgggcacggcggccgaggcacgcgagctggccgccctcgccgacgaacgcggcctgctgctctccgtcttccagaaccgccgctgggacaacgacttcctgaccctccgcaagctgctcgaggagggcgagctcggcgacgcctggcgcttcgagtcccgtttcgagcgctggcgcccgcagcccaagggcggctggcgtgagtccggcgacccggcagagatcggaggtctgctctacgacctcggcagccacctcgtcgaccaggcgctggccctcttcggccccgccgcctcggtgtacgccgagtcggacgtccgccgccccggcgcggagaccgacgacgacacgttcatcgcggtcacgcacacgaacggcgtccgctcccacctctacgcctccgcgaccgcggcccagctcggcccgcgcttccgggtgctcggctcacaggccggttacgtgaagtacggcctcgacccgcaggaggccgccctgcgtgagggcgatcggcccacgggtgacggggactggggcgtcgagcccgagtcgctgtggggccgcgtcggcgccggcgagtccccgctgagcggcggcggcacccccgtacccacgctgccgggcgcgtaccccgccttctacgacgccgtggcgaaggcgctgcgcgaggacggccccaacccggtgaccgcgtacgaggccgcggacgccctggacgtcctggaggcggcccgccgctccgcccgcgacggcgagaccgtgatcgtg

SEQ ID NO: 5196 - DNA, 1284 bp, Streptomyces avermitilis
  CDS (1)..(1284)
atggcctacgtgaacaggagcaacgaggagtcgggtgggacggcgggcgcgaggcccgcagtggcgtcggagacgggggccggggtgaagccgggtgcgaagtcgggtgtgaaggcgggcgtcaatctgctggggctgcgcgggcacaacgcggcgctggtgctcgatctgctgcgcaccgccgggccggccggcatcagccgcctcgaactcgccgagcggaccgggctgaccccgcaggccgtcagcaagatcaccgcccggctgcgggcggacggtctggtggcggaggcgggccgccgcgcctcgacgggcggcaagccgcgaaccgtgctgtgcctggtgcccggcgccggacacgcggtggggctgcatctggaccgggacgagctgcgggcgctgctctgcgatctgacgggtgcggtggtcgcggagcgccgggcgccgctggacctgggggcgggcgccgagaccctggtggaaggggcggcgcgggaggtggaggcgctgctggcggccgggggctcggtctcggtgctcggtgtcggcgtcgcgctgcccggaccgctcgaccacgtgcacggagtgctgcaccgggtcaccgggttccccgagtgggacgggtttccgctgcgggaggcgctggcccggcggctgggggtgcccgtggtcatggacaaggacacgaacgcggcggcgctggggctggctgtgggcggggtggtcgagggcgatcacgaggcctacggggcgtacggggtgaacggggtgtacgccccgccgtggggttccgccgaatcctcggggcccgcgagttcctccgcgtccttcgcctacctgcacctcgggaccgggctcggtgccgggctcgtcatcggtggggccgtgcaccggggggccaggaccggggcgggggagttcgggcatcaggtcatccagctggacggaccgccgtgcggctgcggcaaccgcggctgcatcgaggcgctgtgcctggccgccgtggcccgcggtgccgtcgacgaggccgcgcgggtcctcggcgcgggcgccgcgaatctggccggactgctcgacatcgacctggtactgctcggcgggcgtaccgtcgccgcccaccccaaggcgttcgtccgcggggtcggcgccgttctcgacgaacgcgcccgccgtgagggcacgaccgcggccgttccggtacgcatcgcgccgggcggggagcgcggggtcgccgagggagcggcccagctgctgctcgcgccgctgttcgggcgggcggacggg

SEQ ID NO: 5197 - DNA, 1017 bp, Streptomyces avermitilis
  CDS (1)..(1017)
gtggaccccgaatcggctgcccacgaatcggctgcccgcagatcgactgccctcgcatcagctggccccagaccggctgccctcgtatcggcggtctccagcccggcgcccttcagcccggcggtcaccaacccggtggcctccagcccggtggccaccagcctggcggtccccctcccggcggaccgtagccccacctgcaccacccccgtcgtcggcgccttccccctcgccacccgcattcacggcggccccggctcctacgaggccggtggcgccgagggcacctggttcatcgacctcaagaacaccaccgcccacccgtgcgggaacatccaccccgtcgtcgtactcgtcgacgagaagcgcgtgctgaccgtcactcagccccggctggagttcttcgaaggggcccgcccgcaccccgtcaccttcgagcgcaccgaccaggacgagctggtcggggtcttcgacgacggtttccccggtttcacggtcgcgccgggacggacgctcacggtcaaggtgcggctcacggtcgccgcgggcaccgtgcccgacgccgtggtggcgaacgcggcgatcgtgcagcggcggggcgccgacggggactgggtggggcagtcgaacgactaccggttccaggtcgtcgtcgacgccggcaacggcgacggcaacgcgagcgacggcaatgagagcgagggcaacgcgagcgagggcaacggcgacggcaccgggagcggtgacggcaccgagaacggtgacggcaacctgagcggtgacggcaacacgagcggtgacggcgacacgagcagtgacgacagcaacgccggtgacggcagcgcctcccccgcgccgacggggtccccgctgccgcgggaggacggggccgaggagctggcccggacggggccgcgggcaccgcacgggctcggggcggtgttcggaaccctgctgctggtcgtgggcggcgtcctgctggccgcggccggcccactgctccaccgcaaccgccgc

SEQ ID NO: 5198 - DNA, 777 bp, Streptomyces avermitilis
  CDS (1)..(777)
atggcagagcgcaagcccatcgagtcatggctcaccgacatggacggtgtgctcatccacgagggcgtcccgatccccggcgcggacgccttcataaagaagctgcgcgagtccggcaagcccttcctcgtcctcaccaacaactcgatctacaccccgcgcgacctgcacgcccgcctgcggcgcatgggcctggacgtgccggtcgagaacatctggacctcggcgctcgccaccgcccagttcctcggcgaccagcggcccgacggcacggcgtacgtcatcggcgaggccggcctgaccacggcgctgcacgacatcgggtacgtgctgaccgaccacgagccggactacgtggtgctcggcgagacccgcacgtactccttcgaggcgatgacccaggccgtccggctgatcaacaagggggcccgcttcatctgtaccaaccccgacgagaccgggccgtccgccgagggcccgctgcccgccacgggcgccgtcgcggccctgatcaccaaggcgaccggcaagaagccgtacttcgcgggcaagccgaacccgctgatgatgcgcaccggcctgaacaccctgggggcgcactccgagaccagcgcgatgatcggcgaccgcatggacaccgacgtgctggccgggatggaggccgggatgcagacgttcctggtgctcacgggcctgacgggacccgaccaggtcgaaaactacccgtaccggccctcgaaggtcgtcgactccatcgcggacctcgtcgactggatc

SEQ ID NO: 5199 - DNA, 645 bp, Streptomyces avermitilis
  CDS (1)..(645)
atgggttcattgcgactcactgtctgtacgggcgcggtcgtcgcggccgctctcacccccacgtcgtacgcggcggcctcgacgggcgtcggcgtgtccccggcgtcccccgccccgggcagcgacatcaggctcgcggcgcggggctgcgacggcaggaccggcacggcggcatcggacgcgttcgtggcggacacgccactcgtcggcaaggacggcgtcctcgtcggcgagagccgggtccgtacgctgctggcgcccggcagctacgacgtcctgatcagctgcgacggccgtgacgacaaggtcagggccgcgctcaccgtcgccggggcgtccccggcgacccccgccgaggccccgacggcgcccctttccccggccgcgcccctctcctcggccgtgcccccttcccccgcggcgcccctctctcctgtcgagcccctctcctctgtcgcgcccctctcctcggccgcgcccgcctctccggtcgcgcccgtgaacgcgggcggcggcggcacggcacacctcgcgtccgagaaagcccgggagaccggcgccgggaacgtcctcgtcggcctcgccctcgcgggcatcgccgcgtgcgcggtacgcggcgccgcccgccggaaccgcggaacgaac

SEQ ID NO: 5200 - DNA, 663 bp, Streptomyces avermitilis
  CDS (1)..(663)
atgtccgaccgggagcgttcctccggtaacggtcgtctgctgatgggcatctcctgggcggtgctgctgctcggactgtggctgtggggccggcaggtgaccgacgtaccgccggggatgtccgcgcggaccaccggggacgtggcggcggtcgggcggccgctcgaagtggaactgccgcactccgccgaaccgctcggggaggcgctgccgcagcgcgtcgacatcccggcgatgggcgtgcaggcccccgtggtggcgcgcggcctcgacgggcacggcgccgtgcagccaccgccgttcgaccagccgggagtcgtcggctggtacgcggccggggtgaaacccggggcggccgggaccgccctcttcgtggggcacgtcgacaccgagacccggcccgccattttctacaagctcagcacgctgcggcccggcgacgcggtccgggtggtccgtgacgacggccgggtcgccgagttcaccgtggacgacgtacaggtcctcgcccgcgaccgcttcgacgcccagcaggcctacggaccgagaaagccgggccgggccgaactgcggatgatcacctgcggcggttccttcgaccgcgacagcggcggctacacggcgaacgtggtggtcaacgcctacctgacgggcagcggaccg

SEQ ID NO: 5201 - DNA, 1014 bp, Streptomyces avermitilis
  CDS (1)..(1014)
atgtacgggaagaggggggccggggcactggcggccgtggcgttggcgggggccgcgctgctgctggcggggtgttccgctcccgaggacaacagcaagaagggcggcgggggcgctgacatcgcgcagcggccgaaaggctcggacccgttctgggtcaaccccgaggggaacgcggccgagcagctcgccacctacgcgagagcgggcaggaaggacgacgccgagcaaatccggaagatagcggagcagccgacgggggagtggatcgggccggagaacccggaagcggaggcgcgcggttacacggaggccgcggagaaggcggaccgcaccgcgctcctcgtcctctacaacattccgcaccgcgactgcgggcagttctcgcagggcggcgccgcggacggcgacgcgtaccgggcctggatcgacggcgtgaccaagggcatcggggaccggaacacgacggtggtcctggagccggacgcgctgctgcacatcgtcgacggctgcacgccggacgagttccacgaggagcgctacgacctgctcaagggcgcgatcgccaagctcggagcgctgaagaacaccaaggtctacctggacgcgggcaacgcgggctggggccaccccgaccagatcttccagccgctccagcgggcgggcgtcgaccgggccgacggcttcgcggtcaacgtctccaacttctacacgacgcgggactccatcgcgtacggcaagcagctgtcggcgaaggtcggcgacaagcacttcgtgatcgacacgagccgcaacggcaacgggccgtacacggcgggcaaggcggacgagaactggtgcaacccgccggggcgggcgctgggcgagaccccgtccacgaagacggccgatccgctggtggacgcgtatgtgtgggtcaaacgcccgggcgagtcggacggcacgtgcaagggcggcccgaaggcgggcgagtggtggtccgactatgcgctgaagctggcccgcgcgtccaag

SEQ ID NO: 5202 - DNA, 1935 bp, Streptomyces avermitilis
  CDS (1)..(1935)
atgaaggaccaggccggccgccgccgcgctcgtcgcatcgcgataagcggggcggtggtcctcgcactggccgggatgaacgggccgtggctgtaccgcttcggaacggagaaataccaccagtacacgatcaacaagcccgagtacaaagccgccaacggccactgggacgtcatcgacttccccgaggagtaccggctgaacacgatccacgccgcgctcctgcacacgggcaagatcctgctgatcgcgggctcgggcaacaaccaggacaacttcgacgcgaagaagttcgacacccggatctgggacccggaaaagcgcaccatcaagaagatcccgacgccgaaggacctcttctgcacgggccacacacagctcgcgaacggcaatctgctcatcgcgggcggcaccaagcggtacgagaagctgaagggtgacgtcaccagggccggcggcctgatgatcgtccacaacgagaacccggacaagccgatcaccctgcccgcgggcaccgcgttcaccggcaagcggaacggcaagacgttcgtgtcgaaggacccggtgctcgtaccgcgcgcgaagaaggtcttcgacaaggcgacgggcaggttcctgcgcaacgacccgggcctcggccgcatctacgtcgaggcgcagcgcagcgggcagaagtacgagaccggcacgcaggacaactaccgcatcgggggcctggccggcgcgagcgcccgcaacacctacggcatcgcccagaagctcgccctcgacaagaaggacttccaggggatcagggacgccttcgagttcgacccggtcgccgagaagtacatcaaggtcgacccgatgaacgaggcccgctggtatccgacgctgaccaccctgtccgacggcagggtcctcagcctctccggcctggacgagatcggtcagctggtgccgggcaagaacgaggtgttcgacccgaagaccaagaagtggacgtacacgaagggcgtccggcagttcccgacgtacccggcgatctcgctgatgcagaacggcgagctgttctactcgggcgcgaacgccggatacggccctgacgacgtgggccgtgaccccggcgtctgggacctggcgagcaacaagttcaccaagctccccgggctgagcgacaagaacatgctggagacggccgggaccgtgctgctgccgccggcgcaggacgagaagtacatggtcgtcgggggcggcggggtcggcgagtccaagctgtccagcaaccggacgcggctcatcgacctcaaggcgaagaacccgcgcttcgtggacgggccgacgctggagaagggcacgcgctacccgcagtcctcgatcctccccgacgacacggtcctggtctccggcggctcgcaggactaccgcggacgcggcgactcgaacatcctccaggcccggatctacgacgcgaagacgaacggcttcaagcgcgtcgccgacccgctggtgggccgcaactaccactcggggtcgatcctgctgcccgacggccgggtgatgttcttcggctccgactcgctgtacgcggacaaggcgaacaccaagcccggcgtgttcgagcagcgcatcgagatctacaccccgccgtacgtctaccgggactcacggccctccctctcgggcggcccggggaccctcgcacgcggggcgtcgggcacgttcaagtcggcgcacgcgtcgtccatcaagacggcgcgcctgatccgcccgagcgcgtccacgcacgtcacggacgtggaccagcggtcgatcgcgctggacttcaagaagtcgaaggacggcatcacggtgaccgtcccgaagaaccgcaacctggtcgaatccggctggtacatgctgttcgtgacggacgaccaggggaccccgagcaaggcccagtgggtgcgggttccc

SEQ ID NO: 5203 - DNA, 1992 bp, Streptomyces avermitilis
  CDS (1)..(1992)
atgacgtcgacgccgacgggcgcccgacagaacttcgatccgtcagagacgacccagctcagggtgccgggtcacagatccggcaacacgggcagcttccgcagaatcaagaagaacctgccgagatacgactacgagcactacagccgtctcgcgggtccgctcacccagcccgacccgcaccagccgtacaaggtgcagtaccgcacgctgctctcgcaggagccgcaccgcctgcgcgccgcgctcatgctgggcgcggcaccgctgctgtcactggtcctgctcggctggctgctccagcccgaacactggaccgaacgggactatcccgcctacgacttcctgccggctctcgacatagtgatgctggtctcgatcggtctgatcgagttcttccgctgtatgaacgtgctgtcgaacgcgcacgccaccctggtcgcccgcgacccgatcccggtggtgcccgagaccggcaccagagtggccttcctgacctccttcgtgcccggcaaggagccgctggagatggtgacgaagaccctggaggcggccgtccggctgcgccaccggggccttctgcacatctggctcctggacgagggcgacgacgcggaggtgaaggcggtctgcgagcgcctgggcgtgcaccacttctcccgcaagggcgtcgccaagtggaaccaggccaagggtccgcaccgcgccaagaccaagcacggcaactacaacgcctggctggaagcccacggcgacgactacgactacttcgcctcggtcgacaccgaccatgtgccgctgcccaactatctggagcggatgctcggcttcttccgtgacccggacgtcggcttcgtcatcggcccgcaggtgtacggcaactacgacaacccgatcaccaaggccgccgagtcccagcagttcctcttccacgccctgatccagcgggccggcaacgcctacggcgcgccgatgttcgtgggcacctccaacgccgtacgcatcaaggcgctgaagcagatcggcggtctgtacgactcgatcaccgaggacatggcgaccggcttcgagatccaccgccacaagaaccccgccacgggcaagaagtggcgctcggtctacaccccggacgtcctcgcggtcggcgagggtccgaacgcctggacggacttcttcacccagcagctgcgctggtcccggggcacgtacgagacgatcctcaagcagtactggaagggcttctactcgctgccgccgagcaagctcttcaactacaccatgatgatcatcttctacccgatgtcggccctcaactggatcctcgcggcgctgagctgcgcgctgttcctgggcctgggcgcctcgggcgtgaacatcgacccgacggtctggctgatgctgtacggcaacgcgtccgcgctgcagatcggcctgtacgtctggaaccgccggcacaacgtctccccgcacgagcccgagggctccggcggtgtggcgggcatgatcatgtcggcgctctccgcgccggtctacgcccgctcgctgatggacgccgtgctgcggcgcaagagcaagttcgtggtgacccccaagggtgattcggcgagcccggacacgctgttcgggaccttccggatccatctgttcttcatcctggtcttcgccggttcgatcgccgccggcctgttcctcggccacgcccacccggcgatgatcacctgggcctcgttcgccctgctgatcacggcgtcgccgatcctcgcgtggcgctggacgctgcggcaggcgaagcggcggccggccgccgtggccgacccggccgagccgccggacgccccggtgacaccgccgcagcccgctccggcgcacgcgcggcccaagcccagctgggccgcggacgcggggaacgccacgggctccgccggctccgcggactccacggccgcggggaatgaccagaccatgcagatcgcccttgggggacacaagaaa

SEQ ID NO: 5204 - DNA, 720 bp, Streptomyces avermitilis
  CDS (1)..(720)
ttggccggataccctctcgccatggcgcgcgacctgcaagagcggatcaagaagctcatcatcgaccggcggctgccctcgggggccgtgctgccgaccgagcccgaactgatgaagctgctcggcgccagccggaactccgtgcgcgaggccctcaaggcgctccaggcgatgggcatcgtcgagatccggcacggcttcgggacgtacgtcgggccgatgtccatggccccgatgatcgaggggctcgccttccgcacggtcgccgggcaccgtcgcggcgaggactccctgctccagctcctggaactgcgcgaggcgatggagaccgggctcgtctcgcggctcgccggccgggtcgcgccgcgggatctcgttgaactggatggcctcgtcgaccgtatggagagggaggccgccgaaggagccggcctcgccgagacggaccgcgcctttcacgccaccctctaccggggccttggcaatgtattgctgagcgaggtcctggaggccttctgggacgccttccaccgcgtacgcaccgatctggcggacgtgccgcaggacccacgggtcacctgtcggcagcaccgggagatcctcgacgcggtccgctcgggggattccatacgggcggaggaggcgataagggagcacttcggcaacatccgtacacggctggcctcaacggaaccaatcgcacccacaaggcgtcccaat

SEQ ID NO: 5205 - DNA, 1197 bp, Streptomyces avermitilis
  CDS (1)..(1197)
atggcgactccggaattcgaggaattcgatcccgcgagcggctgcgactgccccggctgtgttcactggcatcgcgccgggggtgccccctcgggaggtcgtccgagggcgggggagtcccctttcgcgctgtcgggacagctcgtccgcccggcggcccgcggagcgctggtcctggccgcggtggccggtgcggtccttggcgcaagccactcgatgccggccgtcgccgccgctcacggccccgttcggccgggcgttcccgcaggtgacgagccccagaacccacaggggggcaaggctccgctgcatggccccggcggccgccccgcaaccgtgaaagcgcccccgaccacccgggccgcgatcatcgaccgggccaggacatggaccgccgcggagatcccgtacagcatgagcgcctactggtccgacgggtaccgccaggactgctcgggctttgtctcgatggcctggaacctcggcgacaacgaatggacgggcagcctggacaagttcggcgtccgcatttcgaaggaggagatcaagcccggcgacattctcctcttccataatcccgacaacccggagaagggctcgcacgtcgtccttttcggcggctggacggactacacgcacacggaatacctcgcctacgaggaaacgcccccggtcgcccggatgcaggccactccgtacgcctactggagcaattccgacagctatgtggcgtaccgctacatgagcgtgctggaggacgtgggcgtttcggggtcccccgcggccgtgcccctggaagtggttcccgactacccgggcgacgcctacttcgggccgggtgccgacaaccgttacgtcacccagctcggccggctcctcgtcgaccgcggcggggcccgcttctacgccaccgggccgggcccgcgctggtcggacgcggacagccgggccacccaggcgttccaggaggcgcagggctggcaaggggcgggggcggacgggctgccggacccgacgacctgggcctacctgctggaaaggaaggggcgggacattccgccggccgacagctccggggtcacgggcagcccggtgggggaccggcggagcgtcgaggcgttcccgcgcgccaagggccggcgcggtggtgcggccgacggccacccggggcccgaggcctggcggcggctgttcgcc

SEQ ID NO: 5206 - DNA, 1194 bp, Streptomyces avermitilis
  CDS (1)..(1194)
atgactacgacaacgtcgaacacgccggagtccgaaggcccgccgcacaacggcgctccgcggcccgcccggctcatccacaacgagtcgaccaccgagatccccgtccatctcctcttccgggacgaccccgaccccgaccccgaccccgtctccgtgccgccggcgcccgccgtcgtggggcgccggcgcggcaccggtgaacagccgcgcctacgccggtccgtcccggtcagggagcgcccggtgccggtcgtcgatccggagctggtggaacgccccgcacgggtgctgcccggcgcggcgggcgtactggccggcgtctgcggggtggccggctgtgtcgtcacctcgtggtggtcgggcgtcctgccgccggtcgcggcacgggtgctgcagagtctgtccggggacgtcgcgcaccagttgggcggcgcgctgccctggtacgagggtgccgggctcggtcccgcccagtgggccgcgtacgccggagccggggcgctcggtctgttcggcttcggcggcctggcccgcggctgcaccggacgggcctgggtgctcggcctcttcggccgctaccggggcaccatccggcgcaccgggctgatgtgggtgaacccgctgctgctgcgccgccgtgtcgacgtaaggctgcggcactggcgcagcgagccgatgccggcggtcgacgccaacggggtgccgctgcgggtggtcgtcctggtcacctggcgggtcaaggacaccgcgcgggccctgctcggcatcgacgaccaccagacctatctgcgcgagtgcgtggagtcggcgctcgctcgggtgctcccgcaggttccggccgaggcgcccgtcgtgaaggacacggtgagcctgcgcaacgtcgacgcggtcggcgacacgctcacccgcctggtggcggcggacgcggcgccggtgggcctggaggtgttctcggcgcagccgacgcggatcgagtacgcccccgaggtcgcggcgcggatgcagcgccgccggatcgccgcgctggacgcccagcaccgggacacggtgctcacctcggtcgtcgactcggtccaggacacggtgacgcggctgaccatgcgcggcctggtcgagctcgacgactacgagcgcaaggcactcgtgaaggacctgacggtggcgttctacacgggacacagagaatcgtcg

SEQ ID NO: 5207 - DNA, 654 bp, Streptomyces avermitilis
  CDS (1)..(654)
atgcgcatacggacgaccaggaaagagccccggcgagcgaccgggaaagcggccgggaaggccaaggtgtacgcggccgtcatcggtctcgcgacggcgggcaccttcgtgctctccaccggcccggccggcgcccacggctacaccgaccagcccctcagccggcagaagatgtgcgcgaccggcgggtccgtggccaactgcggtgacatccagtgggagccccagagcgtcgagggccccaagggcttccccgcgggcggaccggccgacggacagatctgttcggcgggccactccaacttcggccagctcaaccagcccaagacccccgcgggcacggcctggcccacgaccagggtgacgggcggacagagctacagcttccgctggcagttcaccgcctcgcacgccacgaccgacttcaagtactacgtcacgaaggccggctggaaccagaaccacgcgctgacccgcgcggatctgaacaccacgccgttcctgacggtgccgtacaacaaccagcgcccgccgtccacgctctcccacagcggcaccctgcccaccgggctgagcggtcaccacgtcatcctcggggtctggacgatcgcggacacggcgaacgcgttctactcgtgcgccgacgtcactttc

SEQ ID NO: 5208 - DNA, 468 bp, Streptomyces avermitilis
  CDS (1)..(468)
atggacgtcattttctatgccatacccagcctgatcatcgccggcgtgctggccatggcgaccgtggtcgtcaggcgctcgctccagctcaggagcaactggaacagcggactggtcgccgaggcgcgctgtctgcgggcgtacaccacgaccagcggtggcggcggtgacacctccgtgagcaccacccagcaccacgtctacgagttcaccagcggcgacggcctcacgatccgcttcgacgaggcgaacggcccggggacgaccgtcccgggcgacatcgtcaccgtgcactacacggccgagcgccccgaccgggccaccgcccacgccccggcgcgcggcctggccctggccggcacgatcggcatcctggtgttcctcggggtggtcgccgtgtcctgcgtcggcttcatggttacgtacaccgaagtcttcgcgggggacggcgggttcagcaccatgccg

SEQ ID NO: 5209 - DNA, 1638 bp, Streptomyces avermitilis
  CDS (1)..(1638)
atgaggcgtaccgtcgcggagctggtgcgggaacggtggggcgaccaccggccggggctgtggttcgaagggcgggtgctcagccatcaccagatggcggcgggcgcggcggcccgcgcggagctgctggccggcctgctggcgtccggcgccgaaccgcatgtcggggtcctgctcgacaacacccccgagtacccgctgtggctgagcgcggccgccgtcgccggtgcggccgtcgccggcctcaaccccacccgacgcggccccgaactggcccgcgacatccggcacaccgagtgccgggtcgtggtcaccgagcgcgcccacctgccgctcctcgacgggctcgaactgcccggcgtacgcctgctggtgaccgacacggacgcctacgaggaactgctcgcgccctacgccgacgcggagccggacgcgtcccgggccaccccggacgaccgcctcctgctgtacttcacctccggctcgacgggcgcccccaaggccgcgatctgctcccagggccggctggccgccgccgggcactcactcgtcggtcacttcggggtgcgcccggacgacgtgcactacgtctgtatgccgatgttccacggcaacgcggtgatcgccgactgggcgcccgcgctcgcggcgggtgcgggggtggcgctgcgccggcgcttctcggcctcgggctttctgccggacgtacgggcgtacggggcgacgtacttcacgtatgtggggcgtgccgtccagtacatcctggccaccgaggagcggcccggcgaccgggacaacccgctgcggctcggcttcggcacggaggcgggggcggtggacgcggcggccttcgagcggcggttcggggtgcggctggtggaggggtacggctcctcggagggcggcgcggcgatccagtggcgtcctggcaccccgccgggggcggtcggccgggcggcccccggggacgacctggcggtactcgacccggacacccgcgaggagtgcccgccggccgagttcgacgcggccggccggctcggcaacggggccgaggcgataggggagctggtgaaccgcgggcccaaccccttcgagggctactggcgcaatcccgaggcggacgcggcgaggcggcgggcgggctggtactggacgggtgacctgttctaccgggacgccgacgggttcctctacttcgccggccgcacggacgaccggctgcgcgtcgacagcgagaacctcgccgccgcgacgatcgagaacatcctcgcccggtacgagggtgccgccgccgtcgccgtgtacgcggtgccggatccggtggccggggaccaggtgatggcgacggtcgccggtgacttcgacccgctcggcttcgccgcgttcctgctggcccagccggatctggggacgaagatggcgccccggttcgtccgggtcgtggagcggatgccggtcacggccacgaacaagatccatcgggcggggctgcggcgggaggggttccggtgcgccgacccggtgtggtggcggccgcccggggagcgctgctaccggcggctcaccggggcggatgtggcggggctggtggacgagtaccgggcgcgggggcgggaggagctcctcaccagggcg

SEQ ID NO: 5210 - DNA, 849 bp, Streptomyces avermitilis
  CDS (1)..(849)
ttgtcaacccctgccctcttcacccctcttggcggctatcgtggacacagccaggctgtccggaaacggcccacaaaagcgcagggggaaaccgtggcgctgaagcacgagccgaccgccccgaaccactcggcccaggacgccctccgcgtcctggagacggtggcccgacactccaccggcgtcaccgacaccgaactcgcccgtcggaccggtctcggcacggagcggctgaccgccctcctgcggatgctgcgcagggagggatacgtcgaacaggtcgccgacggggagtacgtccccggtgcctccctcagcaggctgggttccacgcacggccatgaccaggccctgcgggagaagctccagcacaccctcgaccggctgcgcgactccgtgggtgccgcgatctacatcagccgctacatagacggcgaggtgcacgtcacccagtgcgcggagggcccgaccacgcccgccgtgcacgagtgggtcgacttccgctcctccgcccacgccagcgcggtcggcaagagcctgctcggccagctcgatctcaacggacgccgcgaccacctcgcccgccacaagatggcccgcctcacctcgcggacgatcaccagcgagcgggtgctgctgtcccgtctggacgcccagccgccgacggttcccgtgctcgacctccaggaatacgcggtcggcacggtctgcgcggccgtcccgatcaccgccggctcctccgtgggctgcctcgccctgtccctgccgatcgagcacgcccaccgcctgcggcaggcggcggaaacgctgaacaagggggcggcgccggtcctgctctcgctggcgatc

SEQ ID NO: 5211 - DNA, 813 bp, Streptomyces avermitilis
  CDS (1)..(813)
ttgcccgctgacaccaccccctcgacacagacggccggccccacggtggacggcgacgagctgatccgcttcgagaaggtcaccaagagcttcgggtcccacaccgtgctggactcgctggacttctccgtcgactccggcaagcacgtcaccctgatcggcccgtccggctccggcaagacgacgatcctgcggctgctgatgacgctgacgaagcccgactcgggcacgatcagggtcaacggcgactacctcacccacgaggagaagaacggcgccctggtcccggccggtgagaagcacgtccgcgaggtccgcaagaacatcgggatggtcttccagcagttcaacctgttcccgaacatgaaggtgctgcgcaacgtcaccgaggcgcccgtcaccgtgctcggtctggccaaggacgaggccgagcagcgggcccgtgaactgctcgacctggtgggcctcgccgacaaggcggacgcctatccgacccagctgtcgggcgggcaacagcagcgggtcgcgatagcccgggccctcgccatgcgcccccaggtgctgctgctcgacgaggtgacgtcggcgctggaccccgagctcgtcgcgggcgtcctggacgtcctgcgcgacatcgcccgcagtacggacatcacgatgctctgcgtgacccacgagatgaacttcgcccgggacatctccgaccaggtgctgatgttcgacgcgggccatgtgatcgagtccgggtcgccggagaagatcttcggcgaccccgaccacgagcgcacccgcgagttcctgagcgcggtccgc

SEQ ID NO: 5212 - DNA, 648 bp, Streptomyces avermitilis
  CDS (1)..(648)
gtgaactggaactggtccacgctcggcgacttcatgccccggttctgggacggtgtcctggtgacgctcgaggccctggtcctcggctcgctgatcgccttcgccctcggactggtctgggccctcgcccagcgctcgtcgctgaaggcggtgcgatggcccgtcctggccgtcaccgagttcatccgcaacaccccgctgctcgtgcagcttttcttcttcttctacgtcctgcccgagtggggcatcaccctgtccgcgctggccaccggcgtgatcggcctgggcctgcactactccacgtacaccgcggaggtctatcgcgcgggcatcgacggcgttcccgtgggccagtgggaggcggccacggcgctcagcctgccccgttcgcgcacctggaccgcggtcatcctgccgcaggccctgcgccgcgtcgtgcccgccctcggcaactacgtcatcgcgatgctgaaggactcgccgatgctcatgaccatcggcgtgctggagatgctgggcgaggcccgccagttcggttcgcggaccttccacatgaacgagccgatcgtgctcgtcggcgtcgccttcatcgtcatcgcctaccccgcctcccttctcctccgagctctggagcgccgccttgcccgc

SEQ ID NO: 5213 - DNA, 747 bp, Streptomyces avermitilis
  CDS (1)..(747)
atgagtgagataagcgcaggcttgtgggagctgctcctcaagggtgtgtggatcacggtccagttgaccgtctacagcgccgcgctcggcgccgtggtcgccttcaccgtcggcctggcccgtacccatcggctgtgggtcgtacgtttcctgtccggggcctacttcgaggtgttccgcggtacgtccgcgctggtcctgatgctatgggtgttcttcgtggtgccgctgaccctgggctggcagctggtcccgatgtgggccgccgtactcacgctcggctgcacctacggcgcctacggctccgagatcgtgcgcggtgccgtcgcggccgtcgcgccggcccagcgcgaggcggggatcgcactgagcttcacacccgcccagcggctgcggaagatcatcctgccgcaggcctggcccgagatggtgccccccttcaacaacctgctcatcgagctgctgaagggcaccgccctggtgtccgtcctcggcgtgggggacatcaccttcgccgcccagctggtgcgtaacgccaccggacagagcgctccggtgtacacggtgatcctggtcatgtacttcgtgctcgcgttcctgctgacccgggtgatgcgcctggtggagcgcagggccaaggccggcatcgggcagtccccggccggcggcgccgccgtgacgcagaagaccggcctcggcccgcagcaggacttcgcccgcagctggtccggccccggaggtgcctcg

SEQ ID NO: 5214 - DNA, 924 bp, Streptomyces avermitilis
  CDS (1)..(924)
atggcttcaccgcagggaaacacctcaggaagcatgccccgagacagactccgccgccgctccctcctcgcgggagcggcggccctcgccacggtgggcacggtcggcgcgaccagcggatgcagccgggtggccaccgccgacaccggggacgggggccatctgctggagcagctgagggccaggggaaccgtacggctcggcatcgcgggcgagcagccctacggctacatcggcaaggacggaagggtgacggggtcggcgccggtcatcgccacccgtatcttcaacgaactcggcatcgaccatgtcgagccgttccccaccgacttcggctcgctgatcttcggcctcaactccctccagttcgacgtggtcgccgccgggatgtacatcaccccggaacgctgcgggcaggtcgtcttcgccgatcccgagtaccagatgaaggacgccttcatcgtgcgcaagggcaacccgctgaagctgcgcacctacgcggacctcggcaggtcgaaggcccgcgtggccaccggcatcggctacgcggagatcgactacatcaaggaggcgggggtcaggaaggtcgacaccctgccggaccagctggccggtctcctcgccgtcgagcagggccgcgtcgacgtgttcgtcggcaccgcggtcacggtgcgcaacgtggtcaaggagaccgggagcagcaaggcggaggcgaccgccgaggtcacgccctatctggacggcaaaccggtcaccgacgtcggcgccttcgcgttccgcaggccggagcggaacctgcgcgacgcctacaaccgtgagctgcgcaagctgaagcgaagcggtgaactcctggagatcatgcggcccttcggcttcacgaaggcccagatgacgaccatcacggccgaggagaagtgcacacca

SEQ ID NO: 5215 - DNA, 486 bp, Streptomyces avermitilis
  CDS (1)..(486)
atggcagaccgatacctcgaagtcgcgctcgacaagcgcgcagtgcgctgcaccgcccgacttctcgacgaccgcgcgcccctcacctgccaggcggtgtgggacgcgctgcccctcggctccgacgtctaccacgccaagtacgcgcgcaacgaggtctacgccctcttcccgcccttcgcggcccaggaaccgcccctggagaacccgacggtcacgcccatccccggcgacctctgctacttcaccttctccggcgcggagctgggcacgaaggcctacggctacggaaaggcccagcaggagacggtggtggacctcgccctcttctacgagcgcaacaacctgctgctcaacggcgatgtgggctgggtgccgggcatcgtctggggccaggtggtcgagggcctggacgcgatggccgaggcgtgcaacgacctgtggcgatcgggcgcgcagggcgagaccctgagcttccgccgcgcc

SEQ ID NO: 5216 - DNA, 1440 bp, Streptomyces avermitilis
  CDS (1)..(1440)
atgaccgaactcaccgagctgaccgcggtacaactcgtcgacggctaccgcaagggcgaattcagccccgtggacgcggtgcgggcgaccctggagcgggccgagcgcatccagcccgccgtgaacgccttcgtactcccccacgctctcgactccgcccgggcggagcggtttccgccggccgcgcacgaggcgctcgcgcgggcggccgagtcggcggaccgatggcggcgcggggaaccggccggtctcctggacggcgtcccggtcaccgtcaaggacatcatcctgcaacgcggcaggccgaccctgcgcggctccaaggccgttgatccgcagggggcttggggcgaggacgcgccgtccgtggcccggctgcgggagcacggtgccgtcttcatcggcaggacgacgacgcccgagttcggctggaagggggtcacggactcgcctctgacgggggtcacccggaatccgtacgacacctcgcgcacggcgggcggatcgagtggcggaagcgcggcggccgtggcgctgggcgcggggccgctgtccctcggcacggacggcggcggcagcgtccgtatccccgccggtttctgcgggatcttcgcgctgaagccgacgtacgggcgagtgccgctgtatccggcgagcgcgttcggcacgctcgcgcatgtggggccgatgacgcgggacgcggccgacgcggcgttggcgatggacgtgatcagcggtcccgacgcacgggactggtcggggctcgggccggtcggcgggtcgttcactcaggcgctggcgggcggggtacgggggctgcgcgtcgcctactcgccctccctgggcgggcaggtcgcggtgcggcccgaggtcgcctcggcggtacggcgggcggtgcaggggctggcggggctgggcgcgtacgtgtccgaggccgaccccgacctcacggatccggtggacgcgttccatgtgctgtggttcagcggggcggcccgggtgacgcagcatttcgggccgcagcagcgggaggtgctggatccggggctgcgggagatctgcgggatcggggcgcgcttctcggcgctcgactacctcgccgcggtggacgtccgcatggacctcggccgacggatgggccgcttccacgagtcgtacgacgtgctggtcacgccgacgctgccgatcacggcgttcgaggcgggcgcggaggtgccggccggctcggggctgcgccgctggacggggtggaccccgttcacgtacccgttcaacatgacgcagcagccggcggccacggtcccggtcggggtggacggggacggactcccggtggggatgcaggtggtggcggcccggcaccgggacgacctggtcctgcgggtcgcgcacgcgctgtacgaggcgggagtcgccggtatcggggcaccgaccgaagtg

SEQ ID NO: 5217 - DNA, 957 bp, Streptomyces avermitilis
  CDS (1)..(957)
atgtccggtcccccgtccgaagcgacccttctcgtcctggatgccgagccgccgccccggctcggcacactcaccgggcgggtacggatcgagcacgccgacgagtccacgctcgccgagcggctgccgtccgcggatgtgctgctggtctgggacttcacctcgcacgcggtgcgccgggcctggccgggtgagggcccgcggccgcgctgggtgcacacggcgagcgcgggcgtggaccatctgatgtgccccgaactcgccgcgtccgacacggtggtgacgaacgcgcggggcgtcttcgaccagccgatcgccgagtacgtcgcggcgctggtcctggcgatggcgaaggacctgccgcgaacctgggacctccagcggcagcacgagtggcgccaccgcgagtcgcagcgggtggcgggcacgcgcgcgtgcgtggtgggctccggcccgatcgggcgggcgatcgccaggacactcaaggcactcggcatcaggacggccctggtggggcgcaccccgcgcaccggcatccacggtccggacgacctcgaccggctgatggcgcgcgccgactgggtggtgtcggcggcgccgctgacaaaggccacgcacggcatgttcgacgcccggcgcttcgggatgatgcagccgtcggcccgcttcatcaacgtggggcgcgggcagctcgtcgtcgaggaggcgctggccgaggcgttgtcgaagcggtggatcgcgggggcggcgctggacgtcttcgcgcacgaaccgctggtccgggaaagcccgttgtgggaggtgcccggcctcatcgtctccccgcacatgagcggggacacggtgggctggcgcgatgaactcggcgcgcagttcctcgagttgttcgagcgctggcaggcgggccggccgctgccgaacgtggtcgacaagcagcgtgggtacgtacctggacac

SEQ ID NO: 5218 - DNA, 801 bp, Streptomyces avermitilis
  CDS (1)..(801)
atggacgtctccttcctgggcgggccgcgcccgcagcgcggtgtcggtgttgtcgcccccttcgacttcgcgctcgaccgtgagctgtggcgctgggtgccggacgacgtctcgctgcacctcacgcggaccccgttcgtgccggtcgaggtgagcctggacctcgcccggctggtctccgagcacgagacgctcggcgaggcggtgcgcgcgctgaacgcggtcgcgcccgaggtcgtcgcgtacgcctgcacctcgggcagcttcgtcggcggcatcgcgggggagcgggccatgtgcgaggcgatgacgcgcgcgggcgccgtgccgtcgctgacgacctcgggcgcgctgctcgccgcgctggcggagctgcgcgcccggcgcatcgcgctggtgacgccgtacaccgtctcggtgacccagtccctggaggactacctcgtggggggcggggtacgggtgacgggacgtgccttcatgggcctcacccggcacatctggaaggtgccgtaccgcgacgtggtggacatggcgcggcaggcggtcggcgggcgcctgccggcgggcggcacggccgacgcgctgttcatctcgtgcaccaacctgccgacgtacgacgtcatcccccagctggaggcggagctgcgcatcccggtgatctcggccaaccaagtgacgatgtgggccgcactgcgtcacctgggtacccgtgcggtgggtccctatcaggcgctgctcgacgagtccgcccgtccggtgccggggcccgtactgccggaagaacaggaaggttgggca

SEQ ID NO: 5219 - DNA, 732 bp, Streptomyces avermitilis
  CDS (1)..(732)
atgaccgcactcggattcctctacccgggccactccgcggaggacgactatccgcgcatcgagcaactgctgggcagtgacatccgccttcccctggtccacacggacatcggcgaggacgcgcaccgggtggacgcgctcctcgagatgggttcggcggcacggctggccgcgggcgtcgaggagctgcggctgtcgggtgccgaggcggtggtgtgggcctgcaccagcggcagcttcgtgtacggctggcagggcgcccacgaccaggtccgcagcctcgcccgcacggccggcctgccggcctcctcgacctccttcgccttcgcgcacgcggcgcgcgagctgggcgtccggcgggtcgcgatcggggcgacctacccggacgacgtggcggccctgttcgccgcgttcctgaaggacgcgggcgtggaggtggtcgcggtccgcggctccgggatcatcacggccgcggaggtggcgacgtgggacgaggagcaggtcctcgcgctggcccgggcggccgaccaccccgaagcggaggcggtcctcctcccggacacggccctgcacacggcgtcgcacatccaggccctggaagcggccctgggcaagccggtcctcaccgccaaccaggtcacggtctgggaggcgctgcgcctggcggaccgccgggtgaacgccccgcgactcggcaccctcttcacgaaggagccgctcgtgcaggtccac

SEQ ID NO: 5220 - DNA, 1149 bp, Streptomyces avermitilis
  CDS (1)..(1149)
gtgacggcagacgagacggcaggcgacacgacggccaagacggcggacgagacggcggccgagacggcggacgagatccggggcacggcacagggcaccgcccccgtccccctctccgtactggacctggtcaccgtgggcgcgggccgcaccgccaccgacgccctgcgcaccagcgtccggatctcccgcctcgcggagtcccgcggcttccaccgctactgggtcgccgagcaccactcgatgccgggtgtggcctcgtcctcgcccgccgtgatcctggcccacctcgccgcccacacggaccgtatccggctcggctcgggcggcgtgatgctcccgaaccacgcgcccctcgtcatcgcggagcagttcggcaccctggaggccatggccccgggccgcgtcgacctcggcctcggccgcgcgcccggcacggacggcgcgacggccgccgccctccgccgcaccgaccggctgaacgagggcgccgacgacttccccgagcagctcgccgaactcacccgtttcctggacgacgacttccccgacggccacccctacgcccgtatccacgcggtcccgggcccgatccagtcgacctcgcccggcggcgtccagtccccgcaccgccccccgatctggctgctcgggtcctccggcttcagcgcccgcctcgccggcatcctcggactcccgttcgccttcgcgcaccacttctcggcgcagaacaccgtccccgcgctggacctctaccgcgagtcgttccggccgagcgaggtgctggacgccccgtacgccctgatcggcgtctcggccctggcgaccgacgacgagaaggaggcccgccgccaggtcctggccgcggccctcaacatggtccgcctgcgcaccggccgccccggcctggtcccgaccccggaggaggcggaggcgtacgagttcagtcccatggagcgcgagttcgtcgccacctggaactccaacgtcatccacggcaccgcggacgaggtccgcgccggcctcgacgacctccagaagcgcaccggcgccgacgagttgatgatcacgggcaacgcccacagcggcgacgtacgcctgcgctcgtacgaactgatcgcggacgcctacgggctgcccacggccggc

SEQ ID NO: 5221 - DNA, 1860 bp, Streptomyces avermitilis
  CDS (1)..(1860)
gtgagcggaacgtccgaagggccggcgcccacggcagacctcatccggccggccgtcacagagcgtcacatcgacacacctcctcgtacgaccacgaccagcgcgtccccctcctccaccggcgccgccttcgccgcggcccccctcgccatggcggtcgtcgaccgcgaggggctcgtcgtcacggccaacgagacgctgggcacgctgctgggcaccgacgcggacgcgctggccgggaagaccgccgccgacctggtggacctctcctccgacccccgcgcctggcacgcgtaccgcgaagtgctgcgcggccggcaggcccggctgcgctgcacccgccggctcaagcaccccgacgggcgctcgttctgggtccaggtgacggtctccccgctgcccgaggaggagcgggcgatactgctgtcggtcgccgacatcagcgccggccgtgaactccaggcgcggctgcggcacttgcagatgcacgacccggtgacccgcctgcccaaccgcacgctgttcttcgaacgcctgtcggccgcactggaggcggaggcgtacgaggagagtggcaccggccgcatcgggctgtgctatctggacctcgacggcttcaaggcggtcaacgacacgctcggccaccggatcggcgaccggctgctcgccgccgtcgccgaacggctgacgcgctgcgcggaagaggcgggatacgccaggccgagcgccccgctggtggcccgactcggcggcgacgagttcgcgctgctcgtggaggactcgacgggcaccgaccaactcgccgacctggccgagtcggtgctgaaggcgctccaggcccccttcgacctctccggccagcgactgtcggtctccgcgtcgatcggcgtggtggagcggcacgcggcgggcaccaccgccaccggtctgatgcaggccgccgacacgacgctgtactgggctaaggccgacggcaagtcccgctggacgctcttcgacccggagcgcaacgcacaccgtatgacccgccaggccctctcctccggtctgcgtccggcgatcgagcacggtgaattcgtactggagtaccagccgttggtgggcatggaggacggccgcctccgcggggtcgaagccctcgtccgctggaaccatccgcagttcgggatgctgacgccgaatcggttcatcggactggccgaggaggacggctcgatcgtgcagctcggccgctgggtgctggcgaccgcctgccggcaggcccgccgctggcagctggaacacccggacgcaccgccgctgttcgtcagcgtgaacgtggccgtgcgccaggtgtgggactccgacctggtcacggacgtggcggagatcctcgcggagacgggcctggccccgcacctcctccagctggagctcacggaatcggccgtcatgggctcggccggccgcccgctccaggccctccaggcgctcagcgacatgggcgtgcacatcgcgatcgacgacttcggtacgggctactcgaacctggcctatctcagccggctaccggtctcggtgctgaagctggacggctccttcgtacgcggcttccagtacgacacctccgagaagcacgacgggaccgacgcccgcccgaacccggccgacgaggtcgtcgtcgaggccatgatccagctcgcccaccggctggggctgacggtcacggccgagtgcgtggagacctcggcccaggcgtcccgtctgcgcggcatcggctgcgacaccggccagggctggctgtactcccgtccggtggcgccggatcgtatctccgaactgctgcggacaccggcccgccggagcagatccgaaccgatc

SEQ ID NO: 5222 - DNA, 1521 bp, Streptomyces avermitilis
  CDS (1)..(1521)
gtgtcccgtgagccgcatccggaggtcgatttgccgcgccaactcccattgaagggatgtgtccgtgacggggggctccgctggcgcagcaccgcggccgtgttcacctccatggcggcactcgcggcgacctcgctggtcacggggcccgccctcgccgaacccggtgcggcctgtgagctgaggcggaccggggcgcaccactcggagggcgtcgacacctggaacgccgcctatccgcgaccgacccgcccgctcgacgcggtgatggtgttcctgtcgttccccgactcggcgccactgaccgcgccgagtgagctgaccgccgactacttcccggccaccagtcagttcttcgagcgtgcctcgtacggaaggttcaccctgcgcccgcatgcgctgccggggtggatccggatgccgcacgcctccacgtcgtacgccatgcggcgggactggaacgccgagcaccgggccgcctatctgcgggacgcgctctccgtggccgacgggcaggtcgacttctcgcggtacgacgtcgtgtacttcgtggccgacccggacgcgccgggcgtggactcggacgcgacgaaggtcgtgaatctggacgcgccgttgcgggccgacggcaaggacattcggcgggtggtcacggtcttcgagaagcatccgccggaccatctcgtcctcgcccatgagacgggtcatgtcttcgacctgcccgacctctaccaccgccccaccgacggcaagggcgactgggacacctacgtgggcgactgggatttgatgggcagccagttcggcctcgcgcccgacctgttcgcctggcacaagtggaggctggggtggctggatccgcaccaggtggtgtgtgtgcggagccgcgggagcacgcggctgacgctggagccgctgggggtggggccggcaccggctgccgcggcgggggcgacgccgactccggaggtggcgtcggcggcggcgtcggcggctggagtggagccggtggtgggagcgaagccggtggctggagtggagccggtggtgggagcgaagccggtggctggagtggagccggtggcggggagcgcgagtccgggtgcgggccttctcggtgcgggcatcagttcggacgcggtgtcccacggcccggaggtgccggcgcccgccaccgccttcggggtggggcgcgggaccaagctggcggtggtgcgtaccggtcccgacagcgcgctcgccttcgaggcgcgcggtccggtgggcaacgacggctcgacctgttcgcagggcatcctcgtctaccgggtgcgcagcgaggccgagtccggtgccgggcccgtgcaggtcgtcgacgcccacccgcactccgagtcctgctggggcgactcggtctacccgccgctcgcggacgccccggtgggcctcggcgagagcttcacggtgccgggggagggcgtgaaggtggaggtggaggaccggacgccgtccggggcgtggacggtgcagatcgcgacgggg

SEQ ID NO: 5223 - DNA, 645 bp, Streptomyces avermitilis
  CDS (1)..(645)
atgagcagcgaaccgcacccggcagccgatccgctccccgaccgcttcgacgtcaccggagtcaccgcggagggagccgcctggctcgcctcggcgggaacgtatccgcgcagcacgctcgccctctgggaggagcggcccaccgccccggtcgtcctgccctgcggtaccgccttcgacgtcgtcagcgcacccacgatcttcggccgccgcatgctcgaccggctgtgggacgaggggccgggctccggaccggtcgccgcctaccggtgccgcatgctgctcttcgccgcacccggcaccgcccagcgcctcccctcgctgctcgactgggaggagtggggcgcaggcggcgccgccgggcccggccggagtgccggaatcccgccgctgctgtgccacgggccgggcgacgcggtgaccgtgccggcgctcgggacggacctcggcgagggtgccgccggccgccccgaatcccggtggctggtggcccccgacacccgccgcccctggcttcccggccccgagatcctggtctgggcggcggtccgcgcggcccgcgccgccgcctccgccgccgtacggatatcgatttttcctcccgccgatcaggatgctaaggtctacgacgtcagcaggcgccgc

SEQ ID NO: 5224 - DNA, 363 bp, Streptomyces avermitilis
  CDS (1)..(363)
atggcggagcccacgccgcgtcggaacgaaccgcggctacgccccgcgcccctgctcttcgagcccacggaggcggccggggacccggagcacttcttcgacctggagtcgatcgacgacccccgggcgctgctggcgcgggcgacggagctgacgcacgcgttccgcgcggcggccgaccgggcggtcgagttccaggcggtcgccgcggcacagctggccgatccgcggcggttcgaccggctcacaccggcggacatcgccgagcgggcggagtggaccgaggactacgcgaagaagatggtggagttcggccgggatctgctgcgggggcgggaagggaacggaccggcggacatgctc

SEQ ID NO: 5225 - DNA, 1317 bp, Streptomyces avermitilis
  CDS (1)..(1317)
gtgaccaccgcgttcgattcgggggccgcgcgggagccgggcggcggcttcgatccgggagccgcggccacccgtgccaccgacgcgattctgcgcgacacgctgcacggcacgcaccgcggtgtcgtcgtggactccccgccgggggccggcaagtcgacgctcgtcgtgcgggccgcgctcgaactggcgtccgcggggcgcccgctgatggtcatcgcgcagaccaacgcccaggtcgacgacctggtgctgcggctcgccgagaaggactccgagctgccggtcggacggctgcacagcagcgacccggacccgtacgacaaggcgctggacgaccttgcgaacgtgcgcaagtcgaccaaggcgggcgatctcgcggggctggacgtcgtcgtctcgacggccgcgaagtgggcgcacgtcaaggacgtcgagccgtggcggcacgcgatcgtcgacgaggcgtaccagatgcgctcggacgcgctgctggccgtggcgggcctgttcgagcgggcgctgttcgtgggcgacccggggcagctcgacccgttcgcgatcgtcggctcggagcagtgggcgggcctgtcgtacgacccgtccgcctccgccgtgacgacgctgctcgcccacaacccggagctgccgcagcaccggctgccggtttcctggcggctgccggcgtccgccgcgccgttggtctcggcggcgttctacccgtacacaccgttccgcagcggcacggaccacggcgaccggcggctggccttcggcgtggcatcggacggctcgggtcccgaccgggtgatcgacgaggcggcggagtcgggctgggggctcctcgagctgccggcccggcacacgccgcgtacggaccccgaggcggtacgggcggtcgcccaggtcgtacgacggctgctggaccggggcggggcggcggtgtcggagcggtcggcgcgtccggtgccgctgacccccgaccggatcgccgtcggcacggcccaccgggaccaggcggcggccgtccgcacggcgctggccgacctcggcgtcgcggacgtcaccgtggacacggcgaaccggctccaggggagggagttcgacgtgacggtgatcctgcacccgctgtcgggccgcccggacgcgacggcgttccacctggagacgggccgactgtgcgtcctggcctcccggcaccggcacgcgtgcatcgtggtctgccgggcgggcctgccggaactcctggacgaccacccctcgacggagccggtacagctgggagtgacggtgaagttcctgatggctgggaggcga

SEQ ID NO: 5226 - DNA, 1593 bp, Streptomyces avermitilis
  CDS (1)..(1593)
gtgtcgctgatctccgccctcgcccggctggaggccgcgcagaccggccgcgcccagcccgctgccacggtccggcaccggcacctgtccgaacaccccctggtgttcgtgccactgaccaccgccggtgaggccggggccccgctcggggcgctcgtcggcaccgaccggcacgcgccgcggctgctcgtcgtaccgcagccgcgcgaccgtgacctgcggttcgcgttcctcgccgagctggcggacatcgtcctgccgtacctcgacgggtacgccgacgtcgtcgaggccgccgagcgcagcgagaccgacccggagaccggcaagcgagtcaaggtcgaggtcgaactgtgcgcggacgcaccgcagttgatcgtgccgagccgcgcgggcgtcgagttcgtacgactcctgggccgctccatgcgcttccgccgcaccgccgagcaggagccggaggccccgcaccccgcgccgccacgcgtaccgctgctgggccgctggctcacgcacttcggggagcgggcccgggtgcccggctcctccctgctcctcgccctcaccgaggtgctgggacggcactgggcgaccgggcagagcagcctggaggaccagcatctgggcgcgctgctggcctggatcgagccgcccgccggggagtcgggcgcgacggccgcgctgcgggccgaactccagcgggactccggcggccagctcctgtgcccgcccgccggacccgccaccgaccccgcgttcgacaacaagctgctcgccccggccatcgagcgctacgaccgtgcgcggacgcggctggccgccgccgaggacggcctggaggccgacgaccggctcggtgaactcacctccgccgagcgggagatccgcgccctcgtcgccggcctcacccggcccacctgggacgcggtgtggcgcggcctcgacctgctgcgggcgctgcccgagggcgcgcacgtcgacgaccggtggacccgcgaccgctggtcgttcaccggacaccgggaccgggtgaccgccggggagccgccgcagccgcgccgcgacgacgcggtcaccgcggcgaacaaactggccacgcgcgagcgcgaacaggcccggctggacgcccaggaagccctcgacgacccgctggtcatggccggccggcggctggcgggcgaggccttcgcgggggaggtcacggatgtcgtcatggcgtacagcgagggcaagcgcccgagcccgcgcccgttggtcaccgtgcgcacggaggaccggccgcacctcggggagcgtacgaaggtcttccgcccgctcggcgggaagccgcaggccgccgagttcgtcggatacgaggacgacggcaccctcgtcgtgctgcggatcgtcgacaagatggggcgcggcaaggagccggaggccgggtccgtccccgagaagggcgaccgcctctgcttcacgctcttcgagcacgagcagcggggtggcgcgaagctgcccgatccggaggcgacaccgtggacgcacggcggaccgccgggtgaccccgaggccgtaccgctgccggacccggtgaccgaggaggacgttctg

SEQ ID NO: 5227 - DNA, 1038 bp, Streptomyces avermitilis
  CDS (1)..(1038)
gtgaacaaggcggtgctggcggacgcgctcggttcgccgtccgcgttcggccagtcgcagttcgccttcatgcggggcaacgcgttcgaggcccgggtcaaggcggacggcggcgcggagctgctgcggctcgtgcacgagaagctggaccccggtgccgagccgcccaccgactcgctcgtgcccgatctcacggccggcggccccgagggccgcgcggcccgtacggcgctcgccctgcgcgaggcgaccggggccggcgcctggacgctcctcgaccaccccatgctggccctcgatgtcgcgggctcgcccgccttcctggagccggacgcggtggtcgtgcacccggacggcagctggacggtcgtggagatcaagtcgttccccgtgctggacggttcggcggaccccgcgaaggtgggggcggccgcccggcagtccgcggtgtacgtgctggcgctggaggacgtcgccgcgcgcctcgatcccgcgcccccggtccgccaccgcgtcctgctggtctgcccgaaggacttctccaacctgccgaccgcctccgccgtcgacatccgcaagcagcgctcggtcacccgccgccagctgacccggctcacgcgcgtcgaggagatcgccgacgccctccccgagggcacgtgcttcgcgcccgacctgccgcgcggagagctgacggccgccgtggagtcggtcccggcggcatacgcgcccgagtgcctcgccgcctgcgagctggccttccactgccgcgaccacgcgcgcgccgagggcgcggtgacctccctggggcggtcgctgcgggccgagctgggcggcctggcgacggtcgacgacgtactggccgcggcccacggcacggccggggacccggacgacccggcggtggcggccctgcgcagggccgctcggctgcgggccgaggcactggacgccgcagggccgacagcgaccgggcccggtaccgggtacgcgggagccgagggcctcggcgccgagcggccggagggcgccccgtgtcgc

SEQ ID NO: 5228 - DNA, 954 bp, Streptomyces avermitilis
  CDS (1)..(954)
atgccgcagaccgtgacaccaggcatcgagagggcggtgccgaagacccggctgcgctggtggaccgaactgccgctgatcgtcctcgtgtacgcctcgtactcggcgggccggctcctcgcccggggcgatgtctccaccgccgtcgaccacggtctggcgatcctgcgcatcgagaaggccctgcatctcaacgccgagcatccgctgaaccgtctcttcacgcgcgaggcatggctcggtgtgccggccgacttctggtacgcctcgctgcactacctggtcacgcccgcgctcctgatctggctcttccgctcccgcgcggtgcgctacagagccgcccggacctggctgttgacgtccacgttcatcggcctgatcggcttcaccctgctgccgacctgcccgccccggctgctgtctcagggccacggcttcgtcgacacgatggcccagtacagctcgtacggctggtggggcggcgaggccagcgcgccgcgcggcctgggcggcatgacgaaccagtacgcggcgatgccgagcctgcacgtgggctgggcgctgtggtgcggggtgatgctgtggcggtacggccgcacccccgccgccaaggtcgcgggcatcgcgtatccgctgctcaccacgatcgtcgtgatgggcaccgcgaaccactacttcctggacgccgcggcgggcgccgccgtgatgggagccggcctgctgctgaccccggcgatgatgcggctcgcggacctggccaaggagcgcctgagcgcccgctccgcacccgtcgcggccgcctcgcagggcgcaggttcctcaattgtcagtggggagtgccagacttccccgggtgagcgaattccccgacagcgcgtatcccgccacggtccgggagccgagcccggtgccactcccgcggacgcgggggacggcgctccggcagcggctcgc

SEQ ID NO: 5229 - DNA, 615 bp, Streptomyces avermitilis
  CDS (1)..(615)
atggcaccgcgcatcctgctggcccggcatggacagacggaatggtccctgctcgggaagcacaccggcaggacggacattccgctcctcgaagagggccggcgcggcgccaagctgctgggcgaacggctgcaccgggcgcccttcgacgggctcttcgacgccgagatccgtacgagtccgctggcacgcgcgcgtgagacatgcgaactggccggtttcggtgaccgcgccacctcctgggacccgctcatggagtgggactacggggcgtacgagggcatgacgccggccgagatccagaaggtgcggccgggctggttcatctggcgcgacggcgtccccgagggcgagaccctcgcgcaggtctccgcgcgcgcggacgaggtcgtcgcctgggcgcgtgccgaggaccgcgacgtcctggtgttcgcccacgggcacatcctgcgctcgatcggcgcgcggtggctcggcctgccgatcgatttcgccgcgcgtatcaggctcagtccgacgtccctctcggtgctgggatgggcctacggggagcccgcgatcgagagctggaacgatctggggcatctggtgcaccagggcgagcagcggatcgcc

SEQ ID NO: 5230 - DNA, 1590 bp, Streptomyces avermitilis
  CDS (1)..(1590)
atggcgtcgtcaacggtgacctcgtcccagccccccacgccaccgcggccgaacctcgccttccggcagttgcgcggacagcgctcaccgggcgagttcgcctcggcggtgcggcgggccgcgcgcgagatcggcgagcgggtcagctgtgacgcgcgctacatcgggcgggtggaggcgggcgagatccgctgccccaactacgcctacgaacgcgtgttcctgcacatgttccccggccgcaccctcaccgacctgggtttcgcaccccgctccgcggtacggggcaggggggcggcgcgcaccaccgacgatgcgcctcccccacgcaccgagagccctttgcgcgcctcgcatgagatggaaggggcgtgcgagacgtatgacatgccagatccgtcgcacgaaacgcaggctccgcaggacccgtacgacccgtacgacccgctcaacccgcagcacgcgccagacccgttcaacccacagcccacgccagacccgtacgacacacaccacacgtcagacctgtacgacacgcacgagtaccacgatcagaaccacgaggagagcgacgtgcagcgtcgcgcattcatgacgggcggcaccgccacggtggcagccgcctcgctgggccccttcgggctcaccttcggcagcccggcggcggccgccggacgtcccggccaccgggcgggttcgtccgaggcgggcgccctcgaagaggccgtgcgcagaatccggctgctggacgaccggcacggcgcggacggcctctaccggcgcgcgtcggccccgctgcggaccgcgtacgcgctgctcgacgcggggacgacccggcagtcgaccgcggaccggctctacatgggcgcgggggaactggccatctcggtgggctggctggcccacgactcgggccgcttcgacgacgcccgctcgcactacgcggaggcgctcgcgaccgcccgcatggccggggacccggggcttgaggcgcacgcgttctgcaacacggcgttcctcgcgcgcgacgcgggccggccgcgcgaggcggtgcgggcggcgcaggcggcccagcgcgcggcccgcccgctgggctcgccccgcctcatgtcgctgctcgcgctgcgcgaggcgggcggctgggcggggctcgcggaccgggcgggctgcgagcaggcgctggcccgggcccaggccctcttcgaacggggcccttcggagacggaccccgagtggatgaccttctacggagaggccgaactggagggcctggaggcgcagtgctggtcgacgctcggcgactggccccgtgcggcccgccacgcccgccgggccgcgcacctccaggacccgcacttcacccgcaacatcgccctctacacggcggagctcgccgacgacctcgcgcgcgggggccgtcccgacgaggccgcgatggcgggcctgcgggttctggagctcctcggccaggtccagtcctcccgcgtccagacgatgctggcgggcaccgcccgggtcctgctgccgcaccggagggcgtcggaggtgtcggcgttcctggagcggcacgcgagcctgccgcgcatggcg

SEQ ID NO: 5231 - DNA, 432 bp, Streptomyces avermitilis
  CDS (1)..(432)
atgcagaccaggcagagcaccgagttccgtacgtcgtcgacggcgcagcaccggccgaccccggagagcagcgcgccaccgcggccggagtccgcctgtgacctcgtgaccgttccggcacgacagggtctggaggcggtcgacattctccgccgcggcgccggcgactccgtcggccccgtgctccacgacaacgactgcgacaccctcggcttcctggtgccgcccggcaccgcggacgcctgggacgtgcccggcagtacgtgcacccagaccggcggacgggggcagagccttgtgcccgagcccccggtcgagggctcggactggctgctgccgcccggggacgcggagctggcgacggatccggcggtgctgcgggcggcgctgggggaagcggcgcggctgatcgaggccgcggacaactgtcgc

SEQ ID NO: 5232 - DNA, 891 bp, Streptomyces avermitilis
  CDS (1)..(891)
atggcgagggcgaagaaaaagaggtccgacgacgggcgtggcgggcggcgcgggcagaccgcggccgaggccgtcgtcgagcccgtcgacggcgggctcgccgagctgatacccgaccgggaccgggcgcgcgcctggactctcttcatcgacggcgccccgcagtcgcacgtcgatctcgacgacccggcctttctgagcttcgagtaccagcggcgcctcggccatgtcatcgacctggtcgccccgcccggcaggcccgtgcacgtcgtgcacctcggcggcggcgcgttcaccctcgcccgctatgccgccgccacccgcccccgctccacccagcagatcgtggaacgcgacgcggccctcgtccaactggtccgccgtgagctgccgttggacccgaacgcccgcatccgggtgcgctccctggacgcccgcgaagggctcgccaaggtggccgacgactgggcggacctggtgatcgcggacgtcttcagcggcgcccgcacaccggcgcacctgacgtcgacggagttcctcaccgaggtgcggagggtggtgaagccggacggcgtctacgccgccaacctcgccgacggccccccgctcgcccacctccgcggccagatcgccaccgccgcggtcgtcttccccgagctggcgctggtcgccgatccgaccgtgctgcgcggcaaacgcttcggcaacgcggtcctcgtcggctccggccacccgctgccgatcgccgaactcacccgccgcgcggcctcggacccgcaccccgcgcgcgtggagcacggcaaggaactgaccgacttcaccggcggagccgtaccggtcctggacgcggtggcggtggcgtcaccgccgccaccgccctcggtgttccgg

SEQ ID NO: 5233 - DNA, 528 bp, Streptomyces avermitilis
  CDS (1)..(528)
atgaccgggatgcgcagaggacttgtacacgttctggcctggtcgctcgccacgggcgcggcggtcacgctgtcgtggtggggtgtccacacggtgatggcggggaccgcgtacgacccgccgcgcgccctgcccatcaccgcgggtgacgcggcgacacggaagccggaaccgctggcctcctcgacggagcgggcgcagccgtcgaagagcccgtcgaagggcccctcgcaccgccgggcgccgagcgggaagccggccccgacgccgtcccggacggcgtcctcctccccctcacccaccacctccggccaggtcaagagctacgacaccgacggcgggcgggtggtcttcgacctcggcaggacgtccgcgaccctcgtctcggcgacgcccggatccggctggtcgatgcaggtgtggaagacggagacgtggatccgcgtggagttcagctcgggcgcggaccgggtgacggtgttctgcacgtggcacgacagcgcgccgcgggtggacgtccagaactac

SEQ ID NO: 5234 - DNA, 741 bp, Streptomyces avermitilis
  CDS (1)..(741)
gtgccgcccatggcaagtgtgctcgtggtcgaggacgaccagttcgtacgctcggccctcatccggcatctgaccgaggccgcgcacaccgtgcgcagcgtcggcaccgccctcgaggcgctgcgcgaggtcgcccacttctccttcgacgtcgtgatcctcgacctcggactgcccgatctggacgggtccgaggcgctgaagatgctgcgcggaatcaccgacgtaccggtgatcatcgccaccgcgcgggacgacgagacggaggtcgtccggctgctcaacgcgggcgcggacgactatctgaccaagccgttctcggtcgaacacctggccgcgcgcatggcggcggtcctgcggcgggcacgctcggccgccggggaggcgccgccgtcgaccgtgatccgggtcggcgggctcgccatcgacccgctgcgccgccaggccgagctggacggcgtacgactcgatctcacccggcgcgagttcgacctgctcgccttcctggccggacggcccggtgtggtcgtggcgcggcgcgagctgctcgccgaggtctggcagcagtcgtacggggacgaccagaccatagacgtccatctgtcgtggctgcggcgcaagttgggcgagacggcggcgaagcctcgctatctgcacaccctgcggggcgtcggagtgaagctggaaccgccgcggggcgagccgtcgtggggtgcgcgatcacagggggagccgctgcca

SEQ ID NO: 5235 - DNA, 1371 bp, Streptomyces avermitilis
  CDS (1)..(1371)
atgagatgggcactggtcaaggtgtgcgtggcggtcaccacgatggtcgtggtcgccttcgcggtcccgctgggcctggtgatcaaggagatggcgcgcgaccgggccttctcgaacgccgagcgggaggccgccgccgtcgcgcccgcgctctccatcaccaccgaccgggaccagttggagcgcgtcgtcgcctccgcggcctcggacgaggggatggccgtgcacctgccggcgagcgacggcaaggcggcgtccgacatcgggcggcagcgcgccgccgacaaggacatcaccaccacccggaagctgggccgcgcctccaccgcggaggtcgcgggcggctccacgctgctccagcccaccgcgctcagctccggcgagatagccgtcgtcgaggtctacgtccccgagtccgaggtcagcaacggcgtcggcacggcctgggcggtgctcgccgccgtcggggtcgcactgatcatcggctcggtcgcggtcgccgaccggctcggcgtgcggatggtgcagccggctcagcgcctggtcgagggcgcacacgaactgggggagggaaagctgggcgcacgggtgcccgaggaagggccgaccgaactgcggctggcggcggtcgcgttcaactcgatggccgatcaggtcgttcaactgatggccaatgagcgggagttggcggccgatctgtcccaccggctgcgtacgccgctgaccgtgctgcggctgaacacggcctcgctcggcgacgggccggccgccgagcagacccgggcggccgtcgcacaactggagcgcgaggtcgacaccatcatccgtacggcccgggaggccaagccgcagaccgccgcgccgggcttcggcgccgggtgcgacgcggccgaagtggtgcgcgagcggatggacttctggtcggcgctcgcggaggacgagggccgcaaggtccgggtcgcgggcgcggaccggccggtccgcatacccgtcgcccgcgccgacctcgccgccgccctcgacgcgctgctcgggaacgtgttccggcacaccccggagggcacggcgttcgcggtcgacgtgcacaacggcgaggacgcggtgatcgtgctggtgtcggacgcggggccgggaatccccgaccccgaggcggcgatggctcggggccgcggctcggggagcgacggctcgacggggctcgggctggacatcgtgcgccgcctcgcggagtcgacgggcggcgatgtgcgcatcggctcgtcggtgctcggcgggacggaggtccggatctggatccagctggacggccgggcgccggtgcgacgcggacaccgggggtccgtacggcgtcggtggcgcatggcggcgagg

SEQ ID NO: 5236 - DNA, 1467 bp, Streptomyces avermitilis
  CDS (1)..(1467)
atgagcagtacgcaccggcgcaaggtcagcggtcggaacaaggcgataggcggcatcgtcgccgcggccgtggtcggcggcggcgccctcctgttcaccggcaccgcccaggcggcgagtgtcggcgccgcgtacaccaagaccagcgactggtcgacggggtacaccgcgcagtacgtcatcacgaacgacaccgcgcagacgaaggccgactggacgctccagttcgacctgccctccggtaccaagctcagctcgctgtggaacggcgagtcgagcgtgagcgggcagcacgtcaccgtgaagccgccgacctgggacaagaacgggctggcggcgggcaagtcggtgaccgtcggcttcgtcgtcaacggcagcgcgaacccgacgggttgcctcatcgacggcgtcaagtgttccgccgacgacggcgccacgcccgagccgagcggccgcccgacccagtccgcgacaccgacgccgacgccgacaccgacgcccactgcgaccgcctcgcagagcacgaagccgactcccaccccgtcggcctccgagacccccggcagcggcaccaccaccagcgccggcttcgccccctacgtcgacacctccctctaccccgccttcgacctgctggccgccgccggcgccaccggcgtgaaggactacaacctcgcgttcatcacggacggcggcggctgcacgcccaagtggggcggtgtgacggacctgggcagtgacggagtggcggcccagatcggcgacctgcgcgcgaagggcggtgacgtccgcgtctccttcggcggcgcctccggctccgagctggccacgacgtgctcatcggccgacgcgctggcgacggcgtacgagaaggtcgtgaacgccttcaagctgacgaaggtcgacttcgacgtggagggcggcgcgctgccgaacacggccgccaacacgcgccgggcgcaggccatcgcgaagctggagaaggcccaccccggcctcgacgtctcgtacacgctgccggtgatgccggagggcctgacccaggacggcgtgaacctgctggccgacgccaagtcgaacggcgtgtccatcaacacggtcaacatcatggcgatggactacgggcccgcgtacagcggtgacatgggcacctacgccgagcaggcggccacggccacgcaggcgcaggtgaagagcgtcctcggcctgtcggacagcgcggcgtggaaggccgtcgcggtcaccccgatgctcggcgtcaacgacgtggcgtccgagatcttcaaggtcgacgacgcgacccagctggtgaacttcgccaagtccaagggcctcggctggctgtcgatgtggtcggcgacgcgcgacaagcagtgcgcgggcggcgcgaagccgtcggccgacgcgacgtgcagctcgatcgtccaggacgcgaacgccttctcgaaggcgctcggcgcgtacaag

SEQ ID NO: 5237 - DNA, 1446 bp, Streptomyces avermitilis
  CDS (1)..(1446)
gtggcatccgccgagacctccgcggcacctgtgtcgcccgtgacgtttcctcccgccttcctctggggcgcggcgacctccgcgtaccagatcgagggggcggtgcgggaggacggccgcacgccctcgatctgggacaccttcagccatacgccgggaaagacggccggtggcgagaccggtgacatcgctgtcgaccactaccaccgctatcgcgacgacgtggcgctgatggcggagctcggccttggcgcgtaccgcttctcggtctcgtggtcgcgggtgcagccgatgggccggggccccgcggtccagcgcggcctggacttctaccgccggctggtggacgaactcctcgcccacggcgtcaaaccggcgctcaccctctaccactgggacctgccgcaggagctggaggacgcgggcggctggcccgagcgcgacaccgcgtaccggttcgcggagtacgcgcagatcgtgggtgacgcgctgggcgaccgcgtcgagcagtggatcacgctgaacgagccgtggtgcagcgccttcctgggctacggctccggggtgcacgcgccgggccgcacggacgcggcggcttcgttgcgcgcggcgcaccatctgaacctggcgcacggcctgggcacctccgcgctgagggccgcgatgccggcccgcaacacggtcgcggtgagcctcaactcatcggtggtcaggaccgtttcggacagtcccgcggatgtggccgcgggccggcggatcgacgacctggccaacggggtcttccacggcccgatgctgcacggcgcgtatccggcggggctgttcgcggcgacggcctcggtgacggactggtcgttcgtccaggacggcgacctggaggcggtcaaccagccgctggacgcgctggggttgaactactacacgccgacgctggtctcggcgacggagtcggccccggcgggcccccgcgcggacggccacggagcgagctccttctccccctggccgggcgcggacgacgtcgtgttccacctgacccccggcgagcgcacggagatgggctggtcgatcgacccgaccggcctgcacgaactgatcatgcgttacacgcgggaggcgcccgggctgcccctgtacatcaccgagaacggcgcggcgtacgacgacaagccggacccggagggccgggtgcacgaccccgagcggatcgcgtatctgcacggccatctgacggcggtccggcgggcgatcaccgacggcgcggacgtccgcggctattacctctggtccctgatggacaacttcgagtgggcgtacggctacggcaagcgtttcggcgcggtgtacgtggactacgcgacgctggcccgtacgccgaagtcgagcgcgcggtggtacgcgcaggcggcccggacggggacgctgccgggggcgacagccgccgag

SEQ ID NO: 5238 - DNA, 921 bp, Streptomyces avermitilis
  CDS (1)..(921)
gtgacgacgaccctgacgccccccgccgacagcgcggacaacgccgccgacgccgccaaggcaccccggcgctcgcgccgcccgcgctccgctcgggccggcggaacgctgcacggcggcccgatcgcgtacgcgatcctgatcctgttcaccctcggctcgctgttccccctggtgtggacggcgatcgccgcctcccgcgacaacaaccggctggcgcagaccccgccgccgttctggttcggctccaacctcttccgcaacctcgacgtggcctggacggacgcgaacctgggcgaggcgttcttcaacaccacgttcgtggcgggggtctcggccgcggccgtcgtcatcatgtcgacgatcgccgggttcgccttcgccaaactgcgtttccggggccgcggcgccctgatgctgatcgtcatcggcacgatgatggtgccgccgcagctgagcgtgatcccgctgtacatgatggtcgccaagctcgactggaccgaccagctccaggcggtgatcctgccctccctggtgagcgcgttcggcgtgttcttcatgcgccagtacctgatccaggccctgccggacgagctgatcgaggccgcccgggtggacggcgcgagcagctggcgcgtggtgtggcacatcgtgttcccggcggcgcgtcccgcgatggcggtcctcggcatgctgacgttcgtgcagacgtggaacgacttcctgtggccgttcctggtcctgacacagaccggcaacccgaccgtgcaggtcgcggtggcgggcctcggccgcggatacacgcccgaccagtccctgatcatggcgggcgcgctgttgggcacgctgccgctgctcctggtcttcgcgatcttcggcaagcagatcgtcggcggcatcatgcagggcgccgtcaagggc

SEQ ID NO: 5239 - DNA, 1014 bp, Streptomyces avermitilis
  CDS (1)..(1014)
atggccacccggcacgacaccgccgcgccccccgtgaaggaggggggcgcggccccggcccgcgcgtcggccgacgccgcgcccaccgaggctgagcagcggcaccgggcccggctgtcccgccgctggcagcgggacatccggtggagcccgtacgccttcgtctcgccgttcttcctgctgttcctcgcgttcggcctgtttccgctgatctacaccggctgggcctcgctgcaccaggtggagctgaccgcgcccaccgacatggagtgggtgggtctgcgcaactacacgcggatcttcgacgacgacttcttctggaacgcggcgaagaacaccctgaccatcggcatcatcgccacggtgccgcagttgctgatggcgatgggtctggcccacatcctcaactacaagctgcgcgcctcgaccttctaccgggtcgcgatgctcgcgccgtacgcgacgtccatcgccgcggcctcgctggtgttcgtgctgctcttcgggcgcgactacggcatgatcaactgggcgctgcaccaggtcgggatcggcgcggtcgactggcagaacgacaagtggccgtcccagttcgccgtctcctcgatcatcatctggcgctggaccggttacaacgcgctcatctacctggcggccatgcaggccatcccgcaggacctgtacgagtcggcggcgctggacggagccagccgctggcggcagttcctgcacgtcacgctgccggcgctgcggccgaccatcctgttcaccgtcgtggtgtcgaccatcggcgccagccaggtcttcggcgagccgctgctgttcgacgcgaacaagggcgcgtccggcggcgcggaacaccagttccagacgctgggcctgtacctgtacgagcagggctgggtgaaccagcacctgggccgggcctcggccatcgcctggacgatgttcctgatcctcatcctggtcgggatcgtcaactacgtcatctcgcgccggctgcgcgccagtagt

SEQ ID NO: 5240 - DNA, 1359 bp, Streptomyces avermitilis
  CDS (1)..(1359)
atgcgagcattcaccctccccccctctcggcttcgctcgagcggggggacccccatcgtccgccgggcggtggtcctggcggcggtcgcgtcgctgggcgccgggttgctggccggctgcgccgacgacagcggcgacggcgcttccgacggctcgtcgtcggacggcaaggggaaaaccaccctcacgctgggcctgttcggcacccagggcttcaaggaggccgggctctacaccgagtacgagaagctccaccccgacatcaagatcactgacaacgtcgtggagcggaacgagaactactacccggcgctcctgaaccacctcaccaccaacagcggcctgatggacgtgcaggccgtcgaggtcggcaacatcgccgagatcgtcgccacccaggcggacaagctcgtggacatgtccaaggtctcgggtgtggacaagagcaagtggctggactggaagtgggcgcaggccacgaccaaggacggcaggacggtcggcctcggcaccgacgtcggcccgatggcgatctgctaccgcaaggacctcttcgagaaggccggtctgcccaccgaccgggaagaggtcggcaagctgtgggcgggcgactggagcaagctggtcgacgcgggcgagaagtacaaggcgaaggcgcccaagggcaccacgttcatggactcccccggcggtctgatcaacgcgatcctcagcagtgagaaggagaagttctacgactcctccggcaaggtcacctacaagacgaacccggccgtcaagagcgccttcgacctgaccgcgaaggccgccgaggaggggctggtcggcgcgcagacgcagttccagccggcctgggacaccacgatcgcccacagcaagttcgccacggtggcctgcccgccgtggatgctcggctacatcaagggcaagtcgaagcccgagtccgccggcaagtgggacgtggccgccgcgcccaagtccggcaactggggcggcactttcctcgccgtgccgaagagcggcaagcacgtgaaggaggcggaggcgttcatcacctggctgaccgcgccggagcagcaggcgaagctcttcaaggtgcagggcagcttcccgagcgcgccgagcgcgtacagctcgtccgcggtcaccggcgccaagaacgagatgaccggtgactcgccgatcggcacgatcttcgccaaggccgcccagtccagcccggtgcagacgatcggcccgaaggaccagatcatccagcagggcctgaccgacaacggcgtcatcctcgtgacgaagggcaagtcgcccgaggaggcgtggaacacggccacgaagaccatcgacaacaacctggacaag

SEQ ID NO: 5241 - DNA, 1053 bp, Streptomyces avermitilis
  CDS (1)..(1053)
atggcaggccacggagcgcggggccggagcggcgggcggccgacccttgaggaggtcgccgcgcgcgccggggtgggccgcggcacggtctcccgggtgatcaacgggtccccccgggtcagcgacgccacccgcgcggccgtcgaggcggccgtcgcggagctcggctatgtcccgaacacggcggcccgtgccctcgccgccaaccgcacggacgcgatcgccctggtcgtccccgaaccggagacccgcttcttcgcggagccgtacttctccgacatgctcaagggcgtgggctccgcgctgtcggagaccgagatgcagctgctgctgatcttcgcgggcagcgaccgggagcggcagcggctggcccagtacctggcggcgcaccgggtggacggtgtcctgctggtctcggtgcacgcggacgacccgctgcccgacctccttgcccagctggagatcccggcggtgatcagcggccgcagatccgcggaggagacgctgccctcggtcgactccgacaacttcggcggcggccgggtcgccgtggaacacctgatcgaccagggccgccgcaacgtcgtccatctcgccggccgcctcgacgtctacggcgcccagcgccgcgtcgacggctaccgcgaggcgctgcgggacgcgggacgcccggtcgacgagagcctgatcgtcgccggtgacttcacggaggagggcggccggcgcgcgatgaccgaactgctggcccgctgcccggcgctggacgcggtcttcgcgggctccgacgtgatggcggccggcgcgcgccaggtcctgcgggaggccggccgtcgtatcccggacgacgtggcactggtcgggtacgacgactcggccatcgcccgccacatggaccccccgctcaccagcgtccgccagccgatcgaggagatgggccgcgcgatgatcgacctgctcctcgacgagatcgcggaccggcgcccggcggtgtcccggggcctggagcgacgtcagctggtgctcccgtcggagctggtgcggcgggcgtcttcg

SEQ ID NO: 5242 - DNA, 606 bp, Streptomyces avermitilis
  CDS (1)..(606)
atgcccgcgcaccccgaacccgccgaaccccccgagccccccggccccgccgcgtccgtcgggaccaccgggaccaccgggaccaccgggaccaccgggaccaccgggaccgccaggatcatccgcaccgcccgcctcgatctcctccccctgcgcgtcgagcacgccgaggagatggcccaggtcctcggcgacccggcgctgcatgccttcatcggcggtgtgcccgacaccccggccgccctgcgcgcacgctacgcacgcctggccgccggctcgccccaccccggcgtccgctgggtcaactgggtgctgcggcggcgtgcggacgcgtgtctggtggggaccgtgcaggcgaccgtcacgggcgaggtcgcggagatcgcctgggtggtgggcaccccgtggcaggggcggggcttcgcctcggaggcggcccagggcctggtcgaccggctcacccggcagtccgggtccgtacgcatcgtcgtcgcccatgtccacccggaccatcacgcctccgcgtccgtcgccgccgcggccgggctgtcaccgaccgaccgggagcaggacggcgagattcggtgggagctcaccgtacgggcc

SEQ ID NO: 5243 - DNA, 480 bp, Streptomyces avermitilis
  CDS (1)..(480)
gtgggcggacgatcaaggggcatggattcgttccacccagcgccatcaccactctcaccgtgctcacccgcaccagggggactctccgtgctccgctccgccagaggccgtgtcgtcaccaccgtcctcgccgccaccgcccttctcctcggcgcgcagggcacggccaccgccgccgcgcagcgggccaacaccgagggcgggtacgccctgtggaacgccgacccggacggcgccaccccgggcgactccgtccgggcctgcgacacgacgaccgacgggtggggcatcgaggcccggctcgacatcaaccgcgacggcaccatcgaccgcaccgcctccacccgcgggcggaccgcgccgtactgcaccgcgtggaagagcggcgacatccccgagggcgcgccggtcgccgtctacgcggtcaccgtcagaggcgacgacaccaaggacaagggcggcctgatctggagccacgcg

SEQ ID NO: 5244 - DNA, 600 bp, Streptomyces avermitilis
  CDS (1)..(600)
atgaacgatcgcatggtgtggatcgactgcgagatgaccggtctctcgctgtccgacgacgcgctcatcgaggtggccgcactggtcaccgactccgagctgaacgtactgggcgagggggtggacatcgtgatccgcccgccggacgccgcgctggagacgatgccggaggtggtgcgcaccatgcacaccgcctcgggcctgctcgacgagctggcggccggcacgacgctggcggacgccgaggcgcaggtgctcgcgtatgtacgggagcacgtcaaggaacccggcaaggctccgctgtgcggaaactcggtcggcaccgaccgcggcttcctcgcccgcgacatgtcggcgctggagacctacctccactaccggatcgtggacgtcagctcggtgaaggagctggcccgccgctggtacccgagggcgtacttcaacagccccgagaagagcggcaaccaccgcgcgctggcggacatccgcgagtcgatcgcggagctgcgctactaccgcgaggccatcttcgtaccgcagccgggccccgactcggagacggcccgcacgatcgccgcgaagcacgtgctgcccgcgcag

SEQ ID NO: 5245 - DNA, 1278 bp, Streptomyces avermitilis
  CDS (1)..(1278)
atgagccacgactccactgccgcgccggatgccgcggcccggaaactttccgggcgacgccgcaaggagatcgtcgcggtgctgctgttcagcggcggccccatcttcgagagttccataccgctttcggtgttcgggatcgaccgtcaggacgccggcgtgccgcgttaccggctgctggtggccgccggtgaggaaggcccactgcggaccacaggagggcttgaactcaccgcaccacatggcctggaggcgatctcccgggcgggcacggtcgtcgtgccggcctggcggtcgatcacctcgccaccgccggaggaagcgctcgacgcactgcgccgggcgcatgaggagggtgcccgcatagtcgggctgtgcaccggcgccttcgtgctggccgcggccgggctgctcgacggccgtccggcgacgacccactggatgtacgcaccgacgctggccaagcgctacccgtcggtccatgtcgacccacgtgagctgttcgtggacgacggagacgtactgacatcggcgggtacggcggccggaatcgatctgtgcctgcacatcgtgcggacggaccacggaaacgaggcggcgggcgcgctcgcccgcaggctcgtggtccccccgcgccggagcggcgggcaggagcgctacctcgatcggtctttacccgaggagatcggcgccgacccgctcgccgaggtcgtcgcctgggccctggagcacctccacgagcagttcgacgtggagacgctcgccgcccgcgcgtacatgagcaggcgtacgttcgaccgccggttccgctcgctcaccgggagcgctcccctgcagtggctgatcacccagcgggtgctccaggcgcagcggctcctggagacgtcggactactcggtggacgaggtcgcgggccgctgcggcttccgctcgccggtggcgctgcgcgggcacttccgccgccagctcggctcctcgccggccgcctaccgggccgcctaccgggcccgccgtccgcagggtgaacggcccgtggatccggacagcgtcgtgggaccgccaccggcgctgccgcaggaggccccggtcccgatgcagacgcgccgcacggcggccgcgagctcactgggtccggccgcgtccctgtccacggaaccgggcaaacacgggtcccacggatctcatgggtctcacgggtcgcatggatcacatgggtcacatggatccgagctgtacgcggccgggcggcccagcctgccggggcagcggagcgcgccg

SEQ ID NO: 5246 - DNA, 435 bp, Streptomyces avermitilis
  CDS (1)..(435)
atgcccgtatcccgcacctcccccacctcccgcacctcccccgacgacctgcgccggactcccgcccagggggcgcccccgtccccggcgcgcccttcggccgcaccgccgtcggacacggcgagcgatgtcgtccgctgggcggtcttcagctgcgccctggtgcccgtggtcctcgtctggtacggcacctcgctcgccggggcggccggtacggcgctggggctcgcggccgtcaccggggtctgccggatgctgctgcggcagtccgagcgaggggcggcgcggctgtcggacgaggcggcccggcagcgcgtcccgcaccgggggcggcacggcaggagcggttggcaggggacgggcggggcacacgggaagagtggctcgggggcgcacagaggcggccgccacacggcgggaaatacgccggtcgac

SEQ ID NO: 5247 - DNA, 525 bp, Streptomyces avermitilis
  CDS (1)..(525)
atggccggtcacgaattcttcgaacctgcggaccgcaagcgccccgtcgccgatcccacggcggccgagcccttggcggcggaagagccacgccattcctgcgaccccgccttcaagcacggggtcgtcgtcggcttcgacggctcgacgtccagcgagcgcgccctcgcgtacgcgatcggcatggcccatcgctccgggtcgggcctgatcatcgtgcatgtcgccaaccggctgcccaccacggtgtgggccggctgcgagccgccggtcttcgtcgatgtgccggaccaccggaccgaggtcctcgggctcgaactcgcctgcgcggagtatctggccgaggtgccctggatcctggtcgagcgcggcggcgacatctgtcacgaactcgaagaggtggggcgggagtacgaggcggacgcgatcgtcgtcggctccacgcacggcatcgtcggccgtctcttcggctcggtcgcggggcggctggcgaagcgcgcccagcgcccggtcatcgttattccg

SEQ ID NO: 5248 - DNA, 564 bp, Streptomyces avermitilis
  CDS (1)..(564)
gtggacaatgacgtctccgcgggaagcaccaccacggtcgtcggccgactcaccctcgggatcaccctgttggccttcgggctcgggtacgccgacgtgatcgacggagtgacggcggctgacgccgtatcagtggcccactacgtcggcggcgtggcgctgttcgtcgcgggcctgttggccctgcgcgaacgcgacgcggcctccggtacggccttctcggcgctcggcgccctgtggttcacctgggccgtcaccgccggcagccggatgtccgacaacgccgcgggcctcttcctcctgctgttcgccctggtcgcactgagcctgacgctcggggcggcgggcggcgtcctcgaccagggcgcctacggcctgttcgccgtctcgctcctgctgctggccatcgcgcacttcgcgggcaacgacggtctcggcaggatcggcggctggttcgcggtggccgcgggcgcggtcgcctggtacgcggcgacggcggccctggcccactggcccaccgccctcccccgacgcgctgccggccggggggtgacggccgccggc

SEQ ID NO: 5249 - DNA, 1815 bp, Streptomyces avermitilis
  CDS (1)..(1815)
atgtgcgggattgtcggatacatcgggaagcgtgacgtcactccgctgctcctcgagggactccagcgcctggagtaccgcggctacgactccgcgggcatcgtcgtcaccagcccgaagacggccggcctgaagatggtcaaggccaagggccgggtccgtgacctggaggccaaggtccccgcgcgcttcaagggcaccaccggtatagcccacacccgctgggccacccacggcgccccgtccgacctcaacgcgcacccgcacatgtcgcaggacaaccaggtcgccgtcgtccacaacggcatcatcgacaacgcctccgacctgcggaagaagctcgaggccgacggcgtcgagttcctctccgagaccgacaccgaggtcctcacccacctgatcgcccgctcccagcaggagaagctggaggacaaggtccgcgaggcgctgcgcgtgatcgagggcacgtacggcatcgcggtcatgcacgccgacttccccgaccgcatcgtggtggcccgcaacggctccccggtcgtcctcggcatcggcgagaaggagatgttcgtcgcctcggacatcgccgcgctggtcacccacacccgtcagatcgtcacgctcgacgacggcgagatggcgacgctgaaggccgacgacttccgtacgtacaccaccgagggcacccggacgacggccgagccgaccaccgtggagtgggaggccgcctcgtacgacatgggcggccacgacacgtacatgcacaaggagatccacgagcaggccgacgccgtggaccgcgtgctgcgcggccggatcgacgaccggttctccaccgtgcacctcggcggcctgaacctggacgcccgcgaggcgcgtgccgtgcgccgggtgaagatcctcggctgcggcacctcgtaccacgcgggcatgatcggcgcccagatgatagaagagctggcccgcatccccgcggacgccgagccggcctccgagttccgctaccgcaacgcggtcgtcgaccccgacaccctgtacatcgcggtctcgcagtccggtgagacgtacgacgtgctggccgccgtgcaggagctgaagcgcaagggcgcgcgggtcctcggcgtggtgaacgtcgtcggctcggcgatcgcccgcgaggcggacggcggcatgtacgtgcacgccggacccgaggtctgtgtcgtctccaccaagtgcttcaccaacaccacggtcgccttcgcgctgctcgcgctgcacctgggccgcacccgtgacctgtcggtccgcgacggcaagcggatcatcgagggcctgcgcaagctgcccgcccagatctccgagatcctcgaccaggaggacgagatcaagaagctggccgcgcagtacgccgaggcccgctcgatgctcttcatcggccgtgtgcgcggctatccggtggcccgtgaggcctccctgaagctcaaggaggtctcgtacatccacgccgaggcctacccggcctccgagctgaagcacggcccgctggccctcatcgagcccgcgctgccgacggtggccatcgtccccgacgacgacctcctcgagaagaaccgcgccgccctggaggagatcaaggcccgcagcggcaagatcctcgcggtggcgcaccaggagcaggagaaggccgaccagacgatcgtcgtcccgaagaacgaggacgagctggacccgatcctgatgggcatcccgctgcaactcctcgcctaccacacggcgttggcgctgggccgggacatcgacaagcccaggaacctcgccaagtcggtgacggtggag

SEQ ID NO: 5250 - DNA, 255 bp, Streptomyces avermitilis
  CDS (1)..(255)
gtgcacgacgaacttgttgatcatctgacgcggtccacgcccctcaaccggggcgaggcgctgcgggtgatccaggacgtgctcgcctacttcgacgagacgaccgaggaatacgtccgtcgccgccaccgcgaactccaggcccagggcctggtgaacgcgacgatcttcgaacggatcgaggcggacctgaagtaccgcgcggtcgcgccgccggagctcacgctcaggcagctgcgccgcatcgtctacggc

SEQ ID NO: 5251 - DNA, 1524 bp, Streptomyces avermitilis
  CDS (1)..(1524)
atggccgagcagcacgaataccttcgcgccaggttctcgcggcgcaacatgatcagaggcggcgccgtgaccctgggtgccgtcgccggtggcgccttcgtcccgggggcgaccgcgcgggccgcggttcccgcgcagcgggcggccgcctcggccgagaaggtcgacggcgccctcgtcgcccccttcggccgccacctcgcctacggcaccgacccgcgcacggagatgacggtctcctggcaggtcccggtcgcggtgaagaagccgtacatacggatcggcgcccacccctgggacctctcccgcaagatcgaggccgaggtccgcgccctccacaccccggccggcgtcggcgcgagcggcgaccacacccagtactacctgcacgcccggctcacccacctgcgcccgggcaggacgtactactacggcgtcggccacgacggcttcgacccggccgccccgcacctcgtgggtaccctcggcaccttcaccaccgcgcccgcgcacagtgagccgttcaccttcacggccttcggcgacgagggcgtcggctaccacggcctcgccaacgacgccctgctgctcggccagaacccggccttccacctgcacgccggcgacatcgcgtacgcggacccggccggcgcgggcaagaccggcgacaccggcttcgactcgcgtatctgggaccagttcctcgcccagaccgagtcggtcgccaagtccgtcccgtggatggtgtcgtacggcaaccacgacatggaggcctggtactcgcccaacggctacggcggcgaggaggcccgctggcagctgccggagaacggcccggacaaggcgaacctgcccggcgtctactccttcgtgcacggcaacacggcggtcatctcgctggacgccaacgacgtgtccttcgagatccccgccaacctcggtatctccggcggcacccagaccaagtggctggaggcgcggctcaagaagtaccgggcggcgaaggacatcgacttcatcgtcgtgttcttccaccactgcgcctactgcacctcgaccgcgcactcctccgagggcggcgtgcgccaggagtgggtgccgctgttcgagaagtacaccgtcgacctggtgatcaacggccacaaccaccagtacgagcgcacggacgtcatcaagggcgacgaggtcaccaagaagctgccgatcggcggcaccgcgtaccccgagacggagggcgtcgtctacgtgacggcgggcgcggcgggccgcagcctgtacgcgttcaccgccccggactcgtacgagggccacgagaacgacgtcgagtccgtgtcggcgttcgtcaacctcaagggcggcaagcagaacgagacggtcgcctggtcgcgcgtgcgctacctcgactactcgttcctgcgcgtcgacgtgacgcccgccgccaagggccgcacggccacgatgagggtgcgcggcatcgccgagagcggcgtggagatcgaccacttcacggtggcgcgccgggtc

SEQ ID NO: 5252 - DNA, 1587 bp, Streptomyces avermitilis
  CDS (1)..(1587)
gtgagacagcaccacagaacgccccgtcttctcggcacgctgctgctcgtggcggctgccggcttctccgtcgccggctcggcgcccgccgcggccgcgaagacggcgagcccgctcggccaggtcgttccggcccccgcctcggtcgacccgggcggatcgccgtaccgcatcacccgggacacccgcatccgtgtggacgactcgcgggaggtacgacaggtcggcgagtacctcgcgggcatcctgcggccctccaccggttaccggctgccggtcgcctcccagggcggcggaggcatccggctccggctgggcgaacgctcgctgggcgacgagggataccgcctcgacagcggcaggaacggcgtcaccatcaccgccgccgcaccggccgggctcttccacggcgtgcagaccctgcgccagctcctcccggccgcggtcgagaagaactccgtacagcccggaccctggctcgtcgcgggcggcaccatcaaggacaccccgcgctacggctaccgcggcgcgatgctcgacgtgtcccggcacttcttcgacgtcggccaggtcaagcgctacatcgacgagttggcgctgtacaaggtcaacaagctgcatctgcacctctccgacgaccagggctggcgcatcgcgctcgacgactggccgcggctcaccacctacggcggatcgacgcaggtgggcggcggccgaggcggcttctacacgaaggcccagtacacggagatcgtgcggtacgcggcctcccgccatctggaggtcgtcccggagatcgacatgccgggccacaccaacgcggccctcgcctcctacgctgagctgaactgcgacggcaccgcgccgccgctctacaccggcaccgacgtcggcttcagctcgctgtgcgtgggcaagccggtgacgtacgacttcgtggacgacgtcatccgtgagctggccgcgctcacacccggccgctatctccacatcggcggtgacgaggcccactccaccagccacgccgactatgtggccttcatggacaaggtgcagcccgtcgtcgccaagtacggcaagacggtgatcggctggcatcagctgaccggggcgaccccggcgaagggcgcgctcgcccagtactgggggctcgacgacaccagcgccgcggagaaggcgcaggtcgtgaaggccgcgcagaacgggacggggctggtcctctcgccggccgaccggatctacctcgacatgaagtacaccgcggacaccccgctcgggcaggactgggcgggtctggtcgaggtgcggcgggcgtacgactgggatccgggcacctacctcgccggagcccccggcgcgtcgatcaggggcgtcgaggcgccgctgtggacggagacgatcgtcaccggcgcggacatcgactacatggtcttcccgcggctgcccggcgtcgccgaactcggctggtcgcccgcgtcgacccacgactgggacacgtacaaggtgcggctcgcggcgcaggggccgcggtgggaggcgcgggggatccggtactaccggtccccccaggttccctggcccggtgcg

SEQ ID NO: 5253 - DNA, 1770 bp, Streptomyces avermitilis
  CDS (1)..(1770)
atgacccagtccgacgccgtggcccacctctcccccgagcgctgggagcgggccaaccgcctcctcgtccgcaaggcgctcgccgagttcgcccacgagcggctgctcactccggaggccgccggtgacggcgcgtacgtcgtccgcagcgacgacggcctgacccgctaccgcttcaccgcccgcctccgctccctcgaccactggcaggtcgacgccgagtcgatcacccgccaccgggacggcgccgaactcccggttgccgccctggacttcttcatcgagctgaagaagtcgctcggcctgagcgacgaggtgctgcccgtctatctggaggagatctcctccaccctctcgggcacctgtttcaagctcaccaagccgcagatccccgtcgccgagctcgccgaagcgggcttccaggccatcgagaccggcatgaccgagggccacccctgcttcgtcgccaacaacggccggctcggcttcggggtccacgagtacctctcgtacgcccccgagaccgcgagcccggtgcggctggtgtggctggccgcgcaccgctcgcgggccgcgttcacggcgggcgtggggatcgagtacgagtcgttcctgcgcgaggaactgggcgagcagacactgaaccgcttcgctgccaccttgcgcgaccagggcctcgaccccgacgactacctcctcatccccgtccacccctggcagtggtggaacaagctctccgtcaccttcgccgccgaggtcgcccagcgccgtctcgtctgcctcggcgagggcgacgacgagtacctggcccagcagtccatccggacgttcttcaacaagtccgcccccgagaagcactacgtcaagacggctctgtccgtcctcaacatgggcttcatgcgcggactctcggccgcctacatggaggcgaccccggccatcaacgactggctggcccagctcgtcgacaacgacccggtgctcaagtccaccggcctgtcggtcatccgcgagcgcgcggccgtcggctatcgccacctggagtacgaggccgccaccgaccgctactccccgtaccgcaagatgctcgccgccctgtggcgcgagagccccgtgcccgcgctccaggagggcgagagcctggccaccatggcctccctcgtccatgtcgaccacgcgggcgcctccttcgcgggcgcgctgatcgagcgttcggggctgtcgccggtggagtggctgcgccgctatctgcgcgcctacttcacgccgctgctgcacagcttctacgcgtacgacctcgtgtacatgccgcacggcgagaacgtcatcctcgtcctcaaggacggcgccgtacagcgcgcgatctacaaggacatcgccgaggagatcgccgtcctggacccgcaggcggtgctgccgcccgcggtcgagcggatccgcgtcgaggtccccgaggacaagaagctcctgtcgatcttcacggacgtcttcgactgcttcttccgcttcctggcggccgacctggccgacgagggcgtcctcggcgaggaggacttctggcggacggtcgccgagtccgtacgcgagtaccaggagtcgacgcccgaactcgccgacaagttccggcagtacgacatgttcgcgccggagttcgcgctgtcctgcctgaaccggctccagctgcgcgacaacaagcagatggtggatctggcggatccgtccggcgcactgcaactggtcggcaacctgaagaacccgatcgcgggactc

SEQ ID NO: 5254 - DNA, 549 bp, Streptomyces avermitilis
  CDS (1)..(549)
atgagcacccctgacataggcaccttcaccgtccgcccgctcgacccgacgcgggacgccgagctgctgcacggctgggtgacccaccccaagtccgccttctggatgatgcaggaggcgagactgcacgacgtggagcgcgagtacatggccatcgcggccagcgagtaccacgacgcgttcctcggactgctggacgacgagcccgtgttcctgatggagaagtacgacccggcgcacgtcgagctggtcggcctgtacgagcccgagcccggcgatgtcggcatgcacttcctggtcgcgccgacggacacgcccgtgcacggcttcacccgggccgtgatcaccgcggtgatggagcacctgttcgccgacccggccacccggcgtgtcgtcgtcgaacccgacgtgggcaacaaggccgtgcacgccctgaacgaagccgtcgggttcgtgcccgagcgcgagatccagaagccggagaagaaggcgctgctgagtttctgcacacgcgagcagttcgcagcagcggtgcgaggagcagccgta

SEQ ID NO: 5255 - DNA, 1269 bp, Streptomyces avermitilis
  CDS (1)..(1269)
atggaaaagacgtccgcaggcaagacgtacgacttcgtagggatcggtctcggccccttcaacctcggcctcgcctgcctcaccgagccgatcgccgaactggagggcgtcttcctggagtccaagccggacttcgaatggcactcggggatgttcctggagggcgcgcacctccagacgcccttcatgtcggacctggtgaccctcgccgacccgacctccccgtactccttcctgaactacctgaaggaatcgggccggctgtactcgttctacatccgggagaacttctatccgctccgggtcgagtacgacgactactgccgctgggccgcctcgaagctctccagcatccgcttcggcacgacggtcaccgaggtgacgtacgaggacgacgtgtacgtggtccgcacggaggccggtgacctctaccgcgcccgccacctggtcctcggcacgggcacgcccgcgtacctcccggaggccgtccagggcctgggcggggaccacatccacaactcccgctacatgcagcacaagcaggagctccaggccaaggagtcgatcaccctggtcggcagcggccagtccgccgccgagatctactacgacctgctcagcgagatcgacgtccacggataccggctgaactgggtgacgcgctccccgcgcttcttccccctcgaatacaccaagctcacgctggagatgacctccccggagtacatcgactacttccacgcgctgccggagccgacccgctaccgcctcaccgcggagcagaagggcctgttcaagggcatcgacggcgacctcatcaacgagatcttcgacctgctgtaccagaagaacctgggtggcccggtccccacgcgcctgctgaccaactcggcgctgaacggggcgacgtacgagaacggcacgtacaccctcaccctccgccaggaggagcaggagaaggagtacgaactgcgctcccagggcctgatcctggccaccggctaccgatacgccgagccggagttcctgaagcccgtacgcgaccggctgcgctacgacgcccagggcaacttcgacatcgcccgcaactacgccatcgacacgacgggccgcggcgtcttcctccagaacgccggcgtgcacacgcacagcatcaccagccccgacctgggcatgggcgcgtaccgcaacgcgtacatcatccgtgagctgctcggcaccgagtactacccggtcgagaagacgatcgcgttccaggagttcgccgta

SEQ ID NO: 5256 - DNA, 1515 bp, Streptomyces avermitilis
  CDS (1)..(1515)
atgtcggggcgctgcgccctctcccctgcccctctcctctgttccgcacggactgtcccctcggaggacccccacatgcgctcgcacctgctcaatgacacgaccgcggatcggtaccgccgttccgtgaccgaaggaatagagcgggtggcggccaaactcgccaccacagcaagcccgttcaccggcatcacggtcgacgccctcgccccccggatcgagcggatcgacctcgaccgcccgctgcacgacaccaccgcggtcctcgacgagctggaagaggtctacctccgcgacgccgtctacttccaccacccgcgctacctcgcgcacctcaactgcccggtggtcatccccgcggtcgtcggcgaggcgatcctctccgccgtcaactcctccctcgacacctgggaccagtcggcgggcggcaccctgatcgagcgcaagctcatcgactggaccaacgagcgcatcggcctcggccccgccgcggacggcgtgttcaccagcggcggcagccagtccaacctccaggcgctgctcctcgcccgcgaggaggccaagtccgacgacctcgccagactgcgtgtcttcgcctccgaggtcagccacttcagcgtgaagaagtcggcgaaactgctgggcctgagcgcggactcggtcgtctcgatccccgtcgaccacgacaagcgcatgcagacggtcgcgctcgcccacgagctggatcgctgcaagcgcgacggcctgctccccatggccgtcgtcgccaccgccggcaccaccgacttcggctccatcgacccgctgcccgagatagccgagctgtgcgcccagttcggcgcctggatgcacgtcgacgcggcctacggctgcgggctgctcacctccctgaagcaccgggaccggatcgacggcatcgagcgcgccgactcggtcaccgtcgactaccacaagtccttcttccagccggtgagttcgtccgccgtgctggtccgggacgcctccaccctgcgccacgccacctaccacgcggagtacctcaacccgcgccgcatggtcgaggagcgcatccccaaccaggtcgacaagtccctccagaccactcgtcgcttcgacgcgctcaagctgtggatgacgctgcgcgtgatgggcgccgacggcatcggccaactcttcgacgaggtctgcgacctggcggccgagggctggaaactgctcgccgccgacccgcgcttcgacgtggtcgtggagccgtccctgtccaccctcgtcttccgctacatcccggcggccgtcaccgacccggccgagatcgatcgcgccaacctgtacgcccgcaaggccatcttcgcctccggcgacgccgtcgtcgcgggcaccaaggtcggcggccgccactacctgaagttcaccctgctcaaccccgagaccacggcggacgacatcaccgccgtgctcgatctgatcgccggccacgccgagcagtacctgggagaatcccttgaccgcgcttcc

SEQ ID NO: 5257 - DNA, 870 bp, Streptomyces avermitilis
  CDS (1)..(870)
atgacgacggctgtggccgccccgttccgtttcttctccctccaggtcgtacggacgaggcggctcggcccgtctctgctccgcgtcaccttcaccggcgccgacctgcacgcgttcgcctccgacggccgcgaccagagcctgtcgctgttcctgccgcacccggggcagaccgagccggccgtcccgatcgagctgggcgacaactggtggcagggctggcgcgaactgcccgacgacgtacgggcggtgatgcgctcgtacaccctccgggccctgcgccaggacgcccatggcaacaccgtcgagatcgacatcgacttcgtgctgcacggcgtggagcccggcgcggccgccccggcaggccccgcctcccggtgggcctcacgcgccaccgccggcgaccgggtcctgctgctcggccccgcggtcgcggacaaccgggcgatccgcttccgcccgcccgagggcaccgacctggtggtcgtctgggccgacgagacggccgtccccgccgcctcggccatcctggagtggctgccggcgggcacccgcgccaaggtctggctggaggtccacgacgccggagacatccaggacctgacgaccgaggcggacgccgagatcacctggctcgtacacagcgagcgcgagacgcggggcgagggctcccccatggccctcgacgccgtccgagccgccgcgttcccgcccgccgagcgcccgtacgcctggatcgcgggcgagtccggctgcgtgaaggagctgcgccgccatctcgtacgcgagcgcgggatcgaccgacggcaggtgacgttcgtcggctactggcgacagggcctgagcgaggagcagttgcgcgaacaggag

SEQ ID NO: 5258 - DNA, 1047 bp, Streptomyces avermitilis
  CDS (1)..(1047)
atgtccaacgcccgtgccacccatctcacccgtcgcggcatcctcgcggcaggcggcgccttcggcctcggtgccgcgctcgccgcctgcggggacgacaaggcgaaagacagtggctcggacagcgggacggcggctgccaagtccggcccctggtccttcaaggacgaccgcggccagaccgccaaggcggacaagaccccgtcgagcatcgtcgccttcaccggtgtcgccgccgcgctgtacgactacggcgtcgacgtcaagggcgtcttcggcccgacgaagaccaaggacggcaaggccgacgtccaggccggcgacctcgacatcagcaaggtgacgatcctcggcaacgagtacggccagttcaacatcgagaagtacgcggccctcgcgcccgacctgctgatcaccacgatgttcgacgacgccggctcgctctggtacgtgcccgcggagtccaagaagaaggtcctcgccgtcggcgccccgagcgtcgggatctccgtctacgaccgccagttgaccgagcccctccagcgcatgctggcgctggcgaagtcgctcggcgccgacacctcctccgccacgatcaccaaggccaagaagcgtttcgaggacgccgccgcccgactgcgcgcggccaccaaggccaacccggacatcaaggtgctggccggttccgcgagccaggacatcttctacgtctcgacctcgaacctctccatcgacctggagtacttcaaggccctcggcgtgaacttcgtcgagccctccgcctccgcgctgaaggcgagcggcggctggttcgagaacctgagctgggagaacgtcgacaagtacaaggccgacgtcatcatcatggacaaccgctcctcgaccatccagcccgccgacatcaccaaggcgacctggaagaagctgcccgccgtcaaggccggccaggtcaccgcccgcaaccccgagccgatcctgtcgtacgacaagtgcgccccgctgctcgaggacctcgccgaggccatcgagaaggcgaagaaggtcagc

SEQ ID NO: 5259 - DNA, 1158 bp, Streptomyces avermitilis
  CDS (1)..(1158)
atggaccaccgtctcacccccgagctggaagaactccgccgcacggtcgaggagttcgcgcacgacgtcgtcgcccccaagatcggcgacttctacgagcggcacgagttcccgtacgagatcgtccgcgagatgggccgcatgggcctgttcgggctgccgttcccggaggagtacggcggcatgggcggcgactatctggcgctcggcatcgccctcgaagaactcgcccgcgtcgactcctccgtcgccatcaccctggaggccggggtctcactgggcgcgatgccgatccacctcttcgggacggacgcgcagaaggcggagtggctcccccggctgtgttccggcgagatcctcggcgccttcggtctcaccgagccggacggcggctcggacgcgggcgcgacgcgcacgacggcccgcctggacgagtcgacgaacgaatgggtgatcaacggcaccaagtgcttcatcaccaactcgggcaccgacatcacggggttggtgacggtcacggcggtcaccggccggaagcccgacgggaaaccgctgatctcctcgatcatcgtcccgtccggcacgcccggcttcacggtcgccgccccgtactcgaaggtcggctggaacgcctcggacacccgcgagctgtccttcgccgacgtccgcgtcccggccgcgaacctgctgggcgaacagggccgcgggtacgcgcagttcctgcggatcctcgacgagggacggatcgccatctcggccctggccaccgggctcgcccagggctgcgtggacgagtcggtgaagtacgccggggaacggcacgcgttcgggcggaacatcggggcgtaccaggccatccagttcaagatcgccgatatggagatgaaggcgcacatggcccgcgtcggctggcgtgacgccgcgtcccgcctggtcgccggcgagcccttcaagaaggaggcggcgatcgccaagctctactcgtccacggtcgccgtcgacaacgcccgcgaggccacccagatccacggcggctacggcttcatgaacgagtacccggtggcccggatgtggcgcgactccaagatcctggagatcggcgagggcaccagcgaggtgcagcggatgctgatcgcaagggagttggggctcgtgggc

SEQ ID NO: 5260 - DNA, 945 bp, Streptomyces avermitilis
  CDS (1)..(945)
atgagcacccccgagtcgggcctccccatggtcgtaccggcccaggacctccccgcccgcgtccgcatccacgaggtcggcgcgcgcgacggcctccagaacgagaaggggacggtcccgacggaggtcaaggcggagttcatccgccgcctcgccgacgcggggctgaccaccatcgaggccaccagcttcgtccacccgaagtgggtgccccaactcgccgacgcggagcagctgttcccgctcgtgagcgacctccccgtggcgctcccggtcctggtgccgaacgaacgcgggctggaccgcgcactggtcctgggcgcccgtcaggtcgccgtcttcgccagcgccaccgagtccttcgcgaaggccaacctcaaccgcacggtggacgaggcgctggccatgttcgagccggtggtcacccgtgcgaaggccgcggacgtgcgggtgcgcggttacctctccatgtgcttcggcgacccctgggagggcgcggtcccgatccaccaggtcgtgcgggtctgcaagtccctcctggacatgggctgcgacgagctgagcctcggcgacacgatcggggtcgccacccccggccatgtccaggacctcctcgccgaactgaccgaggagggcgtgccgacccgtgcgatcggcgtgcacttccacgacacctacggccaggcgctcgccaacaccctcgccgcgctccagcacggcgtcacgaccgtcgacgcctccgcgggcggcctcggcggctgcccgtacgccaggtccgcgaccggaaacctcgccaccgaagacctcgtgtggatgcttcagggcctcggtatcgacaccggagtcgacctcgcccgtctcaccgccacgagcgtgtggatggccgagcgactgggccggcccagcccctcccgcaccgtccgcgccctctcccacaaggagcaa

SEQ ID NO: 5261 - DNA, 2100 bp, Streptomyces avermitilis
  CDS (1)..(2100)
atgttcgacaccgttcttgtggccaaccggggtgagatcgccgtccgcgtcatccgtaccctgcgcgcgctgggcgtgcgctcggtggccgtcttctccgacgccgacgcggacgcacggcacgtccgcgaggccgacacggccgtacggatcggtccgccgccggccgccgagagctatctgtccgtggagcggctgctggaggcggccgcccggaccggcgcgcaggcggtgcacccggggtacggcttcctcgcggagaacgccggcttcgcgcgtgcgtgcgccgacgcggggctcgtgttcatcgggccgcccgcggacgcgatctccttgatgggcgacaagatccgcgccaaggagacggtgcaggcggtcggcgtcccggtggtccccggctcctcgggcagcggcctgacggacgcccagctggtcgacgcggcacgggagatcggcatgcccgtactcctgaagcccagcgcgggcggcggcggcaagggcatgcggctggtgcgcgacgagaggctgctcgccgacgagatcgccgccgcccgccgcgaggcccgcgcctccttcggcgacgacacgctcctcgtggagcgttgggtggaccgcccccggcacatcgagatccaggtcctggcggacggccacggcaacgtggtgcacctgggcgagcgcgagtgctcgctccagcgccgccaccagaaggtcatcgaggaggcgcccagcgtgctcctcgacgaggcgacccgcgccgcgatgggcgaggcggcggtccaggcggcccgctcctgcggctacgagggcgcgggcaccgtcgagttcatcgtccccggcggggacccctcctcgtactacttcatggagatgaacacccgccttcaggtcgagcacccggtcaccgagctggtcaccggcctcgacctggtggagtggcagctccgggtggccgcgggcgagcgccttccgtacgggcagcgggacatcgaactcaccgggcacgcggtcgaggcccgcatctgcgccgaggaccccgcgcgcggcttccttccctccggggggacggtgctcgcgctgcacgagccacagagcgacgtggtgcgcaccgactcgggcctctccgagggcaccgaggtcggcagcctgtacgacccgatgctctccaaggtcatcgcgtacggccccgaccgcccgaccgcgctgcgcaggctccgggcggcgctcgcggagacggtcacactcggcgtgcagaccaacgccgggttcctgcggcggctgctggcccacccggcggtcgtggcgggggacttggacacgggcctggtggagcgggaggtggacgggctcgtcgcgcaggcggtcccgccggaggtgtacgcggcggcggcgctgctgcgccacgccgccctcggcccccaggcttcagggacctcggattcctccgggtccttcgggacatccgggtcccccgggacctcaggggcctccggctcgtccggggcctccgcctgggtcgatccgttctccgtgcccgacggctggcgtctgggcggcgagcgtgcctggacggctcaccacatgcggccggcggggcaggatcccgtgaccgtccgcgtgcgcgccacggcggacggcggcgtcgagctgctactcgacgacggactgccgcccctgcggggcacgctccccgtagcggtggccgcccgcgggggcgccgcgtcccggttcgccttccggctcgacggcgtcacccacaccttcgccgccctgccggacggcacctggctgggccgcgacggcgactcctggcacctgcgcgaccacgacccggtcgcggcgtccctcaccggcgccgcccactccggcgtcgactccctcaccgcccccatgcccggcacggtgaccgtcgtgaaggtcgccgtcggggacgaagtggccgccgggcagagcctgctggtggtcgaggcgatgaagatggagcacgtcatctccgccccgcacgccggcaccgtcagcgagctggacgtcacaccgggcacgaccgtcgccatggatcaggtgctggcggtcatcacccccgcagaggaggagacggca

SEQ ID NO: 5262 - DNA, 1629 bp, Streptomyces avermitilis
  CDS (1)..(1629)
atgcaagaggcaccggagctgacgagcgcggcagaccccgcgtcggaggcctggcgggccaacgaggcggcgcaccgcacgctgggcgaggagctgcgcgccaagctggcggcggcccggctgggcggcggcgagcgggcacgggcgcggcacaccgcgcgcggcaagctgctgccccgggaccgcgtggacacgctgctggaccccggatcaccgttcctggagctggccccgctggcggccgacgggatgtacgaggggcaggccccggccgcgggggtggtcgccgggatcggccgggtcggcggccgcgagtgcctggtcgtcgccaatgacgccaccgtcaagggcggcacgtactacccgatgaccgtgaagaagcacctgcgcgcccaggaggtggccctcgagaaccgcctcccgtgcgtgtatctcgtcgactccggaggcgccttcctgcccatgcaggacgaggtcttcccggaccgcgagcacttcgggcggatcttctacaaccaggcacggatgtcgggcgccggcatcccccagatcgcggccgtcctcgggtcctgcacggcgggcggcgcgtatgtgcccgcgatgagcgacgaggccgtgatcgtgcggggccagggcacgatcttcctgggcggcccgcccctggtgaaggcggccaccggcgaggtggtgacggccgaggagctgggcggcggcgaggtccacgcgcgcgtgtcgggcgtgacggaccatctggcggaggacgacgcgcacgcgctgcggatcgtgcggaacatcgtctccaccctgccggcgcggggcccgctgccctgggcggtcgagccgtccgtcgagccgaaggtggatccgtacgggctgtacggcgcggtgccggtcgactcccgcaccccctacgacgtccgtgaggtcatcgcgcgcgtggtggacggttcgcgcttcgccgagttcaaggcggagttcgggcagaccctggtcaccgggttcgcgcggatccacggccacccggtcggcatcgtcgccaacaacggcatcctgttctccgagtcggcccagaagggcgcccacttcatcgagctgtgcgaccagcgcggcatcccgctggtgttcctccagaacatctcgggcttcatggtcggccggcagtacgaggcggggggcatcgccaagcacggcgccaagatggtcacggccgtcgcctgcacccgcgtgccgaagctgaccgtggtgatcggcgggtcgtacggcgcgggcaactactcgatgtgcggccgggcgtactcgccgcgcttcctgtggatgtggcccggcgccaagatctccgtgatgggcggcgagcaggccgcgtcggtcctcgcgaccgtcaagcgcgaccagttggaggcgcgcggcgagtcctggcccgtcgacgacgaggaggccttcaaggacccgatccgcgcccagtacgagcagcagggcagcgcctactacgcgacggcccgcctctgggacgacggcgtgatcgacccgctggagacccggcaggtactgggcctcgccctgaccgcgtgcgccaacgcgccgcttccccaaaaggactacacagcgcccggcttcggcgtcttccggatg

SEQ ID NO: 5263 - DNA, 588 bp, Streptomyces avermitilis
  CDS (1)..(588)
atggccacgagaaccgacgcccccacccgccgcgagcagatcctcaaggaggctgcccggctcttcgccgagcgcggcttccacggtgtgggggtcgacgagataggtgccgcggtcggcatcagcggccccggtctgtaccggcacttcgcgggcaaggacgcgatgctcgccgagctgctcgtggggatcagcgggcagctgctgacgggcggcaagcgccgggcggccgaggcggagggcgaccccgaggcgctcctcgactcgctcatcgaggggcacatcgacttcgcgctcgacgaccgccccctgatcaccctgcacgaccgtgagctggaccgcctccgggacagtgaccgcaagctcgtgcggcagctccagcgccagtacgtcgagctgtgggtggaggtggtgcgcaacgtgtacccgggcctcgacgaacccgccgcccgttccgccgtgcactccgtcttcggcctgctgaactccacgccacacctggggcgtccgggcgcgcttccggggcgcgcggggaccgccgcactccttcaccgtatggcgcgaggtgccttcggggccgccggggcg

SEQ ID NO: 5264 - DNA, 1155 bp, Streptomyces avermitilis
  CDS (1)..(1155)
gtgcgccgtacggtgttcaacgaggatcacgaggcgttccgggagaccctgcgcgccttcatcgaggccgaggtcgtcccggtctacgacgaatggttcgccgccggccaggcgccgcgcgacttctactacaagctcgccgagctgggcgtcttcggcatccgcgtggacgaggagcacggcggcgcgggcatcgactcgtacaagttcgaggccgtcctgtacgaggagaccgcccgcgcgggtatctccttcggcggctccggtgtgcacgtgctgctcggcctgccctacatcaagctgctcgccaccgacgagcagaagaagcgcttcctgccgaagttcgtctccggcgaggagatgtgggccatcgcgatgaccgagccgggcaccggctccgacctcgcgggcatgaagaccaccgcgaagctctccgacgacggcacgcactacgtgctcaacggcgccaagaccttcatcacgggtggcgtgcacgccgaccgcatgatcgtctgcgctcgcacctccgcgcccaccaaggaggaccgccgccacggcatctccctcttcgtggtggacaccaaggccgagggctactcggtgggccgcaagctcgacaagctcggcctgaagacctcggacaccgccgagctggcgttcgtcgacgtgaaggtcccggtcgaggacctcctcggcgaggagaacaagggcttctactacctcggccacaacctcgcctccgagcgttggggcatcgccttcggcgcgtacgcgcaggccaaggccgccgtccggttcgccaagcagtacgtgcaggagcgggtcgtcttcggccagcccgtcgccgccttccagaacaccaagttcgaactggccgcctgccaggccgaggtggacgcggccgaggccgtcgtcgaccgggccaccgaggccctggacgccggtgagctgacccccgccgaggcggccagcgccaagctgttcgccaccgaggtcgcgcaccgtgtcatcgaccgctgcctccagctgcacggcggctacggcttcatgaacgagtacccgatagcccgcctctacgcggacaaccgcgtcaaccgcatctacggcggcaccagcgagatcatgaagacgatcatcgccaaggacatgggcctg

SEQ ID NO: 5265 - DNA, 870 bp, Streptomyces avermitilis
  CDS (1)..(870)
atgagtcaggcacttgagtccctgctcgatctactcgacctcgagcggatcgagcaggacatcttccgcggccagtcccggtccgccgtcgtcccgcgcgtcttcggcgggcaggtcgcggcgcaggcactggtcgccgcgggccgcacggttcccgaggaccggctcgcccactccctgcacgcgtacttcctgcgtgcgggggacccgggcgcgccgatcgtctacaccgtcgaccggatccgcgacggccgttccttcaccacgcgccgtgtcgtcgccgtccagcacgggcagccgatcttccacctctccgcgtccttccagacgtacgaggagggcatggagcaccaggcggacatgccgcccgcacccgctccggagacgctgcccacggcggcggagatgctgccgcggtacgcgcacctgttcaccgagcccgtcgtcatcgaccggctcctggaggcccgcgaggcggtcgacctgcgctacgtcgacgcaccgcccttcgggaccgtgggcgagccccgcgaaccccgctcccaggtgtggttccgcacgaacggcaagctcgtcgacgacccgctgctgcacgtctgtctcgccacgtacgtctccgacatgacgctcctcgactccgtgctcctcgcgcacgggcgtggcggctgggtgaccggggacgtcgtcggggcctcgctggaccacgcgatgtggttccaccggccgttcagggccgacgaatggctgctgtacgaccaggagtcgccgtccgcgtccggcgggcgcgggctcgggcaggcccggatctacacgcaggacgggcagttggccatctcggtcatccaggagggcgtggtccgcgttccccgc

SEQ ID NO: 5266 - DNA, 786 bp, Streptomyces avermitilis
  CDS (1)..(786)
atgccgataaccgggacccccagccgcgccgagctcgtcgaccaccttgtacggacccgtatcgcgggcgacgtcgccacgccccgcgagaacaacctctcccactaccgcaaactggccaacggcgaccgcaactactggctcggtctggaactcggcgaccgctggagcgacgagcaggacgtgctggccgtcatggccgagcgctgcggcgtgaacgacgacccggagtaccgctacggccaggacaccatcgacccggagctgacggtggacgccctggaccgcatggcggcacggctgcgcaaggccgcggccggccggcagcgcgtcctgttcgccaccggccaccccggcggcctcctcgacgtgcaccgcgccaccgccgccgcgctgcgcaccgccggctgcgagatcgtggtcatcccggaggggctccagacggacgaggggtacgtctggcagctcgcggacgtcgcgatgctggagcacggcgccagcctctggcacacccactcgggagagccgatgcgcgccgtcctgaacggtctggagcgtgcggggcgcccgctgcccgacctggtggtcgcggaccacggctgggcgggctgcgcgggccagctgggcgtcgactccgtcggctacgccgactgcaacgacccggctctcttcctcgccgagtccgagggcaccgtccaggtcacggtccccctcgacgaccacgtcaagagcccccggcactacgacccgatgacggcgtatctgctctccggggcgggcctggcg

SEQ ID NO: 5267 - DNA, 1611 bp, Streptomyces avermitilis
  CDS (1)..(1611)
atgccggacccatccgcaccatctgcatcgtcagcatcatccgcaccaaaaacaacagcggcaccaggaacaccagcagcaccaaagacctcagcggccccaggaacaccagccgtaccgcccaccccgcccgtcccgctcgccgcgctgctggcccgggaggacctggcgctgcggcagatcgccgggccgaccgaccgcgacacggtgatccactgggcacacacctcggagatggccgacccgtacccgtatctgctgggcggcgagctgctgctgtccgccggggtgcacattccggaggcggcgggctcggggacgtacttcgaggactatgtctcgcggatcgtggcggcgggcggcgcggcgctgggcttcggcctggccccggtgcacgacacggtgccgcgggcgctggtggcggcctgcgacgcgtacgagctgccgctgctcgaagtgccgccgcagacgacgttctcgggtgtggcgcgtgcggtgtggcagctgatggcgcaggcccggctggcggagctgcggcgggtgacggaggcccagcggagcctcgcggccgccgccgcccgcccggacccggtcccctcggtgctgcgccagctcgcccagcgggtgggcggctgggcggcgctgtacggcccggacggggcggaactggcgcgggcgggacgtatcccggaggcgccggacacgccgaccgcacaggcgctggccgagctcgcggcggtggtacggccgagcgagccgagcgcatcacccgcctcccccgctcccgccccgtcccccaccccgtcctccgccacggacagcgtcggcggggtccacctcgccgcctacgcgctcggcaccggccagggtttcgtcctcggggtcgcctccgcgcgccgggactccggcgaccacaccatcgcctccgtggccgcggtgctgctctcgctcctcaccggcgagcaccagagcggcagcggggcggcccgctcggcggcgctcgtacggcttctgctgggcgccgccccggaggcggtcgcgccgctgctcggcggggagcggtgggtcgtggtgcacgcgcgcccggtggcggacggtcccgctccggacgccgtcgcggcgtcggccctgggcgcggcgctgggctccgcgctcgtcgacgccggcggggacgtcgtacgcgtcctggtgcccggcgaccgggcaccggccgcgcagtcgggctggacgctcggggccagcgtggcggtggccccgcacgagtgggcggccgccgacacccaggcggcccgcgcgctggcccgcgcccgcgcgacccgctcaccgctggtgcggcacggcgagcgcccgggcctcaccgacctcgtcgcgccggcggacgcggcggcccacgcccgtacgctgctcgcccccgtcgccgacacccccgcgctgaccgagaccctgcgcacctggctctccctgcacggcagttgggaccgtacggcggtggccctgtccgtgcaccgcaacacggtccgtcagcgcatcacccggtgcgcggcgctgctgggggcggacctggacgatccggatgtgcggatggagttgtggttcgcgctgcggcacggc

SEQ ID NO: 5268 - DNA, 1458 bp, Streptomyces avermitilis
  CDS (1)..(1458)
atggccgtcgactacacagtgatcgtcgtctatctggccggcatgctggccatgggctggtggggcatgcgccgcgccaagtccaagagcgacttcctggtggccgggcgccgcctcggccccgccatgtactccggcaccatggccgcgatcgtcctcggcggcgcgtccaccatcggcggcgtcggcctcggctacaagtacggcctctccggcgcctggatggtcttcgccatcggcctcggcctgctcgcgctctccgtcttcttctccgcccgcatcgcccgcctcaaggtctacaccgtctccgagatgctcgacctgcggtacggcggccgggccggcgtgatctcgggcgtcgtcatgtgggcgtacaccctgatgctcgcggtgacgtccaccatcgcctacgccacgatcttcgacgtcctcttcgacatgaaccggacgctcgcgatcatcctcggcggctcgatcgtcgtcgcgtactcgacgctcggcggcatgtggtcgatcacgctgacggacatggtccagttcgtggtgaagaccatcggcgtcctgctcctgctgctgcccatcgccatcgtcaaggcgggcggcttcagcgcgatgaaggccaagctgcccaccgagtacttcgacccgctgggcatcggcggcgagacgatcttcacctacgtgctcatctacaccttcggcatgctgatcggacaggacatctggcagcgcgtgttcaccgcgcgcagcgacaccacggcgaagtggggcggcacggtcgccggtacgtactgtctggtgtacgcgctcgccggcgccgtcatcggcaccgcggccaaggtcctctaccccacgctgcccagcgccgactccgccttcgcgaccatcgtcaaggacgaactcccggtcggcgtgcggggcctggtgctcgccgcggcactggcggccgtcatgtcgacgtcctccggcgcgctcatcgcctgtgccaccgtcgccaacaacgacatctggtcgcgcctgcggggggtctcctcgcgcaagggcgacgaccacgacgaggtccggggcaaccgcctgttcatcctggtcatgggcgtcgcggtgatctgtacggcgatcgcgctcaacgacgtggtcgaggcgctgaccgtcgcgtacaacctgctggtcggcggtctgctcgtcccgatcctcggcggcctgctgtggaagcgcggcaccgtgcacggcgcgctggcctccgtgatcgtcggcggcctcgcggtcatcggcctgatggcgacgttcggcatcctcgccaacgagcccgtctactacggactgctgtcctcgctggccgcgtacgtgatcgtctccctggccacgcccgccaccgacgccgcggtcctcgccgcctggcgtgagcgcctcgcgggccggacccccgaacccctggcggagccggtcccggccccccag

SEQ ID NO: 5269 - DNA, 966 bp, Streptomyces avermitilis
  CDS (1)..(966)
atgagcagcaacgagacgccccgcggccccgtcgactcgtcccgcgtcccgcggtacgccggccccgcgaccttcgcccggctgccgcgcctcgacgaggtcggcaccgccgatgtcgccgtggtcggtgtgccgttcgactccggcgtctcgtaccggccgggcgcccgcttcggcggcaacgcgatccgcgaggcgtcccggctcctgcgcccgtacaacccggcgcaggacgcctcgcccttcgcgctcgcccaggtcgcggacgcgggtgacatcgcggcgaacccgttcaacatcaacgaggccgtggagacggtcgaggccgcggccgacgagctgctcggcaccggcgcccggctgatgaccctcggcggcgaccacaccatcgcgctgccgctgctgcgctcggtcgccaagaagcacggcccggtggcgctgctccacttcgacgcgcacctcgacacctgggacacctacttcggcgccgagtacacgcacggcaccccgttccgccgggccgtcgaggagggcatcctcgacaccgaggcgctctcccacgtcggcacccgcggcccgctgtacggcaagcaggacctcaccgacgacgagaagatgggcttcggcatcgtcacctcggcggacatctaccgccgcggcgccgacgaggtcgccgaccagctgcgccagcgcatcggtgaccgtccgctgtacatctccatcgacatcgactgcctcgacccggcgcacgcgcccggcacggggacgccggaggcgggcggcatgacgtcgcgcgaactcctggagatcctgcggggcctcgcgtcctgcaacctggtctcggccgacgtcgtcgaggtcgccccggcgtacgaccacgccgagatcacggccgtcgccgcgtcccacacggcgtacgagctcaccacgatcatgtcccgtcagattgcggaggcccggaacaag

SEQ ID NO: 5270 - DNA, 1683 bp, Streptomyces avermitilis
  CDS (1)..(1683)
gtgacccacgaccacgacctggtgcttcgccccacggccgccgagacgtcagccgcgttgaacccacccccggggcgcaatggcggggacctggtcgtggagaccctcaccggtctcggcgcgacgaccgtcttcggcctgccgggccagcacgcgctcggcatgttcgacgcgctgcggcggtcggacctgcggtacatcggcctgcgggtggagaacaacgcgggtttcgcggcggacgcgtacgggcggatcaccggggaggcggccccgctgctgctctccaccggccccggcgccctcacctccctggccgcgctccaggaggcggcggcggcctcggcgcccgtcctcgcgatcagcagccagatcccgaccgccggactgggcggcggccgccacggctatctgcacgaactcccggaccagcaggcgtcgttccggggtgtggtgaagtccgtccacacggtccgtacgcagtcgcagatcccgtcggcgatcgcggcggcctgggagtcggcgctgacggttccgcacggcccggtgtgggtggagatcccgcaggacgtcctgctcgccgagacgagcctgccggtggtgacggcgctcgacgcgacaccggaggacgtggtcccgcgccccgaactgacggcggtggcggcccacctgctgtcgaacgccgcccgccccgcgatcatcgccggcggcggggtcgtacgggcggacgcggccggaaagctgagggcgctggccgagaagctggacgcccccgtgatcacgaccttcggcggcaagggcgccttcccctgggagcacccgctgtcgctccagtcctggctggaggaccgtcacacgacggacttcctggaggacgcggacgtcctcctggtggtcggctcggggctcggcgaactgtcctcgaactaccacacgttcaagccgcgcggccgggtgatccagatcgaggccgacctcggcaagctggagtccaaccacccggcactgggcatccacgcggacgcccggctggcactctccgcgctcctggagacggtcggggaacgcaccgacccgacggcggcggaccgcgtacgcaccgtcctcacccgcgtccgtgaacgcatcgccgcccaggaactcaccctggaacaggacgtactggcgtccgtgcgccgggccctgccggacgactccccgtcgttctgggacatgacgatcctggcctactgggcgtggtccgccttcgacccccgcggctccaactccatgcactccgcgcagggcgcgggcggtctcggctacggcttcccggcggccctcggcgcggccgcggccgaccccacccgcccggtcctggcggtctcgggtgacggcggagccctgtactccatcgccgaactggccacggcgaagcagtacgacctgaacgtcacctggctgatcgtcgacgacggcggctacggcatcctgcgcgagtacatgacggacaccttcggcgaggcgacggcgaccgagctgtcccgcccggactatgtggccctcgcggagtcgttcggggtgtcgggggtgcggacgacccgcgagacgctggaagtggacctggcgaaggcgctggcgaccccggggccgtcggtggtgctgctgccggcggtgctgcggatgttcgcgccgacgcacctgggc

SEQ ID NO: 5271 - DNA, 1425 bp, Streptomyces avermitilis
  CDS (1)..(1425)
atgtcccgagcacgacgcagaacccgttccgcgcggctgaccgcccctctggccgccgcggtgctgctcgccggcggagtcggtgcctgggcgctgaccggggcctcggcccaggccgccaccgggaccgcggacgcccaggacgacttcaacggcgacggctacgccgacctcgtcgtcggcgccccgaacgccacggtgtccagcaaggccaaggcgggctacgtggccgtcacctacggctccgccagtggcctgtccgccgccgacaagaagatcgtcagccgctccaccagcggcgtccccggggccgccaccgcgagccagcgcttcgggtcgaccttcaccaagggcgacctggacggcgacggcttcagcgacctcgtgatcgcgggcggcacggcgggctccgtcgtgctgtggggctccgcctccggcctcaccggcggcacgagcatcgccgggtacggggacagcccccaggccggtgacttcgacggcgacggcaagactgacctcgccctgttcgcccaccagcaggtcgagggcgacgatcccccgagcggcgcggccaccgtgtggaagggcccggtctcgcgtgccggaaagcccaccgccaccctgcccgtcctggccacgtccgccggctcgatcagcggtcccatcaagtccagccaggccggcgacatcaacggcgacggcaaggacgacatcgtccagtggatctacaccggtgacggcacctggggcaaccgcctgctgtacggcggcggcagcaagggcttcaccggcggctgggtacccggcgacggcgtgggcgacctcacgggcaccggcatcggggacgtgaacggcgacgggttcgacgacgtggtggtcggcgccgacggctggaacagcaaggtgcgggtcgcgctcggctcggcctccggcctgtccgagtcgcgtgtccagagcttcgaccaggacctcgccggcttcccgggcgcccaggaggagggcgacgaactcggcgcctcggtctcggtcggcgacgtcacgggtgacggctacgccgacatcgcgctcggcataccgggcgaggacgtcggcacgatcgccgacaccggctcggtcgccctcgtccacggcagcgcctccggcgtcacgggcgccggaacccaggtcttccaccaggacaccgccggggtgcccggagtcgccgagcaggacgaccggttcggtgtcgccgccgccctcctggacgtcgacggcaacggccaccccgacctcgccgcggcctccacggccgagaacgcgagcaacggcgcggtctgggtgctgcgcggcgacgcggccggcctctccgccaagtcggccttcgccttcggcccgaagaccctgtcggccccctacacgaacgcgctgttcggctcgttcctgcgg

SEQ ID NO: 5272 - DNA, 651 bp, Streptomyces avermitilis
  CDS (1)..(651)
atggacgcggacgtccggcgaagggatgggacattgggctactgcctcgagatgagcaccggtgacatgcgcgatgtgatgcggctgctcacggcggtggagcggaccccggagcaggagcgggcgctcgggatcgtgcgcgagggatgcgcgaagaccgacgcccggttccgggagcagggcatcggtctcgacgtgtccgtggagcaggcactccacgagttgatcgagggggtgcccggcggggctcggggggccgcgtacacgtacgcgttccacgaggtggtggcggcgcacttctccgaccccacggatctcggcgtctggagccggccctcgtggttcttcgccctggacgacgaactggcccggcacgggatccccgcggacctgctgccgggctcgttcctgttcagtggaccgccgctgcggctgccgcaccccggggacgcgtttccccagatcggcgtcctgccgacaccgcgggccgcccccctggccaccgcgtacgaggccgtcgcggaccggctcggacccgactaccgggccacggcgcgcaagttcgcggaactcatgcggttcgaggcggaggagtgggagagcgcccagcagctcgggcagacactggacagcatcttcttctggttccgc

SEQ ID NO: 5273 - DNA, 804 bp, Streptomyces avermitilis
  CDS (1)..(804)
atgcccgcgacaacgcacatacgccgctggaagacgctggcgctgaccacctccgccgtactggtgggcctcaccctgccgacgctgaccgcggctcccgcgagcgccacgacgaccgcgtacgacagcacgtactacaagaacgccgtcggcaagaccggcacgagcctgaagtcctcgctgcacacgatcatcagcagccagaccaagatctcgtactccgccgtctggaacgcgctgaaggtcaccgaccaggacccgaacaacagcaacaacgtgatcctgctgtacagcggcgtctcgcgcagcaagtccctcaacggcggcgacgtcggcgactggaaccgcgagcacacgtgggccaagtcccacggcgacttcggcgaggcgaccggtcccggcacggacctgcaccacctgcgcccggcggatgtccaggtcaacagcatccggggcaatctggacttcgacaacggcggcagcacggtcacaggcggcggcggcagccttgtcgactccgactccttcgagccgcgcgacgccgacaagggcgacgtggcccgcatgatcctctacatggccgtgcggtacgagggcgacgacggctgggccgacctcgagcccaacgagaaggtgaacaacggcagcaacccgtacatcggcaagctgtccgtcctcaagcagtggaacgacgaggacccgccgagcgccttcgaggagaagcgcaaccaggccatctacgacacctaccagcacaaccgcaacccgttcatcgaccacccggagtgggtggaggcgatctgg

SEQ ID NO: 5274 - DNA, 2325 bp, Streptomyces avermitilis
  CDS (1)..(2325)
gtgacatctgccaccgacccactgtcctcggccccggccccggccccgggccgctccacgacccccggcgcaccggccgccgagccggcccaggagccgtccccctcccccgccacaccccgctggtcgctgcccgccctggtcgcgatcatgatcctggcggcggtgctgtactcctggaacctgtcctcctcgggcctcaacagcttctacagctccgccgtgttcagcggtacgcagagctggaaggcgtggttcttcggctcgctcgacgcgggcaacttcctgaccgtcgacaagccgccgctcgcgctcatggtcatgggcctgtcgtgccgggtcttcggcttcggcacctggcagatgatgctgccgatgatcgtggccgcgctcggcacgatctggatcctgcactcctcggtgaagcgggtgttcggccacgcggcggccacgatcgccgcgttcgtgctggcgctcaccccgatcaccgtcgccatcaaccgcgacaacaaccccgacacgctgctcgtcctgctgatggtggcggccgcggcgctcgggctgcgcgcgacccgggacggcaggctgctgccgctgctcggctcggcggtgtgcttcgggctcgccttcaacacgaagatgctccagggctacatcgcgctgcccgccgtcttcgcggtctgtctgtacgcgtcgggcctcagctgggcgaagcggatccggaacctgtcgctggccgccgtggccctggccgtgtcgagcttctggtgggcgaccgccgtctcgctcgtgcccgccgacgaccggccgtacatcggcggttcgacggacggcaccgcctggaacctgatcttcggttacaacggcctgggccgcgtcctcggcggcgagggcaacggcggaggcggcggtggcggcggtggcggcggcttctccggtaccgcgggcctcggccggctgttcaacgacatcctgggcggccagatctcctggctgatccccttcgcgggcatcgccctcgtcggcggcctggtgctgtgcggccgcgccccgcgcaccgaccggacccgggccgcgctggtgctctggggcggctggctgctgctgcactacgtcacgttcgccaccgccgaggggacgatgcacccgtactacacgaccgcggtcgccccgggcatcgcggcgctgtgcggaggcggcggcgtcctgctgttccgtgccttccgcggcggtgacgtccgctggtcctgggtcctgcccgccgggctcgcggtcaccggcatctgggcggtcgtgctgctgcgccgggccgacggctggaacacctggctgtggccggccatcgcggtggtcatggcgacggccgtcgtgggcctgctcgtcttccgctccggcacccgcgtacggctgctggccgcgtccctggcggcggcgatcgtcgcggctctcgcgggcccggcggcgtactcgttcgccgtaccggccggtgcggggggtgcgggcggcggcatgggcggcaccaacccgaccgccggcccgtcaaccggcaacggcggcttcggcggcggccggggcggccccggcggcaacgcgggcggccccggcggcgggatgcccggcggcacccagcagggcggtcaggcggccggccaggagggcggccagcagggcggtccgacggcgcccggtggcggcggaacctgtgaactgcccagcggcgccccgcagggcggcgggaacggcggcttccccggcggcggcacgggcgagggcccaggcggcggcacgggcggcgagaacggcacggctccgggcggcacaggcggtcagcgcggcggcggtggcggcatgggtggcggcatgggaggagagaccagcagcgaactgatctcgtacctggagaagcaccaggacggcgccaagtggctgctcgcggtgtccaattcacagtccgccgggcagctgatcctcagcacccacaagcccgtcatctccatgtacggcttcaccggcaccgacaagggcatgacggtcgccaagctcaaggaactggtgaagaagggcgagctgcactacatccaggtcggcggctcggggatgggcggcggcatgggcggcggcaacagcgtcagtgccgcggtgaccgcgtgggtgcagaagaacgccacggcggtgaaggagagcgcctacagcaagaccaccacctcggagtcgagtgcgaccacgaactccgactcgaacgccggcacgaactccgactcgcagaacggccagtcggcccagtccacgtcgaccctctaccgcctggatccgtcggacgtcggc

SEQ ID NO: 5275 - DNA, 477 bp, Streptomyces avermitilis
  CDS (1)..(477)
gtgccctctgccgagcagcagttcgccggattcctgctgtcgctggaccgcttccagaaacagctcgccgagttcatgctcggcgcctatctggcgtgcgacttcggcggtgattccggcgacgacggcgattcggcgctcagcccgcaggtacggctcgacgtcgtggacggcgcaccgcaggtgacgctcgaccacgccgtcatctggatggacctggcccgggaccaggagccgaacgaataccgtctcgccgtgaccctcaccttcaccgaggcggggatcgcgctggaggcgttcgtccggctcgacctggaccgggacatgggcgagtggccggccggggtccatgtcccgtaccggcaacaggccgacggtctcggcctcgacgaggcgctggccttcgtggaggcccgggtcgaggagatgtgccgccgctacgacgacgtgaccaggctgggcctcaccccgcggcac

SEQ ID NO: 5276 - DNA, 1908 bp, Streptomyces avermitilis
  CDS (1)..(1908)
atgtacctgcacgtaaaacagaagatcgtcacgctcgcgaccgccttgtgcctgaccgtaggcgcgggcgtgggcacggccgcggcggccggacccgccccgaagcgggagccggagcccacgctgctggagatcgcggccaaggtggcgaagtactccgactgcggttcccagccgctgctggaacggcccgcctgcctgaaggagttcgccctcaagtccgccaagctcggcctcggcgtgggcgtcttcctctacgtcacccgtgacgcgatgaaggacgagggcacctctttcaaggggctggagaaggagctgaccgagctgcacaagctcaagcccctcctcctgctcgacccggacaaggagaccgacccggagaagaagaagcagatctacgagcagacggtcaaggcgctcaaggccgccaagccgcacgtggacaagctgcgcaccgacgtcgtgaaggcgtcccggatactcgacgcccacacggagtcggtcgaggccctcgccgtgctcgccgtcgcggtgggggactactaccccgaccccaagcccgtcgacgaccggccgccgaaggacacctgggacatcgcgggcttcttcaaggacatcaacaagagcctggaccagataaacgccggcttcgacaagatgaacggcgccctcgatgacatgaacaaggccacggccgaggtcaaccggggcctggacaaggccaacaagggcatcgagaaggccaaccgggggatggacaagctcaacgagggcatcaaggaggccaacaaggggctgaacgagacgaagaaggccgtcgacggcatcggcaaggccgcgtcgaagctccacgaggtacccgagttcgacttcgacttctccggcatcgccgacaagatcggttcgaaggacaccactcccggggaacgggccgcgcaggagcgccggatgtcgatgctgctcaacctgctgcccgggatcggggacggcaagggcgtcatcgaggccatcaccggcaccgacctggccaccggtgagaaggtgagcagcaccgaccgggtgctgggctcgctcgcggtcatgcgctggctcaagtacgggggcaagctgctcccggaggacatccgcgccgcccgcaagggcgacaaggtgcccgactgcaacagcttcccggccggcacgcgggtcctcatgggcgacggcaccaccaccctgcccatcgagcagatcaccgtcggcgacagcgtcctggccaccgacccggaagcggggaccacgggctcgcgcccggtggacgacacgatctacacgcccgacgacgaggacttcaccggcgtcaccctggccggcgacgcggccgacgggccgcccgcgctcaccgcgaccgaccgccaccccttctgggtcgagaaccgggggcggtgggccgacgcccgcgacctcaactccggtgacacccttcgtacccccgacggcaccggggtccggatcgacaaggtcacgcactggaaggagccgcagggcgcctacaacctgaccgtcaacgacctccacacctactacgtgctcgccggtacggtgcccgtactggtgcacaacgcaggattgtgcaccgagaaaatcgacagcgtcttccataaccccagcggcaggtcctctcaggatcagttcgaataccactgggaaaagcatgcgaaggcgcgcggtgtcacgcgtgagcagtacctccaggatgcgaaaggctgggcgacgggcattgcccggccaggagggaagagagggctcaacgccagcttggaggagttggcggacgggtcgcgcgggataaaatacgtggacccccagacgggtaagggcgggatcatcggccccgacggcaaggtcgtaaccttctggtatggcgccgac

SEQ ID NO: 5277 - DNA, 570 bp, Streptomyces avermitilis
  CDS (1)..(570)
gtgtgggcggctcatcgtcaattcatgcggcagaaccgtgacacgctggttcagggaggcagtcagggtatgtatgagattcgcggctacgtcaacggggctccgccgggaatgcttgaccgttccgacgaaacacaggtaccggccgtgagcgcgttccggatgtacctgagggtggtcagcgagtccctgcaaccggaggagatctccgcgcggctggggacagggcccgacgaagcgaccgcgatcggcagccgcagacgcccccagtcgccgccgcgcgcgcatgcgacctggatccggcacgtcctggccgcgggcgggcccgggcggccggaggatctcgaaccggtggtcctcgggtgggggccggagttcgccgcggccctggggcggctggccggctccggggaggctgacgtctgcctggtggtcgtccaggagttcaccgaccccgaggacccgcagcagaagggcatcttcctgagcgcggccctgctggcctggctggccgaggccggggcgtcgctggacatcgaccagtacgtgtacctcgaccgcgacgaccag

SEQ ID NO: 5278 - DNA, 219 bp, Streptomyces avermitilis
  CDS (1)..(219)
atggctgaccagataatcccgaacgccgcgacgctgcgaggctggcgcaagtcgtcctacagcaacagcgagggcggcagctgcctcgaggtgctggacggccacccctccggcgtccccgtccgcgactccaaggtcccgcacgggcccgcgctggtcttctcgcccgccgactgggcatcgttcgtcacggccgtcaaggacggcgagttccccgcc

SEQ ID NO: 5279 - DNA, 798 bp, Streptomyces avermitilis
  CDS (1)..(798)
ttggccatgaccagcacgtacggtgactggctgaagcagcagcgcgagacggcgggactgacgcagcaacagctggccgacgcggcggtcatgacgcgctcgcacatcgcgcacatcgaggcgggccgacggaccccgtccaaggaggacgcgcgacgcctggacgaggtcctgaacacagggaatgtgctgagcagctttctgccgcgggaggacgcggcggtcgccgactacttcgaagcggcgctgctgctcgaacaacaggcggtgaggatcaacgagttcgccctgtcgttcgttccgggcatcctccagacggaaaggtacgcacgtgcggttctgagcaagtccttccctcctgcgagtgatgaggaatgtgacaggctcgttgtcacacgccttgagcgcgcgaagattctcgatgccccgggggcgcccgtagtctgggcgacgctggacgaggcggtgctacgtcgcgtcgtgggcgggcgagaagtcatggcggagcagctcatgcacctcgtgtgcttggcagagtgtcgccgggtccgcgtccacgtgctgccgttcgcactgggcttccatccgctgatggagagcatgctcagtctcatgtggttcgaggaccagccgccggtggcgtacagcgagggcctccgcatgggaaaagtgcacgactccccgtccgtggttcaggagttgcagggtcgctacgctctcgcgttgagcgacgcactgccgctgaaggagtcagtggctctgctgagggcaacagcgaaggactacggacaccatggc

SEQ ID NO: 5280 - DNA, 435 bp, Streptomyces avermitilis
  CDS (1)..(435)
gtgagtggatcgccacacaaagcgagacccccgcgaccgagcgaccggtccgggggcgtggccatcaacgaacccaacggagttgacgacatgagccaccgtatcgcccgcctcttcgagccgctgctgcggcttctgctccccggcacgggacgccgtcgccgcgcggtcaccgccccggcgcaccgacgccccaccccctcgtacgcccctggacggaccgcccgtcgcgacgggtcccgccccctgcgcggcgaggacaacgcgatggtccgcccctatctcgtcgcccatgagcggagcgaggaagcgcggcggcagcgagcccggcgacgcgccctgtggctcgccgtgcacggcatcgacgtcggccctcggatcattcacggcatcgacatcggcccgcggatcatccaccgtgtggaggtgcccgcg

SEQ ID NO: 5281 - DNA, 336 bp, Streptomyces avermitilis
  CDS (1)..(336)
gtgaccagcgaccggacggaaaccgtgcggctgctcccgtggtccggcccggaaggcaagccctgttacgtcgtcggcgacgggaccggatacgtctcccgcatggccgacagcgtcgagagtgtgcagctgggcatggcggcccagatcctcgaccacgccgccgacatgctcgccgaccacaaggccaccgccgcgcaactccgtttcctggcggcccgtatggccgaggcactccgcgatgttcgccgcatcgcggagagcaggggcgcccggctccccgggccggccggtgaaggccccgaggacgacaccgaaagccctgcgacagacgtc

SEQ ID NO: 5282 - DNA, 930 bp, Streptomyces avermitilis
  CDS (1)..(930)
atgactcaccggatgtcccggggtgcccgtgtgctcgcagtgagcctcggtgccgggatgctcataccgctcgcggccgccgcgacgcccgccgctgccgtggggacaccccaggtcagctgtacctcggagaaggcaggcctggccgccaagctccagagcgacatcaccgcggctctcgcgaaccgcaagggcacgatcgcggtcggcctctacgaccgcaccaccaagacgagctgcaccctgcgttccagcaccgcctacgactcggcgagcgtcgtcaaggtcaccgtgctggccacgctgctgtgggacgccaagaagcacaaccgctatctcacgtcgcgcgagaccgacctcgccacggacatgatcaccaagtccgacaacaccgcgaccagcacactgtggaggcagctgggcgtgaccaaggtgaaaggtttcctcgctgccgccgggatgacgcagacgaagccgggagcggacggctactggggcctcacccagatcacggtccgcgacgagcagaagctgctcgccctcgtcaccgccaagaactccgtcctgaccgacaactcccgtgcctacatcctgaagctgatgggcaaggtcgtctcctcgcagcgctggggcaccccggccggcgcgccctcgtccgtcgccgtgcacgtcaagaacggctggctgtcccgggcgacgcacggctggcgcgtccacagcgtcggcaccttcaacggcggcggccacgactacacgatgaccgtgctcacccacggcaacagcaccatggactacggcgtcgacaccatccaggccgtggccaaggccatccacaaggacctggtgccggccaccagcagcgcgagcgtccagcggtacgtgcccacggacacgcccaaggaggcgttcccggcggtgcccgccaccggc

SEQ ID NO: 5283 - DNA, 3771 bp, Streptomyces avermitilis
  CDS (1)..(3771)
atggacggacggaaaggcaccggcgtgacagcgcacgagggggagacagcgcacgagggggagccgcgcggctgggcgtatcggctcgcgggatacgcctggcggtatcccaaggacgtcgtcctcgcgctcggctcctcgctcgccggcatggccgtcatggcgctcgtcccgctgatcaccaaggtgatcatcgacgacgtcgtcgggaaccacacccgcgacatggccccctgggcgggcgcgctcatcggtgccgccgtcctcgtgtacgcctccacctatgtccgccgctactacggcggacgtctcgccctcgacgtccagcacgacctccgcacggcgatgtacgggacgatcacccggctcgacgggcggcggcaggacgagctgtccaccggccaggtcgtcggccgcgccaccagtgacctccagctgatccagggcctcctcttcatgctcccgatgaccatcgggaacgtcctgctcttcctgatctcgctcgggatcatggcctggctctcgctgccgctcaccctggtcgcgctggcggtcgcccccgccctctggttcgtcgccaggcgcagccgctccaggctccaccccgccacctggtacgcgcaggcgcaggccgccgccgtcgcgggtgtcgtcgacggcgcggtcagcggcgtacgcgtggtgaagggcttcgggcaggaggaccaggagaccgggaagctccgggaggtcgggcgccggctcttcgcggggcggctgcgcaccatccgcctgaacgccaagtacaccccggctctccaggccgtccccgccctcggccaggtcgcgatgctcgcgctcggcggctggctcgccgtgcgcggtcagatcacgctgggtacgttcgtcgccttctcgtcgtatctcgcgcagctcgtcggaccggtgcggatgctcgccgtggtgctgaccgtcgggcagcaggcccgggccggcgccgagcgggtcctggagctgatcgacaccgagccgtcgatcgaggacgggaagaagacccttccgtccgacgcgcccgcgaccgtcgagttcgacgacgtgttgttcggctacgaggagggccgcccggtcctcgacgggctgagcttcgagatccgccccggcgagaccctcgccgtcgtcggctcctccggctccggcaagtcgaccgtgtcgctgctgctgccccgcttctacgacgtcacccacggcgcggtcctcgtcggcggccacgacgtgcgcgagctgacgaccgagtccctgcgggccgcgatcgggctcgtccccgaggactccttcctcttctccgacaccgtgcgcgccaacatcgcgtacggccgcccggacgccacccgggagcagatcgagaccgcggcccgtgccgcccaggcggatcgtttcatcgccgagctgccggacgggtacgacaccaaggtcggcgagcacggcctcaccctctccggcggccagcgccagcgcgtcgccctcgcccgcgccatcctcaccgacccgcgcctgctcgtcctcgacgacgccacctccgcggtggacgcccgagtcgaacacgagatccacgaggcgctccagcaggtcatgcggggccgtacgacgctcctcatagcccaccgccgctccaccctgaacctcgccgaccgcatcgccgtcctcgacgccggccgcctcgccgacatcggcacgcacgaggagctccaggagcgctcgtccctgtaccggcggctgctcaccgacccggacgagctgggcggggtctcgcccggccacgcccagcccttcccggtgcgggaggacacctccgtacgggacgaactggacgcggagttcgacgccgagcggggcgtcactccgcacctgtggaccggcgaccgcgagcccaaggacaccgcgctcgccggaatgcccgccactcccgaactcctcgcccaggtcgaggcgctgcccccggccggcgaccgccccgacatcgacgaggcgcgcgcggtcacgcccgaacagtcgtacgggctgcgcaggctgttgcgcggtttcggggcgccgctgctcatcagcctcggcctggtcgcggtcgacgcggtgatgagcctgctgcttccggtgctgatccggcacggcatcgaccagggggtgacccggatggccctcggcgcggtgtgggccgccgccgggctcggcctgttcaccgtgctcgtccagtgggccgcgcagatcggcgagacgcggatgacgggccggacgggcgagcgggtcctgtactcgctccggctgaagatcttcgcgcagctgcaacgactcgggctcgactactacgagcgggagctgaccgggcggatcatgacccggatgaccaccgacgtcgatgcgctgtcgacgttcctccagacggggctcgtcaccgcgttcgtctccgtggtcaccttcttcggcatcatggtcgcgctgctcgtgatcgacgtgcagctcgcgctggtggtgttcgtgacgctgccgccgctgatcatcgccacgttcttcttccgccgggcgagtgtgaaggcgtacgaactcgcccgcgagcgggtgtcggcggtgaacgcggaccttcaggagtcggtctccgggctgctgatcctccaggccttccggcgcgagcggtcgggccggcagcggttcgcggacggcagcgacagctaccgcagggcgcgtatccgcgggcagtggctgatctcggtctacttcccgttcgtacagctgctgtcgtcggtggccgcggccgccgtcctgatcatgggcgcgcaccgcgtcgacgcgggaacgctgacgaccggtgcgctggtcgcgtacctcctctacatcgacctgttcttcgcgcccgtgcagcagctctcccaggtcttcgacggctaccagcaggcgaccgtgtcgctgggccggatccaggagctgctccaggagccgacgtcgacgaaggccgcggacgagccgctcgaggtgctctcgctgcgcggtgacatcgtcttcgaggacgtcgacttcgcgtacggggacgacgaagaggccctcagggaggtctccctggccatccccgccgggcagaccgtggccttcgtcggtgagaccggcgcgggcaagtcgacgctggtgaagctggtcgcgcggttctacgacccgacgggtggccgggtcacggtcgacggcgccgatctgcgggccctcgacctgacgtcgtaccggcaccggctgggcgtcgtgccgcaggaggcgtatctgttccagggcaccgtccgggacgccatcgcctacggccgccccgacgcgaccgacgcccaggtggaggccgccgctcgcgcggtcggcgcgcacgacatgatcgccacgctcgacggcggctatctgcacgaggtcgccgagcgcggccgcaacctgtccgccggacaacgccagttgatcgccctggcccgcgccgaactcgtcgacccggacatcctcctcctcgacgaggccaccgccgcgctggacctggcgacggaggccgtggtcaaccaggcgaccgaccgcgtcgccggccgccgtacgaccctggtggtcgcccaccgcctgacgaccgcggcccgcgcggaccgggtcgtgctcatggaccacggccgcatcgccgaggacggcacccacgagcagctgctccagctgggcggccggtacgcgcagttgtggcggacgttcgtcggagcggccgagccaggggagccggtggcgtcctccgcc

SEQ ID NO: 5284 - DNA, 1446 bp, Streptomyces avermitilis
  CDS (1)..(1446)
atgcgcaaggcgctcagatggctgctggcgctcgcggtgctcataggcacgctgagcacggccggggcggccaccgccgctcagccggaggccacgggttccgccagtgcggccgacaccgacatcaaggaccggctgctcgcgataccgggcatgagcctgatccaggagaagccgtacacgggttaccgcttcttcgtcctgaactacacccagccgatcgaccaccggcacccgtccaagggcacgttccagcagcgcatcaccgtgctgcacaaggacacctcgcgcccgacggtcttctacaccggcggctacaacgtctccacgacccccagccgccgcgagcccacccagatcgtggacggcaaccaggtctccatggagtaccggttcttcaacccgtcccggcccgacccggccgactggtccaagctcgacatctggcaggcggccagcgaccagcaccgcatcttcaaggccctcaaggcggtctacggccagaagtggctgtccacgggcggctccaagggcggcatgaccgccacgtactacgagcgcttctacccgcgcgacatggacggcgtcgtcgcgtacgtcgcccccaacgacgtcgtgaacgacgaggactcggcgtacgaccgcttcttcgcgaacgtcggcaccaaggagtgccgcgacaagctgaacgccgtgcagcgcgaggcgctggtgcggcgggagccgctggagaagaagtacgcggcgtacgcggccgacaacggctacacgttcaccacgatcggcagcctcgacaaggcgtacgaggcggtcgtcctcgactacgtctggggcttctggcagtacagcctgctgtcggactgcgacgcgatcccggcggacgcggcgcacgcgacggacgacgcgatctgggactcggtcgacacgatctccgggttctcggcctacgccgaccagggcctggagacgtacacgccgtactactaccaggcgggtacgcagttgggcgcgccgacgatccacttcccgtacatcgagaagaagctggtccgctacggctaccagcctcctcggaacttcgttccgcgctccatcccgatgaagttccagccgggggcgatgcgggacgtggacggctgggtgcgccaccacgcccggcacatgctgttcgtctacggccagaacgacccgtggggcgcggagcgcttccgcctcggggcgggcgcgcgtgactcgtacgtcttcgcggcaccgggcctgaaccacggcgccaacgtcgcgggcctggtcgccgacgagaaggcgctggcgacggcccgcatcctggagtgggcgggcgtggcctcgacagcggtccaggcggacccgtcggcggcgaagcccctggcgaagtacgacgcgaagctggaccgccgggacgtggaccgcgaaccgacgctgcgcccg

SEQ ID NO: 5285 - DNA, 630 bp, Streptomyces avermitilis
  CDS (1)..(630)
atgcgagcgagaccggcgctgccgggcgggctgctgacggctgtgctgacgctcctgtcggcggcggtggtctccgggtgctcgcagcagtccggcggccaggccggtcagccgacacaggggacgacgtccacgcggccctcggggtacggggcggtgttcctcgcggtcgacgagtgcagttccttcgggacgacgagcttcacggaagtgccgtgcacgagcgaacgggcggcggcgcgggtgatcgcccggtacgacgggaagccgtcggacggcccggcctgcccggcgacgacggacttcgtcctgcacatcagcgagacgcggcccgcgtcggacgaggacggggacggcgcggtgccgcggggatacgcgtgcatgcgcaatctggagccgccgcacccgggtgatcccgggggcgggggcggcccgcgcacgatcgtcggcgactgcgtgtacggcgcgggccggggcgaggtccgcgagacgtcgtgcgacggcaagggcaggaaaccccccgagtaccgggtgacctcggcggtcccgaaacgctccgactgcccgaggtcgacagcgctgtacgtccaactgggcggccccaccccggtgggctgcgcccggcctgtg

SEQ ID NO: 5286 - DNA, 1848 bp, Streptomyces avermitilis
  CDS (1)..(1848)
atgcgcgactccggcacgggaagcacgggaaacacgggaaacacgggaaacaccgcacagccgtccagacgtaccgtcctcgccgccaccgcgggtgccggcgccgttctcgccgtcagcgggaccgcacacgccggcccgagcggcgaccggaaactccgcgccctcatctcccgtatgacgctggaggagaaggtcgggcagctcttcgtgatgcgggtgtacggccattcggccaccgcgcccgaccaggccgacatcgacgccaacctcaaggagctcggcgtacggacggccgccgagctgatcgccacgtaccgcgtcggcggcatcatctacttcacctgggcgcacaacacccgcaccccgcaccagatcgccgacctgtccaacggcatccagaaggcctccctcgaccagccgcgcggactgcccgtcctgatcgccaccgaccaggagcacgggatagtcgcgcgcgtgggaaagcccgccaccctcttccccggcgcgatggccatcggcgccgggggctcccgctcggacgcccgcacgctcggccggatcggcggcgccgagctgcgcgcgctcggcatcctccaggactactcccccgacgccgacgtgaacgtcaacccggccaacccggtcatcggcgtacggtccttcggcgccgatccggacgcggtggccggtctggtcgcggcggaggtgaaggggtatcagcagtccggcgtcgcggcgaccgccaagcacttcccggggcacggcgacaccgccgtcgacagccacttcggcttcccggtcatcacacacagccgcgaactgtggggggagctcgacgcggtccccttccgggcggccgtccgggccggcatcgactccatcatgaccgcgcacatcatggtcccggccctggacgcctccggcgatccggcgacgctctcccgccccatcctcaccggcatcctgcgcgaggaactgggctacgacggggtcgtggtgacggactccctcggcatggagggcgtacgccagaagtacggcgacgaccgcgtgcccgtgctggccctgaaggccggtgtcgaccagctcctcaacccgccgtcgatcgacatcgcgtggcacgcggtgctgaacgcggtgcgcggcggcgagctgaccgaggcccgcctcgacgagtcgatcctgcgcgtcctgcggctgaagtcgaagctcgggctgctgcacgacccctatgtcaccgagcgcggcgtcgaccggacggtgggcaccccggaacacctgcgcgcggcggaccgcatcgcggaccgtacgaccacgctgctgatcaacaagcagggcctgctcccgctgtcccgccgtacccgcccgagggtcctcgtcgtgggcgccgaccccgcgtcaccgtccggcaccgacggaccaccgaccaccgtgctcgccgccgccctcaccgagctgggcttcacggcgacggccctgtccaccggcacggcaccgtcgacggcgacgatcgccaaggcggtggcggcggccgggagcgccgacgcggtggtggtgggcacgtacaacgtgacggcgggcagttctcagcgcaccctggtgaacaagctggtcgccacgggcgtcccggtggtcgcggtcgccatccgcaacccgtacgacgtggcccagctccccgacgtcggcgcctgcctggcctcgtactcctggaccgacgtcgaactgcgcgcggcggcccgggtgatcggcgggcgggtgacaccgcgggggaagcttccggtggcggtgcagcgcgcggacgcgccggagcaggtgctgtatccgatcgggtacgggctgacgtac

SEQ ID NO: 5287 - DNA, 924 bp, Streptomyces avermitilis
  CDS (1)..(924)
gtgctcgatctccaacggctgcgcgccctgcacgccgtctccgtccacgggacggtcggcgccgccgcggccgccctcggctacacaccgtccgccgtgtcccagcagatcgccaagctggaacgggagaccaggaccgtactcctggaacggcaggggcgcggggtgcgtctcaccgagcaggccgagcaactggctgccacggcacaggagttgctcgccatcgtggagcgggcggagacggagctggaggagcggcgcgggctgcccgcggggcggctgacggtggcggcgttcgcgagtgcggcgcgggggctgatgccgggtgtgctcgccgacctggccgcgcggcatccgtcgctggacacccgtctgaccgaggtcgatccgcatctgtcggtcgacctggtcgccaagggcgcggtcgacgtcgcggtcgcgcacgactgggacatcgcgccgctgccggccccgccgggggtggagcaggcggtcatcggggacgacctgtgcgatctgctcgtccccgccgggcatcccctcgccggccgggcgtccgtgcgacgtgcggaactcgccggtcagcgctggatctgccagccgcccggccgggtctgccacgactggctggtgcggaccctgcgcgcggccggctgcgagccggacatcgtccaccaggccgacgagaacccgacgctggtcgccctggtcgcggccggcctcggcatcgccctgatcccccgcctgggccgcggcccgctccccgacggagtcgtcgcggtgccgctcgccccgatgcccgtacggcgcctgtacgccctgtggcgcgccggtgccgcacgtcggcccgcgatcgcggagacggtacgcacgctccaggcccactggacggaggagcggacgccggcccaccagggtgacgtg

SEQ ID NO: 5288 - DNA, 918 bp, Streptomyces avermitilis
  CDS (1)..(918)
atgcgacccgctcacatctgcctcgccgtcctcgtcgccgccgtctggggcgtgaacttcaccgtcatcgaggtgggcctggcgcacttcccgccgctgctcttctccgccctccggtttctcgccgccgcgcttccggcggtcttcttcgtgggccgcccgaaggtggcgtggaagtggatcgtggcggtggggctggtgctcggcgtcgcgaagttcggtctgctcttcatcggcatggacgcgggcatgccggccgggctgtcctccctggtcctccagatccaggcggtcttcacggcgctgatcgccttcgcggcgctgggtgagcgccccaccggcatacggctggcgggcatggcggtcgccctgtgcggggtggggctcgcggccgtcgacgagggcacgggcggcccgctcggtgccttcgccctggtgataggggcggcggtctgctggggcgcgtccaacgtcctcacccgcaaggcgtccccgccggacccgctgaacttcatggtgtgggtgagtacggtgccggtcgtgccgctgctggggctgtcgctgctgacggaggggccgtccgccgacctgaacgcgctcggctcactcgactggcagggcgcgggcgtcatcctctacgtcgcctggatcacgacggtcttcggcttcggggcgtggggctggctgctccaccgtcaccccgcgtccacggtggcgcccttctccctcctggtcccggtcttcggcatgtcgtcggcggcgctgttcctgggggagccgatcggtcccatgcgctggggcgcggcggcgctgctggcgggcggggtggcgctgacgtcactggcgcccgggaaagaacgttccggcggcccgaacaccttggacctccgcggcgtcggtattcatgaggccggacgg

SEQ ID NO: 5289 - DNA, 507 bp, Streptomyces avermitilis
  CDS (1)..(507)
gtgatgtgcggcctccgcaccgtccacggaagcggaaacgctccaagaggaggcgtaccgatgaaggccgtagagatgaaggccgtagagatgaaggccgtggcgatgaaagccgtactcccgatcggcaggaccggatccgtgtggatgctgccggcggcgttactggtcacgatgtccgtcgcctgtacgtcgtccgacggcggcgcgtccgcgtcgtcctgcgcgtacctggtcgagtaccagagccgcacgtacgcgggctcggcggccagggacttcaccctcggggacgaactcggtgccgccacccttccgccgtgcgacgacacgccgaacgacgacagcgacggtcgaacgacgccgacctcgacgaccgcctatgcgatcgagggagtggaccccgccatcgccatcgcgttggaacagtcgtccgacgacgtcatcttcatcgacgtcgactccgactggacgctgcctgagatcaagaagatgatccacggcacg

SEQ ID NO: 5290 - DNA, 1749 bp, Streptomyces avermitilis
  CDS (1)..(1749)
gtgccggccgaccatgtcggcatcgtcaaacggaacttcggcgccgcacactccgacccctcgttcaaagaggtcaaccccgacaacgcacgcggggtacgggcccgcacactgctccccggcggctttcactggctcacaccgctgctgtactcggtggagtgcgtgcccaggctgcacattccggcaggcatgctcggcctggtctcggccaccgagggccgtacccggaccgaaggccgcccgctcggccggcacgtcgcgtgcaacagcttccaggacggcgaggcgttcctccgcggcggcggcgagcagggcgtgcaggtgacgacgctcagcggcggccagtcgtactacatcaacaccaggctgttccgcgtcgagacggtaccgcgcacctatgtgccgccgggcacggtcggcctggtccaggcgcaggcgggtgccgtccggccccccgaccagcggttcggccggcacgtcgagtgcaacagcttccaggacggcgaggcgttcctgctcggcggcggtgagcagggcaggcagctggccatcctcggcggcggggcgtactacgacatcaacccggagctgttcgacgtcatcacggtcgacaacgtgacggcctcccgcgacggactgaccgaggcccacctccaggacgtgtccatcgaggagggctgcaccggggtggtcatcacgctggacggggccgagccccgccaggacaccaccggcacggtcgcacctcgggtggagggccacggcagcttccgtcggccctgggtgttcctcgcgaagggcggcgagcggggcatccaggaggagacgctgggcgagggaaccacctactccctgaacccctggttcgtacgggtgatgctgatccccacgcgcgtcctgtacctcacgtggcacaacaagcgggagtccgagtccgacaactacgacgcggacctcggacagatcaccgtcaacgtccagggcttcgacctggacgtcgacctcacgcagaacctccagatcccgcgcggcgtggcgccgcgcctggtcagccagttcggcggcgtgcgcacctccggactgggcggcctcgtcgacgacccgacccccatgcagcggttcgtcaggaacgtgctcggcaacacggtcgccgggtacttcaacgagatcgccgtgacgagttcggtgctggagttcctcggcacctaccaggacatccgcaaggacctcaccgaccaggtcacgcacgcgctggagaagtggggcgtgggcatgcagggcaccgccctcggcaggttcatcccccgggatccgtccctgctcgagaagctcaaggagaagttcgccgaacaggcgcggctcgccaacctcgaagtgggcgtggagcaagccaagttgaaggacctgatcgacacgtacgaggcgctggcggaagcccggcgcgtcggcctcgaactccagaaggaagtggaactgctgggccgggagaacgtcacgctgatccgcgtcgtgggggagttcgccaagttcgacgtcccgcagtacgtcggcgggggcggcgacatctcggaatacgtccagatgctgccgctgaccgtcaagcaggacctcctggcccggctgcgcaacctgcacggggggcggccggtcgacccgggccaggagaggccggtactgacgaaggaatccgacgccatggacgacgacacggacgacacgatcgacggtgacgtccgcctcgtggac

SEQ ID NO: 5291 - DNA, 1626 bp, Streptomyces avermitilis
  CDS (1)..(1626)
gtgacaacagggcggaaggagaggctcctcccttaccttggtcgctccccggagccgacgactcggtccgaccgccgcgcgcaggaggtccagcggttgaacgacgtgttcctctcctacgcggccgccgacgccgtctgggccacgaagctggccgaacatctcgccgggcacgggctgtcggtgttcttcgaccagtggagcatcgaacccggccaggtggtgatccacgagctggaggcagctctcctcgcgtccaccaacggaatcgccgtgatcagcccggcgtccgtccgctcggcccccgccatgaacgagtacgcggtgctggcgggcgcgtcggccacccacggactgcggttcataccggtgctgctcgggcaggtggccgcgcctccgttcgccgcccagcgcgtctggcgtgacttcagcgacgcgaccggccaggagttcacggacaaggtcgccgaactcgcggccgtcatcgcccggcgccccgcccccaccggcgccggcgccgcgtcgtcccgggacaacctggccgccgtccacccctccccgccccggccgctcaccgcaccggaagaacccgccttcgtcgtgtgctgcgcgcccgccgacgccgcgtacggcgggcggctgaccgagcagctgcgcgcggccgggctgccggtctggtcgacgggggatctgcggcccggggacgcccagttctggacgatcagacagcagctccggtacgccgtggcagtcgtcgtggtgatgactcctcagtcgcaggactccgacgacgtcacccgcatgatcctggagggccaggtgcacgggcgggctttcgtccccgtcctgctggacggtgaggtcaactaccacctggcggccacctggcatgtggacgcccgtcacgggggcctgctcgacgaggccgagctcggcctgttgcgcctgctgcacgaggacgtgacacagggccgacccgcccgcctccccgaagcggcccccgcccggggctcggccccggccgtccgtatgacgacacccgccgtaggtatggcgccgccggccgtccgtatgacgacaccggcggtacacacgacggctccggagatacgcacgacggctccggcggcgcgcatgacggccccggccgcgctggagcggctgcgcgcccacctcgccgaggacgagtacgagcatgccgacctgctgaccacccggctcgtcctggagacggcgggccgcctcggcgagggctggttgagcgaacggcacgccgccgcactgccgttggagctgctggccggcatcgacgcgctgtggaccgcccactcccacggccggcagggctttgggcgccagcgcgcactggcgcccatggaccggggcgggcggggttcgcgcttccccgacctgggcgccgcgctgggctggcgcgactcggccgaggccgccgtaccccggctctaccaggacttcgcacggcgggcgggacccggcagacgggccgggttctttcccacgctgcgcgatccgggccgtgagaacaaccccgactggtacgaccgttggagctcaaccgtgctggcggtgcacgcacggctgcgagagtggaaggccgccccatgc

SEQ ID NO: 5292 - DNA, 984 bp, Streptomyces avermitilis
  CDS (1)..(984)
atggtggtgacccggccgtggcggctgccgcgcagcacggaggtgcgcgaagtgcgtcgcgggcggtacgggcggaccgtgctggcccggctcgacggcgaggccggtgaagtcggcgaagtcggtgacctggtggcggtgcgctatataccggccgggctgctgatccaccgcccgcgggcggaggccttctggacggacgtcgcacggctgaccggcctcgaagcgcccgaggcggtcccgttccggcagtacgttcacgcacccgggttcacggccgcgtacacccgttcggccggggcggtcgaggcggtcggcggtgcgctggtcagcgacgcggtcgagggcgtcaccctgtcgcgggtgctggaccggcacggagccctgcccccggccgccgcgctgctcgtcgtccacagggcgttgcgggcgctggccgccgcacacgggcgtgcagtggtccacggtgacctgcggcccgccaaggtgctgatcgacgccgacggggtcccggccgtgaccggcctggggctggccgcgctgaccaccggcgccgccgggctgcgtgcgccggagctgtggcgaggcggcggggccgcgacgcccggcggcgacgtgtacgggacggcctgcgtgctccacctctgcctgaccggcgaactcccttttcctgtacggcagttgttcagtctgatggcgcggcacaccacggcgcaggtgccgatggaggcagtccccgggccgctgcgcgctccgctcgccgccgggctgaccaaggatccggcactgcggccgggcgccgaggccctgctggcccacctggaacggacggcgcggacggcgctcggccgcgactgggaggagcggggcggctcggcgctgaggaccctcgccgcacccctgaccgaggcgcttcctctgacatcgccgagtgcggaagaccgtccacacgccgactcatcacacgaaggtgtgctgatgatg

SEQ ID NO: 5293 - DNA, 555 bp, Streptomyces avermitilis
  CDS (1)..(555)
ttgccacggtggcgtccacgtacttcgcctgggttccgctgcggaaccggggcggtcccggccggcgccgcggtcgcgacccgggccccgaccccgcgccccgccccacccctccgccaccgcaggcacagacgcagggcccgtacgacgtgttcgtgtcgtacgcggacgcggaggccgaacgccgcggagcggctggcggagcggctgcgcgaggcgggcgtgtcggtcttcctggtgcgctgggtcgagccggggctggtccccctgctggagaccgaacgggccctggtgggtgcgaccctcggagtgctgctgttcggacccggaacgatggccgactcgcggatcagggaggaatacgcggtcctgctccagcgcgtccacggaggcggtttccggttcgtaccggcgcgggccgggagcgtcgaactcccgccgttcgccgacatccgccggccggtggatctgcgggagcccggcactccgcgctacgacggcgaggtcgcccggctggcggacaccgcactcaggctgcggcgaaggacggacgtc

SEQ ID NO: 5294 - DNA, 798 bp, Streptomyces avermitilis
  CDS (1)..(798)
atgaaactggccttctccaccctcggtgttcccggcctccccgtccccgacgtcgtacggctcgccgccacgcacggctaccacggtgtcgagctgcgcgcccaccccgaggaaccggtgcaccccggcctcggcccggccgagcgggccgaggtggccgccgcgttcagggcgggcggcatcgagatcctgggcctggcgggatacgcgcgggtcgcggcgccgggcgacgacgaccccgtcctcacggagatccgcggactcctcgacctggcccgcgacctgggcgcccccttcgtacgcgtgttccccggcgcggttgcggagcagagccgcgcggaagccgacgcgacggcggcccggcggctgggcacggccgcggagtacgccgccgacgtcgacgtacggatcctgctggagacccacgactcccatcgcaccggcgccgacgcgatccgcgtcctcggccccgtcggccaccgccacgcgggcgcgctgtgggacgtgatgcacacctggctgggcggcgaacagccctcctcgacgtatgcggccctggccccgcacctcggatacgtgcaggtgaaggacatcgcgtccgccgaggacacgaccccgctgccgctcggcaccggcgtcctcccgctcgccgagtgcgtggaactgctgtcgcgggaggggtgggacggctggctgtgctgggagtacgagaagcggtggtacgagcaggcggcgccgctgcccggtctgctgcgggcgggccggaaccacctggcccggctgctcaacgagtcggcg

SEQ ID NO: 5295 - DNA, 930 bp, Streptomyces avermitilis
  CDS (1)..(930)
atgaccgtccacgacatccgctcgttcaaccgcttctacacgaacgtcatcggcgcgctggactacggccgccacctctacgccccgtacacgctcacggagtcccgtgtgctgtacgagctcgcgcactcaccccgcaccgacgcggccgacctgcggaccgaactctccctggacgcgggctacttgagccgcattctcaacaagttcgaggacgacgggctgatccggcgctccccctcggagcgtgacccgcgccgccgccacatcacgctcaccgcacgcggccgggacgcggccgacctgctcgccgagcgggcccgcgcatccgtcggcgcgctgctctccaccgtgcccgccgccgaccacccccgcctcaccgaggcgatgcgcacgatccaggagctcctctccgccggccgcccgccgcgccgcgaggacgtgctgctgcgcgagccggccccgggcgacctcggctggatcgtgcagcgcaacgccgccgtctacgccgccgagtacgggtggaacaccgactacgagggcctggtggcgcgtatcgtcgcggacttcgcgcaggaccacgacccgcatctggagcgggtgtggatcgcggaggtggacggccgtccggcgggctgtgtgatgtgcgtacgggacgaggcacccggcgcggcacgcctgcgcctcctcctggtcgaacccgacgcacggggtctgggcatcggcgaccgcctggtgagcgcggtggtcgaattcgcgcgcggtgcgggctaccgcgaggtgctcctgtggaccaacgacgtgctgtccgccgcccgccacatctaccagcgccacggtttcgtcctcctcgccgagaagccgcaccgctccttcggcgcggacctggtggggcaggactggcggctggacctgcacgaagcacatgag

SEQ ID NO: 5296 - DNA, 1038 bp, Streptomyces avermitilis
  CDS (1)..(1038)
atgacggtgaccctggcggacgtggcggcacgcgcgcaggtctcgcccgcgaccgtgtcgcgtgtgctgaacggcaactacccggtggccacgtccactcgggagcgggtgctgcgggcggtggacgaactggactacgtcctgaacgggcccgcgagcgccctggccgccgcgacctccgacctggtcggaatcctggtgaacgacatcgccgaccccttcttcgggatcatggcgagcgcgatccagtcggagatcggagggcccggcggacgcgcgggcggcgaacggctcgcggtggtgtgcaacacgggcggctcgcccgagcgcgagctgacctacctcacgctgctgcaacgccagcgcgccgcggccgtcgtgctcaccggcggcgcggtcgaggacacggcgcacgccgccgcggtctccgcgaagctgcggaagctggcggaggcggggacccgggtggtgctgtgcggacggccgcccgcgccggaggcggtcgcgctcaccttcgacaaccgcgggggcggccggcagctcaccgagcacctcatcgggctcggccaccggcgcatgggctatatcgcgggcccggaggaacgcacgacgacccgccaccgtctggagggccaccgcgaggcgctcgaggccgcgggcgtcgaggacgacccgcggctgacggtcctcggccgctacgaccgccgctccggctacgaggcgacgctcgaactcctgcgccgcgacccgtcgctcacggcggtggtcgcggccaacgacacggtcgccctgggcgcgtgcgccgcgctgcgggattcggggctgcgcatcccggaggacgtgtcggtggcgggcttcgacgacctgccgttcgcgatcgacgcggtaccggcgctgacgacggtacgactgccgctgaccgaggcgggcgcccgggccggccggatcgcgatgggccgcgaggaaccaccgccgggcgggatcgccacggtgcgcggagaactgatggtccgagggtccacgggggcaccgcggggg

SEQ ID NO: 5297 - DNA, 1149 bp, Streptomyces avermitilis
  CDS (1)..(1149)
gtgacacgcaagacggtgcgtatcgccatgaacggggtgacgggacgcatgggctaccgccagcacctcgtccgctcgatcctcgccctgcgcgatcagggcggcctcgacctgggcgacggcaccgtgctgtggcccgagcccgtcctcgtcggccgccgcgagcacgccctgaaggcgttcgccgagcggcacggcctggagcactggtcgacggatgtggaccaggtcctcgcggacgactccatcgacatctacttcgacgcgcaggtcacctccgcccgcgaggaggcgatcaagaaggccgtcgccgccggcaagcacatctacaccgagaagccgaccgccaccgggttcgaaggtgccctcgagctggcccgccgcgcgaacgccgccggcgtcaagcacggcgtcgtccaggacaagctcttcctcccgggcctgctcaagctcaagcgcctcatcgacggcggcttcttcgggcggatcctgtcgatccgcggggagttcggctactgggtcttcgagggcgactggcaggccgcccagcgcccgtcctggaactaccgtgccgaggacggcggtggcatcgttgtcgacatgttcccgcactgggagtacgtcctgcacgaactcttcggccgggtgacgtccgtccaggcgctcaccgccacccacatcccgcagcgctgggacgagcagagcaagccgtacgacgccacggccgacgacgccgcgtacggcatcttcgaactggagggcggcgcgatcgcccagatcaactcctcgtgggcggtgcgcgtcaaccgcgacgagctcgtcgagttccaggtcgacggaacggagggctcggccgtcgccggcctgcgcaactgccgggtccagcaccgcagcgcgaccccgaagccggtctggaaccccgacatccccgccacgtactccttccgcgaccagtggcaggaggtcccggacaacaccgagttcgacaacggcttcaaggcccagtgggagctgttcctcaagcacgtctacgcggacgcgccctaccactgggacctcctggccggcgcccgcggcgtccagctcgccgagctgggcctgaggtcctcggccgagggcgtccgtctcgacgtgccggagatctcgctg

SEQ ID NO: 5298 - DNA, 1149 bp, Streptomyces avermitilis
  CDS (1)..(1149)
gtgaccatccgacttcccggcgtgggaggggagttgcgcacgtacgtcccgcgcaccgagcccctcgccccgaccgcgggcgcgcccttcacctcccgtacggtcttctcggcggcgcacgtggtcgccgacccgtacgcggacacgacccccgactcgcccgccgcggtcgactgggacgccacgctcgccttccggcgccatctgtggtcccacgggctcggcgtcgccgaggcgatggacaccgcgcagcgcggcatgggcctggactgggcgggcgcggcggagctgatccgccggtcggcggcggaggcgaaggcggtcggcggccgtatcgcctgcggggtgggcaccgaccagatcgccggggggacgccggccgaggtgcgggccgcgtacgaggagcagctcgcccttgtcgaggagtcgggggcgcaggcgatcctgatggcgtcgcgcgcgctggccgcgtccgcctccggacccgaggactacctggaggtctacggccagctgctgcgccaggccaccgagccggtgatcctgcactggctgggcccgatgttcgacccggcgctggcgggctactggggttcgtccgacctggacgccgccacggacaccttcctcgaggtcatcgccgcgcaccccgacaaggtggacggcatcaaggtctccctgctggacgcccggcgcgaggtcgagctgcggcgccggctgccgcggggcgtgcgctgctacacgggcgacgacttcaactatcccgagctgatcgcgggcgacgagaagggcttcagccacgccctgctcggcatcttcgacccgctcgggcctctggcggcggaagcggtacgggtactggacacgggtgatgtgaagggcttcagggaactcctcgaccccacggtcgacctctcccgccaccttttccggcctcccacccgcttctacaagacgggcgtggtcttcctggcctggctggccggccaccaggaccacttcacgatggtgggcggcctccagtcggcccgctcgctcccgcacctcgcgaaggcgtacgaactcgccgacggcctgggcctgttcccgaagccggaactggccgaggcgcggatgaagaccctgctgtcgctgtacggagtgagccga

SEQ ID NO: 5299 - DNA, 831 bp, Streptomyces avermitilis
  CDS (1)..(831)
atgagcgcggccctggagcgtttctcgatcaaccagatgacggtcaagcagctggacctgcccgaactggtcgacgcctgcctggagtcgggcgtccccggcgtgggcctgtggcgcgcgccggtccagtcgtacggcgtcgaggcgacggcgaagctgatccgcgacgcgggcctgtcggtgacgaccctgtgccgcggcggcttcctcacggcgatcgagccggccgagcgggcccgggcgctggacgacaaccgcctggccgtcgacgaggcggccaccctcggcacggacacactggtcctggtgtcgggcggcctcccggcgggctcgaaggacctgcacggcgcccgggaacggatcgcggacgcgctgggcgagctgggcccgtacgcggcgtcccggggcgtacgcctggccgtcgaaccgctgcacccgatgtacgcgtcggaccgctgcgtggtctccaccctggcccaggccctggacatcgcggaacgcttcccggcggagcaggtgggcgtcacggtggacacgtaccacatctggtgggacgacacggctcccgcacagatcgcccgcgccggtgcgtccggccgtatccacaccttccaactcgccgactggacgacgccgttgcccgagggcgtcctcaacggccgcggccagatcggcgacggcgcgatcgacatgcgggagtggaagggctacgtggaggcggcgggctactcgggcccgatcgaggtcgaactgttcaacgacgcgctgtgggcacgcgacggccgcgaggtcctggcggagaccgcggcacggttcgcggagcacgtgggg

SEQ ID NO: 5300 - DNA, 387 bp, Streptomyces avermitilis
  CDS (1)..(387)
gtgaagaaggccggaatactgaaccgtcacctggccggcgcgctggccgaactggggcacgggcacggagtgctcgtgtgcgacgcggggatgccgatcccggtggggccgcgggtggtggacctggcgttccgggccggggtgccgtcgttcgcggaggtgctggacgggctgctggacgagctggtggtggaaggcgcgacggccgcgcgcgaggtccgggaggcgaaccccggggcgacggcgctcctccagacgcgcttccccgcgctggagctggtcccgcacgaggaactgaagtccctgtcggcgaacgcgcggctgatcgtacgcaccggggaggcacggccgtacgcgaacgtgctgctgcgctgcggagtgttcttc

SEQ ID NO: 5301 - DNA, 897 bp, Streptomyces avermitilis
  CDS (1)..(897)
atgtacgactacgaccttctggtcgtgggatcggccaacgccgacctggtgatcggggtcgagcggcggcccgcggcgggagagaccgtgctcggctccgatctggtcgtccacccgggcggcaagggcgcgaaccaggcggtcgccgccgcccgcctcggggcccgtacggccctgctggcgcgggtcggcgacgacgcgcacggccggctgctgctcgactcgcagcggcgggcgggcgtcgacaccgtgggcgtgctggtcggcggggcgcccaccggggtcgcgctgatcacggtggacccgtccggggacaacagcatcgtggtctcgccgggggcgaacggccggctggcgccgcgggacgtacgggccgcggacagcctcctccggtccgccgccgtggtctcggcgcagctggagatcccgctggagtcggtcgtggaggtcgtacggaatctggcgcccggcacccgtttcgtactgaacccgtcgccgccccggccgctgcccgaggaggtgctggcggcctgcgatccgctgatcgtgaacgagcacgaggcgcgggtcatcgcgggcggtgagctggacggttcccccgaggactgggcggcggcgctgctggcgctggggccgcgttcggtggtggtgacgctgggcgccgagggtgcgctggtggcttccgccgagggcaccgcccgggtgccgtccgtgcgggtggacgcggtggacacgacgggtgcgggcgacgcgttcacggcggcgctggcgtggcgtctggggctcggcgagtcgctcgtgcgggccgcggcgtacgcggcccgggtgggggcgtccgccgtcacccgctccggcgcccaggcgtcgttcccgacggcggaggaggtcgcggcgctg

SEQ ID NO: 5302 - DNA, 1944 bp, Streptomyces avermitilis
  CDS (1)..(1944)
gtggccactgacacgctcaagagcacaacgggcgcgagtggcgcctcggcggtccgccggctcctgctcgacaacggggcgctcaccgcgctcatcgtcctcgtcgtcgcgatgtcggcgctgtccggcgacttcctgacgacggacaacctgctcaacatcggcgtccaggcggccgtgaccgccatcctcgccttcggtgtgaccttcgtgatcgtctcggcgggcatcgacctgtcggtcggttcggtcgcggcgctctcggccaccgtccttgcctggacggcgacttcgcacggcctgccggtcgtggtcgccgtggccctcgcggtcgccaccggcgtagcgtgcggtctcgtcaacggcttcctgatctcgtacgggaaactaccgccgttcatcgcgacgctcgccatgctgtcggtgggccgcggtctgtcgctggtgatctcgcagggcagcccgatccccttccccgactcggtctcgcacctcggtgacacgctcggcggctggctgccggtgcccgtcctggtgatgatcgtgatgggtctgatcaccgccctgatcctcggccgtacgtacatcgggcgctccatgtacgcgatcggcggcaacgaggaggccgcgcgcctgtcgggcctgcgggtgaagaagcagaagctcgcgatctacgcgctgtcgggtctgttcgcggccgccgcgggcatcgtgctcgcctcccggctctcctccgcgcagccgcaggccgcacaggggtacgagctggacgcgatcgccgcggtcgtcatcggcggcgcctcgctcgcgggcggtacgggcaaggcgtccgggacgctgatcggcgcgctgatcctggcggtgctgcgcaacgggctgaatctgctgtccgtgtccgcgttctggcagcaggtcgtcatcggtgtcgtgatcgcgctggcggtgctcctcgacacgctgcgccgcaaggccggggcgactccggtggccggtgcctcgagtggcggcaagggcaagcaggcgatgacgtatgtgatcgcggccgtggtcgcggcggccgtcgtgggggcgatgtccttcctgcacaacggctcgtcggcttcgccgacgcagaagatgggcctgtccctctcgaccctcaacaaccccttcttcgtacagatcaagacgggtgcgcaggaggaggcgaagaagcagggcgccgacctgacggtcacggacgcgcagaacgacgcctcgcagcaggccaaccaggtgcagaacttcaccagctcgggcgtcggttcgatcatcgtcaacccggtggactcggacgcggcgggcccggcggtgcgctccgccaacaaggccgacattcccgtcgtgggcgtcgaccggggcgtcaacaaggcggacacggccgcgctggtcgcctccgacaacgtcgcgggcggcaggctgggcgccaaggcgctggccgagaagctgggcggcaagggcaggatcgtgatcctccagggtctggccggcacctccgccagccgtgagcgcggggcgggcttcgccgagggcctgaaggcctaccccggcatcaaggtcgtcgcccggcagcccgcggacttcgaccgcaccaaggggctcgacgtcatgacgaacctgctccaggcgcacccggacgtccagggcgtcttcgccgagaacgacgagatggcgctcggcgcgatcaaggcgctgggtgccaaggccggaaagtcggtctcggtcgtgggcttcgacggcacgccggatgggctgacggcggtcaagtcgggcacgctgtacgcgtccgtggcgcagcagccgaaggagctgggccggatcgcggtgcagaacgcgctgcgggcggccgagggcaagaaggtcgacaagacggtgaaggtgccggtgaaggtggtcacggcgaagaacgtggcggccttcggcggc

SEQ ID NO: 5303 - DNA, 1566 bp, Streptomyces avermitilis
  CDS (1)..(1566)
gtgagcaacgcggacgagttgctgcgcatcgaaggcatacgcaagacgttccccggcgtcgtcgcgctcgacggcgtggacttcgatctgcgccgcggcgaggtgcacgtactgctcggcgagaacggcgcgggcaagagcaccctcatcaagatgctgtcgggtgcctaccggcccgacggcgggcgcgtcctcgtcgagggcgaggaggtgcgtatccatggggcgcaggactccgaggcgctcggcatcgccaccatctaccaggagttcaatctcgttcccgatctgacggtcgccgagaacatcttcctggggcggcagccgcgccgcctcggtctgatcgaccggaagaagatggaggcggacgccgccgaactgctggcgcgggtcggcgtccaggtgtcgccacgcgcgcgggtgcgtgaactcggtatcgcacgccttcagatggtcgagatcgcgaaggcgctgagcctgaacgcccgtgtcctgatcatggacgagccgaccgccgtgctcacctccgaagaggtggagaagctgttcgccatcgtgcgccagctgcgcgaggacggcgtcgggatcgtcttcatcacgcaccatctcgaggagatcgccgccctcggggatcgcgtcaccgtcatccgggacgggaagagcgtcggacaggtgcccgcatccaccagcgaggacgaactcgtacgcctcatggtgggacgctcgatcgaacagcagtatccgcgcgaacggccggactccggggccgcgctgctcagcgtcgaggggctcacccgggacggcgtcttccacgacgtgagcttcgaggtgcgggccggtgaggtcgtcggcgtcgcggggctcgtcggggcgggccgtacggaggtcgtacgggccgtcttcggggccgatccctacgaccgggggtccgtgcaggtcgcgggcgcgcgggtgccgcggcacgacgtcagcgcggcgatgagcgccggcatcggcctcgtacccgaggaccgcaagggtcaggggctcgtcctcgacgcctccgtcgaggagaacctcgggctcgtgaccatgcgggcggccacccgtggcgggctcgtcgacctcaaggggcagcgggacgccgccgcccgggtcgccggacagctgggcgtgcggatggccgggctcggccaacatgtgcgcacgctctccggcggcaaccagcagaaggtcgtcatcggcaagtggctgctcgcggacaccaaggtgctgatcctcgacgagccgacgcgcggtatcgacgtcggcgccaaggtcgagatctaccagctgatcaacgagctgacggccgcgggcgccgccgtcctgatgatctccagcgatctgcccgaggtgctcggcatgagtgaccgggtgctggtgatggcccagggccggatcgcgggcgagctcggggccgacgaggcgacccaggactccgtgatggcactcgccgtcagtacgaaccaatacaagccagataagtcagataagccagacgcgagtgcaggcaagacagaccagaaggaggccccccgtggccac

SEQ ID NO: 5304 - DNA, 1062 bp, Streptomyces avermitilis
  CDS (1)..(1062)
atggcgagcatcaaggacgtcgccgccgcggcgggggtgtccgtcgccacggtgtcccgtgtgctgaacgaccacccgtcggtcagcgacgacgcccgcgcccgcgtactggccgccgtccaggagctcggctaccggcccaacgccgtggcccgctccctgcgcaccgaccagacgcgcaccctcggcctggtcatcagcgacgtactgaacccgtacttcaccgagctggcccgttccgtcgaggaggaggcccgcgcccacggctacagcgtgatcatcggcaacgccgacgagcggcccgagctacaggaccaccacgtccgtacgctcctcgaccgccgtatcgacgggctgctggtctcccccaccgacggcgggtcgccgctcatgctggacgccgcgcgggccggcaccccgatggtcttcgtggaccggtggatcccgggcgtggacgtaccggtcgtcaggtccgacgggcgggcggccgtacgcgatctcgtcgcccatctgcacgggctcgggcaccgcaggctcgccatcatcgcgggcccggcggcgaccacgaccggcagcgagcgcgtcgaggccttccgggaggccatggccgagtacgggctgcccctccccgacgcctacataggccagggcgacttccaggccgagagcgggcgccgcgccaccgagcggttcctcgatctggccgagccgcccgaggtcgtcttcgcggccgacaacctgatggcgctcggcgcgctggacgcgatccgcgcccgcggcctgcgggttcccgaggacatcgcgctcgccgcgttcgacgacatccggtggttcgtgcacaccgatccgccgatcaccgccgtcgcccagcccaccggcgagctggggcgggccgccgtgcgcgcgctcgtcgaccgcatcgagggacggcccccgcagtccgtgaccctccccgcccggctcgtcgtacgccgctcgtgcggcgagccggcctcccaagagcagacgtcccaagaaccgacctcccaagagccgtcccccgtaacgaacaggagccagtcg

SEQ ID NO: 5305 - DNA, 330 bp, Streptomyces avermitilis
  CDS (1)..(330)
atgaagttcgacatggggtcgcaggttctgtcgacgttgatcagtaactcgcgtgggtcgagtgatgatctggggacgttgattcgtcagttggtgcaggccgcgcagccgttggaggggaagttcaacggtgcgggccgggtggcgttcgattcgttcaaggggcggtcggacgagatcacggcgagcttgaactcggcgctctcggggattctgggcggtcagtcggggatggagtcggcgttcggttcgggtgatcaggagcagggcgagaacgcgcggacgcaggaagcggcggcgaacttcgacggggcgcgtttttcgggccgg

SEQ ID NO: 5306 - DNA, 315 bp, Streptomyces avermitilis; identical to SEQ ID NO: 4080
  CDS (1)..(315)

SEQ ID NO: 5307 - DNA, 396 bp, Streptomyces avermitilis
  CDS (1)..(396)
gtggtgccgggctgggatctgaagccgcagggtattcagggtgtgctgaagacgacgggtgagacggcgtcgcacatcgagacgcatgcgaagtcgtacggggagcatctgacgtcggcggcgacgaacgccggcaccatttccgccgagggcggcgggggcgggggcggggagaaggcggccgggggtctggtggcgcttgctctgtcccagtacgcggaacacgcggccaccgacctgaagttcattgccgcgcgggcgggcaagtcgttgcagggtgcggtggatgcgacgacggcgtatctgaacggggatcaggagatggccgcggaggcgcagcgcaaggcgttgtcggcgccggatcttgatccgatgaagccgggggtgcagacgtcg

SEQ ID NO: 5308 - DNA, 2700 bp, Streptomyces avermitilis
  CDS (1)..(2700)
gtgatcaagccggaggcgattccgcagtacacgggggatctggcgctgctggagagcgcgtacggcgatctgaagacggacgcgtcgcacatccgttccaccggtaaggacgtgcactcccagttccaggggcttgcggcgtactacacggcgccggaggcggagcagttgttcgcgtcgacgaagccggtggcggaccgggcggacgggttcgcggatgatctggagaaggtgtccggggcgctgtcgtcgtatggcaccgagatccgccccctcgtcgacaagctcaagcagctgaagatcgacgcgaccaatttcgtcagctcggtcaaggacgacgacgactgggagtacgacgaggacaagatcgacaagcacaacaagatccgggatgacgtgacggcgaccgtcgcggcgttctgggctgcggagcgcacctgtcacaacgcgatcaccaagctgttcggtggcacgcagatggtggccggtgacggttcggaccgcaaggaccagtacgggttcaacgcggacgacctgaagaacgcgaagcttccctggggtgacccgatggaggagaagcatcacgtctgggaggtcgggcactgggtcaagtcgttcgtgtgggacggcctgatcgtggacggcgtctggggcaccatcaagggcctgggcacgctggtcgggttcggcggctgggacgcgatgggccaggcctggaagggcctcgcacagctggcgaccggtctggcgatttcctcgattccgggtgcgagcgcgctgttctggactctgccggacgacaaactcccctcctggctgcgggattcgcgcaccgcgatgaaggagaccggcaaggcgctggtggcgtgggacgagtggggcaagaaccccgggcgtgctgccggtgcggtcacgttcaatgtgctgaccaccgtgttcacgggtggtgcgggtggtgcggcggccggtgccgggaaggcgggcgcggtcgcgaaggtgctgtccgtcgcgggcaaggcgggcaagttcatcgacccgatgacgtacatcaccaagggcgcgggcgcggggctgtcgaagatcggggacatcgcgaagggtctgaaggggatcggcaacatcgagatccccaagctccccgacaacgcgatcactctcccggagggcgcgctcaaactgcccgacgggtcggtgcatatcccggagggcgcggcgatcccagagggcgcggtcaagctcccggacggcaacttccagctgccgcacgacaccccggcgttccccgagggcacgacgaaactgccgaccgagccgggtgccccggcgcagtacctggacccgaagggcaacatcctcgaccaccagggcaacgtggtggacaacgtcgaccacgcgcccaccgacgtggtcgacaagccgaccggagggaacccggccgcgggttcggacgtcccgcacacgccctccccgatcaaggaaccggccctggtcggcgcgggttcgcacaccgcggacaacgccgctcacgtcggcgacaacgccggccagacggtccgcctcggcgacagcctggacaacaacctcggcgacgtaggccgcaccggagacaacgcgggcaccccgaccgtgcacgcgggcgacaacctccccggccaggcgggccacgacctcccgggcggcaatgtcggagacaacctcccgggtggccgcgcggccgacaacctccccgggggatcggcggaccatctcccgggtggtaccgcaggcgatcacctccccggcggccgagccgacgacctcggcaccggtccgtccgccagccacgagccgcccaccggcggtcacacggacggccacacaggtggagaaacgggcagccacggtgatggttcgagccctggcagccacgaaggccccactacgggcggcgacggacctggtggcgacggacctggcggtcctcacgatcctggcggtcctcacgatcccggcggtcctcacgatcccggcgccggtggtgccgacgacgcaggtggttgggagaaggcagaggactccggcccgttcgagcgcggcggtgaaaccgaacagcagatccgtgatcagctacgtgggtcgaacgtgaaaccggcggacctggaccgggtcctggcaaaccttgccgagaaccccgccggcaaggagatcgccgacaccatggcgtccggccggttcaacgggctcaagaattacgaccaggtgatctccagcctgagtcacgccgacaagatgtccggcggcatcgagcaactgcgtctcggcaatcgactgtacgagagcggagttcacgacatctcgttcgagctcaagggcggttcggagatcaagccgggtgtcagggcaggagaaggcacggatcttgacgtgatggccagggatgcagagggcaaggtccacggctatcagttcaaggaagtccagaacccgaagaggcttgtcaagaagatcttcgataacatgaagcagatggagtcgtcgggtgccgacttcaatacctttgtggtcgacacgaagggcacattggccgaccacctggcccttcggaccgagcagcgtctcacggacgtttacggaaagtccgggatccagtttgtcattcgcgtcgaggacggggtgctgaccatcccgcccggaggcaagttcatgccggagggaacactg

SEQ ID NO: 5309 - DNA, 1005 bp, Streptomyces avermitilis
  CDS (1)..(1005)
gtgatcgccaccactcctgtcgctcggtggacctgggggcgcgaacaccaggagcaggacaatgtggtcgcctgcctccacgaactgcttgctgcctatgaggtcctgaatgcgcacgaactcatgatcggcattccgaaagtctcggtggccgtgcatgaggcgggcaagccgaacagctatctgttccaggggacggtcgagctcgatgcgaccgcccctccgggagaggtcgcgcgtcagatggccgcacggatcgcggccgcagcgcatccgggagaggtcggctcggtatatgccgacgcgaagagcgacggcatcgtcatgcgcgcaggcgaggcgatccgtgaagaggggctgttccggctcggggcgtccgctctgctcgattacgtcagtgtcgagttggtgacgtacagcgacgtctggatgccgtatgacctcgaggggcgtgctcagccctctgtgttcgctgagaacggttctcggctgtccgcagccctgcgtgatctctcggaggcgctggacacggaaaccgatccggacgacccgacgtatttcgggaagccgtccgaaacaggcgtcgaaaactacttcgaggaagacggttcagcttcggacgtgtggtctcggttcgaaatcccgtatcggtaccaggagttcacacacgcgcccgggttcggacgtatcggctacaagcgtacggcgaccggagaagtgcagtacatgccggtgcatgctgagcagacactgcttggtcatatctgggccagcgacgtggagaatgccgcgagcttcgagcccgtggatgtcggggatgaggaagcgtacaaggcggggctgctctggctggaacggctgcgcgccgcgcacgaccgcggtcttgcgccgtcggccgctctggacgagttgtcccgtcttccggacgagaacggcacggggaaggtggacaccacgaccgagcagcgtcgtgcgagcctcgctgacctgcgggaacgaaccccc

SEQ ID NO: 5310 - DNA, 360 bp, Streptomyces avermitilis
  CDS (1)..(360)
atgaggcggatcgacatcgacggccctgaggtcgacatggatatgggccagcggctgctctaccgcggagaactgttcaccggggaggttgtcgagtaccaacggggtgcgctcgtcagtctcaacacctataaggacggtgtcgaagacgggccgacccgtgagtggtacatggacgggaccctacggtcggagggagtcatgcgtgacggggttcccgtgggagagcttcaaagttggcaccccaacggcaggctggcggcacggatgactatgagcgacaacgggttgcgtcagttggcgttgtttgaatgggacgaggacggaaacctgacgaaggaatggcatgccgagcgcaac

SEQ ID NO: 5311 - DNA, 690 bp, Streptomyces avermitilis
  CDS (1)..(690)
atggcatgccgagcgcaactgaccgccgatggtcgaggtgaactgaaacgtatgtccgccttgatgcgcgcacccgaggaatgcgcatcctggttctgggacctggaggactacgcgccgcccgggttgcgctcagcgctcgttacggctgctcacatgtcggctgtgctgctgaaacacgacctgatgaagccggcttccctggaatggtattgggtcgtacccgaattgggcggtgcgatcgcgaagacgcgtttgcggcttttgtggccgcttgacgacgagcaggtggcccagcgcgtcgaggcgttgcgccctgtcggatttccgcaggccgagttcagtggcttcctcgtcacgggacccgggatgtggctcgatgagcatggcgcgcagcgtcatgaaaaccgtctcgtggaattgacggtctcctcggagccgctcgggctgtcggccgatgtctccgtcttccacgacatctggggccccttcgactttcgtggcacaccgcatccggaagtgcaccagcagaacgctccgcggctcgcagtcgcgttgaaggagctggacgcgttggtgggggtggcggcggaacccggtgaacccacctacttcgggagggccgaaggccacggagtcggcactccggacgcggaggacggacgcggcccggacctgaccgatcagctc

SEQ ID NO: 5312 - DNA, 360 bp, Streptomyces avermitilis
  CDS (1)..(360)
atgcgtcgcatcgacatcgacgaccccgaggtcgacatggatccgggacagcggctgctgtaccgcggggagctgttcacgggcgaggtcgaagaacgcctcggcggtgctgtcgtcagccttgaaacctacgcggacggagtgctgcacggtccgaaccaggagtggtacaaggacggcactcttcggtccgaagggatggcacgcgggggacgccctgtcggcatcacacgggattggcacccgaacggcacgctcgctgccgagagggagttcgccgaggacgggttgaccatgttgtcggaccgggagtgggacgagaccgggcagccgacgagagcgtggcgcaaggacggcgac

SEQ ID NO: 5313 - DNA, 2274 bp, Streptomyces avermitilis
  CDS (1)..(2274)
atggccagtggggcgagtcgggcggcacagccaggtaccggagagcggcacctggccgtgctcgaaggcgtactggagcggatcacgtacgccaacgaggagaacggatacacggtcgcgcgcgtggacaccggccgtggcgccggcgatctgctgaccgtcgtcggctcgctgctcggcgcccaggtgggggagtcgctgaggatggagggccgttggggttcccatccccagtacggcaagcagttcaccgtcgagaactacacgaccgtgctcccggccaccgtccagggcatccgccgctatctcggctccggcctcgtcaagggcatcggccccgtcttcgccgaccgcatcacccagcacttcggcctcgacaccctccagatcatcgaggaggagcccaagcggctgatcgaggttcccgggctcggacccaagcggacgaagaagatcaccgaggcctgggaggagcagaaggcgatcaaggaggtcatgctcttcctccagaccgtcgaggtgtcgacgtccatcgcggtccgcatctacaagaagtacggcgacgcctccatctccgtcgtcaagaaccagccctaccgcctcgccaccgacgtctggggcatcggcttcctcaccgccgacaagatcgcccagtccgtcggcatcccgcacgacagcccggagcgcgtcaaggccggtctccagtacgccctttcgcagtccaccgaccagggccactgctacctccccgaggagcagctgatcgccgacgcggtgaagctgctccaggtggacacggggctggtcatcgagtgcctcgcggagctggcggcgccgagcgaggaggacggcgagcccggcgtcgtacgggagcggctgcccggccccgacggaggggacccggtgacggccatctacctcgtccccttccaccgcgccgaactctccctctccgcccagctgttgcgcctcctgcgcaccgaccaggaccggatgcccggcttccacgacgtcgcctgggacaaggcgctcgactggctcaaggggcgtacgggggcggagctggcccccgagcaggaggaggccgtccggctcgcgctcacccagaaggtcgcggtcctgaccggaggccccggctgcggcaagtcgttcacggtccgttcgatcatcgagctggcccgcgccaagcgggccaaggtcgtgctcgccgcccccaccggccgcgccgccaaacgcctcgccgagctgaccggcgccgaggcctccaccgtgcaccggctcctggagctgaagcccggcggcgacgcggcgtacgacaaggaccgcccgctggacgccgacctggtggtcgtggacgaggcctccatgctcgacctcctcctcgccaacaagctggtcaaggcggtcccgccgggcgcccacctcctcttcgtcggcgatgtcgaccagctgcccagcgtcggcgcgggcgaagtgctccgggacctcctcgcggacggcggccccatccccgccgtccgcctcacccgcgtcttccgccaggcccagcagtccggagtcgtcaccaacgcgcaccgcatcaactccggccggcacccgctcaccgacgggatgaaggacttcttcctcttcgtcgaggacgacaccgaggaggccggccggctcacggtggacgtcgcggcccgtcgcattcccgccaagttcggcctcgatccgcggcgggacgtccaggtgctcgcccccatgcaccggggccccgccggcgcgggcacgctcaacggcctgctccagcaggcggtcacccccgcccgcccggacctgcccgagaagcggttcggcggccgcgtcttccgcgtcggcgacaaggtcacccagatccgcaacaattacgagaagggcgaaaacggtgtcttcaacggcaccgtgggcgttgtcacctccctcgacctggatgaacagcgcctgacggtgctgaccgacgaggacgaggaggtggcgtacgagttcgacgaactcgacgagctggcgcacgcctacgcggtgaccatccaccgctcgcagggcagcgagtacccggccgtggtgatcccggtcaccaccggcgcctggatgatgctccagcgcaatctgctctacacagcggtgacccgcgccaagaagctggtcgtcctcgtcggttcgcgcaaggcgataggccaggcggtgcgcacggtatcggccggacggcgttgcacggccctggacttcaggctttccccgcggcctctcgccccc

SEQ ID NO: 5314 - DNA, 1287 bp, Streptomyces avermitilis
  CDS (1)..(1287)
gtgagcgacaactctgtagtactgcggtacggcgatggcgagtacacctacccggtgatcgacagcaccgtcggcgacaagggcttcgacatcgggaagctccgcgctcagaccggtctggtgactctggacagtgggtacggcaacactgccgcctataaatccgcgatcacctatctcgacggtgagcagggcatcctccggtaccgcggctacccgatcgagcagctggccgagcgctccaccttcctggaggtggcgtacctgctgatcaacggcgagctgccgaccgtcgacgagctctccacgttcaagggcgagatcacgcagcacaccctgctgcacgaggacgtcaagaacttctaccgcggcttcccgcgtgacgcccacccgatggcgatgctgtcctcggtggtctccgcgctgtcgacgttctaccaggacagccacaacccgttcgacgagaagcagcgcaatctctccacgatccgccttctcgccaagcttccgacgatcgcggcgtacgcctacaagaagtcgatcggtcaccccttcgtctacccgcgcaacgacctcgggtacgtcgagaacttcctgcgcatgaccttctcggtcccggcgcaggactacgacctggacccggtcgtcgtctccgcgctcgacaagctgctgattctgcacgcggaccacgagcagaactgttcgacctccaccgtgcgtctggtcggctcgtcgcaggcgaacatgttcgcgtcgatctccgccggcatctccgccctctggggcccgctgcacggtggcgccaaccagtccgtcctggagatgctcgagggcatccagacgagcggtggcgacgtcgacaccttcatccgcaaggtgaagaacaaggaagacggcgtgaagctcatgggcttcgggcaccgcgtctacaagaacttcgacccccgcgcgaagatcatcaaggcggcggcgcacgacgtcctctcggcgctcggcaagtccgacgagctgctggacatcgcgctgaagctggaggagcacgcgctggccgacgactacttcgtcgagcgcaagctctacccgaacgtggacttctacaccggtctgatctaccgcgccatgggcttcccgaccgagatgttcacggtcctgttcgccctcggccgccttccgggctggatcgcccagtggcacgagatgatcaaggagccgggctcccgcatcggccgcccgcgccagatctacacgggcgaggtcctgcgcgacttcgtcccggtcgagggccgg

SEQ ID NO: 5315 - DNA, 2250 bp, Streptomyces avermitilis
  CDS (1)..(2250)
atgagcagcaccaccgcagaggcaccgataggcccggcctcgcaggtcgagctcaccatcggcgggatgacctgcgcctcctgcgcggcccgcgtcgagaagaagctcaaccggatggacggcgtcacagccacggtgaacttcgcgacggagaaggcgagggtctcctacccggcggaggtggaggtcgccgacctcatcgccaccgtggtgaagaccggctacacggcgacggagccgccaccaccgcggcccgaggcgcccgaggaaccccagccgtcccgggcatccgaggaagaccccgagctgacgtcgctgcgcgggcggctcaccgtctccgtcctgctcgccctgcccgtcgtcctgctctccatgatcccggccctccagttcgacaactggcagtggctgtcgctgaccctcgccgcgcccgtcgtcgtctggggcgcgctgcccttccaccaggccgcgttcaccaacgcccggcacggcgcggccaccatggacacgctcgtctcggtgggcacgctcgccgccttcggctggtccgtgtgggcgctgttctgggggcacgccgggatgccgggcatgcgccacggcttcgacttcaccgtctcccgcgggaacggcgcgtccacgatctacctggaggtcgccgccggtgtcgtcgcgttcatcctcctcggccgctatctggaggcccgctccaagcgacgcgcgggtgcggccctgcacgccctcatggagctgggcgcgaaggacgtcgccgtcgtacggaacggtcgtgaggtacgcgttccggtgacccggctgaccgtcggcgaccgcttcgtcgtacggcccggcgagaagatcgccaccgacggcaccgtcgtcgagggcgactcggcggtcgacgcgtccatgctgaccggcgagtcggtaccggtggacgtgaccgtgggggacaccgtcacgggcgcgaccgtgaacgccggcgggcgcctcgtcgtcgaggccacgcgagtcggcgcggacacccaactcgctcggatggcacagctcgtcgaggccgcgcagaacggcaaggccgaggtgcagcgcctcgccgaccgcatctccggcgtgttcgtgcccgtcgtcctgctgatcgcgctcggcacgttcggggtctggctcgcggtcaccgatgacacggtcgccgcgttcaccgcggccgtcgcggtgctgatcatcgcctgcccgtgcgccctgggcctggccaccccgaccgcgctgatggtcggcacgggccgcggcgcccagctcggcatcctcatcaagggccccgaagtcctggagtccacacgccgcgtcgacaccgtcgtcctggacaagaccggaacggtgacgaccggccgtatgaccctccaggaggtgtacgtcgccgagggcgccgccgagaaggaggtcctgcggctcgcaggagccctggaacacgcctccgagcacccgatcgcccgggcgatcaccgcgggcgctcaggagcgcgcaggggcccttcccgcgccggagcgcttcgagaacgtccccgggctcggcgtacgcgggcgcgtggaaggtcatgaggtcctggtgggccggcttcccgaggtggccctcccggagggcctggcacgcgccaaggcgacggccgaggccgaggggcgtacggccgtcgtggtgtcccgggacggcgtggcgctcggcgtcctgaccgtcgccgacgcgatcaaggagaccagcgccgaggcggtacgcgaactgcgcgccctggggctcacgccggtgctgctgaccggtgacaaccgggcggtcgccgagtcggtcgcccgtgcggtcggcatcgacgaggtgatcgccgaggtgctgccgcaggacaaggtggccgtcgtcgaacggctgcgcggacagggccgtacggtcgcgatggtcggcgacggggtcaacgacgcggccgcgctcgccaccgccgatctggggctcgcgatgggcacagggacggatgcggcgatcgaggcgagcgacctgacgctcgtgcgcggggatctacgggtggcggcggacgcgatccggctgtcgcgcaggacgctctccacgatcaaggggaacctggtgtgggccttcggctacaacgtggccgcgctgccgctggccgcggccgggctgctcaacccgatgatcgcgggggcggccatggccttctcctcggtgttcgtggtgacgaacagccttcggctcaggacattctca

SEQ ID NO: 5316 - DNA, 237 bp, Streptomyces avermitilis
  CDS (1)..(237)
atgaccgccgagaccgaaaccccgggttccaccacgaccgtctaccaggtgagcgggatgagctgcggacactgcgaaggttcggtgtccagcgagatcgccgagatcgccggcgtcagctcggtgaaggccgtcgcgtccaccggcgaggtcaccgtggtctccgccgcgcccctcgacgacgaggccgtgcgcgccgcggtcgacgaggcgggtttcgaactcgccggcagggcc

SEQ ID NO: 5317 - DNA, 696 bp, Streptomyces avermitilis
  CDS (1)..(696)
gtgcccgagagtcagcagagcgaggagcagcggccgaacacctccgacgaacaggacacttccgaggagcagcggccgggcgacaaggacagaccgcgccgccgccaggcccgcggcgagcgccgtatcgtccagctcctggaagccgcggcctcggtcttctgccgggccggctacaccggcgcgagcacgaacgcgatcgcccgcgaggccggcgtctcgccgggcacgctgtaccagttcttcccgaacaaggaagcgatcgccgtcggcctcagcgaccggctgctccacgactggcgggagtcgcacgggcaggcgctcgccgcggagaacatcgggctcccgctggacgagatgctcgacgcggtcctcgacccgctgatcgccttcaacgtcgagaaccccgccttcggcgtcctgatgcacggccctgacaccccctgccggatcaccgaggagaagggcgtcctggggggcgcgatcctcacccgcgtcgaggagatcatcgcgggctatctgccggacgccccgccggacgagcgcacccgcacggcgacgatgacggtcacccttttcaaggcgggcctcgacctggtcatgtcccatgagggcgccgagcgggacgcgtacatcgccgagctgaagacggtcatgtaccgctacttgaagcccctggtcgaggacaccgcgggc

SEQ ID NO: 5318 - DNA, 2316 bp, Streptomyces avermitilis
  CDS (1)..(2316)
atgtccgaagtcaacagcgcagatgacggagagcgacccgaccggggcggtgggccggggagggatccgggcggtggcgtgcggctgggtggctggacccggttcgtgaccgcgcggccacggctctcgctgctcgtcgcgctgctgctcaccgccctcgcggtggtcgccggcggcggggtcgccgaccggttgggcagcgggggctgggaggacccggccgcgcagtccacctacgcgaccaaggtgctggagcgggagttccccggctcacagcccaacctgctgctcctcgtcgactcggggcgccggtccgtcgacgctccttcggtcgccgcggaggcgaagcggctggccgcgcggctcgccgccgagccgggcgtcacgggcgtcggctcgtactggcagtcgggcgcacccaccctgcgcgccgaggacggccacgaggcgctcgtcgcggctcgcatcacaggcgacgagaagacggcgagcgagaccctggaccgcttggcgcccacctatcggggcgcgcacgggccggtgaaggtcaaggtcggcggcccggtggccgtccggcacgagatgcagacaaccatccgggaggatctgacccgggccgagctgatcgccctcccggtgaccttggtcctcctggtgatggtcttcggcagcgcggtcgccgccctgctgccgctcggcgtcggcatcgtcgccatcctggggaccaacgcggtgctgcgcggcatcacggagttcacggacgtgtccgtcttcgcgatgaacctcaccacggccctggggctcggcctcgccatcgactacgccctgttcatcgtgcgcaggttccgcgaggagctggcgacgggcgcggagccgccggcagccatcgccgccaccctgcgcacggccgggcgcacggtcctcttctcggccctcacggtcgccgtctcgctggccgccatgctcctgttcccgcagtacttcctgcgctccttcgcctacgcgggcatcgcggtggtgctgctggcggccggtgcggcgctgatcctcctgccggccgccctcgtcctgctgggacaccgggtgaactcgctggacctgcggcgggtgttccgacgtgggaagtcacgagagacgaccggggcgggagccgccggggagcggacggccgccggggagcggacggccgacggaggagccgcctggggccggatggcgtcgctcgtcatgcgccgggcacccctcttcgccgtggccaccacggtcggcctcgtcgtcctcggacttcccttcctgggcgtgaagttcggcacggcggacgaccgccagctgccctcgagcgccgaggcccatgtggtgcagcagcacatccgggagggcttcccgggcagccccggcggcggtctggaggtgctcgccgagggacgggcgaccgagacgcagtacaccgcctacaaggagcggatcgccgcactgcccgaggtgcgccgcgtggacggtcccctggtgaagggcgacacggcgtacttcgcggtgcagccgaagggcgaggccgtcgacgagggcgcccaacgcctggtgggcgaactccgcgcgacggacgccccgttcgacacctcggtgacgggcacggccgcggtcctggtggactcgaaacacgcgatagccgaccagctgccctgggcagcgggcttcatcgccgtggtcaccctgttcctggtcttcctgctgacgggcagcgtgctgatccccgtccaggcggtgctgctcaacgcactgagcctgacggccatgttcggcgcggtggtctgggtcttccaggacggccatctctccggcctgctcggcttcaccagctccggctcgatcgagacgacccttccggtcctgatgttctgtgtggccttcggcctctccatggactacggagtcttcctgctctcccggataaaggaggagtacgaccgcacgggcgaccaccgcgacgcggtccgcttcggcctccagcgcaccgggggcctgatcaccgcggcggcggtcatcctggccgtggtgatggtggcgataggcacctcgcgagtgaccaacaccaagatgctcggcctgggcatcgcgctggcggtcctgatggacgcgatggtcgtacgcagcctgctggtaccggcggtcatgcggctgacgggccgggccacctggtgggccccggcgccactgcggcgcttccacgagcggttcggactgagcgagggggagcctccggcggcgcccgaggagaaggaggccgaccaggagcgggacaaggtcgcggcacccggc

SEQ ID NO: 5319 - DNA, 1041 bp, Streptomyces avermitilis
  CDS (1)..(1041)
atgcgtgcggtggtgttcgagcggttcggggagccggccgaggtgcgggaggtggcggatccggagccctcggagcacggggtcgtggtgcgggtcgaggcgaccgggttgtgccggagcgactggcacgggtgggtggggcacgacccggacatcacgctgccgcatgtgccggggcacgaactcgcgggcgtggtcgaggcggtgggcacccgggtgagcgggtggcggcccggcgaccgggtcaccgtaccgttcgtctgcgcctgcggaagctgcgccgcgtgcgcggcgggcgatcagcaggtgtgcgagcggcaggcccagccgggattcacgcactggggctccttcgcgcagtacgtggcgctggagcacgcggacgtgaacctggtcgcgatgccggacgagctgtcgttcgggacggcggcggcgctgggctgccggttcgccacggcgttccgggcggtggtggcgcagggcagggtggcggcgggggagtgggtcgccgtgcacggctgcggcggcgtcggactgtcggcggtgatgatcgcggcggcctccggcgcccgcgtcgtcgccgtcgacgtctcgccccaagccctcgacctggcacggaagttcggcgcggccgcgagtgtggacgcctcgcgcgtcgaggacacggcggcggcggtccgtgagctgaccggcggcggcgcccatctctccctcgacgcgctcggctcacccgtcacctgcgtggcttcggtgaacgggctgcgccgccgcggccggcacgtccaggtgggcctgctgccctcgtccaccggctccaccccggtccccatggcccgggtgatcggcctcgaactcgaggtcctcggcagccacggcatggcggcgcacgcctacccgccgatgctggagctggtgcgcgcgggggtgctgcgccccgacctcctggtcacctcggcgatcccgctggacacggccccgatagcgctggcggccatggggacggccccgggggcgggggtgacggtcatcgaaccgtggcgc

SEQ ID NO: 5320 - DNA, 276 bp, Streptomyces avermitilis
  CDS (1)..(276)
gtgatcgccagcgcagcgtccggctcccccgacggccgtcccggccgacgccgcggcgcgcgcggggaggtgccactgatgaccgaccgtcgcctttggtcgtacaaggagatcgctgcgcacatccgggtccagccggacaccgtgaggtcgtatcgcaagcacggtctgctgccaccgcccgaccatgtggagggcgggaaaccctactggtacgccgacaccgtccgggcctgggtcgcctcccggccgggcaaccgcggccgcagagacctc

SEQ ID NO: 5321 - DNA, 906 bp, Streptomyces avermitilis
  CDS (1)..(906)
ttgtcaccacagtcctcactctcccgcatccgcgtcgggtcggctcccgactcctggggcgtctggttccccgacgacccccggcaggtgccctggcagcgcttcctcgacgaggtcgcccgctccgggtacgagtggatcgaactgggcccgtacggctatctgcccaccgaccccgcggtgctcaccgaggagaccgcgcggcgcgggctcaaggtctccgccggcacggtgttcaccgggctgcaccgggggccggacgtgtgggagtccacttgggcgcatgtgtcggacatcgcggcactcacccaggcgatgggcgcgtcgcacctcgtcgtgatcccgtccttctggcgcgacgacaagacgggcgaggtactggagccgagcacgctgaccgctgagcagtggcggcacctcacgacggggaccgagcgcctcggccgtgaggtgcgcgagcgctacgggctggaaatcgtcgtccacccgcacgccgacacgcacatcgacagcgaggagaacgtcacccggttcctcgacgggaccgactcgtccgcggtgtcgctgtgcctggacaccgggcactacgcgtactgcggcggcgacagcgtcaagctcatcgagacctacggggagcggatcggctacctgcacctgaagcaggtggacccggagatcctcgccgacgtccgggccggcgaggttcccttcggtccggccgtggcccgtggcgtgatgtgcgagccgccgtccggcgtaccggcactggagccggtgctggcggccgcgcagaagctggacgtcgacctcttcgcgatcgtcgagcaggacatgtacccgtgcgagccggacaagccactgccgatcgcccagcgaacccgggcgttcttgcggtcctgcggggcg

SEQ ID NO: 5322 - DNA, 948 bp, Streptomyces avermitilis
  CDS (1)..(948)
atggcgtacgacctgatcaccatgggacggatcggagtggacctctatccgttgcagacgggcgtgcccctcccacaggtgacgtccttcgggaagttcctcggcggctcggcgacgaacgtcgcggtggccgcggcgcggctcggccgcagcaccgcggttgtcacacggacgggtgatgacccgttcggcacgtacatccacgaggcgctgcgcggcttcggtgtcgacgaccgctgggtcacgcaggtcgccgggctgccgacaccggtcacgttctgcgagatcttcccgccggacgacttcccgctctacttctaccggcagcccaaagcgccggacctggagatcgacgcgcacgagctggacctggacgagatccgcgccgcgcgcatcttctggatgacgggcaccggcctgagcgaggagcccagccgcacggccaccctcgcggccctcgcccaccgcgccaagtccggtacgacggtcttcgacctcgactggcgccccatgttctgggccgaccccgcacaggcccgccccttctacaccgaggccctgcgccacaccacggtcgccgtcggcaacgtcgacgaggtggagatcgccacgggagagcgggacccgcactcggccgctcgcgcgctgctggccgcgggtgtcgaactcgccgtcgtcaagcagggccccaagggcgtcctcgccgtccatcgcgacggtacgacggccgaggtcccgcccctgcccgtcaaggtcctcaacggcctcggcgcaggtgacgccttcggcggctcgctctgccacgggctcctcgacggctgggacctggagcggctcatgcggtacgcgaacgcggcgggcgccatcgtcgcctcccgcctggagtgttcctccgcgatgcccaccccggccgaggtcgaggacgcgctcacggcgggagcggtcctg

SEQ ID NO: 5323 - DNA, 1032 bp, Streptomyces avermitilis
  CDS (1)..(1032)
gtgagggcggggcaggtcggcgggggccggcacggagacgaacaaggcgcaggagacggcggcgcgccggcgcgaggcagcgacggccccgcacgcgcacgaagcggagacggccccacgcacgcgcgcgtgggcgacggcactccgcacgcgcgcgtggacgtcgcccacctcgtccgcacccgcacccaccaccccgaggcgatcgccgaggccgccgcgcgccgcccccgccgcgccctcctcggcaacgacaccggccggctgatgatcgtcgccgccgaccaccccgcccgcggtgcccttgccgtcggcgaccgcaccctggcgatggccaaccgtgccgacctcctggagcggctctgcctcgcgctgtcccgccccggcgtggacggcgtgctcgccaccgccgacatcctggacgacctgctgctcctcggcgccctcgaccgcaaggtcgtcatcggctcgatgaaccgcggtggactggcgggcgcctccttcgaactggacgaccgtttcaccggccaccgcccgcaggacatcgagcgcctcggcttcgacgcgggcaagctgctcctgaggatcgactacgacgacccgggatccctcaacaccctcgaatccaccgcccgggccatcgacgacatggccgcgcgcagactccccgtcttcgtcgagccgttcctgtcccgacgcggggcggacggcaagctccgcaacgatctgagcgccgaggccgtgatcaagtccatcgccatcgccgccggcctcggcggcagttcggcgtacacctggctgaaggtccccgtcaccgagaacccggacgacatggcccgggtcatggagacctcgacgctgcccgccgtcctgctcggcggcgacgtcggcgaggaccaggagggcgcgtacgagaagtggcgcggcgcgctgcaacttcccaccgttcaggggctggtggtcggccggtcgctgctgtacccggcggacggcgatgtggccgccgccgtggacaccgccgtaggactgctg

SEQ ID NO: 5324 - DNA, 819 bp, Streptomyces avermitilis
  CDS (1)..(819)
atgaccaccaacctgtacgtcccccagggcgccacctcgggcccccagtacgtcctcgacatcgaccccgagcgggccggctggacgtacagcagcctgcggatcgtggagctcgcgccgggcggcacccacaccttcaccaccggtgacagtgagtggatcgtgcttcccctgggcggcgcctgtaccgtggaaatcgagggcaaagagttccaactcctgggcagggaaagcgtgttcgcgggggtcaccgacttcgcgtacgtgccccgtgacgcccgggcacagatcgcctccggcgcgggaggccgcttcgccctggcaggagcgaagtgcgagcgccgactccccgcccgctacggccccgcgccggaggttcccgtcgaagaccgaggcagcggcaactgcgcccgccaggtgcgcaatttcgcctccgccgacgccttcgactgcgacaagctcatcgccgtcgaggtcatcacccccggcggcaactggtcctcgtacccgccgcacaagcacgacgagaaccggcccggagccgaaacggaactcgaggagatctactacttcgagatcgacggcccgaacggtttcgggtaccagcgcgtattcccctcacgcgtgggcggatccgacgtcctcgcggaggtccgcaccggcgacgccgtcctcgtccccgacggctggcacggcccgtcggtcgcccagccgggccacgccatgtactacctgaacgtcatggcggggccgggtcaggagcggcagtggcggatctgcttccacccggaccacgtagagagcacaggggggtaccga

SEQ ID NO: 5325 - DNA, 1881 bp, Streptomyces avermitilis
  CDS (1)..(1881)
atgacctcgacgacgaggctgacggtcgcacaggcgctggtgcgctttctcgccgcccagtacaccgagcgcgacggcatacggcagcggctgatcggcgcgacgtggggcatcttcggccacggcaacgtcgccgggatcggtcaggcgctcgtcgagtacgccgacgacatgccgtaccaccagggccgcaacgagcaggccatggtgcacgcggcggtcggctacgcccggcagtcgaaccggctgtccacccacgcggtcacgacctccatcggcccgggtgcgacgaacctcgtcaccggcgccgccctcgcgaccgtcaaccacctcccggtcctgctcctgcccggcgacaccttcgcgacgcgcccggcggacccggtcctccagcagctcgaagtcccgtacgcgggcgatgtgtcggtcaacgactgtctgcgtccggtgtcgaggtacttcgaccgcgtcacccgccccgaggcgctgatcccggccgcgctccaggcgatgcgggtgctcaccgacccggtcgagacgggcgcggtcacgctcgcgctgccgcaggacgtgcaggcggaggcgtacgactggccggaggagttcttcgccgagcggacctggaccgtgcgccgtccgggcgccgacccgaccgaactcgcggaggccgtgcgggcgatccgggtggcccggcgccccctcctggtggccggcggcggcgtccaccacagccgggccgaggaggcgctcgcggagttcgccgaggccacccgcattccggtcgcctcgacgcaggccggcaagggttcactgcgctgggatcacccgcaggacgtcggcggcgtcggccacaccggcaccgcgaccgccgatgagctggcccgcacggcggacctggtgatcggcgtgggcacccggtacaccgacttcaccaccgcctcgcacaccctcttcaccggcgacggcgtccgcttcctcaacctgaacatcgcgcccttcgacggccacaagctctccggcctgccgctgatcgcggacgcccgcagcggcctccaggagctgaccgaggcgctgctgatgcacgagcaccgcgtcccgcccgcgtacgtgagcgagtacacggaggacaaggagcgctgggagtaccgggtcgacgcggcgttcgaggccgaggatccggacatccggcccacccagccgcaggtcctcggtgccctcgacgaactggtggacgagtccgacatcgtgctcaacgcggccggctcgctccccggtgacctgcacaaactgtggcggacgcgctcccgcgaccagtaccacctggagtacggctactcctgcatgggctacgagatcccggccgcgatcggcgtacggctggccgcccccgaccgcccggtgtgggcgctggtcggcgacggcacgtacctgatgatgccgacggagatcgtcacggccgtgcaggagggcatcgcgatcaaggtcctgctgatccagaaccacgggtacgcgtccatcggcggtctgtcggagtcggtgggcggcgagcggttcggcaccgcgtaccgctaccggtccgaggacggccagtacacgggggctccgctgcccgtcgacctcgccgccaacgcggccagcctgggcatgcgggtcctgcgcgcgaagacggtccgtgacctgcgggcagcgctcgcggaagcccgcgccgccgacactcccacatgtgtctacgtggagaccaaaacggcagacacagtgtcgggcgcgcctccggcacaggcctggtgggatgtacctgtggccgagaccgcgacccgttcgtcggcggtcaaggcacgtgagctgtacgaacggcacgtctcgacccgacgccgccatctg

SEQ ID NO: 5326 - DNA, 1500 bp, Streptomyces avermitilis
  CDS (1)..(1500)
atgacgaagatcgtcaaccactggatcggcggcaagaccgtcgaaggcgcgtcgggcacgtacgggccggtcaccgacccggcgaccggcgcggtcaccacgaaggtcgccttcgcgacggtcgacgaggtggacgccgcggtcgccgccgcgaaggacgcctacgcgacctggggccagtcctcgctggccaagcggagcacgatcctcttcaagttccgggcgctgctcgacgccaaccgggacgcgatcgccgagctgatcaccgcagagcacggcaaggtgcactccgacgcgctcggcgaggtcgcgcgcgggctggagatcgtcgacctggcgtgcggcatcaccgtgcagctgaagggcgagctgtcgaccgaggtcgccagccgggtggacgtctcgtcgatccggcagccgctgggtgtcgtcgcgggcatcacgccgttcaacttcccggccatggtgccgatgtggatgttcccgctcgccatcgcgtgcggcaacacgttcgtgctgaagccgtccgagaaggacccgtcggcggccctgaagctggccgagctgctggccgaggccggtctgccggacggcgtcttcaacgtcgtacacggggacaaggtcgcggtcgaccgcctcctggagcacccggacgtcaaggcggtgtccttcgtcggctcgacgccgatcgcccgctacatccacacgaccgcctccgcgaagggcaagcgtgtccaggcgctcggcggcgccaagaaccacatgctggtcctcccggacgcggacctggacgcggccgccgacgccgccgtctcggccgcgtacggctcggccggcgagcgctgcatggcgatctccgcggtcgtcgcggtgggcgccatcggggacgagctggtggagaagatccgcgagcgcgccgagaagatcaagatcggtccgggcaacgacccggcctccgagatgggtccgctgatcaccaaggcgcaccgcgacaaggtggcctcgtatgtggcgggcgcggcggcgcagggctccgaggtcgtcctcgacggcacgggccacacggtcgacggcttcgaggacggccactggatcggcctctcgctgctcgataaggtgccgacgtccgcggacgcgtaccgggacgagatcttcggcccggtgctgtgcgtgctgcgcgtggactcgtacgaggagggcctcgccctcatcaacgactcgccgttcggcaacggcaccgcgatcttcacccgggacggcggcgccgcccgccgcttccagctggaggtcgaggcgggcatggtcggtgtgaacgtgccgattccggtgccggtgggctaccactccttcgggggctggaaggactcgctcttcggcgaccaccacatctacggcaacgacggcacgcacttctacacccgcggcaaggtcgtcaccacccgctggccggacccgtccgaggccccggcgggcgtcgacctgggcttcccgcgcaaccac

SEQ ID NO: 5327 - DNA, 1407 bp, Streptomyces avermitilis
  CDS (1)..(1407)
atgaccgacacgctccgccccgcagagactcccgtactggacgccggccccctgacgtccgacggccctcagaagctcaagcgctccatcggcatcgtcggcggcaccctgctcacgctctcgtgcgtgacgcccgcctccacgctcttcgtggtcgtaccggacctcttcggttcactcggcaccgcgaccgccctcaccatcgcgatcggctcgctgctctgtatcgccgtggcgttctgctactccgagctgggcaccctcatccccagcgcgggcggcgagtacgccatggtctccacgatggccgggcggctcgcgggctggctggtcttcgtgctctccctgctcgttgtcatgatcgtgccgccggtgatcgccatgggaacggcggactacctggcgccgatcgtccacctggacccggccgtcgccggcgccggcgtgatgctcctcgccaccctcgccggcctgctggacctgcgcgccaacgcctggatcaccggagtcttcctggtcctcgaagtcattgcggcggccgtcgtggcggtgctgggcttcgcccacagcgagcgcggagccggcagtctggtctcgatgcaggtggccggctccgggggccacacggacaccgtgacgggcatgctggtcgtctcggggctcgcgatcgccctcttcgtcacccagggcttctcgaccgccgtctacctctccgaggaactggagaacccgcgccgcaacgtcgcccgtacggtcctcgctaccctcgccatctcgaccgtgatcatcctggtgccggtcgtcgcgatcaccatgggcgcctcggatctctccacgctcaccggcggcgacatcagctccatggtcaccgcctggtccaactccgccgtcggcaccttcgtcagcctctgcgtggccctcgcgatcatcaacgcgggcatcgtcatggtcatccagaactcccgcgtcctgttcgcctcggcccgcgacaaggcctggcccgagccggtcaaccacggcctcgccaagctcggccgcttcggctcgccctgggtcgcgaccctcgccgtcggcgtccccggcgcgctcctgtgcttcgtcaacctggacaccctgtacggcgtgaccggcgtctccgtcaccggcatgtacctgctcgtcgcggtcgccgccctgctcgcccggcgcggctcccacgcccacacgccggcctggcggatgcccctgtggcccgcgatgccggtcctgctcatcgtggtcctcgcctacatcctcagtcagcaggagaccggttacctcctgtggaccggcggcatcacggccgtggccaccttgtactgggccttctacctgcgcccgcgccgcgacacccgctggctggtgtcgatcccggaggacacacaggag

SEQ ID NO: 5328 - DNA, 2592 bp, Streptomyces avermitilis
  CDS (1)..(2592)
gtggccgcggtggccgccgtcgtcgtgctggccggtgccggtacgtggacggccgtcgcctcggacgaggcgccacccgtgcaccgcaccgacagagccatggcgatgggcgacggggtgaagatcaacacgtcgtacttcaccgcgggctccggccgccgccccgccgtcctcctcgcgcacggcttcggcggcagcaaggccgatgtgcgggaccaggcgcagaagctcgcccgcgacggatacgcggtgctgacctggtcggcgcgaggcttcggcggctccacgggcaagatcgggctgaacgaccccaaggccgaggtcgccgatgtgtcgaagctcatcgactggctggcccggcggcccgaggtccagctcgacaagagcggtgacccgcgcgtcggcgcagcaggcgactcgtacggcggcgcggtctcgctgctggccgcggggtacgacgaccgggtggacgccatcgccccggcgatcacgtactggaacatggcggacgctctgttcccgaacggcgtgttcaagaagctgtgggccggcctcttcatcaactccggcggcggctgcgacaagttcgaggcgcagctctgcgcgatgtacaaccgggtcgccgagtccgggaagccggacgcgcaggcgcgcgcactgctcgacgtccgctcgccgtccgccgtcggcaagcgcatcaaggtgcccaccctgctcgtgcagggccagtccgactccctcttctccctcggccaggcggacgccgcggccagggcgatccgcgccaacggcgcgcccgtggacgtcgactggatcgccgggggccacgacggcggcaacatggagacgaaccgtgtccaggcccgcgtcggggcatggttcgaccgctatctgaaggacgagaagggcgtcgacaccggcccggccttccgggtcacgcgcaccggcggcgtcaactcgaccgacggaacggcccagctgcggggcgcgagcggggagacgtaccccggccttcggagcgggcggcggacgatcgcgctgagcggccgcgagcagaacttcgccaacccggcgggggcgaacccgcccgcgctctccgccctccccggcctgggcggctccggaggcctctcccagctgtcgtccctcggcatcggagcgtcactcgacttccccgggcagttcgcgcggttcgactcggcacccgtcacccgcgacctgcggatcagcggatcgccgaccgcgacggtgcacgtgaagtcgaccagcgaggacaccgtcctgttcggaaaggtgtacgacgtcggcccgggcggcacccagaaggtgctgccgtcgcaactggtcaccccgatccgggtcgagggcgccaaggagggcaaggacgtcaccctgagcctgcccgccatcgaccacgaggtgcggagcgggcaccggctgcgcctcgtcctggcctccacggacctcggctacgcgtcaccgacggcaccggcgacgtacacggtgtccctgaagggcgacctgttggtgccgaccgcgcccggcgtgacgaccgcggccgcgccgctgcccgcctgggtgtggtggctgcccctggccggagtggtcgtggcgctggccctgctgctgtcgggccgtcgtcgtacggcgaccccggcacccgatcccgcactcgccgaagtccccttggagatcacggacctgagcaagcggtacgcgaagtccgcggaccggtatgcggtacgggacctgtcgttccgggtggagaagggccaggtgctgggcctgctcggaccgaacggcgcgggcaagaccaccaccctccgcatgctcatgggcctgatcaagccggacgccggcgagatccacgtcttcgggcacgcgatccggccgggcgcgccggtgctgtcccgggtgggctccttcgtcgagggtgcgggtttcctgccgcatctgtcgggccgcgagaacctggagctgtactggcaggcgaccggccgcccgtccgaggacgcccacctggacgaggcgttgcagatcgcgggcctgggcgacgcgctggcccgcgcggtgcgcacgtactcccagggcatgcgccagcgtctcgccatcgcccaggccatgctgggcctgccggacctgctcatcctcgacgaaccgaccaacggcctcgacccgccgcagatccgcgagatgcgcgaggtgatgatccggtacgcggcggccggccgcacggtgatcgtctccagccacctgctggcggaggtcgagcagtcctgcacgcatctggtggtcatggaccgcggccgcctcgtccaggcgggcccggtgcacgagatcgtcggttccggcgacaccctgctcgtgggcacgggcacgccggtggacgagcccgtcgtcgagaaggtgggcgcgctgcccggggtggcctcggcggtccgcacggacgagggacttctcgtccgcctcgacaccgacggcagcgccgggcggctggtcgtggagctcgtacggctcgaagtgcccgtggagtcggtgggaccgcaccgccggcttgaagacgccttcctcaccctgatcggaggtgccgca

SEQ ID NO: 5329 - DNA, 861 bp, Streptomyces avermitilis
  CDS (1)..(861)
atgagcacgctcgtcgagcggaccgagacggccgacggataccgcgcgcggcggacgctgccgctgcgggtcgagttcgtccggcagctgaagcggcgccgcactctcgtcatgggcgcgatcctcgccgtgctgccgttcgtgctggtcgccgccttcgcgatcggcggcgaacccggcgcacgcaacgggcgggtgacgctgatggacacggccaccgcgtccggcgggaacttcgccgcggtgaacctgttcgtgtccgcgggcttcctcctggtgatcccggtcgcgctgttctgcggtgacacgatcgcctccgaggcgagctggtcgtcgctgcgctatctgctggcggccccggtgccccgggcccggctcctgtggtccaagctcgtcgtcgcgctcgggatgagccttgcggcgatggtgctgctgccggtcgtggcgctggcggtgggcacggccgcgtacgggtggggcccgctggagattcccaccggcggcaccctgcccgcgggcacggcggcccagcgtctgctcgtcgtggtggcgtacatcttcgcgtcccaactggtcaccgcggggctggcgttctggctgtcgaccaagaccgacgccccgctgggcgcggtcggcggcgcggtcggcctgaccatcgtggggaacgtgctggacgcggtcaccgccctcggcgactggcgcgacttcctgcccgcgcactggcagttcgcctgggccgacgccgtacagccgcaactggagtggagcggcatgatccagggcacggcgatctccctgacgtacgccctggtgctgttcgcgctggccttccggggtttcgcccgcaaggacgtggtgtcg

SEQ ID NO: 5330 - DNA, 258 bp, Streptomyces avermitilis
  CDS (1)..(258)
gtgatgagcaagctcaagaaggtcgcggccgtagcggtcatggtcggtggcatggctctcggtggcggggtcgccaacgcagccggcggccacgggtacgacgacccggctgacgtcatcatcggcaacctgcagcctgtgaactgccaccaggacttcgagggtggcctcgcgttcgcgcccgttcagctcgcgtccaccgagggcaactcccagaacatcggcaacttctgcacggtggtcggtcccgtcgaggac

SEQ ID NO: 5331 - DNA, 258 bp, Streptomyces avermitilis
  CDS (1)..(258)
atgagcaagttcaagaaggtcgcggccgtagcggtcatggtgggcggcatggctctcggtggcggggtcgccaacgcagccggcggccacgggtacgacgacccggctgacatcatcatccccaatctgcagaccgtgaactgcaaccaggagttcgagggtggcctcgccttcgcgcccattcagggtgcggccctcgccggctccaacagccagaacatcggcaacttctgcacggtgatcgggcccaggaacgac

SEQ ID NO: 5332 - DNA, 336 bp, Streptomyces avermitilis
  CDS (1)..(336)
gtgctgcatgttatcgtctgtaactgtccgagcacggtccgtaagggatccgggcgcgcgaaggaaaacggagaagtgatgagcaagctcaagaaggtcgcggccgtagcggtcatggtcggtggcatggctctcggtggcggggtcgcccacgccggcgatggccccctgtacgacgacccgtccggcgtcatcatcggcaacctgcagcccgtgaactgcgaccaggagttcgcgggtggcgccctctttgcgcccgtccagggggcggctgccctcggtgacaaccaccagaacatcggcaacttctgcacggtggtcggtcccgtcgaggac

SEQ ID NO: 5333 - DNA, 279 bp, Streptomyces avermitilis
  CDS (1)..(279)
gtgcgcgaagaaatcggagaagtgatgagcaagttcaagaaggtcgcggccgtagcggtcatggtcggtggcatggctctcggtggcggggtcgcccacgcgtgtgatggccccctgtacgacgacccggccggcgtcagcattgacaacctgcagaccgtgaactgccaccaggagttcgagggtggcctggcgttcgcgcccgttcagctcgcgtccaccgatggcaacagccagaacatcggcaacttctgcacggtggtcggtcccgtcgaggac

SEQ ID NO: 5334 - DNA, 1719 bp, Streptomyces avermitilis
  CDS (1)..(1719)
gtgcgaccagtcgagccgcgatgcggggtgcagctcgcgagcaggactcgcgcagtcgctgctcccatcagatcgcggtgtgcaacggcctgttccttcggtccggggccggcttttcccacttattcgagcaggaagacgacgagattgcgcaagaacctgagcaagggaatggtcgtggccgccgccgcgacgagcatcctgtccctgtacgccatcccggcgttcgcggacccgcactccgaggggaccaccgggggatcgcacggcgccctgtcgggtgacgccgtccaggctccggacgttcccggagcttcccacggctccgaccgtagtgacgacgaccgcgagcacggcggctacggccacgacagtgattacggcgatgacgccgattacggcgacgccgccagcagtgttccgacggcggaggcgtcgtcgacggcgtcccacgacacctacggcagtggccacagcgagcacggcgactacagccacgacagtggttacagcgatgacgccgattacggcgacgccgccagcagtgttccgacggcggaggcgtcgtcgacggcgtcccacgacacctacggcagtggccacagcgagcacggcgactacagccacgacagtggttacagcgatgacgccgattacggcgacgccgccagcagtgttccgacggcggaggcgtcgtcgacggcgtcccacgacacctacggcagtggccacagcgagcacggcgaccacagccacgacagtggttacagcgatgacgccgactacggcgatgacgccgttcgcagcgacgccagcagcactggcggggctccgaaggcgaaggcgccgtcgaccgcggcccatgtctccggccgtggtgacgacgtccgtgaccatggcgttgcccgccaggacagtggttacggggatgacgccgttcgcagcgacgccagcggtaccggtggggttgcgaagtcgggcgggtcgtcggcgccgaagtcgggcggagcgtcggccgcgcctcgcgactccggccgtaagcacggcggcgtcggcgccgttcacggcgacgccagcagcaccggtggggctccgaaggtgaagacgccgtcggctgcggcccatgtctccggccgtagtgacgacgaccgtgaccatggcgttgcccgccaggacagtggttacggggatgacgccgttcacggccatgacgccgttcacggccatgacaacggcaatggcggggttccgaagacgcaggcgccgtcggcttcgtcccacgagtccggccgcaaggacgacgaccgtgagcagggcgatgccggccacgacagtggttacggcgatgacggcgttcacggcgacgacagtggcaatggcggcggcgacgtcggctacggcgacgacagtggcaatggcggcgacgccggttacggcgacgacggcggctatggcgacgacgccggctatggcgacgacgacgacagcgacaagccgcccacgaagcccacgaagcccgcgaagcccacgacgccgcccaccactccgccgacgaagccgcacacgtggacgccaccggccaccacgcccgtggcggagcggccttcccttcccgacaccggcagcggggagcagatgctcgcggcttcgggtgtcgccgcgctgctgctgacgggcggcgccatcctgtaccgacgaggccgagccgcgtcccgtcgt

SEQ ID NO: 5335 - DNA, 1218 bp, Streptomyces avermitilis
  CDS (1)..(1218)
gtgggcgcccgggaggaagcggccgccaagtcaccggtaccggtgccggtgccgacgacagcggcgacggcggcggcgacggcggtgccaacggcatcagcgtcggcatcactaccggcaccggcactggcaacagcaccggcaacagcaccggccaccgccgaaccgcccgccccgccccccgcattcggcgcctacctcgactacggcccccgaggcgtgacccggatggccaaactcagccggtggctggacggcgccgagctgcgcgtggggcacacctacctgccgggcgaccgctggagcaacatcgaaggcgccccccgcttcctcgacacctgggcgaactggcgtcgggagagggacgaccggatcctcgtcctcaacgtgcccatgctggagcgcaacgaggagagccactcctacaccgaggtacgcaccttgctgcgccagggagcggccggggagttcgacgagcactaccgccaactggcccagcggctggtcgacttgaaggtgccggacaccgtcctcgtgctcggctgggaaatgaacggcacgacgtacacccatcggtgcgggccggacccggaggcctggaagacgtactggaacagaatcgtcaccaccatgcgcgcggtgccgggccagaaattccggttcgacttcgcgccgagccgcgggcacgacgccgttccctggacggattgttatccgggcgacgacacggtcgacatcatcggcatggacacgtacgaccagccgcagggaatgtcattcgacgagcaggtgtcggagccgtacgggctacagaaacacgtcgacttcgcgaaggaacacggcaagcccatttcgtacccggaatggggactgttccgcaatggcgacaacgcggcgtacatgcggcgcatgctgacctggatggacgagcacaagccgctgtacaacacgctcaccgactactgcccgcacggcgtgtggcggtgcagacagaacccgaaggcggccgaggagtaccggtccgcgctctccggccgcaccgagcccgagccgacgtccccggtgccgacgccggcgcccaccccggggtcgacgtcccagcccaccccgttgcccctgcctctccaggcatgctcgccgctggacctgggcacctgggccgagtacctgctcggcggaaagctctgcgtccgcttcgactggtggtcgcgcatccgg

SEQ ID NO: 5336 - DNA, 1122 bp, Streptomyces avermitilis
  CDS (1)..(1122)
gtgagcggggcgccgcgggccgagggcggcactctgcgggccgaactgtgcaccgacgagcgggagttcgccgcgctgggcccggcctgggggcgcctgtaccgcaggtgcggtgcggcgaccccgttccagagccatgcctggctgcactcctggtggacgtcgtacggcaggcccggccggctgcggctggtactggtgcgcgacggcggcgaactgcgggcggtcgcgccgctgatgcgggttgggcgtccgctgccccggctcgtcccgctgggcgggacgatctccgactacggcgatgtgctgctcgacgacgagcacgccgaccaggcggcggccgcgctcgccgaggcactgtcgagggccgcccgcaccacactgatcgacttccgggaggtccggccgggcggcgcggtcgagcgcgtctacgagtgctggcgcggaccgcgccgccgggcgggcgactcgctctgcctcgaactgcccgccctaccgatggcggagctcgcggcccggctgcccgcggcgaaggcccagcgggcgcgggccaagctgcgcaaactgaccgcgctgggcgtggagcgccggaccacggacccggaccgggtggacgcggcgctgcggctcctcctcgcgctgcaccggttgcagtggcagggccgcagggtgacgccggagcacctccacgagcggttcgccgcgcatctggtgcgcgcggtcggcccgatggtgcgctccggcgacgccgtggtcaccgagttcctgctggaaggcgaggtgatggcggtcgacctgacgctgctgtcgccgcgtcttgcgggcggctatctgtacggcgcccatccgcggctgcgcgagcggaaggcggatgtcgccgcgatgctgctggacgcctgcgcgcggcacaccgccaccggtgggcacgacacgctcagcctgctgcgcggcgacgagccgtacaagtacaactggcgccccgagcccgtggtcaaccagcggttgctgctggcccggcggcgcaccgccccgctgctgtcggcgatcgtctgcggtgtcgccgcgcgcagccggggcaaggaactcgtgcgcgggtggtgggagcggggtggcggcgggacc

SEQ ID NO: 5337 - DNA, 672 bp, Streptomyces avermitilis
  CDS (1)..(672)
atgaacctcatgacctccatggccgattccgcgacacccccggcccggcggcatccggcgcaccggcgcctgcgagcgctgccgccgtggtccctgctcgcggccggcactctcgccggagccctcgccgggggcgcgtacggcgtcctcacgccgcccgcctactcggccaccgcctacgtgatcgccgtaccgaccgccacatcggatccgcaggcggcgctcggcctcgcccaggcgtacggccgggtcgccacgcagctcgcggtactcggcgacgcccaggtgtgggcgggcgtgccggtgaagacgctgagggagaatgtgcagtcggcgacctcgccggacgcgccgatggtcgccgtgacggccacctccgcacgcgccgatctcgccaccgacatggccaacgcggtctcccgctcgctgatccggcacgccaacgacaccaagaacgccacgcacgtcgaactcctccagttctcccgggccgtcaagcccgccaagccgtcctcggcgtccccggcgctgaccggtctggtgggcgcgagcgcgggcggcctgctgggcggcctcgcgctgctggtccgcccgcggcgcgccgccgacgacgacgcgcgtccggccgccgtgcccggcccggccaccgccgccgacgcacacggccagctg

SEQ ID NO: 5338 - DNA, 1173 bp, Streptomyces avermitilis
  CDS (1)..(1173)
atgcccgagttcaaggcactgcacatcatcaccggcctcggcgtcggcggcgcggaacagcaactccggctgctgctgcgccacctgcccgtcgactgcgacgtcgtgacgctcaccaaccccggcacggtcgccgacggcctgacggcggacggcgtccgtgtcgtccacctcggcatgaccggcaaccgcgacctgtccgcgctgccacgcctcgtgcgcctgatccggtccggcggctacgacctcgtccacacccacctctaccgggcctgcgtgtacggcaggacggccgcgcgcctggccggcgtccgggccgtggtggccaccgaacactccctcggcgaaacgcagctggagggccgcgccctgagcgccggcgtgcgcgcgctgtacctggccagcgagcggctgggccgcaccacggtcgcggtctcgggcccggtggccgaccggctcaggcgctggggcgtacccgagccgcgcatcgaggtggtgccgaacggcatcgacgtggcccgcttccgcttcgacccggtcacccgcgaacgcacccgccgccggctcgggctgccggagggcgcgtatgtcgtcggcggcatcggccggctgaccgcgggcaagcggttcgacgtcctgatcggcgcgctcgcccacctccccggtgactgctggctgctgctggtcggcggtggcccggaggagaacgtgctgcgccgcgccgcccagcgggcgggggtgaccgaccgggtgctgttcacgggcgagcggccgtacgagcccgacggcacccccgtttctgatctgccggcgctgacctcggcgatggacgtgctcgcctcgccgagcccggaggaggccttcggcctcgctctcgtggagggcctggcggcggggctgccggtgctgtacgcctcctgtccggccatcgaggacctgccgccgcgttccgccgaggcccgccgggtgcggggtggtgccgacgcgttcgcccacgcactggcgcagacgcgcgccctggccgaggcccggagttcgtgcccgccgagccgcacggtctccgtcgctgcccgccactactgcatcacccgcagcgccgcacagctcatggacgtgtacgcggccgccgtctcctgttcgtccccgtccccgtcacccctgggagtgaccgtc

SEQ ID NO: 5339 - DNA, 696 bp, Streptomyces avermitilis
  CDS (1)..(696)
atgtaccactccgtgggtgactgctcctacgacccgtaccgcgtcaccgtctcgccccgccgcctggaccggcagctgggctggctgcgtcgccggggtctgcgcggtgtcggcgtgcgcgagctgctcgccgcgcgcgcccgcggcgcggggcaggacctggtggggctcaccttcgacgacgggtacgccgacttcgtcgcgcacgccctgccgctgctgcgccgccacggctgcggtgccaccctgttcgtgctgccgggcaggctggacggggacaacgcctgggacccgctcggcccgcgcaagccgctgctgtcggcggcgggcatccggcaagccgccgccgagggcgtcgagatcggctcgcacggcctcacgcacgtggacctgatccgggccgacgacgcgttgctccgcgccgaggtgagcgacagcagagcactgctctccgaaatgaccggtgctctcgtcgacggcttctgctacccgtacgggagggtcgaccgccgcgccgtggacgccgtacgggaagcgggctacacgtacgcctgcgccaccggtcccggcgacctgaccggccctctcgccctgccccgcgtccacgtcggggagcacgacacggcctggcggctgcatctcaagcaccggctgcaccaactgcgccggctgcaccaccgccccgccgagagggtg

SEQ ID NO: 5340 - DNA, 1758 bp, Streptomyces avermitilis
  CDS (1)..(1758)
atgacggtcacccctccgcaggcgggggacgccacgattcccccggcgcgcctcggcgcggaccgcccggaccccggcagcgccagggccgtctcacagggcttcctcgccagggccgcgctcgtcaccgtcggcctctccctggccggtgccctgctgggcctcggccgggaccaggtgctggcgcgcctcttcggggccgggagcgagacggacgccttcctggtcgcctggaccgtaccggagttcgcggcgacgctgctgatcgaggacgggctggccttcgcgctcgtccccgcgttcagcgcggccgtggcccgccgccgtacccacggcgatacgggcgacccggtgcgcgccctggtccgcagcaccctgccccgcctgtcactggcgttcgccgtcgcgtcggcgctgttcgtcttcggggcgccgtacctggtcgaggcgctggcgccggggctccacaacccggggttcgcggtggactgcacccggctgaccggcacctgtgtcctgaccttcgggctcgccggatattgcagcgcggccctgcgcgggcaccgccggttcgtcgcgcccgcggccatctacgtcgcgtacaacaccgccatcatcacggcgatgttcgccctcggcgcgcgctggggcgtacgggcggccgcggtcggtgtcgcggtgggcggggccctcatggtcgtcacccaactgccctctctgctgaggcagttgcaccgcaggcagacggcgcccgcgacagacagggcggatccgacggacaagacggacgccgcggacacggcagtcacggcagacccggcagacccggcggacacgacagtcacggcagacccggcggacacggcagacgcggcagccccggcgaaggaccggcgcaccatgaacctcaccctcatcgtcaccgtcctgctcttcgccctgtgccgccagtcccaggtcctcgtcgagcggttcctggcctccacgctccccgccggcgccatctcgcatctgaactacgcccagaaggtcgcccagatgccgatggtgctctccctgatgctgtgcacggtcacttttccggtcgtggcgcaggcgctggccgagggcgacaccgagcgggcacgcgaccgcgtcgagtgcgacctccgggtggtgtcgtgcgtcgtactgctcggcacggcggccatcgtcgcgtgtgccccgcagctcgtccacctcctcttccagcggggcgcgttcaccgcgcgggacaccgcggccaccgccgccgtgatgcgggtgtacgcgctcgggctgctcggccaggcactggtgggcgcgctcgtccgctcgtacttctcggcggggcggcccacctggtaccccatggccgccatgaccgccggcatcgtcgccacgtcgtggctcggcgcgtgggcggtcggctcgttcggcgtgctggggatcgccgcggccaacgcggccggcatcaccctcaccgcactgatcctgctgtacggcatgggggcgcgcagcgtgccgatccgtacccggcgggtgctggccgagatgagcaagccgctgcgcgcggcggtggtcgcctgtgtcgtgggcgggttctgcgcgagccgtatcgactcccccgccctcgggctcgcggccggcggcacggccgtgaccgtcgtcttcctcctgctcgcccgggtcctgggcgtgcaggacctcgcacccgcactccgtaccgtcacccgaaggctgccgtatgcccgtatccgc

SEQ ID NO: 5341 - DNA, 1353 bp, Streptomyces avermitilis
  CDS (1)..(1353)
gtgagccacgcatgcgccccgcccgccgcgcgcgggctgacgcccgtcctgccggtggtggcggtggtcgccctgctcgcgctgcccgtcgcgccggggggcgagggcggggcgaccctcgccgacgccgcgtccggtgtcgtcgtgctgtgctgcgcggtacgtctgctgcggcatcggcggcgccccctgtcgcgtaccgccgccgtggtgctgggcctgcccgtggtcgggttcgcggtggcggcgacgggggccgcgacgccgggcgcggcggtcgccggcttcgggcgctatctgcagatcttcgtactcgtcccggccgccgtgctgctgctcgtccgcgaccggcgcgacctgcggctgctggtctggtcgatggtggggctcgcggtgtggcagggggccctgggggtgcaccagtacgcgaccgggaccggcgcctcgtacacgggccgggacatccgcgccgtcggcaccttcgggccgggcgacatcatggggatggcgaccgtcgtctccttcgggctggtgtgcgcggtggggctggcgctgggacccgcgtcggcacggcagagggtgtgggccggggtgtgcgcgctgctgctggtgatgccgctggcggtgtccttcagccggggcgcgtggatcgcgacggccctcgcctgcggggcgcaactggtactggcgggcctgcgccgggcggtcagggcgggcgcggtggtggccgccgtcgccgtgatcctcgtcggcgggttcggtgtcggctccacgctgctggagcagcggctcagcagcatcgggcaggtcgccgacgcacccgaccagtcggtcaccgaccggtacacgatgtgggcggcggccaccgacatgtggcgcgagcggccgctgacgggcatcggcctcaagggcttccccgaccaccgcgacgggcacgcctcgctggcactgtcgtcgggcagcgacaccgagggcgcgaacgcggcgtaccggaggcagccgctgctgtcaccgcacaacatgtatctgctggtgctcagcgagcaggggctcatcgggctgctgacgctggcggggagctggctcgcgctgctggtgctggggctgcggaggctggtccgcgcccgcggggcgaacgaccccggcctcgactgcgcgctcatcgcctgcggcctgctggtctggcagctgatcgacttcgtgtacgccgacatcggcggtccctcgaccgttctcagcgccgtctgcttcggactgacggcgtggtgggcactggcgagtcccggtccggctgtcgccgaggcggcgccggcgtaccccggtacggctgtcgccgaggaggccgccgcacga

SEQ ID NO: 5342 - DNA, 1473 bp, Streptomyces avermitilis
  CDS (1)..(1473)
gtgaccgccgaacgtacccttcctcccccaggcggccagccaccggtacacggattcccgcccgtctcggtcatccccccgcgcgatgccacggccggcttccggttccccgccgggcagcggaccgcggcgcggcgcccccatgggctgcccctgctcgccgcggacgcggccgccgcgctcaccgccgccctggcgctcccccaccccctgctgaccgttccccccctgctgctcgccgtcctctgtctgaacgcgcgggcggcgctgtaccgccccaccgccgtgcccgccgtcctggacgaactccccgccgtctgcgcccggatcgcggtgggctggtgcgcgctcgcggctctggtcgcggcgctctccccggcccacatcctgtccgccggcacgctgctgaccggctgcgtcctccaggcggcggcgagctgcgcgggccgcggcacgctgcactggcgccgccgccggacgctggtccgtcaccccgccgcggccctcgtcgtcggcccggccgccaccgcccggcgcgtggccgccgcctttctgcgccgccccggatgcggcctcaggccggtgggcatcctcgccgacgacgcggccggcggcgaggggctgccggagctcagcacgggcgaggaggcgcagcgggccgtcatccagaacggcgtgcgggccgtgctcatcgtgggcccggtcggcgaacacggcccactgctgcgggcgttggccgagtcgggctgcgcgctgtgggaggtcgacgcggacgtaccggcgtacgaccgggcggggagagccgcgtacgaaggggccgggcgcacgacccgcgaccgggccccgggcgagcggatcgccggcttccgctgccgccgcctggatgtccgccgacacctcggcagtcccgccaagcgcgccttcgacgtcctggtctccggggtcctgctccttctcgtcggcccggcgctgctggcctgcgcggtcgtactgcgggtcagcgacgggccgaaggtcgtcttccgccaggagcgtgtcggcaaggacggccgccccttcacgctgctgaagttccgtacccatcgcccggccgacgcgcacgaggccgcgacccgctggagcgtggcggacgagcggaacatgagccgcttctgccgcttcctgcgccgcacctcgctcgacgagcttctccagctgtggaacgtcctgcggggcgacatgagcctggtcgggccgcgccccgagcgcccgtacttcgtcgccaagttcagccagctccaccccggctacgccgcccgccaccgtatgcggaccggcgtcaccgggctcgcccagatccatgggctgcgcggcgacacgtccatcgaggaccgcgcccgcttcgacaacgcctacatcgacgactggtccctgtggcaggacatctgcgtcctgctgcgcacggccgccgcgctggtccgcgcgacggggagc

SEQ ID NO: 5343 - DNA, 1239 bp, Streptomyces avermitilis
  CDS (1)..(1239)
atgtaccagccagcaaccgccccttcgccgcgcgtcctccacgtcacccagccggtggacggcggcgtcgcccgcgtggtcaccgagctggtgcgtgcgcagcgtgcggccggtttcgacgtcacggtcgcgtgtcccggccacggcctcgcccaggcagtacgggaactcggcgcaggcgtacggcactggtccgccacgcgggcgccgggaccgtcgctccccggtgaggtgcgccggctcgctcgcctcgtcgaggaggtccggcccgacgtgctgcacgcccacagcgccaaggccggtctcgccgcccggctggcggtacgggggcggatcccgacggtgttccagccgcacgcctggtcgttcgaggcggtcggcggggtcacggcggcggtcgccacggcgtgggagcggtggggggcgcggtgggccgcccgcgtggtgtgcgtcagcgaggcggagcgcgcgcgaggcgtacgcgccggggtacgcgcccactggcgggtgatccccaacggcatcgacccggggcgcttccaccccgccgccgtcaccaccgtacgagccgccctcgcaccgctcgccggcctcgatccggccgctccgctggtggtctgcgtgggacggctgtgccggcagaaggggcaggacgtgctgctcgaggcgtggtcctcggtgcggcggcgggtgcccggggcccggctggcgctcgtcggggacgggccacaggagcggccactgcgtcacctcgcgcccgagggcgtgctgttcgccggggccgtcgccgatgccgtcccctggtaccaggccgccgacctggtggtgctgccgtcccgctgggagggcatggcgctggccccgctggaggcgatggcgtgcaggcgtcccgtggtggtcacggacgtggccggggcgcgcgagagtctgccgcccggccaccgggagcactgtctggtgcccgccggccggccgggcccgctggccgacgcgctcaccagggcgctgctcgatccgctgctgcgcgaatcgctcggccaccaggggcgccgccacgtactgaccgcgcacgacgtgcggcactcggccgaggcggtcgcggccctctaccgcgaactcctcggcaccgggcgcacttcggccgaccccgcggaacacgccgagtgcgccgaccccgcggaacacacccagtgcgccgacctcgcggaacacaccgagtgcagggagtccatccgctcg

SEQ ID NO: 5344 - DNA, 261 bp, Streptomyces avermitilis
  CDS (1)..(261)
atgaagtctctgaaggctgccgccgtcgttgccggttccatggttctggccggtgcggtcgcgcccgccgctgcccacgccgccacggaggtcccgcccgccagcctcaccggagcggtgaaccagctcaccaagggccccgtcaacctgtcgccgctgcacgcggacaacaagggttccgcgctcggcacggtcaagggggcggcggactccctcacccagcaggggaacgcccggctgatcggcggacttcccctgggc

SEQ ID NO: 5345 - DNA, 384 bp, Streptomyces avermitilis
  CDS (1)..(384)
gtgacgctggcgccggtcttggcggcgtcggggtcggccggcccggaggaggcgcggttcgacgagacgtatcgcgggcgccgtatcgtcggcgacaggtacgacgcccagcggtccggggacgcctactccggcgcgtggcacgtcaccgtggacgggcggccgctgcacttgatgcgccgggccgacggcagctggatgaccatggtcgaccactaccggtcgtatccgacagtgctcgccgccgcgcgcgcggccgtcgacgaactcggccccaccgcacggctgggcgtgccgcacggcggtggcggccacatggacgacagcggtacgccgggcgggcgcaagggagccgagagggatcatggcagtggtgtacacgcg

SEQ ID NO: 5346 - DNA, 861 bp, Streptomyces avermitilis
  CDS (1)..(861)
gtgtacacgcgtaaggacgtcagcacgctcacccggtccgagcggcgtcggctcgtcgccgcactgctcgaggtcaaacgccgcggcgagtacgacgagttcgtgcgcatgcacatcaagtactacgttgccgacggcgagaccggcctgcgcgccgcccacatggcaccctccttcctgccctggcaccgcatgtttctgctggacctggagcgggtgctgcgccgggtggacgagtcggtgaccatgccgtactgggactggacgcgcagccgcagccggacggccgcaccgtggaccgaggacctgctcggcggcaccgggcggcaatccgaccgccaggtcaccaccggccccttcgcctaccgtcacggtgggtggcccatcaaggaggggatcaccgacgccgagtacctcatgcgtgacctgggccgctcccgggacccgatcgcgctgccgacggccagggatctgcagggcgccctcgacgatcccgtctacgacacggccccgtggaactccacgtccgccaaaggattccgcaacaggctggaggggtggggtccggggcggggagccgcttcgtggcgcaaccacaaccgggtccaccgttgggtcggcggccacatggtgagcggcgcctccgtcaacgaccccgtcttctggatgcaccacgccttcgtcgacctcctctggtcccgctggcagcagaggcaccagggcgcccgctatctccccgagcagcagcccgcccggggcgacgcccagcgtggccgcatcgtcgcgcggcacgagaggatgccgccgtgggacgtgacaccggaccagctggaggatcacagcgggatctaccggtacgcg

SEQ ID NO: 5347 - DNA, 1644 bp, Streptomyces avermitilis
  CDS (1)..(1644)
atgcttcagaaagcctccaaaattgggcattcttcgcatgtggtgaccttggacgtacggcctcagctgctcgacgcactctccgccctgcgcgaccgtgtcgccgccgcaagctttccgctgcccctggcgggggctccacgcgcgcgtgccaaccgcgacgagcttctcgcgcagctcgacgactacttggtgccccggttgagggaccccgaagcgccgttgctggccgtcatcgggggatccaccggggccggcaagtcgaccctcgtcaactccctcgtcgggcgcagggtcagcgaggcgggcgtgctgcggccgaccacccgtacgccggtgctcgtatgccatccggaggaccatcactggttcagcgggatgcgcgtactgcccgacctcacgcgcgtgtgggtgccccatcaggaacccggggacgatctgcacgccctggtcgaacggggggagcggacgctgcgtatcgagaccgccgagacgctgccgcccgggctcgccctcctcgacgcgcccgacgtcgactccctcgtcgccgacaaccgtgtcctcgccgccgagctgatctgcgccgcggacatctggatcatggtcaccacggccgcccgctacgccgacgcggtgccgtggtatctgctgcgtaccgccaaggagaacaaggcgaccctggtcaccgttctcgaccgggtgccccatcaggtggtgtccgaggtctcgcggcagtacggggccctgctcgccaaggccgggctcggcgacgtcccccggttcaccgtgcccgagctgcccgagtccgcgtggggcggggggcttcttccggccaccgcggtggcgaccctgcggacctggctcatccagcaggtgcaggaccccgccgcccggcagcaggccatggcccgtacggcgtacggagtcctcgactcgctcaagtcgcgcatgcccgagctggccggcgcggcggccgcacagtacgccgccgcgctgcgcctcaccgcggccgtcgacggggcgtacgacagcgagtacgcgcgcgtgaaggggcgtttgcaggccggggccgtgctcgcgggtgacgcgctgaagcgatggcgcgcctatccgctggactgcaccgccggcgaactgctcgacgcgctcgtcgaaagcctcggctcgctcctgctgtgcgccgtcacggccgcggacgagcgcgtcgacgaggcctggcggcgcgagcccgcctcgggtgccccggagctgacggaccgtgatcccacgctggagagcgccgaacaccggatcgggatggccgcgcgacgctggcggcgcgtcctcgaggagtacgccgaggaagaggtccgcaacctcgacaagagcctcgcgccggacgccgaggtggtggccgccctcgtcgccacggcgctgctgggtggccggcgggcgcgggccgccggagaggggctcgccgagcggatcggcgcgcacggcgccctcagactgcgcgaccggggcggacggctgctctccgagtacgtcgacacgacactgcacatcgaacgcgagcgccgtctcgcccccctcgacgcgctcgacgtgcacgccgagccacaggccgaactcatcgccgcgctgtccgtactgcagaaggagagg

SEQ ID NO: 5348 - DNA, 1866 bp, Streptomyces avermitilis
  CDS (1)..(1866)
gtgaagcgcggtttcccgcccccgtcggccgccgacgccgacgcgtcgggccgtacggagtccacggaacccgcggattccacggagtccggcgagccctggggcgacgggctgatcgcccggcgcgtgtccgagacggccgacgggcaacaggaggtggccgccctcctggagaccaggagcaaggccgtccagccgcccgagcccctcgcgtacgacgggtcgttgaggtcgcggttggacgccctgcgcgagctggtggggctgtcgcggacccggctggacagccggacgctcgcagaggcaggccgggtactggacgaggcggtggcgcggcgccggctgtccggggagcacaccgtcgtcgccatcgcgggcgcgaccggcagcggcaagtcccagctcttcaacgtgctcgccggagtgaccatttcggaaaccggcgtacgcaggccgaccaccgcggcgcccatcgcgtgcagctggagcgacggcgcggccccgctcatcgaccggctcggcatccccggacggctgcgcaggcgccccctccagagccctgaaggagaggcacaactgcgcgggctcgtcctggtggacctgcccgaccacgattcggcggccgtgcagcaccgcgaacaggtcgaccggatcctggcgctcgtcgacgcggtcatctgggtcgtcgacccggagaagtacgcggacgccgtcctccatgagcgctatctgcggcccatggcgggacacgccgaggtcaccttcgtcgtcctcaaccaggtggaccggctgcccggcgaggccgcacaccaggttctcgacgacctcaggaggctgctcgacgaggacgggatcgctctgggggagtacggcgagccgggcgcgaccgtgctcgcgctgtccgccctcaccggggacggcgtcggcgaactgcgcgagtcgctcgggcagttcctggccgagcgcggggccgccgcgcgccgcatctccgccgatgtggaagcggccggtgcgcgcctgcggcccgtctatgcgaccggtcggcgtaccggcctcagcgaggaggcgcgcgacgacttcgccggccggctcgcggacgcggtgggtgcgaccgctgcgggcgaggccgccgagcgcgcgtggctgcgcaacgccaaccgagcgtgcggcacgccctggctgcggctgtggcggtggtaccaggaccggagcgaacccaccacgggtcgcctcagggtgggcgcgcccgcggacgaggaggcgaccgcccgacagcgcgtggagcaggccgtacgtacggtggcggaccgggccgcggtagggctgcccgcgccgtgggcacaggcggtgcgcgaggcggccgtacgggggtcgcaggggctgccggaggcgctggacgagcttgtggtgcgtacggggtcgccggcggggcggccgccgcggccgggctggtggccggtcgccgtgctcgctcaggcgtcgatgacgctcctccaggtcttcggcggcctgtggctgctggggcaggtgatcgggttcatgtcgccgaatctcggggtgccggtgctgttgatggtcgcgggcatcgtcgggggacccgttgtggagtggagttgcaggctggcggcgcgggggccggcccggcggtacggactcgaggccgagcgccggctgagggaggcggccggggggtgcggcagggcgcgggtgctggatccggtggcggcggagctgctgcggtatcgggaggtgcgggagcagtacgcgaaggtcatgggggccggggctggggctggggccggcgcggctggggtcggcgcgggagccggagccgggacgggagcgggggtgcaggctcgggtgggg

SEQ ID NO: 5349 - DNA, 474 bp, Streptomyces avermitilis
  CDS (1)..(474)
atgaacgagacgatcgtgtgcgtggtggggaacgtcgccacgcggccggtgtaccgggagctggcgtcgggcgcatcggcgcggttccggctggcggtgacgtcgcggtactgggaccgcgagaagagcgagtggaaggacgggcacaccaacttcttcacggtgtgggcgaatcgagccctggccaccaacgtgggggcgtctttgtccgtgggggatccggtcgtcgtgcagggcaggctgaaggtgcgcaccgaggcgcgcgaggggcagaactggacctcggcggacatcgacgcgctggcggtcggccacgatctctcgcgcggcacgtcggcatttcgccgtccctcggccaaggacggggaagcgggagtgagccccgccgcgcggccggagcccaactgggagacagagccaggaagtcagccctcggtggagcaccaaccccagccggagcccgctggagtgacg

SEQ ID NO: 5350 - DNA, 1413 bp, Streptomyces avermitilis
  CDS (1)..(1413)
gtgtcatttgcgttctctgcgttctcggcgctgtccgtgcgtggacggggggccgcccgcctcgccgccgcgacgctggtgtccggcctcgtcgccgcgggtgccctggtcaccgcgggcccggccgtcgccgactcgacaccgcagagcgggggcggcgcgaccgccaccatgggcggcctcaagacgtacggggacgcggtgatccacgacaacggcggggacgagcaggtctccgcgggcctgttcgagatggccgtcgacggtggcggcatgctgcagacgtactgcatcgacatccacaacccgacacagaaggacgccaggtaccaggagaccccctggagcggcacatcgctgagcggcaacgagaacgcgggcaggatccgctggatcctgcagaactcctatccgcaggtgaacaacctgacggcgttggcgcggcaggcgggcgcgagcggcctcaccgagcaggacgcggcggccggaacgcaggtggccatctggcgctactcggacggcgccgacgtggacgcggtcgacccccaggcggagaagctcgcggactacctggagaaggccgcgcggaatctggcggagcccgcggcttcactgaccctggacccgcccgcggtctcggggcatgcgggcgagcgcctcggccctgtcacggtgcacacgaacgcggacagcgtgacggtgacgccgccggtggacgccacggcgaacggggtgaagatcgtcggcaaggacggcaaggcgatcacctccgccgccgacggcaggccgatctacttcgacgtgcccaaggacgccgcggacggctcggtcgcgctgacggtgcaggcgtcgaccaccgtgccggtcggccgcgccttcgcctccgagtcccgcagccagacccagatactcgcgggctcgagcgagtcgacggtctccgcgaccgcgacggcgaactgggcggtcaagggtgcgatacccgcgctgtccgcggtgaggaactgcgccaagggcggggtcgacatcacggcggccgacgagggcgacgaggcgttcacgttcgaactgatggggagcgagtacaccatcgaggcgggcaagtcgcagacggtgacgatcccgctccaggaggaccaggcgtacgacttcaccatcaaggggccgggcggcttcgaggagcgcttcaagggaatcctcgactgcaagaccgagagcggcgcgggcggcgacgcgacccagacgctcagcgaacccagcccggccacggtgggcggcacgtccacggacacgaacctggccgagacgggcagctcgagcgcgacgccgttcatcgcgggcacggcgatagccctggtggtcatcggcggcgcggcactcgtcctcgtccgcaacaagaagacatcgacgcaggac

SEQ ID NO: 5351 - DNA, 1641 bp, Streptomyces avermitilis
  CDS (1)..(1641)
atgcgcaagacgcgcaaggcgcacggcgacaaggtgattctcgacgacgtcaccctgaacttcctgccgggtgcgaagatcggtgtggtcggtccgaacggtgccggtaagtccaccgttctcaagatcatggcgggccttgagcagccctccaacggtgacgcgttcctgtcgcccggctacacggtcggcatgctgctccaggagccgccgctcgacgagtccaagaccgttctggagaacgtccaggacggcgccgccgagatcatgggcaagctcaagcgcttcaacgaggtcgccgagctgatggcgaccgactactcggacgcgctcctggaggagatgggcaagctccaggaggacctggaccacgccaacgcgtgggacctggacgctcagctggagcaggccatggacgccctgggctgcccgcccggcgactggccggtcacgaacctctccggtggtgagcgccgccgtgtcgcgctgtgcaagctgctgatcgaggcccccgacctgctgctcctcgacgagcccaccaaccacctggacgccgagtccgtgcagtggctggagcagcacctcgcgaagtacgacggcaccgtcgtcgccgtcacccacgaccggtacttcctcgacaacgtcgcgggctggatcctggagctcgaccgtggccgcgccatcggctacgagggcaactactccgtctacctggagaagaagcagtcccgcctcaaggtcgagggccagaaggacgccaagcgcgccaagcggctcaaggaagagctcgagtgggtgcggtccaacgccaagggccggcaggccaagtccaaggcgcgtctgacccgctacgaggaaatggccgcagaggccgacaagatgcggaagctggacttcgaggagatccagatcccgccgggcccgcgcctgggctccatcgtggtcgaggtgaacaacctctccaaggccttcggggagaaggttctcatcgacgacctctccttcacgctgccgcgtaacggcatcgtcggtgtcatcggccccaacggtgccggcaagaccacgctcttcaagatgatccagggcctggagaccccggacaccggcacgatcaaggtcggcgaaaccgtcaagatctcgtacgtcgaccagagccgcgagaacatcgacccgaagaagtccctgtgggccgtggtctcggacgagctggactacatcaatgtgggccaggtcgagatgccctcgcgtgcgtacgtctccgccttcggcttcaagggcccggaccagcagaagccggccggtgtcctctccggtggtgagcgcaaccgcctcaacctggcgctgaccctcaagcagggcggcaacctgctgctcctcgacgagccgaccaacgacctcgacgtggagacgctgtcctcgctcgagaacgcgctgctcgagttcccgggcgccgcggtggtcgtctcccacgaccgttggttcctcgaccgggtcgccacgcacatcctcgcctacgagggtgactccaagtggttctggttcgagggcaacttcgagtcgtacgagaagaacaaggtcgagcggctcggcccggacgccgcgcgtccgcaccgcgccacctacaagaagctgactcggggc

SEQ ID NO: 5352 - DNA, 408 bp, Streptomyces avermitilis
  CDS (1)..(408)
ttgcggcacatctaccgctgcccgctgcgctgggcggacatggacgcgtacggccacgtcaacaacgcggtcttcctccgctacctggaggaagcacgtatcgacttcctgtctccccccggcaagcagttcaagcaggggtccgtggtggcgcgccacgagatcgactacaagcggcagctggtccaccggcgcgagccggtggacatcgagctgtggatcacggagatccgagcggcgtcgttcacgatcacctatgaggtcaaggacgcggatcagctctacgtccgggccgcgacggtggtcgtgccgttcgacttcgaggcgcagcggccgcgccggatcaccgccgaggaacgggagttcctggaggagtaccgggacgacgtgaccgagaccgtcgcggca

SEQ ID NO: 5353 - DNA, 693 bp, Streptomyces avermitilis
  CDS (1)..(693)
atgaccgtcctgtacctggccgacgagggggaggcggcggacctcgccgccttcctcgcccggctgatccactacgaccgcggggcggcggtgcggcttcaggcgtccgggaccgcgctggcggtcttcggacggccgccgtccttcgacgtcctcgcgatccggacggcgcggctcggcaagccgtacgaggacggcctcgacgtctcgctcgatgtgaccgtctcggccggtgaactcctggagtccatcgacgagtcggcggccacggccgtcgtgcccgccgcggtcaccgggccgccgtgggccggactgctcccgccccggggcggctggcagccggagcccggactgcccgcgccggacgcgctgcgggcgacggtggccgccgcggtgagcgaattccgctcccgcacccagcagttgccgcccgaaggacgtacccgggccgaactcgaccggatcgggcgggagatctggtcccggacgctgggcgacacacgcctcccggtgcgggccgcgcacgcggctcagtcgctgggtttcctacgccctgcaccgggcggcacgagcacgcccgacgaggcgccgctcgggcttttctcgtcgggcgcgtggctgcggctgcgtacgccgtacggatcgatcgcggtccgcagggcgggcctcggcgcgctggacgtcagcgtccgc

SEQ ID NO: 5354 - DNA, 402 bp, Streptomyces avermitilis
  CDS (1)..(402)
gtgaatgagattcggcgcggcacgcttcaggagcagaccttctacgagcaggtcggcggcgaggagaccttccggcgtcttgtccaccgtttctacgagggcgtcgccggggacccgctgctgaagcccatgtaccccgaggaggacctgggtccggccgaggagcgattcacgctgttcctgatccagtactggggcggcccgacgacatacagcgagcagcgcggccacccccggctgcggatgcgccacgcccccttcgccgtcgaccgggccgcgcacgacgcctggctcaagcacatgcgggtcgccgtcgacgagctcggcctctccgaggagcacgagcacacgctgtggaactacctgacgtacgccgcggcctcgatggtgaacacggagagc

SEQ ID NO: 5355 - DNA, 978 bp, Streptomyces avermitilis
  CDS (1)..(978)
atgagcgcgcacgcactcgaccacgacctggaggccctcgccgcgtcggcgcgggcggtacttctgcgcgagatcgacgcgagcggggcctgggatgccgatccgcggtggcgggaggcgttcgagacggtcccgcgccacctcttcgtgccgtactactacgcgggcgccgtcggcggctacgagcgcctgtggcgcgacagccccgacccgcgcgcccgggagcgctgggtgcgcggcgcgtacgccgacgccccgctggcgacccgggtgcgcgacggggagctggtgtcctccagcagtcagccctccctgatggcgaagatgctcgtcgagttggacgtgcgggacggggacgccgtcctggagatcggtgccggcaccgggtacaacgcggccctgctcgcccaccggctcggcgacgagcaggtcaccaccgtcgacctcgacgccgagatcaccgagtcggcgcggcagcacctggccgccgccggacaccacccggcggtcgtcaccggcgacggcgcgcggggagtgcccgcccgcgcccccttcgaccggatcatcgccacctgcacgctgacgtcgatcccgcgcccctggctcgcccagtgcgttcccggagcccgcatcctggcgccgttcgcgaccggtctgatcgccctgcgggtacgggacgccgggtacgccaccgggcacttcctgcacacgcccgcctacttcgtaccgctgcgcggtgtcgtacggcccgagcaggagcccccgaacctgggcgggctgccgcgccgggccaggggccacgagctgttccggttcctgctgaccctgaccgccggccgcctcgacccgcaggaggcgtacaccctgtgggagcgcgaggggcagccggggcgcgagcggtacggggtcacggtcggcgacgggcgctcctgggcctggctggacgaccccgaagggccgtacacctggccactgccg

SEQ ID NO: 5356 - DNA, 1443 bp, Streptomyces avermitilis
  CDS (1)..(1443)
atgccgacctgcccgaacggacaccagtcgggttccgacgactggtgcgagatctgcggtcaccgcatggcaggtgccgtgcccccgccgcctccgccaccaccgccggcttccggatacggctatccgccgcccggctcgcctccgccgcctccgggcgcgggaggccagcccgggggtcagcccggggggcgcccgcacctgtcctcggggcccgagccggagctgtgcccgcagtgccgcacgccccgtgagggcggtgcgccgttctgcgaggagtgccggtggaacttcctcaccaacacggccacctcgtacacgccggcggccccccgtccgtcgacgcccaatcccgcgccgcgcttccagcagggcggccccgggcagccgaccgggcccggcggggacccgtacgagtaccagagctcgcgcccgtcgcagatgaaccggcccgcggagccgatcccgccgggcccgccgtacggcggtgacccctcgggcccgtccggccggcccggcttcggcggcgacccctcgcgccagcccggcttcggcggtgacccgtcgcgccctcccggctacggtggcgattcatcacgtccttccgctttcggtggggattcctcgcgtccgtccgcttttggcggcgacccgtctcgtcccgtcccgccgccgcccgggcccggtgggccgggtgcgcccggtgggccgggtgcgcccggtgggccgggtgcgcccggtgggcctgagagcaccggtggtcccggtgccccgccgtcgttccagcaggccggaccgccgcccgtgttccagcggccgggtccgcccgctccgcccgcgttcccgcaggagaccgggcaaccgcccgtaccccggcagcccggcggcccgtccttcggcggcggtgacgacgactgggtgatctccccgccgtcgtcgtcctcccctggtggccccggcggtgctcagggcggcggctacggctacccgcagcccggctccacccaggcgccccccggccccggctaccagcagcagccgctgacctggagcgcgacgatcggccccgaccgtgactacttcatggcgatgatgcagcgctcgggccccgaggcggcgggcctgaacctgcccgcgtactcgccggagcagcagcgcacgctcaccggcaaccagatcagcatcggccgccgccgtcactccaccggcgacacccccgacatcgacctgtcggtgccgccggaggacccgggcgtctcgcaccagcacgcggtcctggtccagcagccggacggctcctgggcggtcgtcgaccagaactccaccaacgggaccacggtcaacggcgccgaggaaccgattcagcccttcgtgccgatcccgctccaggacggggaccgggtgcacgtcggggcgtggacgacgatcacgattcgccggggc

SEQ ID NO: 5357 - DNA, 1374 bp, Streptomyces avermitilis
  CDS (1)..(1374)
atggggttcttgagggggatcagagaaggcatggccaatttctcgaagtcgaacgcgccgcagttctcggtggacgtctatcagaacgagtacctgccggagggcggccgcgaggtcaacgccatcgtcacggtgacagcgaccggcggcggcacgaccaagagcgcggtggccgctccccgtccgtacgcgtcgggagctgccccggacgcggccgtggccgtcatggtcgactgttcgggctcgatggactacccgccgaccaagatgcgcaacgcccgtgacgcgacggccgcggccatcgacaccctgcgggacggcgtgcacttcgcggtgatcggcggcacccatgtggccaaggaggtctaccccggcggcggacgcctcgccgtcgccgacgcgcgcacccgcgaccaggccaagcaggcgctgcgcaagctgagcgcggggggcggcaccgcgatcggcacctggctgcgcctcgccgaccggctgctgtcctcggcggacgtgtcgatacggcacggcatcctgctcaccgacggccgcaacgaacacgagtcgccccaggacctcagggccgcactcgatgcctgtgccggacgtttcacctgtgacgcgcgtggagtcggcaccgactgggaggtcaaggaggtcaccgggatcgcgtccgcgctgctcggcaccgccgacatcgtcgccgacccggccgccctgtccgaggacttcacgcggatgatggaaacagccatgggcaaggaggtcgcggacgtcgcgctgcggctgtggacacccgtcggcacggccatcaagttcgtgaagcaagtggcccccacggtcgaggagttgaccgaccgtcgcaccgaggcgggcccgcgcgccggggactaccccaccggctcctggggcgacgagtcccgcgactaccacgtgtgcgtggaggtgcccgccgccggcctcggccaggagatgctggccggccggatctccctggtcgtcccacagagcgacggcagcacccagaacctcggcgcgcaagggctcgtacgggcggtctggaccgacgacatggaggcgtccacgtcgatcaacccccaggtagcgcactacacaggtcaggccgaactggcgcaagtcatccagcagggtttggacgcccgcaaatcgggagatgtcgacggagcaacggccaaactgggccgggccgtccaactcgccagtgcgtcggggaacacggatactgcgaaactgcttgcgaaggtggtggacgtggtcgatgccgcggcaggtactgtgcgattgaaggccaaggtggaagaggccgacgaaatgaccctcgaaacacggtccacaaagactgttcgtgtaaagaag

SEQ ID NO: 5358 - DNA, 1341 bp, Streptomyces avermitilis
  CDS (1)..(1341)
ttgatgtcgcagatgcctcagccgacggctctttcgaggtgccccagttgcgcggagcccctcgagtccggtgaccgtttctgcggtgcgtgcgggtacgacctctcggcggtgcccgtgccgccgcaggacacgcccacgctcaccatgaacggcgcgacgccgcggcccccttcacaggtcgcgtccgtggactggcccatcgctcccgaggtggacggctcccacgcgcctgccgcggtgcatctgcccaccgacctgccgggcacggactccggcggctccgaactgcccgccgggaaacccgccatgagcggttcgacgggggtacggttcgaccggcccgccgagcccgacgactatccactggcagcgccccgccctgccgccgacccacggacggccgacttgcccactcccccggccggcaccaagctctgcgtggcctgccgcgcgggccatgtcgacagcgacggctactgcgagaactgcggccacgcacagccacgcgaacgcgaccacatggagcaggagttggacgcggtcgccgccgtcagcgaccgcggcctgcgccaccaccgcaacgaggacgcgttcgcggtctcctcgaccgccctgcccgacggctcccccgccgtcgtggcggtcgtctgcgacggggtctcctcggcgacccgccccgacgaggcgtccctcgccgcctcccgcgccgcgggcgagtcgctgctggccgccctgccccgcggcacccatccgcagcaggccatgcacgaggcgatcatcgccgcgtcgcacgccgtcaactccctggccacggaaccggagacggcccaggagcactccccgcaccagaacgcgcccgcctgcacgctcgtcggcgccgtcgtcaccacgagtctgctggtcgtcggctgggtcggcgacagccgcgtgtactggatcccggtggaccgggcgctcccgccggtccggctcaccgaggacgactcgtgggccgcgcagatggtcgccgccggtctgatgagcgaggcggaggcgtacgcggacgagcgcgcccacgccatcacgggctggctcggcgcggacgcgtacgaactggagccgcacaccgcttccttcaagccggaccggccgggcgtggtggtggtgtgcaccgacgggctgtggaactacgcggaggccgccgaggagatggcggagatcgtgcccctcgacgccgcgctgaggccgctgcacagcgcccaggtgcttgtgggccacgccctggacggcgggggccacgacaacgtaacagtggccgtcctcccgttcccggccccgccgcagggggcaggatccgcc

SEQ ID NO: 5359 - DNA, 2502 bp, Streptomyces avermitilis
  CDS (1)..(2502)
gtgagtgaggcgcagcagaagtgccagcgccccggttgcacggggtcgtacgaggacgtgggcggcggcgagctgtactgcgacatgtgcgggctggcgccggtcgtcgcggcgggcggcatggtcggttcgccggcgacggggatcaccggcggtggccggggctcccggggttcggggagcagttcccgcgccagctcccgggcgtcctcgcgttcctcgcagtcccggcgctcggtgtcgggtcggctgtcgcgtgccctgtcggggaagacgtccggccgctcggtgtcggtacgcagctcgggttcgaccgccgggacctccgggcgcagccggctcggcatgggcctggtgcaggtgccggacgtgccgcggcccgatccgcgcgcgatggtgctggagaacccggaggtgcccgagcgcaagcggttctgctcgcgctccgactgcggggcgccggtggggcgggcgcgcggcgagcatccggggcgcacggaggggttctgcacgaagtgcggtcacccgtattcgttcgtgccgaagctgcacacgggtgacgtggtgcacggccagtacgaggtcgtgggctgtctcgcgcacggcggcctcggctgggtctatctcgccgtggaccgtgccgtgtccgaccgctgggtcgtgctgaagggcctgctggacaccggtgaccaggacgcgatggcggcggcgatctccgagcggcgtttcctcgcggagatcgagcacgccaacatcgtgcggatctacaacttcgtggaacacctggaccagcgcaccggctcgctcgacggctacatcgtcatggagtacgtcggcggcaagtccctcaaggagatcgccaacgaccgccgtacgcccaccgggaagcgggacccgctgccggtggagcaggcgtgcgcgtacggcatcgaggcgctcgaagcgctcggacacctgcacagccgcaacctgctgtactgcgacttcaaggtcgacaacgcgatccagaccgagaaccagctgaagctgatcgacatgggcgcggtgcgccggatggacgacgaggagtcggccatctacggcacggtgggctaccaggcgccggaggtcgcggacgtcggcccgtcggtcgccagcgacctgtacacggtcgcccgcaccctcgccgtactgaccttcgacttccaggggtacacgaacgtcttcgtggactcgctgccggacccggaccacatcgaggtcttccgccagtacgagtcgttctaccggctgctggtccgcgccaccgacccggacccggtccgccggttcgcctccgcgcaggagatgacggagcagctgacgggtgtgctgagggaggtcgtgtccctgcagacgggccgcgcccggccggccctgtcgaccctgttcgggcccgagaccaaggtcacggacacggtgttgttcgcggagctggagggggacgtgtcgcggctgggggcgcgcgtggtgccggtcggaaagcggggccgggcggcgagtacggcgtcgggtgtcgtcccgggccgcggcacgcgcaccctcgtcaagcccctcgacacggccgccgccgccctcgcgctgccggtcccccgggtcgaccccggtgaccccaacgccgggttcctcgccgggctcatgacgtccggcccgctggagctcgtcgcggcgctcggcaacgccccctcgccctccgtcgagacccggctgcgccagatccgcgcccggctggagaacggcgactcgcacacggcgctggaggtcctcgcgaagctggaggacgagcggcccgacgactggcgggtcgtctggtaccgcggtgtggccgcgctcgtcaccggcgaccacgaggtcggcgcgctctccttcgacgcgatctacgacgccttcccgggtgagccggcccccaagctggccctcgggctgtgcgcggaggtgctcggccagctggacaacgccgccgagtactaccgtctggtgtggacgaccgacccgagctatgtcggttcggcgttcggcctggcccgcgtccagctcgcggccggcgaccggcgcggtgccgtacggacgctggagtcggtgcccgagtcgtcgatccactacaccgcggcccgcgtggccgccgtacgggcgcgcctgagacaccgtacgaacgaagcgccggaagcgtccttcctggacgacctcggcgccgccgccgggcaggtcgaggcgctgaacggctacggtctggacgcggtgcgccgtgagcagttgtccacagaggtccttggctgcgcgctggactgggtactctccggtagccagggttccgctccgcctccggacggcggacgcgcactgctcggcaatgaactggacgagcgcggcctccgcttcggcctggagcgctcgtaccggacgctggcccggctggcgcagggcggcgaggaaaggatcgacctggtggagcgtgccaaccgctaccgcccccggacgtgggtg

SEQ ID NO: 5360 - DNA, 1323 bp, Streptomyces avermitilis
  CDS (1)..(1323)
atgggcgtcacgggaccccccgagccggtgctggaccgggacgaggtggaccgtgcgctggcgcggctcggtgcggagcacgaggccatcgagacctcgctcctcgccctccaggaccacgcgggccgcagactcctcgaaggcgccgagctcacgggcacgaccaaggagcgctggacggccgccgaggcgtcgatcaccttgctgtgggcgtacttcgacgcgtactcggacgcgctgcgctcggcgcgcgacatccgttcgcgccggcgctggtcgagccgtgaggacctggtcgagctgaccgggatcctgcgcggcgcgaccgtcacggtggcgggcagcacgacggcgacggcgaacgcgccgacactcgcgggcaccggcaagctcagcgagcagttcacgctggcggcgctcgtggaccggatgaacgagctgtacgcatcgtcgctggacatggtcgtcgccgccgacgcggtgtggtcggcgctgcccgcgcggatcgatttactggccgcggagttgcagcgcacccggcgactcgcgcactcggtgggcgtgcgccccggcgagcacccggcgggcgacgacctggagcggatcacccgcacgctgacccggctgcgcgaggaggtcatctccgacccgctgacgtactgggttccggcgccggggagttcggcgcccggcggcggacgtccggacacgacgacgtacgaccgcgaggcgcgcgccctggaggacgtgcgccgggagatcgacgccgtgctcaccgtccggcaggacgcggaggcgcggctcgtcaggctgcgggacgtcctcagccgcgcggaccgcaccctcgcggaggcgcgcagtgcacgcggcgaggtgctggcgaagatcgccgcgtcggaggtgcccgcggtcagcggtccgccgaccgcgcttcaggagcagttgcagacggccgccgagtaccgcagacacgcccagtggcaccgtctgtcgccgctcctggagtcgctggagcagcgggcggaggacgaactgctgcgcgcccgcgagtcgttgaccgccgtcaccgcgcctctggcggtccgtgcggagctgcgcggccgcctcgacgcgtacaaggcgaaggtcgcccggctcggcttcgcggaggacccgctgctgatcgagcggtacgacgcggcccgccgcatgctgtggagcgcgccctgcgacctgcgggtcgccgaggaggcggtgctccgctatcagcgggcggccgccgacctgttgagtccgcgggtgcccgaccagggcggtccgaccgaccggagggggcccgtcgcg

SEQ ID NO: 5361 - DNA, 1005 bp, Streptomyces avermitilis
  CDS (1)..(1005)
atgaccgcacgacgcctgagggcgagcctgaagggctggggcggcgtaggggcgatggccgtcgcctgcctcctcaccgccgtcttcgtcctgctgccgctcacccgtgcgagcggggaaggcggtgcgggcgtcggcggccagggcgtggccgagggcacgcaggtgagggacgagacctgcgaccaccccgagcgcaagagcccgccggcctcgaacgacgagagcggcgcggcgatcaaggccatcaagaagcgcggctatctgtcggtcggtgtcgaccagaacagctaccgctggggctaccgcgacccgaacagcaccaagaagggcagcgacctcgagggcttcgacatcgacctcgcccaccggatcgcggacgagatcctcggcaagccgaacgccgacgtccggttccacgccatccccaccaaccagcgcatcgaagcgatcaggagtgggcaggtcgacatggtggtacgcaccatgacgatcacctgcaagcggctggcggacgtggcgttctccgacccctacttccgcacgggccagcaggtcctggccccgaagaagtccggcatcacggggtacgacaagtcgctcgcgcacaagaggatctgcacggcggcgagttcgacggcgttcgacacgctgaccgccgaccggaaggcgggcaggctcgtcgtgtccgcccgcatgtccgaacccgtccccaatcaactcgactgcctcgtaaggctccagctcggccaggtcgacgcggtggtgaccgacggcgcgctcgccgcgagccaggccgcgcaggacccgacggtcgagctcaagggcgccgccttcaccgacgagtactacggcgtggcgatgaaactggacgccaaggatctggtacgccgggtcaaccaggtactcgtggactaccgcaggagcggctggcaggcctcgtacgacacctggctgtccccgaccctggggaagaactcgggaccgtcgaaaccgcccgcctcc

SEQ ID NO: 5362 - DNA, 1461 bp, Streptomyces avermitilis
  CDS (1)..(1461)
gtgacacacccgcagaaaggcagcgcgccaccggcccaggccgcaccgacgacgccggccctgccgcggtccggcgtgcccggcgcgcgggaagcgcccggcgcgcgtgcgtcacagggccgccccgaccccgccccgccccgccgcacggcctgggcggagggcgtcgaccagctgcgggccgccgcgacgaccgagcccggccggctgcgcctcatcggcgccgtcctggccctgctcgtggtcgcgttcggcgcggtcaccgcctggcagatgaccgaccgctcggccgccgcggacgacgtgctgcacagcagccagccgctgagcgcgggcgcggcggacatctaccgctcgctcgccgacgccaacacgaccgcgtccagcggcttcctcgcgggcggcgaggagccggcgggctcccgcacgcgcttcgaggacgacatcaggacggccgccgacaagctggtcgtcgccgccgccaactccgagccgggctcgccctccgcggacaccatcgccaagctcaacaaactgctgcccgagtacaagggcctgatcgagcgggcccgcgccaacaaccggcagggcttcccgctgggcggggcctatctgcggtacgcgaacgacacgatgcagcagaagatgctgccggccgcgcaggatctctacaccaaggagaaccagcggctgcgctcggactacgacagcgcgacgccgtacccgtgggccgcgatgggcctcggcgtcctcgctctcgccgcgctcggctgggcccagcgccgcaactaccggcgtacgaaccgggtgctgaaccagggcctggtcgccgccacggccgcctccgcggtggtcctgctctggctggtcgtcggacacaccgtcgcgcgcgccggcctcgactcgtcgtacgaccacggagtgcgctcgctcaacgtgctgcacgacgcccggatcgcgtcgctgaacgcgcggggcaacgagaacctgaccctggtcagccgcggcgccgagaccaagaccctgcccgacgagagcgtcgaggacgtcttcgactacaacttcaagcaggacatgaagaagctctccgcgggcctcgccgaggcgaagtcgctggccgacgaccaggcgggcgggcagcccgtgacggccgccaccgggaacatggaggagtggcagtcgcgccaccgggaagcgcgcgcggccgacgactccggcaactaccaggccgcgctggacaaggtcatcggctccaaggcggacaagccgacgggcgagtgcttcgacggcgtcgaccacaacctggagctggccctcgcccacgaggagaccgagttcaagcaggcggcgggcgacggccgggacgcgatgaccgggctctcggtgggcgccgcggtgctggccgtgctgggcgcggcgggcgcggtgctgggcatcgggcgcaggctttcggagtaccgg

SEQ ID NO: 5363 - DNA, 954 bp, Streptomyces avermitilis
  CDS (1)..(954)
gtgctcgcgatcgacgcggggaacagcaagaccgacgtcgcggtcgtggccgccgacggcacggtcgtcggcgccgcgcgcggcggcgggttccgtcccccggcggtgggggtggagacggcggtggacgtggtcgccgacgcggtgggccgggccttcgccgcggccggcgtcacctcggtcacgcatgtctcggcgtgtctggcgaacgccgatctccccgtcgaggagaagcagttggcggccgccctgcacgcgcgcgcgtggggcacgagtgtggaggtgcgcaatgacaccttcgcgatcctgcgggcgggcgtcgccgagccgcacggggtcgcggtggtgtgcggcgcgggcatcaactgcgtgggcatgcgccccgacggccgcaccgcgcgtttcccggccatcggccgcatctccggcgactggggcggcggctgggccctggcggaggaggccctgtggcatgcggcgcgggcggaggacgggcggggcggcccgacggccctggcccgtacgctccccgcgcacttcggcctggagtcgatgtacgcgctgatcgaggcgctccacctggagcacatcgagcactcccggcgccatgagctgacacccgtcctgttcgccacggctcgcgacggcgacccggtggcgcgggccgtcgtcgaccggctggcggacgaggtggtggcgatggccgtggtcgccctgacccgcctcgacctgctcgcggaggagacccccgtgctgctcggcggcagcgtcctcgcggcccgccacccccaactcgacgaccggataagggacctgctggcggcccgcgcccccaaggcggtaccccgggtggtcaccgcagggccggtcctcggcgcggccctgctgggcctcgaccacgtgcacgccccggaggaggtccacgcgcgcgtacgggcacactacgaaggagcg

SEQ ID NO: 5364 - DNA, 1263 bp, Streptomyces avermitilis
  CDS (1)..(1263)
atgaaactggcagttgtgggcggggggtccacgtacacccccgaactcatcgacggcttcgcccggttgcgggacacgctgcccgtcgaggaactggtcctcgtcgacccggccgccgaccgcctcgaactggtgggcggcctcgcccggcgcatcttcgccaggcagggccacgacggcaggatcgtcaccacgtccgacctggacgcgggcgtcgagggcgccgacgcggtgctgctccagctgcgcgtgggcggacaggccgcacgcgagcaggacgagacctggccgctggagtgcggctgcgtcggccaggagacgacgggcgcgggcggtctcgccaaggcgctgcgcacggtgccggtggtgctggacatcgccgagcgcgtccgccgcgccaacccggacgcctggatcatcgatttcaccaatccggtggggatcgtgacgcgcgccctgctccaggccggtcacaaggccgtcgggctgtgcaacgtggcgatcggcttccagcggaagttcgccgggctgctcggcgtcgcccccgccgacgtccacctcgaccacgtcggcctcaaccacctcacctgggagaccggggtgcgcctgggcggccccgagggcgagaacgtcctgcccaagctgctcgccgagcacggtgacgccgtcgcgggcgacctgcgcctgccgcgcagcatcgtcgaccggctcggcgtcgtcccctcgtactacctgcgctacttctacgcgcacgacgaggtcgtacgagagctcgggaccaaaccctcgcgggccgcggaggtcgcgcggatggagcggcggttgctggagatgtacggcgaccccgcgctcgacgagaagccggcgctgctggccgagcggggtggcgcgtactactcggaggcggccgtggacctcgcggcctcgctgctgggcgggggaggcagcccgtaccaggtggtgaacgcctacaacaagggcacgttgcccttcctgcccgacgacgcggtgatcgaggtgcaggccgcggtcggcccgcacggccccaccccgctgccggtgccgccggtggacccgctgtacgcggggctgatggcgaacgtcacggcgtacgaggacctggcccttgaggccgcgctgcgcggcggacgcgaccgggtgttccgggcgctgctcgcgcacccgctgatcggccagtacgggtacgccgacgccctcaccgaccggctgatcgcgcacaaccgggagcacctcgcgtgggcg

SEQ ID NO: 5365 - DNA, 891 bp, Streptomyces avermitilis
  CDS (1)..(891)
atgacccaagtgctggacaagccggtggagttgacgacaacggtctccccggccgagcgcaccgcccggcgccgggccctgctggagtgggtcgcggtccactcgctgggcgtggcggcggccctcttcttcgtcctccccttcgtgttcgtgttcctgacctcgctgatgagcgacacccaggcgctcagccgcgatctgatcccgcacacctggcagtggggcaactaccggaaggtgttcgacaccccgggcttcctgacctggtggaagaacacactcctgtacgccggtgccggcaccgtcatcacggtcgtgtcgtcgatccccgtggcgtacgcgctcgccaagttccgcttccgcgggcggaatctgtcgctgatgctggtcatctcgatgatgatgctgccgccccaggtgatcatcatcccgatgtacctgttctgggcgaagcagctggatctgtcgggcacgctgtggccgctgatcatcccgatggcgttcggggacgcgttctccatcttcctgctccgccagttcctgatgaccatcccgaacgagtacctcgacgcggcgaaggtcgacggctgcggggacctcaggaccctcctgaaggtcgtcctgccgatggcgaggccgggcatcgcggccgtcgcgctcttccagttcttctacgcctggaacgactacttcggcccgcagatctacgcgtccgagaacccgggcgcctggacgttgagttacggcctggagtcgttcaagggcgcgcaccacaccgactggaatctcaccatggccgcgaccgtcctggtcatggcccccgtgatcctcgtgttcttcttcgcgcagaaggcgttcgtcgagggtgtcacgctcaccggagtgaagggc

SEQ ID NO: 5366 - DNA, 939 bp, Streptomyces avermitilis
  CDS (1)..(939)
atgaccacgtacacgctgcgtgccaaacgccgccgggcggcgttcaggacggccgccttcatgtcgccctggctgatcggcttcacggtcttcttcgcgtatccgctgatctcgacggtctacttctcgttcatgcactacgacggcttcaagccgccgacgtggagcgggacgaagaactggacgtacgtcttcgagcactacccgctgttctggcccgcgttgcgcaacaccctgtggctggtcctcgtcatggtgagcctgcgcgtcgtcttcgggctgggcgtcgggctcctcatcacgaagatcaagacgggcacgggcgtcttccgcaccctcttctacctgccctacctcgccccgcccgtcgccgccaccatggccttcgccttcctcctcaaccccggcaccgggccggtcgactcgatcctggagaaggcgggcatcccggcgcccggctggttcaacgaccccacctggtccaagcccgccctgaccctgctcgccctgtggggcatcggcgacctgatggtcatcttcatggccgcactgctcgacgtcccccaggagcagtacgaggcggcggagctggacggcgcgtcggcccttcagcgcttccggtacgtgacgctcccgaacatctcgccgatcatgatgttcgccgtggtcaccggcgtgatccagaccatgcagtactacacccagccactgatcgccggaaaggtcgcgtcgggcgtcatccagggcgccggtacgcagttcgagccgggctaccccgacaagtcgacgctcaccctgccccagctcgtctacaacctcggtttccagcgcttcgactacggctccgcctgtgtggtcgcgctcgtgctgttcgccctgtccatggtgttcaccgcgttcctgatgcggcgccggggcggcctcatccaggcaggtgac

SEQ ID NO: 5367 - DNA, 1335 bp, Streptomyces avermitilis
  CDS (1)..(1335)
atgcccgcaatgtccagaaaggtggctgtcgcgctggccgcgtccgcctcgatagccctcctcgccaccgcctgtaccggccagtccgacgccggcgcgaacgacgacgcgtccaaggacacgacgatcaacttctggcatgcgtggagcgcgccgggcgaggtcaaggccgtgcggtcgctggtcgcgggcttcgagaaggcgcaccccaacatccacgtcgacatcgtcgccaacatgaccgacgacaagatcaaccaggcgctgcgcgccggcggtgacaaggccccggacgtcatctcctccttcaccaccaacaacgtcggcaagttctgctcctccggtgccctcgtcgacctcaaccccttcttcaagaaggcgggcgtcgacccggccaccaccttcccgaaggcgatgaacgagtacacccagttcgacggcaaccgctgcgcggcgccgctgctgggcgacgcgtacgggctctactacaacaagaccgccttcaagaaggccgggatcaccagccccccgaagacctggtcggaattcgagaaggacgccaagaagctcaccctcaccaagggcgactcctacaagcagctcggcttcatgccgaactaccacggctgggaatcgaccaccgagcactacttcgcgcagttctcgccgacgtacttcgaccggagcggcaagtcgaacgtcgccgaggaccccgcgttcgaggccgggttcacactccagaagaagctcgtggacgagctcggcggctacaagaagctggagacctaccgcgccacgctcggtgacgagtggggccccaagcaccccttccacaccggccaggtcgcgatgcagctggacggcgagtggcgcctgggcatggccgaggaggccaagcctgacttcgagatcggggtcgcgccactgcccgtccccgacgaccgggccgaccagtacggcaagggctacatcaccggcaccatcaccggcatcgccgccaccagcaagaagcagaacgcggcctgggagttggtgaagtacatgaccacggacacggacgcggtggtcggcttcgccaacgacatccacaacgtgccctccacgctcgcggccctcaagtccccgaagctgacgtacgacccgcgcttcaagacgttcctggacatcgccgccgacccgaactcgaccacgactcccgcctccgtcaacggcggtgtgtacctcgtgaccatccaggagttcggctacgcctacgagagcggcagggccaaggacctcaaggcgggcctggcggggaccgcgaagcagatcgacacggacatcgcgcaggccaag

SEQ ID NO: 5368 - DNA, 1209 bp, Streptomyces avermitilis
  CDS (1)..(1209)
atggcaggatccgccggcacgccgggcaccccgcgcgtcctgcgcgccatgaacgaccgcgccgccctcgacctgctcctcgagcacggcccgctcagccgcacccgcataggcaagctcaccggactgtcgaagcccaccgcctcccagctcctggcccgcctcgaagccgccgggctcgtcctgatgaccggcaccagcgaaggacgccccggacccaacgcccagctctacgtggtcaatccgggcgcggcccacgcggccgggctcgacgtcacccccgagcgcatcctcgccgccgtcgccgacgtcaccgggcggaccgtgggcgcgtacgaactgccgacccccggccggcgcccggcccagcccgtcgtacggcaggtcaccgacgccctggacggcgcggtgaaggccgccggcctggcccgggacgacatccaccggctcgtcatcggcacccccggcgccttcgaccccaacaccggccggctgcgctacgcctcccacctccccggctggcactcccccaccctcctcgacgaactcgccgccgcactgccgatgccggtcgagtacgagaacgacgtcaacctcgtcgcgatcgccgagcagcggctgggcgcggcgcgcgggcacgcggacttcgtactgctgtggaacgagggcggactcggcgccgccctcgtcctcggcggccggctgcaccgcggctggaccggcggcgccggcgaggtcggcttcctgcccgtgcccggcgcacccctggtccgccaggtgacccgggccaacagcggcggctaccaggagctggccggttcccaggccatacccgagctggcccgcgagctcggcatcgaggacataccgccgggcccgtacgccgaggtcgccgccaccctcgtcgagcgggccgccggccacgacgacggcccctaccggcagttgctgcgcacgtacgccaccggtctcgccaccggtctcgcctcgctggtctccgtactcgaccccgaactcgtcgtcctcagcggcacctcgctcagcaggggcggcgagccgctgcgggccctggtgcaggccgagctggaggacctggccgcgtcccggccgcgcctcgtcgtcggcgacgtccacgaacaccccgtgctgcgcggcgcgttggagagcgcgctggcggccacccgcgacgaggtcttcgacacctcccgc

SEQ ID NO: 5369 - DNA, 1098 bp, Streptomyces avermitilis
  CDS (1)..(1098)
gtgtccttgcccgccgtcctactggccgccggtgtcacaccgtccccgtctccctcgcagacgacggacccggccaccgccacgctccaggacgcccagcacagcgcgacgaacgccgcgagctgggtctcgcagaactggtccacgtggctggcgatcggtctgcgcgtcctgctgatcctggtgatcgcgggcgtgctgagagtggtggtgcggcgggcgatcaccaagctgatcgaccgcatgagccgcacggcggagggggtcgacggcacggcgctcggcggtctcctggtgaacgtggagcgccgccgccagcgttcccaggcgatcggctcggtactccgctcggtggcgtcgttcctgatcctcggcaccgccgccctgatgatcctcggcaccttcgagatcaacctggccccgctgctggcgtcggccggtgtcgcgggtgtcgcgatcggtttcggcgcccggaacctggtcaccgacttcctctccggcgtcttcatgatcctggaggaccagtacggggtcggcgacacggtcgacgcgggcgtcgcgtccggcgaggtcatcgaggtgggcctgcgcgtgaccaagctgcgcggcgacaacggcgagatctggtacgtccgcaacggcgaggtcaagcgcatcggcaacctctcccagggctgggcgacggcgggcgtggacgtgaccgtccgcgcctccgaggatctggaccgggtgaaggccacgctcgacgacgtcgccgagcggatgagcaaggaggagccctggaacgagctcctctggggcccgatcgaggtcctcggcctggacagcgtcctgctggactcgatggtggtccatgtctcggcgaagacgatgccgggcaaggctgcagccgtggcccgcgagctgcgctggcgcatcaagcgcgccttcgacgcggcggacatccgcatcgtgggcggcctcccgtcccagccggacggggacccggtccccgacccgacggcgacggtcgcggccccctcggtctactcgaacacggcgtccccgcaggcggaggcggcatccccgctcacgccgcccgtgcgccccgcgccgaag

SEQ ID NO: 5370 - DNA, 534 bp, Streptomyces avermitilis
  CDS (1)..(534)
gtgccgcatgtcctggtcctcaacgcgtcgtacgagccactcggcgtcgtaccgctccgccgcgcgctcgtcctcgtccttgagaacaaggcagtctgcctcgaggaatccggcgccttcatgcacagcgcaaccgttactgtccccgcacccagcgtggtccggctgaagaggttcgtacgggtcccttaccgggggcccgttccgctgacccggcgggcgttgttcgcccgcgacggcggccggtgcatgtactgcggtggcgtcgcaaccagcgtcgaccacgtcatcccgcgcagccgcgggggtcagcacgcctgggacaacgtggtggcgtcctgccgccgctgcaaccacgtcaaggccgaccgccacctcttcgagatcggctggcggctgcgccacaaacccgctccgcccacgggtctggcctggcgcatcatcggcaccgggcatagggacccgcgctggctgccctacctacagccgtacggcgcggacgacgcgatggcccggatcgacggcatctccgcc

SEQ ID NO: 5371 - DNA, 1341 bp, Streptomyces avermitilis
  CDS (1)..(1341)
atgaggaccgatctccggctcgccctgctgctgatccgcggctccgaccggcgtgagtggtggcgggtcgcgctcacggcggtgggcgcgatgggcgccacggggctcgccctgggcgcgacggcgatcgtctcgctccgggggcagtacaacgtgcccctcgcgaacgggctgctgaaccagcccggggagcgctcgggcgtgatcctcacgctgctgctcctgctggtccccgtgctcggcttcctcgggcagtgcgcccgcatcggcgcactgcaccgcgaccggcggctggccggactgcgcctcgcgggcgccacgccgggccaggtgcggcggatcgccgccctggaggcggggctcacctgtctgctcggctcggtggtcgccaccgtcttcgccgcgctgctcctgctgagccagtggcagcatccgccggcgacggtctgggccgggttcgcgctggtcatggtggccgtaccgctgctgggcgtgctggtgagcaccctcgcgctgcgtcgggtgatcgcctccccgctgggctgggtgcgccgggtgcgcccgcaaccgggcaagggccggggtccgggcctcgcgttcatcgcggcggcgctggtcctcctcaccgtgggcctcgtcatcactccgggcaccttcggcgggttcggcacggccccgctgctgatcttcaccgtggtggtcgtcaccggtatgggcgccgtctggctgaccggcgccaccgcccggctcacgggccggctcctcgcggcgcgcaccgggaacccggcgaccctgatcgcggcggaacggctgcgcgacgacccgtgggccgccgcccgcacccatgccgccgtcctgctggtgaccgtcgtcgggacggcattcgtgggcatccgtcaaacgctgctcgccggcctgaccgggcgcgacaggcggatgttcgccgacaacatgtccttctacaccaccggcatcaatctgacgggagccgccatcctcgtcgccctggggatcacgctcgcggggctcgccgtaggcaccgcggaatcgctcgccgcgcgccgccggggcctgtccgcgcaggccgccgccggggtgccgaggccggtcctggccaaggccctgctcctggagaccgccctgccgctcgcccccgcggtggcgctggccggcctcggcggcatcggcatcggcgtcttgtacgcggcggcgttcggtgagggcatacccgtgctgccgctgctggtgccgccggccgtgtacgcggcctgcctgctcgccgcggcggcctccctgccgcgtctgcgccgctcggtacacccggcggaactgcgctacgcc

SEQ ID NO: 5372 - DNA, 711 bp, Streptomyces avermitilis
  CDS (1)..(711)
atgagcaacccactcctcgcggcccggggactcgtcaaagcccacggctccaccccggcactgcgcggcgcctcggtggagctccgggcgggcgagatcctcgccgtcaccggggccagcggcagcggcaagtccacgctgctgcactgcctcgccgggatagtccgcccggacgagggtgccgtcgtctacggcggcgaacgcctcgaccagctcccggagaaccggctgagcgagctgcggcgcacggagttcggcgtggtgttccagttcggacagctgatccccgagctgaccgcgctcgacaacgtggcgctgcccctgctcctcgcgggcacctcacgcaaggcggcgcaggagcgggcgggcgaatggctggagcggttcggcgtccgcgggcaggaggagtcgcggcccggcgagctgagcggcggccaggcacagcgggtctccctggcgcgggccctggtgaccggcccgaaggcggtcttcgcggacgagccgaccggcgcgctcgactccctcgccggggagcaggtgatgaccgcgctgacccacacggcccgcgagtccggcacggcggtgctgctgatcacgcacgacgcgcaggtggcggcgtacgcggaccgggaggtgtcgctgcgggacggggtcgtgatcgccgccggacacctcccgagcggggccgacacgtcggcggaggtgactcga

SEQ ID NO: 5373 - DNA, 531 bp, Streptomyces avermitilis
  CDS (1)..(531)
atgagcacccgccacatcctgctcggactgctcgccgcagggccgagccatggctacgacctcaagcggcggcacgacgagcggttcccgcaagcgcggcccctcgcctacgggcaggtctatacgacgttgcagcgcctggtccgcgacggtctcgccgaggtcgacgggaccgattccgacggcggccccgagcgcaccctgtaccgctccaccgacgacggctccctggagctgacccgctgggccggtgagatcaccccgcccgctcccttcgtgacgaacgagatcttcgccaaggtcgtcgtcgcgatcctcgcctcgggggacccggccgcgtacctgagcgcacagcgtgccgcgcacatggcacggatgcgggagctcacggccgtgaagaccgcatccggcgccgatctggcgaccgtcctctcggccgactacgccctcaaccacctcgacgccgatctgcgctggatgaccaccacaggcgcccggctcaccactttgaccgcggaggtcgacgcagca

SEQ ID NO: 5374 - DNA, 249 bp, Streptomyces avermitilis
  CDS (1)..(249)
gtggccgcatcggcacatcttctgctctcggccctgtccaaacctgaggcggagccgtccgccggacccgagcacctgctgtacgccttcagcgccgaaggggccggcgccgaggcgccgctcaccagcgagccgcccctgcccgacgccgagcccctcaccagcgagcccccgctcgccgacgccacccccctgaccagtgagcccacggccacgggtaccgccgccggcccggaccccgcggggttc

SEQ ID NO: 5375 - DNA, 2220 bp, Streptomyces avermitilis
  CDS (1)..(2220)
atgcccccggccgagacgggtgagagcgagacggacgaacccggtgaggccgaccgggctcatgcggccgacgggatccatggcgccgacgagaccgatggggcccacgaggcccacggtgtcggtgaggcgccgctggcgcggctcgccgcgctccatggcgttgccacctcctacagcccctccccgggccggacggtcgccgcttcggacgccgccgtcaccacggccctcgccgcgctcggcgtcgacgcgggcaccccggacgccgtacaccgtgccctcgcggcgcgcgagacggagctgcgccggcggctgctgccgccgaccgtcgtgtgctggggcgaacagccgcccgccgcgctgaccgacctgccggacggcacccgcctgcgcatcgagaccgaacagggcgagacccgcgcctcggccgagcagctcccgcccggtgtccacgcgttacacatcaccgcaccggacggccgcagcgccgacgcccatctcgtcgtcgcgcccgcccggctgtccgcgccgcccggacgcgcctacggactcctcgtccagctctactccctcctctcccagcgctcctggggcatgggcgacctcggtgacctcgccgagctggccgcctgggcgggccgggcgctcggcgccggattcgtgcagctcaacccgttgcacgtggccgtgccgggcgaccccaccgacccgtccccgtaccgcccctcctcccgccgctaccccgacccggtgcacctgcgtgtcgaggacgttcccgagttcgcgtacgtcgacgaccccggtccggtccgtacgctcctcgaccgcgccgcccggctgcgcgaatccgtcctgcgaaagggcgcgttgatcgaccgcgacgccgtatgggagctgaagcgggaggcgctggaacgcgtgcacgccgtgcccctcggacccggacggcgcgccgcctacgtcgacttcctcgccgaggagggcgaggcgctggaggaccacgcgacgtggtgcgcgctggccgaggtgtacggggccgatgggcacggctggccggccgggctgcgcgacccgcgctcggccgagaccgcccgggcgcgcggcgagttgatggaccgcgtcgacttccacgcctggctcgcctggctgaccgacgagcagctcgccgccgctcagcgggccgcgcgtgacgcgggcatggcggtcggactcgtgcacgacctcgcggtcggcgtccatcccgtcggcgccgacgcctgggcgcagcaggagtacttcgccgcgggcatgtcggtgggcgccccgcccgacgccttcaacgcgctcggccaggactggggcctgccgccctggcgaccggaccgcctcgccgagtccggctacgccccgtaccgccgtctgctccgcgccctcttccgatacgcgggcgccctgcgcatcgaccacgtgatggggctgttccggctgtggtgggtgccgcaggggcggccgcccacggagggaacgtacgtccggtacgacgccgaggcgatgctcgcgatcctcgtcctggaggcatcgcgcaccggggcactggtgatcggcgaggacctcggcacggtcgaacccggggtgcgcgagacgctgcacgcgcgcggcgtgctcggcacgtcggtgctgtggttcgaacgggactgggagggggacgggctgccgctgccgcccgagcgctggcgcgcggactgcctggccaccgccaccacccacgacctgccgccgaccgccgcccggctcaccggcgcgcacgtcgaactccgcgaccgtctcggcctgttggcccggccgctggaggaggagcgggccgcggcggcggcggacacggcggaatggctggccctgctggcccggctcggactgctcaagggtgcgagcgggggcatctgctcggtgtccgaggaggccgagatccaggccgtgcacgcctttctgctgcgcaccccggcccggctggtcggcctgtggctgccggacgcggtgggcgaccggcgcccgcagaacctgccgggtacgtgggaccagtatccgaactggcgtctgccgatcgccgatgcgcggggccgtccggtgacgctggaggagctggcggccgcgccgcggttgcacgcgttggtggatgtgctgcggggccttccggcggggggcggggcgccgggcggcgcgaggtgcggggagcggggc

SEQ ID NO: 5376 - DNA, 237 bp, Streptomyces avermitilis
  CDS (1)..(237)
gtggacaagaagaacgccctgcgcgccggcgccctggctgccggtacgacgctgatgatgctgctcatgtcgtcccccgcgctcgcggtggtccgcgacgacggcgacgaccccggcccggggctgagcgtgatcgacacgctgggtctcttcgtcgcggcaccgatcgtgctgttcgtggtcatcgccggtctcgtgatcgtcggcgagaagtcccacaagcagccgaagcagggc

SEQ ID NO: 5377 - DNA, 528 bp, Streptomyces avermitilis
  CDS (1)..(528)
atgaacgcgagccgcccgatcacaccccccaaggaccccgtcgacgcgatcatcgagcagtgggccgccgcccggccggacctcgacaccgccgcgatggaggtcttcgggcgcgtcttccggctctcgcggacgatgggcgaccggatggagaaggcgtacgagcggttcgggatctcgcgcggcgagttcgacgtgctggcgaccctgcgccgttccggcgagccgtacaccctctcgccccgccagctctcggcgacgctgatgctcaccaccggcgggatgaccggccgcctggacaagctggaacgggcggggctgctgcgccgctcccccgacccgcacgaccggcgcgggctccaggtgacgctcacggacgaggggttccggctgatcgacgaggcggtggaggccgggctcgccgtccagacggaggcgctcgacgccctcgacgcgcagcaggccggccaactggccgacctgctgcgtcagttgctcgccggaaccgtcagccccgccccagggaac

SEQ ID NO: 5378 - DNA, 1107 bp, Streptomyces avermitilis
  CDS (1)..(1107)
atgaccaagaacggctccacgcgtgccccgctcatagcgctcaccgcgctcgcccccgtctcctggggcagcacctacgccgtcaccaccgagttcctgccggcggaccgtccgctgttcacgggcctgatgcgcgccctgcccgccgggctgctcctgctcgccctcgcccgggtgcttccgcgcggcgcctggtggtggaagtcggcggtgctgggtgcgctgaacatcggcgccttcttcccgctgctgttcctctccgcgtaccggctgcccggcggcatggcggcggtcgtgggctcggtgggtccgctgttcgtggccgggctggcggcggcgctgctcagtgagcgaccgaccgttcgtacgctgttgaccggtatcgcggcggccctgggtgtcagcctggtcgtgctgaaggcggccggcgcgctcgaccccctcggtgtgctcgccgccctcgccgccaccgcctccatgtccaccggcaccgtgctcaccaagcggtgggggcgcccggccggggtcggcccgctggccctgaccgcctggcagctcaccgcgggcggactgctgatcgccccgatcgccctgctcgtcgaggggacgccgcccgcgttggacggccgggcgatcggcggctacctctatctcgcgctggcgaacacggcggtggcgtactggctctggttccgcggcatcggccggctcaccgcgacccaggtcaccttcctcggcccgctctccccgctcaccgcggccgtcatcggctgggccgccctcggccaggcgctgacgccggtgcagctggcgggcatggccgtggccttcggcgcgacggtcttcggccagctcaggccccgcgcccaggaccgacgccgacaccgtgaaaccacggcggttccgctggacgccgggccgaactcgaacgccgcaaccaccgcgccgggcgcggccgctgtgccgggcgcgccgacggcgaccgctgcgccgagtgtgccgacggcgactgccgcgccgactgtgccgggtgcgaccgctgcgccgagcgcgccgaccgcgccgaccgcgaccaccgcaacgaccgcgaccacccccaacggctcc

SEQ ID NO: 5379 - DNA, 2571 bp, Streptomyces avermitilis
  CDS (1)..(2571)
gtgcctggcacaaacctgacccgcgaagaggcgcagcagcgggcgcagctgctcaccgttgactcgtacgagatcgatctcgacctctccggcgcgcaggagggcggcacctaccggtccgtgaccacggtgcgcttcgactccgccgagaccggcgcggagtccttcatcgacctggtggcgccgacggtccacgaggtgaccctcaacggcgacacgctcgacccggccgaggtcttcaaggactcgcggatcgcgcttgcgggcctgctggcgggccgcaacgtgctccgcgtcgtggcggactgcgcttacaccaacacgggtgaaggtctgcaccgcttcgtcgaccccgtcgaccagcaggcctatctctacacccagttcgaggtgccggacgcccgccgggtcttcgcctccttcgagcagcccgatctgaaggcgaccttccagttcaccgtgaaggcgccgagcggctggaccgtcgtctccaactcgccgacgcccgagcccacggacgacacctgggtcttcgagccgacgccgcggatctccacgtacatcacggcgctcatcgtcgggccgtaccactcggtgcacagcgtgtacgagaaggacggccagtccgttccgctcggcatctactgccggccctcgctcgccgagttcctcgactccgacgcgatcttcgaggtcacccggcagggcttcgactggttccaggagaagttcgactacgcgtaccccttcggcaagtacgaccagctcttcgtgccggagttcaacgcgggcgcgatggagaacgccggcgccgtcaccatccgcgaccagtacgtgttccggtccaaggtgaccgacgccgcgtacgaggtgcgcgccgagacgatcctgcacgagctggcccacatgtggttcggcgacctcgtgaccatggagtggtggaacgacctgtggctgaacgagtcgttcgccacgtacacgtccatcgcctgccaggcgtatgcgcccggctcgcgctggccgcactcctggaccaccttcgccaactccatgaagacgtgggcgtaccggcaggaccagctgccctccacccacccgatcatggccgagatcaacgacctcgacgacgtgctcgtcaacttcgacggcatcacgtacgccaagggcgccagcgtcctgaagcagctcgtcgcgtatgtcggcatggacgagttcttcgcgggcgtgcaggcgtacttcaagcgtcacgcgttcgggaacacgcggctcagcgatctgctgggggcgctggaggagaccagcggccgtgacctgaagaactggtcggagaagtggctccagacggccggtatcaacatcctgcgtcctgagatcgccaccgacgcggacggtgtcatcacctcgttcgccattcgccaggaggcgccggccctgcccgccggtgccaagggcgagccgacgctgcggccgcaccgcatcgcggtcggcctgtacgacctcgacgaggcgagcggcaaggtcgtgcgcggcgagcgggtggagctggacgtggacggtgagctgaccgccgttccgcagctggtcggcaagcgccgtccgtcggtggtcctgctcaacgacgacgacctgtcgtacgcgaaggtccgcctcgacgaggagtccctcgcgttcgtgacggagcacctcggtgacttcgaggcctccctcccccgcgccctgtgctgggcctcggcctgggacatgacgcgtgacgccgagctggcgacccgcgactacctgtccctggtcctgtcgggcatcggcaaggagtccgacatcggtgtcgtgcagtcgctgcaccgccaggtgaagctggcgatcgagctgtacgccgacccggccgcccgcgagaacctggtgaaccgctggacggacgccacgctggcgcatctgcgcgcggccgaggcgggcagcgaccaccagctggcctgggcgcgtgccttcgcggcgaccgcgcgtacgccggagcagctggacctgctggaggggctgctggagggcacgcagacgatcgagggcctggccgtcgacaccgagctgcggtgggcgttcgtggagcggctcgcggccgtgggccggtacgacgagacggagatcgccggcgagtacgagcgggaccgcacggcggccggtgagcggcacgcggcgaccgcccgggccgcgcggccgaccgaggaggcgaaggcggaggcctgggcctcggtcgtcgagtcggacaagctgccgaacgccgtgcaggaggcggtgatctcgggcttcgtgcagaccgaccagcgtgagctgctggccccgtacacggacaagtacttcgcggcggccaaggacgtgtgggactcgcgctcgcacgagatggcgcagcagatcgtggtcgggctctacccggcggtccaggtctcggaggagacgctcaggaagacggacgagtggctggcctcggccgaccccagcccggcactgcggcggctggtctcggagtcccggtcgggcgtggagcgggccctgaaggcgcaggcggcggacgcggccgcggcg

SEQ ID NO: 5380 - DNA, 519 bp, Streptomyces avermitilis
  CDS (1)..(519)
atgacgacgtacccgacgcacacggcacgcacgacgtacaccgcacgcccgatcgggccgagcgccctgaaggaactccgcgacaccgacgacgcgggccgcccccgcgtaccgttcaccgacgacgagggcggtgccccgctccgctgctgcctgcgccgcagcgaaccgggcgagcacatcgtcctcgtctcgtacgccccgctgcgccgctgggccgccgagacgggcgccgagccgggggcgtacgacgagcgggggccggtcttcatccatgcggccgagtgcgagggaccggccggggacggccacccgttcaccggcgcccaccgcaccgtccgccgctactccgccgacggccggatcctcggcggccgtctcgtggaggtcccggacgcggccgccgccgaccaggccttcgacgaagccttcgcggaggccttcggcgaccctgagacgcggctcgtccatgtgcgggccgtggaatacggctgcttcctgtacgaggtgcgcaggccc

SEQ ID NO: 5381 - DNA, 1014 bp, Streptomyces avermitilis
  CDS (1)..(1014)
gtgagggtcggaatcgtcggagccaccggtcaggtcggcacggtcatgcgcaggatcctcgtggagcgggactttccggtcaccgagctgcgcctgttcgcctcggcccgctcggccgggtcggtcgtcgacggtgtgacggtggaggacgcctccacggccgactacacgggcctggacatcgtgctcttctccgcgggcggcgccacgtccagggcgctgtgcgagaaggtcgccgcccagggcgcggtcgtgatcgacaactcttcggcgtggcggaaggacccggccgtacccctggtggtcgccgaggtgaacccgcacgcgatcgcggaccgccccaagggcatcatcgccaacccgaactgcacgacgatggccgcgatgccggtgctgaagccgctgcacgaggaggcgggcctcgaagcgctgatcgtcgccacctaccaggcggtgtccggttccggcgtcgcgggcgtggcggagctgcacggccaggcgcagaaggtgatcgccgacgcggacaagctcacgcacgacggcgaggcggtcgactaccccgaaccgcaggtctaccagcgcccgatcgccttcaacgtcgtgcccctcgccggctccctcgtcgacgacggtctgcacgagaccgacgaggagcagaagctccgcaacgagtcccgcaagatcctggagatcccggccctcaaggtctccggcacctgcgtccgcgtcccggtcttctccggccactccctccaggtcaacgcccgcttcgcgcgtccgctgtccgtggagcgcgcgacggagctgctgggcggcgcgccgggcgtggccctctcggagatcccgacgcccctggaggcggccggcaaggacccctcgttcgtgggccgcatccgcgcggacgagaccgtcgacaacggcctcgcgctgttcatctccaacgacaacctccgcaagggcgccgcgctgaacgccgtacagatcgcggagctggtggcggccgagctgaagggc

SEQ ID NO: 5382 - DNA, 537 bp, Streptomyces avermitilis
  CDS (1)..(537)
gtggctgtgctgcgcagaatggcgcgccgtgcccagggggcgtacgccggtgcggacgatcccctggacgcggctcaggaacggcgggtgcgagcggtgctcgcgctcggcggggtgccgcaggcggacctgccggacggggtgcagcaggtccgtctgcggctgctggagcgggtggcccgcggggacgaggcaccgcgtgacgtctccgcgtgggcggccgtggtcgcctccaatctggcgatggactggcaccgggccaagcgccgccaggagcggctgggggagcgcctggcctcgctgcggcagctggagcacccctccggcgaggactccagcgtgctctcgctcgccgtcgcgcagggcctggacgagctgcccgacgcccagcgccaggtcctcgtcctgcgcttctacgccgacctgcccgtgcgcgggatagccgaggagctcggcatccccgagggcacggtcaaaagcaggctgcacacggcggtccgcgccctgcgcgaccgtctgcacgaggacgaggtggtg

SEQ ID NO: 5383 - DNA, 750 bp, Streptomyces avermitilis
  CDS (1)..(750)
gtggccgagaacgagagcgacgcgggcgagcgggccgtggacgcgctgatggccgcgatcaccgacgagccgctgcccgcgggggcggagaccgacggtgcgctgatggcggagcaccgggcggcgctggcggacgtggcggtgctgcgggagcagctggggatcatcggagccgcgctcgcggagccggagggagcagcggaacggccggcaccggtaccggcgcccagggagcacgcgggccgtcccccgggccgtcccggcaggcgctcccggcgccccgccgcccgggccgtcgccttcggcaccctggtcgcggccgccgtcgccggtgccgtcgtcgggatgggatggctcgccgcgtccggcggggacggggtctccgccgactcgaaggcgagcggcgggaaggcggacgcctcgtcccggaccgcgccggggtacgtcgcctgtgcccggctcatcgtcgaggggacggtggcggacgtggagccggtgcccggtgccgaccaggaccgcatcgccctcgccgtcgaccgctactacaagcccgccgccggcaaggaccaggtcaccttcgtgatggaccacgacgtcgacccacggctccaccagggcgaccacgtgctgatcggcatcccgcgcgactccgcggtgcccgacatctggaccacgggcgagaaggacatcgcccatgaacgcgcctggatccgcaaggcgttgcccgagtcgcggaacctcatctgcgaa

SEQ ID NO: 5384 - DNA, 3303 bp, Streptomyces avermitilis
  CDS (1)..(3303)
atgacccccgaccctcagcccgctccgacttcgggcgcgagacgcgtggcccgcatagccgtggccgcaggcctggtggccgcgctctccgcggccgggccgatacccatggccctcgccgcggaccacgcccccgccacacccgacccgggcaccaagtccgcgacggccaagctcggttcgaacgacgcggacctcctcgccgaggccaaggccgacggcgcgaagaacgtcacgatgatgatcgccaccgcggccggccagaccgagcaggtcgccgaccagctggacgcggtgaagggcggctccgtgggccgcgcctacgacaagctgggctacgtccgcgccaccgtcccgacggccaaggccgacgcggccatcgccgccgccgcgaagctctcctccgtgcacggcatcgacctgcgccaggagatcgcgctcgacgacccggcgccgagcgccgacacggccaagggcgcgtcctcgaaggccacgggcacgtactccggcccgtccaagagcacccccgccgagaacccgtacaacccgtccttcgagacgggcgccgtcgacttcgtgaaggaccacccgaaggcggacggccggggcatcaccatcggcgtcctcgactcgggcgtggacctcggccacccggcgctccagaagacgaccaccggtgagcgaaagatcgtggactgggtgacggccaccgacccgctcctggacagcgacgccacctggcgcccgatggtcacctcggtggccggccccacgttcacctacagcggcaagacctggacggcgcccgcgggctcgtaccagatcagcacgttcaaggagtccgcgacgaccggcggcgacgccaagggcgacgccaaccgcgacggcgacaccaccgactcctggggcgtcctctacgacgccgcgaccggcaaggtcaccgtcgacctgaacaacaacgccgacttctccgacgaccagccgatgaagccgtacaaggacggccaccagatcggctacttcggcaccgacgacccgacgacggacgtcgtcgagcgccagccgttcgtcgtggagatccgcaaggacgtcccgatggacccgctcggcgggacctgggtcggcaagaaggccgacttcgtcaacatcggcgtcatcgagtccgagcacggcacgcacgtcgccggcatcaccgccgcgaacggcctgttcggcggcaagatgaacggcgccgccccgggcgcgaagatcgtctcctcgcgtgcctgcacctggaccggcggctgcaccaacgtcgccctcaccgagggcatgatcgacctcgtcgccaaccgtggcgtggacatcgtcaacatgtccatcggcggtctgccggcgctgaacgacggcaacaacgcgcgcgccgagctctacacgcgtctcatcgacacctacggcgtccagctggtgatctccgcgggcaactccggccccggcgccaacaccatcggcgaccccggcctggccgacaaggtcatctcggtcggcgcggccatctccaagcagacctgggccgccaactacggctcccaggtggagaagccgtacgcgatgatgccgttctcctcgcgcggcccgcgtgaggacggcggcttcacgccgacgctgaccgcgcccggcgcctcgatcaactccacccagacctggctgccgggctccccggtcgccgaggcgggctactcgctgccggccggctactcgatgctccagggcacgtcgatggcgtccccgcaggccgcgggcgcttcggcgctgctgctgagcgccgccaagcacaagggcatcgagctgacgcccgccaccctgcgcacggcgctggcctcgaccgccgaccacatcaagggtgtgcaggcgtacgaggagggcgcgggcctcatcaacatcgtggacgcgtgggagtccatcaaggacgacgccacggcgcacgactacaccgtgaaggcgccggtcgacaccgcgatcgacgacgcgttgaagacgccgggcttcggcacgggcctgtacgaccgcgagggcgggctcaaggccggtgacaagaagacgtacgacgtcaccatcacgcgtacgtccggcgccgacagggcgatccggcacgagctgtacttcgagaacaacgccgccggtaccttccggatcgtcggctcggacgaggtcaagctcccgctgaaccagccggtgaccgtcaaggtccaggccgccccgaagtcggccggcctgaagagcgcgatcctcgaggtcgacgacccgcgcaccgagggcgtcgacaagcagatcctgtcgaccgtcgtggtctccgcgccggtcaagtacacgtactccgcgtcgggttcggtgcagcgcaacagcaccacgtcgtacttcgtcacggtccccgagggcgccaagtccctcgaggtcgcgatcggcgggctgaaggacaagagccagacccggttcatcgcgatccacccgtacggcactccggtcgacaacaccggcaccccgtactgctacccgaactacctcgacggcaacggctgcaagcccgacgtgcgcgcgtacgcggacccgcaggccggcgtctgggagatcgaggtcgagtcgcgccgtacgtcgccgctgctcgacaacccgtacaagctcgacgtcgccgtgctcggcgcggccttcgacccggcggtcgtgaccgttcccgaggccaaggtcggcaccccggccgccgccgcctggaaggtgacgaacaacttcgccgcgctcgacggcaagctgaagggcggcccgctcggttcctcgaagaacgcgcggccgaccatcgccgagggcgcgacgcaggtcaccacggtcgaggtgcccacgggcgccaagtccctcgacgtcgccatcggcaaggtctcggacgcggccgccgacctcgacctgacggtgaagaacgccgccgggacggtcgtcgggtcgtccgcggacggcgactccgaggaggccgtctccgtcgcctcgcccgccgccggcacgtacaccatcgaggtcgcgggctactcggtcccgtcgggctcgacggcgtacgactaccaggacgtgttcttctcgtcctcgctcggccaggtcacggtcgacgagtccgcgccggtgaagctcggcacgggtgactcggcgacggtgtcgggctcggtcaccgccgcggccgcggcgccggagggacgcgagttcttcgggcaggtccagctggtgaacgcgcgcggcacggtcgcgggcctgggcagcgtgaagatcgagaaggtcacgccg

SEQ ID NO: 5385 - DNA, 534 bp, Streptomyces avermitilis
  CDS (1)..(534)
atgtccgtcacccgtgacccgcgtccgctgaccggtgagccggtctcgctcgatctcctcaacacccggtggaatcgcgagggcgcgacgcaggacctgctgacggacacggacgggctggcggtgtggctggccgcgaacgcgctcgacttccccgccgacgacacggtgctccggcatgtgctccaggcgcgggacgcgctcgcggcggtggtggacgggtctctcgacgagggggccgggcgggtcgacgccgttctcggtcacgggcggatccgggcgaccctgaccgccgaagggcccggcgagagcgtcgagttcgaggacgcgtcctggggaccggcctggctcgccgtccgcgactacctgaagctgctgaacaccgcccccgaccgcatccgccactgcgcccacgacagctgcatcctgcacttcttcgacacctcgcggaacggcacgcggcgctggtgctcgatggccgcctgtggcaaccgtgcgaaagcgtcccgccactacgcgcgcacaagagaggcc

SEQ ID NO: 5386 - DNA, 450 bp, Streptomyces avermitilis
  CDS (1)..(450)
atggcactccgcaccggccacgtcggcctgaacgtcaccgacctcgaccgctcgctcgccttctaccaggtcgcgctcggcttccggctgctcggcgagagcaaggaggaggaccgcaggtacgcgttcctgggcgccgagggcgaggacgaccgcccggtcctcacgctctggcagcaggcgcaggggtcgtacgacaccacgcgcgccggcctgcaccacctcgccctggaggtggacagcgtcgaacaggtgagggcgtacgagagctccctgcgcgcctacggggtggagttcgcctacgagggagtcgtcgcccaccgcgagggctcggcgtccggcggcatcttcttccacgaccccgacggcacccgcctggagatctacgcgccgagcggcacggacggcgcgccggccccctcggcgaccgctccgacgtgcggattcttc

SEQ ID NO: 5387 - DNA, 879 bp, Streptomyces avermitilis
  CDS (1)..(879)
atgacgtaccactcaggctcgcgcgccgtacaggaccgactcggcgtccgggagttcgccgatcatgtgggccggggcatcgggcagggcatccggccggtggccgccgccttcctcggactccagccgctgctggtgctgggcgccgccgacccggcgagcggtgcggtgtgggcctcgccggtcacgggcgagcccggattcgtacgggccacgggcccccggcagatctcggtcgccggcggagtacggccggacgacccgctcgcaccggcgctcgccgccgagggcacccccgtcggcacgatcgccctcgacccgcgcacacgccgccggatgcgcctggacggccacgcccgcccgacaccccgcggcttcgcgatcacggccgaccaggtcttctccaactgcccgaagtatctgcagaggagggagtcgtacgagcgcctggaccgcgcaccgaagccggcccggcggtccaccgaactgaccgcttcacaaagcgagttcgtcgcgaaggccgacaccttcttcctggccaccgtgcacgaacacggcgcggacgccagccaccggggcggcaaccccggcttcgtacgcgtcgattcccccggcgagctgagctggcgcgactacccgggcaactcgatgttcctgaccctggggaacctgtcgctggacccccgcgccggactgctcttcctggactgggaatccggcacgaccctccagctcacgggcacggcgagcacggagttcgccgcggacggggagcgcacggtccgcttccgggtgaaggaggccgtcgagaccccgtccgcactgcccctgcgctggtccgcccccgcatactcccctgccaatccggagccggcacgc

SEQ ID NO: 5388 - DNA, 456 bp, Streptomyces avermitilis
  CDS (1)..(456)
gtgcgcaagaacttgagggtggcggcctacgccatctgtgtccgcgacgggaagctcctgctcgcccgggcgcaggaccccgacggcaagcccgagtggaccctgcccggcggcggcatggagcacggcgaggacccctacgacaccgtcctgcgggaggtggaggaggagaccggctaccacatcgaggtcaccgggctgctcggcgtggactccgtccggcgcacgttcccgcgccgcctgcggacccccaccgaccaccacggcgtacggctcgtctacgaaggacgggtcgtcgggggcgaactgcgcccggaggtgggcggcaccaccgacctcgcggcctggcaggacctggacgccgtacccgggctgccccgggtcggggtggtcgacataggcctcgcgctgtggcggcggcgtccggtcacgggacgggtcgcccgcccggcaaaa

SEQ ID NO: 5389 - DNA, 1788 bp, Streptomyces avermitilis
  CDS (1)..(1788)
atgtcgcgcatacgctctgtcgctgccgccactgccaccgccgcccatgccgctgccggcgccctggaccgccgctcgctgctcgccgccaccggagcggtgtccctctccgccggtctcggcttcgccctgcgtcccggctccgaggtgcccgcacccgcccacgccgccacgggcgaggcactcgccgtgtcccgccaggcgccggccgcgccactcgccccgtacacccggggcaccaccctgagcagcgtcgccgccgcccggtccggctcctcgggctaccggcggctcggcgacggcgccgcctggaagcgcgtcgtgcgcggcgacctggccacgcccaaggcgggccgcgcgggacggcgtacggccctcgcctccttcgtgcagttcaccgacctgcacctggtcgatgtgcagcaccccctgcgctacgagtatctgcgctcccagaccgccagcgcctggcgcccgcaggagtccctgtcggtggccggcgcggtctcgctcgtcgagcgggtgaacgcgctgcggggtgcccccgtcaccggcaccccgctgcacttcgtgatgaccaccggcgacaacaccgacaacaactccaagacggagctggactggttcctgaaggtgatgagcggcggcagggtcacccccaactccggtgacccgcgccactacgagggcgtccagagcagcgggctcaagctctactggcagccggacgcggcgctgcgcgacgccgacaagcagctcggcttcccccgtatccagggcttcctcgcggcggccatccgcgagctgcgcagcccgggcctgaacctcccctggtattcgacggtcggcaaccacgacgccctgcccggcggctgctacgcgcccggcgactcctacttcgccgaggtcgcggtcggcggcaagaagctgatgacgctggaccaggcggccggaaaggcgatctgggacaacgtgaagaagggcggcgaccccaagggcgtcgacttcaaggcgatgctcaagtcccaggccagacacatgcgttcggtcaccccggacgaggcgcgcgcgcccttcaccccggccgagtacctcaaggcgcacctcgaccccgcgcacacgggcccgggccccatcggccacggctactcggaggccaacctctccgcgggcacccagtactacgtcttccgcatcgccgacgacgtcctcggcatcagcctcgacaccaccgacccgggcggccactacgagggctcgatcggcaccgcacagctgaagtggctggagaagacgctgcgggacaacaaggactcgtacgtcatcgtcttcagccaccacaccagcaagacgatgcgcaacctcaacacggaccccgcgcacccgggcgagaagcgccacggcggcgccgaactggtctccgtcctcggcaaccaccccaacgtcgccgcctgggtgaacggccacagccacaagaacgacatcaccgcgcacgcggcgccgaacaagggctccaagggcgccttctgggagatctccacggcctcgcacgtcgacttcccccagctggcccgcatcatcgagctggtggacaacaaggacggcacgatctccctgttcaccacgctgatcgagtcggcggccccgcaccgcacggatttcgccgacctcacccagacgggcctggcggcgctctaccgggaactgggcttcaacgcacccggcgcccggtcgacgctgtcgggcacggcggaggaccggaacacggagctcgtcctgaccaagggc

SEQ ID NO: 5390 - DNA, 1221 bp, Streptomyces avermitilis
  CDS (1)..(1221)
atgacaaccatctccctcgtccaaccatcgacggcaccggccggtacgcaggtcacgatcgtcggcagcggcttcaccggtgcgaccgccgtgaagttcggcgccaccaacgccacgagcttctccgtgctgtccgacaacgtgatcacggccgtggtcccgcccggcagcggatcggtcctggtcaccgtggtggcacccagcggcaccagcaacggcgtcagcttcgcctacaccgtgccggtcatcacggtcatcaatcccacgtcgggaccggctacgggcggcacgtcggtcacgatcataggcaccggcttcaccggcgccaccgccgtgaagttcggcgccacgaacgccacgagcttcaccgtgctgtccgacaacgtgatcaccgccgtgtctccaccgggaaccggcacggtccaggtcaccgtggtgacacccagcggcaccagcaacggcgccacgtacaactacgtcccgaccctgaccagcctgagtccggcctcgggccccgccgcgggcggcaccgtggtcaccctcaccggcacgggattcacgggtgcgacggcggtgaccttcggcgggacaccggcgaccagcttcacggtcaactccgacacccagatcacggcgaccgctccggctcacgccgcggggacggcagcggtcacggtcaccggccccgggggtaccagcaactccctcccgttcacctacatcccggtgccggtcgtgatcgcactggcccccgcttcgggaccggccgcgggcggcacgtcggtgacgatcatcggcaccggcttcaccggcgccaccgccgtgaagttcggcgccacgaacgccacgagcttcacggtgctgtccgacaacgtgatcaccgccgtgtctccgcccggagccggtacggtcctcgtcacggtggtgacgcccggcggcacgagcaacggcgccgcgtacagctacaccgggacaccggtaccgacgctgaccagcctgaccccgacgtcgggtccggccgcgggcggcaccgtggtcaccctcaccggcacgggattcaccggcgctacagcggtgaccttcggcggcacaccggcaaccagcttcaccgtcgactccgccacccagatcacagccaccgccccggccggcaccgggacggtacaggtgcaagtcaccacccccggcgggaccagcaacaccctcgcctacacctacgtc

SEQ ID NO: 5391 - DNA, 207 bp, Streptomyces avermitilis
  CDS (1)..(207)
atgcacccgcgccccactgcacccgaaatcgtccctgagcaggcctggttcaggtcgtcctacagcgacgccggccagaactgcgtagaaatagccgcccccacccccggtaccgacatcgccatccgcgactcgaagaacccgaccggcccctccctcctcgtaccggccgcggcgtggtccgccttcgtcacgggcatccgtacg

SEQ ID NO: 5392 - DNA, 885 bp, Streptomyces avermitilis
  CDS (1)..(885)
gtgcacatggcagcgaagcgcgggcggacggcccagcggctcgaactcggcttgcagttacgccaactacgagaaaactgcgacgggggcgaccgaggcgtcggcctcacccgcaagcaagcggttcagggactgcgcatttcggaagcgtctctgcaacggatcgaaacgggatctctgaacttccggtttgtaggcgacctgaggaagctcctgacgaagtacggcgtcaccgacgaggacgtcgtcgactcgctgatcagcctcaaccgggagtccaaccagcaggactggctgacgcagtaccggggcctgatgccctcggggatgccggggttcgtcggactggagccggaggcacacgccatgaaggcctatcacccgacgctggtgtacggccttttgcagactgagcgctacgcccgtgccgtgcacgaggtgcaaaagccgatcgaggagtacaccacggagttcatccgaagtagcgtggagctgcggatgaagcgccaggaggttctcacccgggagagccccgtcaagctgcacgtcatcctgggagaagcagccttgcggtatccgatcgggggcgctgaggtgatgcgcgaacagtgcgcgcggatcgaggagttgtcggggtgggaccacatcaccgttcaggtgctgccgttccgcccgagctaccgctcgatcaacgacttcgcgatcctcgacttcggcaacaatctgccgccccgggtccaggcggacagcgcctggggctccgtctccacctcggacaagccccgtgaggtcgaccgcttcagccgccggttcgacaccatgacagcgtcggcgctgccgcccgaggacacccccgagttcctccaccgactggaacgagagctg

SEQ ID NO: 5393 - DNA, 525 bp, Streptomyces avermitilis
  CDS (1)..(525)
ttggacacattgcggatgaagggaccccacatgcccacccccgaaccccccaccctcctcgcccacgactggagcatgggctaccccatgaccctgcgtagtgtccggctcgcccggcttcacgtccgtcggcggctgacgatgtggcagtggggcggcgatatcgacgacgccgtgctcgtggcgtcggagctcgtcgccaatgccgtacggcatgcgcgtgtggttgggcgcgaattgtgggtgcggatcgccgagttggagggagatgggctcctcgtcgaggtggcggatcctgtgcgggcgtttcccgaggttgccgccgaacccgacggcgagggcggtcgtgggctcctcgtcgtgcggcacctcaccgccgaactcgactggttcctccgcgccgatgtcggcaagactgtacgcgcccgtttcgccccgcacccgcaccagaactcggacccgcacccgcacccgcacgcacgaggaggggccgccggcggaccggtgacccctccactcccctcc

SEQ ID NO: 5394 - DNA, 747 bp, Streptomyces avermitilis
  CDS (1)..(747)
atgatcacgggcctggcggcactggcgctgcacggcttcgcgtcggcgccgccgtttccgtccctcgacaagatcgacgtactggtgccgaagccgcgccggctgcgctcgacgggctacgcgcggatcgtccgcgcctccgcgctgccggacgcgtccgttgtcgcgggcgtgccggtggccccggtcccgcgcgccttggcggacgcggtggcggagttgtcggacgcgggtgtcgtacgccggctgctgacggaggcggtacgcgcgggccactgcgaaccggcgtccgtggtgcgggagttgacgcaggcgcggctgctggggcgcccgcacgtggtggacgcggtggactcgctgctggcggagggccgggcgatcgcggagggccgcctgtaccggatggtccgcgagcacggcctgcccgacccggtgtggaacgtcgatctgcggctacccggagggccccctctcgggggcctggacgcgtactggccggaacaggcggtggcggtggaactggacacccgggctccgcgccagggccatcggcaggacgccgaggacgcgtcgtggtcggagtacgcccgcaagcgcgagcttctggagcggctgggcatcacggtcgtccacatcaccccgaagaagctgagggacgcgatggaacagcaggcggcggtgatccgtacggccatgatggcgtccgaggaccgggatccggcggcacacgtcgtggtgcttccccga

SEQ ID NO: 5395 - DNA, 2505 bp, Streptomyces avermitilis
  CDS (1)..(2505)
gtgtccctcgacctgcgctccgccgtcggggacagggacgacgagcgcgcgccgcgcaccttccgctcggtcaccacgatccgcttccgctgcgccgagccgggcgccacgagcttcgccgacctcatcgcgccgagcgtcacggccgtctcgctgaacggcagggacctcgacccgggggaggtcttcgacggcgcccggatcctgctggaggacctcgccgccgagaacgagctggtggtcgatgcccagtgcgcctactcccgcaccggcgagggcatgcaccgcttcgtcgaccccgaggacggcgaggtgtacctctacacgcagtacgagcccgccgactcgcgtcgcgtcttcgccaacttcgagcagccggacctcaaggcccccttccgcttcgaggtccgggcgcccgagggctgggtcgtgtggagcaacggggtcggtgaactgaccgacggcgtatggaggttcgccgagaccaagccgatctcgacgtacatcacggcggtcgtggcgggcccgtaccactatgtgaccgactcctactcccgcaccttcgacgacggtacgacgctggagatccccctcggcgcgatgtgccgcaagggcctggccccccacttcgactccgacgacgtgttcctggtgaccaagcaggggctggacttcttccacgaccacttcgactacccgtacccgttcggcaagtacgaccaggcgttcgtgcccgagtacaacctcggcgcgatggagaacccgggactcgtcaccttccgcgaggagttcatcttccgcggcaaggtgacgcaggcgtcgtacgagggccgggcgaacgtcatcctgcacgagatggcgcacatgtggttcggcgacctcgtcaccatggagtggtgggacgacctgtggctcaaggagtccttcgccgacttcatgggggcgttctcgctggtcggcgcgacccgcttcaaggacggctggatcaccttcgccaaccgccgcaaggcgtgggcctaccgagccgaccagctgccgtccacccacccgatcacggccgacatccgcgacctccaggacgccaagctcaacttcgacggcatcacgtacgccaagggtgcctccgtgctgaagcagttggtggcgtacgtgggccgggacgcgttcctggagggcgcccgccgctacttcaagcgcaacgcgtacggcaacacccgtctcggcgacctgctgtcggtgctggaggagacctccgggcgcgacctggcgacctggtcgcgggcctggctcgagaccgccggggtcaactccctcaccccgcaggtgatcctgagcgcggacggccggatcacggagctgtccgtcctccaggaggcggccgagtcccaccccgaactgcgcccgcaccgggtggcggtgggcctgtaccgcagcgaggcgggtgcgctcacgcggtacgcgcgggccgaggtggacgtgttcgggccgcgtacggtcgtgggcgagctggccggcagcgcggcaccggacctcgtcctggtcaacgacgacgacctgacgtactgcaagatccgcttcgacgagacgtcgctggcgacgctcaggtcccatctcggcgacatcacggacccgttggcgcgggccctgtgctggtcggcgctgtggaacctgacccgggacgcgctgatgccggggcgggacttcatcgatctcgtactccgtttcgcgggccgggagtcggacatcggcgtcctccagatgctgcacgcctgggccaactcggcgctgacgttctacgcggcaccggagtggcgggagaccggcgcgcgcctgctggcggacggcgcgctgaaggagctgcggctcgccgaacccggcagccagcaccagctcacctgggcgcgtttcttcgcagcggtggcgtcgagcgaggccgatctccagctgctccagggcctgttggagggcacggcgaagatcgacggactggacgtcgaccaggagctgcgctggacgctcctggaacccctcgccgcccacggcacggcggacgagagcgtcctggccgccgaactggcccgcgacgacacggcctccggcaagcgccaccaggtccgctgcctggccgcacgcccctcggccgcggtcaaggcgcaggcgtgggcctcggtcgtggagtcggacgcgctgtccaacgcgctggtcgaggcgacgatcgccgggttcacgcagccgtctcagcgggagctgctggcgccgtacgcggcgaagtacttcgcggcgatcgaacgggtgtggacggagcgctcgatccagatcgggatggacgtggtgaagggcctgttccccgcgctccaggactcgcaggagacgctggacgccacggacgcgtggctggcggcgcacgagggtgccgcaccggcgctgcgccgactggtcctggaggcacgggacgacctggcgcgcacgctgcgcggacaggcgtgcgacagggcggcggccgtg

SEQ ID NO: 5396 - DNA, 636 bp, Streptomyces avermitilis
  CDS (1)..(636)
atgtccgagaagacccctgtcgacttctggttcgacccgctgtgcccctgggcctggatgacttcacgctgggtgctggaagtggagaaggttcgggacatcgaggtccgctggcatctgatgagcctcgcggtgctcaacgagccgaagctggacgagctgcccgaggagtaccgcgagctgctggagaccaaggcctgggggccggtacgggtcgtcatagcggcccagcaggagcacggggccaaggtgctcggcgacctctacacggcgctcgggacccgcttccacaaccagggggagggccccacgaaggaggccgtcgccgccgccctggacgaggtcggcctgccggcgtcgctcctcgaccactgggactccaccccgtacgaggccgagctgcgggcctcgcacaaggagggcatcgagaaggtcggccaggacgtgggcacgccggtcatcgcggtccccggcgccgacggtgagcagatcgccttcttcggcccggtcgtcaccccggcgcccaagggcgaggaggccgccaagctctgggacggcacgctcctcgtcgcctcggtcccgggcttctacgagatcaagcgctcgcggtcgcaggggccggacttcagcaacctg

SEQ ID NO: 5397 - DNA, 639 bp, Streptomyces avermitilis
  CDS (1)..(639)
atgcccgtctacacactccctgaactgccgtacgactactccgcgctcgcgcccgtgatcagccccgagatcatcgagctgcaccacgacaagcaccacgcggcctatgtgaagggcgccaacgacacgctggagcagctcgcggaggcacgcgacaaggagtcgtggggctcggtcaacgggctggagaagaacctggccttccacctctccggccacatcctgcactcgatctactggcacaacatgacgggcaccggcggcggcgaaccgctggccgcggacggcgtgggcgacctggcggacgcgatcacggagtccttcggctcgttcggcgcgttcaggacgcagctgtccaaggcgtcggcgacgacgcagggctccggctggggcgtcctcgcgtacgagccgctgagcggccggctgatcgtcgagcaggtctacgaccaccagggcaacgtgggccaggccgccacgccgatcctggtcttcgacgcctgggagcacgccttctacctccagtaccggaaccagaaggtcgacttcatcgaggcgatgtggcaggtcgtcaactggcaggacgtggcccgccgctacgaagcggccaagtcgcgcacggacgtcttgctgctcgccccc

SEQ ID NO: 5398 - DNA, 1386 bp, Streptomyces avermitilis
  CDS (1)..(1386)
atgtcctcccgcaccacccttgacacggcaccggagacatccgctgccgacgcccccctgtcccacggcctcaagcagcgccacctgtcgatgatcgctctcggcggagtgatcggcgcgggcctgttcgtcggctccggcgcgggtatcgccgccgccgggccgtcgatcgtcatcgcttactcggtctccggcctgctcgtcatgctggtgatgcggatgctaggcgagatgtcggccgcctatccctcgtcgggctccttctcggcgcacgccgagcgggcgatcggcccctgggcgggcttcaccgccggctggtccttctgggtgctgctgtgcacggccgtcggcctggagggcatcggcgccgcgaagatcgtcaccggctggctgcccggcactcccgagtggggctgggtggccctgttcatggtcgtcttctgcgtggccaatctcgccgccgtgaagaacttcggcgagttcgagttctggttcgcggcgctgaaggtcggcgcgatcagtctgttcctggtcctcggcgtgctggccatgaccggagtgctgcccggcacggactctccgggcgcctcgaacctccacgacttcctgccgaacggcagcgagggcctggtcatcggtctgctcgcgtcggtcttcgcgtacggcggtctggagaccgtgacgatcgcggcggcggagtccgagaacccggtccagggcgtcgcgcgcgccgtgcgcaccgcgatgtggcgcatcgcgctcttctacatcggctccatggcggtcatcgtcacgctcgtcccgtgggactcgaaggaggtcgtcgagaagggcccgtacgtcgccgccctcgaccacctgggcatcccgggcgccggtcagctgatgaacgtggtcgtgctggtcgcgctcctgtcggcgatgaacgccaacatctacggctcctcacgcatcgcctactcgctggtggagcgcggacagggcccgaaggcgctgggccgggtctccgggggcgtcccgaggatcgccgtactggtctcctgcgtgttcggcttcgtgtgcgtggtcctcagctactggcggccgaacgacgtcttcccctggctgctgaacatgatcggcgcggtcatcctggtcgtctggatcttcatcgcggtctcgcagctgctgctgcgccgcaaggtcgagcgagaggcaccggagaagctggtcgtgcggatgtgggcgtacccggtgctgacctgggtggccctggcgggcatggcggcgatcttcatcctgatggcccggcagccggacacccgcgtacagctctactcgacgggcgccatgacgctggtcctggccgccgtcggctacgcctggcagcgggcacgcgcgcgggcc

SEQ ID NO: 5399 - DNA, 897 bp, Streptomyces avermitilis
  CDS (1)..(897)
atgaccgccatcgagatccgcaaggtcaccgcccacatcggcgcccaggtgtccggcgtcgacatcggcaaaccgctcgacgaggagaccgtcaccgccctgcgtgacgcgctgaacgcccacaaggccctggtcttcgacgacgtcgacctggacgacgcgggccagcaggccttcgcccgccacttcggcgcgctcaccaccgcccaccccaccgtgcccgccgtggaaggcgccccgaacgtgctgcccgtggacagcgagcggggccgtgccaaccactggcacaccgacgtcaccttcgtcctcaacccgccgcaggccagcaccctgcgcagcatcacgatcccgccgtacggcggcgagaccctgatcgccaacgcggcggccgcctaccgggacctgccggagccgctgcgcgccctcgccgacacgctctgggccgagcacaccaatgactacgactacgcggttccggacgaggcggtcgacgaggaacaggcccgccagcgcgcccagttcacctccatcacctaccggacggcgcaccccgtcgtccgcgtccacccgctgaccggcgagcgcggtctgttcatcggcggcttcgcccagcggatcgtcggcctgtcgacgggcgagtcccgcaagctcctcgacctgttccagtcgtacgtcacccggccggagaacatcctgcgctggcgctggtccccgaaccagctcgtcctgttcgacaaccgcatcacccagcactacgccatcgacaactacgacggccggccgcgccgtctcaaccgggtgaccgtcgccggcgacgtaccggtcggcatcgagggcaaggagagctactcgatcgcgggcgacgcctcgcactacacgccggtcgcggtcgcggcg

SEQ ID NO: 5400 - DNA, 1359 bp, Streptomyces avermitilis
  CDS (1)..(1359)
gtgaccgccccgcgccagctccacctgaacgcgttcctgatgaacaccggccaccacgaggcctcctggcggctgcccgagagcgacccgtacgcgagcgtcgacctcgcgcactacgtcgaactggcccgtatcgcggaacgcggcaccttcgactcgctgttcctcgccgacggtccggtcctcttcaaccgcgtcggccagcgcccctccggcgccctcgaacccatcaccctgctcaccgccctggccaccgccaccgagcacatcggcctgatcgccaccgcctcgacctcctacaactccccctacaacctggcccgcagactcgcctccctcgaccacctcagcggcggccgggccggctggaacatcgtcaccaccgcgggcgccgaggccgcccgcaacttcggtctcgacgaggagcccgcccacgccgcccgctacgagcgtgccgccgagttcctcgacgtggcgctgaagctctgggacagctgggaggacgacctgatcgtcgccgacaaggcggcgggcgtgtggggggacgaccgcaagatccatccgccccggcaccaggggccgtacttccgtgtcgagggcgcgctcaacgtgccccgcacaccgcagggttaccccctcctcgtccaggccggctcctcggacgacggcaagcggttcgcggcccggtacgcggaggcggtcttcaccgcgcagcagacgctcaaggacgcgcaggacttctacgccgacctcaagtcccggacgcgggaggccggccgcgatcccgaccacgtcaagatcctgcccggcatcgtcccggtgatcggttccaccgaggccgaggcacgccgaaacgagcaggtcctggaggaccacatcgtccacgagcacggtgtcgagcgcctcgaacaccttctgcacctcgagcccggcacgctccggctcgacgccccgctgcccgccgatctgccgccggagagcgccatcgagggggccaagagccgctacaccctggtcgtggagctggcccggcgcgaacggctcaccgtccgcgagctgatcggccgcctcggcggcgggcgcggccatctcacgttcgccggcacgcccgagcaggtcgccgacgccatcgaggagtggttccggcacggcgccgccgacggcttcaacatcatgcccgccgtcctgccgtccggcctcggcctgttcgtcgaccacgtcgtgccgatcctccgcgcccgcggcctgctccgcacggagtacggcccgcgccggaccctgcgggagcgctacggccttccgcgccccgccaaccagtacgccaccgcactctccgcactctccgcactcgccacccgc

SEQ ID NO: 5401 - DNA, 750 bp, Streptomyces avermitilis
  CDS (1)..(750)
atggcgacgcacactgagcaactgacccgtcctgccgtccggctccagggcctgacccggtccttcgccgaccgtacggtcctcgacggcatcgacctcgacctcccggccggacagttcacggcgctgctcggccacagcggctccggcaagagcaccctgctgcgcgccgtcgccggactcgaccacgaggtcaccggcagcgggcagctgaccgcccccgagcgggtgtccgtcgtcttccaggactcccggctgctgccctggcgccgcgtcctcgacaacgtcctgctcggcacggacggcaaggaggccgccgaacgcggccgggccgccctcgccgaggtgggcctcgccggacgcgaacgggcctggccgggcgagctgtccggcggcgaggcccagcgcgccgcgctggcccgctcgctggtccgcgaacccgagctcctgctggccgacgagccgttcggcgccctggacgcgctcacccggatccggatgcacaccctgctgcgcgagctgtgggaacgccaccggccctccgtgctgctcgtcacccatgacgtggacgaggcgatcgtgctcgccgaccgcgtcctcgtgctcgaacggggccgcatcggcctcgacctgaccatcgaccgcccgcacccgcgctcctaccgcgacccgctcctcggcgagtaccgcgaacgcctgctcaccgccctcggtgtcacggagcaccagggcgcccaggaggaccaccag

SEQ ID NO: 5402 - DNA, 870 bp, Streptomyces avermitilis
  CDS (1)..(870)
atgaccaccaccgatgtgccgacagccacggcgcccaccaccaccgaaccccgccccgcgcccgccgagaagtcccgccgggaccaacggatcaggcgccggaccctcgcccccggcaagcgcctgcccgcctcgcgcctcatcggccccgccctcttcctcgccctgtgggccgccgcctccgccgccggacagctggaccccggcgcgatcccggcgccctggacggtgctccgcaccacaggtcagctgtggagcgccggcacgctccccaccgacgtactgacctcgctggaacgcgccgcatacggcttcgccctcggcctgagcgccggggtgctcctcgccctcacggccgggctcagccgggtcggcgaggcgctgatcgacgggacggtgcagctcaaccgggcgatcccgaccctcggtctgatcccgctgttcatcctctggctgggcatcggcgagaccttcaagatcgcgatcatcgccatcgtggtctacatcccgatctacctcaacctgcatgccgcactgtccgggatcgaccaccgcttcgtggaactcgccgaggtccaggggctgtccaggctccggttcatccgcgagatcgtcgtccccggcgccctgcccggattcttcgtgggtctccggctcggggtcaccgggtcctggctgtcgctggtcgttctggagcagatcaacgccaccagcggcctcggctacatgatgttccaggcccagaactacggccgtacggacatcatcctcgtcggcctgctgatctacggcgtcttcggcctggcctccgacagcgcggtccgcctcttcgaacggagggtgctgtcatggcgacgcacactgagcaac

SEQ ID NO: 5403 - DNA, 1071 bp, Streptomyces avermitilis
  CDS (1)..(1071)
atgccacctctgtccccgtccacgcccggcgtcgaccggcggctctttctgacctccctgctcggcgccacggccgccgccgccggactgagcggctgcgcggacagcagtgccgccgccgccaagggctcatccccgtccgccccgctggccacgaagatcccgtccggtacgagcctgaaaatcgcctcgtaccagaacgtccagcaaacccagttcaggctcgcgggcctgtccaagctgccgttcacggtctccagttgggcgaacatcggcgcgggacccgatgtcatcaacgccttccgcgccaagtcgctggacgtcgccaacaacgcgggcattccgccgatccaggcgcacttccagggattcgacgcgaagatcgtcgcgatcaacatcacccgcaagcccaattacgtcttcgccacgaaacccggcagcgacatccggacggtcgaggagttcaagggcaagcggctggcgttctcgcaggggcaggcgcagggtgtggtcctgctgcgcgcgctgaagaaggccgggctgaagtacgacgaagtggacctggtgccgctgaccagcaaccagttcctcaccgccctccaggccggccaggtggacatcgccccgctcgccaaccagcagtccccggcctacctcaagcagtacggctccaagggcgcccacaccatccccaccgacgtcgtcgacctcctcaacctgctgtgggcgccgacctccgtgctggccgactccgcgaaggcggccgcggtcgccgcgtacatcccgcgctgggccaagggccaggtgtgggcgtacgagcaccccgaccagtggaacaaggagttctacgtcaagacgcagaacctgaccctcgcccaggccgagtcgatcaccaagctcgccaacaagccgctgttcccgccgagttgggacgaggccgtcacgtgggagcaggagaccgccgatctgctcgccgagggcggcttcgtgaaggcgttcaaggtcggctcgctcttcgaccgccgcttcgagggcatcgccgcgaaggccgtgccggcggaataccggagg

SEQ ID NO: 5404 - DNA, 1230 bp, Streptomyces avermitilis
  CDS (1)..(1230)
atgccccgtaccgcggcacccactctcctgccccctcagccccctcagccccctcagccccctacgaccgttctgcgggccgccgacagcgcgcgccgcaggaccagcgccagcgcggtcctgcggtccgtgctcgagcacgggccggtcgcccgcagcaccgtcgcccggctgaccgggctctcccccgcgtcggtgaccgactactgcgcccggttcgccgaactcggcctgctccatgaggcgtccgtgccccggcggtcgggcggggtcgggcgtccgcacgtccccgtcgacctggacgactcgcggttcgtcgtcggcggggtgcatgtggcggtgccgtacaccacggtcgcgctgctcgatctgcgcggccgggtggtggccgagcgccgtctgaaacacgaccggaccgagccctccctggtgctggcgcgggccgccgacggcctggccgcgctgctctcggcggcggccgaccgtacgccgctgggtgtcggcgtggcggccgggggctgggtggaccgggactccgggaccatcgtggagcacccgctgctgggctggcgcgacatccccgtccgggacgtgctcggcgcgcacaccggcctgccggtccaggtggacgggcacgcgcgggccctggtcggcgcggagcggctgttcgggcgggcccgcggcagccggagcctgctgcacctgttcgtcggcaatgtggtggacgccgccttcgccaccaacgacgaggtgcaccacggtccccgttcccaggccggcgcgatcgcccatctgccgttgcggggcggtgcggagacgtgcgactgcgggcgtgtcggctgcctccaggtcgagctgagcgagcgggcgctgtgccggcgggcgcgcgcggcgggcctggctgtcggcgtgaacccggtgcgtgtggtcgaggcggcggcgggcggcgacccggtggccgtacggctgctggtggagcgggcccggatgatcgggcgggcggcggggctgctgctcgacattctcaatccggacaccgtcgtggtcaccgagatcgggatcatccaccgggaggactgcctggcggcgctgcgcgaggcggtcggtccgcagcgggcggcggcggtcgtgccgaccagttttccggattcggtgctcgcggtggcgggcggttcggtggctctcgacgtgctgtaccgagatccgctgggcgtgtcaccgggggcgact

SEQ ID NO: 5405 - DNA, 579 bp, Streptomyces avermitilis
  CDS (1)..(579)
atgagcacggctgtcgccagcgccccccgttccggccaggttctcgccgatctgctgcctgcctcccgcgtccgcgatgccgcgctcgtcctgggtggcgccgcgctcaccgggctcgccgcgcagatctcgctgcccgtgcccggctctccggtgccggtgaccggccagaccttcgccgccctcctcgtcggcaccgcgctcggcgccggccgcggtttcctctcgctcgccgtgtacgcgctggtcggcatggccggtgtgccgtggttcgccggcggcggctccggcgccgcggccccgtccttcggctacatcctcggcatgctcctggccgccaccgtcgtgggcgcgctggcccgccgcggcgccgaccgctccgtgctgcgcacggcgggcgcgatgctgctcggcgaggcgatcatctacgcgatcggcgtcccgtacctggccttcgccaccgggatgtccctgaccgccgcgatcgcggccggtctgaccccgttcctgatcggcgacgcgctcaaggccgcgctggcgatgggcgtgctgcccaccgcctggaagttcctcaaccgg

SEQ ID NO: 5406 - DNA, 1359 bp, Streptomyces avermitilis
  CDS (1)..(1359)
gtgagtgtcaggttatgtggccacgatgcgctcatggactcgaacaccgcagacaccaccgaacctctcgccctccggcccgcggaccccggcttcgaggaggaactcgccggtttccagaccggattcacccagcgtcccaccgtggtcttcgccgccgcctcggccgccgacgtggccgccgccgtggcgtacgcggcggccgaggacctgccggtcggcgtccaggccaccggacacggcctgccgggcggcgccgagggcggcgtactcatcacgacgaagcgcatggaccgggtgagcgtcgaccccgtgtcccgcaccgcccgcgtccaggcgggcgtccgctggggccaggtcgtggcggccgcccagccctacgggctcgccccgctcaacggctccgcgccgggcgtcggcgccgtgtcgtacacgctgggcggcggactcggcatcctggcgcgggagttcgggtacgcggccgaccatgtgcgcgcgctggacgtcgtcaccgcggacgggcaactgcgccaggtgacccgggagtcggatcccggcctgtactgggccctgctcggcggcggccacaacttcggcgtcgtcaccgagctggagatcggcctcgtcccggtggccaggctgtacggcggctcgctcgccttcgacgggcgcgaggtggacccggcggccgtgctgcgcgcgtacgagcgctggacgcggaccgtgcccgacgggctgacctcgtccttcgccgccgtcccctacccggacctgccggggctgccgccgcacctgcgcggccggcacgttctctccgtacgcgtcgcgtacaccggcagcgacggcgagcggctcgtcgccccgctgcgggagaccggcccggtgctcgcggactccctccgggtgatgccgtacgccgagagccacaccatccacagcgacccggacttcccgcacacgtactacggggacagcgcggtgctgagcgagctggacgtcgaggcggcggcctcggtgccggccctggccgcagcggacgcccccgtgatgagcgtcgtacagatcaaccatctgggcggggcgctggcgcgccgggcaccgaactccgtaccgcaccgcgacgggcgtttcctggtgcggctgctcgccatggccgaccgggacacggcccgcgaactcctcgacccggcccttgcccggctcgcgccgtggacgatcgggcgggcgctgaacttcgccttcggggccggggaccgtacggaaggcctgtacgaccccgaaacgcggaagaggctcgccgggttgaagtcggaacacgacccggcgaacctcttccgcaggaactacaacctcaccggt

SEQ ID NO: 5407 - DNA, 768 bp, Streptomyces avermitilis
  CDS (1)..(768)
gtggtacctcttcaagtactgcgaattcaggcgcagccaagggggacgaacatgggttctcgtcacatgacggccatcacgggatcgctgctcactgcatctttctcggcagtgatgatcttcgcgtgcaccgccaccgcggatgaccagggaccggcgagcggcaaagggggaaagcccgtcgacgaggcaccggcgggtgtaaagctgaccacgctgctgccctcgaagatctcggtcgacaacagttcgcacaaaacggcgattacggccacggtaaagaacgggggaaccaaggacagcggaaagatcaggcttttggtagccggttttgacggtctcgtggtcaagaacgtcaagggctgcacggcaattgccaaagcggatcttccgccgggttcgaacagcgcattcagctgcgccatcgacaacctcgcggccggcaagtcgacgtcgtacgccgtcgacgcgacgttcgacaccggcaagaccgggaagatctgtcttccggtccagacgagcgacgggaagaagacctactggcagcagggcccggtgccgttcggtacgacgaacccgtcaccgaacgccccggccaccccgctgctgctcggcaccgacaacaagccggtcgcccccggcggtgaccgactggccgacaccggcgtcacggaggacgtcctgccactggccgcggcgggcgtgacgctggtggcggcgggcgcggcgggcctgtggtggacccgtcgccggcccgagccacagccc

SEQ ID NO: 5408 - DNA, 2409 bp, Streptomyces avermitilis
  CDS (1)..(2409)
ttgccgggtaattcgggtggcggtgttccggggttattggtgacgggtcggtatcggctggtcgagagcatcgggcaggggggaatggggcgggtgtggcgtgccaccgacgaaatgctggaccgtcaggtggccgtcaaggaaatgcggatagacggactcgacgcagaggacacgcgcacccgccgcgaacgcacgctgcgcgaggccagggccacggctcggatcagccatccgaatgtcgtgcgcgtctacgacgtggtggacgagagcgaccggctgtggatcgtcatggagctcgtcgacggccgctcgctggagcggatcgtggtggaggacggaccgctcgggccgggggagacggcacgcatcggacgcgaactggtggcggcgctgcggcaggtgcacgcggggggtgtgctgcaccgggacatcaagccggggaacgtcctggtcgagaacctggggcaccgggtcgtcctcaccgacttcggcatcgccgcgatccaggacgccaaggcgctcacgatggtcggcatgctggtcggttcgcccgactacatggccccggagcgggtgtccggccgtccgcagggcccgccgtccgacgtgtggtccctcggggcgacgctgtgcgcggcgctcggcggccactccccgttctcgcgctcgacgaccctggcgacgctgcacgcggtgctgtacgaggagcccgaactgcccacggaggcgggagggttacggcagatcctggccgcgctgctggaaaaggagccttcggtccggcccggcctcgaggaggtggcggcggcactggaggcgctggtggccacggggacgagtgtcgccggggcgggtgatgccggggcgggtgccgccggggcgggtgtcgaggcggcgggtgtcgaggtggccgggtcgggttctggggatggagggaatggaggggatagaggggagggagcggtcggggagcggggggctgggctgggcgccggatcggggggtgagccgggcgccgggtcgggacctgagttgcgggttgggccgggagccgaatcgggagccggggcgggcgcggagtcggaagtcggggcggtgccgcggggagtgcggcagccgggggaggagggcgagcccgagcagggcggaccggacgccggctccggaggccggcggctggaatccccgacgcgcgcgctcctggacacggccctgatccgcgcggcccggacggccccggaggagacgcggccggatgccgatccgcggtggtccgagcccgtccaggacgccataccggggcggcccacccgggccgtcccaccggaggccccgccgacgagggagacgcccgccgtcggacccggccatacggcagtcacccagcccagccactccccggcccccgcccccgctctccccacgccgctcccgttccccgcacaaccccaccaccccgaagcccccctcgtaccccccaccgcgtcccccaccgcgtcccccaccgcgtcccccaccgcgtcccccgccgtgggcaacgcctccaccgaggctccctccgcaggccgtgccgagccgcttgcctcgggagttccggagcgggcgggggccggggagcgcccgtcccgcggcggtgccgctcccggtacgggaagtcacgccgcactggccaacgcggtcaccgcgagccgactgcccgggtggcccggcgccgccccgacgtcgtccccgatgtcgcccggtgaactccccggcccggccctgccgtccgcgcccaggccgccgcgtcaccggcgccgtatggggctggcggcagccggaggtgtcgtcgcggccggtgccgtagccgtcgtcgtcatcgccgcgaccggcggatcgcccggccacgaccgcgacgcgtcctccgccacgtcgtcggcgccgtccgcctcgtccggcgggccctcgcggtcgcccacggtcgacggcacctcacgcccgccgagcttgccgccggggtcacgcaccgaggccgggatgtacgcgtgggttccgcccaagggctggaaacgagtggtgcagagcggcaccgaggtgcactacacctcgcccgacgcccagcaggagatcctggcgaacgcgaccccggcccggggcgacctgctgaagcagtggcaggtcgcggaggaggaccgcgagaagggcctgaactaccggcggatccgcctggagcggaccacgttccgcggcgcgcccgcagtggtctgggagtacaacgtcacggccaaggggcagtactggcacgtaaggctgctcggcttccgcagccgcggcacgtcctacgagctcagcacctggtaccacccggacatcgagggcagcgcggtcccggcctacgaacgggtcaagaagagcttcacgccactg

SEQ ID NO: 5409 - DNA, 1482 bp, Streptomyces avermitilis
  CDS (1)..(1482)
atgacctcgcagccgaccctgtcgaaggccgaaaacggcccggaccgacccggagaacccggcggcggcctccaggccggactcaagaaccgtcacctttcgatgatcgccatcggtggcgtcatcggagccggtctcttcgtgggctccagcaccggcatcgccaccgcgggcccaggcatccttctctcgtacgccctcgtcggcacgctcgtcgtcctcgtgatgcgcatgctcggcgagatgtccgcggccaacccgacgtccggctccttctccgcgcacgccgaccgcgcgctcggccgctgggccgggttctcgatcggctggctgtactggttcttctgggtggtggtgctcgccgtcgaggcgaccgccggggccaagatcctcgaagggtggatgcccggcgtaccgcagtggggctgggcgctcatcgtgatggtggtgctcaccgcgaccaacctggtctccgtcggttcgtacggcgagttcgagttctggttcgccgggatcaaggtcgtggcgatcggcgcgttcatcgtcgtcggcggcctcgcgatcttcggcgtgctgccgggcgtcgacgccccgaaggccggcctcggcaacctgaccgacagcggcggcttcctgccccacggccccggcgcgatcctcaccggtgtgctcctggtcgtcttctccttcatgggcagcgagatcgccacgctggcggccggtgagtccgaggacccgcagcgcgcggtcaccaagtcgacgaacagcatcatctggcgcatcggcgtcttctacctgggctcgatcctggtcgtcgtgtcgctgctcccgtggaacgacccgtcgatcaaggacaagggctcgtacgtcgccgccctcgactccctcggcatcgcgcacgccggtcagatcatgaacttcatcgtgctgacgtcggtgctgtcctgcctcaactccgggctctacaccgcctcccgcatggcgttctcgctcggccagcgcggggacgcgccgaaggcgttcgcgcggaccacgtcccgcggtgtgccgctggccgcgatcgtcgtgtccgtcgtcttcggcttcgtcgccgtcttcttcaactacaagttcccggactcggtcttcctcttcctggtcaactcctccggtgcggtcgccctgttcgtctggctggtgatctgcttctcgcagctgcggatgcgcaagatcatccagcgggagtcgccggagaagctcgtcgtgaagatgtggctgtacccgtacctgacctgggcgacggccgcgctgatcgtgttcgtgctcggttacatgctgacggacacggagcacgacgggcgcgagacggtgctgctgtcgctgctcgtggccgcggtggtgctggtgatcgccgtggtgaagcagaagctggacggttcccgggcggtggctgccgcgggtgccgacgagccggctgtggccgaggccgtggccgacgcgcac

SEQ ID NO: 5410 - DNA, 477 bp, Streptomyces avermitilis
  CDS (1)..(477)
gtgtacctcggctctgatcatgccggtttcgaactgaagaaccacctcgtcgagtggctcaaggcggccggccatgagcccgtcgactgcgggccccacatctatgacgcccaggacgactacccgccgttctgcctccgtgccgcagagggggcggcggcggaccccgacgccctcggcatcgtgatcggcggctccggcaacggtgagcagatcgcggcgaacaaggtgaagggggtgcgcgcggcgctcgcctggagcgaggagaccgcgtcgctgggccggcagcacaacgacgcgaacgtggtcgcggtgggtgcgcgcatgcacacgcaggaggaggcgacgaagttcgtcgagaccttcctgaacacgccgttctccggtgacgcccgccacatccgccgcatcgacatgctgtcggcgtacgagacgacgggcgacctgccggccatcccggcccaccacccgcagcag

SEQ ID NO: 5411 - DNA, 807 bp, Streptomyces avermitilis
  CDS (1)..(807)
gtgcccgaggggcacacgattcaccgcctggccgacgactacgaagccaggttcggcggcgcggccgcacgcgtgaccagcccgcagggcaagttcgccgacgccgccgccctcctggacggcacggtcctcgaaacggcggacgcccacggcaagcacctcttcctcggcttccgccgggccgactggatccacatccacctcggcctcttcggcaaggtcggcttcggcgacgcacccgccccgccccccacggacaccgtccggctgcgcctcgcgaacgacacgtcgtacgtcgacctgcgcggccccacgacctgcgccctgatcaccgacggcgagaagcgcgcgatacacgaccgcctcggccccgacccgctgcggcccgacgccgacccggcccgcgcgtacgaccgtgtctcccgcagccgtacgagcgtcgccgccctgctcatggaccagaaggtcatcgcgggcgtcggcaacgtctaccgcgccgaggttctcttccggcacggcatcgacccgtaccgcacgggcagggagctcacccgccgcgaatgggacgcgatctgggcggacctcgtcgcgctcatgcgcgagggcgtccgcaacaaccgcatcgacaccgtccggcccgagcacacccccgaggccatgggccgcccgccgcgcgtggacgatcacggcggcgaggtctacgtgtaccgcagggccaacctgccctgccacatctgtggcggcgagatccgcaccgccggtctcgccgcccgcaacctgttctggtgcccgacctgccaacaggcg

SEQ ID NO: 5412 - DNA, 1227 bp, Streptomyces avermitilis
  CDS (1)..(1227)
atgaccactgatgtgcgcgtgctgcggcaggacgactggaatctctggtacgacaccctgatccgtgcgttcggtggggtcgcggaggcgtccgaggagcgtgagctgtggcagacgctcaccgaatgcgaccgttccatcggtgtgtgggacggcgacgcctgtgtgggcaccgcgggagcgttcagcttccgtgtcacggtgccgggcggcgcgtcggtgcccgccgcgggcatcacgatggtgagcgtcgcggccacgcaccgccgccgcggggttctgacggccatgatgcgccggcagctggacgacatccggtcctggggtgagcccctcgccgtactcaccgcgtccgagccggcgatctacggccggttcggctacggcatcggtacgcaccagctcaccgccgacgtcgacaccagccgcgtacggctgtccgtaccgcccggcacggacgacgtacgactgcggtacgccgtccccgccgacgtactcgacgtgtgcgaggcggtctacgcacggctggtgccggggcggccgggtatgccggcccggcggccgggctgggaccggctgatggtgctcgacccggagagccgacgggacggggcgtcgccgcttcagtgcgtggtcgcggagcgcgacggcgagaccgtggggtacacacggttccgggtgaagcccgactgggagccgtccgggcccaagggcacggtcgtcctccaggacctggaggcgctcgacccggccgcccacgcggcgctgtggcggttcctcttcgacatcgatctgacgtcgcacctcaacgcgcgcaaccggccgctcgacgaggcgtggctgcacctggtgtcggacatccgccgctgcaatctgcggaaacgggactcgctccacgtacggctggtcgacgtcggcgcggcgctcgaagcgcgcacgtatcaggcgccggtggacgtggtgttcgaggtcgaggacgccttctgcccctggaacgaggggcgttggcggctgacgggcgacggcaagggcgcgacctgtgtgcgtacccgtgactcggtcgatctcgccctgtccgtaagggacttgggggcggcctatctcggcggggtgtccctcgtgtcgctgggcgcggccgggcgggtacgggagctgcgaccgggcgcgctgacggaggcgacgtcggcgttctcctcggcaatcgcaccatggctaccgcacggcttc

SEQ ID NO: 5413 - DNA, 1173 bp, Streptomyces avermitilis
  CDS (1)..(1173)
atggcagcaggacgagagcggcgcgccgcagccgagacgttcacggcccggttgaagaagcagtggcaccgggctcgcaccggcgtgcgcagatccgctgtcgactacttccgcggggacggctcggactggatcgcgctggccggtctgctgctgacgatcccgctgatcgcggcgacgaccctgatgaactccgtgtggtgttcgccggccgcgctggtgctgccgatcgtggcgggcgggctgctgctgcggccgtcgagcctgctggggctgtacgccgctgccgccagcgcgctgatcgtcgagtccgtgaagctcggcccgtacacggaggggccgtcgcgggtcacgccgggtgtggtgctggtcgtggccgcctgcggcttcttcggcctgctgatcgcgcagttccgcagccgggtgggcgtgccgtggcggcggggcggcacgatgctgttcgacctgcgggaacgtatccgggtgcagagcaagttgcccaagctgccgttggggtggcaccgggagatggcgctgcggccggccggcgggcagtcgttctcgggcgacttcgtggtggcggcccgcacgaacgggggccgcacgctggaggtcgtcctgacggacgtgtccggcaagggcatggacgcggggtcgcgggcgctgctgctgtccggggcgttcggggggctgctggggtcgctgccgccgcacgcgttcctgccggcggcgaacggctatctgctgcggcaggactgggacgagggcttcgcgacgtcgatccatctggtgctggagctggactccggggactacgagctgttctcggccgggcatccgccggggttgcagctcagtgcgggcagcgggcggtgggaggagaaggccgccgaggggccgctgctcggcgtctacgacggcgcgcagttcgatccggtgaaggggtcgctgcggcccggtgacgtgctgatgctgttcacggacggtctggtggagacggcggagcgggacatcgtggagggcatcgaccggctcacgggggaggcggaccggtatgtcgccggcggtttccacggggcggcgtggcatctgatcgaggcggtggcgaaggacgtgaacgacgaccgggcgctcctgctggtctgccgggacggcccgaccgcggcggcgcgc

SEQ ID NO: 5414 - DNA, 945 bp, Streptomyces avermitilis
  CDS (1)..(945)
atgggcctgcgcaagaggcggcgcgagatcgacgagcgggcgtccggacggatccccgggccgatccccggccggacaccgctcgcctccggcgctgacggggccgacccgggcgcttacggggccgtccccggcgtcgacaggaccgccccgggcgtcgacaggaccgcccccagcgtcggccgggccgtctccggcgccgactgggccgtcgagctgcggggtgtgcggcggcggtatgggcgtggtggttccgccgtgcatgccctgcgcggtgttgatctcgccctggcgcgcgggagtttcacggccgtcatggggccctcggggtccggcaagtccacgttcctccagtgcgcggcgggcctcgaccggccgagcggcgggaccgtacacctcggcggcaccgacatcaccggcctgagcgagaacaagctgacggcgctgcgccgttcgcggctcgggttcgttttccaggccttcaacctgctgccgtcgctgacggtcgagcagaacgtcgtgctgcccctgcggctggccgggcaccgccccgaccgccgccgcgccgccgaggtgctcgcccaggtaggcctccaggacaaggggcggcgccggccggggcagctctccggagggcagcagcagcgggtcgcgatcgcccgcgccctggtcacccggcccgacgtcgtcttcgccgacgaaccgaccggcgccctcgacaccaccaccgccgccgagatcctgggcctgctccgccaggccgtcgacgtccatggcgccacggtcgtcatggtcacccacgacccgacggccgccgcctgggccgaccgcgtcctcttcctcgccgacggctcgatcgtcgaccacctggaacgcgccaccgccccgcggatcgccgcccgggtggccgctctcaccacgccgtccttcgagggagcggcggcc

SEQ ID NO: 5415 - DNA, 2442 bp, Streptomyces avermitilis
  CDS (1)..(2442)
gtgcccaacggcctggcccgcgccgccgtccgcttcaagcccgccgcgttcgccggtacgttcgtcgccctcgcgatggccgccctgatcgtgtcggcctgcggcatcctcctggagacgggactacgcgcctcggtgccgccgcagcgctattccggtgccccggtggtggccgccgccgaccagcgcgcccacctcgtcaccggccacggcgacgaccgcgacgacgaggcccagcccctcccggacaccgcccggatcgacaactccctcgtggccagggccggttcggtgccgggggcgcgtacggcgatcgcggacgtgaccttccccgtgctcgacgagaagggcgccgcccgcaccgcgcacggctggggatccaccgccttcaccggcgagaggccgatgtccggacgggcgccgggccctggcgaggtcgtcctctccggcgccgggcgcgccgccgtgggcggccgggtgaccctcaccaccgccgacggaccccgcaccttccgggtgtccggcacgacggccgagcaggccacccccaccgtctggttcgccgacaccgacgccgtacgcgtctcgggccaccccggtcgcgtcgacgccatcgccgtactgccgaaggaaggcgtgaccgccgcagctctcgaagcccaggtggccaaggccctcggtgaccgcgcacaggtccacaccggcgacgaccggggtgccgtcgaggacgcctcgctcgcccaggccaaggaactgctcgtcgggctcggcggctccttcggcggtgtcgccaccctggtcgccgtcttcacggcggccggcaccgtggcgctctccgtcggccaacgcgcacgtgagtacgccctgttgagggccatcggcaccacccctcggcaggtgcgccgcagcatcgccaccgagaccctgctcgtcgcccccctcgccggagcagtcggctgcctgcccggaatcgccctggcccgctggtggttcggccaactccaggacaagggcgccgtcccgcacgcggtgcggctgtccgtgtcgtacatcccgctgctgtccgcgatcggcgccgtactcctcaccgcactcctcgccggctacctggccgcccaccgcacctcccgcatcaagccgggccgtgcgctcagcgaggcctccgtggaacggctgaggcccggctggatccgcaccccgctgggcatcgccgcggcggtcggcggcttcgtctgcgcggggctcgccgactccctcgacggcgaggacgcggccaacgcctcgctcggcatcgtgatgctcttcatgctggccgtcgccctgctcggcccgctggtcgcgcgcgtctgcgccgccctgttcggactgccgttgcgcggcgcgggcgcccccgccgtcctggccgccgccaactcccgtaccaacgcccgccggctggcctccgccctcacccccatcgtgctcgccatggccttctcctccgtactcgtcttcctgcacaccagcgaggaacgggccacacgcgaccagcagcgggccggcatcaccgccgaccacatcgtcacgtcggacgcgggcctcgccccggccgccgtccacgaggcagccgcgtcgcccggtgtcaccaccgccgtgggcgtgctgagaacggcggtactgatcccggccgcgggctcgctggagtcggcgaccacgcagggcgtcacgggctcggcggcggacctggcccgggtccaggacctggacgtcgagcacggcgcgctcagcctgaaaccgggccgggtggcgctcgacgcctcgctcgcggacagcgcccatgtgcgggtcggcgaccgcgtgcacctgcggctgcccgacggcaccaaggcgtctccgatactggcggccacgtacgggcgcggcctcggcctgtcccaagtgacgctgccgcgcgccgacctggcgacccatgtgacctccgccctggacacggagatctggacgaagggcggccgggcgggagcactcgctccgctgggcagggtcctggaccgcgccgactacaccaccgcggagtccctggaccgcgcgctcaacgcctgggcgaacaccgtcatggcggccgtgctcggcggcttcgcggcggtcgccgcggtcaacaccctggtgatgacggtcctcggacgccgaagcaaactcggcacgctccgcctgatcggcaccacccggcgtcaggtgctgcgcatggtccgctgggaggccctgctggtcgccctctcgggcatcgtcctcggcacggcgatcgccctggccaccctggtcccgatggtgaggggcctgaccgggcggtccccgtacataccgcccctcgtgtacggctcgttcgcgggcgccgtcctcctcctcggcctgaccgccgtcaccctcccggcccgggccgccctccgcccggcaagggagcga

SEQ ID NO: 5416 - DNA, 330 bp, Streptomyces avermitilis
  CDS (1)..(330)
atgaagttcgacatggggtcgcaggttctgtcgacgttgatcagtaactcgcgtgggtcgagtgacgatctggggacgttgattcgccaattggtgcaggccgcgcagccgttggaggggaagttcaacggtgcgggccgggtggcgttcgattcgttcaaggggcggtcggacgagatcacggcgagcttgaactcggcgctctcggggattctgggcggtcagtcggggatggagtcggcgttcggttcgggtgatcaggagcagggcgagaacgcgcggacgaacgagaaggcggcgaacttcgacggggcgcgtttctccgggcgt

SEQ ID NO: 5417 - DNA, 315 bp, Streptomyces avermitilis; identical to SEQ ID NO: 4080
  CDS (1)..(315)

SEQ ID NO: 5418 - DNA, 312 bp, Streptomyces avermitilis
  CDS (1)..(312)
tggctggtgcgggttcggatcgtcggtcgtacgacacgggtgcgtcggcggatgcgcagggcaatatccaggcggtgatcggccggttggaggaggtcatcgcggcgcgggaccggcaggtgaaggcggcgatgtcggatttcgcggctgatggtgtggcggatgagtaccacggcaaggaactgcggtggaatcgcgcgtcgaccgaggtgaagagcattatccagctgttgaagacgacgctggagaagaacgacgggacggcgcagtcgacgatctcgaaggcgaaggcggcggtcgacaacatcggct

SEQ ID NO: 5419 - DNA, 393 bp, Streptomyces avermitilis
  CDS (1)..(393)
atgaccggctgggatctgaagccgcagggtattcagggtgtgctgaagacgacgggtgagacggcgtcgcacatcgagacgcatgcgaagtcgtacgggaagcatctgacgtcggcggcgacgaacgccgggacgatctccgcggagggcggcggcgagcagggcggcgagaagccgtcgggcggtctggtcgctctcgccctgtcccagtacgccgaacacgcggccactgacctgaagttcatcgcggcgcgggcgggcaagtcgttgcagggtgcggtggatgcgacgacggcgtatctgaacggggatcaggagatggccgcggaggcgcagcgcaaggcgttgtcggcgccggatcttgatccgatgaagccgggggtgcagacgtcg

SEQ ID NO: 5420 - DNA, 2472 bp, Streptomyces avermitilis
  CDS (1)..(2472)
gtgatcaagccggaggcgattccgcagtacacggggaatctggaacagctggagaaggactacggcagtctgaagacggttgccgggagtatccggaccaccggcaaggacgtgcactcgcagttccaggggttgtcggcgtattacacggcgccggaggcggagcagttgttcgcgtcgacgaagccggtggcggaccgggcggacgggttcgcggacgatctggagaaggtgtccggtgccctgtcgtcgtactcgaccgaggtgcgtccgctggtccagaagctggagcagctgaagctggacgcgacgaagttcgtcagctcggtcaagggtgacgacgactgggagtacgacgaggacaagatcgacgagcacaacaagatccgggatgacgtgacggcgaccgtcgcggcgttctgggctgcggagcgcacctgccacaacgcgatcaccaagctgttcggtgggacgcagatggtggcgggggacggttcggaccgtaaggaccagtacgggttcaacgcggacgacctgaagaacgcgaagcttccctggggtgacccgatggaggagaaacatcacgtctgggaggtcgggcactgggtcaagtcgttcgtgtgggacggcctgatcgtggacggcgtctggggcaccatcaagggtctgggcacgctggtcgggttcggcggctgggacgcgatgggccaggcctggaagggtctcgcacagctcgcgaccggtctggcgatctcctcgattccgggtgcgagcgcgttgttctggacgttgccggacgacaagctgccctcctggctgcgggattcgcgtaccgcgatgaaggagaccggcaaggcgctggtggcgtgggacgagtggggcaagaacccgggccgggccgcgggtgcggtcaccttcaatgtgctgaccaccgtgttcaccggcggtgcgggtggtgcggcggctggtgccgggaaggcgggcgcggtcgcgaaggtgctgtccgtggcgggcaaggcgggcaagttcatcgacccgatgacgtatgtcgccaagggcgcgggcgcgggcctgtcgaagatcggtgacatcgcgaagggcctgaaggggatcggcaacatcgagatccccaaactccccgacggttcggtgcaactccccgacggccgcctcctggagccgaacggcgatctcgtgggcccgggcggtgtcgtcgacacgacgccggtcccgcacgagccggtgctcccggcccactggaccatccaggagcccgcgctctccggggtgcgtgccggtgacggtctgcctggtggcgtggcgcatgcgggcgattcgttgccgacgggcggtcactacgacacgtcgttgccgagcggtgccgcggaccatgtgccgggcggaacggccgggcacacgcccagcggtacggccgcgcacacgccgagcggaacgttcgacgggacaccgacgtcgtacgaccacaccccgacggccacgccgcacgacgtgccgacgggcaccccgcacaccgggcacgacctcccgagcggcggcggccacccgccggagccgcacggcacggggcacgacaccccgggcggccacacggacgacgcgtcccacggctccgggcacgacgggccgggtcacgggcacgacggcaccgggcacacggacgacgcggcgcacgtcggcgaccacgcgggcgtcgaccacgccgccgtggacgccgccgcgcaccacggcaccgacactccggtcgcgccggggcactcgggtgcggatgcggcggggcacggcggggccggggagccgttcgagtacgagccgcacatgtcgggggacgacttcgaagaactggccaccgacgcggagaaacacgcggtggccacggcggaactggagcggggcacgaaccccgcggccagcctcagcgacgacgcggggcaggcgtacggcgacgcgtactggaacgactacgtggacaacctcgacccctccgggagagaggcgctccgcacgtacaccggtcacgactacacggagatcaacagccacctccggggcgagaaccccgatgtgtatcccgagacgctgcacaccatcgacgagatggaccgcgtcatgggcacccgtcccgtgcccgaggacatcatgatcgtccgcggtaccgggatcgagcacctcaagctgaggtcgccgctcgacatgctgggcaacacctacggggacggcgcgtacacctcgtcggcgctcggcaggacggtgccgcccgccttcgcgtggaagccggtcgtcatgcactggcgggtaccgaaggggacgcccgccctctggctggacaagatctccaagcaccccggggaacgggagctgctcctcgcccgcggtacccagtacaaggtgacgcgcgtcttcatggacgaggcgggcaagtggcacgtctacggggaggtcctgcccaggccg

SEQ ID NO: 5421 - DNA, 411 bp, Streptomyces avermitilis
  CDS (1)..(411)
gtggacttcatgagcagtgaacaaccgatcaacccgcgcttcgacgacgacctgaggttcgtggagagcccgggcggcccgccgcgctatcgggactggaccgagaagccggtgcagtacttcacggtggtcgacaagcagggcggcggggtcctcgggtacgtgtgggccggcgacgaggacgacgccgccgcgtacgagccgcggcaggccgccggaccccgaggggtgaacgcgggcatctcctggggcagtcggctgcgcaaagccaaggaacggggcatccgaccgtccgaggccctcgccgagttggtggccgacccggagccgggcggcacgggacggcccctgcccggctccctcaccgacgccccgaacgccgccgcggtcgacgccctcgccaagagcgac

SEQ ID NO: 5422 - DNA, 606 bp, Streptomyces avermitilis
  CDS (1)..(606)
ttgcagactccacgggggacaagcaccatgaccacgccgccggcacccaacccgcaccagcagccgcacccgcaggccaatccctacgcccagccgcaggccaacccctatgccctacagggcggtcacccgcaggcccccgggtacggcgcccccgggtacggcgccgtacctccgcaggccggcccccagtggggcgccccgtacgggcccggtgcgtacctttcgtgcaagttctgtggaggtgcgcccgccgtcgacgtcaccttccgggcccatcggggcctgttgatcctgatgtcgttccagaagctgtccgggccgatgtgcgcgacctgcgggctgggcgtccagcgggccatgaccacccagaccctgtggcagggctggtggagcccgttctcgctgttcctgttcacgccgttcacgctcgtctggaacctcatcgcccgcggcaaggtgacgaagctccagcccccgcagcccgggcagcacggcccgcaggtcgaccccggtgagccggtgcaccggcggggcctcgcctacgtggcactcgtcccggtcctgtggatctgcttcatgatcgcgcagggtctgacccagtcg

SEQ ID NO: 5423 - DNA, 522 bp, Streptomyces avermitilis
  CDS (1)..(522)
atgccttatgttgcagaggcaaagttagggggagcctgctttatgccgcaggaagggcgagcacaggcgcagccgcggctcatggccttggcggaggtcgaggccgtcgcgcgcaccgcgcatgccgcgcagaaggacaaggccggacggccgtacgcggagcatctgcaggccgtcgccgagggagtacgggctcgcggcggagcggacgaactcgtcgccgccgcctggctgcacgactccgtggaggacggcgtgctcagcgagcggtggctggcggacgcggccctgtcgcagcgcacgaaggacgtcgtccgggccgtgaccaagcgcgcgggggaggatcccgaggcgtacgcccggcgcatcctcgccacccccggggcccggctcgtcaaggcggcggacctcgcgcacaacgccgacccgcggcggctcgccgtactcgacggcccgaccgccgagcggctcaccctcaagtacgccgccatgcgcgcgtatctcggcctcggcgccgaggac

SEQ ID NO: 5424 - DNA, 261 bp, Streptomyces avermitilis
  CDS (1)..(261)
gtggcgctctgccccgacgggttgtacagctgctcctgctgctgttgctgtttcttctgctcggccttctgcttcgccagggtggcctggaggaaggaccagccgatgcatccggcgcacaggacggcggcgatcgcgatcccggcgaacaccttgccgaaccgctcgtccaccgtgcggcggccgcgctgcgcgccgaacagcagcgcgtcgcgcatccgccgccggcgcaccgccaccgactccagcagctggctgtcg

SEQ ID NO: 5425 - DNA, 1353 bp, Streptomyces avermitilis
  CDS (1)..(1353)
gtggtgagcactgcaacgacttcccgggcccagctgagccgagtgaccctggtcggcgagcgacggcgagccgacatcgtcctgccgtcggacaccccgatcggtcaactgcttcccgacatcctccagttgctcgacgaccgggccgccgcgcgccccatgacccgacagctgatcacctccgacggctcggtgctgccgcacgacgccacgctgtcctcggccgaggtcgccgacggcgcggtactccagctcgtacgcgcccactccgcgccgcccgccccggtcgtgcacgacgtgaccgaccaggtggccgacgacctcgacctgcgggcctggcgctggcgcccttccgcgcgccgggcgagcgccggggtggcgaccgtcgccttcgcggtgctcgcggccgtactcgcccgccgcgagttcgccctggagtccctcaccggaggcctggtcgccgccacgcttctgttcctggtgaccggcgctctcgtcgccaggatcggggacggcaaccgaggcctcgccaccgccctgctgctcgcctgcggcggactcgggctgctcaccgcgtggaccgcggccgacgcgtaccactggccgggcacggcccgcctcgccgccgtcgtggcggcgctggtgctcacgctcgtcctgctcgcgttcttctcgccgctgggccgcggcggactcatcggcgccggagggaccgccgtcatcgcgatcgtctgggaagccgtcgccgcggtacaggaccagccggcccggctcggcgccgtgatggccgtcttctccgtggtgctgctcgggctgctgccccggttcgcgctgatggcgtccgggctcaccggcctcgacgaccgccgctccgggggcgtctccgtcagccgccaccaggtgggcaacgccctggccgccacgcaccgcgggctcgccctcgccaccatcgcgaccgccgcctcggccgccgccgggggctggctggtgaccaccgccgggacgccgaccgtgtggaccgtgaccctcgcctcgctgaccgcggtggtgctgctgtcgcgggcccgggcgttcccgctggtcgccgaggtggtggcgctgttcgccgccgcggccctcctcggcgtacgcctggtcatggtgtggctggaccacgacggcggtgccgcgccgctcatcgtgctgtgcgccgcctcggtgctgccgttgctcgtgctcgccgtgcagccgcccgagcacgtacaggtccggctccggcggagcgccgacctgatcgagtccatcggcgtcatcgggctcttcccgctggccgtcggcgtcttcggtatctacgggcaactgctcaacaagttc

SEQ ID NO: 5426 - DNA, 1098 bp, Streptomyces avermitilis
  CDS (1)..(1098)
gtgcccgcaccagggtcagggcggccacggagctcaccccgtacccggcgcacccaccagccctccgcacccgccgaggcccaggcccaggcccaacaggcgtacacggcccagcagccgcacgccccgcagccgcaagcccggtccgccgcccacctccccggcgcacgtcccgcccgcacccccgactcccgccccgtcgtggacaagaccctcgccggggccggcctcaagccccggcacggcgagcccttcgccacccgtgccgtgcgcgccgtacgccgtaccgtctcctcctccgccgcccgcgaggtcgccgagaccaccgccaccgccgaggtccttcagcaggcggtgaccacgggacggcagatcgccgtcacctcgatccgcggcggcgccggcaagtccaccatcgcggcgctgctcggcaccacgtacgcgcactaccggcacgaccccgtcctcctcgtcgaggccgaccccgcgctcggcacactgccgctccggctcggcgccgagacgctgcgctggaccaccggggacgtcgccggcatcgtcgaaccgcagatgtcactgctcgacgtcaccggctacctcgtccaactccccgacaacgcctggctgttgccgggcagccaggggcagatcggcgcgatgctcgacctcaggtcgtacgagaaggtcatggtgtcgctgcgccgctacttcggcgtgaccgtcgtggactgcgagacgctgcccgccgaggtcgcccgcgtcgcgttgtccgcctcgcaggcgcgggtgctggcggtgcccgcgacgctggagggcgtctccagtacgtacgccgtcctggagtggatgcgcgggctgccccggcatgtcatcgccgggaccgtcgtcgtgctgaccgagacggtgccgcactccggactcgacctcgacaaggccgccgagaaactgagggcgaccggcgcgagcgtccagctcctgccgtacgaccggcatctggcggccgggggcgtgatccgcacggaactcctcgcgcagcccacccgcctggcggccacccgcctggcggcccaggtcttcgagctctcccagcagcgccgc

SEQ ID NO: 5427 - DNA, 3972 bp, Streptomyces avermitilis
  CDS (1)..(3972)
atgagcacccgactgatccaccgcccggcccggaccacccgtcccgccgccgcgtccgagccgcgcaccatcgaggcgccgcccaacctgcccgagggcaagtccggcagcatcgcgacctcgctgctgcccgtcgccggcgtcatgtcgtccgtcgtgatgatgaccgtcgtacgcaacagccagttcgcggggctcggcgcgatcatcctcgtcgtcacgatcgtcggttccatggccctggtcttctcccagcgcggcaaggcccagcgcacgcgccgaacccagcgcgaggcctatctcgcctacctggaggacctgcgcgaggaactgtccaaggaggagcgggagcgccgggaacgcgccggggtcctcaatccgccgccggacgcgctgtacgacatagtgcgcgacccggcgcggctgtgggagcgccgccgggtggacggcgacttcctgcgcgtccgcgtcggcaccggcgaaatgcccgtacgcgacctcaaggtcgcccagcaggggtcctccgtcctcaccccgcccgaccagttcatgttgaacgaggcgtccgcgctgatgtcccgcttcagcaccggcaccgaactcccgctcaccgtcccgctcgaccgcgtcggcaacatcagcgtcatcggcccccgcgaggacaccctgcgcgtcgcccgcgccctgctcgtccaggccgccgccacgcacgcccccgacgacgtcgccatggcgctcgccgtgccgggggaccggctggccgactgggagtgggccaagtggctgccccacctcctcgacaccgagcagttcgacgggccggtcgccgcccggcgcatcgccccctccacgcctcaactcgcccgccagatcggcccggagctgcgccgacgcgcctccttcgcggccgaggtacgccgcggcctgtccggcaaggacgccctctcgatgtcctcgcggctgctcgtcgtcaccgacgggcacggcgaggacgccgtcgacctgccacgacccgacgacgcggtcggcctgcgcgacatgggtgtcacggtgctgcacctgctcgaccagcgggtgcaggagcccggcagcgtcggggtccggatcaccgtcgacggcgaccgcatcgtcatcgaggacctgcgggaggccgagccgatcggtgcgcacggcaccgtcgacgaggtcagcgtcccgttcgccgagggcctggcccggatgctcgccccgatgcggctgtccgccgagtcgatggtcgacgcgccgctgaccggcccggtcgacttcgccgaactgctcggcatcgacgacgtcgcccatctcgaactcgaccagctgtgggcgccgcgcggcgaaagagcgttcctccgcgtcccgatcggcatcagcgactcccgcgagccggtactcctggacctgaaggagtcctccgagctgggcatgggcccgcacggcctgtgcgtcggcgccaccggctccggcaagtccgaactcctgcgcaccctcgtcctcgccctggtcgccacgcatccgccggaggacctcgccctcgtcctcgtcgactacaagggcggcgccaccttcgcccccttcgcggacctcccgcacgtcgccggcgtcatcaccaacctggagaaccaggccggtctggtggagcgtgtgcacgcgtcactggccggcgaggtcaagcgccgccagcaggtcctcaaggacgcgggcaacgtcgccgacatcggccactacgccgccctgcgcgccgagaagcgccccgacctggacccgctgccgcacctcttcgtggtcatcgacgagttcggcgaactcctcaccgccaagcccgacttcatcgacctgttcctgtccatcggccgcatcggccggtccatcggcgtccacctgctgctgtccagccagcgcatcgagggcggcaagctcaagggcctggacacctacctctcctaccggctcggtctgcggacgttctccgccgacgagtcgcgtacggtcctggacaccacggacgccttccacctgccgccgctgcccggcttcggctacctcaaggtcgacaccagccactacgagcgcttcaaggccagctacgtctccggcggctaccggggccccgtgcagcgcgagaccgaggacaccggaccgctcgcgctcgagtaccaggccttcaacaccctcggcgagtcccagagttcgggacccgacgagccgaagatgcggcgtcgggagaccgggccgaccgagatgggcgtcctcgtcgagcagatcgagaacgcggacaccgcgcccgtacgccagatctggctgcccccgctgcccgacgccatcgccctcgacaaggtcgcgggcccgctcgacgtcggggcccgcggcatgcagctcgccaagcgccgcggcccgctccaggtgccgctcggcgtcctggacgacccgaccaagcagtggcagggccagtggtacctggacctcacggtcgcgggcggccacgcggcggtcatcggcggcccccagtccggcaagacgaccctcctgcggaccctggcgctctccctctcgctgacgcacaccccgcaagaagtcggcatctacggcctcgacctggtcggcggcggcctccaggccctctccgggctgccgcacgtcggcggggtcgccggccgcgccgaccgggagcgcgccggacgcaccatcgactccgtacgcggcatgctcaaccagcgcgaggaactcttccgcgtccacaacatcgactcgctggagcaactgcgcgacctgcgcgcggcgggccgcctgcccgaactcgcctccaccgagatcgtgctgctcatcgacggcttcggcgcgctgcgcgacgacttcgaggagctggacgacgccgtcgtcgacatcctcaagcgcggcggcggctacggcatccacgtcgtcgccggcatgctccgctggaacgatgtgcgcatcgccacccagtcccagttcggcacccgtgtcgagctgcgcctgaacgaccccagcgagtccagcatcgaccgcaagctcgccgagaccctcgcgccggaggagaagggccgcatcctcaccgacggcaagctgttcgcgcaggtcgccctgccgcgcaccgacggcctccccgacaaggcggacctcggcgcggtcctggagcgcaccgcccgcaccgtccgcgccacctggaccggcgaagtcgcccagcccgtaagggtgttgccgcacatcctggaaccacagctgctgcccggtccggccgccgaaccgcgccgggtgcccatcggcctcgaccagacccagctcgcgccggtcctgctcgacctgttcgcgcacgaccagcacctggtgatcatgggtgacagcgagtgcggcaagaccaacctgctcaaggtgatcgcggacgggctcatcgagcgctacagcgaggacgagctggtcttcgcggtgatggacccgcggcgcggtctgcgcggggcgatccccgaggagtaccggggcgggtacgcgtacaactccaagctgtgcgcgggcctttcggcgggtatcgccaccgaactggagaagcggctgccggacgagagcgccgacagcgaggacctggaaccgggcagctggggttcgggcccgcgcatcgtgatcctcgtcgacgactacgacgtcctgacgaccgcgggccagcagccgctcgccccgttcatcccgtacatcccctccgccgtcgacatcggcctccacttcgtcctcacccgccgtgtcgcgggcgccgcgcgcggcctgtacgagccgctgctccagggcctgcgcgagtcgggcgcctcggcgctggtgatggcgggcgaccgcagcgagggccagctcttccccggcgtgtacgccacccagcagccctcgggccgcggggtgctggtccgcaggggcgaaccgaaccggctgatccagacggtgtacgcggccggg

SEQ ID NO: 5428 - DNA, 1428 bp, Streptomyces avermitilis
  CDS (1)..(1428)
atgaccaaggacgtcatcgccctcacgaagaagatgcccgacccgctgagcgtgctcgcgggcctgctctccggcggccccgacaagctggtgggcgccgagggcgaaggcgcggtcgtccagctctgcgacgaggaggggcgccccctggtctccgtggaggcgccgctgctcgtgcaggtcaggggcgaggcccagcggctgctcggcgcgacggagcccgaggtgccgtactggtggaccgaggcccgcgccaccaccggcgtcaaggaggccgagcaactcgccggaacgttcgcggcgcggctcgcctccctggtcgggggcaccgcctggccaccgcaggccgcgggctcgctggccgtggtgaaggcggacggggtgcgcgccgcgccgacgccggccgccgcgcagcccgccgtggacgtcctgaccgacaaggtcgccgtcgtcatccaggaccgcccggtcgtcgccatgacggcctggctctcggacgcgctgcgcgccgccgccaacgccgagctcggcctccagatcgtcacccccgcgggcacccgcctctcccccgccgtccgcaacagcctgccgggctggccctcgcggtgggtcgtgcaggacgagaaggacggctactacgacggtctgtcgggcgccgtgctccagtggacgaacggcctgttcgccacggtcgagtcgcccgacgccaccccgcaggacccgcacaccccggtcgccgacgccttcaagaagggcctcgcggaggaaggcgacacgggagagcgccaactggccatctccttccgcacgatccacccggccgacgaccgcctcgtgctcggcggtgccctggagtccgtatggcgcggcatcaccggtgaaccgccggccggctggggcaccgaggaacccgccaacctcccctggtccctgcggcagttgacggacgtggccttcgagcggtcgcccgcgcccacctggctggtggtcgtcggcagcccggagcggccggggctcgcgacggtccgcgtcagccgtacgacgggcggtgtggaggaggacgtcacactggcgttcggctacggccccggcgaggagccgccggtggacgccctgccgaaggtcgcggagaccctcgcgacccggcacgacctccagtcgatgctcgtccagatccgcaaggcccgccgcgacctgtccgtgccgccgcgcttcgagggccccggcgtcccgctggcgttcgcactcggcgccgaggaggtccgcgcgatgcccggcgaccgtgcccgccgcacccccctggcgcagccgcccgtccaactcggcccgaagacccgcccggccctgtactacccgctgccgggcgacccgtcggacctgtcgggctggcaggacttcgaacggctgatgcggcacctgaaaggcgcg

SEQ ID NO: 5429 - DNA, 1125 bp, Streptomyces avermitilis
  CDS (1)..(1125)
gtgccgagtcctcgtgccccgcagaactcgtcgtcctcgcagatttcacagacctcacggggtgcctcacaggccgcctcccccgagagcaaaccggtcaaacaacgcgacgcgttctttgacaacgccaagtacctggccatcgtgttcgtcgcgatggggcacgcctgggagccgctgaccgaccacagccgcgccgccgaggcgctgtacatggtcgtctacaccttccacatgccggccttcatcctcatatccggctatttctcacgtagtttcgacatgcggccggaccggctcaagcggctggtgaccggcgtcgccgtgccctacgtgctcttcgaggtggcgtactccctcttcaagcgctgggccgacaacgacccggggcatccgatcagcctgctcgacccctggtatctgacctggttcctggtcgcgttgttcgtgtggcggctgaccaccccgctgtggaaggtcgtgcgctggccggtgccgctcgcactggccatcgcggtcctcgcctccgtctcacccgacatcggcgacgacctggaccttcagcgggtgcttcagttcctgccgttcttcgtcgtgggcctgttcatgaagcccgagcacttccagctgctgcgccgccgtgaggtgcgcgtcctgtcggtgcccgtcttcgcgatcgcgctggcggtggcgtactgggcgggtccgcgcatgaactcggcctggttctaccaccgggacagcgcgcaggagctgggcgcgccctggtgggccggtgtcgtgatgacgctcgcgctcttcggctgctcgctggtggtcaccagctgcttcttcgcctgggtgccgcgccgcaagatgtggttcacggcgctcggcgcgggcacgctgtacggctatctgctgcacggcttcatcgccaagggctcccggttctgggactggtacgacgccgcgtggttgcagacgccgtacggcgaggtcatcgcgaccgtgttcgcggccacgctgatcaccgtgctgtgcacgcctccggtgcagcggatcttccggttcgcgatggagccgaagatggagtgggcgttcaagcgggacgcgacagagatcgcgcgggagcgggccaaggcc

SEQ ID NO: 5430 - DNA, 192 bp, Streptomyces avermitilis
  CDS (1)..(192)
gtggccatttcgctgtcagtggtactgctgttggcgatcatcctggtggtgttgatccgagggggatcgatcaaggcgggccccgcgatcgtggcggtcctcttcggcttcttcctcgcctcgaccggcatggctccgtccatcaaccggttcctcgactcgatagcggagacgatcaactcgatcagcttc

SEQ ID NO: 5431 - DNA, 1389 bp, Streptomyces avermitilis
  CDS (1)..(1389)
gtgaagagcgccgtggagaccctgaacccgactcgggttcggctcactgttgaggtgcccttcgaggagctcaaggacagcctcgacgcggcgtacaagaagatcaaccagcaggtcacggtgaagggcttccgtaagggcaagatcccggcccgcgtcatcgaccagcggttcggccgcggtgccgtgctggaggaggccgtcaacgacgcgctcccgaagttctacaccgaggcggtcaacgaggccgagctgaacccgctgggccagcccgaggtcgacatcacggagctgaaggacggcgagacgctgaacttcaccgccgaggtcgacgtccgcccgaccatcgagatcccggactactccggcatcgaggtcgaggtcgacgcggtcgaggtcagcgacgaggacgtcgagaaggccgtcaccgagctgcgtgagcgcttcgcgtcgacctccccggtcgagcgcgccgccgaggacggcgacgtcgtgacgctcgacctggaggccaaggtcgacggcgaggtcctcgaggacggcgtcgccgagggtgtctcctacaccatcggctccggcgagctgctggacggcatcgacgacgccgtgaagggcctggaggccggtggcgagaccaccttcacctccgagctcaagggtggctcggcggccggcaaggaggccgaggtcaccgtcaaggtcagccaggtcgccgcgcgcgaactgcccgagctggacgacgacttcgcgcagctcgcgtccgagttcgacaccctggaggagctgaaggcggacagccgcaagcgcctcgagaacatgaagcagtacgaccaggccacgcaggcccaggagcgcgtcctggagaagctgctggagctcgccgaggtgcccgtccccgagaagctgctcgaggacgagatcaacacccgcaagcacaacctggagcaccaccagctcggccagatgggcctcgacctcgagaagtacctcgagatccagggcaagacggtcgaggagttcgacgccgagaccaaggaagcggcggtcaagggcatcaagacgcagttcgtcctcgacgagctcgtcaacaaggagaagctcaacgtcaaccaggaggagctcaccgagcacctcatgcggcgtgcggcttcctccggcatgtcccccgaccagttcgcccaggcggtcgtcgagggtggccaggtcccgatgctggtcggcgaggtcgcccgcggcaaggcgctggccgtcgtggtcgaggccgccacggtgaaggacaccaacggcgagatcgtcgacctggacgacgaggacgagaccgagtccaccccggagacgaccgaggccgccgaggctgccgaggagtccaccgaggacaagcccgaggcg

SEQ ID NO: 5432 - DNA, 657 bp, Streptomyces avermitilis
  CDS (1)..(657)
gtgagacggcccggcgccgtcgtaagacgagcaggtggatacgtgacgaatctgatgcccacagctgccggcgaccctatcggtggtggcctcggcgaccaggtctacaaccggctgctcggcgagcggatcatcttcctcggccaggcggtcgacgacgacatcgccaacaagatcacggcgcagctgctgctccttgcctccgacccggacaaggacatctacctctacatcaacagccccggcggatcgatcacggccggcatggcgatctacgacaccatgcagtacatcaagaacgacgtggtgacgatcgccatgggcatggcggcctcgatgggccagttcctgctcagcgcgggcacccccggcaagcgcttcgcgctgccgaacgccgagatcctgatccaccagccctcggccggcctcgccggttccgcgtcggacatcaagatccacgccgagcggctgctccacaccaagaagcggatggcggagctgaccgccttccacaccggccagacggtcgagcaggtcacccgtgactcggaccgcgaccgctggttcgacccggtcgaggccaaggagtacggcctcatcgacgacatcatgcccaccgctgccggcatgccgggcggcggcggcaccggggcggcg

SEQ ID NO: 5433 - DNA, 678 bp, Streptomyces avermitilis
  CDS (1)..(678)
gtgaacgactaccccggcagcggcctccacgcccgcacgcaggccgagtacaccggcgcccgcgcggagtcccgctacgtcatcccgcgcttcgtcgagcgcacctcgcagggtgtgcgcgagtacgacccgtacgcgaagctcttcgaggagcgcgtgatcttcctcggcgtgcagatcgacgacgcctccgccaacgacgtcatggcgcagctgctgtgcctggagtcgatggaccccgaccgtgacatctcggtctacatcaacagccccggcggctccttcacggcgctcacggccatctacgacacgatgcagttcgtgaagcccgacatccagacggtctgcatgggccaggcggcctccgccgccgcgatcctgctggccgccggtacgccgggcaagcgcatggcgctgccgaacgcgcgcgtgctgatccaccagccctacagcgagaccggccgcggccaggtctccgacctcgagatcgcggcgaacgagatcctccggatgcgttcgcagctcgaggacatgctggccaagcactcgaccacgccgatcgagaagatccgcgaggacatcgagcgcgacaagatcctcacggccgaggacgcgctggcgtacggcctgatcgaccagatcatctccacccggaagatgaacaactcggcggtcgcg

SEQ ID NO: 5434 - DNA, 1284 bp, Streptomyces avermitilis
  CDS (1)..(1284)
gtggcacgcatcggtgacggcggcgatctgctcaagtgctcgttctgtggcaagagccagaagcaggtcaagaagctcatcgcaggccccggtgtgtacatctgcgacgagtgcatcgatctctgcaacgagatcatcgaggaagaactcgcggaaacgagcgaggtgcgctgggaggaacttcccaagccccgcgagatctacgagttcctcgaggggtacgtcgtgggccaggaggccgcgaagaaggctctctcggtcgcggtgtacaaccactacaagcgggtccaggccggtgagaacggcggcggccagagccgcgaggacgcgatcgagctggcgaagtccaacatcctgctgctcggccccacgggttccggcaagacgctcctcgcccagaccctggcccgcatgctcaacgttccgttcgccatcgccgatgcgacggcgctcacggaggcgggctatgtgggcgaggacgtcgagaacatcctgctgaagctcatccaggcagcggactacgacgtcaaaaaggccgagaccggcatcatctacatcgacgagatcgacaaggtcgcgaggaagagtgagaacccctcgatcactcgcgacgtgtccggtgagggcgtccagcaggccctgctgaagatcctcgagggcacgacggcctcggtcccgccccagggcggccgcaagcacccgcaccaggagttcatccagatcgacacgacgaacgtcctgttcatcgtgggcggcgccttcgcgggcctggagaagctcatcgagtcccgggccggcgcgaagggcatcgggttcggcgcgacgatccgctcgaagcgggagctggagtcgaaggaccagttcgaggacgtcatgcccgaggacctggtcaagttcggcatgatccccgagttcatcggccggctccccgtcatcacctcggtccacaacctggaccgcgaggccctgctccagatcctcgtcgagccgcgcaacgcactggtgaagcagtaccagcgcctcttcgaactcgacggtgtggagctggacttcgagcgcgaggccctggaagccatcgccgaccaggcgatcctccgccagaccggcgcgcgtggcctgcgcgccatcatggaggaagtcctgatgtcggtgatgtacgaggtcccgtcccgcaaggacgtggcccgcgtcgtcatcaccgcggacgtcgtccactcgaacgtgaacccgacgctgatcccgagggacgcccgcggccggggcccgggggagcagaagacggcg

SEQ ID NO: 5435 - DNA, 966 bp, Streptomyces avermitilis
  CDS (1)..(966)
atgagcttcaaccagccgggcccgtacggcgggcagcctcagcagcccgggccgtacggtcagccgggcccctacggccagccgccgcaggccccccagcccggctacggttacccgcagcaggcgccccagcagcccggctacggctacccccagcaggctccgcagggtgccccgccgcagcagcccccgtacggccagcagcccggctacggccagcagccgccgtacggccagcagcctccctacggcgtcccgcagccgccggctccgggcggcggcaagaagaagaccggcctcatcatcggtgccgtggcggtcgtggccgcggtcgcggtcggcgcgtacttcgtcatcgggagcggcggaggctcgggcctcgcggacgacggtgcccacaagctgacgactccgcagacggtgctcagcgagtacaagcgggtcggcaagggcggggagagctccagcaacagcaccgtgaaggacctcgcggagagcggcgtcaagaacggcaagtccgtcgtcggcttctactcgacggccgacttcggcaactacgaccccgagaacccctcggacaccagcgacctgcccagccagtccgagctcctgacggccaagggcgtcacgatggcgggcggctacggcacgatcgcggaccccaaggcggccctggacaagttcttcgccgcgctcaagaagaacgccgaggagagctcctccggcagcaagtccgagctgatcggctcgcccgagtcggtcgacctcgacggtgcggtcatgaagtgccagtcggccaagagcaccaactcgctcaccaagaaggtgtcgaccgactggttctgcgcctgggccgactacagcacgatcgccatggtctcgcccggtgacaacacgggcagcgtgtcgaaggacgtcgcggcggacatcaccacgaagctccgcgaccaggtccgcgtcaaggcc

SEQ ID NO: 5436 - DNA, 2622 bp, Streptomyces avermitilis
  CDS (1)..(2622)
gtgaccgagaactctcagcagcagccaccagcgtccgaacccgaactgccgacccagtacgcgccggccgatgtagaggggacgctgtacgagcgctgggtagagcgcggttacttcgaggccgacgcgaagagcgacaagcctcccttcacggtcgtcatcccgccgccgaacgtcacgggcagcctgcacctcgggcacgccttcgaacacaccctcatcgacgccctcacccgccgcaagcgcatgcaggggtacgagacgctgtggcagcccggcatggaccacgccggcatcgccacgcagaacgtcgtcgagcgggagctgggcaaggagggcaagtcccggcacgacctggggcgtgcggccttcgtcgagcgcgtctggcagtggaaggccgagtccggcgggcagatctccggtcagatgcgccgtctcggtgacggtgtcgcctggtcgcgtgagcgcttcaccatggacgaggggctgtcgcaggccgtccagaccatcttcaagaagctctacgacgacgagctgatctaccgcgccgagcgcatcatcaactggtgtccgcgctgtctcacggccatctcggacatcgaggtcgagtaccaggacgacgacggcgagctcgtctccatgaagtacggggagggggacgacacgatcgtcgtcgccaccacccgtgccgagacgatgctcggtgacacggccgtcgccgttcacccggacgacgagcggtacaagcacctcgtcggcaagaccatccgcctcccgctcaccgagcgtttcatcccggtcgtcgccgacacccacgtcgaccccgagttcggcacgggcgccgtcaaggtcaccccggcccacgacccgaacgacttcgagatcggccagcggcacaacctgcccaacatcgccgtgatggacgagcacgcggtcatcacggtctccggcccgttccaggggctggaccgcctggaggcccgttccgccatcgtcgccgcgctgcgcgccgagggccggatcgtcgccgagaagcggccgtacgtccactccgtgggccactgctcgcgctgcaagaccaccatcgagccgcgcctgtccatgcagtggtgggtcaaggtcggcccgctcgccaaggccgccggtgacgcggtccgcgaggggaaggtcaagatccatccgcaggagatggagaagcggtacttcgactgggtcgacaacctccacgactggtgcatctcgcgccagctgtggtggggccaccgcattcccgtctggtacgggccgaacggcgaggtcgtctgcgtcggccccgacgacgaggtgcccacgggcgagggctggtcgcaggacaccgacgtcctcgacacctggttctcctccggcctgtggccgttctcgaccctcggctggcccgaacagaccgagagcctcgcgaagttctacccgaactccgtcctggtcaccggctacgacatcctcttcttctgggtcgcccggatgatgatgttcggcctgtacgcgatggacggcaccccgccgttccacaccatcgccctgcacggcatggtccgcgaccagttcggcaagaagatgtcgaagtccttcggcaacgcggtcaatccgctggactggatggacaagtacggctcggacgcgctccggttcacgctggcccgtggcgccaaccccggtgtcgacgtcccgatcggcgaggactgggtccagggctcgcgcaacttcgccaacaagatctggaacgccacgcgcttcgcgctgatgaacggcgcgacggtcgagggtgaactcccgcccgtcgagcagcagtcggccaccgaccgctggatcctgtcccggctcaacgccacggtcgccgaggtcgacgccctctacgacgactaccagttcgccaagctgtcggacgccctgttccacttcgcgtgggacgaggtcttcgactggtacgtcgagctgtccaagacgacgttcatgggcggcggcgaggccgcgaaggtgtcgggccgggtcctgggtgaggtcctggacgtcacgctgcgcctcctccacccgatcgtcccgttcgtcaccgagacgctgtggaccaccctcacgggcggcgagtcggtcgtcatcgccgactggccggttgactcgggcttccgtgaccaggccgccgagaaggagatcgagacccttcagtcggtcatcaccgaggtccgccggttccgcgccgaccaggggctccagcccggccagcgcgtcccggcccggctgaccctcgacgatacggcgctcgccccgcacgaggcggccatccgtcagctgctgcgtctccagccggagggcgaggacttcgcggccacggcgaccctgccggtcgcgggtgccacggtcgcgctggacctgtccggcacgatcgacatcgtggcggagcgcaagcggctcgccaaggacctcgcggcggccgagaaggagaaggcacaggcgggcgccaagctcggcaacgaggcgttcctcgcgaaggcgccggaccacgtcgtggacaagatccgcggccgcctcgccaaggcggacgaggacatcgcccgcatccaggcacagctggaccggatgccggaggcc

SEQ ID NO: 5437 - DNA, 1359 bp, Streptomyces avermitilis
  CDS (1)..(1359)
gtgcccgcgcgtcccgccgaccccgagaccgacaaagcgctgcgcgaggtcgaggccgagctcgccacccgctggggcgagaccaaactggagccctccgtcagccgtatcaccgccctgatggacgtgctcggggacccgcagcgcgcgtacccctcgatccacatcacggggacgaacggcaagacctccaccgcccgcatgatcgaggccctcctcggcgccttcgacctgcgcaccggccggtacaccagcccgcacgtccagtcggtcaccgagcgcatcagcctcgacggcgccccgatctccgccgagcgcttcatcgagacgtacgacgacatcaagccgtacatcgagatggtcgacggccagcaggagttccggctctccttcttcgaggtcctgaccggcatggcgtacgcggccttcgcggacgcgcccgtcgacgtggcggtcgtggaggtggggatgggcggcagctgggacgccaccaacgtcatcgacggtgacgtcgccgtcgtcacgcccatcgacctcgaccacaccgaccggctcggcgagacacccggcgagatcgcctcggagaaggccggcatcgtcaagcaggacgccaccgtgatcctggcccagcagccggtggacgcggcgcaggtgctgctgaagaaggccgtggaggtcgacgcgaccgtggcccgggagggcctggagttcggggtcgtctcacgtcaggtcgccgtcggcggacagctgctgacgctgcgtggcctcggcggcgagtacgaggaggtgtacctgccgctgcacggtccgtaccaggcgcacaacgcggccgtcgcgctcgccgccgtcgaggcgttcttcggcgtcggctcccagcggcccgagccgctcgacctcgacacggtccgcaaggccttcgccgcggtgaccgcgccgggccgcctggaggtcgtacgccgctcgccgaccgtcgtcctggacgcggcccacaatccggcgggcgcccgcgccaccgcagaggccgtcggcgaggccttcgacttcagccggctcatcggagtggtgggggccagcggcgacaagaacgtccgggggctgctcgaggccttcgagccgatcttcgccgaggtcgtgatcacccagaactccagccatcgcgcgatggacgccgacgagctggccgcgatcgccgtggaggtcttcggcgaggaccgcgtccaggtcgagccgcgcctcgacgacgcgctggaggccgcgatcacactcgccgaggaagagggcgagttcgcgggcggcggcgtcctcgtcaccggctccgtcatcaccgtcggcgaggcccgactgctcctcgggaggggc

SEQ ID NO: 5438 - DNA, 366 bp, Streptomyces avermitilis
  CDS (1)..(366)
gtgcgtacgctctgtgcttcgaccctgatcggcgaggtcttcgtgatcgggttcgccgggctggtcgcgatgaaggacccggacctgtccacgggcacggtctggacggtcagcggcatcgccatggcggtgtgcgtcctgctctgcggcatgatcacgcggcccggcggcgtccagctcggctgggccctgcagatcgccctgatcgcctccggcttcatcgtccccagcatgttcttcctgggtgcgatcttcgcggccctgtggtgggcgtcggtccactacggccgcaagatcgacgaggcgaaggcgagattcgcggcgcaggccgcggaccaccccgctccagtaccacctgacgctgcg

SEQ ID NO: 5439 - DNA, 411 bp, Streptomyces avermitilis
  CDS (1)..(411)
gtgagccagcgcaccctcgtcctactcaagcccgacgccgttcgtcgcggcctgaccggcgagatcatcagccgtatcgagcgcaaggccggctgggcgatcaccgcgctggaactgcgcacgctggaccaggacacgctggagcagcactacggcgagcacaagggcaagcccttctacgagccgctggtggagttcatggcgtccggcccggtcgtggccctggtcgtcgagggcgagcgggtcatcgagggtgtccgcgcgctggccggtccgaccgacccgatcgccgccgcgcccggttccatccgcggcgactacggtgtgatcgtccgcgagaacctgatccacgcctcggactcggaggaatccgccgagcgcgagctgaagattttcttccccggccgggtc

SEQ ID NO: 5440 - DNA, 1029 bp, Streptomyces avermitilis
  CDS (1)..(1029)
atggggaactcaatgtcgttcatcggccgtgacatggctgtcgacctcgggaccgccaacacgctggtgtacgtcaggggtcgcgggatcgtactcaacgagccgtccgtcgtcgcgatcaacaccaacaccggtggcatcctcgcggtcggctccgaagcgaagaagatgatcgggcgcacgcccggcaacatcgttgccgtgcgtccgctgaaggacggtgtgatcgccgacttcgagatcaccgaacgcatgctccgctacttcatcctgaagatccacaagcggcgctacctcgcccgcccccgcgtcgtcgtctgtgtgccctccggcatcaccggtgtcgagcgccgcgcggtcatcgaggcgtcgtcccaggccggtgcccgccaggtgcacatcatcgaggagcccatggccgcggccatcggttccggcctgccggtccacgaggccacgggcaacatggtggtggacatcggcggcggcaccacggaggtcgcggtcatctcgctcggcggcatcgtcaccgcccagtccatccgcgtcgccggcgacgaactggacaacgcgatcatccagcacatcaagaaggagtactcgctcctcctcggtgagcggacggccgaacagatcaagatcacgatcggttcggcgtacgacctcgacactgacgagcacaccgaaatccgcggccgggacctcgtctccgggctgccgaagaccgtcgtcatctccgcggccgaagtgcgcaaggccatcgaggaaccggtcaacgcgatcgtggacgcggtcaagacgactctcgacaagtgtccgccggagctgtccggcgacgtcatggaccgcggaatcgttctgaccggcggcggagccctgctgcgcggcctcgacgagcggctgcgccgcgagaccggcatgccgatccacatcgcagaggaccccctggacagcgtggcgctcggctccggcaagtgtgtcgaggagttcgaggcgctccagcaggtcctggacgcccagccgcgcaga

SEQ ID NO: 5441 - DNA, 942 bp, Streptomyces avermitilis
  CDS (1)..(942)
gtgagggacacacgagagagccggctgctcctggtgctgctggtcgccatcgcgttcgcgctgatcacggtggacatccgtggcgggcaggactcaccggtcgacggtgcccgccaggccgccgccacggtcttcggcccgatcgagaacggggtgtcgtcggcggtcgaccccgtcggcaacgcggtcgcggccgtacgcgactccggcagccggcacgaccgcatcgcccaactcgagcacgacaacgcggccctgaaggcgaagctcggcagcgacgaccgcaaccgcagccgcctcaagcagctcaacaagatgatcagggtggcgggcgagggccagtacgggatcaagggcgccgaggtcatcgggataggagcggcccagggcttctcctggaccgtcaccatcgacgtcggcgcgaacgacggcatcaagcgcgacatgaccgtcctcaacggggatggtctcgtcggccgggtcaccacggtcggcccgaacgccgccaccgtgctgctcgccaacgaccccgacttcacggtcggcacgcgcatggagtccagcgacgaactcggcttcgcctccggacagggcgaccgcccgctgcgcgtgcaactgctcaacggcaaggccaaggtggtgaagggcgaccgtctggtcaccttcggctcgcaggcggaccggccgttcgtgcccggtgtaccggtcggcgtggtctcccgggtcgatccctccggcggcgacctgacccgcacggtctacgtcacgccgtatgtctcgttcacgaagctcgacatcgtcggcgtggtcgtcgcggcgcccaagaaggacccgcgcgacgaggtgctgcctcccaagcccagaccgacgcccacgccgaccgtgaccgtgacggtcaccccctccgcgaacgcgtccgccgacggccagcagcaacagcag

SEQ ID NO: 5442 - DNA, 669 bp, Streptomyces avermitilis
  CDS (1)..(669)
atgcgcttcaaccggatgctgctctccaccgccctggtggtggtggccctggtgatccaggtgagcgtcctcgcccgtctccacctcccgggcgccgtccccgacctggtgctcctgaccgtcctcggcctcgccatggtctacggccatgtcggcggcgccctcatcggcttcggcgccggcctgctcgccgacctcgtgccgcccgccgaccacgccgcgggccgctacgccctcgtcctgtgcgtcatcggctacctcgccgggctggccaagcccgagaacggccgcctcaagtccgcgtccggccccatggccgtggtcgtcgccgcggcgatcggcacgaccctgctgtacgcgggcgtcggcgccctcgtcggcgacaccgccgcccgacatgtgggcctcgtcagcctgttggtgacggccgccgtgtacgacctgctgctcgcgccgttcgtggtccccgggatcatggcactggcccggcgcgccgagaacgacccgctcgccgagggcggctccggtgccaaggcggccgacgtctcctcgggctggctgtcctccggcaccggtctgcgcatcggcggccagcgtggcgggctgcgcgcgaaggcggtcaaggcacgggtggcccgggcgggacgcatcaagggggtcaagcggctg

SEQ ID NO: 5443 - DNA, 2247 bp, Streptomyces avermitilis
  CDS (1)..(2247)
gtgaccaacatccccgagaccggtcggaccccacgggtccagatccgcctcgtcgtcatccagatcctcgtcttctccctgctcggcaccctcggcggccgcctctggtatctccagatccgcaacggcgacgagtacgccaaggaggcctccggcaaccacgtccagcaggtcgtccagcccgccgtacgcggctcgatcctcgatgcgcgcggcgtgccgatcgccgacaacgagacccgcctcgtcgtgtccgcctcccgcaccgatctgctgaagatgaaggacgacggcaaggccgtcctcaccaagctcgcgggcgtcctggacctcaagcccgaggacgtcatagagaaggtccggctgtgcgacgccaagacgccccagccctgctggaacggctcgccctaccagcccatcccgatcaccgacgaggccaccgccaagcaggccctgcagatccgcgagcgctccgaggatttccccggcatcaccgccgagcccgaggccgtgcgccgctacgccgcccccggcgaggccaacaccgcgcaggtcctcggctacctgtcgccggtcaccgacaacgagctccagcaggccaaggactccgactcgccgtatctgcgctccgaccaggtcggccgctcgggtcttgagcgccagtacgacaaggagctgcgcggcaaggccggcgtcacccgctacgaggtcgacaacctcggccgggtcatcggcaaggccaagagcgacgcggccgagcccggttccaacctcgtcaccagcatcgacgcccgtgtgcagcgcgtcgccgagtacgagctcaacgacgcgatgaaggtcgcccgtacccagttcgacaagaacaccaacgaaaactacaaggcggactccggcgcggtcgtcgtgatggaggccaagaccggccgtgtggtcgccatggcgtccaacccgacgtacgacccgaacgcctgggtcggcggcatctccgccaaggactacgccaggctcaccggcaagaagtccaactacccgctgctgaaccgcgccattcagggtcagtcggcgcccggctccaccttcaaggtcatctccacggccgccgccgtcgaggcgggctatgacttcaacggccactacccgtgcaccagctcgtactcgatcggcagtcaggtcttcaagaacttcgagtcggagaacttcggcccgatctcgctcggccgcgccctcgaggtctcctgcgacaccgtcttctacggcctcgcccacaacgagtggaagagggacgggggcatcaaccccaagaagaagacgaacgactggttcttcaaggccgcccaccagttcggcctcggcaaggagaccggcatcgacctccccaacgaggtcaccggccgtatccccgaccgccagtggaagcagagctactggaaggccaacaaggacgcctggtgcaagtccggcaagaaggacggcgactacgtcgagaagatcgcgtacgagaactgcctcgaaggcaacaagatgcgcgccggtgacgcggtcaactactccatcggtcagggcgacacgctcgtcactcccatccagatggccacgatctacggggcgatctccaacggcggcaccctgtacgaccccaccgtcggcaaggcggtcgtcagcgccgacggtaagaacgtgcgggagatcaagccgaagtcgcacggcaagctgcccataagcaagtcgacgcgggatcagatggacgaggccctcgcgggcgtcgccacccggggtacggccgcctggcggttcggcggctggccgcaggacaagatcccgatgcacgccaagacgggcacggccgaggtctacggcaagcagaccacctcgtggttcgccacgtacaccaaggactacacggtcgtcatgacgatctcccaggccggtacgggctccggcgcctcgggccccgcggtgcgcaagatctacgacgcgctgtacggcgtctcccaggacggcacgatcgaccggaagaaggcgctgctgcccaccccggagaagagcctgcccaagatccagaacgacggctcgatcgacgcccccaaggtcgagaagtacgacccgaaggcggaccagacgagcgaggagggcgggcagccggcggccaccgacagcccggcggccaccacgccctcaccgaccaccggcaaccgcgacacccgaaggcgcacggcccgccccaggaagcggcggaggatgctgaca

SEQ ID NO: 5444 - DNA, 1194 bp, Streptomyces avermitilis
  CDS (1)..(1194)
atgaccggcaacagcttctccgtctccggttacgggcccgaccgcgccggctggacgcggatcttcgcccgcgactcgctggcccgccgcctcgactggccgatactgctctcggccgtcgcgctctcgctgatcggcgcggccctcgtctactcggcgacccgcaaccgcaccgagatcaaccagggcgacccgtactacttcctgatccgtcacctgatgaacaccggcatcggcttcggcctgatggtcggcacggtctggctcggccaccgcaccctgcgcaccgccgtgccgatcctctacggcctctcggtgttcatgatcctgctcgtgctcaccccgctcggcgccacggtcaacggggcgcacgcgtggatcgtgttcggcggcggcttctcgctccagccctccgagttcgtgaagatcacgatcatcctggggatggcgatgctgctcgccgcccgggtcgacgcgggcgacaagccgtatccggaccatcgcacggtcgtgcaggccctgggcctggccgccgtaccgattctggtcgtcctgctcatgcccgacctcggttcggtcatggtcatggtgatcatcatcctcggcgtgctgctcgcctccggcgcctccaaccgctgggtgttcggcctgctcggcacgggcgccctcggcgcgatcgcggtctggcagctgcacatcctggacgagtaccagatcaaccgcttcgccgccttcgccaaccccgagctcgacccggccggcgtcggctacaacaccaaccaggcgcgtatcgcgatcggctcgggcggtctcttcggcaccggcctcggacagggctcccagaccaccggccagttcgtgcccgaacagcagacggacttcgtgttcacggtcgcgggcgaggagctgggcttcgtgggcgccggactgatcctcctgctgctcggcgtcgtgctgtggcgggcgtgccgtatcgcccgtgagacgaccgagctgtacggcacgatcgtcgccgccgggataatcgcctggttcgccttccagtccttcgagaacatcggcatgaccctcggcatcatgccggtcgcgggtctgccactgccgttcgtctcgtacggcggctcgtcgatgttcgcggtctgggtggcggtcggactgttgcagtcgatcagggtgcagcggccgatgtcggcc

SEQ ID NO: 5445 - DNA, 1521 bp, Streptomyces avermitilis
  CDS (1)..(1521)
atggcggacacgaagcgagagatcgagcgaaagtacgagggacccgcgaccggcagcggcgcgggcctgccgggcctgacggcggtccccggagtcgcgagcgtcgtcggcaagggcgtcaccgagctggacgccacctacttcgacacggccgaccaacggctcgccgcccactccatcaccctgcgccgccgcatcggcggcgaggacgagggctggcacctgaaactgcccgtcgccgacgacgtacgcgacgagatccacgcccccctcgccgacacggtgccccaccacctctcctccctggtgcgctcccgcatccgggacgccgagctcgttcccgtcgtacgtctgcggtcctcccgcgacgtccaccatctgctcgacgcctcgggcgccctgctcgccgaggtcagcgtcgaccgggttcgcgccgagcgcctcgacggcggcgagggcgccacccagtggaccgagatcgaggcggagctggcggacggcggcgaccccgccttcctcgaccgggtcgagaagaaactcctcaaggccggcctgcaccggtccacgtccacgtccaagctggccagggcgctggaggagaccggagccgcggcgaagcggctcaccggagcaccggcggcccccgagccccccaccaccgcgggggaccacgtcctcgcctacctccgcgcccagcgcgacgccctcgtcgaactcgacccggccgtccgccgtgacctgccggacgccgtgcaccagatgcgggtcgccacccgccgcatccgcaacaccctgcgctcgtacaccgccgtcctggaccgcacggtcaccgaccccgtccgcgtggagctgaagtggctggcgggggagctgggcgtggaccgcgaccaggaggtcatcaccgaacggctgtcggcggaactcgacgagcttcccagggcactcctgtcggggccggtgcacaaccgcgtgcgcagctggtcgcagcggcgccatgccggctcccggaaggcgctgatcgcggtgctcgacggccggcgctacctgtatctgctcgccgccctggacgcgctcgtctccgatcctcccctgcgcaaggccgccggccgcaagccgcggaaggtgctcggcaaggccgtacggaaggacttcgagaagctctcccggctggtgacgaaggccctggagctgccgcccggcaaggaacgcgacctggcgatgcacgaggcccgcaagaaggccaagcggacgcggtacgccgcggaggtcgccgcccccgccctcggcagggccgccaagtcccaggccaagtccatgaaggacgtgcagaagctactgggcgaccaccaggacagcgtcatgtcccgggacgccctgcgggacctggcggagaaggcgcaggaggcgggcgagagctccttcacctacggggtgctgtacggccgggaggagcagcgggcggcggccgacgagagcgcgctgccgaaggcgtggaagaaggcccggcgcaaggcccgggtc

SEQ ID NO: 5446 - DNA, 1956 bp, Streptomyces avermitilis
  CDS (1)..(1956)
atgcctgccgaaaccgctgtatcggtgttcccgcagctcgaagctctgctcccgcatgtgcagaagccgatccagtacgtcggcggagagctcaactccacggtcaagccctgggacgcctgtgacgtccgctgggcgctcatgtatcccgacgcgtacgaggtcgggctgcccaaccagggcgtcatgatcctctacgaggtgctgaacgagcgcgagggcgtgctcgccgagcgcacgtacagcgtgtggcccgacctcgaggagctgatgcgggagcaccagctcccgcagttcacggtggacagccaccgtcccgtcaaggctttcgacgtcttcggtctgtccttctccacggagctgggctacacgaacatgctcacggccctggacctggcgggcatcccgctggagtccaaggaccgtacgctcgacgacccgatcgtcctggccggcggccacgcggccttcaaccccgagccgatcgcggacttcatcgacgcggcgatcatcggcgacggcgagcaggccgtgctcgacatgaccgacatcatccgcgcctggaaggcggagggccgtcccggcggccgccaggaggtcctgttccgtctcgcgaggacgggatcggtgtacgtccccgccttctacgacgtcgagtacctcccggacgggcggatcggccgcgtcgtaccgaacaagagcggtgtgccgtggcgggtcagcaagcacacggtcatggacctggacgagtggccgtaccccaagcagcctctcgtcccgctcgcggagacggtccatgagcgcatgtcggtcgagatcttccgcggctgcacacgcggctgccgcttctgccaggcgggcatgatcacgcgcccggtgcgtgagcgctccatcacgggcatcggcgacatggtcgagaagggcctgaaggcgacgggcttcgaggaggtcggcctcctgtccctgtcctcggcggaccactcggagatcggcgacctcgccaagggcctggcggaccggtacgaggaagacaagatcggcctctccctcccctccacccgggtggacgccttcaacgtcgacctggcgaacgaactgacgcgcaacgggcggaggtccggtctcaccttcgcgccggagggcggctccgagcgcatgcgcaaggtcatcaacaagatggtctcggaggaggacctgatccggacggtctccaccgcgtacggcaacggctggcgccaggtgaagctgtacttcatgtgcggcctgccgacggagacggacgaggacgtcctccagatcgccgacatggcgatgaacgtgatcgccgagggccgcaaggtctccggtcagaacgacatccgttgcacggtgtcgatcggcggtttcgtccccaagccccacacccccttccagtgggccccgcagctgtccgcggaggagacggacgcccgtctcggaaagctccgcgacaagatccgcggcgacaagaagtacggccgctcgatcggcttccgctaccacgacggcaagccgggcatcgtcgagggcctgctctcccgcggtgaccgccgcatcggctccgtcatccgcgcggtctacgaggacggcggccgcttcgacggctggcgcgagcacttctcgtacgaccgctggatggcctgcgccgagaagaccctccccgccttcggcgtggacgtcgactggtacaccacgcgtgagcgcacgtacgaggaggtccttccctgggaccacctggactccggcctcgacaaggaatggctctgggaggactggcaggactccctcgacgagaccgaggtcgaggactgccgctggacgccgtgcttcgactgcggtgtctgcccggcgatgcagaccgagatccagatcggtccgacgggcaagaagctgctgccgctgacggtcaacaagcctgcggtcagcggtcacagccac

SEQ ID NO: 5447 - DNA, 1329 bp, Streptomyces avermitilis
  CDS (1)..(1329)
atgcatcatccgcgttcccctgagcgcacggcgcccgccgccttccccctcactggacggagcggagccatgcactctctgaggcgaaggctgggagtttgttcccttgcggtgggcttcattgctgtgctggctgtgccctcggccgacgccgcggtcccggcaggagccggtcaggcggactttcccaaggtttcctgcggatggccggcggtggtcagccccagcaggttgaacttcgcgttccccgagaccaacgccacctactgggtcatgccgtaccagttggccaagggtgaccggctggtggtggacggaacctatccatcagcccgtttcacatcgctgacgacgtacgacgtcaagggatcgacggtcgactcgctcgccgacaaggcgatcaccccgaattcgggaagcaagaacccgttcgcccaggccaacgccggcacgaaccctgccgagcaccggtaccgcgtcaccgtccagagcggagtcgcagccacccccggccacaacaccttggccgcgaccgccgacagcgccgcgtccggcgccgggtttctcgcgttgaggatctacgtgccggacgaggagtccgaccccacgggcggcgttcccctccccgcgctctccctacagcaccagggcggcagcacgagcacctttgacacctgcgcgaatgccggatctgcccacggcgacgccggaccactggccgggttcctccggcaactggtgaagaagtacgcgcctccggggggcttcgagggatgcgggaagtcgactccgagcgctccggacttcgccgtgcccaacaaagccgaagggctgttccccaacccctacaacaagtacctgtgcaccccggtcagccatgaatccggccgcatcgccgtcatccgcggcaaggcacccaccttccccgacaccatccagggccagtcggtcctcaccaagacacaactcaggtactggtcgctctgccagaaccagtggcagcttccctacccgtcgagttcctgcgccgccgactaccaaacggccctgaaggacgggcagtacaccttcgtggtctccaccccgcaggaccggcccaccaacgcgaccacgaccgacaaggtcacctggatctcctggggccccaccgacgtcaacggcatcctgctcttccggaacatgctcccggccggggacttccacaacgccgtgcagaacatccagaagggacaggacccggccacggtcatgggcccgtactacccgaccatcacgtactgcgccaaggccacgttcgaaaagggcggaccggacgcctgcccggcccgg

SEQ ID NO: 5448 - DNA, 1245 bp, Streptomyces avermitilis
  CDS (1)..(1245)
atggatctggaaaagccgtccacccagcagcccccgcccgacgggtgcctcgtcgtcgcgatccgtcttcccgtgcggatcgtcgtgcttgtgctggtcgtgcccgtgcggatggtgtgggacgcgctggtcgtcggcgggcggttcctgagggacaccgtgctgcggccggtggggcgggcactccagtgggtcgcccgggccgtgttcgtctggccgtgggtcacgctgtggcggtacgtcgtcgtgcccgtgggcaaggggttcgcccggctcgggtacgtgctgttcgtcgtccccgccgggtggctgtaccggaacgtcctcacgcccctcgggcacgggatcacctgggtgctgcggggcctcggggccggactcggctgggtcctcgtcaggatcggggctgggaccgcctgggtgctgcggggcatcggcgccgggctcggccgggtcctcgccgggatcggcgccgggctcgcctgggtgtaccggaccctgctcacccccgtcggacacggcatcgcctggctgctccgcggactcgggctggtgctcgcgacggtcggcctcggggcgtacgcggcggtggcgtggctggtgcgccacctgctcgtcataccggcgctgtggtcgtaccgccatgtgctcacacccctcgggcacggcatcgcctgggtcgcgaggggcgtcgcctggctgggcggcatggccgtcaccgggatcggcgccgtcctccactggacgctgcgcatcctgttcgtcctgcccgcgctggccgtccggcgctggatcctcacgccggtcggacgcgtgctggcggtcgtcgcgcgggagatcggcgatgcgctggggcacgcctggcgcgtcgcgggacgcctctcgctcgtcgtcggacgttttctcggcaccctcttccggtggatcttcgtggagcccgtgcggtgggtgtaccggtgggtcttcgtggagcccgtgcgatgggtgtaccgaaccgtgctgaccccggtcgggcacgtcgtgcgcgacatggtcctgcggcccgccgccgaggccgcgcgcggcgtgggcagggtcacccggcaggcgctcgccaccgcccgcgagtccgcccggcaggcgcgcgccgacttccggcggatgctcttcggcggtccgcgtgagccgcagccggtcgcccggcgggaaccgggagccgctgaggcacgtactctaggtagcagtacgaccgttctcacgaaggac

SEQ ID NO: 5449 - DNA, 792 bp, Streptomyces avermitilis
  CDS (1)..(792)
gtgcagcgcatccgactgcgctacaccaagcgcggccgcctccggttcaccagccaccgagacttccagcgcgccttcgagcgtgcgctgcgccgtgccgaggtgcccatggcgtactcggcggggttcacgccgcatccgaaggtgtcgtacgccaatgccgcacccaccggcacgggcagtgaggcggaatatctggagatcgcgctcaccgaggcgcgtgacccggacaagctgcgcgagctgctcgacgagtcgctgcccaccgggctcgacatcgtcgacgcggtcgaggcccggacgtccgggctcgccgaccggctcaccgcttccgtgtgggagctgcgcctcgacggcgtggacccggcggacgcggagcgcgcggtcgaggccttcaagacggccgagaccgtcgaggtccagcgcaagaccaagaacgggatgcgcaccttcgacgcccgtggtgctgtggcaggccttgacgcacgtgtcgagacgcacagtccacaggctgataggccgacggaccagccctgtgcgatactgcgcctggttgttcggcacgtgacgcctgccgtacgacccgacgacgtcctgtccggtcttcgcgccgtggccgacctggcgccgccggtccccgcagcggtgaccaggctggcgcaggggctgttcgatgaagagaccggcacggtgaccgacccgctcgcgcccgaccgcgaggcagcagcgaccgcgccatccatggccgccgcgactgccgccgcgaaggcgccggtgccggaaggttccgcg

SEQ ID NO: 5450 - DNA, 4161 bp, Streptomyces avermitilis
  CDS (1)..(4161)
atgctcgagcccatcgaacccactgagggttccgacaacaacactcccagcgacaccctgccgccgcgtcgtcggcgccgtgccgcatcccgcccggcgggcccgccggcggcagtcgccgagacggcgaccggggcgaccgcgccggccgaggccgcggcggagaccaccgcgccgatcacacggcccgcggacatcgcggagaccgcagaggacgcggaggccgcggaggctgccgggacggaagagaccgaagaggccgccgtcgccgagccggccgaggtggcggctgccaccgaggacgccgctccgcgccgtacccgccgtcgcgccacgcgccgggtgtccgcacccgcgggcgcgccggaggccgcggagagcgccacggccgccgagaccgactccgcggctgagtccgtgaccgccgcgaccggttccgccgaggtctccgcgccggagaccggtgaggccgcggccgaggaagaggccgctcccaagggacgtacgcgccgtcgcgcgacccgccgggcatccgcgcccgccggtgcgcccaaggccgccgaggcgactgaggccaccgaggctgccgaggcgccggtgaccaccgaggccgaggtgaccgccgtcgctcctgaggttgctcaggaggagacccccgaggcagaggacgcggccccgcgccgtgcccgccgtcgtgccacccgccgggtgaccgcgcccgccgccgcgcccacgggcgacgccgccgaagagcgcgtggaggcgcccgtgaccgccagcgacaagaccgaggcccaggccgcgacgaaggccgaagcgaaggccgaggcgaaggccacgagcgagaccagggccgcggcccaggccgaggaggccccggccgctgaggccgcggccgagacggcggaggacgccggtccgcgccgttcccgccgtcgtgccacccgcaaggccgccgtcggcttctccgcgcccgcgcccaaggtcaccggggacgactccggtcgccggccggcgcggcccgccgtcgccgtgttccaggcgccggtgttcaccgagccgatgttccagacgccggagcgggcggccgctgccgctgccgccgaggccgcggtggagcggccggcggagcccgtcgaggaggagaccgcggaagcggccgccgagtcgggtgcgggtgccgccgccggatcgggcgcgggttcgactgccaggtcgggcgcgggttcgaccgcgggttcgcgccgtcgccgtcgccgtggcggcgccgaggacgagccggccgccgtgaccgccaccgaggatgtcgtcgaggagacggaggaggccgaggaggccgaggactccgtcgacggtgacgaggccgaggagaccggttcgcgccgtcgccgtcgccgtggcggccgtcgtcgccgtcgtggcgagtccgccgacgcggacgacgagtccggcgagtccgacgacctggccgccgagcaggcggagcaggacgtcgaggacaccgccgagcaggtcgaagaggacgacgaggaggcggacgagcgcgaggagtcgggcggtgccggctccagcagcagccgtcgccgtcggcgccgccgtcgtcgcgccggtgactccggcaccgacgccgagcccggcgagagcgaccccgagcgcaccgtcgtgaaggtccgcgagccgcgcagcagcaagaaggacgagcacccgtccgacgaggtgcagtccatcaagggctccactcgcctcgaggccaagaagcagcgtcgtcgggaagggcgcgagcagggccgccgccgtgttccgatcatcaccgaggccgagttcctggcccgccgtgaggccgtcgagcgtgtgatggtcgtccgccagagcggcgagcgcacccagatcggcgtcctcgaggacaacgtgctcgtcgagcactacgtcaacaaggagcagtcgacctcgtacgtcggcaacgtctacctgggcaaggtccagaacgtgctgccgtcgatggaggccgccttcatcgacatcggcaagggccgcaacgccgtgctctacgccggtgaggtcaacttcgaggcgctcggcatggccaacgggccgcgccgcatcgagagcgcgctgaagtccggccagtcggtcctcgtacaggtcaccaaggacccgatcggccacaagggcgcccgcctcaccagccaggtctccctgcccggccgttacctggtctacgtgcccgagggctcgatgaccggcatcagccgcaagctgccggacaccgagcgcgcccgcctgaagaccatcctcaagaagatcgtccccgaggacgcgggcgtcatcgtgcgcaccgccgccgagggcgcgagcgaggacgagctgcgccgtgacgtcgagcggctccaggcgcagtgggaggacatccagaagaaggcgaagagcggcaacgccccgaccctgctgtacggcgagccggacatgaccgtccgggtcgtccgcgacatcttcaacgaggacttcaccaaggtcatcgtcagcggcgacgaggcgtgggagaccatccacgggtacgtggcccacgtcgcgcccgacctgtccgaccgcctctcgaagtggacctccgaggtcgacgtcttcgcgacgtaccggatcgacgagcagctgatgaaggcgctcgaccgcaaggtctggctgcccagcggcggttcgctggtgatcgacaagaccgaggccatggtcgtggtcgacgtcaacaccggcaagttcaccggtcagggcggcaacctcgaagagaccgtgaccaggaacaacctggaggcggccgaggagatcgtgcgccagctgcggctgcgcgacctgggcggcatcgtcgtcatcgacttcatcgacatggtgctggagtccaaccgggacctggtgctgcggcgcctgctggagtgtctgggccgggaccgtacgaagcaccaggtcgccgaggtgacctcgctggggctcgtccagatgacgcgcaagcgcgtcggccagggcctgctggagtccttctccgagacctgtgtccactgcaacggacgcggtgtcatcgtgcacatggagcagccgacgtccgtcggtggcggcggcaagcgcaagaagcgcgggcgtggcggtgccgagcaggagctcccgcacgagcacgagcacgagcttgcgcaggagccggagccggacgaggctgtcgcggagacggaggccgaggtggccgccgaggtcgctgcccccgtcgcgctgcccgcgcccggctacgagcccgacgaggagctgtacagcagcgccgcggaggccgaggccgccgcttcccggggccgttcgcggcgccgggcgacccggcgggcgtcggctccggcgggtgccccgcgggccgaggagcgtgcgccgaggtcgcgggccgaggagcgcgcgcctaagtcgcgggctgccgcggaggcggagccgatggcggtcgaggacccggtcgtcgagccgcccgtggccgccgaacccgtggtcgccgagcccgtggtcgccgagcccgtggccgtcgccgaggaggaggccgctcccaaggggcgtacgcgtcgtcgtgcgacccggaaggtgtcggcgcccgccggttcgcccaaggccgccggtgaggcggagacggtgacggtggtggcgtccgcgccggaggcggaggagccgaaggccgagcagcccgctgagccggtggccgagccggccgccgggcccgaggcgcccgtggagagcgcggctccggcccgtccgcgccggcgcgcggtccgcaaggccacggcgccgacctcgtccgaggagacggccgtggtggtcgtaccgtcgagcgagacggcttcggccgacaccgctgccggtgcggctccgtctggtgaggccccttcggctgaggccccgtcggctgaggctgcttcgagtgaggccgaggaggccccggccaagaagacggccgctcgcaagacggccaagaaggcgaccgcgaagaaggcggcgacgaagaagaccgcggccacgaagacggccgccaagaagacgacggccaagaagacgacagccaagaagacggctgccaagtcgacgtcgaagaagacggcggcggcgtcccagccggccccgtcgacggtcaccgcctccaccgacgaggcc

SEQ ID NO: 5451 - DNA, 1347 bp, Streptomyces avermitilis
  CDS (1)..(1347)
atggcgcgcgtgcgcctgaagggcactgggcgacaccgtgctgtgaagccggtcaaggggggacgccaggccgtggccctggcgacggtgctgtccgcggcgggagtccaggccgtggcgtccgcgggtacggcggaggccgacaacccgacgtggaccgaggggccgatcttcaacgacccgctcggcacgacggaccagcagtacgccatccgcacccgcctgatcgagctgaccggcgctgcgctgcccggctcgaccatcaaggtcgcggtctaccacgtgtgggaggcgtccgtcgtcaacgcgctcgtggacgccaagaaccgcggcgtcaacgtgcagatcctgctcgacgagtcctcggtcagcgaccggcccaccaacacctcgtacagcacgctcgcggccgcgctcggcaccgaccgcgcgcagggctcgtacgtcaccacgtgcccggcgaacaagtcctgcctcggcgatccgaaattcgggcagtcgatcatgcacaacaagttctggctgttctccgcggtccagggcgccacgaacgtcgtcgtcgagacgacctccaactccacgccctccgcgcacacccgcttcttcaacgacgcgctactgctgcccaacaacccgacgatgtacgacgcctactccgactacttcaacacgatggtcaccaaggactgggcgtcctggaactaccgcacggtcagcaacggcctctacaaggcgtacttcttcccgcgcgccggcaacacccgggacaccgacaccgtctactcggtgctcaacaacgtccagtgcacgtacaaggacagcgcgggcgtcaagcagcagaccaaggtgcgcgtcgcgatcttcaagctcacccggatggcgatcgcggagaagctgctcgcgctgaagaaggcgggctgctcggtgagcatcgtctacgccgagaccgacagcgcgaagagctccggcggcaccaagggcacctgggagaagctgcacacctccggcggcccgaccgtgcgctgctacaacgacgaccgggaccccctgaaccccggccagaagctggcgacgccgttcatcatccactccaagtacatcctcatcgacggcatgtacgacggcgtgaagaacaaggtcagcttcacgggatccggcaactacacgggcccggccctgcgcgagaacgacgagtcgatcgtcaaggtcgacgacgacaccgtgcacgacatgtacaagacccacttcgaccgggtcacgaaggtcgcctatcccggcaccgcggacaccacggacctgtgcaagggcgtgaagccgctgccggacgacggcgagaagaccctgacc

SEQ ID NO: 5452 - DNA, 318 bp, Streptomyces avermitilis
  CDS (1)..(318)
ttgtacgccatcgtgcgcagcggtggccgccagcacaaggttgctgtcggtgacatcgttgaggttgacaagatttccactgcccaggttggcgacacggtcgagctctcgaccctgctcgttgtcgacggcgacgccgtgacgagtgacccgtgggtcctggccggcatcaaggtccaggccgaggtcgtggaccaccacaagggcgcgaagatcgacatccttcgctacaagaacaagaccggttaccgccgtcgtcagggccaccgccagcagtacacggcgatcaaggtcactgagatccccacggctgcgaag

SEQ ID NO: 5453 - DNA, 252 bp, Streptomyces avermitilis
  CDS (1)..(252)
atggcacacaagaagggcgcatcgtccactcggaacggtcgcgactccaatgctcagcggctcggcgtgaagcgcttcggcggtcaggtcgtcaacgccggtgagatcctggtccgccagcgtggcacccacttccaccccggcagcggtgtcggtcgtggcaaggacgacacgctgttcgcgctggacgccggtgcggtcgagttcggtacgcaccgcggccgcaaggtcgtgaacatcgttccggtcgcc

SEQ ID NO: 5454 - DNA, 1437 bp, Streptomyces avermitilis
  CDS (1)..(1437)
atgaccaccttcgtggaccgcgtcgagctgcacgtcgccgcgggtagcggaggccacggctgtgcctccgtacaccgggagaagttcaagccgctcggcggccccgacggcggcaacggcggccgtggcggtgacgtgatcctggtcgtcgaccagtccgtgaccacgcttctcgactaccaccacaagccgcaccgcagcgccaccaacggcaagcccggcgagggcggcaaccgctccggcaaggacggtcaggacctgatcctgccggtcccggacggcacggtgatccaggacaaggcggggaacgtactcgcggacctggtcggccacggcacctcgtacgtagccgcccagggcggtcgcggcggcctcggcaacgcggcgctggcctcggcccgccgcaaggcgccgggcttcgcgctgctcggtgagccgggcgacttccaggacatcgtcctggagctgaagacggtcgcggacgtggccctcgtcggctacccgagcgcgggcaagtcgtccctgatctccgtcctgtccgccgccaagccgaagatcgcggactacccgttcacgaccctcgtcccgaacctgggcgtggtgacggccggctcgacggtctacacgatcgccgacgtgccgggcctgatcccgggcgccagccagggcaagggcctgggcctggagttcctgcgccacgtcgagcgctgcagtgtcctcgtgcacgtcctggacaccgcgaccctcgagtccgaccgcgaccccgtctccgacctcgacatcatcgaggaggagctgacgcagtacggcggcggcctcaacaaccgtccgcggatggtcgtcctcaacaagatcgacgtaccggacggcaaggacctggccgagatggtccgccccgaactggaggcgcgcggctaccgcgtcttcgaggtgtcggcggtggcgcacatgggcctcaaggagctgtccttcgccctcgccgagctggtgggcgcggcgcgcgcggccaagccgaaggaggaggcgacccggatcgtcatccgcccgaaggcggtcgacgacgccggcttcacggtcgtactggaggaggacggcctctaccgcgtgcgcggcgagaagccggagcgctgggtgcgccagaccgacttcaacaacgacgaggccgtcggctacctcgccgaccgcctcaaccgcctcggtgtcgagacggagctgatgaaggcgggcgcccgcgcgggcgacggcgtcgccatcggccccgaggacaacgcggtcgtcttcgactgggagcccacggtcatggccggcgcggagatgctcggccgccgcggcgaggaccaccgcctcgacgagccgcggcccgccgcccagcgccgtcgcgacaagcaggcggagcgggacgacgcggagaaggagtacgacgacttcgagccgttc

SEQ ID NO: 5455 - DNA, 2172 bp, Streptomyces avermitilis
  CDS (1)..(2172)
gtggtcgaccttggttatgcgggtcgacaccacccccgcttccccccatccgccgcacccttcgcaggagcccagccagtgccctccgcaggcctcgccccacgccgcatcgcgcagttgtccacgctgctcgcgatgttcgcgctcttcacggcccagatcgtctccgcgctgctgccgaacgtcccggtgttcatcgcggcgagcgcggccggcctcgccctggacgtgtacctgcagtaccgggaccccggtctgctcgccctcctcggcaaggtccgcttcgacgtcacggtccgccagctgctgcgcgacatgctcatcctcgtggggttgcagcggatcgacgacatcgagccgctgaacgagcaggcgcccctggtgatcgccctgtgcggtttctacgcgctgcacttcacctgccaggccgtcgcggtcctggtccgccgctcccgcacgctcccggtcgtcacccgcaacatcgacgcgtcggcgctgcgcctgtccgccgccccgccgcgcattctggcccgccgccagggccaccggctgctgacgttctccatcccgaccacgatcggcctgctgatcaccgcggccaccaccgacgcgctctggggcggcatcggcgtggggatcgccatcgccctgctgctcggcggcatcgcgtacctcggcacctggctgacgaagaagaagcgcgccaagagcgagcagcaggtgatggagtggctggacaagtggctggcgaagtacaagccgacggtcgccatgtacttctcgggcggtacgtcgtcggcgtaccaggcgaacatgtggctctccacgctctccgcggtcgagggcaagccgctgatagtgctgcgtgagcgcttcatggtgcagaagatcgaggcgaccgacgtgccggtcatctgcttcccgaaggtgtcgacgatgttctcgctggagaactcgacgctgaagatgatgctgcacccggccaacgccgcgaagacctcgcaggtgctgcgcatccccaccatcaagcacgcgttcatcaaccacggcgagagcgacaagctgtcgtcctgcaacccgtacgcgaaggcgtacgacgaggtgtgggtcgcgggtccggccgcgcgcgagcgttacgcgctggccgaggtcggcgtcgaggacaaggacatcgtcgaggtcggccgcccgcagctggcgccgatccgcccctactccggggcgccgacgggaacgtacacgaccgttctgtacgcccccacctgggagggctgggacggcaacccgggcaacacctcggtggtcctggccggcgagaacatcgtgaagcagctgctcgccgacgacggcgtgcgcctgctctacaagccgcacccgatgaccggctccgtcgacccgcgcgcgggcgcggcgaacgagcgcatgaaggcgatgatccgcgaggccaacaccaggcgttcgggcgcccggccgggctccgaggccgcggccgaactggcccgccgcaccgccgagctggacaagctgacctccaccgcgttccgtgtgagcgcggacgaactggagcggatgatgctccagggcacgccgagcggtgaccgcgaggcggccatcgccgaggccacgctggcctgggagaaggcgtactgggcgtcgttcccggagtgggagcaccagatcatcaccgacgcgcgcccggcgatcttcgcctgcttcaaccaggctgacctgctgatcagcgacgtctcgtcggtggtctcggactggctgtccagcgagaagccgtacgcggtcgccaacacgtcgggcatgtccgagacggcgttccgcgtgggcttcccgacggtctccgccggcgtgatcctcacccccgccgcggacggcgtcccggcgctgctggagtcggtccgccacccggagaaggacctcttcaccgcggcccgcgccgaactgaaggaacacctcctcggcccgtcggacccgccgtccctggcccgcttcaacgcggcgatcgcggacctgtgcacgaaggcggacgagcggcgggtgcggatggagtcgcgcctggcggtggagatcccgtcgccgcgcggcgccgccgaggagacggcacacgaatcgacgcaggggctccaggccgaggacgacggggcggaggactcggtcaacgcg

SEQ ID NO: 5456 - DNA, 1125 bp, Streptomyces avermitilis
  CDS (1)..(1125)
gtgtcagcggcaaggcagggtgtggctcaggcccgcaggatcgtcgtcaaagtgggctcctcgtccctgaccaccgccgcgggcggactggacgccgaccgggtcgacgccctcgtggacgtactcgccaagagccgcagcggcggcgagaaggagatcgtcctcgtctcctccggagccatcgccgccggtctggcgcccctggggctgcgcaggcgccccaaggacctggcccggcagcaggcggccgcaagcgttggccaaggccttctggtggcccgctacaccgcttcctgcgcccgccacggcatccgcgtcggtcaggtgctgctcacctccgacgacaccagccgccgcgcgcaccaccgcaacgcctcccgcaccctcgacaagctcctcgcgatgggcgccctgccggtcgtgaacgagaacgacacggtcgccacggacgagatccgcttcggcgacaacgaccggctcgccgccctcgtcgcccacctcgtacgagcggacctgctggtcctgctgtccgacgtggacggcgtgtacgacggcgatcccagcaagcccggtacgtcgcgggtggcgcaggtgcacggcccgcaggacctcgcgcacgtggagatcggcagcgcgggccgggccggggtcggcaccggcggcatggtcaccaagatcgaggcggcccggatcgccgccgcggccggcatccccgtggtgctgaccagcgcggtccatgccgccgacgccctcgcgggccgggacaccggcacctacttccaccccaccggcaagcgctccgcggaccggctgctgtggcttcagcacgcgtccactccacagggcgcgctcaccctcgacgacggggccgtgcgcgcggtcgtcgagcggcgcaagtcgctgctgcccgcgggcatcgccgcggtcgagggcgagttcaccgcgggggaccccgtcgagttgcgcgacagtgaggggcgcgcggtggcgcgggggctcgtgagcttcgacgccaaggagatcccgcagctgctcggccgctcgacgcgggaactggcgcgcgagctcggtcccgcgtacgaacgagaggtcgtacacagggacgatctcgtcctgctgcaaccg

SEQ ID NO: 5457 - DNA, 543 bp, Streptomyces avermitilis
  CDS (1)..(543)
gtgagacgagtgcgccctggggcggccgcgtcccgcgatggtggcacctcccggagcgtcggcgccacgcgcgcggtcggtgaggaacgcgccctgacgagcgtcgcggccggggacacgtacgacggcgacacatacgacggcgacacgtacgacggcgacgtgtacgagggcgactcgtacgagcgcgaggagccggtggaggtgccccgcctgtggcacgtcacgctcagcgtctcgggcggtgaggctccgctgaaggaggtacggcgcggcctcgaacagctcgcccacgaccatccctttctcctgaccagccgctacgccaacgaccacgcggagatccgctactgggaggaggcccgcgacctgcacgacgccgccgcggtcgcgctgcgcctgtggggcgaacaccgccagaccgccaagctgccgccgtgggagatcgtgggcctggaggtcatcgaccgcgagacctaccaccaccgggtcgcggaggggtacggaccgctgccggcgacgccggtcggagtccatcccttc

SEQ ID NO: 5458 - DNA, 1284 bp, Streptomyces avermitilis
  CDS (1)..(1284)
atgaccacgctttcgccgtacgactccatgaccccggtcacccaggccgcctaccgcgccaaggccgccgccgcggacctcgcgccgctgccgcgggccgagaaggacgacgcgctgctcgccatcgcggacgcgctggaagtccgtacgagcgaaatcgtcgccgccaacgccaaggacgtcgagcgggcccgtgaggccggcaccagcgaggccatcatcgaccggctcacgctcaccccggagcgggtgcgcgcgatcgccgcggacgtgcgcgacgtcgtggcgctgcccgacccggtcggtgaggtcgtccgcggctccaccctccccaacggcatcgacctgcgccaggtccgcgtgccgctcggcgtcgtcgggatcatctacgaggcccggccgaacgtgaccgtcgacgcggccgcgctctgcctgaagtccggcaacgccgtgctgctgcggggctcggcgtccgcgtacgagtcgaacaccgccctcgtacgcgtcctgcgcgacgcggtcggcggggcggggctgcccgccgacgccgtgcagctcgtgcccggcgagagccgcgactccgtacgcgagctgatgcgcgcccgcggcctggtcgacgtgctcatcccgcgcggcggcgcctccctgatccgcacggtcgtcgaggagtccacggtcccggtcatcgagaccggcaccggaaactgccacgtgtacgtcgacgcgcaggccgacctcgacatggcggtcgacatcctgatcaactccaaggcgcagcggcccagcgtctgcaactccgccgagacgctcctggtccaccaggacatcgccgccgagttcctgccgcgcgccctggacgccctcgcggacgccggggtcaccgtgcacgccgacgagcgcgtgctggcatacgccaaggactccaaggccaccgtcgtcgaggcgacgaccgaggactgggacaccgagtacctgtcgtacgacatcgccgccgccgtcgtcgactcgctcgacagggccgtggcgcacatccggctgtggagctccgggcacaccgaggcgatcgtcaccacctcgcagcaggccgcgcgccgcttcacccagttggtcgactcgacgacggtggccgtgaacgcgtccacgcgcttcacggacggcggcgagttcggcttcggcgcggagatcggcatctccacgcagaagctgcacgcccggggcccgatggggctgccggagctgaccagcacgaagtacatcgtgaccggggacggtcacgtacggcgc

SEQ ID NO: 5459 - DNA, 750 bp, Streptomyces avermitilis
  CDS (1)..(750)
gtgctgatgactactggtgcgtaccggtgcggctgtttcctgaccctcacctgtgagtcgtctcgtcaggtggatgaatttccataccgtctgcccaaattgaccccccaggtctactctggatccgtgccggaggacgtggggggcacgccgtcgttccctgacggcggggagcccgacgacgaccgcgaccgcgggggtatggacgaagagttcgcctccgtggtcttcgacgaggccttcgtgcgggcggcggtggtccatgagccgaccgcggtcgaacgcctcctggcggccgcccaggcccgcgcggaagcgcaggaggccgaggcgcgccgggcgcacacccgtggcgtacgcggtgacgacgagcgctatgaggacggcttcggccccgacggcggtgatttcggccaccaccgggatctggacgacctcgacgacacggaggtcctggagggccgctacggagcgccgggaacctacggccggccctacggcaggcaggtccgctggcaccgcccggtcgcctggattctcgccctcgtgatgggcgttggcatggtcgcgctggccttcgcggcggtctaccggggcgcctcctcgggccgccaggagcaggtcccgccgcctgcctcgacgggccttgagcaaggtcaggaggcgggcacggggacaggcacggggacgggcccctcggcctcggccgagtactcgccgccggcggtgtcggcggaaccccgcaccccc

SEQ ID NO: 5460 - DNA, 1065 bp, Streptomyces avermitilis
  CDS (1)..(1065)
atgggcgggcctggaaacccaccggaggggacacccgagggcgctcccggaggtggggaggacgagtaccgatccgtcgttttcgacgagtcgttcgtccgtgctgcccgcctccaggaattctccgcgcaggagcggatgggggaccacgccccggcggtacggcgccggccgcccctccaccgcggtctgtcccggcaggcgctgatactcgtcctgctgatcgccgtcgccttcggcaccgcgatctacatgggcgtccgccacccgtaccagacgcccaaggcgcagcccgtggagccgctgcggatgacggtcatacccctggcgccgcagtccgccgtccccggcgccacggacgccgaggcgctgtacgcgcacagccccgccgcgcagttccgcatcggcgccgagggcatcacactgcccgcctcccggcgtaccgcgcacttctccgacggccaggtcgtcaccgccctgacgaccgtcaaggactacctcgtggagtcgtcgctcgacccggcagtgctcaccggcggcgccacccggcccgtacgcatcctgctcgacccgcaacagctcgaccagttcgaccagagcttcgaccacccggccgcggacggccggcacgcgcccaccggctggctggtccgcttcgacccctcccgcgccgagctcgccgaccgcaagatccgcgtacagggcaccctgcaggccgccgagaccagctccgacacccttgaggtcaccgccgaccacaccctggtgtacgcactgcggccgaccggctccgacaccaaggcccagacgtcgttgttcaccgtgcggcgcgagctgaccttccgcttcgaccgcgacgacctgcgcatgcaccaggccgagctgctcgtctcgtacgtccaggccgggccgctcgcctgcgcggaggacgcggcggaccatctccacccgctgctcgcggggcagacggccaaggcgggcggcccggccggcaccgatccgtacgcgaccggcagcgccacggccctgtgcggctcgctggcggcgagcgcacagccgaaggtg

SEQ ID NO: 5461 - DNA, 1128 bp, Streptomyces avermitilis
  CDS (1)..(1128)
atgtccgacgacagccatgagcacaacgggcacgagaacgtgccgagcaggcagcgcaggcgctttgcggggatctcctcgcgcgcgtacgaacatccggccgaccgatcggcgcttgtcgccctgcgtaagctcagcggcttcgacacggtcttcaaggcactcagcggtctgctgcccgagcgcagccttcggctgctgttcctgtccgactccgtacgggtctcggacgcacagttcgcgcacctcaacgacatgctgcgggacgcctgttacatcctggacctggagaaggtcccgccgatgtacgtcaaccaggacccacagccgaacgcgatgtgcatcggcctggacgagccgatcatcgtcgtcacgaccgggctcgtcgagctgctggacgaggaggagatgcgggcggtcatcggccacgaggtgggccacgcgctgtccggccactcggtgtaccgcacgatcctgctcttcctgacgagcctggcgctgcgggtggcgtggatcccgctgggcagcctcgcgatcatggccatcgtgacggccctgcgcgagtggttccgcaagtcggagctgtccgcggaccgcgcgggtctgctggtcggccaggatctgcgggcctcgatgcgcggtctgatgaagatcgcgggcggcaaccacctgcacgagatgaacgtggacgcgttcctcgcgcaggccgaggagtacgaggccggaggtgacctgcgcgactccgtgctgaagatcctcaacgtcctcccccgttcgcaccccttcaccacggtccgggccgccgagctgaagaagtggggcgaatcccgcgactaccagcggatcatggacggtcactacccgcgccggaccgaggacaaggacgcctcggtcagcgactccttccggcagtcggcggccagctacgccagcgacgtgaagaactccaaggacccgctgatgaagctggtcagcgacatcgcgggcggcgcgggcgacctcggcggacgggtacggcgcggcttcggcggcttcgccggcagctcccccggggacgcgggtggctccgcccaggacgccccgccccacgacgcccacccggacgacgagagccccaacggcaacggc

SEQ ID NO: 5462 - DNA, 162 bp, Streptomyces avermitilis
  CDS (1)..(162)
atgagcttccacagcaccgctgcccagttggtcacccttgccgccgagggcgaggagcacggcggcaaccacgagagcctcagcccctacatgaccggcggtggcgccctcgtcatcctgctgctcctgctgtggatcaccacccgcttcaaccgcgaccgc

SEQ ID NO: 5463 - DNA, 672 bp, Streptomyces avermitilis
  CDS (1)..(672)
atgggagagcaggacatgcctaccggtccggcgagtggcacggtgcacggcgcgcggcgcggcccgggcaacggcccgtcgaatccgggcaagcgccgcctcggcgtcatgggcggaacgtttgacccgatccaccacgggcacctcgtggcggccagcgaggtcgccgcgcagttccacctcgacgaggtggtcttcgtgccgaccggacagccgtggcagaagaccgaccgcaaggtcaccccggccgaggaccgctatctgatgacggtcatcgcgaccgccgagaacccgcagttctcggtcagccgcatcgacatcgaccgcggcggcccgacctacaccacggacaccctgcgcgatctgagcgccctcaaccccgacacggacatcttcttcatcacgggcgccgacgcgctcggccagatcctcacctggcggtacacggaagagctgttctccctcgcgcacttcatcggggtcacccgccccggccacaccctggccgacccgggtctgcccgaggggggcgtctcgctcgtcgaggtcccggcgctcgccatctcgtccacggactgccgtgcgagggtcgccaacggcgcccccgtctggtatctggtgccggacggtgtggtgcgctacatcgacaagcgtgagctgtaccgcggcgag

SEQ ID NO: 5464 - DNA, 1800 bp, Streptomyces avermitilis
  CDS (1)..(1800)
gtgaacgaccgatacgacggatacgcgggcggcgaccagtacgagctcgtcggctacgacgagttcgggcagcctgtgtaccggcaggtgccgtcgcagccccaccaggggtacgaaccgtacgccgggcagcagcagcagcaacaacagcagcagcagcaacagggatacggctacgacccgtacgcgaacggcggtcagcagccctcgccctcgtacgacaccggtcagcagcagcctgtgtcgtcctatgacaccggtcaacaacaacctgtgtctccttatgacaccggtcagcagcaggccgtccctccgtacgactcctacgacccgtacggcaccgcctccacggggaccgcgtacgacccctacgggcggaccgcgaccggcgggcagcagccgcgggtcgccgagcagaccgcgtacatcccgcagcaggcgggtccggcggagagcggaacggggggcggtacgcggtccgcgcaggccgcgcccgacggcgggccggagagtgacggccgcgccgaccgtgacgacggcaccgagcagttcgccttcgtcgaggagcccgacggcgactccgaagacgtcatcgactggctgaagttcaccgagaaccgcaccgaacgacgcgaggaggccaagcgccgtgcccgcagccgggtcgtcgccctggtcgtggtcctcgccctggtggcggtcggcggggtcggctacctctggtacgcgggcaagcttcccggcacgtcctcggacgccaagaccgggacggcgacggccacgggcgcccagaagcgcgacgtggtcgtcgtccacctgcacaacaccaagggcggcggcacctccaccgcactcctcgtcaacaacaccaccaccaagcagggtgccaccgtcctgctgcccaactcccttgccctgacgggcgaggacggcaccgcgaccacgctcgccaagtccgtcgacgacgacggctcgtccgacacccgcgacgagatcgacaccgtcctcggcaccgacatcgagggcacctggcgtctcgacaccccgtacctcaacaacctcgtcgaactcgtcggcaacatcgacatcgacaccgacaccgatgtgcccgaccccgactccaagaagaagggcaccgcgcccctcgtgcagaagggcgacgaccagactctcagcggcaagatggcggtcgcctacgccacctaccgcgcctccggcgagtcccagaacgcccaggtggagcggttcggccaggtcatgcaggccgtcctgcgcaagctgtcctccgacgcacaggccgccacgaccaccgtgcagacgctcgcccagatcctcgacccgtccctgagcgacaaggacctcggaaccttcctcgccaagctcgccgaccacgccaagggcggcgactacaagaccgcgctgctgccggtccaggccgacggcaccctcagcaccaccgacagcgtggtcaaggacctgctcggcggcaccgtgaagagcccccaggccggcgacgccgtccgggtcggcatcaagaacgccaccggcaacaaggacgccaccgagaaggcccgcgtcgtcctggtcaacggcggctacaccttcgtcgaggccggcaccggcaccgcccagaccctgtcccggatcacctacgcggacgccgccgacaaggcgaacgcgatcgaggtcgccaagaccctgggcctgcccaccagctcggtgaagaagggcagcgtcacgtcgaacgccaacgtctcggtgatcctcggccaggactaccaggtgagcggctccacggga

SEQ ID NO: 5465 - DNA, 444 bp, Streptomyces avermitilis
  CDS (1)..(444)
gtgaccgccacggaccgctctctggagctcatcaataccgccgcgcaggcggccgccgacaagctcgcgcacgacatcatcgcgtatgacgtcagcgacgtactgtcgatcacggacgccttcctgctggcctccgcccccaacgaccgccaggtcaagtcgatcgtcgacgagatcgaggagcgcctgaacaaggagctcggcgtcaagcccgtccgccgcgagggcgaccgcgaagcccgctgggtgctgctcgactacgtcgacatcgtggtgcacgtccagcacagcgaggagcgcgtcttctacgcactggagcggctgtggaaggactgccccgagctggcgctgcccgccgacgcccaggcgacgcgcggcaaggccgccgagcacgccaagctccaggacgcggaggaggccgccgaactggatggtgagctccgg

SEQ ID NO: 5466 - DNA, 672 bp, Streptomyces avermitilis
  CDS (1)..(672)
gtgagcagcggcgtgggtcctgacgccgggaagaagccgggccggggccgccgcgtcatcctgtggcggcacggccagacgtcctggaacgtggagcgccgcttccagggcaccacggacgtcgagctcaccgagaccggcgtcggccaggcccgccgagccgcccggctgctggcctccctgaagccggacgcgatcgtggcgtccgacctcaggcgcgccgccgccacggccaccgagctggccgcgctcacgggtctcgatgtcacccacgacgagggtctgcgcgagacctacgccggcgtctggcaggggttgacgcacgaggagatcatcgcccagttcggggaccagtacgccgcctggaagcgcggggagccggtccgccgcggcggcggcgaactggagaccgaggtggccgaccgcgcggcccccgtcgtgctgcggcacgccgagaagctccccgaggacggcacgctcgtggtggtcagccacggcggcaccatccgcaccaccatcggacgcctcctcggcctggagtcccaccactgggagggcctgggcggcctctccaactgctgctggtcggtgctcggtgagggcgcccggggctggcgcctgctggagcacaacgcgggcacgctgccggagccggtgctcggcgacgacgac

SEQ ID NO: 5467 - DNA, 891 bp, Streptomyces avermitilis
  CDS (1)..(891)
atgaccacgacacaacgccgcaggccggagctggcggcctttctgcggagcaggcgggcccgggtgacaccggccgacgtgggcatgccgccgggcttccggcgccgcacaccggggctgcgccgcgaggaggtcgcgcagctctccggcgtgggcgtcacctggtacacctggctggagcagggccgcccgatcaacgcgtcgccgcaggtcctggacgcggtggcacgcacgctgcgcctggaccatcccgagcgcgagcatctgtaccacctggcggaggtgccctacgagccgggcccggcaggcctcgcacagcagatcgagccggagatccaggacatcatcgacgccctcgaccctcacccggccgtcgtctacaactcgcgctacgacgtcctcgccaccaaccccgcctaccgcgacctgttcgtggtgccggcgacgatcgaggtcgccgcgccgaacgtgctgtggacactgttcagcgtccccgagaaggactgcccggtggtgtaccgggacaaggagctgccggtgatggtggccacattgcgctcctcgtacggcagacatgtcggcgagcccgcctgggaggacttcatacgcgggctgtcggccgtcagcccgtacttcgccgagctgtgggcgagcggtgaggtgatcccgccggggccgcgggtgaagacgttccggcacgcggcggtgggcgagctgcggatgacctcggtgtcgctgtcgatcaacggactgccggagtgccggatcgtggcgtacacgccggaggacgcggacgcgcgcaggaaggtggcggtgctccgggagcgcagggagaagctgtggccgccctccgacggccaccgtacggagaccgcgattgccgacgctggg

SEQ ID NO: 5468 - DNA, 1434 bp, Streptomyces avermitilis
  CDS (1)..(1434)
gtgcccggtccaactcctgcaaccagtaaagaccctggcactgacaatcgccccggacggctgctcgcggtcgtgctcgcggcccagttcatggccatgctcgacgtgttcatcgtgaacgtcgccgtacccacgatcggttccgaactccacgcctccggcgccggactgcaactggtgatcgccggatactccatcacgtacgccgtcctgctgatcaccggcgcccgcctcggcgacctgctcggccaccgccgcgtccatctcgccggtctcgcgctgttcacggccgcctcgctggcctgcggactggcccagggcacgggggagttgatcgccttccgtctcgtgcagggcgccggatcggccgcgatgatcccgcaggtgctcagcctgatccagcgcaacttcaccggcgaggcacgggcccgggcgctcggcgcctactccgccgtcctcgccaccggcgccgccgccgggcaggtgctgggcggcctcctcgtcagcgccgacctgttcggcaccggctggcggccggtgttcctcgtcaacgtgcccgtcggcatcgtgctcctggccgccggcagccgcgtactgccgcggggcgacgcccgggccctggagcgttcgcgcgggctcgacctgcccggtctggtgctgctcgccgccgccgtctcgctgttcaccgtgccgctggtgctcggccaggaggaggactggccgctgtggtcctggctgtcgctcgccgcggccgctgtgttcttcgtcctgttctgcgggtacgagtcccggctcgcccggcgcggcggggcgccgctgatcgctccgagggtgctgcgtcaccccggcatcggcctggcggtcctccggctcatcgccgtgatggcggtcaacgccgggttcctgttcgcgctcacgctgcacgtccagggcggtctcggctacagcgcgctgcacgccgggctgaccttcgcgccgaccgcggtggtcttcggcctggtgggtctgacctggcgcagctggccggcctcctggcagggcgccctgatcccgaccggcttcgcggtcgccgcgctctccatggccggcgtgggctggtcgctgcacggcggcggagacggcggaatgcggctgtacgcggccttcgcgggcgtcggggtcggcctggcgctcggtttcagccccacgctcaccacggcgctcgccaccgtgcggcccgaggacgcggcagacgccagcggactgctcgccacggtcacccagctcggtcagctgatcggcatcgcggccttcggcacactgttcttgaaccggcttgagtcacttggggcacctggggcgtatacctctgcggacgcgctcctcgtgtgcatgtacgcgctggccgggacggccgcgacgggtgccgtgtccggactggtacgaaggcgtcgc

SEQ ID NO: 5469 - DNA, 231 bp, Streptomyces avermitilis
  CDS (1)..(231)
atgggtgcacacaggcgaaagtgcgactggtgtggcagcggcacaccgatcgtccgcgacatggaaccggtcaaccacgactaccaatactggtgcgaggaatgcgcacgggcgctgatcataaaaggcgaccccatcgagacgtaccgcgagcttgagggcgagccgatctacggccgtctcctcgacgagcactgcacactcaaacgcttctactccttcgcgaccgcc

SEQ ID NO: 5470 - DNA, 1212 bp, Streptomyces avermitilis
  CDS (1)..(1212)
gtgtcggccgtcatgaccttgatcgacctcccccgggtgtgccgccgtacgcccgtcgccctgggggcgtgcctgctgtcgttcacggcgttctggatcgcgcagcgggccgcacacgtgtcgatgatcgacctgatggtgtaccgggccgagggcgcgacggtacgcgcgggcggcgacctctacacgctgcgtacgacctcggcccggttgcccgccacatacccgcccttcgccgcgctgctgttcaccccgctgacggtgctggacccggcggacctgcgcaccctggcgacggcggggaacctcgcgctcctggtgctgttcgtgtggctcaccctgcgcatcgtcggccacgcacgcgtggagaccctctggtgggtctcggcggcggcggtgtggtgcgagccggtgtggacgacactgcggtacgggcagatcaatctgctgctcgccgtgctggtgctgtgggacctggcccgggggcccgggcagcgttgggccggagccggtatcggcatcgcggctgcggtcaaactgacgcccgcgctgttcgccgtgttcctgctggccaccggagtgatggcgcacacaaggcagcgctccggagggccgtggctgcggcacgcgcgtgccgcggccgccacgttcgccggggcgacgctgctgggggccgccgtcctgccgtacgactcctggcgtttctggacccgcgtggtgttccagacgggtcgggccgggctcgccgaggacaccgcgaaccagtcgctgcgcggagtcctcgcgcggctgctgcacacgcccgagccgggcctgtggtgggccgcggtcgcggccgtggcgggtgcggcgggcctcgccgtcgcggtggccgcggagctgcgcggccagcgggcctgggcggtcaccgcctgcgggatgacggcactgctcgtcagcccggtgtcgtggtcgcaccactgggtgtggtgcgtacccatggcggtggttctcgcgacgctgaacggggcgttcgtcctcggtgcggcactggtcttctgctcgtacgccctgtggtgggtgccgcacggcgccggacgactcgaactgcaccagagcggagccgagttgacgttgtcggccctctacggaggaacggctttcgtcttcctgtccctcgtggggggcgcgctcggacgcacgccccgctcggatcaggcggtcgcgaaggag

SEQ ID NO: 5471 - DNA, 1572 bp, Streptomyces avermitilis
  CDS (1)..(1572)
gtggtcgggcttccgcagctcacgtcgggcttcgaccttgtcgaaagactcgatctaccgatgcacctcaaggtgcacggcccgctcgagccgatgggcggcgagcagctcgcgcagctctcggagcgcatctccctgaaaggccgcggcggcgcgggcttccccttccacaagaagctgcggtcggtcgccgaggcggcgatcaaacgcggtgtgcggcccgtggtcgtcgtcaacggaagtgaggacgagcccgcctgccgcaaggacacggtgctcatcaaccgtgccccgcacctcatcctggacggcgccctgctggtcgcggaggccttgggcgcccgcaccctggtgatcggtgtgacccgtgagtcgacccagcggtcgatggaggcggcgctctccgagcgcggcctgagcaaccggcgcggcgcggccatacgcgcgcgcgtgcagcgcaatccgatccgcatggtgaccggcgcggcagcctcgctgatccgctccatcgacggcggtcccgccatcccgccgggccgcaaggtcagcgcctcgcagaacggcgtcggcggcgcacccaccctgctgtccaacgccgagacgttcgcccagctggcgatcgcggcccgcatcggcgccgagcgctactgcaacaccggcctgtacgacgagcccggcaccgtcatgctcacggtttccggcgcggtggcccgccccatggtgctcgaggtcccgaccggtgtgccgctgcggtacgtgctccagctcgccggtgccccgccggtcccgcagggggtgctgaccggcggttaccacggcaagtggatcgacgcggcgacggtcaacgaggcgatcgtctcgcgcaactccctggacgcggtcggcggcgcgctcggcgcgggcgccatccttccgatcagccaggagacctgcccgctgggcgagtcgctgcgggtggcgcagtggctggccgacgagagcgcggggcagtgcggtccctgctacctcggcctgcccgccgcggcacgtggcatggcggacatcctcaacggtggcggcccggccgccctggaggccctcaagcaggtcgccaaggccgtgaagcggcgcggtgcgtgctcgcacccggacggctcggcgatgttcctggaatcgaccgtcaaggcgttcaccgacgacctggccgcgcatgtcctgggcaacggctgcggcaggcccgtggaaggcgtactgccgctcttcgaggacggccagctccccgccggcatctcgagcggacagcagcaggaggagtcgggtcccagccgacagaagatctacgtcgactggacactgtgcaggggacacggcctgtgcgccgacatcctccccgaggtcttcgagctgggcgccgacggcttccccaccgtcgcacaggcacaggtgccgcggtacgcggagacgaaggcactgcgcgcggtgcgccgctgccccgcgctcgcgctgcgcctcgaggaggacacccgctccgccccggcccgcaacaacctgcccgtcctctcccagggacgcggccgccgggccctcggccgc

SEQ ID NO: 5472 - DNA, 1308 bp, Streptomyces avermitilis
  CDS (1)..(1308)
atgaaccctcgtcgtagtaacagctcgctccccacaccgggccgatcggcctacggtgcggcgacggctgccactctgctgctcatacccgtgattgtgctggtcggaggtgatggactccgggacttcctcaacttcggcgccggcgtgctgtcgctggtcgccctctcctgctccgtgatctggggcctggtcgcaacggaccggctgttcctcaacacgcgccagcgcatcgtcgcgcaggccgtgcaccggacgaccgccatctcctcggtcgccttcctgctgctgcacgtcacggtgaagctggcgctcgaccacacccagctgatcgccgcgctgatccccttcagcctcggcgtcaccggttccgccggcctcatcggcttcggctcggtcgccgggctgctgatgatcttcaccgccatcaccggcgcgctgcgcaacgccttcgcgacgtcctaccccgtcgccgcgcgctggcgcgccatgcacatgctggcctaccccgcctggtgctgcgccctggtccacggcctgtacgcgggccgtgaggcgaagccgatcttcgtgatcctgtacagcctctgcctgatcggcgtcatgggcgcgctcgccctgcgcgccgccccgcgcccgttcaagcgcaaggtggccgaccggatcgtcgccatcatcgggaacggcgctccgctcggacgcgaggatctggaggcgagccgcgcccgcaacgcggagtccatggcgggctccggtggccgttccggtggccgttccggcggctccgggagccgggacgccgaggagtccatcctggccgcttcgcagcgtatggctgcgtcctccgcgtccccgtacgacgctcccccggcgtcgcgcagcatgaccccggagcccggcaacgggttcgcggccgcctatcgtgcgacatccgccacaccgcgcgcgcaggacccgttcggggccgacggaacccaacgcatggacctgccgatggacatgcaggccacggaggccatgccgcgtgtcgacgacggcgcctcgaacgctccccgctggcccgcgccgtccccgccgccggtcggtgaggccccgcggtcctcgttcgacccgatgaacgacacctatgctggcggcatctcgtaccagggctacgacaattcctacgcgcagggtgagtcgaacgtcccctacggcacgtacaacacgaacgacacgtacaacagcggtcccgccactgaaacgctgcccggtgcctacgacgcgccgggctccggcgaaccctggaacgcgccttccggaggcttt

SEQ ID NO: 5473 - DNA, 2886 bp, Streptomyces avermitilis
  CDS (1)..(2886)
atgagcgagacgaaccccgctgccgcctccgaggtggccgcgccgcaccgctacacggccgccgtggccgcggagatcgaggcacgctggcaggacttctgggacgccgagggtacgtacgaggcgcccaacccgaccggtgacctggccgggggtcccgcgctggtcgccaagcccaagaagttcgtcatggacatgttcccgtacccctccggtgcgggactgcacgtcggtcaccccctgggctacatcgccaccgatgtattcgcccggttccagcgcatgaccggccacaacgtcctgcacaccctgggcttcgacgccttcggcctgcccgccgagcagtacgccgtgcagacgggcacgcacccgcgcgtgtccaccgaggccaacatcgagaacatgaaggtccagctgcgccggctgggcctgggccacgacaagcgccggtcgttcgccacgatcgacccggactactacaagtggacccagtggatcttcctgcagatcttcaactcctggtacgacgaggaggcgaacaaggcccgcccgatcgccgaactggtcgcccagttcgagtccggcgagcgcgccgtcccgcgcgctgacggtgccacgcgcgcgtggcgggagctgaccgccgccgagcgcgccgacgtcctgggcgagtaccgcctggcgtacgcctccgaggcgccggtcaactggagccccggactgggcaccgtactggccaacgaggaggtcaccgccgacggccgttccgagcgcggcaacttccccgtcttcaaggccaagctgcgccagtggaacatgcgcatcaccgcctacgccgaccggctgctggacgacctggacgcgctggactggcccgaggccatcaagctgcagcagcgcaactggatcggccgctccgagggtgcccgcgtcgacttcccgatcgacggcgaagccgtcacggtcttcaccacccgcccggacaccctgttcggcgccacctacatggtgctggcgcccgagcacccgctggtcgagaagttcaccccggccgcctggcccgagggcacccacgacgtgtggaccggcggccacgccacgccggccgaggccgttgccgcctaccgtgcccaggccgcctcgaagtccgacgtcgagcgccaggccgaggccaaggacaagaccggcgtcttcacgggcgcgtacgcgaccaacccggtcagcggcgagcaggtcccggtcttcatcgccgactacgtactgatgggctacggcaccggcgcgatcatggccgtcccggcgcacgacacgcgtgacttcgcgttcgcgcgcgccttcgagctgtcgatgcgctgtgtcgtcgagccttccgacgaccgcggaacggaccccagcacgtgggacgacgcgttcgcctcgtacgacgcgaagatcgtcaactcgtcgagcggtgagatctccctggacggcctgggtgtcgtcgaggccaaggcacgcatcaccgagtggctggagcgcaagggcctcggcgagggcaccgtcaacttccggctgcgcgactggctgttcagccgccagcgctactggggcgagcccttcccgatcgtctacgacgaggacggcatcgcccacgccctgcccgagtcgatgctgcccctggagctgccggaggtcgaggactactcgccgcgcactttcgacccggacgacgccaacacgtctccggagaccccgctgtcccgcaacgaggactgggtcaacgtcaccctggacctgggtgacggccgtggtccccagaagtaccgtcgcgagaccaacaccatgcccaactgggcgggctcctgctggtacgagctgcgctacctggatccgcacaacgaccagaagctggtcgaccccgccatcgagcagtactggatgggcccgcgcgaggggcagccgaccggtggcgtcgacctgtatgtcggcggcgccgagcacgccgtgctgcacctgctgtacgcgcgcttctggtcgaaggtcctgttcgacctggggcacatctcgtcggccgagccgttccacaagctgttcaaccagggcatgatccaggcctacgtctaccgcgacagccgtggcatcgcggtgccggccgccgaggtggaggagcgcgacggcgcgtactactaccagggcgagaaggtctcccgactgctgggcaagatgggcaagtccctgaagaacgcggtcactccggacgagatctgcgccgagtacggggcggacaccctgcgcctgtacgagatggcgatgggtcccctggacgtgtcgcggccgtgggacacgcgcgcggtggtgggccagttccggctgctgcagcggctgtggcgcaacgtcgtcgacgaggccaccggcgaggtcacggtcgtcgacgccgagccggacgaggagacgctgcgtgctctgcacaaggcgatcgacggcgtccgccaggacctggagggcatgcggttcaacaccgccatcgccaaggtcaccgagctgaacaaccagctgaccaaggccggtgggccggtgccgcgcaccgtcgccgagtccctggtcctgctggtcgcgccgctggccccgcacatcgccgaggaactgtggcgcaagctgggccacaatgactcggtcgtccaccaggacttcccggtcgccgacccggcgtacgtcgtggacgaggccgtgacctgcgtcgtgcagatcaagggcaaggtcaaggcacgcctggaggtctcgcccgccatctccgaggaggagctggagaaggtggcgctggccgacgagaaggtcgtggcggcactgggcggcgcgggcatccgcaaggtgatcgtgcgggcgccgaagctggtgaacatcgtcaccgcc

SEQ ID NO: 5474 - DNA, 735 bp, Streptomyces avermitilis
  CDS (1)..(735)
gtggtggaagccgtgatcgcagtcgtcgcccttctcttcctgctcttcgtggcgctgggcgcctacgtcacggtgaaggcggtcggcgcggccaagcgcggcgtggaccgtacgctttcgcaggcccgccgcacggtcgaggacaccactctgcgggccaggacctttgcccagcccggccccgtgggcgagctggcccagctccgactgaagctgcgcacctcgatgcgtgcgacgcaggacgcgctgcacgcgggcgtggccgaggacgagtccctgaaggagtcgctcgccctcttcgaccgactcagcgcacacgggcacgaactggacggcgaactcaggcgcctggagaccgaacccgaccgcacgaagctcgctcagcggctgcccggtctgcgcgagcgcacggagcagatcatccactccgcggactccctgcgctgggccgcacgcgaccgggcccgccggttcgcggacgacgacctcgcctcgctgagtgcccagatcgacatggaggcgggtgccctgcggcactggacgaccgagcggaccaccccggcgtccacctggcccgaggcaccggcgcccgaggacgcgacctccggcggacaagcctggcccgagacgcccgagtccggtacggcggaggagcagacccggtcagccatcaccccgccgggccgacggcccacgtatccctggcagaagaagcctcgtcccgaaagcacgact

SEQ ID NO: 5475 - DNA, 843 bp, Streptomyces avermitilis
  CDS (1)..(843)
atgtcccgccatgtcgcgatcgtcaccgattcaacggcctacctgctgccacggacgatggagcgccatggcatcaccgcggtgccgttgaccgtggtgctgggcgaccaggcgctcgaagagggtaccgagatctcggcccgctccctggcccaggccctccagaagcgacggcccgtcaccacgtcccggcccagtccccagctcttcgccgagacttatcgcaaggccgcggaggccggcgcgaccgaaatcgtgtccctccacctctcttccgagatctcgggcacctacgacgcggcggtccaggccgcgcgcgaggcgcccgtgcccgtgcgcgtggtcgacaccgggatggtcgcgatggccctcggtttctgcgcgctggcggcagccgagaccgtcggggcgggcggcacggtcgacgaggcggtcacggccgcggagaagcgggccgcgggcacctccacgtacttctacgtcgacaacctggactatctgcgccggggtggccggatcggagccgcgcaggcgctgctgggctcggcgctcgccgtcaagccgctgctccagctggacgacggacgcatcgaactcctggagaaggtacggacggcgtccaaggcgatcgcccgcctcgaggagatcatcgccgagcgtgcgggcagtgcgcaggtcgacatcgccgtccaccatctcgccgctcccgaacgtgcgtcggccctcgcggatcggctgcgggcgcgggtgccgggggtggcggatctgcatgtgagcgaggtcggtgcggtgatcggcgcccataccgggccgggtttgctgggggcggtcgtctcgcctcgg

SEQ ID NO: 5476 - DNA, 1161 bp, Streptomyces avermitilis
  CDS (1)..(1161)
atggcacttcgatcacgttcacgcacagcgagtcccaccagcggaccaggccgcgggccggtctccgacggccgtacgcgccatcgccaccacccgcgaaaccgggccggccgtcgccatgcgtcggccgaggtactccgcctgcgagcggaggccctcttcgcggaagaaggcggcccgcgaccggagtgggggaacggaccaccggaagcggaccgggatgtcgggggaccgtcggcaggcacggccttgggcttcggcgtcgctcgggtgcgcgaagggcgaggcccggacgctggtggcgtcgctgaggatgaggctgcttgctcgggcgtcactgtaggcgaggccggtggctcgggcgtcgacgcgggcggggtggtgggggccgcctggcgggagcgggtcgggctcgccgtgcgggagcggatgccgttgtggttgcagtcgaggtgtgggctggagcggcggagcgtggccgcgctgaccgtgctgctcgtcgtcgcggccgtcttcgccgcacagcacttctggtccggacggacccaggaggtcagggcacccgaggtcgtgcgagcggcggctcctttcggtggagaaggagaagggggcggccgggaggcgaagcccggggacccggctggagctcgtgctaccggcgatggcaccagctccggaaccgcatcgggaacgggaaacggaactgcggctggtgccggggcagtgatcgtcgtggacgtcagcggcaaggtccgtaaccccggtattcagcggctccccgccgggtcccgggtcgcggacgccctgcgggcggcgggcggggtgcgtcccggcacgaacatgcagggactcaatcgcgcgcgacttctcgcggacggcgaacaggtggtggtcggcggcccggcacccgcgccggaccccggaacggccgcaacagccaccggcggctcaggggcgggcaccaccccctcgacccccgtgtccctcaacacggcgaccgccgaccagctcgacacattgccgggagtcggcccggtccttgcccagcacatcatcgactaccgcacccagcacggcggcttccgctcggtcgacgagctccgcgaggtcaacggtatcggcgaccgccgcttcgcggacctgcagaatctcgtgcggcca

SEQ ID NO: 5477 - DNA, 2520 bp, Streptomyces avermitilis
  CDS (1)..(2520)
atgaggacgacgcaggagcggggtcccgccgagccgggggcatcgcaggcgcccgcgcccggtgcttcccgacccgcgggccccctcgccaccatcctcggcagccgaccggtgcacgtcgcctccggcagcagagcggggaactcgcatcccaagcaggatgggccgacggacctgcggttggtgccgcccgcgctggcagcctgggcgacggccgcgctggcgctggatgcgtcggccgggtgggtcacgggcgtggtgctgctctgtgtggcggtcgctggtgggttgctcgccgcccggcgcacgggtgcacaaggcgccccggccggcggcctgagaaggccatcgggtgagcgggaccgctggggatcgtggccgaaggcatccgttgccgccgtgttgctgtgtgtcgccgcggccgccgcctcggccgggctgcacggcgcggatctgcggcgcggacccgtaccggcgctcgcgcgtcagtacgccgaggtgaccgcggaggtcgaggtcacctccgatccgcggctcacccggccccggatcaagggggaccacacggcgccgacggccgtcctgttggacgcggaggtgcggcggctgacgaaggcggacgggacggtggtggcgacccgtacgccggtgctggtgatcgtcgacgcgcactcgcggacgctggccgggccgaggggagcaccggccttctccgggggaggggcgcggaccgcggtcgagagccggcgctcaccctggctgtcgttgctgccgtcgacacgactgcgcgtgttcgcgcggctcgcgccaccgctggccgctggggaccgggtcgcggccgtgctgcgggtgcggggcggggcaccgcccgaggtgaccggggagccgtccggggcacagcggctcgcggggcggctgcgcgcggggctccgggaggcaaccgacgggctcgacccggatccgcgggcgctgctgccggggctcgtcgtcggggacacctcgcgggtgacgtccgagctggacgaggccttcaaggaaaccgatctggcgcacttgctcgcggtcagcggaggtaacttcacgatcctgctcgcgctgttcatcgggcctgccggacttgcccagcgggtcgagcggcgcgggctggccccctggctgggcatcccgctgcgggggacggcgctgttcggcggcgtgctcaccctcggcttcgtcgtcgtgtgccgcccggacccgagtgtgctgcgggccgcggcgtgcgggacgatcgcgctgctggccattgccacggggcgtcgcagatcgctgattccggcactgtccacggcggtgttgctgctggtgctgtacgacccgtggctggcccgtagttacggcttcctgctgtccgtgctggcgaccggcgccctgctcaccgtcgccccgcgctggagcgccgcgctccagcggcgccgggtgccgccacggctggcggaggcgctggccgccgcgggcgccgcacaggccctgtgcgcgccggttgtcgcggtgctgtcggcccgggtgagtctggtggcggtgccgtgcaatctgctcgccgagttcgcggtggcgccggccacggtgctgggtttcgcggccctggcggtcgctccggtggcgatgcccgtcgccaaggggctcgtctggtgcgcgagttggcccgtcggctggatcgcggacatcgcccgtaccggggccgcgctgcccggcggaggtgtggactggccgggcagttggacgggggcgttgctgctcaccctggtcacggcggctgtggtgcttgtcgggcggcggctggtgagacatccctggccggccggtctgtgcgtcggcctgtttctgctcgtggtggtgcagccgccgccgctgaccagggtgatcacggggtggccgccacccggctggcggttcgcgatgtgcgacgtggggcagggcgacgcgacggtactcgcggcgggcgacggcaccggggtggtggtggacgcgggacccgacccggcactggtcgaccggtgtctgagcgcgctcggggtcgacaggatcccgctcgtcgtactgacccacttccacgcggaccatgtggcggggctgccgggtgtgctgcgcggacgttcggtgggtgccatcgagacgaccggtttcgaggagccgccggaccaggtggagttcgtacgcgcccacgcggccgcccggcacattccgttgacgcgggccgcggcgggcgagcggcgccgcgccggagcgctcgactggcaggtgctgtggccaccgtcggatcgggccccggcgccggacggcccgaacgacgcgagtgtcaccctgctcgtgcggtcggccgggttgagcctgttgctgctgggcgacctcgaacctccggcccagcaggcgctgttgagatcgccggccgcggcgggcctgggttccgtggacgtcctcaaggtcgcccaccacactttccttgtaggacatttacttgagagttttcggcgtcaactccga

SEQ ID NO: 5478 - DNA, 276 bp, Streptomyces avermitilis
  CDS (1)..(276)
gtgggcgtcaggaagatcctcacgatcaagctggagatcgaggtcaacgagaaggtgacccggtacagccgcctggagaacacgtacggggaggtggtcatcgctgccatggaagcggctcgcgcccacatgccgaccgacagcatcgagcagatcacctctcacgcgcgatgggagtaccgccactgggacccgaagtcgatcacctatgccaagggcgagatcccggagatcgaggacctgacggacgacgagatcgagtggctggccgaggac

SEQ ID NO: 5479 - DNA, 327 bp, Streptomyces avermitilis
  CDS (1)..(327)
gtggactcgccggacgaatctcttcaggcatgcgcggatagttggaacgacggcaacgcgaacaaggagagcgtcgcctcgatttccaccgccgcacaggccgaaaacccgactgcctatgtgcatgtcgggttcagttcggtattcccggacaagtgcatgatcacggtcgctaacccgtccacgatgtacgcccagcagtaccttcaagggggcggaggcgaatggtctctggcccccgcctggaccgggtcggtcaacgacctcgacggctcgaccctcccgtggaacgcgcgcatggcccaggacggcacgatcatcgtcctg

SEQ ID NO: 5480 - DNA, 318 bp, Streptomyces avermitilis
  CDS (1)..(318)
atgacgaagtgcatccatggcgaccatgagttcccgttcgaggacgagacgggggcctactgcgaagagcacggcgtgaccctgctgtggaaccctccccacttcgcatgggacgacctgctcgcggagccccgtcgcctgcacagcagcgccttcccgtggctgagcgacctgaccgacgagcaggcgtacgagttcctcggtgaggtgatcgaggccgcccaggcggccgggacccacaccgcctttctccacgcgctggacgttctcgtgggccagcacgcgcccacccccacactccctcacggggtcatgccc

SEQ ID NO: 5481 - DNA, 351 bp, Streptomyces avermitilis
  CDS (1)..(351)
atgcccgaatcaggacatacgtggcgccgggagttcaaggcgcatccggtagaagccgactcggtccgtcgatgggtggcctgtcgcctggagcacccggacgcgccccaggtggccaacgagcttttcgtctcggtcctgtccacgggaagccccgtggtggagatgaccctctccacggcgggctctcgcgcacggatgacggcggccggctcagtcgagatgagcgccctccagagctacggccccggcttccgcatcatcagcggcctctcggccctctccggcgtgaacaccgacgggcagggactgtgggctcagctcacctctaagacgcaggggacggagcaa

SEQ ID NO: 5482 - DNA, 756 bp, Streptomyces avermitilis
  CDS (1)..(756)
gtggcagtggaaaggcccgggtacctgcggatcgccgctgagctgcggaagcgcatctcgtcaggggagttcggaatcggggatcagatcccgaccctcccggctctcgcggaggagtacggggtcttggagacgacggtccgcaacgcccttgcgctgctccggaatgagggcctgatcgagacacgggcccgcgctgggacccgagttcgcgagcggcctccgatccaccggctgaccgccgaccgctaccgcaacaaggccggggtcccctccacgccgttcacccgggaccagggcatcggctggagtgagtaccggctcgacaagaagtacgagcaggtagaggccacgatggagctggcggccctcttcgaatgcgaggtgggagagccgctgttggcccgccacttcgtcttccacgacaacgaccagcccacccagatgagcgtctcgtacctgcgctggagcgacgtggagggatctccggtcgccgaccccatccacgagccgtggccgggagggactcaggcccagttggcctctatcggcatccgggtcactgagatcactgagtccttcacctgcgggatgccgaccgaccacgagtccaagacgctcaagatcggctccggcgtaccggtgctgcggtacacgcggcgccacatcgccgaggacggccggatcgtggaggtggcccacccgatcgtgaggcggggcgacacgaccgtggtggacttcgtcataaagctcgac

SEQ ID NO: 5483 - DNA, 771 bp, Streptomyces avermitilis
  CDS (1)..(771)
atgaagctcgtgacacgacgccagctcggatggcccgcctcggccgctccgacccaaacctccaccaagggcgtgaaggtccactacgaggggacggccgtctcggtcgacctgctcaaggaccacgccaggtgcctggccgagtggcaggcgatccggaagagccacctggccaacgtccgcgagaactactccgacgtggcgtacaactacgcggcatgcccccacgggttcctcttggagggccggggcatcggcaagcggacaggggccaatggcaaccagccgctgaacgtcgcgcactacgccatcgtgggcctggtgggcagcgagggcctgaccgaacccacggacgagatgctctccgcgatacgcgacggcatcgagctgctccgccagcacggcgccggggacgagatcctcggccaccgtgacgggtacgcgacctcctgccctggcggcccgctctacgcctgggtgaagaagggcgctccccgccccacgggcactgagccggcgcagcagtacgagcccttccccggggccgcctggttctccaagggccttaagagccccgtcgtggcccgcatgcacgaccgcctcgtggcggtcggctgcaaccggtacaagtcctcggcgaacaaggacaccatcggctccggcgacgtcgcctcctacgaggcgtggcagcggctccagggcttcaccggctcggccgccaagtggcccccgggcaagacgacctgggaagctctgcacgttccgaagggc

SEQ ID NO: 5484 - DNA, 309 bp, Streptomyces avermitilis
  CDS (1)..(309)
gtgctctacaccctgaccctgtacgtcctcctggggatcggactcgccgcatcggtcggcttcctggtcctgcaccgcccccggcggttcttccgggtcaccgagatcaacgcgtcctggtgggtcatcatcgtcggcctgctgtacgcgcgttccctcatgctcctgggaatccgcggtgcccgacccggcgagacctggtgggacagcgccatctcgatcgggttccttaccgcgatcgacgttctcctcctggtccgcttcttctcatacctctggtacctgcgagagcaccccgagaagcgctcc

SEQ ID NO: 5485 - DNA, 222 bp, Streptomyces avermitilis
  CDS (1)..(222)
atgtggcccttcgcccgtcggaaccaggtgtctcccgagtcggagaccgcgaagagggccgccgagaagtccctcaaggatgcccaggccgggatgcctgaggcccaggcccggctgaacgagagccgccgggtgacggagcagctcaaggcccacaacagggcgaacgcctacagcgacttcatcgagggcatcgtcctcggccgtctccaccgcgacgcc

SEQ ID NO: 5486 - DNA, 345 bp, Streptomyces avermitilis
  CDS (1)..(345)
gtggtacctgagctgatcagggccctggccgtagcccaggaggcaggcggcgggcccgacataggcaagctgctcgggcagttcgcccagtacggcgtcgtcggcctgatcgtcgtcctcctgatcatcggcgtcatcgtcccgaagtacgtgatgtccaacctcctgacggataaggacgcctggcgtgacgccttcgagaaggagcgcgaagcccaccagctcacgcggcagcagctcgccgccgctcaggccagtgccgacgtcgccaacgagcagggccaggccatggtccggctcctcgaagagttcggccaccggccgcaaacagcccccgggagcgcc

SEQ ID NO: 5487 - DNA, 945 bp, Streptomyces avermitilis
  CDS (1)..(945)
gtggatgtcaacaggatcttcggcgagctgttcccgggtgccagacagttcgcgcagtctgcgttggacgctctttcgaaggacgacgaacaggtcttcctcctgcacgcgggcgtcagcatcgagcgactcgccaaggcggtgctggcacagaagagtcccttcctcctactggagacgaaggggaacgggaacgaagacgccctcttccagatcgctggcctggagcagggaaagaagatccgcaccatcggagcggcgacggccatcgcccgactcaagcgtctcggcgttctcccgcagaccaaggacactgagctggacgaactgatcgagctacggaacggtgtcgctcatctcacggctgcgcatgatgggtctttcgacgccctggccaagttcgtgggaacgagcacaacgttgctgacggcctggggcagatccggcccagagcactactgggggcctcactatggcctggtggagctgaccttgagtgaggctggggagaaggccgcccgtcacttcagcaggctcgtcgaacaggcgcgctatcgagtggcccagcgggcccaggcccttccccagaccgccatggaggcgctcctgaaggagcgctcgatcaatgtggctatgacctggcctaatagccgaaccgtgctccttccacacaagtgcccggcctgtggcaacctcggagcgctgctcaccggccctccggtcctgatcacgagcgggaagcctggcgaggcgttccccaggaggttcttttgccccatctgcgaactcgacctgaggacccctgaggagttgacgtccgctggcatggacagtcgggtgccgcttgtcgaggcgaacggagagcgggtgctcaccgaagccgaagaagccctttggcaccagttccccgatggtggtggtgacgagaacgtgtccgccgcccgc

SEQ ID NO: 5488 - DNA, 198 bp, Streptomyces avermitilis
  CDS (1)..(198)
ttggagaacaccatgcagatgacccctgagcagctcgtagaggagtaccgggacaccgtcctggagctgcacctcacccgccgccacgtgagcgccctggaaaccgagaacgcctccctgcgggcccagctcgccccggcggaggagcagggccacagccactcgcacggcgaggacggcggccactcccacaacgac

SEQ ID NO: 5489 - DNA, 1686 bp, Streptomyces avermitilis
  CDS (1)..(1686)
atggcccgtcatttgttcggcctctccccggccgatgtcaccgtgtcccagtccgggacctcgctggtccttcagcccggctcggtcggaactgcctgggacgcccgttccggcggtacccagatcactgacctgaccgacctgagcggcacgccgatcaccaccgtgacgtccgactcgtactccgtgatcggcttctacgggccggacggcgtcacgaccatctacctggacttcggcttctccggggggcgggccctgatgcaggcgacagacctgggcaacgccatcgacgacctccagacgaacaaagcgaacctcgctggtgacaccttcaccggtccggtcgttctctcgggcacgggatccgacctcaccgtgggcggcgtcgtaaacaccaccggcccggccacggtcaatctgggcagcggcagcccgagctacgcgagtctgcccaagggcattgcgggccgctccgagaatgctggcctgatcatcggctcctcgtacatcggcggggacgacgacggcaccggcacggactccaccggccggctcaacctctactcgtaccagcgcgccaacgtcggcagcttcggcgagaacatccggcacttcatgatgcgctcggacgccaagacgatgcaggcgttctacatcccggtgcagacctcgaacaagaagggtgggtacgacgccaccacccgcgacccgctctccacgggcgtctcgtggaagccggtggtttggcagggcgcgcactacgaggccaacgaccacggatcggtccacgggcactgggagctggaggtcgccgacgctaccggtgcgctccaggggcgcctggagatccccttcatcgaccagtcgaagctgagcaacgcggtcgacaccacgaccatcggcatcgcgtggacaaacattcgcaccaacctggcggacttctccatccgagcccagaacatcaccagcggcgactacgcagggcagaacaccgcgctgcggatcggcggcaacaacacggtgaacaaggacgtcctgctgtccatctcctcggatatgcagaactccggccgccgctggggcttccgggccaacacggacaccgagtccactggcaacgcaggcacgaacttccagctcctgcgctatgccgacgacggatctcagctcggaaccgccctgttcgtccagcgcgcggacggtcagatcaccaccggatcgcccgccgcgaagggggcgcgtctcgccttggtgtggggcaccaacgcggtgcagggcttctctgctcagccgtcgtcctccccgggcgcagcggccggtttcgacgccgtcatgacggccaccaccgaccgggcgtaccaggcgaacgtcatcggcgacgccaacaggcgcctcgtcgtgttcgctgacggaaagaccgagtggggcgacggcacggccacgcgtgacgcgaacctgtaccgatcggcagccggacggctgaagacggacaccgcgttctcggtcggtaccaacctcctgatcaataccacctcggtgggcgcgggcgtcggcgtgctgggaatcgccaacgccacgacggtccccacagccaaccccaccagcggcggcgtcctgtacgtcgaggccggagccctgaagtaccggggatcgtccggcaccgtcaccaccatcgccccggcc

SEQ ID NO: 5490 - DNA, 1026 bp, Streptomyces avermitilis
  CDS (1)..(1026)
gtgactcagtcgtccttcccgttcggctcctcgcagatcaccaccgaggaccagtggtccagctacttccggatgttccaggtggacggtgtcttcgccaccagcgagaacggcacggacctgaaggtcactgcctcgaacgcctccaccgtctcgttgggggccggagaggccgtggtgcagggcacgtactacgccaacaccgccgcgctcaacgtcagcgtcccgaccaactccggtggcggctcggcccgtaacgacctgattgtcctgcgccgggacccatcggccgacgccaccacggtgcagtacaagacgggcggcacgagcttcccgtccctgacgcagaccctcaacggcacctgggagatccccctcgcgcgggtcaccgtggctgctggagcgtctgtcgtgcctccggcgggagtcacggacgtccgctggttcgtagggcgccccccggtcgtcggcagcgccgcgtaccgccgtcccccggtccgtgggcagctccacgtcgacaacggctcggacgtgtacctgggcgacgggacgagctggaagtacctcggcaccgccgaggaccctgccgcaagcacctacacgcccgtgtgggacgccggtgggaccgcgatcagctggggctcgggcagcacgaacatcggccggtacaagcggatctcgggcaacctctactgggtcaagatccagctccaacccaccggcaaccctccggcgtacgacgaccccatccgcgtgacgctgcccttcacactccagggctccacccgcgatctgttcaacgtcgccttcagccaggccactgccaacggcggcctctccttcgtcggtaccggcatgacgttcccgaccgaggccaacaacaagatcgcgcgtatccgggtgccgctctccgagggcatctccggcaccagcggcgggatcaacagccggaacatcctgaccaactcgcccttcaacatccagaacggcgacatcctcacgatcaccggcaccttcgaagcggcc

SEQ ID NO: 5491 - DNA, 1188 bp, Streptomyces avermitilis
  CDS (1)..(1188)
gtggagatggccttcgaccagccccgtgtcaccgtccaagtccgggacgacagcctggacatcgtcggggtggtcgacgacttcaccgcgctgaccatcacgccgcgcttcaacgcggtcggggcgtacgtcctgaacatcgccgcggattcccccaaggcccatctgctcgtcccgggcaacggcctggtgatccgtcgcggtgccgacgtgctgatgtccggccccatccgggagccgaactggacccgctccgacaacgacggcggcagcggcaccctgacggtcaacggggtcgacgacatgaccctcctggccggggcgacctgctggcccaacccgacggctgctccgggctcccagacggactcggtgtacaagatctcgggggtcgtggccgagacggccatgcgggccctggtgaacctgaacatcgggccgggagcccaggcggcccggaagatctcgaacctgacgctggccgctgacggcgcccacggggcgagcatcaccaagcaggtcaaccagttcgacaacttgctgacggccctccaggacatcgccaagacggcgggcctgggcttccggatcgtccaggtcggcagcaacctccagttccaggtctatgagccggcggacctctcggcctccgccaagttctccttcggcctgggcaacctaacggacgcctcgtactccgtgaccgccccgacctgcaccaaggccgtcgtggtggcgggaggcggcagcagcccccgcgtggtctccgtgacgacccgggcggacgcggccttccccggcccgtggatcgagcagttcgtcgacctgacgagcgtcgacaccgcatccgtggacctcacggcccagatgaaccaggccgccaacgaggccctgacctccggcgcggcccagggcaacttgaccatgacgcccatagacaccccgcgcctccagttcgggcgcgactacacggtgggcgaccaggtctcgtgccaggtcaagggcgacttcttcgccgacgtggtccgcgaggtcagcatcagcttcgacgcgcagggcggatacctcgctaaggccgtcatcggctcctcggactccacgaacaaccaggacgtcctggcccggcagttccagtacatcgcccgcatcttcaacaagctccggcgcctggaaaccaggaagccctca

SEQ ID NO: 5492 - DNA, 933 bp, Streptomyces avermitilis
  CDS (1)..(933)
atgccgatcttcgtacgcccctccgggatcgttctcccgggcggcatcaacccgccaccggtacagccgttggaggtgcccagcctctcctggacggacgccagggggcgcacgacgctcctgtccgactgggagagcggctgggtcctccagcccggtatccggggcctggacttgcccgggtacgacttctacaccgacgcctcgccgggcatcgacggcaacgccctgcgagggcttcgagcccaggcccgagaggtcttcctcccactggccttcttcgacgtcgaccgctccggcttcatggcccgcaagcggtcctttttccgtaccctcaatccctccctggggctgggcacgctgaccctgaccgagtcggacggctccttccgcagcatcgaggcgtactacgtctccggcgcggaaggcgacttcgggcaggacacctccggtctccactggcagaccgtcggcctgaccttctcctgccccagcccgtactggctcggggcggccgtccaccaggagtacgcggccggggccaccgggagcttctttccggtcctgccggtgaaggtccgggactcccaggtcctcggcaacaccacgatcgacaacccgggggacgccacgagcttcccggtctggacgatccacggcccagccacgtcagcggtcatcacgaacaacacaacgggcctgaacttctctgtgacggcctctctcggctcctcggacgtcctggtcgtcgacacccgtgaacgcgtccagacggccgtcctgaactccagccagaactggtggcccaacctagccaccgactcagacctgtggggcctggagcccggcgagaacgacgtctcgctgaccctcgtcggtacggacagcaacaccacggtccagctcgactaccagccgcgcttcctgaccgcg

SEQ ID NO: 5493 - DNA, 3426 bp, Streptomyces avermitilis
  CDS (1)..(3426)
atgaccaccaccgtcggccgtgtcgaagtgagcatcgtccccgaaacctcgggcttcgccgctcaggccgatgccgcactgacgcccgccatggagcgcctgggccagaagctgggacgcaccctgtcccggtcgatgacccaggcgctcgacttctcgggcatcgacaacgctctccgtcgctcactggacacggccgaggcgtctgccgcctccaagggccaccagatcggcaagcggtacggccaggccatgaaggccgggctctccaccgagctgcgcggcctccaggggacgctggacgtcaccatccgccccgtcatcgaccggggcgcctaccgggccgtacaggccgatctgaactacctgacgcggccccgcacggtctccatcaacgccgacgcggacacccgtgtggcggccgacgatctcgcgctcctcacccgggcgcgaacgcaaaccgtcacggtcaacctccggacggacgaggcacggagcaatctgctcgacttccgccgggctgccgacgacgcctctggagccgcttcacgggccaccgagtccctcagctcggccagtggggccgggggcctcatgggggccctgaagggcgtgggcgtggccgccgccctgtccgcgctccccgctctcggtgccctggttccgatgatggccggggcggggctcgccgcaggcaccctcaagctcgggttcgccggggtcggcgacgcgctggagcaggcgggcaaggaccagaagaagtacgaggaggccctcaagaagctcagccccgcgcagcgcgccttcaccaaggccgtcgtgggactgaagaaggagttcgcgccgatcgggcgcgaggtccagaaggccatgcttcccggcttcacccgggcggtgaaggatgccgggccggtggtcaagatcctcggcaagcacatgaccgagatgggcgaggccttcggagatgctgccgagggcgtcggccggatgctgaaggactccggtttccaggacgacttgcaggccaacctgaagctcggctcgcagttcgtccgcgagatgacatcctcgctcggccccttcacccgcagtctgctcgacttcggcgccgctagcggtccgaccctgcgtgcgttcagcgacggcatcggcggcctgctgagcaagggactgcccagcatgttcagcggcttgagggccgggatccccggtgcggcgaagatgctggacggcctgttctctgcgatcgacgacgtgctcggcggcctcggccggctgtccggcgaggtggcccgcgacctcggccccgtcttcggtgaacagttcgcactgtccgggtcgatcgtcacgggtgcgatggacgccatacgcggcgcgatggtgctgctgcggcccgtcttcaaggacatcaccttcggactcaagtcggtccgcgacatcgctgcgattatcggcccaaccctgcgggacacgggccttgcgatcttcagcgcgttcgcaccggtcggtgattccgtcaacggggcggtcggcccgttgcagcgcctgaaccaggccatcgccgcgaacaagatcggcatcctcgaaggcgcccgccagttcggcaacgccgtgatcgacatgacgagcgcggcaatcaccgcagcaccgacgatcatccatgcgttcacgctcgtctcgggcggcatcctgagcgcgctgagcggggtagcgcacggtgccgcgttggcgttcggatgggtgccgggcatcggcgggaagctgaaggccgccgacaaggcgttcggagatttcaaggactcctacatcgagggcctgaccaccgcggagtccaaggccagccacttcgctgcgtcgaccgctccgaagctggctgcgggcaagctgaagctgaacatcaacaactggtcggatcagctcgccgaggcgaagcggaagctggccacggtgccaccgtcgaagcagtccgcgctgaaggcgaccatcaaggacctggaagccaagatccgctctgcccggggccagctcgacagcctggacggcaagacggcgacgacctacgtcaagaccgtctacgagaaggtcgaggcacagaacgcgcccaagttccgtgcgcgtggagggccgatcaagctggcggccggtgggaatcccagcggcctagtgcgcggtccgggcactggtacgtccgactcgattccggcgatgctctccaacggcgagtacgtgatccgcgcgaagagcgtcgccaagtacggcatggcgttcctgaacgcggtcaaccaggggtcccttggcatcagccgactggcatccggcggtctcgcgggctcggaggtcgccaacggcctcgcgagcggcatgacgaacggcatgtcgaaggtcaacgacgctgcccgggtcatggcggctgccgttgaagcaggcgtccgtaccgaactccagatcgccagcccctcgaagaaaatgcaggcgctggcgaaggagatcggtgctggcctgatcaagggactcaccgggtcccgggatcagatcaagtcgacgtcggcgtccctggccaagtcgatctgggcaaccttcagcgggtccacggacaaccgcctcgtggcgacgctcaaccagcagaccaagaagctgctggacctcgctgccaagcgggacaaggtggcgtcgtccctcgcggcgggccagcagatggccaaggaccagaaggccgcagggctgtctttcgcgtcgatgacctccctgccgaacggcgggaacaccttcgacgccggaggcatcctctcgggcctgaaggttcgcctgggccagctcaagaccttctcgggcaacgtcgccaagctcgccaagatgggcctgtccaaggacctgatcggtcagatcatcgcggctggcccggatggcggagcggcctacgccgctgctctggtgaaggcgactccggatcagctcaaggcgctgaacagcgcccagtcccagatcgccaaggtcagctcgtcgtacggcaactccgcagcggacatcatgtacgacgcgggcagccaggcgggcaagggcttcctgaccgggctcaaggcccagcagaaggccatcgaaaactcgatgtccgacctggccaagaagatccaggcggccatcaagaaggccctgaagatcaagtccccgtccagggtcatggccgagatcggcgagcacgtcggccagggcctggtcatgggcatggacgcgactcacgcggccatcgtctccagctcgaaccggatggccacggccgtccagcgcggcgtggcaactgagccggcacagcgagccgagcagggcaggacggtcatcttcaacgcccacacgacggacaagccgacccggcagaccgtcatggacgcccttcgagacagccacgcgctgtacagcccgctcgtcgcc

SEQ ID NO: 5494 - DNA, 396 bp, Streptomyces avermitilis
  CDS (1)..(396)
atgtcctggctggagctgtgggagttcgtgctcgccctcccgtacgactccatgaccaagtccgccatggctggcgaccatgggcgccgccgctggaccgaatcggactacatgctgcgggagctgctcgccgtggcgcagttccaagcccgcatcgcctgggccggacaccacatcgagggcaaggtccccgacctccctctgtgggaagagccggaccgccgctcccccgagcagatcgaggcggaccgggagcttgccgtggcacgggccgaacgggcccgcaagtaccacgaggccaccaagcccggctctcaggacaccgagtacgcaaagaagctggcggctgccctcgcggagcaccaacgggtggctgccgaagaaacagcggcttcc

SEQ ID NO: 5495 - DNA, 330 bp, Streptomyces avermitilis
  CDS (1)..(330)
atgactcagcccaaccgcaagcgcatcaagctggagaccctgcgcgcccagcgtctggaggccaccggcaccaaggagctggaagtgatcgtggaggacgagaagttcgtcttccccctgttcaactggctcccgatcgcgacgtacaagaagatccagtcgctccccgacaagaacgacctgatcgcgcagacggagatcctgctcggcaaggagaagaccgagcggctcttcgagctggggctcaccaccggtgacctgctcgacatcttcgacgcgctccaggccgacgccggtgtgagcacgggggaatcgaccagctcctccgac

SEQ ID NO: 5496 - DNA, 615 bp, Streptomyces avermitilis
  CDS (1)..(615)
atgcccgtcttcgtgatggcgacaaccacaggagaagaatccatgtctgctgacaacacgcaggtgagggttggcgtcacgggcgcggtctacgtggccccggtcggcaccaccgcacccaccgagccgtacaccccctggggtgcgaactggatcgacctcggctactgcaccgaggacggcctgacggaatccctcaacgaggaccgccaggagttcaagggctggggcaggaagcgccccctccggacccagatcaccaaccggaccaacaccttcaagatcgtcacgcaggagacgaaggcccacacggtctcgctcttctacggcgtggacatcgccgacatgacctcgtccggcactggcgacacccagttcatcagttggaacgagccggagaacccggagccgctgtactacgcactcggcatggacgtgatcgacggcgactacccgaagcggatcaccgtcgcccgtgccgaggtcaccgcgaagggcgacatcgtctacaaggcggaccagaccgtcagctacgacctgacgttcaccgccctggaggctgcgtccggcgtcagcgccatcaactacatgctcgggaaggtcccgctcccggcc

SEQ ID NO: 5497 - DNA, 441 bp, Streptomyces avermitilis
  CDS (1)..(441)
gtgaccgttcccctgacctctctggtcttcccggacacggagcagatggtcgtgaaccacctgctcgaagtgctcgggtacgaagcctccaccgtgcggccggacggaggcgccttcaccgaggcgctccccttcatctgggtcaaccgcatcgggggcgtacgcgtcaccaggacttcccagggccggagcctccacgacgaggcccggatctccctggacgtctacgcaactgagggcgccaacacgtccagccgggtggccgccactgacgcggtcgcccaagtccgtgccgccttcgagcagatgcacggcacctcccgggacggcggcttcgtgctgcgcacctgggaggagacgggccctgcggttcgccccgaggagcccaacaccaacgtcacgcggatcggcctgatcgtcggcctccgcgttcgccctgtc

SEQ ID NO: 5498 - DNA, 237 bp, Streptomyces avermitilis
  CDS (1)..(237)
atggccaccttcaagctcaccttcccgtacaagggccgatggcccggtgacgtggtcgaggtccgcgacgacgaggtcagggatctcgtccagagcggcatcggccacctggagggcgctgagcctgtgctccggctcgggcggctccccgaggtcgtccaaccccccgaagccccgcacgaggccactgaggccccgccggagcccgtcaagcgccggggcaagacctcggccgac

SEQ ID NO: 5499 - DNA, 282 bp, Streptomyces avermitilis
  CDS (1)..(282)
atgggcgccttccagcccaacaaggtcgcgatcgaggcgttgggcttcgaggacttcgtccagcaggacctgcacgagcgagccggccgcgtggtggacgtcgctcaagcgactgcccccgtggactccggtcgcttccgggactcgattcacgccgaggacggctccgacggagagatcctcgtggtctccgacctggagtactcggtgtacgtcgaactcggcacccgggagcaggccccgcacaacacgatcgccaccgcactcgatgccgcaagggat

SEQ ID NO: 5500 - DNA, 339 bp, Streptomyces avermitilis
  CDS (1)..(339)
atgctgctcctccccactgacgacgtgacgatcctgacccggcccgaagccacgagggaccgccagaacaaccgggtcgtcgactggtccgacgcggagcggacgacctaccgagcccgcgtgcagttcctcagctccaccgagaccgagcagcagggcgatcaggtcatcaccgacctggaggtcttcctcccgcccgaggccgtcgtcacagctgtcgaccaggccgaggtggacggcgtcacgtacagggttcacggcaagccccaggtccagcgcggagccgggcccatcgcccagctcgaccacatgcggatcgtcctgcgagaggtcaccggc

SEQ ID NO: 5501 - DNA, 393 bp, Streptomyces avermitilis
  CDS (1)..(393)
atggcgtacgccacggtggaggagttcaccgactacctcgatccggatccggtcccggccaacgcctcccggctcctggaccgagcgtccaccaagctcgacaggctcctcaccggagccgtgtacgagacaaacgcagacggcctccccacggaccccgccctcgcggcagtgttccgggaggccgtctgcatccaagcgcagtacatcggcgcccttggagacgagacgggggccaacgccaacgtggcctccatgaccttggggaaccagagcatcgtccgggccctaggaggccgtgacggcaaggggacgaccccccgggtctcccaggacctgctggacctgctccaggtgaaggggctcctgcccgtcttcccgcgcgtctggggg

SEQ ID NO: 5502 - DNA, 333 bp, Streptomyces avermitilis
  CDS (1)..(333)
atggcgcgtactgcgctgaccccgcagcggttcgccaccaccggcctgaccgcgacctacgtgacgccggacgtggcgggggtctccctccgctccagcggcaagcaggtgctccacgtcaagaacgcctcgggggcctcgatcaccgtgacgctcaagatcggtcgcaccgtgcagggccaggccgtcaccgcccccaccgccacggtggccgccagtgccgagaggttcttcggccccttcccggacgactacgagcagccggacggcacggacaccgtgttcgtcgacttcagcgccgtggcctccgtgacggtcgcctgcctgtcgctc

SEQ ID NO: 5503 - DNA, 1320 bp, Streptomyces avermitilis
  CDS (1)..(1320)
atgcccgtcaccctgagcgaggcgaagaacaacgccacggacgccgtagacgtccaggtcatcgacgagttccggaaggagagcgccgtcctggacgcgctcaccttcgacgacgtcgtgaaccctgccggtggcggcgcaaccctgacctacggctaccgccgtctggtcacccagcccaccgcggccttccgtgcgctcaacaccgagtacgccccgagcaacgtccagacgcagcgctacagcgtcgacctggccgtcctcggtggcagcttcgaggttgaccgcgtcatcgccaaggtcggcccggccgcgtccggcgccgtggcgctgaacatggcccagaagatcaaggcgaccaagacccgcttccaggacgccgtcatcaacggcgacgtggacggcggcgaggacgccgacgcggagaacggcttcgacggcctggacaaggcgctccggggctccgacacggagttccgcgcgacccagaccaccaactggtcggacttcgacaccaacccggcctcggcccaggtggccctggacacgctggacgagtggctctccctgctggacggcgctccgaccatggtcctcggcaacaagaccgccctggcccgtgtgcgtgcgctcgcccggcgtgcgggtcagtacgtccagagcccggtggacggtctcctcggccccggcggccggcccatcgtgcgcgagcagtacggcaacatcgtgttcgtcgaccccggcgagaagcccggcacctcggccccgatcatcccgatcgagacccgggacccggacagctcgacctggaccctggaggtcaccgggtccccgacgggcggcacctacacggtgagcgtcaccgtcggcggcagcacccagaccacctcgggcatcgcgtacaacgccaacgcctccaccgtgcagagcgcaatcaccggcctctccaacgtgggcaccggcaacgcgaccgtctccggcacgaccgtgaagaccctcaccttcaccggtgacctcgcggacctgtcggtcggcgtgaccgcctcgggcgcttccctgaccggtggcacctctccggccgtcgcggtggcccagacgggcaacagcgccgtctcggggctcaccgacctgtacgcggtccgcatgggcctggacggcttccacggcgtcaccacggtcggtggccagatcgtctccacctacctcccggacttcaccaccgccggcgccgtgaagaagggcgaggtcgagatgggcccgatcgccgtggtcctcaaggccaccaaggcggcggccgtcttccgcaacatcaaggtccag

SEQ ID NO: 5504 - DNA, 627 bp, Streptomyces avermitilis
  CDS (1)..(627)
atggcgacacccgcagagcccggcacgggcgcggagaaccccggcattcccccggagggcaccacgcctcccgagggcacggcccagcccgagtccgtcaaggacgacaagggcagcaagagcggcgagacgaactggcaggccgaggccgagaagtggaaggcccaggcccgcaagcacgaggaccgctcgaagagcacgaccaccgaactccagcgacagtccgccctgctggcccagttggccgagaaggcgggcatcaagctcgacgacggcaagccggacgccgagaagctcacacagcagctcaccgccacgcagggcaaggcccgacagagcgcggtggagctggcggtgtaccgagccgccaccaagcacagcgcggacgcggacgccctgctcgacagccggggcttcctgaagcaggtcgatgacctggacccggacgccgacgacttcgccacgaaggtcggcgacgcgatcaaggcagctgtcgagtcgaacccgaagctcaagaccgcccccgcccctcccgcccgtagcgggacggagatgtccgggcgcggcgaaggagcccgcaagcccaccaacctcgccgacgccgtggcagcacggatgcgcggcaac

SEQ ID NO: 5505 - DNA, 1575 bp, Streptomyces avermitilis
  CDS (1)..(1575)
gtgatgggcaccgcatggcctcctccggaactcgccgatgtcttcgcccaacaggacatctggagcgcctggtatgccgggacccccgagggcctgacggacgcgtacctcaacgccccgaacgacaggcccgccgcgcgccggaagggcctcctggcccgtctggggcggtggttctggggtcagcccaccccgatgggtgagcggccctccaagctccatgtgccgctcgcgggggcaatcgccgccgtcagcgccaacctgctcttcggggcaccgctgaacctcaccgtggacgacgcggccacccaggagcgcctggaccagctcgccgacgacacgacgtacgccgtcctgcgggaggccgccgagatgtcggccgccctcggcggggtgtacctccgtgtggtctgggaccagagcatccaggacaagccctggctggtcgcggcctcccccgacatcgctgtccccgagtggaagtggggccggctgagcgctgtcacgttctggaacgtgatccgcgaggacgcaaacaccgttgtccggcagctcgaacggcacgagccgggctggatcaggcactccgtgtggatcggctcggcgaacgagctgggtgtccagatggccctgacggacttcccggagacggctggtctcgcggacctggtgatcgacggcgacggcatcccgaccgggacgccgaagctcacggcgcagtacatcccgaacctgaagccgaacaagctctggcgtcacctccccgcagccgcgaacctcggccgctcggacttctccggtgtcgaagcgcttatggacgctctggacgaggcgtacagcgactggatgcgcgacctgcgtacgggcaaagcccgactcctggtcgggacagaggtcctggagaacctcggcaagggccagggtgctcacttcgacatcgaccgtgagctgttcgccccgctgaacctggagcccggcgaggacaagggctcggtcatcgagcaggtccagttcaacatccgcaccgaggagcaccgcgccctctgtgccgacctggccgaacgaatcatcctcggtgccgggtacagccttcagaccttcggcgtgacgagcgagggcagcggcaacccgacggcgaccgagatcgctgctcgggagcgtcagtccctcacgacccgggcgaacaagaccagttactggcgtcccgccctagcccacctcttcggcgtgctgctggagatcgaccggaccgtcttccggtcccaggtcgtcccccagatccccgacgtggagttccccgacgtcgtcacgcccgacccgggcgagaccgcccgtcagctcaacgacctgaacaccgccggggccatctccacgtacgagaaggtccgtcgcctcaaccccgactggcgggatgagcaggtcctcgaagaggtcgcgcgcatcaaggccgaccaggccgaggccaagccccagccgacccaccccgcgagggctcaggagcccgctggacagcccgagaagagccccgagggctcacaggtcaacgaagacgtcagcgagccgctggtggcccgc

SEQ ID NO: 5506 - DNA, 1296 bp, Streptomyces avermitilis
  CDS (1)..(1296)
gtggacctccagccgctgaccgcaaagcagcgcctgggtgttcagatcagccgtcagcaccagatcacgatctacgagggatcggttcgctccgcgaagaccatcacgtccctgatcgactggctggacttcgtacgcaacgggccgcccggcaacctgctgatggcggggaagaccaccaggacccttcgccagaactgcatcgacgaactcgtaagcattctcggcacccagctctgctcgtacaacgagggcaagggcgtcctgacgctcctgggccgccgcatcatcatcgcgagcggcaacgacgagagcagcaaggacaagatccggggtctctccctggtcggtgcgtacgtggacgagctgtccaccatgccggagagcttcttctcgatgctcacctcccgcatgtcggacgcgaacccgcgcctgatcgggacgagcaacccggacagcgccaaccactggctgaagaagaagtacctcgacaaggcccgggtgcacctgacgaggaccggtgaggtccggacgcccggcaacgacctggacctggcccggctgacgttcgtcatcgacgacaaccccaccctgacgccgacgtacgtgcagcagcgcaaggcggagtacgcggccacgccgctgctgtacaagcggctgatcctcggtgagtggtgcatagccgagggcgcggtgtacgaggtcttcgacgaccaacgtcacgtggtcgacatcgtcccggagatcgtgcagtggctcggggtcggactcgactacggaacgagcaacgccacggccgccctcttggtgggcatcggctccgacgggtgcgtctacgtcacgaacgagtggcgtcatgacggccacaccgaggagcagctcagcgacgggcagatctcccagcgcctccggacctggatgcgcaccctcaccgtccccggtagcagggacaaggggatcgagccgccccggctgatcgttgacccgtcggccgcctccctccggaagcagctccagctagacggcctgggctcgatgcgggcccacaacaaggtcctgtcgggcatccggatcgtggccaacctgctggccgccgacaagctccgcatccatcgcggctgcactcacctgctggacgagatggcctcgtacgtctgggaccccaaggcgtccctcctcggcgaggacaagcccctcaagcaggacgaccacagcgtggatgccctccgctacgcgatcaagacgactcagcacatctggcgtccccacgtcgaactcaacttcgaggaggtggcg

SEQ ID NO: 5507 - DNA, 486 bp, Streptomyces avermitilis
  CDS (1)..(486)
atggcccgcaccttctccgaagcagacgaagcgactctgcgtcagctccacgctgacggcgtcagccgcaacgccatcgcccgtcagatgggcttcgccgtcggcaccatcacgaaccacgcgcggcgcctcgggctctccttcgacagggaggccgtcagggccgccacggacgcccgtcaggtcgatctgaaggaccagcgtcagcaggcccagcagcgcctgatggacttcttcaaccaccagctcgaccgtgccgagagccggtacctggtgacgggctggacccacaccggggcgcccgttgccgagtggctccaggagcctccggcccgggagaccaaggacctgacgtccgcagcgacccaggccctggaccgcgccctgaagctcgcccagttcgacgcggagcacgacgacaagaacctctcggccatggaccgcttcctcggagcgatgctgagcgagcgtcccgagcaggacgag

SEQ ID NO: 5508 - DNA, 243 bp, Streptomyces avermitilis
  CDS (1)..(243)
atggccaccgtcgagaaccagaacctgtacgagttcctccaatcggcccgcgtgagcgagatcgagctgaagtacccggatgaggtcaagcgcatcagccggacccctctggactccaaggtcacctgcacgctcctggagctggcccggttcgccaagagggttcgggacgaggcgaaggccgagagcctggacgagttcaaggcctggggccatgacaggcccgtgaagaccaccctcatc

SEQ ID NO: 5509 - DNA, 474 bp, Streptomyces avermitilis
  CDS (1)..(474)
gtggagaacccgtcgccacttcccccgaacgttcccccgcgcccgtctggcgctcctacagcgcacaccacggctaactcgacggactcgccggacggctggcgggacgagtacgagaacgacccggagtaccaacgcatcctggcgggggtggaaaggccttggtggaagcggccggtggccctgtggggtggcgttgtcgccgttgccgttggttcgttcttcctgggcggtgcagtcctggggtccggcgacaactcgggcagtccttcccaggattcctgggtgcaggatcaggtggacgaccagccgcagggcaaccagccggccgggatatccctcgcgcagaagagtcaaatcctgagcaagtactgcaatcggcaggctggcggtccgtacaacgtgtcggaggctgcgctcctggagtgtctacagagctacgaggtgacggaccagggcatggtcatgccgaag

SEQ ID NO: 5510 - DNA, 207 bp, Streptomyces avermitilis
  CDS (1)..(207)
gtggaggacgagatttggctgacgatccgagaagcatccgacctgacgggcgtcagcccgcagacggtctactcgtggatccgcagaggccacctgaaagtcgagggcctcgatcaccgaggccagaagctcttccgccatctggacgtcgcgagggccgagatggccacgagggcgaaggccggacgcgtgctggtccgtgccgcc

SEQ ID NO: 5511 - DNA, 621 bp, Streptomyces avermitilis
  CDS (1)..(621)
atgatgatcgtcatgcaacctgaagtgctctccggtctcatcggtttcggcggtgccctcgtgggtggtgcggcgtccttcgggggcgtgtggctcaccctgtcccaccagaggaagctggcccgggaggcccgcctcgcggagatcggccaggaagcagcggacaaggccctgaacgagctgatcacgctcggggagttcctgggttcggtcaggagcgacgtcgccacgatgcccacggacgagcgggcgtcgtacctggacaccgtgttcggccacatggagaacgtcgagagggctgtggcccgcatcccgaaccgggaactccgcaaccgcgtgaagtccctcctgatcgtcatgcgccggttcagggccgccggtgtccggcacttcttcgcggtgagctggctcgcggagctgacggacgagctgaccgacctcctgtcggcctacatccgttccgatccccttccgtcgctctccgagcggacagaagagaagcagcgcagggccgcccagcacgagctggccgaacggcggcgcttcgagttgatgcaggaccccgaccccgccaacgtcgacccccgcgaggaggacgccgacgacgacggtccggcgtca

SEQ ID NO: 5512 - DNA, 558 bp, Streptomyces avermitilis
  CDS (1)..(558)
gtgaatcacatgacaatcgccctcttcgggttgaacaaggattacaccgtcgccctggtgggcctcacagggacgctcctcggtgcggtggtggccttcctgggcatccgatggcaggtaaatcgccaggagcgggaaaagcaactcgaccacgccaccaaggagtgcgggagagcgctgctgaccctgctccgactgttcaggaaggagcccgagtacgtgagcggggacgcgcccgagtcctggaagagcgacatgacagaccaagtggatgtcctcaagctcaccatcccgctcttccaccacaaggacttgaggaagcggctgaactccacggtcgacatcttggcggactggcattacgtggtcttcgatggccctggcggtcacgagtatcccgaatccgctccggtgatccgggaggtactccaacacgccgtcgactgcataggtgcagtccgacgaggagcacgccggctccccgaggagaccgaagccttcagaacggccatcggcaacatcagcgagttctgggcctacgacgcggacagccgactc

SEQ ID NO: 5513 - DNA, 513 bp, Streptomyces avermitilis
  CDS (1)..(513)
gtgggtatccggctgcccgcaccagagctgaccgctccaggaacgggtgaacggccagcagacgccagggcttcgggcatagcgtccacaacgcgacaggcaaagcggcacactgtcccgatggcatacgacctctcgaagggtgcgcccgcacccaagcccgaagcacagatcttcaagggctacgtcgcgaccgtgacgctctacgcagatcgcgctcagatcaagcgcaagctcatggggaaggtgaccggcgccaaagacgccgtgatccccctcggtgacgtcatcaaggtgcagtccaaggagccgactcgactcgtgaacgggtacgtacagctcgccaccgaggaggaccggggacagctcaggatcgccacggccgaggcacagaaggccatcgcgaacaactcgcgaaccgtcctcttcacgtggaaccagcgagagaccttcgcggcctacctggcagcggctaccgccggagtccaggcccaaggcggcaacccgttcgga

SEQ ID NO: 5514 - DNA, 159 bp, Streptomyces avermitilis
  CDS (1)..(159)
atggactacgcagcgatgtaccgccaggcgatggcggacggctccaccgactacgcccacacgatcgtcgtctccgccacccaggccgccgaggccggaggcgtgagccccgaggagcttcgggacctcgtgaacgagatcaaggcgcacgaggagggc

SEQ ID NO: 5515 - DNA, 666 bp, Streptomyces avermitilis
  CDS (1)..(666)
atggagcgcctcgccaaggggagttcggccctgaccgtcggtacggcccgaggcatcaccgcgtggctcaaggcgggcgagaaggtctcggactacgtggtccgcgtcatattcctcacgatccccgggggagtcctctgggggctcctgtccgcctcccgggccttcatgtggctcctggtggtcatctggtgcatcgccgcctggcgagcagcacagccggcccaggaaaagtccgaggccaaggagcccgacctccaccccgacgacctcgcggatctcctctgggagctggccggagaccgcaagggagtccacctctcccaggtcgcccagcagctcacgaaggagaccccggggaggacctggagcgtcaaggacgtccggcgcctcatggaggccgcggggatccccacgcgccacagcgtccgtgtgcagggcatcggggtggccgtgggggtccaccgccaggacatccccggcagcccctcccccgcccctgtgagcccctctccccaaggcgtagagccgcaggtcaacccagctacggctacagctactacgccctacgtccgcgacctcgggggaggggctacggccaccttcacccccgacccccaacagcccaaccggacgcacgtgaccgtcgtccggcccaccgaagac

SEQ ID NO: 5516 - DNA, 534 bp, Streptomyces avermitilis
  CDS (1)..(534)
atgaacagcgtcaccacggcgaccgtcagtctcggcgccgtcaccatcggcctggggatcctggcctggcacctcacgaagtggtggcgcggtggcgggaagggtcctggacccggtggcggaggaggccgggacccgaaggccctgatcccgctgctcagctcgatgtccctcggaatgatcgcgatcacggctgccggaggactgatcggcacggctgccgggttcctgctcaacaccggaagcctgatcggcaactggtccctgacggccgcgacgggcaccgtgacgcccgaggtgacgcggtccggcctcaaggccctgtcgcccggcggatgcgcactcttgtgcatctacttcgtggtctgtgtcgccttgtggaagagcggcgcgaagctcctgaaggggaagatcgcggcaggcgtcacggcgggcgtcatgctcggcctgagcgccgggttcagcgggatggcctcggtcgccctcgtgacgatcacgaacaccgtcggcgacaagatcacgggcgtggtcctg

SEQ ID NO: 5517 - DNA, 390 bp, Streptomyces avermitilis
  CDS (1)..(390)
atgaccgacaagatccccgatcccccgaactacccgccgtacagcgccgggtgcgctccgaccgaggtccacgtccacctcaccaccgagcagcccgaggagagccgctgggacttccgctggctccagctcggccggaacaccaagtgcctgctcgtctccgtcatcacggccccttggtgggccggagccctccgggacgtccgcacggagcagggccagcccggcgcctggttcatggccggagcggccctctgtgcggctctgtggttcgaccacatccgtcagcggttcgtcacccgcgtcttcgtgtggaccgcagccctgggggccgtcggcgccctgcccctgctctctgccttcgtccgcatgatgaccgggagccccgca

SEQ ID NO: 5518 - DNA, 942 bp, Streptomyces avermitilis
  CDS (1)..(942)
atgagtcctcccgtgcccaagctcgaacctaccctggcgcccttaacgccgtcagggtcaactgccgttccgacaaccccgttacccctactcgtccgcgccgccatcaccggtggacgccctgccgtcctcgcggcggccctcgccctcagcgcccccggtgagtaccgcctcgccgtactggccgggtgggactggcgcttcgccctgatcatgccgggcgtcctgagcctgtacgcctccgtcgccgctgccatcgcgggctccctcccgaagggcagcaccgagcggaagcaggccaacgccggtgccctgatcgccctcgcactggccatgacggcccaagtcgcctcccacctgatcgaggccgggtacctggacaagtcccccgccgtcgtcgtggcggtcagcgccgtgcctcctctggtggccgctcacacgctgcacctgacggccgccgcgacgcgcctgacgcccaaggccgtgagggtggaggaacccgtcagcgtgcctgcgccggctgtccaggaatcgttggagaccgtggcgcccgaaccttcgcgccagaacgccctgacggctccgccagtgccgtcagtcccgctcgtgacgcccgtcatggaggccgacgagcacgaggcctcggaggagccccaggaggccgacgaggcccccgaggacgagcccgaggtgacggaggagccggagcccgtcacggagccggagaagccccgtcaggagctgacgcagcgggaccggatcgaccaggtcatccgggctctctacgacgagctgggcaaccggcgtccggccacccgtcacatggtggcggccctgactgacgcgggtctccccaacagcgaaggcaccgcacgcgagagcaggaagcgcgtcgagctggctgagccccacctgaaggacctcccggacgccatcgcggcc

SEQ ID NO: 5519 - DNA, 645 bp, Streptomyces avermitilis
  CDS (1)..(645)
atgaacctgtacgagtgcttcgtctgcggcaccccgcaggaggccaagacgtgcgaccggtgccggagtcgaatccgcggtgacctctccgccctccccgagctgtaccgggggctggaggggtgccgtcagcggggacagaacggtggcggtgacgggcgctcctcgaagcgtctgcacgcccctgtaccgggcgatgagagggtcttgaatctgctcggtcccgcgagccgtcagcccgtcactgacgcccgggaccagacgggcgagacgccgttcctcgcgctgttggaatcgtggtgccaggcggtctccgaggaaagggcgttggaccacgtcaagacgaacgtgacggccatgacggccatgctgacggcccacctcccctggatctgcgatcagccctgggttgtcgagttcgccgaggagatcagggcgttggtccacacggtccagcggatcaccatgacacagccgcgcaaggagctgcttaggggcgtcacgtgcccgtcatgcgaaggtctgacgctcgtcaggcactttcccggggactggtcggctgagtgcgcgctgtgtccctcggtccggctggacgagcgcgactaccggctcttggtgcagagccaggcgcagggcctgacggcc

SEQ ID NO: 5520 - DNA, 222 bp, Streptomyces avermitilis
  CDS (1)..(222)
atgaacctgaccgcagtggctgacgccctcgcgctggaggactcggagaccgccatgcatctcggagtcctcctggccctggcccaccaggtcgcccagggccagccggctcggatccatgaggtcctcagccagacccctgagatccctgagggggccacccggggcgagtacgccgccctgctccgcctgaccgtcctggaggtccacccattacgcatc

SEQ ID NO: 5521 - DNA, 1545 bp, Streptomyces avermitilis
  CDS (1)..(1545)
atgagggggcgcagggctgatgttcagcgcgaaccacacccaggcgatccagtacgccaattacgccctccatctcctcgccctcggcatcgtcaccggcctgatcgccgcggtcgtccgccagatgcggagggcccggtgaccctgagcttgaccgatctgttctgcggtgccggtgggtcctccaccggtgccgcgatggtcccgggcgttcaggtggccttcgccgccaaccacgcccgggacgcgatcgactcccaccaggccaaccacccggacgccgatcacgacttggccgacatctccgaggtggagccgacccggtatccgaggacggacttgttgtgggcctctccggcctgcaccgcccactccctcgcctctggcaagaagcagggccacggcgagtacgtggacggagtgaaggccacgagcggcatcgacgaggccgcgatcaaaagccgcgcgaccatgtgggacgtcgtccgtttcgccgagtcccaccagtaccgcgcgatgatcgtggagaacgtcgtcgaggtcatgcagtgggggccgccggggaagcccggagcggtcttcaaggcctggctcgactcgatccgcgcctgggggtacgagcaccgcctgatcttcctgaactcgatgttcgcccaggccctcgggcccggcgctcctcagagccgtgaccgcttctacgcgatcttctggaggagcggcgagagggcccccgacttcgacaagtggctgaggccccaggccgagtgcccgacccatggccctgtgcgagtcgtccagcgcttcaaacggccggaccgcctgtacgggaagttccgctcccagtacaccttcaggtgcccgtacacgtcgtgtgctgaccaggccctggagccgaaggcccgcgcggctgccgcggccatcgacttcagcctcccggccaagaccctcggagaacggaagcggcctctggctgagtcgacgctccgacggatcagggcggggtaccaggcgttcgccagcgaccacctgctcgtcccggtcgagggacgtcagggcaaggtggcacgtccggcccatctgccgttgaggacttgcacgacccggaacgagaccggactcgcgctgcggtacatggtcgagctgcggggtggggcgtcttcccaccgggccatcacggagccgctggcggccgtctgtgcgggcggcactcaccacggtctcgtccaggccccggcgatgacgctgccctactactccacgagcaaggcccgtccggccgctgagccgctcggcacggtcaccacgctggaccgtcacgcggtcctgccgggtggagagatcgagcacttcgaggacctgaggttcaggatgctggagccctcggagtacgcccgtgcgatggcgctgccggacggctacatcctcacgccgacgtccaagcgcaacaaggtcaagctgatcggcaacggggtcacgcccccggccgcccgggacttagtcgccatggtggtcgaggccgtcacgggcgaggccctcgaacccgca

SEQ ID NO: 5522 - DNA, 435 bp, Streptomyces avermitilis
  CDS (1)..(435)
atgaaccagccgaccgtcagcctgaacgacttgatccggacccggatcgaggagatcgccgaggacctctgggccaaccaccgcgtcatgcaggtgccgagtggagaggccaggtggctcgaagtcggacatgccgtcgtcgctgagcagtggagctgccaccagaaccacggagacggcgtctgcggagagccgctcgtgccgtaccaggtcgccaaggaactcctcggctgccccgaggaccccacgttcccggaggacgagttcaagcgggagctgatccccttcgatcacctggacccgatctggggcttcaacgccagcgaacttatccacttctccgacgtcagggccatgcacggggtctacggcgagccgttcaataccccggacgggatcatcgagtggcgctacccggatgagggggcgcagggc

SEQ ID NO: 5523 - DNA, 240 bp, Streptomyces avermitilis
  CDS (1)..(240)
gtgagcgccctggaccagtacctcgtctgctccggcccggagatggtccaggacctggtggtcctggaggacggctgcatcgaggccgtcacgacccgcgagatccgggtcttcgagtaccaggcggaccgctccctgaaggagctgttcggcccggacaaggaccgcgcgctgaccgccttctggcaggacgtcgagcgcttcaacgaattgaacgacatcagcggggggaacgaccga

SEQ ID NO: 5524 - DNA, 225 bp, Streptomyces avermitilis
  CDS (1)..(225)
gtgaacgcccaggccatccgtgaggtcctcacggacacggagctggctccgtccacccgcctggtctgggcgtacctgaacgtcgccgccgagccgcagaacagcagctccatcggtcatgacctcgggttctgccactccacggtctcccaccacatcggggccctgaaggaccggggcctggtccgcaggcgtaacggcgtctggctgccggaggtgccccag

SEQ ID NO: 5525 - DNA, 858 bp, Streptomyces avermitilis
  CDS (1)..(858)
atgagcgtttcgcacctgcccagcatcttcagggcggtccaggagatcttcccggacaccgccctccgcatgggcttcagcaccgagcacaaggcggctttcgtggtggctgccgacctcggcaaggccatcgactacaaggccgacgccgagtcgttcatccggtccctggtaaagggtccgggagattcccggaccctttacgtgggcaacgagctgatcccgaccgctggcgggcttcagaccatgaaggtcatctacaagcgcggggccttccacctgatgatgaggtccaacctcccgaaggccgccgagtaccgggaccaggtcttcgacctcctggagcagatcgagcgcgagggcttcgtggtcaacgcgagcgctccggtcgagcagctcaagaccatgaagcccctggtcgagcagaccatcgacgagctgctggaggcccgtctccaggaacgcaaggactaccgctcgatcatccgggccgtccgggacgctggtggtcaggaccgcgacttcgcggacgtccagaacatgatctacctcgggctgttcggcatgaccgctcagacggtccgcgagcgccagcctcaggtgagcggcgagcgctacaagcgggagtaccgaagcgcgaaggccggggatctgcggccctcgaaggtcgccaaggacttcctgaccaaggagcagctcaaggccctggacgacggggtcaactacatcacgtcggtcctgaacctccagtgcccggacggcgtgatgaccctggacgacatcaagggcgctgctctggacttcggcgcccacatgcgctccctgcgggcccgccgagccggctcgggcgtggccgcg

SEQ ID NO: 5526 - DNA, 1455 bp, Streptomyces avermitilis
  CDS (1)..(1455)
gtggtatctgggtgcttatgctggggcccagacgcgacgaagcccccggggctggtaaccccaggggccgcgtcagaggaatttaaattcctcgggtccaggaggctcctacacctctcaggaccagcagtccccgcacaccttcacgagacgggaaccaccttgaagaacgttgccaattctagcggctcctccccttcgggtcacgttgaccttgacgccgtgaactccctccacctcgtcgagatggccgcgcgctccgtgggccgctccgagaccctgatcgagcacctgctctcatggcagatcgagacccgccccttcctgtccgggactcgtggactcgcccgttggaccaacctctccgacaagaccgtccgggcgaccgtcggtcccgagggtggcctgagcgaatttaagttcctctggaccaggacccgtgggtcctcctccgccctcgccgaggagcgcgactccatggaggtccgcttccgctccaatagcggcggtgactaccgcagtacttcacctaaagaccttcaggcccctggtggccccctggctgggggcctgggggacctggacaagaagcaggggaaggaaggagcttggtggggtaatgcggtagtcaccgccgcaatcagcgagagggcccaggaggtcctggccaacggcttgaagaccctctcggagctggacacgatgaagggcatggagcagaaggcgaggaccctgcgggccctggatgcctccctggacgtctggagcgaggtgcagggcccggacgccccggagttcgccctcggccgccaggcgtggaagctcgcggtcctgtgcggtctccgggacgtgaccctctccaccgacgacatcgccggactgctgggcctggcccccaagagcgtccgggacctcctggcccggatgaccaaggcgatccccggtctcgtccggaaggtccgtcagggccgctcgttcgtctacgagatcgcctgggcgcaggtcttcgacgaggccatgggggacatgtacgacgagcgggtctcccgccacgacatccgcaaccgcagggcggcccaggacaaggctctccaggccacggcggcccgacggggcacgggtgccggatacctcgcgtaccgcctctccatggctaatccgaagcgcgccgagtacctggagcgcaaccccctcccggagggcgctgacggggcctggagggccctcgtggaggccggggacgagctggccctgtacgagcacctgcgggcccaggaggccgaggctggaccggtcccgagcaccccggcggtgctggtcgaggaggccaaggaggtcacctcgttgaacccccttctgggacagccggctcaggaatccttggaggctccgcagcggatcgaccccgaggtcctggcggccatgcgggcccgcatctgcgccagtacgtacgcg

SEQ ID NO: 5527 - DNA, 339 bp, Streptomyces avermitilis
  CDS (1)..(339)
gtggtcatcccggaggccgtgaaggccccggagccggagaagcccggcgagccctcccaggacgagctgagggccgcgtacgactatctcggcctccgggagacgtcggagggcctggaggtcactcagaggggcgtccagagcgccctgggcaccgtgaagaagatcgcccgagaggacccctcctcggccgaggcccgggtgatggcgatgggtgcagccgatgatgaccgcatcgagttcctgcggtgcgtgcagctcgacaagctctcgaaggtcatggccaagagggctgctggtgacccccgctggttgggcgtcgcgactcctcctcgaatt

SEQ ID NO: 5528 - DNA, 243 bp, Streptomyces avermitilis
  CDS (1)..(243)
gtgcagcacgtagcaccgtccaactctccgtacatcacctgcatccagtgcgagagcacgtggctgaccgagacgtacgaggcggccaacggaatcggcggttcgtactccgatgagttcacgtacgaatgcccgaccgacggataccacgtcccggaatgcacctgcgcctgttgcgtgtacagcgactgcggccatgacaacgacaagacctgtttcgacccgaaccgagaactgaagcac

SEQ ID NO: 5529 - DNA, 246 bp, Streptomyces avermitilis
  CDS (1)..(246)
atgagtttggaatggacgcagaaggcgtattacgaggcgagcggaggggaccgggtcggtctcctgtcgctggatgacggccactcggcggtggtgtgggcgtatgccgatccgcactgctcgatgcaggtgatctccttcgacccggacaaggccctggaggtcttcgagatctcccgtaacggcgctgagaaccgcgagggtctgcggtacgactcccgccaggcgtgggacgggggttccctg

SEQ ID NO: 5530 - DNA, 189 bp, Streptomyces avermitilis
  CDS (1)..(189)
gtgggacgggggttccctgtgagcgagcagctctacaccgtcaccgcgttctcgaacgactacgagcacaagccgagtcggggcgtcgtgtaccaggtggtcgacgccaccgaggagtacgtggagaagctgaaggcccgcgaggccgaggagcaccccgaccgctggctgaaggtggaggcccagggg

SEQ ID NO: 5531 - DNA, 372 bp, Streptomyces avermitilis
  CDS (1)..(372)
gtgctggggtgccccgcccgcctggagtcacgaggacgggagcgccttgtgcccgatcgtcggtccgaacggatacgagcccgctcagccggagttcctgacgtgaagggcctcgtcgtcatcgacccggaggcccccggcggctgccggaaggtctcgtacggccccgtcgtgaacggccgcccccttcgctctccggccatgcggaagctcatcggcaacctggtgaaggaccaggtccgttgggccgagagggaggccaaggaggccgcctgggtcgagcgtcagatggccaccgcgcccccgctgaccatggtccagacccagatgctccgccgggtgaagacggacctcacccgggctgcccagctc

SEQ ID NO: 5532 - DNA, 837 bp, Streptomyces avermitilis
  CDS (1)..(837)
gtgagcgcagcaacccgtaacgcgttccgctctcttgccacggatctgaccatccggatcgtggccgagctgtgggaggaccatgggttcgcgcccatcccgcccgaggagctgaagtacgacgaccccgggcagcggcggaccaccttcatgctctatgcggagggcgtggactggggcgatcctgagcatgtccgccgggctctcctcgtcttcgaggacttcattcgcgcgtaccgagaccccgaccagcagggcaccccgaagtggcttgaggacatcggtgttcgactggagcgggacggattcctgctcgacaagagcggccgaatctcatgggagcgagcgccggtccgtctcctggatcgggacctgagcaccctgagtgacggctcggggatcgcggtcgaactggagcgaatcaggcgggacctgacgaccgatcctcacggggcgatcggggccgccaagcagctcatcgaggccacggcgaagacggctctccgggagctgagcatcgagatcgacaagaatgccgcgctcccgactctggtcagcaccgtccagaaggcactgaagctcgacgccggttcggctcccgacgggcctgacggcagcaaggccgtgaagaagatcctttccggctcggtgaacatcgccgtgggcgtcgcggagctgcgcaaccagggcttcggtagtggtcacgggcaggccagcgcgccgtccgggctgggggttcgtcatgcccgcctgaccgtcaacgcagccgtgacctggtgtgagctgatcctcgacactctggccgacccggccgcgccgtggcgcaagggccaggtc

SEQ ID NO: 5533 - DNA, 1500 bp, Streptomyces avermitilis
  CDS (1)..(1500)
atgaagacctccgccagagatcgggttcgccgcgtcgggatctatgtccgcatctcagatgaccgcgagggcgggggacttggcgtcaagcgccaggaggacgactgccgactcctcgccgcctccctcggctggagggtcatcgaggtctacatcgacaacgacgtgacggccgcggaccgccggaagaagcgcaaggactacctgcggatgctggccgacatcgagatgggctgcatcgacgccatcgtgtcctggcacccggaccgcgtgtaccgccagcccgtggagctggagcacctgatcaacatcgtggaggaccacaagaccgagatcgcgaccgtcaaggcgggcgacctcgatctgagcacccccacgggccggttggtcgcccggatgctcggggccatcgcgaagtacgaggtcgagcacaagcaggagcgcatcctccgcaagatccaggagctggtcgaggccgggaagatccacaactccggccaccggcccttcggttacacccggctcttcgacggcgagggctcacgccggaagatcctgggcgagatcctgaacgaggaggaggccgcccacatcaagaagtgggcccgccgcgtcctggagggcgagaagctcgggaccctggtggccgaggccaacgaggcgggcatcaagacgtccaccggcggggcctggtcgtaccaggccatgcggttcctgctgatgtccggccggatctcgggccgcaaggagcacaggggcgagatctacggtcaggccgtctggccgaagatcatcgagcccgaggacagcgacatgatccgagccctactcgccgagcgctccgaggagttcaaggcggagtacggcgagcgggacaccccggccctgaagtacccgctgagcggcctggtgaagtgcacgtgcaaggtctcgcacgtcgcgggcgagccctgctcctgcaaggaagaggggaagaagcaccaccggatgagcacggggcagcgcggggacaaggacatgcccatctatacgtgcaagaaggacgggggcggctgtggaggccggacgatccagatccccgacctggagccgctgttggagaagctcctcttcaagcgcctggaggaggtcgaggcggcggccgaggcggacgacaacgacccccgcccagcgctggaggccaagctcgcccgctgggagcggcggaagaaggagctgggggacgaactcctggacggcgaccgcccggcccgggagatccgggacgcgatcgacaccctgaacggccggatggccggggcccgcaaggagatcgctcagtacggggtcaaggccaacctctccgaggtcagcgcggccgagctgcggaaggcgtggaaggactactccgtcgcccggaagcagtcgacgtaccgggggctgatccgagagatcctgatccaccccgcgacccggcccttcaacgtctggaacccggaccgggtcgaggtgttctggaag

SEQ ID NO: 5534 - DNA, 354 bp, Streptomyces avermitilis
  CDS (1)..(354)
atgacggagcctatcgccgctggaaagcccgagtccctgcgccgcctaccgtggaccggacccgagggcagcgcggaatacgcagcgcccgaggacggcgtcgagcagatcgcagaccgcaccgaggcacacctcatcagaatggcgcgcaacgatgccgcctacgcgctgaccatggcggagcgaccggaagtctcgcgcactgatctctgcctgctggtacggaagttggccggtgctgtgggcgatgttgccagcgtcgccgaactgcgcggtgaacgactcaacgaaccgatctacgcccctgcggttcgggcactggaggaagccttgcgcgcggctctgagccagcgc

SEQ ID NO: 5535 - DNA, 264 bp, Streptomyces avermitilis
  CDS (1)..(264)
ttgcaagacggcacggggaccgtttccccgcagcagttcagcgaagggataggcaccatgaacgcgatccccgagtacgaattcgtcagtgcggctgcctgccgtgacaagaaagtgggcaactgcccgcaggtggccgtgaacttgccgggcgtggtggcattgcgggacagcgagcgccccgagaccatcgtcaccatgacgcccgaccagtgggtgacgctcaccgacgctgtcaaggccggagagttcgatctgagcgcc

SEQ ID NO: 5536 - DNA, 252 bp, Streptomyces avermitilis
  CDS (1)..(252)
ttggcgagtagacggaccggtgtccctgaatgggaaggcaccagcatgacacgcgagcagtgggagacgacacaggaagccgcagaggccgcctggttccgcaaggctgagtggcagcggatcacgcgccaactggaagccctgtacggcgccatgcgggccggggacacctccgtctacaccaggcagcggatagggcgccttgaggccctccagcaggcactgtgcggcttccccgagcaactcgccgcg

SEQ ID NO: 5537 - DNA, 1614 bp, Streptomyces avermitilis
  CDS (1)..(1614)
gtgtccgtcctccgcctgtccgtactgaccgatgagaccaccagccccgaacgtcagcgcgctgccaacgctgctgccgccgctggtctcggtatcgacctgggcgaccgggaagccgtcgacctgggagtaagcgcaagcaagacaacgccttttgagcggccggagttgggcaagtggctccgccgtccggacgatttcgacgcgctgtgcttctggcgtttcgaccgtgccgtccggtcaatggctgacatggacgacctagtcaagtgggcgcgagaaaacaagaaagtgatcgtctttgccgagggaccgggcggacggttgacgctcgatttccgtaacggtgtcgacctcattaccgaactgattttgaagatcttcgctttcgccgcgcagttcgaggctcagtccatccgagagcgagtcatcagcgcgcaggatgcaatgcgagtcatgcccttgcgctggcgtggttcgcgtccgccgtacggctacatgcccgcgccactcgacggcggaggatggaccctggctcaggacccggaagctgtggcagtcattgagcgcatcatcctggagctcatgggagaccccagtaagagtgtgctcggcaaaagcgcagcagacgtcgcccgaggacttaacgcggatggcattccgtccccccgcgaccattggagcctcaagaaagggcgcgacacaggcggaaagacaggcggccgggcaggcgagaccgtgacccgtgggcgcttcacgtggcgccacggcagcatcaaagaactgctcacctctgagcgcatgttgggctggaagacacaggacaacaagcccgtgagggacagcgagggtaagcccgtgatggctaccgctgagccgatcctcacccgtgaggaattcgacgcaatcggcgcagtgttgtccgagcgatccgtcgataacaaaaaggtcgaccgcgtagacaccatggcgcttttgctccgcatcatccattgcgaaggctgcggacagcgcatgtacctgcaccgaccgtccgccaacagcaagagcaccagcaagacggagacgtacaagtgcggcgcactcaccagggggcaaaagtgcgatgccccgtccatcatcaagcgcgaatgggcggaggaatacgtcgagcgtcagttcctatggatgctcggcgcgctggaagtaacgcacacccgcaccattccgggatacgacccgcagcccgagattgacgccaccctcgctgagttcgaagagcaccaggcgcagaggggacgtcaaaagtccaacgcaggcaaggcggcatggcaacggcacgccgattccctcgacgcgcgactcgctgaccttgagagccgggaaaagactccgccacgcgttgaggaaatccggtccggcaaaacgtattcgcgaatctgggcaagtgcagataccgcaggcaagcgcaagatgctccaggatgccggggcgcatctgaacgtcaagcgcagttctcggggcggctggcgcaagctggatgagcggcgggtcgacttcacagtccgcgacccattcttcgctgaggcagcaagcgaactcacgtccatgggagacgaattggccgcgaacggc

SEQ ID NO: 5538 - DNA, 837 bp, Streptomyces avermitilis
  CDS (1)..(837)
atgaattccgcccaggctgacgcctacctccgtcgtatcggcgtgacacaccccgcgtggcccaccgtcgatgtgctgcgcgagcttcaactgcaccatctgcgcaccgtgccgttcgagaacctgtcgatccatctcggcgaggagatcgtgctcgacgagaagcggctgctggacaaggtcgtgggcgcgcgacggggcggcttctgttacgaactgaacggggcgttcggggcgttgctggagtcgctcggcttcgacgtgacgctgctcgcggcacgggtgtacggggaggagggtcggctcggagtgccgtacgaccatctcgcgctgcgggtgcggacggtcgacggcggcgactggctggccgatgtgggcttcggggcgcacagtcactatccgctggccttcggggagcgtggtgagcaggtggatccgggcggcacgttccgggtgatcgaagcgggggtggacgcggcgggagcgcggagcagcggtgggtcggcggcatccggggacctcgatgtgctgagggacggcaagccccagtaccgcctggagacgcgaccgagggtgctcggggacttcgtggccgggctgtggtggcacagcacgtcgccgaagtcgcatttcacacagtcgctggtgtgctcgcgggtcacggaggacggagggcggatcacgctcagcggtcgcaggttcacggtgacggcggccgacggccggaaggaggtgtcggatctgggcacggacgaggaggtgctgggggtctatcgggagcggttcgggatcgagctcgatcaggtgccgaccgtgcaaaagaggggcgaaatcggg

SEQ ID NO: 5539 - DNA, 243 bp, Streptomyces avermitilis
  CDS (1)..(243)
gtgagtgatgtgagacatgtgctggtgctgcccgaccgtgatgccgctcaggaggcggcggaggcgctcggggagcggttcgcactcgacgaggagccgcagctcgtacgggatgcgctcgctggtgaggacgacgccgaggatgcccagtggctcctcgtgctacgggacgagagggggcggctcgatccgaaggagctggatgagttcgcgggggagtgggacgggtggcgggaggagcct

SEQ ID NO: 5540 - DNA, 1008 bp, Streptomyces avermitilis
  CDS (1)..(1008)
gtggcgcgtgggatgcttggcgcgatggccaagaagaccgcacatgacgaccctctcgcccccgtcacgcttgccgtgggccaggaggacctcctgctcgaccgtgccgtacaggaggtggtggccgccgcccgggccgccgacgccgacacggacgtacgtgacctgacctcggaccagttgcagcccggcacgctcgccgagctgaccagtccgtcgctcttcgccgagcgcaaggtcgtggtcgtacgcaacgcgcaggatctctcggccgacacgatcaaggacgtgaagtcgtacctgggggcgcccgcggaggagatcaccctcgtgctgctgcatgcgggcggcgccaagggcaagggcctgctggatgccgcgcgcaaggcgggggcgcgggaggtcgcgtgccccaagatgacgaagccggcggaccggctggcctttgtgcgcggggagttccgggcgttggggaggtccgcgacgtccgaggcgggccaggcacttgtcgactccatcgggagtgatctgcgggagctggcgtcggcggtgtcccagctgacggcggacgtcgaggggacgatcgacgaggcggtggtcgggcggtactacacggggcgggccgaggcgtcgagcttcacggtggcggaccgggcggtcgaggggagggcggcggaggcgttggaggcgttgcgctggtcgctgtccaccggggttgcgccggtcatgatcaccagcgcgttggcgcagggtgtgcgggccattgggaagctgtcgtccgctcggggtgggcggccggccgatctggcgcgtgagctggggatgtcgccgtggaagatcgatcgggttcggcagcagatgcgggggtggacgccggacggggtggctgtggcgctgcgggcggtcgcggaggccgacgccggagtgaagggcggcggggatgatcccgagtacgccctggagaaggcggtcgtggccattgctggggcggcgcggtctcgacgcggg

SEQ ID NO: 5541 - DNA, 168 bp, Streptomyces avermitilis
  CDS (1)..(168)
gtgcgtgagcgggccggtcgtatgtgcgtgagcgagccggcggccgtggtgacggctgcgcgggattcgcccccgccgcccctacccgtcccatcccgtccctgggagctgccgcccccagacccccgcttcggcctgcacggcctcgtcctcaaacgccggacgggc

SEQ ID NO: 5542 - DNA, 264 bp, Streptomyces avermitilis
  CDS (1)..(264)
gtggcgaacatcaagtcccagatcaagcggaacaagacgaacgagaaggcgcgccttcgcaacaaggccgtcaagtcttcgctcaagaccgcgatccgcaaggcccgtgaggctgctgccgcgggtgacgtcgagaaggccaccgagtaccagcgcgctgccgcgcgtcagctcgacaaggccgtctcgaagggcgtcatccacaagaaccaggccgccaacaagaagtcggcgcttgcttccaaggtcgcgcccctcaagggc

SEQ ID NO: 5543 - DNA, 1866 bp, Streptomyces avermitilis
  CDS (1)..(1866)
gtgcccgcgacccctaacaatgtgcccgagccgagccgtaccgacccggctctgatccgcaatttctgcatcatcgcgcacatcgaccacggcaagtccacgctcgccgaccgcatgctccagctgaccggggtggtcgaccagcggcagatgcgcgctcagtacctcgaccgcatggacatcgagcgcgagcgcggcatcacgatcaagtcccaggcggtacggctgccctgggcgcccacccaggagccgggtaacacccacatcctcaacatgatcgacacccctgggcacgtcgacttcacgtatgaggtgtcgcggtccctcgcggcctgtgagggcacggtcctgctcgtcgacgccgcccagggcatcgaggcccagactctcgccaatctctacctggcgatggagaacgacctcaagatcatccccgtactgaacaagatcgacctgccggccgctcagccggagaagttctccgaggagctcgccaacctcatcggctgcgacccggaggacgttctcaaggtctccgccaagaccggcctgggtgtcgaggcgctgctcgacaaggtcgtcgccgaggtcccggccccggtcggtgtcgccgacgcgcccgcccgcgcgatgatcttcgactccgtgtacgactcctaccgcggtgtcgtgacgtacgtacgagtcatcgatggtcagctcaacaagcgcgagcggatccggatgatgtccaccggcgcgacccacgagctgctggagatcggtgtctcgtctcccgagatgaagccggccgacggcctcggcgtcggtgaggtgggctacctcatcaccggtgtgaaggacgtccggcagtccaaggtcggtgacaccatcaccaccctgaacaagggtgcgaccgaggcgctcggcggctacaaggaccccaagcccatggtcttctcggggctgtatccgctggacgggtccgactaccccgagctgcgcgacgccctcgacaagctccagctcaacgatgccgcgctggtctacgagccggagacctcggcggcgctgggcttcggtttccgcgtcggcttcctcgggctgctgcacctcgacgtgatccgcgagcggctggagcgcgagttcgggctcgatctcatcgccaccgcgcccaacgtggtctaccgcgtcctcatggaggacgggagcgagcacacggtcaccaatccgagcgagttcccggaggggaagatcagtgaggtgtacgagcccgtcgtacgcgccacgatcctcgcgccctccgagttcatcggctcgatcatggagctgtgccagacccggcgcggcaccctcctcggcatggactacctgtccgaggaccgggtcgagatccggtacacgctgcccctcgcggagatcgtcttcgacttcttcgaccagctgaagtccaagacccgcggctacgcctccctcgactacgagccgaccggcgagcaggcctccagcctggtcaaggtcgacatcctgctgcacggcgacaaggtcgacgccttttcggcgatcacgcacaaggacgcggcgtacgcgtacggtgtgcggctggtcgccaagctgcgcgagctcatcccgcggcaggccttcgaggtgcccatccaggcggccatcggctcccgggtcatcgcccgcgagaccatccgcgccatccgcaaggacgtcctcgccaagtgctacggcggtgacatctcccgtaagcggaagctgctggagaagcagaaggagggcaagaagcggatgaagatggtgggctctgtggaggttccgcaagaggccttcatcgccgttctgtccagcgacgacagcggcggctcggccaagggcaagaag

SEQ ID NO: 5544 - DNA, 1908 bp, Streptomyces avermitilis
  CDS (1)..(1908)
gtgagcgacacacagaccctgatcgagaaccgtccgccgtccgtggcggccctcttcctggagcgcgtggcggccacgccggacgccgaggcctaccgctacccggtaccgtcccccaagctctcggcttcgcccgagcagggaggcgcccccgcgggccagggcccggacgactggaagtcgctgagctgggcgcaggccgccgaacgggtcttcgcggtggcggccggcctcatcgagctgggtgtgcagccggagcagcgagtggccctcgcctcctcgacgcgggtcgagtggatcctggccgacctgggcatcatgtgcgccggcgcggccacgaccacgatctacccgcagaccaacgccgacgagtccgcgttcatcctcgccgactccgagagcaaggtgctgatcgcggaggacgcggcgcagctcgcgaaggcggtggagaagcgcgccgagcttcccgcgctgacccatgtcgtggtgatcgaccccacgggcgtggagagcagtgactgggttctcacccttgccgagctggaggcccgcggcgccgcccacctggagaagaaccccgacctgatcaaggagaaggtcggcgcgatcacctccgaccagctcgccaccctcatctacacctccggcaccacgggccgccccaagggtgtccggctcccgcacgacaactggtcgtacatggcgaaggccaccgccgggaccggtctgatcagcgcggacgacgtgcagtacctgtggctgccgctcgcgcacgtcttcggcaaggtgctcacgtccgggcagatcgaggtcgggcatgtcaccgccgtcgacggccgcgtcgacaagatcatcgagaatctgccggtggtgcagccgacgtacatggctgccgtaccgcgcatcttcgagaaggtctacaacggggtcgctgccaaggcgcgggcgggtggcggcgccaagtacaagatcttccagtgggcggccgaggtcgcccgcgagtacgccaaggtcagccaggacaacttccgccgtaccggcgcggcctccgtgccgttcgggctcggcgccaagtacaaggtcgcggacgcgctcgtcttcgccaagatccgcgaggccttcggcggcaacctgcgcgcgtgcgtctcgggcagtgccgcgctcgcgcccgagatcggctacttcttcgccggcgccggcatccacatcctggaggggtacggcctcacggagtcctccgcggcctccttcgtgaaccccggcgaggcgtaccgcaccggcacggtcggcaagccgctgcccggcaccgaggtgcggatcgcggacgacggcgagatcctgctgcgcggccccggcatcatggaggggtaccacgggctgccggagaagaccgccgaggtgctggagccggacggctggttccacaccggcgacatcggcgagctgtcccccgacggctatctgcgcatcacggaccgcaagaaggacctcatcaagacctcgggcggcaagtacatcgcgcccgccgaggtcgagggccagttcaagggtgtgtgcccgtacgtctccaacatcctggtgcacggcgccgaccggaacttctgcacggccctcatcgccctcgacgagccgtccatcctggagtgggccaaggagaacggcctggccggcaagtcgtacgccgacgtggtcgccgcgcccgcgacggtcgccctggtcgagggctacgtcacggaactgaacggtggcctccagcgctggcagaccatcaagaagttccgcctcctgccgcgcgacctcgacatcgaacacggcgagatcaccccgagcctcaagctgaagcgcccggtcgtcgaacgcgagtacaagcatctgatcgacgagatgtacgcggggtcgcgggaggct

SEQ ID NO: 5545 - DNA, 582 bp, Streptomyces avermitilis
  CDS (1)..(582)
atgagcgctgaggaaacgaccgacgagcgcgccagcatcctcctggtcgacgacatggaggacaacctgatggcgctggaggccgtcctggggtccctcaacgagccgctgatacgcgcacggtcgggcgaggaggcgatgaaggcgctgctgcggcggcggttcgccgtcgtcctgctcgacatccgcatgcccggtatggatggcttcgagaccgccgcgaacatcaaacggctcgaccagaccaaggacgtccccatcatcttcctgacgggtacggacgccgacgcgggctacgcgttccgcggatacgcgaccggcgcggccgactatctgacgaagcccttcgatccctgggtgctgcgcgccaaggtgagcgtcttcctcgacctgcaccgcaagaaccgccaactggaacggatgctcgcccgcgaacaggaacggttcgacgagctggcggcccgcctgagagagatagggacacgggtggcgtcgagcgaccaccaggaggtcctggagctacgccaccacgtgcaacagatggaggagctgttacgggggatgcgccaggggcggggcgtc

SEQ ID NO: 5546 - DNA, 4149 bp, Streptomyces avermitilis
  CDS (1)..(4149)
atgagtgagaacagtgctacgcgagtgctcgaagacggacagattcgagcatcggatctgcgtccgctgctcgccgccatgaccgccgcccgggacggaatcttcacccgggtgccggagacggggcacggcctggtggccgagctgagcacggccttcaaccagatcatggaccggaacgcccacttcaactcggaagtgcagcgcgtacggcgggagctggtgcggcacggccggctcgacgagcggctgtcggcgagcccggggcagggctactgggcggcccgggtcagcgatgtgaaccagctgctcgacgcgctggtggctccggcggcgaacgcgacgcgggttctggacgcggtggcgggcggcgatctgacccagcgggtcgatctgcacgacggcaaccggcagttgcgcggagatctgcgccgcctgggccgggcggtcaacaagatggtcgaccagctgtcgctgttcaccggcgaggtgacccgggtggcccgcgaggtcggcaccgaggggcggctcggcgggcgcgccaaggtgcagggcctgtcggggagctggcgggatgtgaccgaggcggtcaacacgatggcgtcccggctgaccgcgcaggtccgcgacatcgccctggtgaccacggcggtggcccgcggcgacctgacccgaacggtgaccgtcgaggcgacgggtgagctgctggaactgaagctcaccgtgaacacgatggtcgaccagctctccgcgttcgccgacgaggtcacccgggtggcccgcgaggtcggcacggagggccagttgggcggccgtgcgcaggtgcgcggggtgtcgggggtctggaaggacctcaccgacaacgtcaacttcatggcgtcgaacctgacgtcgcaggtccgcaacatcgcccaggtcaccacggccgtggccaacggcgacctcagccagaagatcacggtcgacgcacagggcgagatcctcgaactcaagtcgacgatcaacacgatggtcgaccagctctccgccttcgccgacgaggtcacccgggtggcccgcgaggtcggcaccgaaggcaacctgggcggccgtgcccaggtcagaggcgtgtcgggggtatggaaggacctcaccgacaacgtcaacttcatggcggacaacctgacctcgcaggtccgcaacatcgcgctggtgtcgaccgccgtggcccagggcgacctcggcaagaagatcacggtggaggcgaagggcgagatcctggagctgaagtcgacgatcaacacgatggtcgaccagctctccgccttcgccgacgaggtcacccgggtggcccgcgaggtcggcacggagggcaacctgggcggtcaggcgcaggtccggggcgtgtccggcgtctggaaggacctcaccgacaacgtcaacttcatggccctgaacctgacttcgcaggtccgcaacatcgcgcaggtgacgacggccgtcgcgaacggcgacctgtcgaagaagatcaccgtcgacgcccgcggcgagatcctcgaactgaaggacaccgtcaacacgatggtggagcagctgcgcgccttcgccgacgaggtgacgcgcgtggcccgtgaggtcggcaccgacgggcggctcggcgggcgcgcgcaggtgctgggcgtctccggcgtctggcgcgatctgaccgacaacgtgaactacatggccgacaacctgacctcgcaggtgcggaacatcgcgcaggtcgcgacggccgtggcccagggcgacctgtccaagaagatcgacgtggacgcgcgcggcgagatcctggagctgaagaccaccatcaacacgatggtcgacacgctgtcctccttctcctcggaggtcacacgggtggcccgcgaggtgggcagcgagggccagctcggcggccaggcacgggtcgagggcgtgtacggcacctggaagcgcctgacgacgaacgtgaacgagctcgcgctcaacctcaccacccaggtccgcgcgatcgccgaggtggcgtccgcggtggcgcagggcgacatgtcgcggtccatctccgtggaaacgcgtggcgaggtcgccgagctgaaggacaacatcaacctgatggtggccaacctccgcgagaccacccgcgcgaaggactggctggagtcgaacctggcgcgtctcgccgcgctcatgcagggtcaccgggacctgatggaggtcgcggacctgatcctgcgcgagctgacgccgctggtgaacgcccagtacggcgcgttcttcctggccgatcccgacgaggacggcgcctctctgcgcacgaccgtccccgcgaaggggctcgcgttcatcgccggatacggctcggcgcactcggtgaccgtcgacacgggcggcatgccggtccacggcctcgtccgccaggccgcgcgggagaagaagcggatcctggtggaggaggccccacccgactacatcaagatcaacagcggtctgggggaggcggcccccgcgagcgtcgtcatcatcccgatcctcttcgaggacaagctcctcggcgtgatcgaactcgcctccttctcccgcttctccgatgtccacctggcgttcttcgaccagttcgtgaacaccatcggcgtcgcgatcaacaccatcatcgccaactcccgcacggagtccctgctcggcgagtcccagcgcctcgccatccagctccaggaccgctcggacgaactccagtcccagcaggcggagttgcagcgctccaacgcagaactggaggagaaggcggccctgctggcgacatcgtcccagtacaagtcggagttcctggcgaacatgtcgcacgagctgcgtacgccgctgaactcgctgctgatcctggcccgcctgctctccgacaacccggacggccatctctccgaccaggaagtgcagttcgcgacgacgatccaccgctcgggctccgacctgctccagctgatcaacgacatcctcgacctgtcgaagatcgaggccggccggatggacgtacgcccgaagaagctcccgctgatcaagctgctcgactacgtccacgccacgttccgcccgctcacgatcgaccgggggctcgccttcgacgtcgcggtcggcgaggacgtaccgcgcgagatgtactcggacgagcagcgcctccagcagatcctgcgcaatctgctgtccaacgcgatcaagttcaccgcgagcggccgggtcgagctgcgcgtgggccgggtcaaggaccccgagcaccgctacacccgcgaggacagcgaggaagtgatcgccttcgcggtctccgacaccggcatcggcatcgcgccggagaaactcccggtgatcttcgaggcgttccagcaggccgacggcacgaccaaccgcaagtacggcggtacggggctcgggctgtccatcagccgggagatcgccggtctgctgggcggccggatcatcgccgagagcgtccccggcaaggggtccaccttcacgctgtacgtcccggtcgtcagcccgggccacgcggcgaccgggccggcgcccgaggaacgtccgctgccgacgcccgagcagctgtccaccgagtcgtacatcacccacgatccggaggactcctggcctgcgcccaccaagctggaggagtggcaggtggggcgcgcggggcaggtgctgcccggccggcgggtgctgatcgtggacgacgacatccgcaacgtcttcgcgctcacccatgtgctgggccgcgtcggcatgcccgtcctgtacgcggagaacggccgcgaaggcatcgagacgctggagcgcaatccggacgtcgaactcgtcctgatggacatcatgatgccggagatggacggctacgagaccatctccgtcatccgccgcaccccgcgctgggcgggcctgcccatcgtcgcgctgaccgcgaaggcgatgccgggagaccgcgagaagtccatcgcgcgcggcgccaacgactacgtaccgaagccggtggacgtcgatcagttgctgaccgtcgtctgcgcgctcctggaccccgagggcgcggacgccgaggagcgggacgacttcgccgaacccaccgatccggggccggtcacatccggggagcccgcggtcccgccgctgacggag

SEQ ID NO: 5547 - DNA, 2217 bp, Streptomyces avermitilis
  CDS (1)..(2217)
atgggggcctttcccacgcaacgggagacgcagcgggacgcggtatcccgcgcccccggcgcgcccgcgcaccagggggcgggacggcgcacgactgtgcgtacgacgctgcccggcggttctctcgcgcccggcgccgcccgccgcttcgtccgcgaggcgctggccgactgggccgaactcggcctgtccggcgccgcgtcactgcccggccggctctccgacgacgccgtggtggtggtcagcgaactcgtcaccaacgccgtcgtgcacgccggtacggacgtcgacctggtgtgccgcatcgacgagtccgaggaggagccggccgggctggtcgtcgaggtctccgaccgccacccttcgcgtgcggtacgggacgaagccgcgggccacccctacggcaccgcggccgccgaacgcccttacggcacgcccgagtacgggcgcggcctgcggctcgtctccgcgctctccgaggcctggggcatcacgtaccgcaccggcgccaagaccgtctgggcccggctgcccgtcgacggggcgctgcctgtcgacggggcgccggccggcgacggcgtgctgcccgtcgaggggacaccggtcgtcgaggacgggatcggggcgtacgccggggagcgctccctcggacgcgggctgcgggcggacgagatattcgggccggagcaccccgggtatcccggccatttcgggcacgtcgggggctccgagcacttcgagcccttcgagggccccgagcaccccgaccgctccgggctcgattccgggctcgattccgggctcggtatcgggctcggtatcgggttcgccgagaattccggccaccccgaggcctccggtccacgcggcacgcaggaccacgactggctcaaccggggcgcgctctccttcctcgccgaggcctccgacctgctggccggacagctcgacgaggacctggtcgccgcgctcgccggccagctcctcgtaccgcggctcgccgactggtgcgcggtgtggctggaggacgaggcgacgggctggcgcggccccgagacgggcatggctccggggccgcggctcgcccgcgtctggcacggcagcgagaaccgcatcgaggacctgcgccgggcgctggagaggcacccgccccggctgcccgagtcggtgcgcacccggcccgtgcccgcgccctggcccgccgaggcactgggcccgcacggcgcgagcggctcggcgctcgcgtaccggctgatcgccggcggccgtccgctcggcacgttggtcatcgggcgggccgggctgctgcgctaccccgacgagatcaccggcctcgtggaggacctgagccgccgggtggccctcgccatcggggcggcccgccagtacgcgcgccaggccaccatcagccgggtcctccagcgcggactgctgcccggcgcggtcgccgagatccccggggttcgcagcgccctcgtgtacgagccgctcgacaagggcggacccagcggtgacttctacgacctgttcccggccggggacgggcgctggtgcttcgccgtcggcgatgtgcagggcaaggggcccgaggccgccgtggtgatcgggctcgcccggccctggctgcggctcctggcgcgcgagggctaccaggtcgcggacgtcctggaccgcctcaaccagctcctcctcgacgacgcgaccgaggcggcggacgcggcggccagggcgctggtggcggcgggcggacccggtctcggcgccgacgagggcccgcagaaccgcttcctgtccctcctctacggcgagctggtccccttcgagggcggggtgcggtgcacgctcgcctccgccgggcatccgctgccgctgctgctgaccccggacggcgacgtacggcccgtggctcagccgcagacgctcctcggggtcgtcgaggacgcgacgtacacctgcgagaccttcgagctgcaccccgccgacacgctgctgtgcgtcacggacggggtgaccgagcggcgcagcggctcgcaccagttcgacgacggcgacggtctcgcggcggcgctggcggggtgcgcggggctgagcgccgagctgatcgcggaacgcatcagacggctggtgcacgagttcggggcgcgcccgccggaggacgatctggcgctgctggtgttacaggcggagcgcggagcaccgagccggggagaaggaacg

SEQ ID NO: 5548 - DNA, 1230 bp, Streptomyces avermitilis
  CDS (1)..(1230)
atgccttccgcacttcccgacggcgaacccgtccccgacgacggttcgctgcccgcgcacgccctggccggggctgccgagcgtcccctcgggttctacctccatgtgccgtactgcgcgacccgctgcggctactgcgacttcaacacctacacggcgaccgagctgcgcggcacgggaggcgttctggcctcccgcgacaactacgccgagacgctgatcgacgaggtacgcctggcccgcaaggtgctcggtgacgacccccgcccggtgcgcacggtgttcgtcggcggcggtacgccgacgctgctggccgccgacgacctcgtacggatgctgggggcggtccgcgacgagttcggcctcgccgacgacgcggaggtcacgacggaggcgaacccggagtcggtggacccggcgtacctcgcgaccctgcgggccggcggcttcaaccgtgtctccttcggcatgcagagcgcccggcagcacgtactgaaggtgctcgaccgcacgcacacgcccggccgtcccgagcggtgcgtcgcggaggcgcgggcggcgggcttcgaccacgtcaacctggacctgatctacggcacaccgggggagacggacgacgactggcgggcctcgctggacgcggcgctcggcgcgggcccggaccacatctccgcgtacgccctgatcgtcgaggagggcacacagctcgcccgccgcatccgccgcggcgaggtcccgatgacggacgacgacgtccacgccgaccggtacctgatcgccgacgagatcctgtcgtcggcgggcttcgactggtacgaggtgtcgaactgggccacctccgaggcgggccgctgcctgcacaacgagctgtactggcggggcgccgactggtggggcgcgggacccggcgcgcacagccacgtgggcggggtgcgctggtggaacgtgaagcacccgggggcctacgcgggcgccctggcggcggggaagtccccgggcgccggacgcgaactcctctccgaggaggaccgccgcgtcgaacgcgttcttctcgaactgcggctgcgtgagggctgcccgctgtcgctgctccgccccgacggcctggccgcctcccgccgggcactgtcggacggcctcctggagcccggcccgtacgacgccggccacgccgttctcacgctgcgggggcggctgctcgcggacgcggtggtcagggacctggtggac

SEQ ID NO: 5549 - DNA, 810 bp, Streptomyces avermitilis
  CDS (1)..(810)
atgcgccagtactcgccggatctgaccccgccgtggaagaagcccaagcccgtgcccgaggtcccggcggacccgggtctggtggtggaggagcccggcaccggcttctgcggggcggtgatccgctgcgaggcgggcacggtgacgctggaggaccgcttcggcaagcaccgggtgttcccgctggagccgcggggctttctgctggagggccgcgtggtgaccctcgtccgcccgtccggcaacgctcccgtacgccccacccgtaccgcctccggttcggtggccgtccccggcgcccgcgcccgggtggcccgcgccggccgcatctacgtcgagggccgccacgacgcggagctggtcgagaaggtgtggggcgacgatctgcgcgtcgagggggtggtggtggagtacctggagggcgtcgacgacctgccacggatcgtcacggacttcgccccgggcccggacgcgcgcctcggcatcctggtcgaccacctggtccccggcaccaaggagtcccgcatcgcggagtcggtgacgagcgagtacgccttggtggtgggccacccctacatcgacgtgtgggaggcggtgaagccggcgtcggtcggcatccagtcctggccccgtgtcccccacggccaggactggaagaagggcgtgtgccgcgcgctcggctggccggagaacacgggcgcggcctggcagcacatcctgtcccgcgtgcgctcctacaaggatctggagccggagctcctgggccgggtggaggagctgatcgacttcgtcacggccggaggtccggcc

SEQ ID NO: 5550 - DNA, 726 bp, Streptomyces avermitilis
  CDS (1)..(726)
atgcgggtgacttgggaagaggcgggatgggagagcgtggcgccgttcgtcgggcggcgccggcttccggggtgggactgcacggtcgggctggtgatcggcgacagcgcggccctcatgatcgacgcggggtcgagtctgcgggagggcgcgctgctgcgggcggaggcgcagcggctgctgggacccggccgccgtgtgacgcatctcgcgctcacacacccccatttcgatcatgtcttcggcgcggcggcgttctccggggtggaggtcttcggcgcggtcggcctggacacggccctcgcgcacggccgcgaggagctgcgcgcggacgccgtgcgcaacggcctggacccgcgcgcggcggagggggccgcggacctgctcgtacgcccccgccaccatgtcttcggcgagtggaccctggacctgggcggcgaggtgcaggtgctgctggcgaacgtgggtcccggtcacacggcgtacgacctggccgtcctggtgtcctcctcgccggaggtcgtcttctgcggcgacctggtggaggagtcgggcgagccccaggcagggccggacgcgatcccgtcacactggccggcggccctggaccggctgctggacctgggcggacaggacgctgtgtacgtccccggccacggagccacggtggacgcggcattcgtccggacccagcgggacgaactggcggcccgcttcggcatcgcg

SEQ ID NO: 5551 - DNA, 1014 bp, Streptomyces avermitilis
  CDS (1)..(1014)
atgctcagtgaacgcaggctcgaggtgctgcgcgccatcgtccaggactacgtcggcaccgaggagccggtgggttccaaggcgctcaccgagcggcacaacctcggagtctccccggcgaccgtgcgcaacgacatggcggcgctggaggacgagggctacatcgcgcagccgcacaccagtgcgggccgcatccccacggacaggggctaccgcctcttcgtcgacaagctcgcgggcgtcaagccgatgaccgggcccgagcggcgcgcgattcagaacttcctcgacggcgccgtcgatctcgacgatgtcgtcggccggaccgtgcggctgctggcgcagctcacccggcaggtcgccgtcgtgcagtacccgtcgctgacgcggtccaccgtgcggcacgtggagctgctgtcgctcgcccccgcgcgcgtgatgctggtactgatcacggacacgggccgggtcgagcagcggatgatcgactgcccggcgccgttcggggagacgtccctcgcggatctgcgcgcgcggctcaacagccgggtcgccggccgtcgcttcgcggacgtgccgcagctcgtgcaggacctgtccgaggcgttcgatcccgaggaccggggtacggtcacgaccgtgctctccactcttctggagacgctcgtcgaggagaccgaggagcggctgatgatcggcggcaccgccaatctcacccgcttcggacatgacttccctctcacgatccggccggtcctcgaggcgctggaggagcaggtcgtgctcctcaagttgcttggttcggccggggattcgggcatgaccgtacggatcggtcacgagaacgcgtatgagggactcaactccacgtccgtggtctccgtcggctacggttcgggcgacgaggcagtagccaaactcggcgtggtcggaccgacccgcatggattacccgggaacgatgggagcggtacgcgcagtggcacggtacgtcggacagatcctggcggagtcg

SEQ ID NO: 5552 - DNA, 1134 bp, Streptomyces avermitilis
  CDS (1)..(1134)
gtggccacggactactacgccgtactcggcgtgcgccgcgacgcgtctcaggacgagatcaagaaggcattccggcggctcgctcgcgagctgcacccggatgtcaatcccgatccgaagacgcaggagcgcttcaaggagatcaacgccgcctacgaggtgttgtcggacccgcagaagaagcaggtctacgacctcggcggtgacccgctctcgcagagcggcggcggaggcgcgggcggcttcggcgccggtggcttcggcaacttctccgacatcatggacgcgttcttcggcacggcgtcgcagcgcggaccgcgctcgcgcacccgccggggccaggacgccatgatccgggtggagatcgagctcgacgaggcggccttcggcacgacgaaggacatccaggtcgagacggccgtcgtctgtacgacgtgcagcggcgagggtgccgccccggggacgagcgcgcagacctgtgacatgtgccgcggccgcggtgaggtctcgcaggtgacgcggtccttcctgggccaggtcatgacgtcccgcccctgcccccagtgccagggcttcggcacggtcgttccgacgccgtgcccggagtgcgcgggcgacggccgggtgcgttcccgccggaccctgaccgtgaagatcccggccggtgtcgacaacggcacacggatccagctcgcgggcgagggcgaggtcggccccggcggcggtccggccggtgatctgtacgtcgagatccacgagctgccgcaccagaccttccagcggcgcggcgacgacctgcactgcacggtcacgatcccgatgacggcggcggccctcggcacgaaggtcccgctggagacgctggacggcatggaggaggtcgacatccgcccgggcacgcagtccggtcagtcgatcccgctgcacggccggggcatcacgcatctgcggggcggcggccggggcgatctgatcgtccacgtcgaggtcaccacgccgacgaagatggaccccgagcaggagcgcctgctgcgtgaactggccaagctgcgtggcgaggagcggcccacggggcagttccagccggggcagcagggactgttctcgcggctgaaggacgcgttcaacggccgc

SEQ ID NO: 5553 - DNA, 1071 bp, Streptomyces avermitilis
  CDS (1)..(1071)
atgtcctccgcgctgaccgatctcttcccacatccgatcgtgcaggcccccatggcgggcggcgtctccgtgccgcagctcgccgccgccgtgtccgaggccggcgggctcgggttcctcgccgccgggtacaagaccgccgacggcatgtaccaggagatcaagcagctacgcgggctgaccggccgccccttcggcgtgaacctcttcatgccgcagcccgagcaggcggaccccgccgccgtcgaggtctacgccaaccagctcgccggcgaggcgtcctggtacgagaccgagctcggcgatcccgacagcggccgcgacgacggctacgacgccaagctcgccgtcctcctcgacaacccggtgccggtcgcctccttccacttcggctgccccgcccgcgacgtcctggaggccctcgcccgcgcgggaaccttcaccctggtcaccgcgaccaccgtcgacgaggccctcgccgtgcagcgcgcgggcgccggcgcggtgatcgtccagggcgtggaggccggcggccaccagggcacccaccgcgacaacccggaggcggacggggcggggatcggcctcctctcgctcctcgcgcaggtccgcgaggccgtgacgctcccgatcgtcgccgccggcggcatcatgcggggcagccagatcgccgccgtcctcgcggccggcgcgagcgccgcccagctcggcacggcgttcgtcgccacgcccgagtccggcgccaacgccctgcacaagcaggcgctgaccaacccgctcttcgtccgcacggagctgacccgcgcgttctccgggcgtccggcgcgcggcctggtcaaccgcttcatgcgcgagcacgggccgtacgcgcccgccgcctaccccgaggtccaccacctcacctcgccgctgcgcaaggcggcggccaaggcgggcgacgcgcagggcatggcgctgtgggccggccagggccaccgcatggcccgcgaactgcccgccggacagctggtgcggaccctggccgacgaggtcgaggccgcgaagacagcgttgtcgggcggtggcgcgcga

SEQ ID NO: 5554 - DNA, 747 bp, Streptomyces avermitilis
  CDS (1)..(747)
atgaccgcaccggtgttcgtggtcgagcatttcaacgcgggcggtggcggacactacgtgctcgacggcgccgaaggacggcacgccgtctccgtgaagcggctgcggcccggtgaggacgtcgtcctcacggacggggccggacggtgggcggactgcgtggtgctcggcaccgagggcaaggaccggctgatcgtccagatggactcggtgaccgaggagccgccggaggagccgcgcatcaccgtcgtccaggccctgcccaagggcgaccggggcgaactggccgtcgagaccatgaccgagaccggcgtcgacgcgatcgtcccgtgggcggccgcccgctgcatcacgcagtggaagggcgaccggggccagaaggcgctcgccaaatggcggtcgacggcgcgcgaggccggcaagcagtcccgccgggtccgcttccccgaggtcgcgggcgcgatgacgagcaagcaggtcgccgcacttctcgccacggcggatctggcggcggtgctgcacgaggacacggagcacggcaccgagccgttcgcgacggcccaactgcccacgtccgggtcgatcgtgctggtggtcggccccgagggcgggatctctcccgaggagatcgaactcttcaccggggtgggcgcgaagacgttccacctggggcgcaccgtgctgcgcacatcgaccgccgggaccgtggcgacggcgctgctgctcgcccgtacgggccgctggtcc

SEQ ID NO: 5555 - DNA, 630 bp, Streptomyces avermitilis
  CDS (1)..(630)
atgggggcattgaggctgatttggcggcgtccactcaggcagcgtccgctcacgcagcgtccaggcgggcggcgatcgcgcgggcagcgcccgcccgggcgccggctggccgcggcggccggactcgcggtggtcgccatgggcggtgccgtcgcgtgccagcccggcgatctgagcacggccgcggtggcgtacacgaccgaccggaccgcgacgacggaactcgaacggcagcatgtgaacgtccgctggctcagctgcacggccacgtacgggaacggcaacaaggcctacacgcccggcaagtcgtcctcgccgaccgcgagcacgaacaccgtcgccaccgtcgactgccgggggcagacctcggacggcaagaagatcaccgtcaaggggaaggtcacccgcgcggtcgacggcaagtgcgtccgcggaaacctcaccgccacggtcggcggcaaggagtggttccacgtgaacggcctcggcaactgcgacgccgccagtacgcccacgtacaccccgcccgtcacctaccggccgagccccggacagccgggccccaccgtcaccgtgacgaggaccatctggtgccagggcgaccccacctgctggccggtccaggggaag

SEQ ID NO: 5556 - DNA, 3219 bp, Streptomyces avermitilis
  CDS (1)..(3219)
gtgacacagcccgcatcgcccgcgtatctccggttcccgcacctccatggcgagttggtcgccttcaccgccgaggacgacgtgtgggtcgcccccctcgacggcggcagagcctggcgggtgagcgccgacaacgttccggtgacccacccccgtatctcccccgacggcacgaccgtcgcctggacctccacccgcgacggcgcccccgaggtgcacatcgccccggtcgacggcggccccgcccgacgcctcacccactggggcagttcgaggacccaggtgcgcggctggaccccagcgggacaggtgctcgccatcagcacggtcgggcaggcctcactgcgccgcagctgggcccgcgccgtcccgctcgacggcggccccgcgaccaccctgccgtacgggcccgtcggcgacgtctcgtacggcggccccggcgtcctcctgctgtccgctcccatggggcgcgaggcggcctggtggaagcgctaccgcggcggtacggcgggcaagctgtggatcgaccgggacgccgagggggaagaggccggcgagttcgtacgcctccacgcggacctggacgggaacatcgagtacccgtcctgggtgggagagcgcgtcgcgttcctctccgaccacgaaggcgtcggggcgctgtactcctccctcgcggacggctcggacctgcgccggcacaccccgatcgacggcttctacgcccggcacgcggccaccgacggcacccgcgtcgtctactcctcggccggtgagctgtggctcctcgacgacctcgacggggccgagccgcgacgcctcgacatccggctcggcggacagcgcgccgacctccagccgcaccccgtgagcgcggcccgctggttcggggccgccgcgcccgaccacaccggacgcggcagcgcgatctccgtccgcggcgccgtccactgggtcacccaccgctccgggcccgcccgcgccctcgccgccgaacacggcgtacgcgcccggctgccgcgcaccttccgcgtggacggcgaggagcacgtggtgtgggtgacggacgccgagggcgaggacgccctggagttcgccccggcgaccggtgccgcgcccggcgccatcccgcgccggctcgccgccgggcagctcggccgtgtcgtcgggctcgcgatggcccccgacggcagccgggccgccgtcgcctcgcacgacgggcgggtgctgctcgtcgaacaggagaccggagaggtgcgggaggtcgaccgcagcgaggacggggacgtcaccggcctcgtcttctcacccgactcggcgtggctggcctggtcgcaccccggtccgcgaccgctgcgccagctcaagctcgccaacaccgccgacctgtcggtgaccgaggcgacgccgctgcggttccgggactacgcgcccgcgttcacgctcgacggcaagcacctcgccttcctgtcggcacgctccttcgacccggtctacgacgagcacgtcttcgacctcgccttcgtcggcggctcgcgcccgcatctgatcaccctcgccgccaccaccccgtcccccttcgggccgcagcggcacggacgccccttcgacgcgcccgacaaggacgagacgcccgacagcgaaggcgccccgagcacccggatcgacctggacgggctcggcgaccgcatcgtgccgttccccgtcgaggccgcccgctactcgggcctgcgggccgccaaggacggcgtgctgtggctgcgccacccggtacgcggagtgctgggcgcctcccgcgccaccccggacgacccggacccgaagaccgaactcgaacgctacgacctcgcccagcagcgcatcgagcacctcgccgcggacgccgaccacctcgcggtcagcggcgacggcaaacgggtcctgctgtggaccgacggcaagctcaaggtcgtacccagcgaccgccgcgcctcgaacgacgacgagagcgacaccaacatcacggtggacctgtcccgggtacggcagaccgtcgacccggccgccgagtggcggcagatgtacgacgaggcgggccgcctcatgcgggacaacttctggcggcccgacctggccggggtcgactgggagggcgtactggcacgctaccggccggtcctcgaacgggtcgcgacacacgacgacctggtcgatctgctctgggaggtacagggcgagctcggcacctcgcacgcctatgtctcccccgcgggcggaggctgggccggcgaccggcagcaggggctgctcggggcggacatctcccggcacgaggacgggagctggcgcgtcgaccgggtgctgccctcggagacctccgaccccgacgcccgcgccccgctggccgcgccgggcgtcgcggtgcgggccggggacgcggtcatcgccgtcggcgggcggccggtcgaccccgtgaccgggccggggccgctgctcgtcgggacggcgggcaagccggtcgagctgacgatctcgccgtccggcggcggggatccgcggcacgcggtcgtggtgcccatcgcggacgaggagccgctgcggtaccacgcgtgggtcgccgaccggcgggcgtacgtccacgagaagtccggcggacggctcgggtacctgcacgtgcccgacatggtcggctccggatgggcgcagctccaccgcgacctgcgcatcgaagtcgcccggcagggactggtcgtggacgtccgcgagaaccgcggcggccacacctcccagctggtcgtcgagaagctggcgcgccggatcgtggggtgggacctgccgcgcgggatgcggccgtacagctaccccgaggacgcgccgcgcggaccggtcgtcgccgtcgccaacgagttctccggatccgacggcgacatcgtcaacgcggcgatcaaggccctggggatcggacccgtggtcggcacgcggacgtggggcggcgtggtcgggatcgacagccggtaccggctggtcgacgggacgctggtcacccagcccaagtacgcgttctggctggagggttacggctggggcgtggagaaccacggcgtcgacccggacgtcgaggtcgtccagaccccgcaggaccacgcggccggccgggacgtccagctcgacgaggcgatccggatcgccctggccgccctcgaggagaacccggcgaagacggccccgtcgttgccggagtcg

SEQ ID NO: 5557 - DNA, 351 bp, Streptomyces avermitilis
  CDS (1)..(351)
atggcgggagagccgcaggacgactgcctgttctgcaagatcgtcgcggggcacattccggcgaccctcgtgagggagacggagaccaccgtcgccttccgcgacataaacccccaggcaccgacccacgtgctggtcatccccaaggtgcaccaccccgacgccgccgccctcgccgccgccgaaccggcgatcgccgccgatgtgctccgcgaggccggcgaggtcgcccgggacgagaagctcgagagctaccgggtcgtcttcaacaccggcagcggcgccggacagaccgtcttccacgcccacgcccacgtcatcggcgggcgcggcatgcagtggccgcccggg

SEQ ID NO: 5558 - DNA, 903 bp, Streptomyces avermitilis
  CDS (1)..(903)
atgtccgtacgtgagttggtggtcctcggcaccgcgagccaggttcccacccggcatcgcaaccacaacggctatctgctgcgctgggacggcgagggcatcctcttcgaccccggcgagggcacccagcggcagatgctgcgcgcgggggtcgccgcgcacgatctgcaccggatctgtgtcacgcacttccacggggaccattcgctggggctcgccggggtcatccagcggatcaacctcgaccgggtgccgcacgagatcaccgcgcactatccgggctccgggcagcggttcttcgaacggctgcggtacgccacggcgtaccgggagaccgtggcgctcaccgaggcgccggtcgccgccgacggcgtgatcgccgacacgcccgcgtacgtgctcgagacccgcaggctctcccaccccgtcgagtccttcgggtaccggctcgtcgagcccgacgggcggcggatgctgcccgagcggctcgccgcgcacgggatcaaggggcccgacgtcgggaggatccagcgggagggggccatcgggggcgtctcgctcgaggacgtgagcgaggtccggcacgggcagcggttcgcgttcgtcatggacacgcggctgtgtgagggcgtgcacgcgctcgccgaggggtgcgacatgctcgtcatcgagtcgacgttcctcgacggggatcaccaactcgccgaggaccacgggcacctgacggcaggccaggccgggcgggtggcgaaggacgcgggggtacgtcatctcgtactgacccacttcagccagcgctactccgaccccgacgcattcgagcgggaggcgcgggccggcgggttcgagggtgagctgaccgtggcgcacgatctgctgcgagtgccggttccgaaacgccac

SEQ ID NO: 5559 - DNA, 999 bp, Streptomyces avermitilis
  CDS (1)..(999)
atgcccctccccaaagctgaactgcacctccacatcgaaggcaccctggagcccgagctggccttcgcgctggccgcgcgcaacggtgtcccgctgccgtacgcgcacacggacgagctccgcaaggcgtatcagttcgacgaccttcagtcgttcctgaacctgtactacgagctcatggccgtgctgcggaccgagcaggacttcgaggacctcgcgaacgcgtatctcccgcgggccgccgcgcagggcgtgcggcacgcggagatcttcttcgacccgcaggcccacatcgcccggggggtggcgatggggaccgtcgtcgaggggctgtggcgcgccctcggcaggagtaccgagaaccacggggtctccacccagctgatcatgtgcttcctgcgggacgagtccgccgagtcggcgctcgagacgctggaggccgcgaagccctacctcgaccggatcatcggcatcggtctcgactccgccgaggtcgggcacccgccggccaagttccgcgaggtgtacgaggccgccgcggccctcggtctgcgccgcgtcgcgcacgccggggaggaggggccgcccgagtacatcaccgaggcgctggacgtgctgggtgtcgagcggatcgatcacggcctgcggtgcatggaggacgacgcgctcgtcgagcggctcgtccgggagcgggtgccgctgacgctgtgcccgctgtcgaacgtgcggctgcgcgccgtggacgtcctcgcggaacacccgctgcccgcgatgctggacgccgggctgctgtgcacggtcaactccgacgaccccgcgtacttcggcgggtacgtcgcggacaacttccacgctgtacgggacgcgctggggctggaccaggaacggatgcgggagttggcccgcaactcgttcgtcgcgtccttcctggagcacgacgaggagcggcgggcgcggtatctcgccgaggtcgaggcgtacgacttcccgggccggccg

SEQ ID NO: 5560 - DNA, 1287 bp, Streptomyces avermitilis
  CDS (1)..(1287)
gtgtccgcccgcaccaccacgccctggcccctcgtcgcccttttcacggccgggtacctcgccgcgtacctgctgccgaccaccgtcggcagactcgacgccggtctccccctctccgccacccaagccggttccatcggcagcgccctgctgctgagttcggccaccgccggcttcgtcctcgccgccaaggtggaccgcttccccggcggtccccggcgcctcgcccgcgccggcctccttctcgccgccgccggctacggcaccgccgccctcacccacaccgtccccgcggtcatcgcgggagcggtcctcggcgggctcggctccggcaccgccaccaccgtggcggccaccggaatcgccgcccggcacgacccccaccgcgcctccaccctcggcctcctgagcgtctccgccctggccggcgcgctttatctgacgatccctcacctcggcccgggccacggcctcccgctcgccgcgctcgccctcaccgcactgctcacctggcccgccacccaccgtctccccgccaccgcacccaccccgcacaccgcgccccgcgggacgggccgcctgccccacccccgttcgggcctgctgctcgccacgggcatcctgttctggtccctctcccagaactccctgtggggtgtcagcggccgcatcggcctcacccaggccggcctcaccgaggtcacggtcggcgcggtcttcgcggcagcgctcggcgcgggactcctcggcgtgtcggccgcgggcgcgctcggcccgcggctgggccgcgccctgcccatcggcgccggcaccgcgctcatcgcggtgtgcatcgccgtcagcgcctccgccaccgatctccgcaccttcgcgacgggcgagatcgcctggaacgcgctctacccggtcgtgctgtcgtacctgatcggcctggccgcctcgctcgacccgcgcggccgctgggcggtcctggtcggctccgcctcctcgctcggcacggcggcgggccccctcgccggcagcctgctctccgcgcgggcgggctaccccgccatgggcgcgatcctggccgtcggcctgctggtggtcgccctgccgctgaccgccgtggccctgcacaccggcggccgcccgctcctgcccagcacgatccgccgccgcggcggcgccccggcgcagccggcggtcctggagatccccctggacacaccggccgtgccgaaccggggcgcgtacgacacagcagggccccggcaggcagcagccgcaccggggcccggagcctcc

SEQ ID NO: 5561 - DNA, 789 bp, Streptomyces avermitilis
  CDS (1)..(789)
atgccggaacccacggacgagcgcggcgtgcgcgaggtcaagtcggccgcgcgcacggtcgacctgctggaactccttgccgcccgcggcgaccgccccgcgcgcctgacggaactcgcggacgaactcgacgtcccccgcagctcgatgtacgcactgctccagaccctcgtcacccggggctgggtccgcacggacgtcacgggttccctgtacggcatcggcatccacgccctgctgacgggcacgagctatctggactccgacccgcgcgtccgcgtcgtacgcccctacctcgacgaggcctcggaggcgctcggcgagacgatccacctgggacgcctcgacggcaccgacgtggcgtacctggccacgcgcgagtcgcacgagtacctgcgcacgatcagccgggtgggccgccgtctccccgcccacgtcggcgccctgggcaaggcgctcctggcggaacgccccgacgaggcactgcccgagggcccgtacgagcaggccacaccccacacgctcacgacccgcgaggccctcgccgccgacctggcccgcacccgggcccgcggctactccgtcgaccgcgaggagggcgtcctcggcatcgtcggcttcggcttcgccctgcgctacgacactcccgcccaggacgcgatcagctgctcggtgccggtggcccggctgaccccggcacacgaggagcagatcgtgacggtgatgcgcgacatccgggcgaaggcggaggcggcggccccgggcccggcaggggcaccacgctggcgg

SEQ ID NO: 5562 - DNA, 993 bp, Streptomyces avermitilis
  CDS (1)..(993)
gtgagcgcggacacggatacggacacggatacgggcacgggcaccggtcccgataccgataccggtacggcggccgtcgtcgagcggctgcgcggcgggatggcccgcggggtgctgtcgttcccgctgacgagcttccacgacgacggctccctcgacctcgacggcttccgcgcgcacctggagacgcagctcgccgctggacccggcgccgtcttccccgcctgcggcaccggcgagttcttctcgctggacgaggacgagtaccggcaggtagtgaccgcggcggtcgagctgaccgcggggcgggtcccggtcgtcgccggtacggggtacgggtgggcccaggccgcccggttcgcgcggatcgccgaggacgcgggggccgatgccctgctcgtgctgccccactacctcgtcgccgcgccgcaggacgggctcgtcgggcagctggagcggctggcggagcggacccggctgccgctcatcgcgtaccagcgtggtcaggtcacctacagcgtcgagtcgctgcggcgcatcgcccggattccgggggtcgtcgggctcaaggacgggcacagcgatctcgaccggttgcagcgcctcaccctggccgcgcccgaagggttcctgttcttcaacggggctgccaccgccgagatccaggcacgtgcctacgcggccgtcggcgtccccgcctactcgtccgccgtgcacgccttcgcccccgagatcgccggcgccttccacgcggccctgcgggacgggcacggcaaggcggtggagaagctgctgcgtgagttctacgttccgttcgtcgagctgcgcgaccgggtgcccggctacggcgtgtcgctggtgaaggcggccgcccggctgcgcggccggccggtggggcccgtacgcgcccccctcaccgacccctcggccgccgatctcgccgacctcacctccctcctgagcaccggactcgacctcgtaggagccgccctg

SEQ ID NO: 5563 - DNA, 1584 bp, Streptomyces avermitilis
  CDS (1)..(1584)
gtgacccgcgacctgaccatcaccgaagtccggctgaccccgatcctggtcgccgacccgcccctcctcaacacccagggcgtgcaccagccgtacaccccccggctgatcgtggaagtggtgaccgcggacgggctcaccggagtgggtgagacgtacggcgacggcaagtacctggagctggcccggccgttcgcggacaaggtgatcggccgtcaggtgtccgatctcaacgggctgttcaccgtcgccgacgaggtcgccgtcgatcaggcccgggtcgaccaccaggtcgacgtcggcgggctgcggggcgtgcagaccgccgacaagctgcggctgtccgtcgtctccgggttcgaggtcgcctgcctggacgccctgggcaagtccctcgggctgcccgtgcacgcgctgctcggcggccgggtgcgggacgccgtcgagtacagcgcgtacctgttctacaagtgggccggccatcccgagggggtcgcctgcgagaaggacgactggggggccgccgtcgatccggccggagtcgtcgagcaggcacggaagttcaccgagcggtacgggttcacgtccttcaagctcaagggcggtgtctttccgcccgaggaggagatcgccgccgtacgggcgctcgccgaggcctttcccgggcagccgctgcggctcgaccccaacggggcctggtccgtgcggacgtcgctgaaggtcgctgaggagctcggagacgtgctcgagtatctggaggacccggcgctcgggaccccggcgatggccgaggtggccgcgggtacgtccgtgccgctcgccaccaacatgtgcgtgacgaccttcgccgagatcaaggaggcgttcacgcgcgacgccgtccaggtggtgctctccgaccaccactactggggcgggctgcgcaacacgcgtgaactggccgccgtctgccggacgttcggcgtcggcgtctccatgcactccaacacccacctggggatctccctcgccgcgatgacccatgtcgcgtcgaccgtcccgaacctccaccacgcctgcgactcccactacccgtggcagtcggaggacgtgctcaccgagcggctgaccttcgagggcggcaagctcgccgtctccgacgcgcccggcctcggcgtcgaactcgaccgggaccggctggagttcctgcaccggcgctggctcgacgacgacggctccctgcgcgaccgcgacgacgcggcggcgatgcgcgtggccgatccggggtgggtcacgcctgcggtgccgcgctggtacggggctgcgggctgcgggctgcgggctgaggggctgccggtggcccgtggccggtggttcttgggggccgtggatccgggggccggtgggccggtgcccgggggccaacggaccccgtgcccgggggcccgagggccaacggaaccggccgcccggccccgtcccccgggaccggcgggggcctccgccccctccgccccgcgggacggtaccggcgtgaccggcgccgccccgcgaggcgtttggtgcacactggcctggatccgcaccaccccagggagcgcaccg

SEQ ID NO: 5564 - DNA, 1107 bp, Streptomyces avermitilis
  CDS (1)..(1107)
gtgatcgcgtccaacggagagggaccgcaccgccagacccacgtggacccgctggccgccgtgcgcgccccgggcgacccgccctgggacgtctacctcacgggcccggtcttcctcgacatcatcttcaccgggctggactccgcccccgtgcgcgggaccgagtcctgggcccgcgggatggggtcgagccccggcggcgtcgcgaacatggcgaccgcgctggcccgcctcggtctgaagacctccctcgcggccgccttcggcgacgaccactacggggagtactgctgggacgcgctcgcccagggcgagggcatcgacctctccccgtcgcgcacggtgcccggctggcactcgccggtgaccgtctcgatggcgtacgagggcgagcgcacgatggtctcccacggccacgagccgccccccgaggagaccgcaccggactgcccgcccagggcacgggccgcggtcgcctccctcgcgccgggcagccgggccccctggatcgcgcaggccgcgagcgagggcacccggatcttcgcggacgtcggctgggacgacaccggccgctgggacctggcggggctcgccgacctcggacactgcgaggcgttcctgcccaacgcggacgaggcgatgcgctacaccggcgccgactgcccgagggcggcggcgcacgcgctgaccgagcacgtaccgctggccgtcgtcaccctcggcgccgacggggcgtacgccgtggaccgccgtaccggcgaggccgcggaggttccggcgatcgccgtcgaggccatggaccccacgggcgccggcgacgtcttcgtggcgggcttcgtcaccggcacgctcgccggctggccgctggccgaccgcctggccttcgccggcctgatcgccgccctgtccgtacaggagttcggcggctccctgtcggcccccggctggtccgagatcgccgcgtggtggcgccgggtccagtcgtacgacgaccaggatccgacggcgctgcgccggtacgcgttcctggaggggctgatcccggaggtgacgcgcccgtggccgctgcggcgggcggtaccgacgatcgggttcggccgctcggcg

SEQ ID NO: 5565 - DNA, 1065 bp, Streptomyces avermitilis
  CDS (1)..(1065)
atgactcagacacccacagctcagacccccgcgcaggggcaggcacgagcgcacttcacggtccccgcgaagcaccccatggtcaccgtgctgggatccggcgacgccctcctgcgcgtgatcgagaaggccttcccggcggccgacatccacgtccggggcaatgagatcagtgcggtcggcgacgccggtgaagtcgccctcgtccagcgcctgttcgacgagatgatgctggtgctccgcacggggcagccgatgacggaggacgcagtggaacgctcgatcgccatgctcagggcgagcgagaacggggagggcgacggccaggagactccggccgaggtgctcacgcagaacatcctgtcctcgcgcggccgcaccattcgccccaagacgctcaaccagaagcggtacgtcgacgccatcgacaagcacacgatcgtcttcggcatcggccccgcgggcaccggcaagacctacctggccatggccaaggcggtccaggcccttcagtccaagcaggtcaaccgcatcatcctgacccgcccggcggtggaggcgggagagcggctcggcttcctgcccggcacgctctacgagaagatcgacccctacctccgcccgctgtacgacgcgctgcacgacatgctcgacccggactcgatcccccgcctgatggcggcggggacgatcgaggtggcgccgctcgcctacatgcgcggacgtactctcaatgacgccttcatcatcctggacgaggcgcagaacacgagcgccgagcagatgaagatgttcctcacccgtctcggcttcgactcgaagatcgtgatcacgggtgacgtgacgcaggtcgacctccccagcgggacgaagtcgggtctgcggcaggtccaggagatcctggagggcgtcgacgacgtgcacttctcgcgtctcacgtcgcacgatgtcgtccggcacaagctggtcggccgtatcgtcgacgcgtacgagaagtacgacagcgagaacggctccgagaacggctcccacaagccccgtggcaaagccggacacaaggggttg

SEQ ID NO: 5566 - DNA, 495 bp, Streptomyces avermitilis
  CDS (1)..(495)
atgtcgatcgacgtcaacaacgaatccggaaccgaggtcgacgagcaggcgatcctcgacatcgcccgctacgcgctcgcgcggatgcgcatccacccgctctccgagctctcggtgatcgtcgtggacgcggacgccatggagcagctgcacatccagtggatggacctgccgggcccgacggatgtcatgtccttcccgatggacgagctgcgcccgcccatgaaggacgacgacgagcccccgcagggcctgctcggcgacatcgtgctctgccccgaggtcgccgagcggcagggcaaggaagcacccacgcagcactccatggacgaggagctccagctcctggccgtccacggagtgctgcacctgctcggttacgaccacgaggagccggacgagaaggccgagatgttcggcctccaggccgccatcgtggacggctggcgcgcggagaagggcctgaccggcccgtccccggccccgaccgtgtca

SEQ ID NO: 5567 - DNA, 1305 bp, Streptomyces avermitilis
  CDS (1)..(1305)
atgagcccccagctcgtcatcggcgccatcgccctcgtggtcgtcgcctggctcgccgcctgcgcggaggcgggcctcgcgcgcgtctccagcttccgcgccgaggaggccgtacggtccgggcggcgcggcagcgcgaagctcgcgcagatcgccgccgaccccacccgctatctcaatgtcgccctgctggtgcgcgtggcgtgcgagatggcggccgccgcgctcgtcacctacgcctgcctgaaggagttcgaccggacctggcaggcgctggcggtcgccatcggcgtcatggtcctcgtgtcgtacgtggccgtcggcgtctccccgcgcaccatcggccgccagcacccgctgaacacggcgacggcagccgcgtacgtgctgctcccgctggcccggatcatgggcccgatcccgcccctgctcatcctcatcggcaacgcgctcacccccggcaagggcttccggcgcggccccttcgcctccgaggccgagctgcgtgcgatggtcgacctcgccgagaaggagtccctcatcgaggacgaggagcgccgcatggtgcactcggtcttcgagctgggcgacacgctcgtgcgcgaggtcatggtgccgaggacggacctggtggtcatcgagcgctacaagaccatccgccaggcgctgaccctggccctgcgctccgggttctcccgcatcccggtcacgggcgagagcgaggacgacatcgtcgggatggtgtacctgaaggacctggtccgcaagacgcacatcagccgggacgccgagtccgagctggtgtccaccgcgatgcgcccggccaccttcgtgcccgacaccaagaacgcgggcgatctgctgcgcgagatgcagcaggagcgcaaccacgtcgcggtcgtcatcgacgagtacggtggcacggccgggatcgtcaccatcgaggacatcctggaggagatcgtcggcgagatcaccgacgagtacgaccgggagctgccgcccgtcgaggacctgggcgacgaccgccaccgggtcaccgcccgcctcgacatcggcgacctcggcgagctgtacggcatcgaggcctacgacgacgaggacgtggagacggtcggtggactgctcgccaaggcgctcgggcgggtcccgatcgccggtgcctcctcggtcgtcgaactgcccgacggccgtgaactccgcctgaccgcggagacgtcggcgggccgccggaacaagatcgtgacggtcctcgtggagccgatcgacccggccggaccctcggcggagggggcgaaggaggaa

SEQ ID NO: 5568 - DNA, 357 bp, Streptomyces avermitilis
  CDS (1)..(357)
atgaccccgcaggaactgcgcgcgttctgcctgtccttcaacgcgaccgtcgaggacttccccttcaccccggagacctcggtcttcaaggtgcagggcaagctcttcgcgctgacccgcctggacgcgcggcccctgacggtcaatctgaagtgcgacccggatgacgcggtgcggctgcggagcgagtacgagggactgatcatccccggctaccacatgaacaagcggcactggaacaccgtcacggtggacggcgagctcccggaccgtctggtccgggagctcgtcgaggactcgtacgacctggtggtcgcgggcctaccgagagccgaccgcctccgcctcgaccgcccc

SEQ ID NO: 5569 - DNA, 1467 bp, Streptomyces avermitilis
  CDS (1)..(1467)
atggcgatcgacaccacctcatccgctcccgtccacgaaccgcaaccccctctcgacacccggctgtcgacccgcgacaagctcgtgctcttcgtcctgtgcgcggcgcagttcatggtcgcgctcgacttctccgtactcaacgtcgccctgcccgtcctcggcagggacctgggcatgagccagtccgcgctccagtgggcggtcaccgcgttcgcgctgccctccggcggcttcctgctcctcttcggccgcatcggcgacctctacggccgtcgcaggctgttcctgaccggcctggccctcttcggcacggcctcgctccttgcgaccttcgcctgggacccggcgtcgttcctggcgggccgcgccctccagggcctcggcgcggcggcgatcgtgccgaccggcatgtcgctgctgaccacgacgttcccggagggccccgcccgcgaccgcgccctcggcatctccggcacgctgctgtcgctcggcttcacggtcggcatggtcgcgggcggcgtactgacggacgcgttcggctggcgttccaccatggggctgctcaccctcttcgcgctgatcgtgctgccgctggcgcccgggctgctgcccgagtcccgcaccccggaccgcccgcggctggacatccccggcgcggtcaccgtcaccggcggactgctgtccctgatctacgccctgtcgacggccgccgaacgcggcttcggcggcaccgacgtcatcgcgacgctggtcgcgggcgtactcctgctggcggccttcgtgaccgtcgagtcccacgccgaggcacccctcgtctcgctgcccatgctgcgccgccgcacggtggcctggggcaacctgggcggtctgatcaccttctcgatgatgtcgacggtggtcttcgtcctgaccctgtacctccaggagaccctgggcctctcggccttcgagacgggcctggtcttcggggtccagggcgtgctgtcggcggtggcgggggcgaacgcctccaaggtcatcggccggctcggcgcccgccgtacgctggtggtctccctggccggacagggcgcgttcgtggccacgctggtggctctcggcgacggcggctggtccgtgtggctcgccaccgccgcggtgtccctggccagcatgtgccacctgggcgcgatcatctcgtacggcctgacggtcacctcgggcgtgcccgacgacgaacagggcctggccaccggcctggtgacgtcgacccagcaggtcggcatcaccatcggcatcccgctcctgggcgtcctggccaccacgtcctcggacctgctcgccggggtgcacacggtgctggccctggacgccgtgatcgtcctggcggcggcggtactgatcgcggtgggactgggccggcggcccgcgacggccccgggcgcggcctcaggggcggtcgaggcggaggcggtcggctctcgg

SEQ ID NO: 5570 - DNA, 867 bp, Streptomyces avermitilis
  CDS (1)..(867)
gtggccgaggacgcgctcaagacccatcggctgcgggaactgcgcgagttcctgatgagccgccgggcccgggtcacacccgtggaggccggtctgccggacggcggcgcgcggcgccgcacccccgggctgcgccgtgaggaggtcgccgtgctcgccggcgtgggtgcctcctggtaccagtggctggagcaggggcgggacatctccgtctccccgcaggtcctggacgccgtcgcccgcgtgctgcggctcagcaacgccgagcgacgccatctgtacgtcctcgccggcctgaacccgccggcgcccgagcccgcgagcagggacgactgcgaggggctgcggcggctgatcgacacgtggatgccgtatccggcgcacatcatggacatctactacaactgcgtgatgtacaacgacgcggccggtgtggtgctcggcatgcggcccgagaacacgcagaactgcctcatcgacttcttcaccgaccagctctaccgggggcgttcccacagctgggagcggaacgcgcgcacggtggtcgcccagttccgcgcgacgtgctccgcctgccccgacgacgaggggttccagcaggtgctggcgcaggcgaaggcggcgagtgaggagttcgccgcgctgtgggacgagcgggacatccaggacgccgggctgatccgcaaggagctggagcacccggtggtgggcctgctgtgcgtggagtcgacggcgatgaaggtgccggcgcggcccgatctgacggtagtgctgcacacaccgctgccggaggcgaacaccgcggcgaagctggagtggctggcgtcgccggaggggcggcgcgggacgatgtaccccgtcgccggg

SEQ ID NO: 5571 - DNA, 351 bp, Streptomyces avermitilis
  CDS (1)..(351)
atgaccgaaagcagcgcgcttgaccccgaggaccgcaagatcgtcaccctggcccgctcggcgcgggcccgcaacggtgtgcccgagggggcggccgtacgggacgagacgggccgtacgtatgtggccggaaccgtggccctcgactcgctgaagctgagcgcgctccagaccgctgtcgcgatggccgtggcgtccggggcgaagtccctggaggcggcggcggtggtgacggaatccgccgaggcgtccgcggaggaccgggcggcggtacgtgatctgggcggccccgggacgccggtgctggtggccggtccggacggggccgtgcgggtcacggtgacggcgggc

SEQ ID NO: 5572 - DNA, 477 bp, Streptomyces avermitilis
  CDS (1)..(477)
atgagaagcaagcgactcgggacaggcgtggcgctggccgcgggcaccttggcggtggccggcctcgccttcgcgcccaccgctcaggccgtcactccccagacggccacgatcgtcgcggactgcggcacctacggcggtggtgaggccaccctcacggccacccagagcggcaccgccgccaccatcaccctctcctcctccgagatcacctctccactggcgctctcccaggactcgatcacgtccacgctcaccctggtgaaggcgagcggcggcaccacggccttcaccggcaccaagaacccggccgtcgccgccggtgccggcgtcacggtcggcccgctcagcggcaccgtggccgccggcgacagccttcaggcgtacggcggctccctcaagatggtgatcttcgggttcgtcaccatcacgtgtacggcgcaggggctccagtcacccgggccgttcgtgtacgag

SEQ ID NO: 5573 - DNA, 1320 bp, Streptomyces avermitilis
  CDS (1)..(1320)
atggctgccagaacccgaagacaccgctgggcggcggtgctcggagcgaccgcgctcgcgctcgccgggggaggggcgctggcctgcccggccggtgccgtctcacagcaggtggacttcgccacgcactgcataccgcccgcgatcgcgggcatcccgccgatcgacggcacgaccgccgcgaagatcgacgtcgacaacaccgcgcccaaggtgggcgacacggtcaccgtgacctacacggtggtcacgcccgccgcgagcaaccccaccgacctggctctcccggccgacatcatgacgcccaccggcaaggtcaccctgggcggcgcgcagaccggcgccgtcacggtcacgggacccaagaagaacgatcccgtgccgggcaagggtgccttcccgtcgttcagcatgaccggcaccttcacggtcacctcacccggcgcgatcacgctcgcgcccggcgactacaacatccacaccagctacatcctggagctggacaccccctgcacggtcatcagcccgcccgcgcccgtctcccagacgatcaccgccgccgacaccacgccggtcaacaaccgtgccatcacgctcggttcggcctccgggaagccgggggacggcgtcaccgtcaccggcagcaacttcaccgcgggcgcgaccgtcaccctcgccgggcgggcggggacggcccagaccgcggacacggcgaccgtcaccgccaacgcgcagggcgccgtcagtggctcgctcgtcgtgaacgacaaggcgacgaccggtgtcgtggcgtacgagggcagtgcctggagcgacaccaagggcgcgggcccggccgcgtacgtcgtcatcgacgacacgccggtcccggccggcagccagaagatcaacaccaaggtcacggcgggcaccctgtccatgtcgcaggccggtgacaccgtcgacctcgcggcggtcgacttcggcaagggcggcttctcgcgcggctcgctgcagacggtgaccgtcaaggacttccgcggcggcgcggcgggctggtccctgaccggcaaggtcaccgacttcaccggacccggcggggcgaagatcgacgcggccaagctgggctggaccccggtgtgcctcaccaaggcgggcagcccgagcacctgcgcggccggttcgcccggttccgtgggcagcgccggagcgactctggcgtccgctcccaacggcacggtcaccggcggtgagttcaccgtcgacgcccggctctcgctgaacgtgccggcgttcaccccggccggttcgtactccggtgtgctgacactcacgctcacc

SEQ ID NO: 5574 - DNA, 1029 bp, Streptomyces avermitilis
  CDS (1)..(1029)
atgctgcgcaagccgtacgtcctcctcctgaccgccctgctcgccgccggcctcgccacgccctcgtacgccgccgacaacggcagctggtccgtcttccccgtcgcgacgcagctcgcctcgcgcccgtacttctacctctccgccgaccccggcaccaccatcaaggacaaggtcgaggtcgccaacaagaccgggaagccgctgaccttccggctgtacgcggccgacgcctacaacaccgcgcgtgacggcggcttcgcggtgcgcacgaggtcggagcggcagcggggggtgggggcctgggcgaagcccgcgcgctcccgggtgaccgtcccaccgcacgacacggtcaccgtgccgttcacactgcgcgtaccggagcgggccgaaccgggcgaccacccgggcgcgttggtcgccctggacgaacgcgtcgaccggggcgacggctcggtcgcggtcggggtgcggcgggcggtgggcgcacgcgtctatctgcgggtgaacggcccgaccgtccccgccgtcgccgtcgagaacgtccgcttcagccaccatcagccgctgatccccggcaccggagccggcacggcgacgatctcgtacaccctccgcaacaccggcaacgtcaccctcggccccaaggtgcggctgacggcgaagggcctgttcggccgtacgctcctgtcgcgcggcctgacgaggatccccgccgagctgctgccgggacagcgggtgcggctgaccgagccgtggcgcggatcccctcaactcgactggggcgacgtgaccttgacggccagcgccccgcacacgcgggagtcggcgagcgtctcgttcttcgcgctgccgtggccggcggcggtggtgctcctgctgacggcggccgtgggggcggcgctggtgatcagagcgcgtcggggccgcgctcgcccgtccggacccgtaccaccgtctccaccggaaccgaccacaccttcccgtccccgatcttccccgtctgcgcggccttcacgatcgcgtcga

SEQ ID NO: 5575 - DNA, 336 bp, Streptomyces avermitilis
  CDS (1)..(336)
atgaagctcatcaccgcgatcgtcaagccgtaccgcctcgacgaggtcaagacggccctccaggaactcggcgtgcacggcctgaccgtgaccgaggcgagcgggtacgggcgccagcgcggccacaccgaggtgtaccgcggcgccgagtaccgggtcgacctcgtccccaaggtccgtatcgaggtcgtcgtcgaggacgcggactcggacgcggtcatcgacgcgatcgtgaaggccgcgcagacggggaagatcggggacgggaaggtgtggtcggttccggtggagacggtggtacgggtccggacgggcgagcgcggccccgacgcgctc

SEQ ID NO: 5576 - DNA, 1308 bp, Streptomyces avermitilis
  CDS (1)..(1308)
gtgaccctggccgccgcccggatcgacaccggcgacaccgcatggctgctcgccgccaccgcgctcgttctcctgatgacccccggcctggccctgttctacggcggcatggtccgcacgaagagcgtcctcaacatgctgatgatgagcttcgtgtcgatcgccctggtcacggtcgtgtggctggccgccggctactcgctcgcgttcggcgacgacctcgcgggcggactcatcggcggcctggaccacgccggcctggcggacctcggtcccgccgacgtccacggcacggtccccaccctcctcttcgccaccttccagctcaccttcgcgatcatcaccgccgccctcatcagcggcgccatcgcggaccgggcgaaattcgcggcctggctggtcttcgtccccctctgggcgctgctcgtatacgttcccgtcgcccactgggtgtggggccccggcggctggatcctcgaccgcctcggcgccctcgatttcgcgggcggactccccgtcgagatcacgtcgggcgcctcgggcctggccctgtgcctggtcctcgggccgcgcctcggcttcaagaaggacgccatgcgcccgcacaacctgccgatggtgatgctgggcgccggtctgctgtggttcggctggttcggcttcaacgcgggttcggcgctcggcgccaacggactggccgccgcggccttcctcaacacgctcgccgccggctgcaccggcctgctcggctggctcttcgtggagcagaagcgcgacggccacccgaccacgctgggcgccgcctccggcgcggtcgcgggcctggtcgccatcaccccgtcctgcggcgcggtctccctgctcggcgcgctggtcgtggggctcgccgccggtgtcgtctgctcgtacgccgtgggctggaagttcaagctgaactacgacgactcgctggacgtcgtcggcgtccacctggtcggcgggatcatcggcaccctgctgatcggggtcttcgcggccaaggagatgacgggcggcaccgagggcctgctctacggcggcgggctcggacagctcggcaagcagctggtggcggtcgtggccgtgggggcgtacgccttcgccgtcacctacggcctcgggaagctgatcgacaaggtcatgggcctgcgggcggccgaggacgacgagcaccagggcctggaccttacggtgcacgccgagaccgcttacgatcacgggattctggggcacggcgccccaagctccgcgtccgtcgtccccaccgcgcagaaggtcaagagccaggca

SEQ ID NO: 5577 - DNA, 990 bp, Streptomyces avermitilis
  CDS (1)..(990)
atgggcgccatgagcgttcgtacccagtcatccgagccgtccgagggtgggggcacctcccacgccactaaggcagtgggggaccaccgcgccggcttcgcctgcttcgtgggccgccccaacgcgggcaagtccaccctcacgaatgctctggtcggccagaaggtggcgatcaccgccaaccagccgcagaccacgcggcacacggtgcgaggcatcgtgcaccggcccgacgcgcagctgatcctggtggacacgcctggactgcacaagccgcgcacgctgctcggtgagcggctgaacgacatcgtgcgcaccacctgggccgaggtcgacgtcatcggcttctgtctgcccgcgaacgagaagctgggccccggcgaccgtttcatcgcgaaggagctggcgtcgatcaagaagacgccgaagatcgcgatcgtcacgaagaccgacctggtggacggcaagacgctggcggaacagctcatcgcgatcgaccagctcggccaggagctgggcttcgagtgggcggagatcatcccggtgtcggcggtcggtgacaagcaggtggacctgctcgccgacctgatcgtcccgctgctgccggaggggcccgcgctctaccccgagggcgacctgaccgacgagcccgagcaggtcatggtggccgagctgatccgggaagccgccctggagggcgtgcgcgacgagctgccgcactccatcgcggtggtggtcgaggagatgatcccgcgcgaggaccgccccgcggacaagccgctcctggacatccacgccttcgtctacatcgagcgcccgagccagaagggcatcatcatcggccccaagggcaagcgcctgaaagaggtcggcatcaagtcccgcaaacagatcgaggcgctcctcggcacgccggtcttcttggacctccacgtcaaggtggcgaaggactggcagcgggaccctcggcagttgcggaagctggggttc

SEQ ID NO: 5578 - DNA, 843 bp, Streptomyces avermitilis
  CDS (1)..(843)
atgactactcagaaccagcccctcgacctgctcgagggctactacgactccgtgccccgcgcagccggccgggccgaggacttcggaccgctcaccctcttcgtacgggagacggcgggctggccgtactacgcgcggccgaccctggactggacgggccccgcggccaccgcgaaggacgtcgagcgggtccgggagcggcagcgggaactgggcgtgcccgaggcgttcgagtgggtggcggaggtgtcgccgggactgcgggaggcggtcgcggcgacggggctgcgggtgcacgcgcacccgctgatggtcctgaccgaggacctgccgctgcccgaaccgcatccgctcgtccgcgtcctgggccccgaggaccctttcctggcaagcgcgttggccgtcccgcacgtggccttcgcggcccccggcaccgcggtgggcgaggccgggctcgccgaactggccgcggcgatcaccgaccgcgccggtgaggtcccgggcgccgcggaccgtatccgcgcggggcgcacggtactggccgcggccgtcgaggacggtgtcgcgctctgctccgggatgcatctgccggtcggccgggtgagcgagatcgcgggcgtcggcacgctgccctcggcgcgacggcgcgggctcggcctcgcggtcaccgcagccctggtggccgacgcgcgggcggccggcgtggacacgctgttcctgtccgccggggacgaggacgtggcccgtatgtacggccggctgggattcacccgggtggccacggccctcatcgcggagcccgaggagcctgcggagcccgaggagcccgcggggcccgccgag

SEQ ID NO: 5579 - DNA, 1263 bp, Streptomyces avermitilis
  CDS (1)..(1263)
atgaccgcggccgagcccgtcacctcctccgtggaggccctcgccgagcccgtcgagcgggtcggccgtggctgggccttcgcgctctcactcgccaacggggcgatctgggtgggctggtacggcccgctccagatcctgctcgcctcccaggccgaggacttcgcgcccggcaccggcatgtcgaaggagacgatgctggcgtgggtcacgggcgcgggcgcggtggtgtcgctggtcgcgaatccgctcttcggggcgctgtcggaccgcacgacggcgcgccggggccgccgtacgccgtggatcgtggccggggcggcgggcggtgcgctgtcgctgctgctgctcgcgggcgcgggcggggtgtggacgatggcggcgggctggtgtctggtccagctgacgctgaacgcggcgttcgccgcggtcacggccgccgtgcccgaccgggtgcccagacggcagcgcggcgcggtgggcggctggctcggggcggcgcagatcctcggtgtggtcgggggcacggggctggcgacggtggcgggcggggtgggcgcggggtatgcggcgtgcgcgctgttcacggccgccggggtcctcccgtacgtactgaggtaccgggacctgcggctgccccgtgccgcgcgcccgccctggtcctggcgtgccttcgtgacctccttctggctgagcccgcgccgccacccggatctgggctgggcctggctgacccgcttcctgatcaacctgagcaacgcgctcgtgctcctctacctcctctactacctgcgggaccgcctgcggtacgacgaccccggacagggggtgctgatcctgacggcggtgaacggtgtgaccctcctggccacggtcgtcgtcggcggggtgtggtcggaccgcgtcggccgccgcaagcccttcgtgatctggtcgggcgtcctgatggcggtggcgacggcggccctggcggcctggcagacctggcccggcgcggtcgtcgcggcggcggtgctcggcgtgggcttcggcgtcttcgcctcggtcgacttcgcgctgatgacggacgtcctgccgaaggccctggaccgcggcaaggacctgggcgtcatcaatgtggccaacgccctcccccaggtggccgccccggccctcgccgcgccgatcgtcacgtacctcggcggctaccgggtcctgtatctggtggcggcggtgatcggactggcgggggccgtgctggtggggcggattcgcggggtcgac

SEQ ID NO: 5580 - DNA, 1323 bp, Streptomyces avermitilis
  CDS (1)..(1323)
atgatccggcgcatggcgacgaacccgatatctcagttcccggccggcttcctgtggggtgtctccacctcggcccaccagatcgagggagccgcggacgagcgcgagccctccgtgtgggacgccttcacggccgagccgggccgggtgaaggacggctcgacggcggcggtggcctgcgaccactaccaccgctacgccgaggacgtggcgctcctcgccgacctgggcgtggacgcgtaccgcttctccgtgtcctggccccgggtgaactcacccggcggcctcgacttctacgaccgcctggtcgacgagctgtgcgcggcgggcgtccgccccgtgccgacgctcttccactgggatctgcccctcgcgctggactggctcgaccgggacacggcggcgcggttcgccgagtacgcggcacgcgtggccgagcgcctcggcgaccgggtgacgaagtggatcaccctcaacgagcccgccgagcacaccctgctgggccacgcgctcggtgcgcacgcccccggcaggcagttgctcttcgacgcgctgccggcggcccaccaccagctcctcgcccacggtctggcggtacgggcgctgcgcgcggccggggtcaccgacatcggcatcgcgaactcgcacggaccgacctggccggcctcccaggagccggcggacctggaggcggcggccttctacgacctcctcctcaaccgcctgttctccgacccgctgctgctcggccggtacccggaggggatcggtgagctgatgcccaaaggctcagcaggcatcgagtccgatctgaaggtcatcgcggagccgatcgactggtacggcatcaactactacgcgccgacgaaggtgggcgctccccagggcgcggagatcgagttcggcgggctcacccttcccgcggaactccctttctccgtacgggagatcgagggtcacccggtgacggacttcggctggccggtggtgcctcaggcgctgacggagttgctgacgggcttccgtgagcggttcggcgaccggctcccgccgatcgtcatcaccgagaacggctgctcgtacgagggcatcgacgaccaggagcggatcgcctacctcgacggccatgtgcgggcgctccaccgcgcggtggaggcgggcgtcgacgtgcgcggctacttcgtgtggtcgctgctggacaacttcgagtgggcggaggggtacgagcgccgcttcgggctcgtacacgtcgactacgacaccctggagcggacgccgaaggcctcgtacggctggctgcgggacgcgctgcgggcgcggaga

SEQ ID NO: 5581 - DNA, 264 bp, Streptomyces avermitilis
  CDS (1)..(264)
atgcgtatccaggtgaagcgtacgggcgggttcgcgggcatcgagcgccacgccgaggtggacacctcggggcgggccgacgcacccgagtggcatgccctggccgagcgggcggtcgccgcgggccggggcacgcccccgatcggagtgccggacggcttcggctacgagatcaccgtggacgggacaacggtgtacgccgcggatccccggctgaccgaggagcagcggaaactggtctcgcgggtactcaaggaaggggcg

SEQ ID NO: 5582 - DNA, 1068 bp, Streptomyces avermitilis
  CDS (1)..(1068)
atgaccaccaacgggggcttcgagcccgtcttctgcaccatcgtcccgccgcacgtcctcgacacgctcgcccagcacgaggaccccgcggtcgccgagcccgcgcgccgcaccctggagcgcgacgccctcgagcgcacccaccgccggctgaccacggtcctcggcgcgcccaccgtggccccgcccagggacgcggccgcggacaagccgcagcgcacgatctacgacgccaggcaccaccaggacctgcccggcaagaaggtgcgcggcgagaacgacaagcccggcaaggacgccacggtcaaccgcgcgttcgccggactcggcgcgaccttcgagctctatctgagcgcctacacccgcaactcgatcaacggcgagggcctgccgctgaccgcgaccgtgcacttcgacgagaactacaacaacgccttctggaacggcgagcagatggtgttcggcgacggtgacggggagatcttcctcgacttcaccatcccggtcgacgtcatcgggcacgagctgacccatggcgtcacgcagtacacggcgaacctcacctacttcggccagccgggcgccctcaacgagtccatgtcggacgtcttcggctcgctgatcaagcagtacacgctgggccagaccgccaccgaggccgactggctgatcggcgccgggctgctcgcgccgcgcgtcaccggcacggcgctgcgctcgatgaaggagccgggcagcgcgtacgacgacgacctgctcggcaaggacccgcagcccgggacgatggacggctatgtgcgcacgggccgcgacaacggcggcgtgcacatcaactccggcatccccaaccacgccttctacctggtggccaacacgctcggcgggcacgcctgggagcgggccgggcagatctggtacgacgtgctgaccggcggcgagctccagtcccaggcgagcttcgcggacttcgccaagctgacggtggcggcggcgaaggcgcggtacggggacggcgaggagcagcagggggtgctgaaggcgtgggagcaggtcggcgtgccgacgtcg

SEQ ID NO: 5583 - DNA, 1719 bp, Streptomyces avermitilis
  CDS (1)..(1719)
atggcgaaccgccagcagcccacgtccatgccgatccacaagtaccgcccgtacgagcaggtcgacatcgccgaccgcacgtggccggacaaccgggtcaccgtcgctccgcgctggctctccaccgacctgcgcgacggcaaccaggccctgatcgaccccatgtcgcccgcccgcaagcgcgagatgttcgacctgctggtgaagatgggctacaaggagatcgaggtcggtttccccgcctccgggcagacggacttcgacttcgtgcggtcgatcatcgaggacgagaccgcgattcccgacgacgtcacgatctccgtactgacccaggcccgcgaggacctgatcgagcggaccgtggagtccctggtcggcgccaagcgcgccaccgtgcacctgtacaacgcgacggcccccgtcttccggcgggtcgtcttccgcggctccaaggaccagatcaagcagatcgccgtcgacggcacccggctggtcgtggagtacgcggagaagctgctggacgagcgcaccacgttcggctaccagtacagccccgagatcttcaccgacaccgagctggacttcgccctggaggtctgcgaggccgtcatggacgtctggcagcccggaccggaccgcgagatcatcctcaacctgcctgccaccgtcgagcgctcgacgccgtcgacgcacgcggaccgcttcgagtggatgagccgcaacctgtcccgccgcgagtacgtctgcctgtccgtacacccgcacaacgaccgcggtacggcggtggcggcggccgagctggccctgatggccggcgccgaccgcatcgagggctgtctgttcgggcagggcgagcgcaccggcaacgtcgacctggtcaccctgggcatgaacctgttctcgcagggtgtcgacccgcagatcgacttctcgaacatcgacgaggtccgccgcaccgccgagtactgcaaccagatggaggtccacgcccgccacccgtacgtcggcgacctcgtctacacctccttctccggctcccaccaggacgccatcaagaagggcttcgacgcgatggaggccgacgcggccgccaagggcgtcacggtcgacgacatcgaatgggccgtcccgtatctgccgatcgaccccaaggacgtcggccgctcctacgaggccgtcatccgcgtcaactcgcagtccggcaagggcggcatcgcgtacgtcctgaagaacgaccacaagctggacctgccgcgccggatgcagatcgagttctcgaagatcatccagacgaaaacggacgccgagggcggcgaggtcacgccgaaggacatctgggcggtcttccaggacgagtacctgccgaacccgcggaacccgtggggccgtatccaggtcaagaccggccagaccacgacggacaaggacggcgtggacacgctgacggtcgaggcctcggtcgacggcgtcgacaccgtcctgaccggcagcggcaacggtccgatctccgcgttcttcgacgcgctgcagtccgtcggcatcgacgtacgtctgctcgactacaccgagcacacgatgagcgagggcgcctccgcgcaggccgcctcctacatcgaatgcgcgatcgacgggcaggtcctgtgggggatcggcatcgacgcgaatacgacacgcgcgtcgctgaaggccgtcgtctccgcggtcaaccgcgccgcccgc

SEQ ID NO: 5584 - DNA, 723 bp, Streptomyces avermitilis
  CDS (1)..(723)
gtgctgccaggacggggacgaaacggccgggttgtcctgagaggccgcgtgccacagatccttggcatccgtacgtcgatcctcggcacgcggacgtcctggactcccgtcggtgacggcgagttcttctgcccggggtgcgggggtgaccgcaactaccagcggctcaccggccgccgccgcttcacgctcgtcggcgtccccgtactgccgcgcggtgagaccgggcccgtcgtcgaatgcgcggcctgccgccaccactacggcaacgacgtcctcgaccaccccaccaccgtccgcttctccgcgatgctgcgcgaggcggtccacacggtcgcgctggccgtgctggccgcgggcggcacctgtgcccgcgcgtccctggagacggccgcgtccgcggtgcgctccgcgggcttcgaggactgcacggaagaccagctcagcgcgctggtcgaggccctcgccgccgacacgggccgcgtcttcggcggcccctgcgacccaggtctggccatagagctccacgaggccctggacccgctcgccccgcacctcgccgccacgggccgggaggcgatcctgctccagggcgcccgcatcgccctggcggacggcccctacacaccggccgagcgggatgcgctggccacggtgggcgcggcgctgacgatctgctcggacgacgtgacacggttgctggcggcggcgcgcacgccttcc

SEQ ID NO: 5585 - DNA, 2076 bp, Streptomyces avermitilis
  CDS (1)..(2076)
atgggggccagaaatacgagtgtgacgcgttcacggcggcgggccgtgccctggctggtgctcgggctgtgggtggccgcgctggccgccgtcggaccgttcgcggcgaagctcgccgaggtgcagcacgaccgggtcgtcgactatctgcccgcgagcgccgactccacccaagtggccaggatccaggaccagttgcccggcggcgagaccaccgagctggtgctcgtgtatcaccgtgagggcgggctgaccgccgccgaccggaccgtggcgggggagcaggtcaccgagatcgccgggcggcaccggctgaccgggacaccccgcggggtcccgtcgacggacggtacgaccctcatgtacccggtcgccagcaacgagcccggtgccgacgaggacgagcgggacgccctcgtcgacgacatacgccacatcgcccacggtgaaggcgggctgagcgtcgaagtcggagggacggccgcactcgccaccgacgccgccggggtctacgcctcactcggcgggcccctgctctacacgaccgtcgccgtcgtcgccgtgctgctcgttctcatttaccggagcccggtgctgtggctcgtaccgctcgccgtggccggtgtcggcgactatctggccatgggcgtcgcgtacgggctccaccaggccttcgggacgacgatctcggggcagagccagggcatcatgaccatcctcgtcttcggcgcggggacggactacgcgctgctgctcgtctcccgctaccgggaggagctgcggcgcttcgagcggccctacgaggccatgcgcgccgccctgcgcggctgcgggcccgccgtgctcgcctcctccggaaccgtcgccgccgggctgctgtgcctgctcgccgccgacctcaactccaaccgggacatggggccgctggggacggtcggcgtgctgtgcgcgctcgtcgcgatgctgacgctgctgcccgccgtgctcgtgctgctcggacgtcgggtgttctggccgctcgtgcccgcgtacgggagtgagccgaaggcgcggcggtcactgttcgccgcgatgggctcctccgccgggcggcggcccctggcggtgctcgccggcggtgccgtgctgctcggcgcgctcgccctgggcgcgctgaacctgcccggtccgatcaagcagcaggacaccttcgtcgacaaacccgagtcgatcgcggcgatggagaccctcgccgaggcctaccccgagcggtcgacccagccgatcgccgtgatcacaccggccggacgcgcggacgggacgctcgcgcggatccgtaccgtgcggggtgtcgacagcgtgcgggaggggcgcacgggggacggctggaccgagatctccgtcatcgcgaaggacgtgccccagtcggcgggtgagaccgcgaccatcgagcggctgcggcacgcgctgacgggctcgtacgtcggcgggcccagcgcccagcggatcgacctgttggacaccaacgcccgggaccggggggtcgtcgtaccgatcgtgctcgcctccgtgctgctgatcctggtcgcgctgctgcgcggcctcgtagcgccgctgctgctggtcggcgccgtggtcgcggtgtggggtgcggcgctcggcatcggcgggctggtcttcgggccgctgttcggcttcgagggcacggatccggggctcgggctgctgtccttcgtgttcctggtggcgctgggcgtcgactacgggatcttcctcatgcaccggatgcgggaggagtccacggcgggcgcggaacccgcggcggccgcgctcaccgccctgcggaccaccgggggtgtcatcgcctcggccggtctcgtcctcgccgccaccttcgccgtgctgacgaacatggggctggtgcagctcgtcgagctgggcttcgtgatcgcggtcggggtgctgctcgacacgttcctcgtccgtacgtatctggtgaccagcgcgagcgtggcgctgggccggaaggtgtggtggccgggcgggctctccaaagaacccgatccaccgcggcccgagcgtcagccggaacccgta

SEQ ID NO: 5586 - DNA, 1350 bp, Streptomyces avermitilis
  CDS (1)..(1350)
atggatttctatgagccaccgggcgcccctccctgccggaggggcgcccccctggcggaggatggacccgtgcaggcaaccaccacagcggcgcggccccgccggggcgagcggatcatggcggcggtcaaccgcgacccccggaccgccccgcacgccctccgcaacgacgcgctgctggccgtggcggtcgccgtcctcggcacggcgctcgccctgttcaccgacgagggccgccggcccgacacgctcggctgggtgctgctgctcgccgcccaggtgccgctggtgtggcggcggcgccacccgatgctcgtcctggccgtggtggtggcgctggtcgtgccctatcacgccctcgacaacaaccacgccgcgccgaccccggcctcgtacgtcgcgctctacacggtcgccgtcaccggccgcccgctgcgcacgctcctgaccggcatgaccgtcctcgccatctccgtgagcgtgatgctcaccgtcaacacccaccaggccgtcgaactgctgcggatctccggctggatcgtcgccatgctcttcttcggcgtcgacgtccgcttctaccgtcagtacgtcgcctcgatcgtcgaacgcgccgaacgcgccgaacgcacccgcgaggaggaggcccgccgccgcgtcgccgaggaacggctccgcatcgcgcgcgacctgcacgacctgctcgcgcacagcatcaccctgatcggcgtccagacctccgtggccgcgcacgtcctcgccgccgaccccgagcgcctcgaccgggcggcggtcgctaaggcgctggacgacatcgcggagacgtgccgttcggcgcggggcgagttgcgtacgacgctggaggtgctgcgggagcacacggcggacgactcctggcaggccccgtacggcgcgcacggaccgctgcccggcctcgacggcctgcccgacctcgccggggccgcccgggccgccggcgccgaggtcgagctgtccgtacgggccgacggtgtcccgcccgccgtgggcgccgccgcctaccggatcgtgcaggaggcgctcaccaacgcggtgcggcacgggggccgcgcggacctcacggtgcgggtgggcgtggccgaccgggacggcgccctgcgggtgagcgtcaccgacgacggcgcgggcaccggcgggggcacacccggcttcgggctggtcgggatgcgggagcgggcgcggagcgtgggcggcacactggacgccgggccgggtccggaggaggggttcgaggtgctcgccgtactaccgctgaccaggggcgatgtcccatcggcccgcacagcggggccattgcgcccggaaggagtccga

SEQ ID NO: 5587 - DNA, 681 bp, Streptomyces avermitilis
  CDS (1)..(681)
gtgccgcccacgcccgtccgggtactcctcgccgacgaccagaccctcgtccgcgccgccttcgcgatgctcgtcgagtcggccaccgacatggaggtcgtcgggcaggcgggcacgggacgggaggccgtgcggctggccaggtccgagcgggccgacgtcgtcgtcatggacctgcgcatgcccgacctggacggcatcgacgcgacccggctgatcgccgccgacgacgacctcgccggggtcagggtcctcgtcctcaccacgtacgacaccgacgagtacatcgtggaggcgctgcgcgccggcgcctccggcttcctcgtgaaggacacgaaaccggccgaactcctcgacgccatccgtacggtggccgccggcgaggccctgctctccccgggccccaccgcccgcctgatcgcccgcctgctgcgcacccccgtcccgcccccggcggcggccgtcggccccgagtgcctctccggccgggagcgcgaagtgctcacgctggtcgcgcgcgggctcaacaacacggagatcgccgagtcgttgggactcagcccgctcaccgcgaagacccatgtcagccgcatcatgggcaagctgggcgcccgggaccgggcccagctggtgatcgtggcgtacgagtcggggctggtcacacccggtaccgcccagggc

SEQ ID NO: 5588 - DNA, 1209 bp, Streptomyces avermitilis
  CDS (1)..(1209)
atgtccgtcaggagccgtacgaccctgctcgccgccgcggtggggctggtgaccgccctcgcggtcaccggcacggcgggcccggccgcggccgccccgccgccctcccgcggctgcacgtcctccgtgccgtacaccgcgggccagtacggctacgacacctaccgcatcccggcgacgctcaggacgagggccggcacgctcctcgccttcgcggagggacggcgaggcggcgcgggcgacaccggcaacatcgacgtggtcctcagacgctccttcgacggtggctgcgcctggggcccgctgacggtcgtcgcggcgggccggggcgacacccggggcaaccccgcgccggtggtggattcgaggaccggccggatcgtcctggtcacgtcctacaacggcggtgccgtgaccgaggcgcagatcatgcgcggggaggtgacccccgagcagagccgccgcgtcttcgtccagacgagccgcgacgacggccggcacttctccgcgccccgtgacatcacggcgcaggtcaagccggcgaactggcggtggtacgcgaccggcccgggccacgcggtggccctcacgcggggcccgcacgccggccgcctcgtcgtccccgccaaccactccgccgcgccgcccgagggttcggccgacaccgggcgggaggccaggtactacggcgcgcacgcgatctacagcgacgacggcgggctcacctggcggctcggcttcgtcgacgactcctacgacggcgtcgacaacgccaacgagaacgccgccgccgaactgcccgacggacggctctacttcagcgcccgcgaccagaacggcacgagcgccggcaaccggctggacacgtactccggcgacggcgcgcagaccctggaccgcccgtacgccgtccagcccaccctgaacgacgtcccggtcgtccagggcagcgtgctgcaactgacggggaacggggcgcccctgctcttctccgggccctccgtgccgaccgcccgccggtcgatggcgatccggcggagcgaggacgggggcgggacgttcgtgacggtgaagaccctgtcggcactgccggcggcgtactcggacctggtgcaggtgagcgccacgaaggtcgggatcctgtacgagaccggggtggccgggccctacgactcgatcgagttccggcgggtgccggtgggggagctg

SEQ ID NO: 5589 - DNA, 933 bp, Streptomyces avermitilis
  CDS (1)..(933)
atgaccctgcccaccccgttgaccggtgtcgtaccgcccgtctgcacccccctgacaccggatcgcgaggtggacgtcccctcgctcatcaggctcgtggaccacctggtgaacgggggtgtggacggcctgttcgtgctgggctcgtcctcggaggcggcgtacctgaccgaccgccaccgcaggctggtggtggagacggtgaccgcgcatgtcggcgggagcgtccccgtcctggcgggggcgatcgacatgacgacgccccgggtgctggaccacgtggagtacgtgacggcggccggcgcggacgcgatcgtcgtgacggcgcccttctacacgcggacgcacccggcggagatcgcccgccactaccgtctgatcgcggcccgctcctcggtaccggtcttcgcgtacgacctcccggtcgccgtgcacacgaaactggaccccgagctggtcctcgagctggcggccgagggcgtcctggccggcctgaaggactccagcggcgacctgggcggcttccgcgccgtcgtcaccggcgcccgcgcgcgtcccgacatcaccggcttcagcgttctgacggggtcggagctgttcgtggactcggcgctggccctgggcgcggccggggcggtgcccgggctggcgaacgtcgaccccgaggggtacgtccgcctggaccgtctgtgccgcgcgggcgacggggagcgggcgcgggccgagcaggagcggctgtgcgcgctgtacgggatggtcggggccggggatccggcgcggatgggcgggagttcgtcggcactcggagcgttcaaggcggcgctgttcctgcggggagtgatcgcgtgcgcggcgacggcggagccgcaggtgccgctctcggaggaagaggtggagcgggtggggaagcatctggcggcggcgggattgctg

SEQ ID NO: 5590 - DNA, 1065 bp, Streptomyces avermitilis
  CDS (1)..(1065)
gtgaccgggctggtctcgctgtccggcgtccatgtcgttcacaaggcgcgcagcggcggcctgttcacccgggaccgggtccacgcgctgaccggcgccgacctcgccgtcgcccgcggcgagacggtgggcgtggtgggcgagtccggatgcggcaagtcgacgctggcgaaggtgctggtgggggtgcaacggccgacgtccgggacggtgtccttcgggggccgcgacctgtggtcgatgaagccggccgagcgcaggacggtggtcggcggcggcaccggcatgatcttccaggacccttcgacggctttgaaccgccgtctgacggtccgccggatcctgcgcgatcccctggacgtccaccggcgcggcacgcccgccgaacgggaggaccgggtacgggagttgatggcgctggtgggtctgccgcgcgccctggccgacgggctgcccggccagctctccggcggccagcggcagcgtgtcgccatcgcccgggccctggcgctcgacccggatctggtggtcgcggacgagccgacgagcgcgctggacgtgtccgtacgcgcgcagatcctcaatctcctgctggacctgaaggaacggctcgggctggccctggtcttcgtctcgcacgacatccagacggtacgccggatgagcgaccgggtgatcacgatgtatctgggccggatcgtcgaggaggcgccggcggacgaggtcacggacggctcccggcacccgtacacccgcgccctcttctccgcgacgcccggcctgctggacccgatcgacccgatcccgctggtgggtccggtcccgtcggcgacgcgcccgccgagcggctgcccgttccgtacccggtgctggaaggccgacgcccggtgcgccggcgagatgccggacttcacggccgtgtcgggtccggagcaccggttccgctgccaccatcctgtgcaggagggcgagtcgacccacgacctcgtgggccaggccgcgtccgcctccccggccaccgccatggccgacgtacccgtccagcacgtcccccgggagccttca

SEQ ID NO: 5591 - DNA, 1956 bp, Streptomyces avermitilis
  CDS (1)..(1956)
atgatcactcgtacgcgcctcgcccacgccctgtcccggcccggcgtccggctgcgccgactgcccccgctctcgcgcatcgccctcgggctcctcaccgtcgtggtcctggcggccctgttcgccccgctgctcgccccgcacgacccgctcgaccagcagccgccggccgacggcagcgggcacccgtccgccgggcactggatggggcaggacagcctcggccgggacatcctcagccggctgatgtacggcgcccgctggtccctcgccatcggcctcggcgccaccgcgctcgccctcctcgtgggagcactcctcggcgcggtcgcggcgacctcgcgcaaggcggtcgacgagacgctgatgcggtgcctggacgtcgtgatggcgttccccggcatcgcgctcgcggcggtcctggtcgcggtgttcggcggcggcgtcacggtcctgatctgcgcgatcgcgttcctgttcaccccgccggtcgccagggtcgtacgggccaacgtcctcgaccagtacggcgaggactacgtgaccgcggaacaggtcatcggcgcgcgcaccccgcacatcgtgctgcggcacgtcgccgtcaactgcgcggcgcccgtgctggtgttctgcacggtccaggtcgccgaggccatcgtgttcgaggcgtcgctgtccttcatcggcgcgggcgtacggcccccggacccgtcgtggggcagtgtcatcgcggacggcaagaacatggtgctgaccggtggctggtgggcgaccgtcttccccggtctgctgatgctggtcaccgtcctgtcgctgaacatcctctccgagggtgtctccgacgcctgggccgccccggccgcccgggacgtgcaggggcgtgacgaccggttggagacgcctcggcccggcagcggggaggtgctgcggctgcccggcctgacggaggcggccctgcggctgcgctcccgcgcccggcccctgcccgagggccggccggtcctcgccgtggagaacctcgccatcggcttcgacgcccgccacggcggcgtggacatcgtcgacggcatcagcttcgaggtgcgccccggcgaagtcctgggcctggtgggcgagtcgggctgcggcaagtcgctgacggcgctgacggtgatgggcctggaaccgaagggggcacgggtccgcggccaggtccgtttccgtcagcggcaactggtgggcgagccgatgcgggtgcgccgcaggctcctcggccacgagatggcgatgatctaccaggacgcgctgtcgtccctgaaccccgcgatgaccgtccgggcgcagctgaagcaggtcgtgcgcaggggcgggaagcggtccccggcggccctgctggagctggtcggcctcgaccccgagcgcaccctgcgcagctatccgcacgagctgtccggcggccagcgccagcgcgtgctgatcgccatggcgctgtcccgcagccccaggctgatcgtcgcggacgagccgacgaccgccctggacgtgacggtgcaggcgcaggtcatggagctgctgctgcggctgcgggcggagctgggcttcgcactgatcctcgtctcgcacgacctggccctcgtcgcggacgtcacggaccgggtggtcgtgatgtacggcggtcagatcgtggagacgggggtgaccgcggacctggtggaggcaccggcccaccactacacgcgcgggctgctcggcagcgtgctgtccctggagtcggcggcccggcggatgacacagatcgagggcgtcgtccccgcccccgcggacttcccggcgggctgccgcttcgccgaccgctgcccgctggcgagcgaggtgtgccggacgacggcacccggtctggccgggacgcgtacgcacacggcggcctgccaccatccggccgtcgacctggtgaccacggagagcgaggcggtgacg

SEQ ID NO: 5592 - DNA, 960 bp, Streptomyces avermitilis
  CDS (1)..(960)
gtgatcgccatcgccagaatcctggcccgccgtgtcgtcctgctcgtcccgctgatgctcggcatcgtgctcttcgtgttcctggtgatgcggttctcggacgtcgacccggcgtccgcgttcttccagggcgcgaaccccacaccgcggcaactgcacgacttccggcagcagaacggcctgctcgacccgctgccggtgcgctacgtccacttcgtgggcgacctgctgcacggcgacctgggcatcagcgcgctgacccgggcgccggtggtcgagcaggtcaccaccgcgctgccgctcacgctccagctcaccttcctgggcctcggcatcgcggtggtgctcgccctgaccggcggagtgaccgccgccatctaccgcgaccggctgcccgaccagctggtccgggtggtctcgctcaccggcgtcgccgcccccggcttctggctggcgctgctgatgatccagtacctggcggtcgaccggggctggttcccgaccggcggctacatcaaccccgccgactcgccgagcggctggctcaggacgatgacgctgcccgcgttcgcgctgtccctgccggtcgcggcacagctcacccgcatcgtgcgcacggccgtcgtcgaggagctcgacaaggactacgtacggacggcgatcgggagcgggctgccgccgagggtcgtggtgggccgcaacgtcctgcgcaacgccctcatcaatccgctcaccgtgctcggcctgcgcgtcggctatctgctcggcggcgcggtcgtcatcgagacgatcttctccctgccgggcatggggaaactgatgatcgacgccgtgcagaacggcgatcccgcggtcgtccagggggtcgtgctgacgacggccaccggcttcgtcgtggtgaacctcgtcatcgacatcctgtatctgctggtcaatccgcgactgagggatgcggcccga

SEQ ID NO: 5593 - DNA, 1629 bp, Streptomyces avermitilis
  CDS (1)..(1629)
gtgcgcgacgcgacccacgacgtaccggcgctgcaccgccgttcgttcctgaagtactccggcgcgctgggcgcggccgccgcgctctcctcgtcgctggccgcctgctcctcgggcccggagtccaccaacgacaccggcggcgggggcagcggcgggaaccggacgttgaccgccgtcatcggctatgggaacgacggcagctgggatccgacacagaccgcgtccgccttcagcatggccgccaacaaccacatctacgagggcctgctcgacaccgatccgatctcccgcgagccctacgcggcgctcgccacccaggtgccgaaggatctcggcggcacgtcatggaagttcacgctgcgctccggggccacgttccacgacgggaagccggtcaccgccgacgacgtggtgttcgtcttcggccggatcctcgacccgaagacccagaccctcgtcaaggggttcttcgcgagctggctgaaggacgtccggaagatcgacgcacagaacgtcgagctggtgctcaagttccccttccccgaaggggtttcgcggctcacgctcgccaagatcatgccccggcacgtcttctcccggccgggcgcctgggaggacgcgatcaagggcaaggcggtgggctcggggccgtaccggcagaccgcgcaccacccgaagtccaacaccacgttcgaggcgttcgccggctacaacggcccgcgcaagccggccttcaagaagatgaactggctgaccatcgtcgacgccgccccgcgcgtcgcgaaggtctccggcgcgagcgccggcgcgcagctcgccgacaacatcccgtacgccaacatccagcagctgaagaaggacgggatgaccgtcgagggcggggcagggatgaacaacctgttcctgatgttcaacaccaaacacaagccgttcgacgacgtgcgcgtgcgccaggccctccactacgccatcgacaccggcaagatggtcgaggtcgccctcaaaggccatggcaagccctcgagttcgttcctcaacgagggcaacccggcttaccgcaaggcgaagaccgtctacgactacgaccccgagaaggccaaggagcttctgaaggcggccggcgtcaagggactggagatcgagatcctctcggtgaacgtcagctggatcgtggactgtctgccgaccatcaaggcgtcctgggacgcgatcggcgtgcggaccacgctctccccgcaggagaccacggccgtcttcacgaagatggaccagaagcaggactaccaggtcgtcgccgccgcctcgaaccccaaccagttcggcctcgacgccgacctgatcatgcactacaactacggcccccagaacctgtggatgcagtacgcccgctgggccggcgactccgtcgccaagcagctcttcagggacatggacctggccacccggcagccggacgccgagaagaagaagttgatgatccaggactacatcgacgtcgtcgccgaacaggccgtgctctacccggtcgtccacaacgagctgatgaccgcctgggacccggagaagctcagcgggatcagggcccagccctaccccggcgtcaatctcctccaggccaagtgggcg

SEQ ID NO: 5594 - DNA, 711 bp, Streptomyces avermitilis
  CDS (1)..(711)
atgcggcgcatgtccgaggagaccgggaacagtcggatacggcgcgaggtcgtgcagctgatcctcgaccgcaggctccgggccggcgcgccgctgcccaccgagacggagctgatggaggatctcggtgtcagccgcaactccgtgcgcgaggcgctgaaggcgttgcaggccctggacatcgtggagatcagacacggctacggcacctacgtcggacgtgcctcgctgaccccgctggtcgacggcctcaccttccgtacgctctcgcggcccgacgacgacacggacgcgctggcggagatcctccaggtccgggaggtcctggaggagggtctgatccgccgggtcacggcgaccctctccgaggcggagctggaccggctggagtcggtggtggcgcggatggagacggccggccgggcgggccgttcgttcgccgaactggaccgggagttccacgagttgctgtacgcgtccctcggcaacgcctttgtgccgcagctcctcggcgccttctggacggtgttccgccgggtcgcgggcgcccgtgactggacggacgacccggccccggcggtgacggcccgccgccaccgcgacatcctcacggccctgcgggcccgggacgtcgagggcgcgcaacgggcgatggcggaccacttcaggggcatcgaggcgcgggcggcggaggagtcgcggggggtgggg

SEQ ID NO: 5595 - DNA, 432 bp, Streptomyces avermitilis
  CDS (1)..(432)
atgaccgacacctggagtcccacggacgtgggtgtgctgcggctgccgtcagggcgcctggtccgcggccgaggcctgcgccgccctcttccggaggggcaggaaccgacgtacgccgtgtatctgctcggcaagcggccgcccgaagtcccctgggaggcgcactggttgcgctggccggacttccgcctgcccagcagccgtacacaggcccgggaggtgctgaccgacgcctggcggcgggccgccgccgagcgcgtggagatcgcctgcggcgggggccgggggcggaccggtacggccctcgcgtgcctggcggtactcgacggcgtaccccctcaggaggccgtggcgtacgtccgcgcccactacgaccggcatgcggtggagacgccctggcagcggaggtacgtacgacaggcgggctgctgg

SEQ ID NO: 5596 - DNA, 1437 bp, Streptomyces avermitilis
  CDS (1)..(1437)
atgctcaccaccctcctccgcgacagccgcgcgctcgccgccctcgccgtcccgctgatcctcacccagctcgcgcaggtcgccctgacgaccacggacacggtgatgatgggtctgctcggcacccgggagctggcggcgggcgggctggccctcgtcatcttcaaccagctgcgcaccatgggcgtcggcctggtcacctcggtcggcaaccagatcgccgccgccggggcccgggcagaacaggccgagcaggccgaggccgagcggacggccggccgtgacgacgacggccggggccacgcgcaggaagaggcacacgaggagatgcggggcatcgtgcgcgccagcctggcgctggccaccctcgccggcctcgccggtgccgtcctcatgatcctcatcgggcaggccctcccctggctaggccaggacgccgcggtcgccgaccgggcccagacgatgctgttcgcgctcgctcccggcctgctgccctgtctctggttccaggcgatccgccagttcacggtcggaatgcggcgcccccaggccctgctccggatcaccgtcgcctccgtcgccgtcaacgccggcctcaactgggtcctcatccacggcacctggggcctgccccgcatggggctgaccggcgtcggtgtcgccacctccagcgtgtacgtcctcacctgcatcgccctctacgtctcggcgaggaaggacggcgcgctcgccccgctgctcgccctggacgtcatgaaggccgacccggccgtcctcaggcggctgctgcgtctggggctgccgatcgccgcgacctacgggtcggaggccgggttcttctccctcaccgcgctcatggccggatccttcggaccggccgctctggccgcgcacaccgctgtcaaccagctcgtctacatcgtcttccaggtcgccgtgggcctctcgcacgccgcgtccatcaacgtcagccgtgaactcgccgtaggccgttacgaagacgccggccgcatcaagaacacggcgctcgcctgcgccgcggccgtcatgaccgtcgtcggcgtcgtctacctcaccctccccgagctggtcctggccccgttcctggaatccggctccgggcaggccctgacgatcgccacccacctgctcgtcgtcaccgccttcctccagttcttcgactgcgcccagaacatcggcgtcggactcctgcgcggcctcgacgacaccaggagcggcttccgcatcaccctcatcggctactgggccgtcggactccccgccgcatggctcctcgcctacgccctggaactcgacaccctgggcatctggctcggcctcctcaccggcctcgccaccaccgccgtcctcctcctgcgccgctacgcgcagtccctcaccacccgatccgcccggcacactcccctcacggcgacc

SEQ ID NO: 5597 - DNA, 1026 bp, Streptomyces avermitilis
  CDS (1)..(1026)
atgcccggatccctgcggcgcccgtccgtggtctcccgcgtgtccgacctcatcggctacaccccgctgctggaactcgcggccacggagaccggcagccgcctgctgctgaagctggagatgttcaaccccaccggcaccgcgaagatccgcatggcccgccagatgatcaccgatgccgaggagcgcggcgaactgcgcgcgggaggccggatcatcgagtccacctccggcaacaccggcctgggcctggccgtcatcgccgccgaacgcggctacaccttcaccgccgtcgtcgacaaccacgccgccgtcgacaagctgcgggccatgaaggccctgggcgccgaactggtccacgtcgtggacgacggaaccgacgaactcgccaccgccgcccgtgaggaactcgccgaggagatggcgcgcggccaggacaacaccatcttcaccgagcagcacaacaaccccagcaacggcgtcggctacttccccgtcgcccacgaactccacgaggcactcgacggccgcctcgacgtcctcgtcggggccgtcggcaccggcggcggcctgtgcggcacggcccgtgaactgcgcaccctcatacccggcttcaccaccatcggcgtcgaaccgaaggggtcgatcgcgttcggcggcccggcgcacgactactaccagtcgggcaccggcacgcccgagggcgccccgatcggtgctctggtcgacttcggcctcatcgacgaaggggccaaggtcggtgacgtcgaggcgttcgccacctgccgggccgtggcccgcaccggcctgctcatcgggggctccgccggcggcgtcgtccacgaagccctgacccgcctgcccggacttccgcccggcacgactatggtcgccctgatcaatgacggcggggagaagtacatggacaccgtcttcaacgacgactggatgcgggcccgcgacctcctcgatcccgcggcggaacgggaagtcgacgaactcctcaccaagctccgcgggaaccga

SEQ ID NO: 5598 - DNA, 1371 bp, Streptomyces avermitilis
  CDS (1)..(1371)
gtggcggtgaccgggccccccgcccttcccacccttcccgccctgcccgacccggccgccgacgccgtgctgggcagcgggctgctggaggaactcgcctacgcgctcggcggcccgttccacttcctgctgcccgacgccttcgacgccaacctgcgcgccctgcacagcgtcctcgacgagaccggcgtcgacggtttcgtgtacttcgcgaagaaggccaacaaggcagccgtgtgggcggaacgatccgccgccggcggggcgggagtcgacgtcgcttccgccgccgaactgcgccaggccctggggcacggtgtgcgcggggagcacctcgtggtcaccggtccggccaaggacttggcactgctgggactggccgtccggcacggtgccctgatcgccgtggacgcgctcgacgaactcgacacgctcatcaccaccgtgtccggggaccgcacgcgcccggcccggctgctgctgcgctgcctgccgcccgctcagccccacagccgtttcggcctgggcgaggccgaagtggccctcgccctggagcgctgtgtcacggcgggcgaagcggtccgtatggagggcttcagcttccacctgtccggatacgacgtgaagctccgcgccgacctggccgggcacctcgtcgaactgtgcctcaaggcccgcgtcctcggactggaggccgaccgcatcagcatcggcggcggcctgccggtcagctacagctccgccgccgactggaacaccttcctgacgcgacagaacggcggccactaccacgcggacaggacgttcgaccccgacggcttctacccctaccactcaccggtcgccggggcggacgccctgcgccggatcctggccacgcgccccgaagggcaccgtccaagcctcgcggcgctgctgaacgacgccggcatcacgcttctgctggagcccggacgcgctctgctcgaccgggccggcggcaccgtcttccgtgtccagggggtcaaggaccgggacggataccagctcctgacggtgaacggcaccagcctgagcctgtccgagcagtggttcaacagcgagtacctgcccgacccgcacctgctgtcagcccaccccgacacaccggacgcggtgtggccggccgccgtgggcgccgcgacctgcctggaatcggacatgctcacgtggcgcaaggtccccttcccccgcagaccgcgcaccggggacctgctggtctacccgaacaccgccggctaccagatggactccaacgagtcccccttccacgacctggcgctgccgcccaaggtggtcatcgaccacaccgaccgggcccgcccgcgctggcgcctcgaccgtcacgccccc

SEQ ID NO: 5599 - DNA, 1029 bp, Streptomyces avermitilis
  CDS (1)..(1029)
atgaccatgcctgacgcctcgaccaccgccgccgccgaaccgataccccgcgccgaccggcacctgcggatcctctcgaccggcgatctggccgggatcgacatctccctggccgacgtggtgtccaccgtggaggacgcctaccgcaccctgcacgccggtgagtccgacaacccccgcaagctcaccgtcaagccgcgggacgggcattcggtcgcgtacgcgatgctcggccgggacggctcccgcgacgtcgtcgccgtcaagacctcctacaagcacggcctggacaaggggcgcgaggagcagcactactacaccacgctgaccctctacgacgatgtcaccgggctgcccgtggcgatgatggactgctcccggatcggatcgctgcgcaccccggcggtctccgcgctgctggcccgcgaatgcgccgcccccggtgcgcgcagcgccctggtcatcggtacgggcacccagggccgtctggcgctgcccttcctgctgacgacgctgcccgggctggaccggctgatgctcttcggcacccaccccgagggcgtcaccgcggtgcgcgagcggcttcgggcgcacttcccggaccgggacgtggagatcgtcaccgacgcgggggccgcggcctcggaggccgacatcatcgtggccacggccggcggccacaccccggccgcggtcggggcggaccggctcaagccgggctccctgtccatcctcgtgggccacggtctcgccccgtcggccctgcaccgggccgaccgggtgatcgccaccagcgaggcccagatgaaggtcaccggcatcgacatggccgacgccgacggcgaactccgcgcggtcgacgccgagttcccgcccgtgatcaccggcgacaccgcgggccgccgcaccgcgacggagcggatcttcgcctacaacagcggactcgtcgtcaccgatatcgcgctggggcaccgcttcgcacagctcgccctcgaacagggcctgggcaccgaggtggcactgtggcgg

SEQ ID NO: 5600 - DNA, 990 bp, Streptomyces avermitilis
  CDS (1)..(990)
atgagcacggcagccgcacctgcccgtcagctcgaccccgactccgtgagtgaactccgccaagccacagagcacatacacgccgaattcggcacctcggcgacgacccccgcgctgctgaagcggatcgcgacgaccgcgaacgcgttcggcgacggcctgcgtcaccactgccgccccgtcgacaccgacgacggactgttcgtcctgcgcggcctcgacatcgacgacgccgcggccggtccgacgccggacagctgggccacggccggagacagcggagcggcccacgacatcacgctcctgctgctggccaccgtgatgggcaacccgatcgcctgggaggggcagcaggacggccgcttcgtccacaacatcgtgccctcgcccggccacgagaccgagcagaccggcgccagcagcaccgtgctgctcagcccccacaccgaggacgccttccaccccggccgcgcccacctgctgatgctcggctgcatgcgcaaccacgacgacatcgccaccaccgcggcgagcgtccgcaagacgcggctgtcggagcgggacgtgcgcaccctgacccgcccggtgctccccatcctgccggacgacgcctacgccgaggcccagggctacgccgaggagccgccgcccgtgcccgccctgttcgcgagcgaggacgggatcacgctgcgcttcgaccccgcctacacccccctcgaccaggcggacgacgcctaccggagcgcgtacgggcggctcggggaagaactggcccgtgtctccgtcgcggtcagcctcgctcccggtgaggtcctggtcgtcgacaacgacctggtcgtccacggccgtgttcccttccaggcccgctacgacggcaccgaccggtggctcaagcgcgcctccgtccgcgttcccgggcgccgcacccgccccctgacagaagcccacgagcacggctacggccagagcgcgatcgaagcccacgcgcgc

SEQ ID NO: 5601 - DNA, 1548 bp, Streptomyces avermitilis
  CDS (1)..(1548)
gtgaacatcaacaggcgtcaagtgctgctggccggcggggcgatgggcgcgtcggcgctgctggccgcctgctccgggggcggggacgacacgtcggccgcctcctccgacaagggcggcaagccccgcaagggcggcacgctccgcatcggggcgctcggccgcgccggcgccatcacccgtgacccgcacggcactcagggcaacgagagcgactacctgatcctcgccctcgtctacgacaccctcaccgtcccgggcgccgaccccaacaccaagcctcggctggccgcttcgtgggagccgtcgaaggacctgaagacctggcgcttcaagctggccgaggacgccgccttccacgacggcagcccggtcaccgccgacgacgtcgtgtggtcgctgcggcggctgcgcaacaccccctccggggccgcccgcctgcccggcatcaaggccgagaacatcaccgccgacgggaaggacacggtggtgctggtctccgactacgcgaacgccgaactcccgcccctgacccggctgacgacgttcgtactgaagaagggcacatcggacaaggagttggcgaaggcgccgggcaccgggccgttcaagctcgaccggtaccgcgccggcaacgcgcgcctggtgcgcaacgaccagtggtacggcggcaccgtgtacctcgacgcgatcgaggtgacgatgttcgagacgccgcaggcgatggccaacgcgctgctcgccgggcagatcgacgtcgcctccaacgcgggtgcggtcgccgcgcgcacggcaaagtcccgcaaggacgtccaggtggtgcgccgccccgacgacatgtcgatgcccctcgtcatgcgcaccgcggacggcccgttcgccgatgcccgggtgcgggaggcgatgcgtctggtggtggaccgcgaggccatggtcaagcaggtcctgtccggatacggaaccgtcgccaacgacatcatgggaaccggcgaccccggctacgccaaggacgtcccgcagcgggagcgtgacctggccgaggccgagcggctgctctccgaggcgaagttcgacctgtccaagacctacgagctggtcaccaccgaggacatctcggggctcgccgagtccgccaccctgttcgcctcccaggcccgcgaggccggaatcaagatcaaggtcgtcaagcaggagtccggcgcgttctacgagaagacctggctcaagggcgacctctacacgacgtactggggcaccaacgactcggtggtgttcttcgcgtccaagaccctggtcagcgaggccgggcagaacgaagccggcttcgcggacaagaagttcgacgcgacctaccgcaaggtgatcgccaccgcggacccgaaggcccgcgccgaggtactcaaggagctccagcggatcgagtacgaccggtccggctatctgctgtggggcatggccgacggcatcgacctggccgcctccaaggtccgtggtctgcccgagctcgccggctacggccgcgtccagctcgagaacgtgtggctgggt

SEQ ID NO: 5602 - DNA, 888 bp, Streptomyces avermitilis
  CDS (1)..(888)
atgctcgcgatcctgatcgcggccgtgttcgccgcggtggagctgttgcccggggacgcggcgaacgcgacctccgagcgtggggacagcgccgcggatgtcgcggcacgccgtcatctgctcggcctggaccggcccctgtgggaacgcttcgccgactggatgacgggtctgcccaccggcgacctgggcaccagcgcccgcggccagaaagtcaccgacctgctggccgacccctttcccaacaccctgctgctggcgacggtcgccttcgtcctcaccgccgcgctctcgctggcgctcggctgctggaccgccgcccggccgggctcgatgaccgaccggatcgtcggccacgccgccacctcggcgttcgccatccccgaattcgtcgtctccgtcggcctgctcatcgtgctgtcgctgtggacgggctggctgcccgccgtgaccctgaccggtgccgacggtgcccccgccacctggaccatgctgatcatgccggccctcgcgctggtcatcccgcagaccggatggaacaccaccatcgtgcgcggggcgctcgccgaccaggcggccaccccgcacgtcgaggccgcccagctcgacggcctgtcgccgcaccgcgtcatctggcgccacgcgcttcccggagccgtcccggccgtcgccaccggcctggccacctccaccgggatgctgctgggcggcgcggtggtggtggagacgctcttcaactacccgggcatcggcagtgtgctggccggcgccgtcgccaaccgcgacacccccctcatcgccggcgtcgtcgtctgcgccggcgccgccatcagcctggtcctgctggccgccgacgtcatccgcgcccgagtcctgggagcctcctca

SEQ ID NO: 5603 - DNA, 846 bp, Streptomyces avermitilis
  CDS (1)..(846)
atgagcgtcgccacgacgggccgcaggccggccacggccgacgggcgaggccgtgtgctgccccgcgtcacgcccgccatcctcctggtcctgctcgccctgaccggcccgtacctcgccgcccaccccctggacaagcccgtcaccgcccccttcgctccccccggcgacggggcgccgctgggcggggaccagctcggccgcgatgtgctcagccgactgctccacggcggcaccgccctgatcggcagcgccctcctggtcgccttcgtcgtcaccctgctggccgccctgatcggctgtttcgccgtcctgcaccccgtcgtgggacgcgccgtggagcggaccgccgacgtgttcatcctgctgccgcccgtcctgggcatcatgctcatcgcactggcctggcccggcggcggtcgatgggccgtcatcagcgcagccaccgtcctgggcatcccgtacgccgtacgcgtcgtcgcaggcgccgccgcccccctggccaccgccggatacgtcgaagccgccctggcgcgcggggaaagcgtcacctacaccgccacccgcgaactcctgccgaacctgcggggcaccgtcctcgccctgttcggcctgcgcttcgtcgaagccgtctacgtcatctcgatggccggcttcctccagatcggcccccagcccccggccgcggactgggcgctgatgatccgcgagaacgccccgggcatcctcctcaacccgtgggccgtcgtcgcccccagcctgaccatcgccctgctcgccatcagcgtcaacctcgcggccacctccctcgcgccccgctccgcacgcaaggcggtgaccaccccg

SEQ ID NO: 5604 - DNA, 1584 bp, Streptomyces avermitilis
  CDS (1)..(1584)
gtgaccacgcccacccccgctccggccaccggccacacccccgacacccctgcctccggcgcggccggaacacccgcgaccctggtgacggcgaccgacgtcggcatccgcatccccgacggtcccgtcctcctgccccccaccagcctgaccgtccgcgccggcgagatcaccgccctgaccggggcctccggttccggcaagaccactctgctgcgcgccctgatcggccacctgcccgcccgagccgcactggcctgcaccgcgctggacgtcctcggccaccacgtccccggcctctccccggcagcactgcgtgcactgcgccgcagcaggatcgcctacgtcggccaggaccccggctccgcgctcaacccgcgcatgacgatccgccggctcatcgccgagaccgccacggacgccggcgaccacgtcgtgcccgacctgctgcgcgaatgccgcctccccaccgtggacggattccccgaccgaaggcccaccgcgctctccgggggccagcagcgccgcgtcgcgctcgcccgcgccctcgcccgtaccccggacatcctgcttctggacgagcccacggccggactcgacgccgccctgcgcgacgacatcgccgacctgctgcgccacctggccaccgcacgcggtctggccatcgtcatggcctgccacgacccgaagctcgtcgacacctgcgccgaccacgtcgtacgcctgaccgcccccgcacggcccgcctccgtggcgcctgtctccgtggcgcctgtctccgcggcgcccgcccccgcaccgccccgcgtcccgggccggcgcaggccggcaccggcaccggtggtggcggcaggcccggcgagcgccgcggacgaggggatcgccgcacggtcggtcagcgtggtgttccgcggccgatatggcgtacaacaggctctcgacagcgtcgacttcaccgctccgcccggctcggccaccgggatcgtcgggccttccggctcgggcaagaccaccctgctgcgggtcctggccggcctgcaccgccccgactccgggacgctcaccctcgaagggcagccgctcgcccacaccgcccgcgggcgcaggcccgaacatcaccggcgcatccagttcgttccgcagaatcccctcgccgccctcaacccgtcccgcaccgtcggcgccgccctgacccggccccttcgccggcacacccgcctcgccagggcggagatacccggccggatcaccgcgctgctcgaacaggtggaactgcccgccgacttcgcccgccgctacccggccgaactctccggcggacagcgccagcgcgtgtccatcgcccgggccctcgccgccgagcccgacgtcctgctctgcgacgagatcacctccgcgctcgacccggacaccgccgtcgccgtcatggaagtcctgcgacgcctgcggacggaacgcgacatgaccgtcgccctcgtcagccacgagatacacctggtggccgcgtacaccgacaccgtgcacctgctcgacgccggacgggtcaccgcgtacggacccaccgcggcactcctcccgacggcc

SEQ ID NO: 5605 - DNA, 1194 bp, Streptomyces avermitilis
  CDS (1)..(1194)
atgtccgccacaccgccgcttcccctgctcaaacgcctgcccccggctgtctgggtggccgtgacctggtgcgcgagcacgctgttcacgctcctgacgaccgtcaggttcccgggcgagacggagccgggcaagtggcccgcggcgcagctgtaccgctgggacggcctgacgttcctggtgctggccgccgccctggtcctgacgggcagccgccggctgcccggacggcccctgaccgccctcgccctgctgctcaccgccgccggactggtcaccaccaccctgggcgtgggggaggtcccgctggcccagttcctggtggtcgacgtcgccctgtacttcatcgcggccggccaccgacgccgcaccggcgtcatcgccctctccatggcgctcgccatgctggtgacatggatggccgtacgcctcctgagtagctgggacgtcggcatgtcggccgaactggccgtcgccctcgtgaccgtcatcgcctggctgctcggcaacgccacgcaccgcacccgcgagtacgccgacaagctcagcgcccgggccgccgaacaggccgtcaccgccgaacggctgcgcatcgcccgcgagatgcacgacatggtcgcccacagcatcggcatcatcgccctccaggcgggcgcggcggcccgggtcgtcaccacccagccggaggccgcgcgcgaggcgatgacggccgtggagaacacgggccgcgaggcactgtcggggctgcgccgcatgctgggcgccctccgccaggccgaccacggcgaggccccggaggcggcgggtctcgcggacgtcgacggcctcgccgccgcgacgacggccgcgggcgtccgcgtcgacgtccgccgcctgggcgaacgccgtcaactcccgccggacatcgacctgtccgccttccgcatcatccaggagtccgtcaccaacgtcgtacggcacgccgccaccgactcctgcgaggtctccatcgactacggcgacgacgaccggctctccatcgaggtcgccgaccgcggccgtggcagcggcacccgcaccgacaccgggttcggcctgtccggcatgcgtgagcgagtcgccctgctgcacggcgagttcaccgccggcccgcgccccgagggaggcttccgggtgacggtccgcctgcccgtcccggcgcctgcggcggcacga

SEQ ID NO: 5606 - DNA, 717 bp, Streptomyces avermitilis
  CDS (1)..(717)
atgagcgccgtccgcgtcgtcctcgccgacgaccagcaactgatccgtacggcactgcgcatggtcatcgccgacctcgcggacatggacgtggtgggcgaggcggcgaacggcgaggaagcggtacgcctcgccgacgaactccgccccgacgtcgtcgtcatggacatccgcatgcccggcacggacggcatcgaggcgacccgccggatcacggaggcccccggtgacgtccgcatcctcatgctcaccaccttcgacgacgacgactacgtctacggggcgctgcgcgcgggcgcgtccggattcctggtcaaggacatgggtctcgacgacatcctggcggcggtgcgggtggtggcggcgggcgacgcgctgatcgccccgggcgtgacccgccggctgatccaggacttcgtcgccagtcccgaacagccgcgcgcccggcgcgagttgaccgaaatcacggaacgggagcgggaggtcctgaccctcgtcggcacgggcctgaccaacacggagatagccgagcgcctgttcatcagcgtggcgacggcgaagacgtatctgacccggctgctggcgaaactggacgcgcgggaccgggtgcagctggtgatcatcgcctacgaggcgggcctggtggccccggctcgcggcgggcggtccgacgatcaccggggagcgggcggtgcggtcacgccgttacggcgccga

SEQ ID NO: 5607 - DNA, 270 bp, Streptomyces avermitilis
  CDS (1)..(270)
atgcgcgagtacgacctgagcaacgcccgctggcgcaagagcacgtacagcaacggcgaaggcggcgagtgcgtcgaggtcgcgtacgacttcatcggcgccgcccgctggcgcaagagcacgtacagcgacgacaacggcggcgagtgcgtcgaggtcgccgacggagtccccggcgtcgtcccggtccgcgacagcaaggtgccggacggcccggtcctcctcatcggctcggcctcctggacggatttcatcggcgccgtaacggcg

SEQ ID NO: 5608 - DNA, 831 bp, Streptomyces avermitilis
  CDS (1)..(831)
atggccaacggttcgcgacaggcggcgtgggagttcttcggagcggagctgaaacgacgccgggaagacgcgggattcacccaggtggagttgggatcacgggtcttcgtctcgggcggctacatcggacagttcgaacaggccattcgcaaaccgcagttggatgtggcacagcggatcgacgagatcctgcaaaccgacggttttttcgaacgcacatggcgaaagctgattgacgacaagcggtacgcggattacttcgcggaggttgtggagctggagcgggcggcgacgaagatctgtcagttcgctccgtcggtgatcccagggttgttgcagacggccgcgtacgcgcgggcagtgaccatcgcggccaacccgttcgtcaccgacgagtatgtggaagagaaggtctccgcccgattggagcgggcccgcatcctcaaggacgctacaaggcccgagtattgggcgatcctgcacgagaacgtcctgcgagtacccgtgggaggccccgcagccatggtcatgcagctggagcacattgctgcgctggcggacgggcggagggtgctggtgacggtggtcccccgcgaggagggggcctgcgcgtcaatggcggcgatgatgcagctcatggagttcgacgacgctcccccaaccctctatacagagacgtcgttttcgggcgaactgctggacgacccggcggtggtgaagcgagcgcagcgcgcatacgatctgctcaggggcgccgcgctgtcgccgaagacgtccctagccctgatcgaatcggcggctgaggactacagacgatgcgcgagtacgacc

SEQ ID NO: 5609 - DNA, 225 bp, Streptomyces avermitilis
  CDS (1)..(225)
ttgcagaacccgcagaacccgccgatcggctcgtacgccgtcgacaccagaaacggaagagtgggcatcgtcatggggtacgagggaccgtacgtacagctgaggccgtacggcggaggcagggagtgggacgtcgagccggaggccgtccggggcgcgacccaggccgagcggctcagcgcggcgacggcgtacgccaacgcacgcagccggggcgagctgcct

SEQ ID NO: 5610 - DNA, 753 bp, Streptomyces avermitilis
  CDS (1)..(753)
atgggcctcatgagtctgttccgcgacgacggcatcgtgctgcgcacccagaagctgggtgaggcggaccggatcatcaccttgctcacgcgtggtcacggacgcgtacgcgccgtggcgcgcggtgtgcggcggaccaagtcgaagttcggggcgcggctggagccgttctcccacgtggacgtgcagttcttctcgcgcgggagcgagctgatcgggcgcggcctgcccctgtgcacacagagcgagaccatcgctccgtacggtggcgccatcgtgacggactacgcgcggtacaccgccgggacggccatgctcgagaccgccgagcggttcaccgatcacgagggggagcccgccgtgcagcagtatctgctgctggtcggcgggctgcgcacgctcgcccggggggaacacgaaccccacctcgtgctcgacgccttcctgctgcgctccctcgccgtgaacgggtacgcgcccagcttcagcaactgcgcgaagtgcggaatgccggggccgaaccggttcttctcggtggccgcgggcggctccgtctgcgtcgactgccgggtgcccggcagcgtcgtaccctcggcgcaggcgctggtgctgctcggcgcgctgctgacgggagactgggagaccgcggacgcctgtgagccgcggtacgtccgggagggcagcggcctggtgtcggcctatctgcactggcacctggagcgcggcctgcgctccctgcgttacgtcgagaag

SEQ ID NO: 5611 - DNA, 855 bp, Streptomyces avermitilis
  CDS (1)..(855)
atggtcgtacgcgggatcctgggacgccagcgccgcgagtacagggcgccggagccgcacccgtccggtgcccgcgcgcccaaactccccggcgagctgatcccgaaccatgtcgcgtgtgtcatggacgggaacggccggtgggccaaggagcgcgggctgccgcgcaccgaggggcacaaggtcggcgagggcgtcgtcatggacgtcctcaagggctgtatcgagctgggcgtgaagaacctgtccctgtacgccttctcgacggagaactggaagcggtcgcccgaggaggtccgcttcctgatgaacttcaaccgggacgtcatccggcgccggcgggacgagatggacgcgctcgggatccggatccgctgggtaggccgcatgccgaagctctggaagtccgtcgtccaggaacttcagatcgcccaggagcagaccaaggacaacgacgccatgacgctgtacttctgcgtcaactacggcggccgtgcggagctcgccgacgcggcgaaggcgatggccgaggatgtcgcggccggccgtctcgaccccgccaaggtcagcgagaagaccatccagaagtacctgtactacccggacatgccggacgtcgacctcttcctgcgccccagcggcgagcagcgcacctcgaactacctgctctggcagtcgagttacgcggagatggtcttccaggacgtgctgtggcccgacttcgaccggcgtgacctgtggcgcgcctgcgtcgagtacgcctcccgtgaccgccgcttcggcggcgccgttccgaacgagcagctgctcgagatggagcgggacatgaaggggagcgaaggcgtccaggacgcc

SEQ ID NO: 5612 - DNA, 2394 bp, Streptomyces avermitilis
  CDS (1)..(2394)
gtgagacgaaccccccgtaaggcgaccgccgccggagccttgatggccgccaccgcctttctgaccgtcggcatacaggccgtcccggccaccgccaagcccgccgcgccgcaccccagccccctgcgcaccggcggccaggaagccaagctcacgcccgcgcagcacagcgccctgctcaagagcgccgcgaagaagaccacgacgaccgccgccaccctgggcctcggcgccaaggagaagctggtcgtccgggacgtcgtgaaggacaacgacggcacgctgcacacgcgttacgagcgcacctgggccggtctgccggtcctcggcggcgacgtcgtcgtgcacaccccgcccgcctcgctggccgccggcacggtgagcagcaccttcaacaacaagcgcaccatcaaggtcgcctccaccaccgcgtccttcaccaggtcggccgccgtgaccaaggcgctgaaggccgccaaggacctcgccgccgagaaggcgaccaccgacagcgcccgcaaggtgatctgggccggcagcggcgcccccaagctcgcctgggagacggtgatcggcggactccaggacgacggcacgcccagccagctgcacgtcatcacggacgccaccaccggcaaggagctctaccgctaccagggcgtcaagaccggcaccggcaacacccagtacagcggcacggtctcgctgagcacgaccctgtccgggtcgacgtaccagctgtacgacaccacgcgcggcggccacaagacgtacagcctcaacaacggcacgtcgggcaccggcaccctgatgaccgacgccgacgacacctggggcaccggctccggctccaacacccagaccgccggcgcggacgccgcctacggcgcgcagacgacctgggacttctacaagaacaccttcggccgcagcggcatcaagaacgacggcgtcgcggcctactcccgcgtccactacagcaccgcgtacgtcaacgcgttctgggacgacgactgcttctgcatgacctacggcgacggcaccagcagcacccacgccctcacctcgctcgacgtcgcgggccacgagatgagccacggcgtcacctccaacaccgcgggcctgaactacaccggtgagtccggcggtctgaacgaggcgacctccgacatcttcggcacgggtgtcgagttctacgccgccaacagcagcgacgtcggtgactacctcatcggcgagaagatcgacatcaacggcgacggcaccccgctgcgctacatggacgagcccgacaaggacggcggctccgccgacagctggtactccggcgtcggcaacctggacgtccactactcctcgggcccggcgaaccacatgttctacctgctctccgagggcagcggctccaagaccatcaacggggtcacctacaacagcccgacctccgacggtgtcgccgtcgccggcatcggccgggccgcggccctgcagatctggtacaaggcgctgacgacgtacatgacgtccagcaccaactacgccggcgcccgcaccgccgccctgaacgcggcgaccgccctgtacggcgccagctccacccagtacgcgggggtggcgaacgccttcgcgggcatcaacgtcggcagccacgtcaccccgccgacgagcggcgtgacggtcaccaacccgggcagccagtcgtccaccgtcggtaccgcggtgagtctccaggtctcggccagcagcaccaacagcggctcactgacgtacgccgcgaccggcctgcccaccggcctgtcggtcaacagctccaccggcgtgatctccggcaccccgaccacggccggcacctacagcacgaccgtcacggtgaccgacagcaccggcgcgaccggcaccgcgagcttcacctggaccgtcagctccagcggaggcggcggcacctgcgcctccacccagctgctcggcaacccgggcttcgaatcaggcaacaccacctggaccgcgagcagtggagtcatcaccaactccagcagtgaagcggcccacgcaggctcctacaaggcctggctcgacggctacggctccacccacaccgacacgctctcccagtcggtgaccatcccgtccggctgcaaggccagcctgaccttctacctgcacatcgacacggcggagaccaccaccagcacccagtacgacaagctgacggtgaccgccggatcgacgaccctggcgacgtactccaacctgaacgccgcctccggctacacccagaagaccttcgacctgtcctcgctggcgggcaccacggtcgccctcaagttcagcggtgtcgaggactcgtcgctccagacgagcttcgtcatcgacgacacggcgctgacgaccagc

SEQ ID NO: 5613 - DNA, 414 bp, Streptomyces avermitilis
  CDS (1)..(414)
gtgacaaccgctggatcgcccgttcggggccgctccacccggcagcgtgccgccgtggcggcggcgctcgacgaggtggacgagttccgcagtgcgcaggagctccacgacatgctcaagcacaaaggcgactccgtagggctcaccaccgtgtaccgcacgctgcagaacctcgccgacgcgggcgaggtcgacgtgctgcgcacctccgacggcgagtccgtctaccgccgctgctccagcggcgagcaccaccaccacctcgtctgccgcgtctgcggcaaggcggtcgaggtcgagggcccggccgtggagaagtgggcggaggcgatcgcggcggagcacggctatgtgaacgtcgcgcacacggtggagatcttcggtacgtgcgcggagtgcgccgcggcgaagagc

SEQ ID NO: 5614 - DNA, 894 bp, Streptomyces avermitilis
  CDS (1)..(894)
atgaccttcctcgactacgccttcatgcagcgggccctgctcgccgccgtcctcgtgggcatcaccgcgcccgccgtcggcatctacctggtgcagcgccgccaggccctgatgggcgacggcatcggccacgtggcgatgacgggcgtcggcctcggcttcctgctgtcctggtccccggtgtggatggcgacggccgtctccgtgctcggcgcggtcctcatggagctgatccgctggtacggcaaaacgcgcggcgacatcgcgctcgcgatgctcttctacgggggcatggcgggcggtgtgatgctgatcaacctcgcgccgggcggcagcaacaccaacctcatgtcgtacctcttcggctcgctcacgacggtctcgcaggaggacgtgacggccatctgcctgctggcggccttcgtcctgctcgtcaccctcggcctgcgccggcagttgttcgcggtcagccaggacgaggagttcgcgcgggtgaccggccttccggtgcgcgccctgaacctgctcacggccgtcacggcggcggtcaccgtcacggtcgccatgcggatcgtcggcctgctgctcgtctccgccctgatggtggtgccggtcgcggccgcgcagcagctcagccggagcttcgccgccaccttcgccatcgcggtggcgatcggggtgagcgtgaccatcggcggcacggtgaccacgtactaccggaacgtgccgcccggcgcgacgatcgtcctgctggccatcggcgcgttcatcctgctgacggcgctggcgacaccactggcgcgccgcagggcacgggccgccgcacaggagaccggcgacccggccgagtgcacgattccggccacccgtagcccggaacggaaggtcggcgtc

SEQ ID NO: 5615 - DNA, 810 bp, Streptomyces avermitilis
  CDS (1)..(810)
atggacggtgtgggcggcatggacggcgtggacggcataggcggtgcgaacgaccccgtcatatccctgcgcggtgtacgcgccgagctgggctcgcgcccggtgctgcgcggcatcgacctcgccgtgcaccgcggtgaggtcgtcgcgctgctcggcgccaacggttccggcaagtccaccgccgtacgcagcatcatcggccaggtaccggtcagcggcggcgagatcgagctgttcggcaccccacgccgcggcttccgcgactggaagcgcgtcggatacgtgccgcagcgcaccacggcggcgggcggcgtgcccgccacggtgaccgagatcgtcgcctcgggccggctctcccgcgcccgcttcggcatgctgcgcaaggccgaccaccaggccgtgcggcgggccctggaactcgtcggcatggccgaccgcgccaaggactccgtcgacgcgctctccggcggccagcaccagcgcgtgctgatcgcccgcgccctcgcctccgaacccgaactcctgatcatggacgagccgatggcgggcgtcgacctggccagccaggagatcctcgcggcgaccctgcgcgagcaggtgtcccggggcacgagcgtgctgctggtcctgcacgagttgggccccctggagccgctgatcgaccgcgcggtcgtcctgcgcgacggctgcgtcctgcacgacggcccgcccccgcaggcggtcggccagcacgcgctgcccggccacgaccacgtacacccgcacgcggctcacgacgccgaaccgatccggacgggactgctgagc

SEQ ID NO: 5616 - DNA, 960 bp, Streptomyces avermitilis
  CDS (1)..(960)
atgaacgtacgacgacgcctcatacccgggaccgccgtggccgcgaccacccttctcggtctcggcacgctctccgcctgctcggactcgaccgcggccgacggcgggaacggcggaaagctcgacgtggtggcgtcgttctaccccatgcagtatctcgccgagcagatcggcgggaagcatgtgcgggtcaccagtctgacccagcccggccaggagccgcacgacctggagatcagcgcccagcagaccgtgcagctcgagaagtcggacgcggtcctctacctcaagaacctccagcccgccgtcgacgacgccgtcgcgcagtccggggtcaggacgaagatcgacgccgcgtcgctgaccacgctggagaagcacggcaacgaggtcggcgggcacgcggccgcgcacgacgacaccaagggcgaggagtccggcggcacggacccgcacatctggctcgaccccgtgaagtactccgaggtcgcccagggcgtcggcaaggccctcgcgaaggccgaccccgagcacgccgcggactaccggaagaacaccgccgcgctggtcgagaagctggacggcctcgacacgcggtacgcggacgggctgaagaacaccgggaccaaggtcttcatcaccacccacgccgccttcggctacctcgccgagcgctacggcctcaccgaggaggccatcagcggcctggacccggagtcggagcccagcgggaaccgcgtgaaggagcttgagaagatggcgcaggcggacggcgtctcgacggtcttctacgagacgctcgtcagcgacaagaccgcgaagaccgtcgccaaggacgcccggctcaggacggacgtcctcgacccgatcgagggcatcaccgagaagtcccggggcaccgactacttccaggtcatggagtccaacctcaaggcgctgcggacagccctgggtgccaag

SEQ ID NO: 5617 - DNA, 1380 bp, Streptomyces avermitilis
  CDS (1)..(1380)
gtggccgccgacaagatcgacaccatcgtcagcctgagcaagcgccgtggcttcgttttcccctgtagtgagatctacggtggccagaaggccgcctgggactacggcccgctcggcgtcgagctcaaggagaacatcaagcgccagtggtggcgttacatggtcacctcccgtgaggacgtcgtcggtatcgactcgtcggtgatccttgcgaccgaggtctgggtcgcgtcggggcacgtcgccaccttctccgacccgctcaccgagtgcacctcctgccacaagcgctaccgcgccgaccacctggaggaggcctacgaggcgaagcacaaccgctccccggagaacggcctcgccgacatcaactgccccaactgcggcaacaagggccagttcaccgagcccaagcagttctcgggtctgctctccacgcacctcggccccacgcaggacagcggctccgtcgcctacctgcgccccgagaccgcgcagggcatcttcaccaacttcgcccaggtccagcagacctcgcgccgcaagccgccgttcggcatcgcgcagatgggcaagtccttccgcaacgagatcacgcccggcaacttcatcttccgcacccgcgagttcgagcagatggagatggagttcttcgtcaagccgggcgaggacgagaagtggcaggagttctggatgcaggagcgctggaactggtacaccggcctcggtctccgtgaggagaacatgcgctggtacgaccacccggccgagaagctctcgcactactccaagcgcaccgccgacatcgagtaccgcttccagttcggcggcaacgagtggggcgagctggagggtgtcgccaaccgcacggactacgacctgtccgcgcacgccaaggcctccggccaggacctctcctacttcgaccaggaggccggcgagcgctggactccgtacgtcatcgagcccgccgccggtgtcggccgcgcgatgctcgcgttcctgctggacgcgtacgtcgaggacgaggcgccgaacgccaagggcaagatggagaagcgcacggtgctgcgcctcgacccgcggctgtccccggtgaaggtcgcggtgctgccgctctcccgcaacccggagctgtccccgaaggccaagggcctcgccaccgcgctgcgccagcactggaacatcgagttcgacgacgcgggcgccatcggccgccgctaccgccgccaggacgagatcggcacgccgttctgcgtcacggtcgacttcgacacgctcgacgacaacgcggtgacggtccgcgagcgtgactcgatgaagcaggagcgggtctctctcgaccagatcgagggctacctcgccgcgcgcctgatcggctgc

SEQ ID NO: 5618 - DNA, 1050 bp, Streptomyces avermitilis
  CDS (1)..(1050)
atgatccgtcggaagctgcgcctgctcgccgtcgcgctgaccgcagccgtcctgaccccactgtcgatcgccaccgcccccaccgcatcggcggccgacacctgcgccgtgaagtcccgcccgtccggcaaggttctccagggctactgggagaactgggacggctcttccaacggagtgcacccgcccttcggctggaccccgatcaccgactcccgtatcgccgcgcacggctacaacgtgatcaacgccgcgttcccggtcatccgctccgacggcaccgcgctgtgggaggacggcatggacacgggcgtgaaggtcgcgacgccggccgagatgtgccaggccaaggcgtccgggcagacgatcctgctgtccatcggcggggctgcggccgggatcgacctcagctcgtccgccgtcgccgacaggttcgtcgcgacgatcgtccccctcctgaagaagtacaacttcgacggcatcgacatcgacatcgagacgggtctcgtcggcagcggcaacatcggccaactctccgcctcgcaggccaacttgatccgcatcatcgacggggtgctgggccagatgccgtccaacttcgggctgaccatggccccggagaccgcgtacgtcaccggcggcagcgtcgcctacggctcgatctggggcgcgtacctgccgatcgtcaagaagtacgccgacaacggccgcctgtggtggctgaacatgcagtactacaacggcagcatgtacggctgctccggcgactcgtactccgccggcaccgtgcagggcttcaccgcccagaccgactgcctgaacaaggggctggtcgtccagggcaccaccgtcagggtgccgtacgacaagcaggtcccgggtctgcccgcccagtcgggcgccggaggcggctatatgtcaccgagcctcgtctcccaggcctggcggcactacggcagcggcctcaagggcctgatgacctggtcgatcaactgggacggctcgaagaactggacgttcggcgacaacgtgaaggcgctgcaaggccgt

SEQ ID NO: 5619 - DNA, 1014 bp, Streptomyces avermitilis
  CDS (1)..(1014)
atgcgcacccgccccctcggatccaccggcccccaggtctccgccctcggcctcggctgcatgggcatgtcctcgttgtacggcgaggccgaccgggccgagtccgtcgccacgatccacgccgccctcgaagcgggcgtgaccctgctcgacaccggtgacttctacgccatgggccacaacgagatgctgatcggcgaggcgctccgcacggcgcccgccggcctgcgcgaacaggctctgaccagcgtcaagttcggcgcgctgcgcggcccggacggcaactggatcggatacgacggccgccccgccgccgtgcagaacttcgccgcgtactcgctccagcgcctcggcgtggaccacatcgacgtctaccggatcgcccgggtcgaccccgacgtaccgatcgaggagacggtcggcgcgatcgccgagctggtggagaagggatacgtgaagcacatcggcctgagcgaggtcggcgccgagacgatccgccgagccgcggccaccgccccgatctcggacgtccagatcgagtactccctcatctcccgcggtatcgaggaccgcatcctgcccaccacccgggaactgggcatcgccataaccgcgtacggcgtcctctcccgcggtctgatctccggccacttcacccgcgaccggcagctggccgcgacggacttccgcgccttctcgccccgcttccagggggagaacctggaccacaacctcactctggtcgaggcgctgcggaagatcgccgagcagaagggcgtcagtgtcgcgcagctcgccatcgcctgggtgctgtcgcggggccagcggcacaacacggacatcgtgccgctgatcggggcccgtacccgggagcggctgtcggaggcgctgggcgcgctggaggtgacgctggacgacgccgacctgaacgcgatcgaggcggccgtaccggcggactccgccgcgggcgagcgctacccgcaggcgcagatggcgcacctcgacagcgagcgc

SEQ ID NO: 5620 - DNA, 585 bp, Streptomyces avermitilis
  CDS (1)..(585)
atggcaccgagtaccgagaccctgaccgccgagcgcatcctcgaagcgaccgaggaggtgctgcgccgccacggtccggcgaaggccacggtggtggacgtggcccgcgcgctcggcgtcagccacgggagtgtgtaccgccacttccgtacgaaggccgcactgcgggaggcggtgacccagcgctggctggaccgtacggccaaggcgctgtcgggcatcgtcgcggaggaccgtgatccgcaggagcggctgctggactggttctcggcgctgttcgccgccaagcgccacaaggcgggcgacgacccggagctgttcgccaccttcatggtgctgaccggtgagagcagtggggtcgtcgacgaccacatagcggacctgaccggccagatcgccgcgatcgtccgcgacggtgtggcccgtggcacgttcgcggcgtccgacccggtggtcgcggcccgcgccctcttccaggccacgggccgcttccacgacccgtgctacgcccgggagtgggaacagcccggcatcgaggccgagttcgacgcgctcctggagctggtactgcgggggctgcgggcc

SEQ ID NO: 5621 - DNA, 822 bp, Streptomyces avermitilis
  CDS (1)..(822)
atgaccgaccacacgaccgctcccggcgcgcaggcgcggccggagttcgacacctcggtgccgcactcggcccggatctggaactactggctgggcggcaaggacaactacgcggtggacgaggcggccggcgacgcctacagcgccgtgtaccccggcatcgtgaccatcgcccgcagcagccgcgccttcctgcgccgcagcatccgccatctggtcgccgaggcgggcatccggcagttcctggacgtcgggacggggctgccgaccgtggacaacacccacgaggtcgcccagggaatcgcgccggagtccaggatcgtctacgtcgacaacgacccgatgatcctcgcgcacgcccgcgccctgctccgctccaccccgcagggggcgacctcgtacgtggacgtcagtctgtacgagcccgaccgcatcctggcggccgccgccgagacgctggacctcacccgtccgaccgccctcatcctcagcggcatcctggggcacgtcccggactacgacgaggcacgctccatcgtccggcgcctgctggacggcctgccctccggcagctatctgtccgtcaacgacggctcccgggggaccgacccggactacgagcgagcccaggacggctacaacgagaccggcgcggtcccgtacttcctgcggccggtggcgcggatcgaggcgttcttcgacggcctggaactcgtggagccgggcgtcgtctccgtaccgctgtggcgtccggaggaatccggggccgacgcccccgcccccgccccgatcggtcagcacggcggcctcgcccgcaagccc

SEQ ID NO: 5622 - DNA, 846 bp, Streptomyces avermitilis
  CDS (1)..(846)
atgggacagcgaggacggcacgcggcgcccagggcaggaatgcagagagtccgccgggtggcggccgtggtgcttgccgccggtgcactggcatccgccggcaccagtgccgcgtttgccgacatgctcgaagacatccccctgagcggtgagcagaacatcgaccaggtcggggcgcagaacctggcctgcggcaactccgcccggctggtcaggctcaacgtcgcgcagatcgagcaccgcgaccgcgtctgcaccgatgacgacggccacaccggccacaacagcgcccacgccggcggggcccgggccgaggggggtaccacgctgggcccgcagggcaacaccgctcagacgggcaagcagaacctcgcctgcggcaactccgccgacctggtcaccgtcaacgtgaccggggacatgtactgggacaccacctgcgtggtcaccgacgacggccatcaccaccacggcggccaccagcagggtgcgcacgccgagggggcccgggccgtgggtggcaccagcgtggggccgcaggccaacaccgcccagaccggtcggcagaacctctactgcggcaactccgccgacgccctcaccgtcaacgtgatgggcaccatcagcaagcacaccacgtgcgccgccgccgaccgctcctcccacggttccggcgacaccgaccacggtcgggcctcggtcctgcccggccaggcggtcggcccggaggccaacgccgcccagaacggcaaccagaaccagacctgcggcaaccccggtaccggcgtggacgtccccctcggccggaccacacgccagaccagctgcaccgtccacgcaggtgcc

SEQ ID NO: 5623 - DNA, 1782 bp, Streptomyces avermitilis
  CDS (1)..(1782)
gtgcgcgcgggaaaagccaggtgcgtagcggttgcggtggccgtcgttggcggagtgatgtcggtggcctgcgggccggccggtgcggacactcctggagccagggcggagggaggaagcggcacgggggatgtgtttcagacgaacgtcgcgcaggaggggcgtcagaacaaccactgttccaacgtgaccggtgacgagacggtggatctgaccggcgggcggctgcaggggcgctgcgtgaccgaggacggctccttcaatgggttctccaaggtgcacaccggtcccgccgacgccaagggcgggggcgggaccacccggctcgcccagcagaacgtcgcgcagcgtggccgccagaacaacgactgcgccagccggaacacgttttcgctgacggcgagcggtgacaagatccaaagtaactgtgccgacgaagacacctccgtcagcgaccacacgtactcccaggggcgcggggcctccgccgagggccgctcgggcgggaacttcgaccagcagaacgtcgcccaggcaggtcggcagaacaacatctgcgacagccccgactatgtgttccccgacctgacgggcagccggttcgacaccgactgcacgaacaaggacgcctcggtgagccggcacacctcggacaagagcggtggcgcccaggcccgtggggcacaggcaggctcctccgaggtgcaggacatcgcccaggaaggccggcagaacaacttctgcgccaaccccaactccacggacgccgacccggtgtcggacagccgtgtcgacgccgactgcgcgaacaaggacgcctcgctgagcgagaaaacccggcacaagggcggtggcgcccaggccaagggaggagctctggcccaggagcagcagaacatcgcccaggaaggccggcagaacaacagctgcgccaaccccaacgtctccactctcgacctcagcggtgcgcggaccgacaccgactgcgtgaacaaggacgtctcccgcaccaagcacagtctggtcaagggcggcccggcccgcgccgagggcggttccggcgaagacgtgttccagcagaacatcgcgcaggaaggccgccagaacaacgcctgcgacaacgccaacgactcggacatcaccgcgactggtgggcggtccaagaaccggtgcgccacggtcgatggctccaagaaccgccacaccgtggagaccagccgtggcgccgcggccgtgggaggctccggcgttgcggacctgtcccagcagaacatcgcgcagtccggtcggcagaacaacgcctgcgccaacgccaacgactcggacatcaccgcgactggtgggcggtccaagaaccggtgcgccacggtcgatggctccaagaaccgccacaccgtggagaccagccgtggtgccgaggccgtgggaggccccagtgcggcggacctgtcccagcagaacatcgcccaggaaggccggcagaacaacgcctgcgccaaccacaacggcctgaacgcggacgtcaccggtgcccgccaggacacggcgtgcgtgacggtggaccgctccgtgaacgcgggcacgaagaagtccagcggcggtgcgagcgttgaaggcggctccagcgtggcggacctgttccagcagaacatcgcccaggaaggccggcagaacaacgcctgcggcaacaccaacaacctcaccctcaccgccaacggcggcagcactcagaaccagtgcgtcgccgtcgaccgttccgtcaacatcgggacgcaggaggac

SEQ ID NO: 5624 - DNA, 453 bp, Streptomyces avermitilis
  CDS (1)..(453)
atgacagcactccattggaaactggtcatcgacacgcaggacgccctctccctggcggacttctgggcggcggccctcgagtacgaggtggaggacaacagcgacctgatcgccggcctgctggcgacgggccggctccccgaggcggcggtcacggagcacgacggccgccgcgtcttccgcggcttcgcggccatccgccacccgcaggacccgcacgagaaggcgaccggcatcggccagggccggcgcatcctcttccaggacgtccccgaggccaagacggtgaagaaccgtctgcacctggacgtccacgccgaaccgggcggccgggacgcactcgtcgcgcgtctggagtccctgggcgccgaccgtctgcgcgaggtggaccagggaccggcgggacactggtggatcatgcgggacccggagggcaacgagttctgcgtcgcc

SEQ ID NO: 5625 - DNA, 321 bp, Streptomyces avermitilis
  CDS (1)..(321)
ttgctgcgcgagcggacgggcagcgcacgcggacagtacggacggacagtacggacggatgtgcgggcaggcatcggaccggatcgcagacaggtgttcctggacgctggaggcgtcatgccgcagatcaacacgagcaaggtcagccgctgggaccagcacggacgcgtgcacatcgtgcacgtccagcgggcgggggtgcagcgcgtgatcaggtgtggcacatgcggctggcgccagggggcgcagttcctgccgtggctgaaggcggaggaacacctcgcggaggcccatcaggcgacggtggacccgacgggggcg

SEQ ID NO: 5626 - DNA, 507 bp, Streptomyces avermitilis
  CDS (1)..(507)
atggcagtgaagcccgaagaatccgagaaatccgaagaagcagacttcacccccctgcgcccgcccacgctcctcgcactcccctcctatctcgcgggccatgtcgcccggatcggacaccgggcgctggtcgaggcgctcaaggagtacgacctgcggctcccgcacttcgcggtactggtggggctcggcgacttcggcccgctcccccagcacgaactggccgaccgcctcggcctcaaccgcagccatctggtcggttacctcgaccaggtcgagacgcagcggctcgtacgccgtgaacgcgacccgcgcgaccgccgccgccagcgggtcgccctcacctcggagggaacggagcggctgggcgagctgaaggcgctcgccggccgctcccagaccgagttcctcgacgcgctgacggagacggaacgggacaccctgatcggcctgatgcggcgcatcgtcacgcgggacgacgcggcgcaacaggcgatgagcacaccg

SEQ ID NO: 5627 - DNA, 789 bp, Streptomyces avermitilis
  CDS (1)..(789)
atgcccgactacggtcacgacctcctcttcggcgccgtcctcacccccgacgcccagaacccgcgcgcggtgctggagtcggcgcggctcgccgaccgctcgggactcgacctcgtcagcgtccccgaccatccgtaccggccggacttcctggacgcctggaccctgttgtccgtcatcgcggcgcacaccgaacgcgtacgggtcttcccgaacgtcgccaatctgccgctgcggcccccggccggcctcgcccgcgccgccgccgcgctcgacgtcctcagcggcggccgggtggagctggggctcggcgccgggggttactgggacgccatcgccggtgagggacagccccggcgtacccccggcgaggcggtcgaggcgctggccgaggcgatcgacgtgatccgcgccctgtgggcgagcgggggcgccggcgcgaccgtcgacggaacgcactaccggctcgacggggcccggcccggaccgcccgccgcgcatcccctcgggatctgggtcggcgccctgggcccccgcatgctccggctcatcgggcgcaccgccgacggatggctgcccagcgccacccgggtgccgcccgccgaactcgccgtggggcagcggatcgtggacgaagcggccatcgccgcgggacgggatccacgggcggtgcgtcgcctctacaacctgccgggaccggtaccggccgagccgctcgccgaactcacccccgcggttcgcgcgggaagtcgtcccggaggtgagggagttggtggcccgaggccgcgc

SEQ ID NO: 5628 - DNA, 1425 bp, Streptomyces avermitilis
  CDS (1)..(1425)
gtgaccgaaactctcacctcacccaccactcgctccccggtggcaccgcccgtgctcggcggactcggactcttcacggtgctgctcggtgcggcactgcccctcatcgacttcttcatcgtcaacgtggccctgccgaccatcggccgcgacctgcacgcgagcgagaccgtcctcgaactcgtcgtagccgggtacggagtctcgtacgccgttctgctggtcctcggcggccggctcggcgacctcttcgggcgccgtgagttcttcctcggcggcatggcggcgttcggtctgacctcgctggcgtgcggcctcgcgccgagcgcgtggaccctcgtcgcggcgcgtgtcgcccagggcgcggcggccgcggcgatgctgccgcaggtgctcgccaccatccagtccgcgaccgaggggccgcgccgcgccaaggccatgggcctgtacggcgcgaccgccgggctgtccatggtggcgggccagatcctcggcggcgtcctcgtggccgcggacatcgcgggcaccggctggcgctccgtgttcctggtgaacgtgccggtggtggtcgtcggtctgttcctggccgcccgtgccgtcccggagacccgctcgcagcgcccggagccggtggacggcccgggcacggtgctcctggccgtgtcgctgctgaccctgctggtgccgctgaccgagggccgggcggcgggctggccgctgtggacctggccggcgctggccgcgttcccgttcgcggcgtgggcgttctacgcggtggagcgccgggcggaccggcaggggcgtacgccgctcgtcccgccgagcctgttcgccctgacgtctctgcggcgcggtctggtgatgatcgtgccgttctccatcggcttcagcgggttcatgttcgtgatcgcggtggcgttgcagcgtggcgccggactgggtccggtcccggctgggctcgccctcgcgccgatggcggtggtgttcttcgccgtctcgctgtgcgggccgcggctggtggcccggtacggcacccgggtggtgaccgcgggcggcctgatccaggcggtcggggtgaccctgatcgtcctggccgccctgcggtcctggccggacctgggcgtgctggagctgctgccgggtgcggcggtggcgggcgcgggccaggcgctccagctgcccgtcctcttccggatcatcctgtccgaggtgccgccgacccgggcgggcgtgggcggcggcgtgatgatcaccacccagcagtcggggctggcgctgggcgtggcgacgctcggctcgctcttcctggccctggtgcccggctggggcatgcgggacgcgctggtgacgacgctcctggtccagctggccggggtggcactgacgacggcgctgagcctgcgtctgccgcgctcgatcagc

SEQ ID NO: 5629 - DNA, 900 bp, Streptomyces avermitilis
  CDS (1)..(900)
gtgcgggcggccgaggagcgggcccgcgcgacgcaggacaccccgcgggcacagcacacgcgggaggcggcgatccggcggcatgaactggccgccttcctgcgccaccggcgcgagcacatcacccccgagcaggtcggcctgccccggggccgtcggcggcgcaccccgggtctgcgccgggaggaggtcgcgcagctctccgcggtcggcgtcacctggtacacctggctggaacaggcccgggacatccaggtctcggtgcaggtgctcgacgcgctggcccgcaccctgctcctcgactccagcgagcgcgcccacctgttcaacctggccggcacggccgaccccgagcccggcgcgaactgcccgtcggtcaccgacgcccagcgtgccctgctggaacagctggagccgattccggcgtgcatccagaacagccggtacgacatcctcgcctacaaccggacctacgggctgctgctgtgcgacctcgacgccatcgcgccggtggaccgcaactgcatgctgctgtgctacacgaacgcggactggcaggcgtccatcgtccgactggacgacacgatgcggctcatggccgccaagttccgcgcctccatggccgaccatctcgccgagcccgcctggaagatgctgctcaagcggctgagcggcgagtccccggagttccgggaggcctgggagcggcacgaggtggtgagcgcgcgcagcaagctcaagcagttccgcaacgcccacgtcgggctgctctcgctgaaccacacggacctgtggctgggtccgcacaacggcccgcgcatggtgacctacgcccccgccgacgaggagtcgcgccgggggctggagaagcttcaggagatcgcggtggcccgggagggc

SEQ ID NO: 5630 - DNA, 1443 bp, Streptomyces avermitilis
  CDS (1)..(1443)
atgcccgagctcagtccccgccggcgtctgctggtactcgcgatctgctgcctcagcctgctgatcgtgagcctcgacaacaccgtcctgaacgtcgcgctgccctcgatgcagaaggaactgcacgccagcgtggccggcctccagtggacgatcgacgcgtacacgctggtcctggcctcgctgctgatgctggcgggctcgaccgcggaccgcatcggacggcgccgggtcttccggacgggactcgtgctcttcaccatcggctcggtgctctgctccctcgccccgaacctcgagtcgctcgtcgccttccgcatggtgcaggcggtcggcggttcgatgctcaacccggtcgcgatgtcgatcatcaccaacaccttcacggagccgcgcgagcgcgcccgtgcgatcggcgtctggggcggcgtcgtcggcatatcgatggccgcgggaccgatcgtcggcggcctgctcgtggactcggtcggctggcgctcgatcttctggatcaacctgccggtgggcctggtcgcgctcctgctcacctggcgctacgtccccgagtcccgtgcccccaaggcccgccgccccgacccggtcggccagctcctggtcatcgccctgctcggctccctgacctacgcgatcatcgaggcgcccagctccggcgccgccgagatcctcgccttcggcggcaccgcgctcgccgcgctgatcgccctcctgtggtacgagccccggcgcgccgaacccctcatcgacctgcgcttcttccgctccgtcccgttcagcggggcgacggtggtcgcgatcagcgcgttcgcggcgctcagcggcttcctcttcctctccacgctgtacctccagaacgtgcgcggtctgtccgcgctgcacgccggcctgtggatgctccccatggcggtcatgtgcttcgtctgcgcaccgctgtcgggccgcctcgtcggcagccgcggcccgcgcttctccctcctgacggccgggatcgcgatgaccgcgagcggggtgctcttcgccgcgttcgaggcggagacctccgacgtcacgctggtgatcggctacgtcctcttcggcgtcggcttcggcttcgtgaacgcccccatcaccaacaccgccgtctccggcatgccgcgtgcccaggccggggtcgccgccgcgatcgcctcgaccagccgtcagatcggcggcacgctcggcgtcgccgtggtcggcgcggtgctggcgtcgggggtgcggacgggcccgtaccgacaggtcttcgagtcggcggcccggcccggctggtggatcatcgcgggctgcggtctgtcggtactcgtcctcggcgcactgtcgagcggcgcctgggccagggccacggcccgccgcacggcacaacgcctggagtcgacggaggtacgggacgaggcgggggtgaacgcg

SEQ ID NO: 5631 - DNA, 1203 bp, Streptomyces avermitilis
  CDS (1)..(1203)
atgtccacgcccgcagccacgatggtctccccgttgcagatcggtccgcacaccgtccagccgcccgtcgtcctcgcccccatggccgggatcacgaacgcgcccttccgcaccctgtgccgggggttcgccgaaggccatggctgggagtccgggggccggccccccaagggcgcggccgatggcggcaagggcctgttcgtcagcgagatgatcaccacgcgggcgctggtcgagcgcaacgagaagaccatgcagctgatccacttcgacgcgaccgagaagccgcgctcgatccagctgtacggcgtggacccggcgaccgtcggcaaggccgtccgcatgatcgcggaggagggcctcgccgaccacatcgacctgaacttcggctgcccggtgcccaaggtgaccaggaagggcggcgggtccgcgcttccgtacaagcggaacctgctgcgggcgatcctccgggaggccgtcagcggggccgggaacctccccgtcaccatgaagatgcgcaagggcatcgacgacgaccacatcacgtatctggacgccggacgcatcgccgtcgaggagggcgtcaccgcgatcgccctgcacggccgcaccgccgcgcagcactatggcggcacggccgactgggacgccatcgcgcgcctcaaggagcatgtgccggagatcccggtcctcggcaacggcgacatctggtcggccgaggacgcggtgcggatggtgcgtgagaccgggtgtgacggagtcgtggtcgggcgcgggtgcctggggcggccgtggctgttcagcgacctggtggcggccttcgaggggcgaacggacgacagtgcgcgccccacgctccgtgcggtcgcggacgtcatggtccggcacgccaccctgctcggcgagtggatcggcgacgaggcgcgtggggtcatcgacttccgcaagcacgtggcctggtacctgaagggcttcgcggtcggctccgagatgcgcaagcggctcgcgatcacctcctcgctcgtcgaactctccgacggtctcgccgagctggacctcgaccaggcctggcccctgggcgccgacgggccccgcggccgcacgtccggcaacaaccgggtggtgctgccggacggctggctgaaggacccgtacgactgcgcggggatcagcgaggacgcggagctggacacctccggaggc

SEQ ID NO: 5632 - DNA, 1851 bp, Streptomyces avermitilis
  CDS (1)..(1851)
ttgcctctcttcacgcgctccaatcagacaccggacagggccggggcagccacggacgagggtctgccgtcggcggacgccgaggatgcgacgccggaggaaccggcggcaccgccgtccgacgccaccgccgggaagcccgagcccgagccggagggcgcgggggccgtggcacaggctgccccgcgcacccgccgagcccgactccgtgcccgccaccccgtagccgcccgcgttctctcctgggccgtgaccctgctcgccggtgcgctggtagtcgtcgcgctgctgctgcccaacaagcccgccgacttccggccctccgagttcgcccgtatcccggtggaggcgttgctcggggccgccgtgctcatcgcgctgccgcgcaggccgcggctgttcgcggcggtgctcggcgggctgagcctcggcgtgctcaccctgctgaacctcctcgacatcggcttcaacgaattcctcggccgcggcttcaacgtcgtactcgactggtccctcctcggcgacgcccagtcgtacctcaaggactcggccggcgaggcgggcgcgctcggcgccacggtcgccgtcgtcgtcctcgtgctcgccgtgccggccgtgatggcgtgggcggtcgtcaggctcggcaacctcatggcccggcacaccgccatcaccacccgggccaccctggtcctcagcacggtctggatgacctgcgcgagcctcagccttcaggtgggcggcgtgccgatcgcctccgagcacaccgccgccgtcgtccgggaccgcgcggcgcgggtgaaggcgaccatcagggacgagcgcgggttcgccagggaggccaaggccgacaccttcggcaatacccccggcagcgagctggtgcccgatctgcgcggcaaggacatcatgttcacgttcatcgagagctacggccgcagtgccgtcgaggacccgatcatgtcgcccggcgtcgacgccaccctcgacgccaagaccaaggaactggccaaggccggcttccacgccaagagcggctggctgacgtcggccacgtacggcggcagcagctggctgggccactccaccttcctgtccggcctgtggatcgacaaccagaaccgctaccgcaccgtcaccgcgggcgaccacctcaccctcaccagcgccttcaagaagaccggcgactggcgcacggtcggcatcatgccgggtgtccagaagggctggccggaggcgaagttctacggcctcgaccatctctacgacgcccatcacctcggctaccagggcccgaagttcagctggtcgacgatgcccgaccagtacacgctggccgcgttccagcgcctggagcacggcaggaagcacgacaagccgctgatgtcggagatcatcctgacctccagccaccagccgtgggcgcccatcccgaagacgattcccgaggaccaggtcggcgacggctccgtctacgacgccgtcgagaaggccggcaagaagcccgcggacgtcttctacaactccacgaaggtgaagcaggagtacggcaagtccatccagtactcggtgaccagcctcatcgactacgtggtgaagtacggcaacaagaacaccgtgctcgtcttcctcggcgaccaccagccgatggcccgggtcagcggcgacaaggccagccgggacgtgccggtcgcgatcgtcgcccacgacccgaaggtgctggacaagatcaccgactggggctactccgacgggctgcggcccgcgcacgacgccccggtctggaagatgagctccttccgcgaccgcttcctgacggcgtacggctccaccccgcgcccctcgaagggc

SEQ ID NO: 5633 - DNA, 1941 bp, Streptomyces avermitilis
  CDS (1)..(1941)
atgacggaccggcatcatctgctcgtgcacggcgggacgttcgccgcagtgggcgacggcggggacatcagcggggtgcggggcggcggttccggttcaccggacgggttgttcgtccgggacgcccggcacctcagccgctggcagctcaccgtcgacggcgcggtgcccgaggcgctctcgccggtcagggccggggacacggcccgctgcgtgctcgtaccgcgcggtggccgtcaggagccgcccgcgtacaccttcttccgagaacaggccgtcaccgagggcgcgttcgtcgagtcgctgcgcgtcaccagcaaccgcccggcgccgacgacggtccgtatcgcggtcaccgcggacgccgacttcaccgaccagttcgagctgcggtccgaccaccgcacgtacagcaaggccggcgcggtgcgctcccgccaggtcctcgacgacggcgtggagttcagctatcagcgcggcgagtggcggtccggtacgagggtcacctccgagcccgcccccgacggcgtggaggagacgggcacgggcgcccgtcgcctcgtctggacgctggacctcgaaccgcacggttccgcggagctgtcgctgcgggtcgccgcccgtccgcacggcgcggcgcacccggcggaggtgccggcctcgcccgccgacgccagtgcccggctcctcgcgctggaaggggagttcctgggcggcgtgcccttcccgacgggctggccggagctggccgcggcctgtgcgcgcggcctgtccgacctcgccgcgctccaggtcccggcgacgggcccggacggtgaggagctgcgcgtccccgcggccggcgccccctggttcctcacgctgctgggccgcgacgcgctgctcacctccctcttcgcactcccctaccggccgcagctcgccgccgccacgctgcccgcgctcgccgcgacgcaggcgaccgaggtcggcgtgggatcggtggcccagcccggcaagatcgtgcacgaggtgcggcacggggagctggcgcacttcgggcaggtgccgttcgggcgctactacggctcggtggacgccactccgctgttcctcgtcctgctcggcgcgtacgtcgaacagaccggtgacgtggcactcgcccgccgcctcgagcccaacgcccgcgcggcggtcggctggatgctcgaccacggcgggctcacctcccgcggctatctcgtctaccgcgccgacgggggcggcctcgccaaccagaactggaaggactcccccggcgcgatctgttccgccgacggcagccgggccaccggcgcggtgaccgcggcgggtgcgcaggggtacgcgtacgacgcgctgcgccgcaccgcccagctggcgcgcactgtgtggggcgacgaggtgtacgcggcgctgctcgaacaggcggccggggatctgcgcgaccgcttccagcgggacttctggatgcccgaacagggtttccccgcgctggcgttggacggcgagggccgccaggtggacgcgctcgcctcggacgcggggcatctgctctggtccgggctgctggacaaggagtacggcgaaatggtcggccggcgtctgctggaaccggacttcttctcgggctggggggtgcggacgctggccgcggaccaggcggcgtaccacccgttgtcgtaccaccggggttcggtgtggccgcacgacaacgcgctgatcacgctggggctcgcgcggtacgggctgcacgacgaggcccgtacggtcgcccacgcgctggtcgacgcggcgacggcggcgggccaccggcttcccgaggtcctcgccgggtacgggcgcgacacgcatgcggagccggtgccgtacccgcacgcgtgcgtgcgggagtcacggtcggcggcagcgccgttggcgctgctcacggcggtcgggggcgcg

SEQ ID NO: 5634 - DNA, 1293 bp, Streptomyces avermitilis
  CDS (1)..(1293)
gtgccctcgcgcggcctgtacccgcaccagtggtcatgggactcggcgttcatctcgatcggcctgcgccatctgtctcccctgcgggcgcagacggagctggacacgctgctcggcgcccagtggggcgacggccggatcccgcacatcgtcttcaacccctccgtgccgctggacgcgtacttcccgagccccgacttctggcgttcctcgaccgcggggcgcgccgcgggcgccccgcgcaccgtacagacctcgggcatcgtgcagccaccggtgcacgcgctcgcggcctggctggtgcacctgtccgaccccgggctgtcccggtcgcgcggcttcctgtcccgggtatacccgcacctcgcggcctggcaccgctatctgctgcaccggcgtgacctgggcggcggcgggctcgtgtcggtggtccacccctgggagcagggcatggacaacagcccgacctgggacgagccgctctcgcgcgtcaccccggccccggcccgctccttccgccgcgccgacctcgaccacggcgccgccgaggaccggccgacggatctggactacgggcggtatgtgcgcctggccaccgactaccgcgacggggagtacgccgacgggcgcggggagttcgcggtcgaggaccccgcgttcaacgcgctgctgatcgcgtcggagcacgcgctggcccgcatagcctgcgagctgggggcggccggcacggctcgtcacacgcgggcggagcgcctgacggcggccctggtggaccggctgtgggacccggcggaggggatgttcttctgccgggacgtgcgcaccggcgacctcgttcccgaacgaagcgtcgccgggctgatcccgctgctgctgcccgccctcccccgcgacatcgccgccgccctcgtaggtaccgcctgcgggccgcacttcggtctcggtgacaccacccggctcgtgcccagttacgacctcaccggtgaggccttcgatccgcaccggtactggcgcgggcccgcctggttcaacaccaactggctgctggagcgcgggctgcggctgcacggggagcgggggcgggccgacgcgctgcgggacgcggcgctgcggaccgccgacgcgtccgggttcgccgagtacgtggacccgtacaccggtgaggcgtgcggggcgctcggcttcagctggaccgccgcgctcgcgctcgatctgctgcacgagccgcacgagcccgacgagcccctcggacacgacgtgtcccccatgggcatcggcacgtttcggcacgag

SEQ ID NO: 5635 - DNA, 1224 bp, Streptomyces avermitilis
  CDS (1)..(1224)
gtgtgcatgaacggaagggccggacgagtgggcaatcaggccagcgccggggatctgctcgaactggtgcgcagcggtcgtgccacgacccgtggtgcgctccagcaggccacgggcctgtcgcgggccacggtcggccagcgcctggaccgcctcttccgggcgggctggctgcgcgagggcgcgggcggaccggtggactccccgctcggcggccgcccctcgatcactctggagttcgacgacgcccacgcggtcgtcctgaccgccgacctcgacacccgccacgcccgcgccgcggtcctctccctcaccggcgagatcctggccgagcaggccgggctcctggtcctgggcgacggcccggacgccgtgctcggcgagctcggccactggttcgccgagctgctgcggaaggcgggccggccggcggacgaggtgtgcggcatcgggctcgcggtccccggaccggtcgaccgcgacacgggccgggtcgtccagccgccgatcatgccgggctgggacggctacgacataaggggccgcctgggccgggccttcgccgagcacgcgcacggccgggcggacgtccccgtcctggtcgacaacgacgccaacctgatggcgtacggggaacagcgcaccgcctacccggactgctcggcgttcgcgctggtcaaggtctccaccgggatcggcgcgggcgtggtcgtcggcggcaccatctaccggggcatcgacggcggcgccggggacatcggccacatccgggtgcccgagggcaccgacgcgctgtgccggtgcggttcttacggctgcctggccgccgtcgcgagcgggggcgccgtcgccgcgcggctggccgaggcgggggtgccggccgcgtcgggctcggatgtgcgcgagctgctgaccgccgggcatcccgaggcggtggcgctcgcccgggaggccgggcgccgggtcggcgacgttctcgcgaccgtcgtgacgctgctgaatcccggggtcctgatgatcgccggggatttggccggaacacccttcctcacgggcgtacgggaactgctgtaccagcgggctctgccgcgctccaccgctcatctggacgtggtgacctcccggctgggggaccgggcggggctgatcggggcgggcgcgctggtcgtggagcacttgtacgcgccggagcgggtcgaggagcggctgctcgcgctgggcgtg

SEQ ID NO: 5636 - DNA, 2748 bp, Streptomyces avermitilis
  CDS (1)..(2748)
gtgtcggaaaacaaagatccccaggtagctgacgtagccgagagcggcgtcgcgggcgtgaagttcgtttatgacttcaccgagggcaacaaggacctcaaggacctcctcggcggcaagggtgcgaacctcgccgagatgaccaacctgggccttcccgtccctccgggcttcacgatcaccactgaggcgtgcaagacctacctcgacagtggcgaggagccggcggcactgcgtgacgaggtgagtgcgcacctcgacgccctcgaggcgaagatgggcaagaagctcggccaggccgacgacccgctcctggtgtccgtccgttccggtgcgaagttctccatgccgggcatgatggacacggtcctgaacatcggcctctccgacaagtcggtgcagggcctggccaagcaggccggcgacgaccgcttcgcgtgggactcgtaccgccgcctcatccagatgttcggcaagacggtcctcggcgtcgacggcgaactcttcgaggacgcgctggaggcggcgaaggcggccaagaaggtcacgatcgacacggacctcgaggcggccgacctcaagaggctcgtcaccaagttcaagaagatcgtcaagaccgaggcgggccgggacttcccgcaggacgcgcgcgagcagatggacctcgccatccacgcggtcttcgactcctggaacaccgaccgcgccaagctctaccgccgtcaggagcgcatcccgcacgacctcggcacggcggtcaacgtctgttcgatggtcttcggcaacctgggccccgactcgggcacgggtgtggccttcacccgggaccccgcctccggccaccagggcgtctacggcgactacctccagaacgcccagggcgaggacgtggtcgcgggcatccgcaacacggtcccgctcgccgagctggagcagatcgacaagaagtcgtacgaccagctgatgcagatcatggcgaccttggagaaccactacaaggacctctgcgacatcgagttcaccatcgagcgcggccagctgtggatgctccagacccgcgtcggcaagcgcacggcgggcgcggccttccggatcgcgacgcagctggtggaccagggcctgatcgacgaggcggaggcgctccagcgggtcaacggcgcccagctcgcgcagctgatgttcccgcgcttcgacgaccaggcgaaggtcgagcagatcggccggggcatcgcggcgtcgccgggcgccgcggtcggcaaggcggtcttcgactcgtacacggcgatcaagtggtcgcgttcgggcgagaaggtcatcctgatccgccgggagacgaacccggacgacctggacggcatgatcgcggcggagggcatcctgacctcgcgcggcggcaagacgtcgcacgcggccgtcgtggcccggggcatgggcaagacctgtgtgtgcggtgcggaggagctcgaggtcgacacgaagcggcgccggatgacggctcccggcggtgtcgtggtcgaggagggcgacgtcgtctccatcgacggttcgagcggcaaggtgtacctgggtgaggtgccggtcgtgccctcccccgtggtggagtacttcgagggccggatgcacgcgggtgccgacgacgccgacgagctggtggcggcggtgcaccggatcatggcgttcgcggaccgcaagcgccggctgcgggtgcgggcgaacgcggacaacgcggaggacgcgctgcgggcgcgccgcttcggggcgcagggcatcggcctgtgccgcacggagcacatgttcctgggcgaccgccgggagctggtcgagcgcctgatcctcgccgacacggacgcggagcgcgaggagtccctcaaggaactgctcccgctccagaagaaggacttcatcgagctgttcgaggcgatggacggcctgccggtgacggtccggctcctggacccgccgctgcacgagttcctgccggacatcacggagctgtcggtccgtgtcgcgctcgccgagtcccgcaaggactccaacgagaacgacctgcgcctgctccaggcggtgcaccggctgcacgagcagaacccgatgctgggcctgcgcggtgtccgtctcggcctggtcatccccggcctgttcaccatgcaggtgcgggcgatcgcggaggcggcggcggagcggaaggccgcgaagggcgacccgcgggccgagatcatgatcccgctggtgggcacggtccaggagctggagatcgtgcgcgacgaggcggaccaggtcatcgcggaggtgcaggcggcgacgggtacggagctgaagctggccatcggcacgatgatcgagctgccgcgcgccgcgctcacggccggtcagatcgccgaggcggccgagttcttctccttcggcacgaacgacctgacgcagacggtgtggggcttcagccgggacgacgtggaggcctccttcttcaccgcgtacctggagaagggcatcttcggtgtctccccgttcgagacgatcgacaaggacggcgtgggcaagctggtccgcgacgcggcggtcgcgggccgggcgacgcggcccgacctgaagctgggcgtgtgcggcgagcacggcggcgacccggagtcggtccacttcttccacgaggtcggcctcgactacgtgtcctgctcgccgttccggattccggtggcccgcctggaggcggggcgcgcggcctcgcagtcggcgggaagcgaccaccgg

SEQ ID NO: 5637 - DNA, 1491 bp, Streptomyces avermitilis
  CDS (1)..(1491)
gtgacccgtcggctgctgctcagctacctcagcctcgccgccctcgtcctgctctgcctggagataccgctgggcttcgtctactcgcggggcgaacgggaacgggtcgtgggcaaggcgagggacgagtccgagtccgtgtccatgtacgcctcgctgtccatcaccgcgggccgggccgagcgggacctgcccgaccgggccgcccactgcgccgagcgcatcggcggcaaggtggtgatcgtggacgagtccggcggcctgctggccacgtcgcacccgctgtccaccgccgaggtgcggggactcgccgcccgccccggcatcgcggccgcgctgcgcggcacgtcgacggtggacgtacggacgtccacgatcggcggtgtgcagtacctgtccgtcgcggccccggtccggcacggcgcgtaccggcagggcgccgtgtggatcacgcttcccacgcggacggtgcactccagagtgcaccacgtctggctgctgctggcgctgggcgggctcgcggtgctcaccgcggtcgcggtcgtgggcttcgcgatcgcccgctggacgggccacccgatccgcgaactcgagcgcgccacacaccagttggccgacggcggcacggcgacgcccgtggcggtcaccacgggaccgccggaggtgcgcagtctggcggccacgttcaaccgcaccgcggcccgcctggaacatctgctggcatcgcagcgcgccttcgccggggaggcctcgcaccagctgaagaccccgctggcggcgctgcggctgcgcctggagaacctggagtccgggatggcgccgcacgcccgccccggcctgaccgccgcgatgacggagacggaccgactggcgcggatggtcgaggggctgctggcgatggcccgcctcgacgagagcgcggccacccgcgaaccggtcgacctggaccgggtctgcgccgaacggcaccgcacctggaccccgctgttcgagcagcacggcgtccggctggtcctgctcggcgaccccgccggacaggtgctggcggtgcccggggcgatcgagcagatcctggacaacctgctgtcgaacgcgctgagggtggcgccgtcgggctccgcggtcaccctcgacgtacgccgcccgccggccccggagcgccgcttccaccaccgcccgccggacccgtcccggccgtcgcgggtcgccctccacgtcatggacgagggaccgggcatgaccgaggaacagcgccgccgcgccttcgaccgcttctggcgcgcccccgacgcgcccaagggcggtacgggcctgggcctggccctggtccagcggctgacccacgcgagcggcggcgaggtcgagctgcggccggcgcggcgcgggggcctcgacgcggtggtccgcctgccgtccgcgcgaccgcccgcccacagccacccctccggcagagagggccggcgccgccgcggggctccggccgtgccggcc

SEQ ID NO: 5638 - DNA, 846 bp, Streptomyces avermitilis
  CDS (1)..(846)
atgggcctacgagtgctgctcatcgaggacgacgagacaatcgccgaaccactcgccgaagggctcgggcacttcggactgacggttgatcacgtcgccacgggcaccgagggcctgagaggtccgtacggggatgtcgtcctgctcgacctcgggttgccggacatggacggcatcgacgtctgccggggcatccggcaggtctccggcgtccccatcgtcatcctcagcgcgcggggcgaggaggccgaccgggtgctgggcctggagctcggcgccgacgactacttggcgaaacctttcagcatgcgggagctggtggcccgggtgcgggcggtgacacggcgaacacagcgcgcccgaccggcccacgagcccacaccgccgacaccgacatcgacaccgtcgccgcccccggcaccttcgtacgagcccacgtccgcccccgcgtaccaaaccgcacccccgccgtcgcacgaaccggcaccgcggccctcgtacgagcccccgccgcaccccgcccccggacccggcccgctcgtcgtggaccgcaggacccgccaggtctgggtcggcgagcagcccgtcgtgctcaccccgaaggagttcgaactgctcgcgctgctcaccgaggacccgggcgccgtgtactcgcggcagcagatcctcgaccgcgtgtgggatccgcactaccagggcccgaccaagacgctcgacgtccatgtcgccacgctgcggcggaagttgggccacccggcgtggatccagacgctgcgtggagtgggtttccggctggccgtgcacaccgagccgagcaggcggcggcatcagcaggtggcctacccg

SEQ ID NO: 5639 - DNA, 603 bp, Streptomyces avermitilis
  CDS (1)..(603)
gtgaaggaattgcttgaccatgcccggtcgttcaagcggcaggtcgatttcgagagcggtgaataccggaaactggccgaggggcaatatcccgaggcgctcttcatcacctgttcggactcacgggtcatacccgccctgatcacaggcgcacggcccggagagatattcgagctgcggaacgcgggaaacatcgttccgccgcacggacagcacggggcctcaggcgaggccgccaccatcgagtacgcgctggaggtgctcggagttcagaatgtcgtggtgtgcggtcactcacactgcggggcgatgggagcgctgaagtccggcgacgacctgtccatgctgccgggcgtggacgcctggctggagctggcccgcccggacctcgcgccgatgctcggcacggcctgcgacgacccgtcgctgcccgacgtggcgcagtgcaacatcgtcaaccagctctccacgctgcggagttacccggtggtgcggcagcggctggagacgggcctgctgcggctgcacggctggtactacgaggtcgacaccggccaggtgtacgagctggacgacgacgggcgcttccgggtgcacgccgga

SEQ ID NO: 5640 - DNA, 2115 bp, Streptomyces avermitilis
  CDS (1)..(2115)
atgagcgggtcgcatgcgcgtggccgcgttccggcgcacaccaggacggccgcgaagacggtgacgaagacggcgacgaagacggccacgaagaccgctaccgacgcggccacggagaccgtgccggagacagccacgaggaccgccccgaaggcgggggcgaaggctgacctcggtacggagatcaccgcctccctcgtcgtcttcctcgtcgccctgcccctgtgcatcggggtcgccgtcgcgtccggcgtcccggccgagctggggatcatctccggggtgatcggcgggctggtggtgggggccgcccggggcagcaccctccaggtcagcggacccgccgccgggctcgccgcgctcgtctcggagaccgtcctggagcacggggtggccatgctcggcgtgatcgtcctgggctccggcatccttcagatcgtcctcggactggtccggctcgggcgactgttccaggcgatctccctcgccgtcgtccagggcatgctggccggcatcggactgccgctgatgttcagccaggcgtacccgatggccgacaccaaggcccccggcacccccatcgagaacatggccgggattcccggactgctcggcgaaacggtcactcatccccaggccgccatcgccgccctgctcggcatcgtcaccatcgtgctgagctttctgtggaagaagatgccgggcccggtcaagaagatcccggccgcgctcgtcgccgtcggcatcggcatcgcggtggccgcgctgcccggcgtgaacgtgaagaccctccaggtcgggaatctgccggccgccgtgcggatgccgggacccgagcagttcgcggggctggcggacgcggcgatcatctcgtccgtcctcaccttcacggtcatcgcgtcggcggagagcctgttcaccgccgccgccgtggaccggatgcacagcgggccgcgcacccgttacaacgccgaactcatcgctcagggcgccggcaacaccgtggccggcatcctcggggcgctccccatcaccgcggtcgtcgcacgcagttcggcgaacgtgcaggcgggcgccacgacccggctctcccgcgtcctgcacggcctgtggctgctcgccttcgcgctgctgctgccccaggtcctcgcgctgatcccgatctcggtactggccggggtcctcgtgcacagcggctggaagctgttcgcgcccgaggagttcccgaagatgtggcgccaggaccggggcgagttcgccgtcatgaccctcaccacgctggtcatcgtggcgaccgcgctgctcgaaggcgtcctgatcgggctcgccgccgggatcgtgctggcggcgctgcgcatgtcgcagacggtcatcaggcagcacctcgacgaggacacggccaaggtcgtcatggccggcaacgccaccttcctgcggctgccgcaggtgatcgaggcactggaggccgccgccgcgtcgggcaggccacggatccggctggatctgaccggggtgacccatctggaccacgcctgccgcaaccaggtcgaggacttcaccgcgcagcagcgggggctggggctgcgggtggagctgctgatgccggggccggcgaaggcggggcccgcggagactgggcccgtcggccgggccggggcgatggcgtccgcgccgggttccgggggcgcggacacaccgtccgcgcgggattccggggccggggcgatgacctccgcgtcgggggcttgggcgcaagcggcggccccagggtcctggaccgaagcatcggcgccgggctcctgggaggaggcgaggacgtcgggctcttgggaggaggcaaggccgcctgcgtcgcccccggcgggcgcggcgggcgcggcggagtcgttccgtcagggctaccgccacgggtcgcggggctaccgcacagcgccgctccccaggcgccgccgcgccgctgcccccgtcgaggagagcgccccggtggaggcacccgccatggccgaggcgcccgcgacggccgaggcacccgccccggcgccgagccccaccgccgagtggttctacctggacacgagcctcagcgaccccgacgactgcgcgggacgcctaggc

SEQ ID NO: 5641 - DNA, 924 bp, Streptomyces avermitilis
  CDS (1)..(924)
atggccgactggaacacgagcgacatccccgatcagcgggggcgcgtcgtcgtggtcaccggcgccaacagcgggctcgggtacgtcacggcccgcgagctggcgcgcaagggggcgcgggtggtgctcgcgtgccggagcgaggcacggggtgccgaggccggggaccgactggccgccgaactgccgggcgccgaggtggagctcgggcggctggacctcggggacctcggctccgtaagggacttcgcggcctggttcccgtacgagcggctcgatctgctggtcaacaacgccggggtgatggcgctgccgtacgggacgacggcggacgggttcgagacgcagttcggcgtcaaccacctcgggcacttcgcgctcaccgggctcctcctgccgacgctgctcggcacgcccggcgcgcgggtggtgacggtctccagcggcatgcacgccctcgccaacatcgacatccacgacctcaacggcgagcgccgctaccgccgttggatcgcctacgcgcgctccaagaccgccaacctgctcttcacgcacgagctgactcgcaggctggcggcgcacgggtcggaggtgctcgcagccgccgcccatccggggtacgcggccaccaatctgcagaccgccggggtgcggatggaggggcgccgcgccgccgagcggatcgtggagctcggaaacagggtcctcgcgcagccggcggaggccggcgccctgcccgtcctgtacgccgcgaccgctcccgaggtgcgccccgactccttcaccggcccgtcgttcgcggggtggcgcggggcgcccgcgccgtcctggcgggcaccctggaccctcaacgacgcgatgggggagcggctttggtccgcctcggagcagctcacgggtgtgacgtacgaggcactgaaggtc

SEQ ID NO: 5642 - DNA, 348 bp, Streptomyces avermitilis
  CDS (1)..(348)
atgaccctggcacccgagacgaccgccctgaaggttcacctcagcctggggggagactggttgtccatctgcgacctgtccctgctgacgccgggacgcggggtggccgcgctgctgcccgacggctgccaggtggccctcttcctcgaccgcgcgggccgtgtgtacggcatcgacaaccgcgacccgttcagcggcgcggccgtcctgtcccgcggcctcaccggcacccaccagggccgcccgttcgtcgcctccccgctcctcaagcagcggttcgacctggagtcggggcagtgcctggacgacgagtcggtccgcatcgccacgtacgaggtgcgtacctcg

SEQ ID NO: 5643 - DNA, 2604 bp, Streptomyces avermitilis
  CDS (1)..(2604)
atgtccacgaccgcacttgtggggaccggccaccgccccacgatcgtgctcgtcggccatggcatggtcggccagcgcttcctcgaagcgctcgccgagcgcggcctgaccgccacgcaccgcgtggtcgtgctgtgcgaggagccacgccccgcatacgaccgggtccagctgacctcgtacttctcgggcacgactcccgacgaactctccatgacggacgcggagttcatcacggagcacggcatcgacctgcgcctcggcgatccggccgagacggtcgaccgggaggcgcggaccgtgacggcccgctccgggctggtgatcgcgtacgacaccctcgtcctcgccaccggttcctaccccttcgtgccgccggtccccggcaaggacgccgagggctgcttcgtctaccgcacgatcgaggacctgctcgcgatcgaggcgtacgcgaagtcacgggccaccacgggtgccgtcgtcggcggcgggctgctcggactcgaggcggccggcgcgctcaagggactcggactcacctcgcacatcgtggagttcgcgccgcggctgatgcccgtacaggtggacgccggcggtggcgcggcgctcctgcgcaccatcgaggacatggggctgacggtccacaccggcacgggtacgcaggagatcgtcaccggtgacgacggcgcggtgaccggcatgaagctgtccgacggctccgaactcgccacggatctggtggtgttctcggccggtgtacgcccccgggaccagctcgcgcgggactgcggactgccggtcggcgagcgcggcggcatcgcggtggacgcgcagtgccgtaccgaggacccgcacgtcttcgcgatcggcgagtgcgcgctcgcggcggacggccgggtgtacgggctggtcgcgccggggtacgagatggccgagacggccgccgcgacgatcgcctccgccgactcctccttcacgggagccgacctctcgaccaagctgaagctcctcggtgtcgacgtcgcctccttcggcgacgcgcacggagcgaccgccggctgcctcgacgtcgtctacgcggactcccgctcgggcacgtacaagaagctggtcatcggccgggacggcgaactgctcggcgggatcctggtcggcgacgcggacgcgtacggcaccctgcgcgcgctcaccggctccgtgccgcccgtctcccccgagcagctggtactgccggcgggcgggggcggcggcgtggccctcggaccctccgcgctgcccgactccgccgtcatctgctcctgccacaacgtcaccaagggcgcgatccgcggcgcggtcaccgagcactcctgcacgacgctccccgaggtcaagaagtgcaccaaggccggtaccgggtgcgggagttgcgtcaaggtcctcggccagctcgtcaacgacgagctgacggcgagcggcgtcgaggtcgaccacggtctgtgcggctgcttcacccagacccgcgaggagctgtacgagatcgtcctcgccctgcgcatcacctcgtaccggagcctgctcgaccggtacgggcgcgagggtgcgcgcggcggtgacggctgcgaggtctgcaagccgacggtcggctcgatcatcgcctcgctggccccgacgatcggcgcgaacggctatgtcctcgacggcgagcagtcggccctccaggacaccaacgaccacttcctcgccaaccttcagaagaacggctcgtactcgatcgtgccgcgcattcccggtggcgagatcacgcccgagaagctgatcgtgatcggcgaggtggcacgggacttcggtctctacacgaagatcacgggcggccagcgcatcgacctgttcggcgcccgggtcgaacagctcccgctcatctggaccaggttggtggacgccggcttcgagtccggtcacgcgtacgggaagtcgctgcgcacggtcaagtcctgtgtgggccagtcctggtgccgctacggcgtgcaggactcggtccggatggcgatcgacctggagctgcggtaccggggcctcaggtctccgcacaagctcaagtcggcggtctccggctgcgcccgtgagtgcgccgaggcccagtcgaaggacttcggcatcatcgccacggccaacggctggaacctgtacgtcggcggcaacggcggcgccaccccgcgccacgcggacctgctcgcccaggacctgtccgacgccgaactggtccgtctcatcgaccggttcctgatgttctacatccgtacggccgaccgtctggagcgcacatcggtctggctggagcggatccccggcggcctggaccacatccgcgacgtggtcgtgcacgactcgctcggcatctgcgaggagctggaatcactgatgacggcacacgtggcgaactaccgcgacgagtggaccgagaccatcaacgaccccgagaagctggcccggttcgtgtcgttcgtcaacgcgcccgacacccccgacccggtcgtcggcttcgtccccgagcgcgaccagatcaagcccgacctgccgctgctgaccatcggccaccgacccctggaaggaagcgcccagcga

SEQ ID NO: 5644 - DNA, 780 bp, Streptomyces avermitilis
  CDS (1)..(780)
atgcctgacatatcgctgaccatggtcgtcgtcctgtgtttcgccgcgctcgcggccggctggatcgacgcggtggtgggtggcggcgggctgttgctgctgccggcgatgctgctcgggctgccgggcggcaccccggccgcgtacgcgctcggcaccaacaaggccgtggcgatcgtcgggacggcgggtgcggcggtgacgtacgcccgcaagacccgggtcgatgtggggaccgccgtacggatcggcctggcggcgctcgccgggtccacggccggcgcgttcgtggccgccgggctgagtacggccgtgctgaagccggtcgtcatggtggtgctgctcggcgtcggcaccttcgtgatcctgcggcccgccttcggcatggccccgtcgaccgagcccgtctcggtgcgccggatgctcgcggcgatcggcctcgcgggcctcggcatcggcttctacgacgggctcatcggccccggcacggggacgttcctggtgctggccctgaccgcgctcctccacctcgacctggtgacggcctccgccaccgccaagatcgtcaactgctgcaccaacgcgggtgccctcgcgaccttcgcctggaagggcacggtgttctggcagctggccgcgctgatggccgtcttcaacctcgtcggcggcatggtcggagcccacacggcgctgaagaagggcagcgggttcgtccgggtcgtgctgctgaccgtggtgttcgcgctggtcgccaatctggcctacaaccagtggatcgcg

SEQ ID NO: 5645 - DNA, 618 bp, Streptomyces avermitilis
  CDS (1)..(618)
gtgcccaggttcggcaacatcgccatagcgtccgtgaccgtggccgccctctgctccggcgcatggctgctgggcagcggcgccgagagccacgcaccaccacagccgtcggccgcacaggcgtcggcccgtgccgatcgcgagcagtccgcggcgcccgcgctgccgccctccccgcccgaccgcatccgcatcccctcgatccgcgtcgacgccccgctgatgggcctcctcctcaccccgcagggcagcctggacgtaccgcccgccgagaagaagaacctcgcgggctggtacgaggcgggcaccacccccggcgagacgggcaccgcgatcgtcgccgggcacgtcgacaacgcggaggggcccgccgtcttctacgacctcggcgccctgaagaaaggcagctccatagaggtgcagcgccgcgacggagccacggccgtcttctccgtcgacgccgtcgaggtgtacgaggcccggaacttccccgacgagaaggtgtacggcgccgcccgccgccccgaactgcgcgtcatcacctgcggcggcggctactcgaagacgacgggttatcaggggaacgtcgtcgtcttcgcccatctgacgggcagccac

SEQ ID NO: 5646 - DNA, 507 bp, Streptomyces avermitilis
  CDS (1)..(507)
atgcgacgtaccgcccgtctgctgaccggcaccgcgctcgccgtcggcgccgcgggcctcgccgcgtcgcccgcgtacggcggcgacagcggcatcctggaggtgtatccgtccaccgtcgtacccggcggcaccatcacggcgaacacggcggcgtgcggcgcggccacgggtgacgccagcgcggtcggcgcgggcaccttcccgctggcgcccagcgcgcacgagcatgacctcatcgggcagttccgggtgccgccgagcgcgcagccggggacgtacgagatcgtcgtgaagtgctccggcggccggcaggtgacgggtgacctgatggtcacactgacctccaccaagcagcaggtgcagccgaaaggaagtgtgaagactggggtcggcggcgcactcggcaccgaccccgtacagaccgcggccggcgtggcggctcttgccgtcgccgccgcgggcggtacctggctcctgcatcgccgggcgagaggcgacgggatc

SEQ ID NO: 5647 - DNA, 660 bp, Streptomyces avermitilis
  CDS (1)..(660)
atgaagaccacaacgaccgtggagttgtcctccgcccccgtctctgcccctgttcctgttcctgttcctgctcccgccgccgctgcggccgacggcccggtccgggtcgccgtcctcgtcggcagcaaccgccagggccgcttcgggcccgtcgtcgccgagtggctgctcggtcaggtccgtgagcgcgacgacctcgtgcccgatgtcgtcgacgtggcggagattccgctgccgacgaccatgtccccgtcccccgcggcgaccgccgcgctcgccgaggtcacgccgaagctggccgcggccgacgcgttcgtcgtcctcactcccgagtacaaccactccttcccggccggcctgaagaacctcatcgactggcactacgccgagtggcgcgccaagccggtcgccctcgtctcctacggcggcgtctcggggggtctgcgcgccgtcgagcacctccgtcaggtcttcgcggagctccacgcggtgacggtgcgcgacacggtgtcgttccacggcgcgagcgcggcgttcgacgaacggggccggccccacgaccccgccggtccgtccgcggcggcgaaggtgatgctggaccaactggtgtggtgggcgcaggcgttgcgggaggcgaagcggacgaggccgtacggaggc

SEQ ID NO: 5648 - DNA, 675 bp, Streptomyces avermitilis
  CDS (1)..(675)
atgaacctgttcagccgcaactcctcgccccgccgcgccaccacccccgccgctccgacagtccctgccggttcgacggcccccgccggttattccgcccccattaccaccgtcacgccggatcccgccctggcggcgctgagcggagaatgggtcatcgaccccgcacacagcaggatcgggttctccgtacggcacgccatggtgacaaccgtgcgcggggctttcgcggaatacgaaagccgcctctacttcgacggccgcaacccggctcgttcccgggccgagatagtgctgtccaccgcaagcgtccaaaccggcgtggaacaacgcgacgcccacctgatcggccgcgacttcctggacgccgcgaggtatccgcacctgcgtttcgcgagtacggccgtacaactcgcgagcccggacgtctaccgcatggccggcgacctcaccataagaaacgccacctgccccgtcgtcctggagctcacctacatcggtcacgtcatggacccgttcggctatgagcgggtcggcttcgacggcaccaccacgatcaaccgttccgactggggcctgacctacaacgccagactggccgagggcggcgccatggtgagcgagaaggtccgcctccagttcgacatcgccgccatccgctccactccggccggc

SEQ ID NO: 5649 - DNA, 420 bp, Streptomyces avermitilis
  CDS (1)..(420)
atggccgctgaactgcaccttctcggaagagccgtcaagcagacccagtaccgtcagcaccgggcgctggacagtcgactggcgggcgtcggcacgacgctcgcccagtgggacgcgctgcgcgcgatcagccgctcaccgggggcgtccgcccgcgcgctggccgcggcgacgttccagagcgagcaggcgttcggcaccctcgccggccggctggtgacccagggcatggtcgaacgccgtccgggtcacggccggcgcatcgagcaccacctgaccccgttgggcgagaagaccctgaaggcggggcaccaggtcgccgaggaggtactggccgaatgcttcgcaccactgtccgaagccgagcgcacgaccttgctgaatctgctccggcgcctcggcgacgaggcgcccgacgaa

SEQ ID NO: 5650 - DNA, 747 bp, Streptomyces avermitilis
  CDS (1)..(747)
atgacttccgaactgcccttcaccctgtccgaggccggcaccggccggcccgtgctgatcctccacggcggcggcggcccggccaccgtcgcgcccctcgccggccacctcgcgcgaaccgcgcacaccctcgtccccacccacccgggctggaacggcaccccgcgccccgaccggttcgccggcgtcgacgacatcgccctcgcctacctgcgccacctccaggaccgggggctgcgggacgtgctcgtcgtcggctcctccctgggtggctggatcggcgccgagctggccgcgcgcgacgacctcggaatcatcaccgggctcgtcctgatcgacgccgtcggcatccaggtcgacggcgaaccggtcagggacttcttcgccctcgacgcgcgcggagtcgccgagtactcctaccacgaccccgaccgcttctacgtcgatcccgccgacatccccgccgggcaactcgccgcccgtcaggccaacatggcgaccatgcgcgcactcgcgggcgacccgtacatgcacgaccccaccctccgcggccgcctggcccgcgtcccggtccccaccctggtgctgtggggggagagcgaccggatcgtcacccccgcctacgggcgcgcgtacaccgatgccttccctgacgcccggttcgaagtcatccccaaggcgggccacctgccccagctcgaacagccggaagccaccttcgccgcgatcgacgcgtacctcgcgcgc

SEQ ID NO: 5651 - DNA, 1512 bp, Streptomyces avermitilis
  CDS (1)..(1512)
gtgatcgacaacgcggccgcggtgctcacgcaccaggccgcacgcctgggcctcaccgccgcccagggcaccagcgtgcgcgatgtcgtcgttgacgcggacggcggccagcatgtgcgctacgaccgcacataccgccacctccccgtgctgggcggcgacttcgtcgtccacctggcgccgaacggctcctaccgcggcgccgaccggtccaccaggcgcgccatctcgctcgccgacatcacgcccgccctctccgcgccgaaggccgccgacctggccacggccgcgctgcgcgccgcgaacaccggtgagctgctgaagaaggtgaccgccaagccccaactcgtcgtcgacgccctgcacggcgcgccgaaactggcctggcgcaccaacgtggtgggacaggactcgctcggcaacccggtcgcccgtacggtcctcaccgacgcccgctccggcaagcagatcgacgcctgggacagcatcgagacggcgacgggcgacggcaagtccctctacagcggcacggtcgcgctggagtcgacgctgtccggatcgacgtaccagctcaaggacgcgacgcgcgggaacacgtacacgggcgacgcggccaacaagacggatctgtgcatcctgggcatctgtttcagccgcgcccccgccaccctcttcaccgacgcggacaaccactggggcacgggggccgcttcggaccgctcctcggcggcggtggacgcgcagtacggcacgaacgagacgtgggactactacaagaacgtccacggccgcaacggcatcgccggcgacggcaagggctcctacaaccgcgtccactacggcagcaactacaacaacgccttctgggacgacagttgcttctgcatgacgtacggggacggtgacgggacgaccttcggcccgctggtggcgctggacgtggccggccacgagatgtcccacggcgtcacgtcgaagacggcggcgctgacctactcgggcgagtcgggcggcctcaacgaggccacctccgacgtcttcggcaccctggtggagttccacgcgaacaactcctccgacgccggtgactacctgatcggcgagaagatcgtccgctccggcttcggcaaggcggccctgcgcttcatggacaagccgtcgaaggacggcaactcggcggactgctggagcagttcggtggggaacctggacgtccactactcctcgggggtcgcgaaccacttcgcgtatctgctcgccgagggcagcggcgccaagaccgtcaacggcgtcagctacaactcccccacctgcaacggctccacggtgacgggcatcggccgggacaagctcggcgcgatctggtaccgggccctgacggtctacatgacgtcctcgacgaactacgccggggcgcggaccgcgacactgagcgcggcgaaggacctgtacggcgccggcagcacggagtacaacgcggtggccgccgcgtggagcgccgtgtccgtgggc

SEQ ID NO: 5652 - DNA, 441 bp, Streptomyces avermitilis
  CDS (1)..(441)
atggtcacggcgcacggcgatgatgacccggtgacactccccttcttcgtgtacggcaccctgcgccccggcgagcacaaccacgacctcttccttcgcggacgcacggagtccgaggagccggcccggctgcgggatgccgtgctctacgaggggcccggatacccgtacgccgtggaggagccgggcgccgggcccgtgtgcggggagttggtgaccgcgctgcccgaggcgtacggggaactgctcggggcgctggaccggctggaggagtacgtgccgggcgaccccggcaacctgtacgagcgggtggccctgcacgtcacccgcggcgacggcgcggccgtacgcgcctgggtgtacgtggccgcgcccgccgtcgcggcccggctacgggcgcgcggcacgctcatcgggggcggcgactggcacgcccgccgc

SEQ ID NO: 5653 - DNA, 1089 bp, Streptomyces avermitilis
  CDS (1)..(1089)
gtgcgggtgctccggtgtcgctcccctcgtgcgggtgaccgcgggggcggtggcccgtgcggcgtcacgggccgccggggcggcgcccctaacctcgccgccatgaccgacagcgacaaaagcgacatcactcgtcgacgggtcctcgcgctgggcggcgcggcagcaggcgccgccatggggctcggcatcagctcctgctcctcggactccggcgcgcgcacgtcgggttcaccggcgcacggtgcctccggcaccgacgtgtgcgtactcaactccagcgccacggaagggtcgtactacctggacggcgcgctgttccgccaggacatcaccgacggcaagaagggcgtcccgctcacggtgcggctgaccgtgcgcgaccggaccgggtcctgtgccccgctcggggacgcggccgtcgagatctggcactgcgacgccgcgggccactactccggttacccgaccgccggcccggccggcaccgcgcccgggccggccggcgggagcacggataccagcggcgcggacgaacggacgtatctgcgcggctaccggacgaccggcgacgacggcaccgtcgagttcacgacgatcttccccggctggtacccgccgcgcgccccccacatccacgtcaaggtgcacaccggcggcacgagcaccgaccgtacctaccagggcggcaaggtcaactggaccgggcagctcttcttcgacgaccgatacggcgacgaggtctacgggacgtccccgtacaccgagcacaccggtacccgcacccggctcaccgaggacacggtctacgcgggcggcggcgccagggacgggctgatggccgtcaccggggacgtggtcaaggggttcaccggcacgctgacggtcgccgtcgacccggaggaggagggcaggggcgccgacaccgtcggcgcggggagcccgccgcccggcggggcaccgagcgggtccccgtccaccgggacgccgagcgggccctcgcccaccgcgacgccgaccgtgacgcccggcggcacgccgaccccgcccccggacagcgccgcgagcgcctcggcgaccgccacgccg

SEQ ID NO: 5654 - DNA, 690 bp, Streptomyces avermitilis
  CDS (1)..(690)
atgggcctgccgcgcctgggaattcgcagaccgcgcctgccacgcacccgtgccgggcggcgccgggccgtacaggtcgtgatgctcgggtgcgtgctcgcgctgctccccgccacctggatgttcgcggtggcgggcgaccggctgcgcacgaccgaggacgcgccgcgcaccgaggtggcggtcgtcttcggcgcgggcctgtgggcgggcgagccgtcgccgtacctcgcgcaccggctcgacgcggcggcgaagctgtaccgggcgggccgcatcgaggtcgtcctcgtcaccggcgacaacagccgcgaggactacgacgagccggacgcgatgcgcacgtacctgacgcggcacggtgtccccgacggccgcatcgtcagcgactacgccggtttcgacacctgggactcctgcgtacgcgccaagaagatcttcggcgtgaaccacgcggtcctgatcagccagggcttccacatccgtcgcgcggtcgcgctgtgccaggcggcgggggtcgactcgtacggcatcggcgtcgacgccaagcacgacgccacttggtactacgggggcacccgggagatcttcgcggcgggcaaggccgccctggacgcggtgttcaagccggatccccggttcctcgggccgaaggaaccaggggtgggcgaggcgctggccgccgaccgg

SEQ ID NO: 5655 - DNA, 918 bp, Streptomyces avermitilis
  CDS (1)..(918)
atgacggcgtcgaacccttctcgcgacgagtcctcgttccgccccggcggtcggccgccacgggccgttcccctcgacagtacggcgcaactcatgaacgcgatcagcagtcagctcggcagtcagctcagtctcgtctcgctcaacggtgcccgtcggccggcgccgcccgcgctcgtcctcgtgggccacggcagccgcgacccgcgcgccctcagcaccgtccgcaccctgatcgaccgggtccgcgaactgcgcccgcacctgcccgtgcacctgggccacatcgagctgaacgagcccctgctgcccgacacgctcgcggctcttcaggacgacagccgggcagtcctcgtaccgctgctgctcagccggggctaccacgtcaagcaggacatccccgacgccgcggccgccgccacccgggtgcgcacccatgtcgccgccccgctcggcccgcaccccctcctcgtggagaccctgcacgcccgtctgaccgaggccggctggcgcacgcggatgagcgactcggcccgccgggcgagcgctgtcgtactcgccgccgccgggtcccgcgacccggagtcggccgtcgacacccgccgtatcgcccagctcctcgccgaacgcctcggcgttcccgtcgtccccgcctacgcctccgcggccgcgcccacggtgcccgccgccctgcgcgccctcgccgcccgcggccgccaccgggtcgccgtcgcctcgtacttcaccgccccgggccgcttcgccacggcgtgcgccgaggccgcgccctggatcgccgccgccccgctcggagcccacccggcgatggcccgcctcgtcctgcaccgctacgaccagaccctcgccgccaccggatccgccaccggccccgcgtccgtgccggccctggccacggcc

SEQ ID NO: 5656 - DNA, 1350 bp, Streptomyces avermitilis
  CDS (1)..(1350)
atggaaggcaccacgcccgggaccccgcaggcatacgaggactacgaggaaaccgtctcgtacgaggacgccgtcacgcgcgtcggctacgacgagagcgctgtcgagcgctgggccgtggagcccgacaaacggcccgggcgcaccgccttccagcgtgaccgcgcgcgcgtgctgcactcctccgcgctgcgccgtctcgccggcaagacccaggtcgtcaccccgggcacccgcagtcgcgcctgggacgccagcccgcgcacccggctgacccactccctggagtgcgcccaggtcggccgggagctgggcgccgccctcggctgcgaccccgacctcgtcgaagcggcctgcctctcccacgacctcggccacccgcccttcgggcacaacggcgaacaggcgctcaacgaattcgccgaggactgcggcggcttcgagggcaacgcgcagtctctgcggctgctggcccgcatcgagcccaagcgtttcgtccggtccgagggctcgggcgagctggtgagcgtcgggctcaacctcacccgcgccgccctcgacgccgccaccaagtacccctggccgcgtcgcgcccaccccacggaccccacgtcaccgaagttcggggtctacgaggacgaccgccccgtcttcgactggatccgcaagggcgcccccggccaccgcacctgcttcgaggcccaggtcatggactgggccgacgacgtggcgtactcggtgcacgacgtcgaggacggcctgcacgccggccacatcgaccccaactgtctgcacgccgagcccgagcggcaggcggtcttcgccgtcgccatcggccggtacgtgcccgccgacaccgaccccgccgagctggccgaggccctcgaccggctcctcgaccaggagtggtggccgcacggctacgacgggtcggccgtcgcccaggcccggctgaaggacgccaccagccagctcatcggccgcttctgcctggcggcggagggcgcgacccgggcggcgtacggcagcggccgcctgacgagatacgcggccgaactcgtcgtaccgcgcgcggcccgtctggagtgcgcggtcctcaaggcggtcgccgactggtacgtcatgcagcgcgccgaacaggagcggctccgcgccgatcagcgtgtcgtcgtcgccgagctggccgaggcgctcaccgcccgcgcgccggaggggctcgacccgcagttctgggcgctgttcgacgaggcggcggacgaccgggcacgcaagcgggtgatagtcgaccagatcgcctcactgaccgacgtcgcggcacggtcgctgcacgcgaggctcacggggcatctg

SEQ ID NO: 5657 - DNA, 1263 bp, Streptomyces avermitilis
  CDS (1)..(1263)
gtggtcgacgcggatcagacattcgtcatcgtcggaggaggtctggccggcgcgaaggcggccgagacgctccgcgcggaggggttcaccgggcgggtgatactgatctgtgacgagcgtgaccacccgtacgagcgcccaccgctgtccaaggggtatctgctcggcaaggaggagcgcgacagcgtcttcgtccacgaacccgcctggtacgcgcggaacgacatcgagctgcacctcggccagaccgtcgacgcggtcgaccgcgccgcgaagacggtccgcttcggcgacgacggcaccctggtgcactacgacaagctgctcctcgccaccggcgccgagccccgccgcctcgacatcccgggcacggacctcgccggggtccaccatctgcgacgcctcgcccacgccgagcggctcaagggcgtcctcgccgccctcggccgggacaacgggcacctcgtcatcgcgggcgccggctggatcggcctggaggtcgcggcggcggcccgcgagtacggcgcggaggtcaccgtcgtcgagcacgggccgaccccgctgcacggcgttctcggccccgagctgggccaggtcttcgccgagctgcaccgtgaacacggcgtccgcttccacttcggcgtccggctgaccgagatcgtcgggcaggacggcatggtgctggccgcgcgtacggacgacggcgaggagcacccggcgcacgacgtgctcgccgcgatcggcgccgccccgcgcaccggtctcgccgaggccgcgggcctgacgctcgccgaccgcgcccacggcggcggtatcgcggtcgacgggcggctgcgcacctccgaccccgacatctacgccgccggcgacgtcgccgccttccaccaccccctcttcgacacccggctgcgcgtcgaacactgggccaacgcgctcaacggcgggccggcggcggcgcgcgcgatgctcggccgcgacctcacgtacgaccggatgccgtacttcttctccgaccagtacgacctggggatggagtactcgggctgggcacccccggggacgtacgaccaggtggtgatccgcggggacgcgggcaagcggcagttcatcgcgttctgggtgaaggaggggcgggtgctggccgggatgaacgtgaatgtgtgggacgtcacggagccgatccaggccctgatccgctccggaaccccggtggacacggaggccctggcaaacccgcacgtcccactggagaccctgaccccc

SEQ ID NO: 5658 - DNA, 1896 bp, Streptomyces avermitilis
  CDS (1)..(1896)
gtggcaggacggatcaacgacgaggacgtgaaggcggttcgggacgcggtcccgatcgacgccgtcgtctccgagtacctccagctgcggaacgcgggcggcggcaacctgaagggcctgtgcccgttccacgacgagaagtcaccgtccttccaggtcagcccgagcaagggactcttccactgcttcggctgccaggagggcggcgacaccatcacgttcgtgatgaaggtcgaccacctcaccttctcggaggtggtcgagcgcctcgccgcccaggccggcatcaccctgcgctacgaggagggcggatacaacccctcccaccagcgcggcgagcgcatccgcctggtcgaggcccacaagatcgccgcccagttctacatcgagcagctcgacaccggctccgaggccgacacgggccgcaagttcctcgccgagcgcggcttcgaccaggccgccgccgcacacttcggcgtcggctacagcccccagggctgggaccacctcacccgctatctccgcggcaagggcttcaccgacaaggagctgctcctctccggcctctcccaggaaggccgccgcggccccatcgaccgcttccgcggccggctgatgtggccgatccgcgacatcggcggcgacgtggtcggcttcggcgcgagaaagctgtacgagtccgacaacggacccaagtacctcaacacccccgacaccgcgatctaccggaagtcccaggtcctctacggcatcgacctcgccaagaaggacatcgccaaggtcagccgggcggtcgtggtcgagggctacacggacgtcatggcctgccacctggccggcgtcaccaccgcgatcgccacctgcggcacggccttcggcaccgaccacatcaagatcctccgccggctgctgatggacaacggcagcgcacgcgtgatcttcaccttcgacggcgacgcggcgggccagaaggccgccctgcgcgccttcgaggacgaccagaagttcgccgccgagacctacatcgccatcgcacccgacggcatggacccctgcgagctgcgcctcgcgaagggcgacgaggcggtcgccgacctggtcgaaccccgtacgccgctcttcgagttcgcgctgcgccagatcgtcgcgcgctacgacctggagaccccggcgggccgcgccgccgcactggacgagtcggcgccgatcgtggcccgcatcaagaacagcggcgcccagcacgaggtcgccgtccagctcgcgggcatgctcggcatcctcgacacccagttcgtggtcaagcgggtcagccagctggcgcgttgggcgcgcgaccggggcggcaagggccccgcccccgcccagcagcgcccccagcagtcgtacgcggccgtccaggtcccctcgggccccgccctgcacctccgcaaccccgtctacgccaccgagcgcgagctgctcaaactcgccctccagcgcccggagctggtctccccggccttcgacgcgtacgggatcgacgagttcaccgccccgcagtacgcggccgtacgggaggcgatcatcgaggcgggcggcgcggagtacggcgtccaggacccgcaggagtacctggtccgcgtccgtgaggtcgcgccggacgacacggtgcgcgccatggtcacggagctggccgtcgaggcgatcatgcgccggacggtcgacgaggcgtacgcgggcgaccagctggtcaccgtgcgccgccgcgcggtggagcggcgcgtgcgcgaggtccagggcagcctggcccgcctgagcgcgggcggcgaccccgcccagctggccgccgtgcagaacgagttgtgggtgctccagcagtacgaccaggcgctgcgcgagcgaggcgcccaggcgctc

SEQ ID NO: 5659 - DNA, 996 bp, Streptomyces avermitilis
  CDS (1)..(996)
atgagcgggacgtggcggggcttcggctgggcgagcggtgagttgccgcgggtgccgttggacgacgccacccgcgaggcggcgaagctgccccggacgctgcgcccggtggtcgcggacgaggtgacgcagcgcccggtcttcgacccggccctgaagcagtacgagaacgcctaccgggcgaccgaccccggtttcaccgacccgaccaggggcgacgcctggcgggccgcgcgacgccgggccctggagctcgtcctggccgcgatcgccgactcggcctgggtcgacgcgctggtgctgcgcggcagcgtgctgatgtcggcgtggttcggcgacgccgctcgcgagcccggcgacctggacttcgtcgtcgtaccgcacacatggaagatcggcgacggccgcacggaccggatgctcgaagggatcgcggcggctgccgaggagctggccgcggagcgcgggccgcgtctggggatctcggcgcggggggcggtggtggaggacatctggacctatgagcgggtgccgggccgccgtatggtcctgccctggtccacgccggggctgcccggcggccatgtccagctcgacttcgtcttcaacgagcggctgccggagccggccgagccggtggagctgcccggcggcgcgatcgtgcaggcggcgacgcccgcgctgtcgctggcctggaagctcatgtgggtgatcaacgacatgtacgcgcagggcaaggacctgtacgacgccgtcctcctggccgagcggcatccgctcccgtacgagctgctgcacgaggtgttccggctctcgggcgagtggccctacccgttccgcgagaagatcctcctggaggacgtggtggaggcggtcgggtacgtcgagtggaaccacttcgtcaaggagtatccgcagttcaccgacgacgagcagctcttcgcggaccggctggtgcgggccgtggcgccgacgttcgacgggcggccggaggtc

SEQ ID NO: 5660 - DNA, 651 bp, Streptomyces avermitilis
  CDS (1)..(651)
gtgaccgtccgctgcgacggcgccgccgagtccggacggctcagccgctgggcggccgcggccggtctcaagctgacgcacatcgtgctggcgcggggccggatgccctcgcagcccatgctcaccctgacgggttccccgtcgtacgccgacgaatccgcgcgggcggacgaagtgacggcgcggctgcgggcggacggcttcgaacccgtccgcgtcaagatcgagtcgacgccgtgggcgcccgaggtgccccgcgaaccgtgcggcggggaacggtacttcgagcatcatgtgaagctgctgctggcggccggcagcgacctcggcgcgctcgcggcgcgggtcgtcccgcacggcgcgcatctgtcgtggaacgcccggcgggcgcacggcggcgggtggcacgagcggttcgtgacacagcggtgccggggcgtggacgcggagggggccgggcgggcgctggagcggttgctccgggagctggacgggcttgaagtggtcgatgtggagcgggagttcgtgctcttcgacagtgatgtctccgtcgacgacgggtggatcgaggaagtcggcggccggtggacggcggcagcggcagcggcagcaacaggggcagcgacagcggtaccgcaggaggtgcgggga

SEQ ID NO: 5661 - DNA, 1329 bp, Streptomyces avermitilis
  CDS (1)..(1329)
gtgcctgagtcctcggagcgcggccggcccgcccacagcgggtcccacacccccgcggttccgctcaacgactacgggatggtcggcggtgaggccgtcgaccccatccccgacgtaccgctgccgcatctcccagcagcgacattcctggaggtcgcccccgtgcagacccagaccctcgcccagaccgacatcagtgccgaaaacgcggagccggacgcggagaccgacgtcatcgcggcggtacccgcgcagagccgggccgcgcaccaccccgagacggagacggagcccacggccccgcccgagccggacgagccgccggccggcgcggtggagagcgtcgacgtcgtggagacggtcgagctcgtcgaggcaccggagccgcccgcgccgcgcgcccgcagcaacgacaccggtggcccttcctccgacctgttccgccagtacctgcgcgagatcggccgcatcccgctgctcacggccgccgaggaggtcgagctcgcccgccgcgtcgaggccggcctgttcgccgaggagaagctgagcagcacccccgatctcgactcccaactcggcctggatctcgacaagctggtcgtcatgggccggatggccaagcgccgtctgatcgaggccaacctgcggctcgtcgtctccgtcgccaagcggtacgtgggccgcggcctgaccatgctcgacctcgtccaggagggaaacctgggcctgatcagggcagtcgagaagttcgactacgcgcgcggctacaagttctcgacgtacgcgacctggtggatccgccaggccatgtcccgcgccctcgccgaccaggcccgcaccatccgggtccccgtccatgtcgtcgagctgatcaaccgcgtggtccgcgtccagcgccgcatgctccaggaacggggctacgagccgaccccggaagaggtcgccgcccacctcgacctgccgggcgaacgcgtcagcgaggtactgcgcctcgcccaggaaccggtgtcgttgcacgccccggtgggcgaggaggacgacgtggccctcggcgacctgatcgaggacggcgatgccacgtcacccgtggagtcggccgcgttcctgctgctcagggagcatctggacgcggtcctgtcgacgctcggcgagcgggagcggaaggtcgtccagctccgctacgggctggccgacggccgcccccgcacactggaggagatcgggcgcatcttcggcgtcacgcgtgaacgcatccgccagatcgagtcgaagaccctgaacaaactccgcgaccacgcgttcgcggaccagctgcggggctacctggac

SEQ ID NO: 5662 - DNA, 1926 bp, Streptomyces avermitilis
  CDS (1)..(1926)
atggcagggccgatggggcggatgatggccgggggcggccctgatcagcactcgatggacttcaaggggtcgggcaaacggctcctctcccagttcaagcccgagcgcgcgaccatggcggggatgctggtcgccgtggtcgtgagcgtggggctctcggtggtcggaccgaagatcctcggcagggcgaccgacctggtcttcgcggggatcatcgggcggcagatgcccgccggggccaccaaggagcaggtccttcagtccatgcgcgagcggggcgagggcggcgtcgccgacatgctctcggggacggacttcaccccgggcaagggcatcgacttcaccgccgtcggcaacgtactgctgctcgcgctctgtacgttcctggtggccggcctgctgatggcggtcgccacccggctggtgaaccgggccgtcaacaagaccgtctaccgcatgcgcgaggacctgcagtcgaagctgtcgcggctgccgctgtcgtacttcgacaagcggcagcgcggcgaggtgctgagccgggcgaccaacgacatcgacaacatcgggcagacgctccagcagtcgatgggtcagctcatcaactcgctgctcacgatcgtcggcgtgctggcgatgatgttctgggtgtcgtggctgctggcactcgtggcgctggtcaccgtgccgctctccttcttcgtcgccacccgcgtcggtaagcggtcgcagccgcacttcgtgcagcagtggcgcaccaccggcaagctcaacgcccacatcgaggagatgtacaccggccacacgctggtgaaggtgttcgggcggcaggaggagtcggcggcgcagttcgccgaggagaacgagaagctgtacgaggccggtttcaaggcgcagttcaacagcggggtcatgcagccgctgatgatgttcgtgtcgaacctgaactatgtgctggtggccgtggtcggtggcctgcgggtcgcgtccggctcgctgtcgatcggtgatgtgcaggcgttcgtccagtactcgcggcagttctcgatgccgctcacgcaggtcgcgtcgatggccaacctggtccagtcgggcgtcgcctccgccgagcggatcttcgaactgctcgacgcggacgagcagcaggccgacccggtgccgggcgtgcgtccgaaggagctgcggggccgggtcgcgctggagaacgtttcgttccggtacgaccccgagaagccgctgatcgaggacctgtcgctgaaggtggagccggggcacacggtcgcgatcgtcggtcccaccggcgccggcaagaccacgctggtcaatctcctcatgcggttctacgaggtcagcggcgggcggatcacgctcgacggggtcgacgtcgcgaagatgtcgcgggacgaactgcgggccgggatcgggatggtgctccaggacacctggctgttcggcggcaccatcgcggacaacatcgcgtacggcgccgcgcgtgacgtcacccgcggggagatcgaggaggcggcgcgcgccgcgcacgccgaccggttcatccgtacgctgccggacggctacgacaccgtgatcgacgacgaggggtccggggtgagcgcgggtgagaagcagctcatcacgatcgcccgggcgttcctgtccgacccggtgatcctggtcctggacgaggccaccagctcggtcgacacccgtaccgaggtgctcatccagaaggcgatggcgaagctcgcacacggccgtacgtcgttcgtgatcgcgcaccggctgtcgacgatccgggacgccgacacgatcctggtgatggagaacgggtccatcgtcgagcagggggcgcatgccgaactgctcgccgcggacggggcgtacgcgcggctgtaccaggcgcagttcgcgcaggccgtggccgaggtggac

SEQ ID NO: 5663 - DNA, 1731 bp, Streptomyces avermitilis
  CDS (1)..(1731)
gtgctcatacgattgcttcgtacctacctcagtccgtaccagaaacccatagccgtgctggtgctgctgcagttcctgcagacctgcgccaccctgtatctgcccaccctgaacgcggacatcatcgacaacggtgtcgtggagggggacacgggctacatcctcgccttcggcggactgatgatcggcgtctcgctggtccaggtcatctgcaacatcggcgccgtctactacggcgcccgtacggcctcggcggtcggccgcgacatccggggcagcgtcttcgaccgggtgcagtcgttctccgcgcgtgaggtgggccacttcggggcgccctcgctgatcacccgcacgacgaacgacgtgcagcaggtgcagatgctcgccctgatgacgttcaccctgatggtctccgcgccgatcatgtgtgtgggcggcatcgtcatggcgctcggtctggatgtgccgctgtccggggtgctggtcgccgtggtgccggtgctcggcatctccgtgacgctgatcgtgcgccggctgcgcccgctgttccggaccatgcaggagcggctcgacaccgtgaaccgggtgctgcgcgagcagatcaccggcaaccgtgtcatccgcgccttcgtccgcgacgactacgagaaggaccgcttccggggcgcgaacaccgacctcaccgaggtgtccctgggcaccgggcgcatgctcgcgctgatgttccccatcgtcatgacggtggtgaacgtgtcgtcgatcgccgtggtctggttcggtgcgcaccgcatcgacagcggcggcatgcagatcggcgacctgaccgcgttcctcgcctatctgatgcagatcgtgatgtccgtgatgatggccaccttcatgttcatgatggtgccgcgcgcggaggtctgcgccgagcgcatccaggaggtcctcgacacctccagcagtgtcgttcccccgaccgcgcccgtcgtcgagctgcggcggcacgggtacctggagatccggggtgccgggttccgctacccgggtgccgaggagccggtgctcaaggccatcgagctgacggcgcggcccggcgaggtgaccgccgtcatcgggtcgaccggcagtggcaagtccacgctgctggggctggtcccccggctgttcgacgccaccgacggcgccgtgctcgtcgatggtgtggatgtgacgaccctcgagccgaagctgctcgccaggaccgtcggcctcgtaccgcagaagccgtatctcttcgcgggcaccgtcgccacgaacctgcggtacgggaacccggacgcgaccgacgaggagctgtggcacgcgctggaggtggcgcaggccaaggacttcgtggagcggctggacaacggcctcgactcccccgtcgcgcagggcggcacgaatgtgtcgggcggtcagcggcagcggctcgcgatcgcccgcaccctggtgcagcgcccggagatctacctcttcgacgactcgttctccgcgctcgactacgcgaccgacgcggccctgcgggcggcgctcgcgcgcgagaccgccgaggcgaccgtcgtgatcgtcgcccagcgcgtgtcgaccatccgggacgccgaccggatcgtggtcctcgacgagggccgcgtcgtcggcaccggccgccaccacgagctgatggcgggcaacgagacctaccgggagatcgtgctctcccagctgacggaagcggaggctgcc

SEQ ID NO: 5664 - DNA, 330 bp, Streptomyces avermitilis
  CDS (1)..(330)
gtgctgcgcgggcgcggggtcgacgtacggcggatcttcctcctcggcgcggcggcggagctggccgccgtgcaggccgcggcgccggcgctgttcggcgtgcaggtcgtcgtcccccagccggccgactacgcggcgatcggcgcggcccggcaggcggcctgggcgctcggcgtctcccagggcacgctctccccgggggccccgcccgtgtggcagggcgcggccgcccaggtcctggagccgggcgaggaactcgcggtggggcaggccgtacggcagcagtacgtgtcggtgcgcgaacagacccatccgggggcgttcagggca

SEQ ID NO: 5665 - DNA, 1095 bp, Streptomyces avermitilis
  CDS (1)..(1095)
atggggatagtcgccgggttggacagttcgcccgatttcactcgcatcgtcgtctgcgacacggacacgggggccgtactcaggcagggctatgcgccgcacccggtcgagaccgagggtggcgggcgtccctccgacgtcgatccgcaggcctggctgctgtccctgggcgaggccgcgagcggcgggctgctcgagggcgtgcaggccatcggcgtctcggcgcagcagaacgcgctgatcccgctggacacccagggcaacaccgtgcggcccgcgatcgtcggcggggaccggcgcgcacaggtcgccgccgccgatctgatcgacacgctcggcgggcgtcaggcatgggccgaggccgtgggctgcgtgccgcaggccgcgcagcccgtgaccaagctgcgctggctcgccaagtcggagcccgacgccgcgctgcgcaccgccggactgctccaggcgcacgactggctcgtgtggcagctgctcgggcggccggcgcgcaggaccaccgaccgcggtggcgcctcggggaccgggtactggtcggcggcgaccggcgcataccggccagatctcgtcgagctggcgctcgggcaccaggcgctgctgcccgatgtgctcgggccgtccgaggcggcgggtacgacaccggaggggctgctgatctccgccgggaccggcgagaccatggcggcggccttcgggctggggatcgggctcggggacgccgtggtgtcgctcggcgcctccggatccgtgatggccgtccaccccgaggcgctggtcgactcctccggaatgatcacctcgctcgccgacgcgaccggcatgcatctgccggtcgtgaccacgatgaacgcggtacggacgctgcgcggtgccgccgaactcctcggcgtgtccgacctggagggcctgtccgacctggcgatgaagtcgacgccgggctcccacgggctcgtcatgctgccgtacctggagggcgagcggacgcccaatctgccgcacaccgccgggacgctggcggggctgcgccgggagtcgatgcggcccgagcacctcgcgcgggccgcgttcgagggcatgctg

SEQ ID NO: 5666 - DNA, 312 bp, Streptomyces avermitilis
  CDS (1)..(312)
atgcgctaccggctcacgttcgtcgccggactggctcttggttacgtgctcggcacgcgtgccgggcgcgagcgctacgagcagctgaagaaggccgcacatcaggtcgcgcagaacccggcggtgcgcaacaccgccgagacggcggcccttcagggccgccagttcgccggcaaggcgtaccacacggtgagcgagaaggtgggcgatcacgtccccgactccgtggccggccgcgtgcgctccctgcgggagcgcaacgcgaacggcagcgtccgcagccgcgaggacgactggggcaccagtaacacc

SEQ ID NO: 5667 - DNA, 414 bp, Streptomyces avermitilis
  CDS (1)..(414)
gtgatgcggcaaaaagtaccggcccgcaagcgcggcctggctgttgatgttctggggctggtgatcgcggtggtcgtggtggccgcgtcggcgcacgagaacgccgtcgggatcacgcggctggacaggggcgccgccgacaccgacgtactgcggcgctcactcgcggtggacgacggcgggaacggtgaggaacgccgcctggtgctggtcgtggaccagctggaggagctgttcacgctgtgccccggcgggcgggagcggcgggaattcctggccgcggtcctgggtgtggcggcccaggtgcagacggcgaagctcccgtcggcctggtcatcttcggcctgcgctccgacttctacacccagtgcgccacccatcccaggctcctcgaagcggtggaaggtaatcagg

SEQ ID NO: 5668 - DNA, 1839 bp, Streptomyces avermitilis
  CDS (1)..(1839)
gtggatcagacacagtcggcggccgagggcgaccgctccacccgggccgcgatcgccaccatgtaccggctcaccaccggccaccgggcgtccctcaccctcgccaccgtactcaccctcgtcggctccgcgctcgggctcgcccagccgctcgctgccaagcaggtcgtggacgcgagcgggcgcggacaggtgttgtggccactgttgcttctcctcgccgggctcttcgtcaccgaagcggcgaccggcgctgtaggccgcttcgttctggagcgcatgggcgaaggcatcgtacgagggctgcgccacagcctggtggggcggctgctccggctggagatgcgggagtacgaccggctccgcagcggcgacctgatctcccgggtcaccaccgacaccaccctgctcagagaagtcgtctcccaagcactggtcgatctgttgacgggtgccctcgtcgcggcgggggcgatcgtcctcatggcgtggatcgacccgctgctgctgctcctgatcgcggcgaccgtggctaccgccgccgcgatcgtcgcctcgcttctcaagggaatccgggctgcctccgaacgcatgcagacctccgtcggcgcgatcgccgccgacctcgaacgcgcgctcggcgccctgccgatggtccgggttcaccgaaccgaggaccgtgaagcgggccgcatcggagaatgtgtcgaatcggcgtacagcgccggcgtacgcaccgcgaaacttgcctccgtgatgagcccggcggtcgaactcgcggtacagggctccttcctgatcgtcctggtcatcggcggcctgcgggtcaacggccacgccaactccctcggcgacctggtcgccttcctgctgtacgcctcctacctggtccttccgctgtcctcggtcttccgggcggtcggcctgatccagcgtggcatgggggcctaccagcgcatcgagcaggcgctgtccctgccggcggagccctcccaggagacgccgaccgtccgggcacgtacacgcgaaccggcccggcagaccgtctcgtacgagaaacccgccctcgccctgcgggacatcggcttcggctacgacccgagccggccggtgctgcgcggcctctccttcaccgcccctcaccggtgccagacagccctggtcggcctgtcgggtgccggaaagagcacgatcttcgccctcatctccagattttacgaaccggactccgggaccctgctcttcgacggcctgcccgccaccgaactgagccgcgccgcatgccgcgggcgcatcgccgtcgtcgaccagaacacccacgtcgtccacggcaccctgtgggacaacatcacctacgccgcgcccgacgccaccgaggccgaagtgcgacgcgccgtcgagctcgcccagctggaaggggtcgtacggcgactgccgggcggcttgtcgggaatgctcggtgagcgcggcagcaggctgtccgcgggagagcgccagcgcgtggccctggcccgcgccctgctcgcccgcccctcgatccttctgctcgacgagcccacctcccacctcgacaccctcaatgaaaccgcgctcaccaccgtgatgaaggacgtcgcccgggaatgcgccctgctggtcatcgcacaccggctctccacggtccagcacgcggaccggatcatcgtgttggacgagggcagagccgtcgcctgcgggcgtcacgaggaactactcaccagcagccccacttaccgcgaactggccgccggccaaatgcttcggccggccgccaccccgccctcccccgtgacgaccgcgcgccatccgcacagcccactg

SEQ ID NO: 5669 - DNA, 432 bp, Streptomyces avermitilis
  CDS (1)..(432)
atgacgacccccagcgccctggagcggcccaccggcgtgcccttcgcccggcgcatggccgcccgtctcgtcctttcccccgccctcgcgctctcgctcctgccgccccgccggctccgcgccgtgctccacttcgcatgtcgcggagccatgccggccaccgccgcccaggcaaagaacgcacgggacgcgatgtgcgcggtgagcctgcgctgcgcaggcccgaaaggctgcctgccccgttctctgggagccgcgctgctgtgccgcctgggagggagctggccgacctggtgcaccggggtacgcgtggtgccgccgttcacggcgcacgcctggatcgaggcggacggccgccctgtggacgagggcgtacccgacgactacttcacccggctcatcacggtcgccgtcgcgagccgatcaggccga

SEQ ID NO: 5670 - DNA, 285 bp, Streptomyces avermitilis
  CDS (1)..(285)
atgaccaccgttccccagcagaaagacacccgcatggcattgaagttcggcgccaatgtctccactgccgagacggactacggcacggtcctgctggacgaacgcgccggggaatattgggagttgaatcccaccggcaccttggtggtcaacaccctgatggcgggcggtgacgaagccgccgcggtcgtcgcgctcgccgacgagttcgacatcgacctcgtccaggcgaagcaggacgtcgacgccctcgtacagcaactgcggacctcggggctggccgaa

SEQ ID NO: 5671 - DNA, 1770 bp, Streptomyces avermitilis
  CDS (1)..(1770)
gtggcccgctccttcgcccgccccggaacgcgaatcctgcagcacgcttcgggccggccctggctggtggggcagtggcacgaccaggagatcgtcaccgcgcgcgccggccacacggccctcgccgtcatcggctgctgtccgatcgacgccgtagagctcgagcgccaagccgggcggctacgtgatctcgccgaactcgacgcactggcccgctcccttccagggagtttccatctcgtcgccgcgctcgatgggcggctcagggtgcagggcaccgcctccgggctccggctggtattccatgcccccgttgacggaacgcaggtggctgccacccgcgccgacgtactcgccgccgcgctgggcaccgacccggacgaggagcaactggccatccggctgctgtggccggttccccatacactcgccgaggcacccatgtggcgagggatcaccgccgtgtccccccaggacgcgctgatcatctcgccggacggccggaccgtacgccgctcgcgctggtggactccgccggaaccggtacgcacgctcgccgatggcgccccgctcgtccgcgaagccctggcggcggcggtcgacgcccgtacccggcagggtggcgtggtcagctgcgacctgtcgggcggcctggattccacctccatctgtttcctggcggaccgctcaccggcccgggtggtggccagcacctggccgggtcgcgaccccgccgacaccgatctgtactgggctgaacaggccgcccgctcgttgccggaaatcgaccatgtggtctgggacgccgatacctcgccgctcgtctacaccggcctgctcgacatcgatgacctgctggacgagccgaccatcggcgtcatggaccgatcaagggtcctgcaccatctgcccggcctggcggagcggggcagccggttgcacctgaccggcatcggcggcgaccacgtggcctggtgctcggaggcgtactaccaccggctgctccgcacccgcccgctgttcgcgctgcgccaactgcgcggcttcagggccctgtggcagtggccacttggcggcacggcacgcgcgctggccgactcgcggccgtacgggaagtggctggccgactccagcggccgcctgcgagacccgctccccgccaccgtcagcaccagcctcggctggggcatgccccctcgcctgttcgactgggtcaccgccgacgccgaacggatggcccaacgggcgctgcgcgaggccgccatgaccgccgtaccgctgcacccggaccgcggcctgcacaccgacctcgaacagatcctttcctgcacccgcatcatccgccagtgggaccggatggccgcccgggccggagttccgatggcatcgccgttcctcgacgaccgcgtcatcgaggcatgcctcgccgtccgcccgagcgagcgcgtcacgccctggcagtacaaacccctcctgaccgccgccatgagcgggatcgtgcccgatgcgtgcctgcggcgcaccaacaaggccgccgcttccatggacgcatccaacggactgcgcgaacaccgcgccgatctgctggcgctctgggagggctcccggctggaacagctcggcctcgtcgacggcacggccctgcgccggctcgcccagcgtccggccacacccgaactgcgcgacgcgatcctctactcgaccatcgccgccgaagtgtggctgcgcggcctccaccgaactagcgagcccaaggcccccgcctcctca

SEQ ID NO: 5672 - DNA, 600 bp, Streptomyces avermitilis
  CDS (1)..(600)
ttgtgcggctcggtgaccgacaccgccgcgcaggtggtggccgccgtgttcgaccaggcagagcaccgcgacaccggccaccgtcgttgctgggacgtcctggtcgacggggcccgccatcagatcgacctcctcaaggccgaagcactacagcgcagcgtggacgtccacatcatcgtcgacctgatccacgtgctcgaatacctgtggcgagcagcctggtgcctgcatgacagcatttccaccgccgcactcgagaaagccgcccacgccgccggacagcgtggcacccagcgcaagagcatcgacgaggccatgaactacctgtccggcaaggccgagcacctgcgctacgacaccgcccttgaacgcggctggccgatctccaccggaatcatcgagggagcatgccgacacctggtcaaagaccgcctggacatcaccggcgcccgctggggcctgtccggagctgaaaccgtgctcaaactgcgtgccgtccgcgccaacggcgacttcgtcgcctcctgggcgtggcaccagcagcaggaatccatccacaaccaccagacgcgctaccgcgaccaggccataaccactgcc

SEQ ID NO: 5673 - DNA, 822 bp, Streptomyces avermitilis
  CDS (1)..(822)
ttgaccgtctccttcttcgtcgtgacgcccatcagccgcatagcctcagcgagcgcctcgtcatcgagatcaatctgtgtgacggacatcgagcacctccagcatccacgatgtatgtcatcaagatacattgccaacattgaggtcaccacccaagagcagccccctgaggcggtgcactgcctctcgcaccgtggagactgcgccggctggggaggcacaaggcggcggactcccttcccaatgcgatggtgctccaccgcgagagtggacagtgccggtccggatcgcctaccgcggcaccggcgtggcggacctgcacccggccgacgcggtgctgaaccttccggacgcaatgcactcgcacgggctggccaggctcgccgcgatcgagtccgcccgcggaagctacgccgacgcctgcgagcggatcaacgccgttaccggctccggcaggtccaggaactcgctgtcagtgccgcggcggacatcgacgcgttctacgacgccctggtgcccgctccctgcaccgacaccacgccactgatcttgtcggtcgacggcaagggcatgatgatgaggcccgaagccctgcgcgaggacaccgccagggctgcggccgccaagggtggcaacgcgatgaagacccggctggcctccggggagaaacacggcaggaaacggatggccaccctgggagccgtctacgatgccgaacccgctccgcgcacagtcgacgacggcaagacgacgccgtccgcggcgcggcgcccgagcgccgccaggggccgaaggcccggtcgaagtggttgtgcggctcgg

SEQ ID NO: 5674 - DNA, 405 bp, Streptomyces avermitilis
  CDS (1)..(405)
gtgatcacatacctgctcgacacctccgccctgtggcacctgttccgcactcccggagctctggcaccctgggaggggcacatcgccgccggggtgttccacctctgcgagccgacacgtgccgaatttctctactcggcaaccagtccgactcaccgggacgagctcgcggaggagctggacgcactctgcctgctctctcccgttccgaagaatgcctggcgttgggtcgataccgcccagtacaagttgacacaacagggtcagcatcgtgcggcaggagcgatcgacctgttggtgtgtgcgaccgcggtccaccacgggcacaccgtcctccatgtggacaacgacttcgcgacggtcgccggagtgctcaaggaacttcagcagcgagacgtgcgagcc

SEQ ID NO: 5675 - DNA, 1893 bp, Streptomyces avermitilis
  CDS (1)..(1893)
gtggtcaccgggcatctgcggtggatcgaggggctgctcgacagcctcggtctaccggccgaacgctccgacgagctgcgggcccggcttctcgcggttcaggcgcgggcagccgacccgcagttgcgggtggcggtcttcggtgagacgtccagcggcaagagcacgctgctcaacgccttcctgcgacgccggttgctgccgtcctccgccctcgtgacgacacgtacgaccacggtgctggaataccgcgagggcgccgagggcctgatggtgagtaccacggacgactccgtcctggagtggccgtccgcgccgttcgccgggtgggcggggcgggggcgggagtccgggcctgacaccttggagcgggcactgcggcgggtgctgaccacagcactggcggacgaggtgggcagtctgcgggtgctctcgccggtccggctgctgggccccggcgtcacggtgatcgacaccccggggttcagcgtgacggaacgtggacaccgggagctcgccgaggccgcggcgcggcaggcggacgtggcgctggtggtggtgcccgccgtcgcggcgatgtcgctgaccctggtggactttctcaccgggccgctgcgcgaccatcacgaccggtgcgcgttcgtcctcaccaagctcgacctgctcgacgaagatgaacgctccgaagccgtcgaggtggtcgagcgtcggctgagggatctgggatgcgcggatccgctgctgctgccctgctccccgggcaaggcgctgggcgaggtcaccgctgtcggcgtccgcgagccgggtgggtccggccatctcgcgtcgttcctcgaggtggaggcgcggatcgcacggctcgcggcggacagccgccggtcggccgtcgccgccacggtgctcgggttgctctcggagctgctgtcggcggtggaggagaccgccgaggcccggcgcgccgccctcagccgtggcgagcgcgaactggcggccctgacgctgccggacctccccgccttcctcgacgcctgggccgcgcgcacccgggaccgggccaggacggagctgaacgccgccaccctgacccggacttcggcgcagtcccgtacgacgctcgaggtgaaagtcggcaacacggtggcgggcgagaagatcaacgacctggccggtgccgcggaggaggtgtcccggctggtccggcgccacttacggcgggacgcccagcaagccgtccgcacggcggtgaaacgggccggcgaggtgctgaccgccgctgccgaggaactcgcccgggacttcgcggcccagtacagcgtgctgaccgacctggccggcgaggcccggacggctcccccggtgccccaggtggtgtggccggagcccccggccccggacatgtccggcatcgaccgggcgctcaccgcgatcggcacccagctgaccagcagtggcaactggcgcaccggcggcggcgcgatggccggtgccctggccggcagcctggtcgccccgggcatcggcaccgtcatcggcggcgcgctcggcgcgctcatcgggcgccgcggccccgacgcgacccgggagcagttcctgcggcaggcccgtcccgtcatcgccgccgcgcacgatgagatcggcgccctcgccgccgcctgcctgccgcgcgtcgcggagggcctcagcgacagcgtcgccgcgctccgccggcagtacgacgaggagtggcgcgacgagatcgcccgcctcaccgcggcccacgaccggcggcgggccgaactggccgccgggatcgcccacgccgagaagaccgcgacggatgcccggcgacgccgcgacgcagtcgcctccctgcgccgggagaccagccggaccgtccccgacctcaaggagtca

SEQ ID NO: 5676 - DNA, 1854 bp, Streptomyces avermitilis
  CDS (1)..(1854)
gtgagcagcgcatcccgatccgaggcaggccccccgccggcggccgacccctccgcccacgtcggcgacgtcggcgctaccgcctccggctcgctgcgggaggcccgcaggctcgccgaggactacggacaggaccacatccgggaggccctggacctgctggccgccggacgcggccgacccgcgttccgcatcgcggtggtgggcgagttcaaccgcggcaagtccacgctgatcaaccggctcctgggccgtgatctgctgccgacgggatcccttccggtcacgcgggcgccggtggtgatccgggtctccgacgcggaggggctgaccctcggccggccggacggccgccgtgaactgcgcaagctcgacgacgacaccctctgggacgggctgaccggccccccggcggaacgggaaccgggtgctcccgccgggcccccggaacccaccgtgaccttggcggtggccgatgactggctcgccggtctggacgccgaagtggtggacacgccgggggtcaactccggtacggaggagcagttcgagcaggtacgccggaccgcggccggaagcgacgccgtgctgttcgtcgtctcggccctttccccgatgagcatcacggagcggcgcctcctggaggaggaggtcctgtgtcggcacgtacccttcgtcgccgtcgtcgtgaccatgctggacctggtggacggcgacgaccgcgaggagtccgtacgggacctcaaaaatcggctgtccggcctggccggcctgcccgtgctgatcgcccccgtgcccggcggcggagagtccgaactcgccgccctgcgcgtgctgttggaggggttcgcgcgggacagtgaacgggcgctgtggcgcgaccgggggatcgccgcccaagtggcggaccactgcgaggccatggcccggatcgccgccgaggccgacgcggtcggccggctgccggaagaggaggtggcggaacgggccaggctggcgcaggcgctgcgggagagcgaagaccggcagtgggagcagctccggacagacatgacgggacgtcagctccatctgggcgcccggctgcgtgaacatgtccagaaggggcgcgacggcatcatcgaacggctgcgctgggacctggagcgcgcctccgaaccgggaacctggtgggaacgcgacctgccggtccggctggggcacgaactgtcgctgctggcccggagctccgagcgcacggtcctgctgccggccatggccgcggacaccgactggctggacagggaagtggcgcgcaggctgccgggcgcggcacgcagcccgctgcccgccacgctggagctgtccaccgatccggacatctccggcgaggtctccagcctgtccaggacccgcctggtcacccggctgggcgcccagggcggttcgatcctcggttttctgatcgctgccacccgccagggcccgcgatcggactccgaccggtccggcccgccgccgatggtctacagcagcgtcctcagcctggtcggcgggctgctggccgaggcgtacgtcaggaacgccaccgaggagcagcgccgccaggtcgacgccgtcctggtgcgggcggtcgacgagagcgcgggggtcttccagcggcgggccgtcgacgcgctcggcgatgtctacgcggacatgttcgcccggctccgcgagtcccaccaggcctgggcggacgcccgacgggcggcggtcgaatcgacatcggcatccggtacggactggccgagcctggcgagcgcggcggcggagctggccgccggcatccgctccgcactcgccgacggcgtacgggccgaggaggaacaggaa

SEQ ID NO: 5677 - DNA, 1977 bp, Streptomyces avermitilis
  CDS (1)..(1977)
atgaaccaaggagaggacggcctgcccatgacgaccgtagaaggcgggtacgctgccgccgccgaacagcggctgcggctggccgagatgtgccgccggacggagaaggccgccgaacagatcggcaacaacggcgccgtccgggatgtgacggcgttgctcgaacggatcgagaacgaggccttccacgtgatggtggtcggcgacttcaaccgtgggaaatccaccttcgtcaacgccctcctgggagaccgggtgctgccggtcaaggcggttcccgccaccgccgttatcaccgaggtcaggttcggcgagtcgccggccgcgctgctgtggacagcggacgcggccgagcccgaggccgtcgacccggaccggctcatcgaactcatcacggtgaacaacgcgtcggccgacgagcgcagcccgtacgtcaaggccgaggtggtctggccgctggagctgtgccgccacaacgtcgtactgatcgactcgcccggcctcaacgcgtacgagacccatgacgacatcaccctcacgcatctcagcaaggccgacgcggtgatcttcctgcagcacgcgatcgccccgatgagcatcagcgagtccacgttcctgaagaagtacctgagcgcgcacgacccgttcttcgtgttcacctacttcgacgccatcgacgatcacgagcgcgacgacgtcacggcctccgcccggcgacgcgtcaccgatctgcggggcgaggaccgggaccggagccggttcttcttcgtcgacggcaagtcggcgctgcgcgcccggatggctgaggacgacgaggcgttccgccgcaccggcgtggaggcggtggagagggaactggaacggtacctcgtgaccgagcggcacaaggtcaagctgctcgccccggcccgctccgtgcgcggcgtcgcacgggaactgcgccgcaacatcccctccgagctccagatgctcgaagcggagagcggtgacctggaacggaactgggccgccgcccagcagcccctcagggaactggaggcgcaggcccagcagatcaccctggacatccgcaacgagacccgggtgctgcaggaccgggtggagaccctgctcgggggcttcctcgcggccgtcgccgacgaggcgccgctggtcgcacaggacgtggagatcaccaccaagctcggcctgaacctcctgaaagccaaagtgcgtgcccagcaggtggcggaggagatcgccggcggcacggcgaaggccatggaggagaaggtcgccctctgggtgggcgagtcgctgaaacccgtgatcgagcaggacctggaacggctcgccgagcggatgaacgccgaactgacctctttcgaggcggccctggagaaactccggatcgacctgcacggggcgtccggggcggccgacgcgggagagggccgggaggacgagccgctgaccaagttcctggcgggcttgggcgggttcgtgctcagcgggccggcgggcgccctggtcggagcgcggttcggggcgaaggaggcgctgcgtaccttcctgcccgccttcgccatcggcgcggcctgggcgctcaccccgttcgggctgcccgtgctggtggcggccctgatcggtcagggcttgttccaaggcaagggcgccggtgagcgcgtggagaagaagatgcgggaggagatcggccgcgcgatggccacccagttgcggttggccgcaccgaaggaggcccagaaggccgcccgggccttcgccgcggacaccatggagcccatgcagcgggagatcacgcagggcatgtccttccggatcgaggaactcacccgcagtgtggcctccgcccgccaggtcctggaccagggcgaggaggcggtcgagcggcgccgcggcgaactgaaccggctggacgggctcctgggccgcgccgacgacgagatcggtgacctggtcgccgagttgacgaggatg

SEQ ID NO: 5678 - DNA, 1263 bp, Streptomyces avermitilis
  CDS (1)..(1263)
gtgatggcccgttaccgcaggcggctgtgcctggccgtggacctgcgccagtacagccgtcacggctaccgcgcgcaggaggacgcgcagtaccggctccggctcgtggtcgagcacgcgctgcgccgggcccgggtgctgcgcgtccgtgcccagcagcaggtgcagggggacggccagttggtcgtcttcccggccgggatcgacgccgtacgtgtggtcccggcgctgatcctcggcctgcgtgacggcctctaccaggcgaaccgcacgcccggtgccttcggccggatgcggatgcgggccgctctcgcgctggggtcggtctcccgggccgaccgcggttacctgggcgactccgtggtgctggtcaaccggctcgtcgacgcggacggactgcgcgacgccctcgaaaacgaagacggcagcgacttggcgctggccgtgccggacgagatgtaccgggacgtgatcctgcccgacgggcgcggtctggccgccgggttccaccggatcgacgtggccgtcgtgaagaaggacttcggctgcggtgcctggctgcatgtgccgccctcggctcccgtccgggattcccggccggagccggtgatctggggacattcgcctggccgtacggcgatgcgtgagttcgtcgtaccggcgctgggtgccgctcacgtggcggccgcggtggtttcgcacggtcagacgctgcgggagtgggcgctgaccggccctgacaccggtgtctcgtacgggggcgggggcggggacttcgacggcccggacgaggcggatccgcgcgacgccgatcgcaccgacggccactacccggggcggcagcggcaccagccgggcgaccaccacgggagcggtcatcacgcgagcggtcatcacgcgagcggtcatcacgcgagcggtccccctggagccccccggctcccgggcccgcatcatgctgccgcgcatcacggggacccgtaccactccgatccccatcacaccggtccgcactatcaggacgcgcatcacgccgacccgcatcacccggacctgggtcacgctgacccgcactatcaggacgcgcatcacgccgacccgtaccacccggacctgcatcacgccgacccgtaccacccggacctggatcacgccgacccgtaccacccggacccgtaccaccccgatccgggccaccacgatctccatcacgacgatccgggacaccacgaccccggccaccacttccatcacggtggccac

SEQ ID NO: 5679 - DNA, 492 bp, Streptomyces avermitilis
  CDS (1)..(492)
gtgatggccgaacacgacccggctgcccgggagttggcggcggcggttgccgcgatggcgtcgttccagcaggtcacgcagcaggcggatgccaaggcggggaccctggtcacggtgcatgtggggctcgcggcagtggtgtccgcgcagatcgggtcggtcggcgctccggcaccgaccgacctgccggccgtactgttctggctggcgtccctcgcctacgtggtcaccttcaccgtgtcgggatacctgctcgtgcaggtgatccggccacgtacggggcggcactcggagccgaacaggttctccctggacgcggcggaccacgcgggggccgacaacggtcggctggcggcccaggcatgggcgaccgcgcacgccatcgcgaggatcgccgcgctgaagaacgtctacaccagccgcgctctcgcctgggtgggcgcgatggttgtcgcggcgaccctgtggctggtgctcgcggggacgatccgt

SEQ ID NO: 5680 - DNA, 702 bp, Streptomyces avermitilis
  CDS (1)..(702)
atgatccggctcgggcggcgggtgcgcttcgagcggggcgaacggctgctacgggagggcgagtacggttcctatgtgttcctcctgctgagcggctggtacaaggtgctggccaggacgccggacgatcgcgaggcgctgttggcggtccgggcaggtggtgacctcgtcggcgagctggcctgtttcgacgcccagccccgggtcgccacggtcgtggccgccggcaggggcagcgcgaagctgataggccggcagcagttcctggatttcctcgcggcgtacgaggagtcggcgcaggccgtgatgtgcgcggtggccgggaagctgcgctgggcgacacggcgacggcaggacttcggcagctgcccggtggggacacgggtggcccgggtcctgctggagttggcccgggcgtacgggcgtccctgcgcgaccggggtctcgatcggggtttcgctgacccagcccgagttggcggagctggtcggcgcctccgaaccgagtgtgcaccgggtactgcgttccctgcgcgagcggggcgtcgtcgagaccggctaccgccgggtcctggtcagggacctcccagaactcacgatcgccgccgacggggacgccgctcaacggatcgtccccgcgagcaccagccacagggtcgccgcgacaaccatcgcgcccacccaggcgagagcgcggctggtg

SEQ ID NO: 5681 - DNA, 1029 bp, Streptomyces avermitilis
  CDS (1)..(1029)
atggcagcgaaccgccgccctaccctggccgacgtcgcccgagaagtcggcgtcagcgccaagacggtctcacgcgtcctcaacgaggacggacccgcctccgcgcagaccagggaacaggtactcgccgcagtggccaagctcggcttccagccgaacctcatggcccgcaacatccgcgtcggcggcccggacaccaccatcggcctggtcattcccgacctcgccaaccccttcttcggagctgtggcccgtgccatcgaggacaccgtccgcgaacgcggactgaccctgctcatgggctcctccgcggacgactccgagcgcgaacgtgccctgaccgacaagttcctcgcccgccgcgtcagcatcctgatcgtcgttccgtccgtcggcgccgaccactcccacctcaagtcccatcgcacggcgggactacccgtgatcttcctcgaccgacccggagtcggcctcgccacggacagcatcgtcagctccaaccgtgccggcgcccacgacggcgtcacccacctcatcgcccacggacaccggcgcatcggcttcgtcggcgacctgcccccgaagctgtacacccgtcgcgagcgtcaggccggttaccgctcggcactacaggaagccgacatcccctacgaccgctcgctcgtcaccaacgcccacgaccagcggggcgccgagaccgcgaccgcccaactcctcggcctggccgatccccccaccgccctgttcgccggcaacaacatcatggcgctgggcatagtcgccgaactggcccgcagcaagcgcaaggacgtcgccgtagtcgccttcgacgacgtggcactcgccgaggcactcgagccggccctgaccgtcgtcgcccaggacgcggaagaaatcggcagaacggcagcgaccaccgcgctgacccgcctggacggggaccgctcccgagcccgcaccatcaccgtccccacccacctgatcgtccgaggctcgggcgaactccccgtccccgcgttacaggaagcg

SEQ ID NO: 5682 - DNA, 834 bp, Streptomyces avermitilis
  CDS (1)..(834)
atgaccgccacctcctcccccacgcccgtgctgcaggcccgcggcctggtcaagcggtacggccaggtcaccgccatcgacggcgccgacttcgatctgctgcccggcgaggtcctcgccgtcatcggcgacaacggtgccggcaagaccagcctgatcaaggcgctcaccggcgcggtggtccccgacgcgggcgagatacggctgggcggcgagcccatcaccttctccggtccgcagagcgcccgcgcccacggcatcgagacggtctatcaggacctcgccgtggccgcctccatggacatcgcctcgaacatgttcctcgggcgcgagctgcgccgacccggcgttctcggcagtgtcttccgcatgctggacaagaagcgcatgcgccaggaggccgccgagcacatggccgacctgaagatcggcctgcgctcgctgacgcagtcggtcgagacgctctccggcggacagcggcaggccgtcgcggtcgcccgttccgtcgcctgggcccgcagcgtcgtcgtcatggacgaacccaccgccgctctcggcgtcaaggagtcgggccaggtcctggacctcatccgccgagtccgcgacaagggcatgccggtcgttctgatcagccacaacatgccccacgtcttcgagatcgccgaccggatccacgtccaccggctgggccggcgtgccgccctgatcaagccctccgattactccatggccgaggtcgtcgccatcatgaccggcgcgctcagcatcgacgaggccggagatactgtcgtagcggattcggaggccgccaaggccgccggagtacaggccacc

SEQ ID NO: 5683 - DNA, 993 bp, Streptomyces avermitilis
  CDS (1)..(993)
atgacagccacgacctcgccgtacgccgagctcaaagcaccgaccacggcccgcagactgctcacggcgccgaccaccggcccgctggccgcccttctcctggcctgcgccttcttctccctctcgaccgaccagttcctcaccggcggcaacttctcgctgatcgtgcagcaggtcatggtcgtcggcaccctcgccatcggacagaccctgatcatcctcaccgcgggcatcgacctgtcgtgcggggcggtgatggccttcggcagcatcgtgatcgccaagatggcggccgagggctccgtcccaccgcttgtcgcgatcgctctgggcctggtcgtctgcggcggcttcggcctgctcaacgggctgctggtgcagaagatcccgctgccgccgttcatcgtcaccctcggcatgctcaacgtggcgttcgcactgacccacatctactccgaggagcagacggtcaccaacctgcccggcccgctgacggctctcgggcagaccttcccgctcggccacaccgacatcacctacggctccctggtcaccatcgccctgttcctcctcctcgcctacgcgctgagcagcaccggctggggccggcacgtctacgccctgggcaacagcgccgaggccgcccggctgaacggcatccgcacctcccgcctgaccatcggcatctacaccgtggccggcctgctgtacggcatcgccgccctgctgctcatctcccgcaccggagtcggcgacccgcaggccggacagaccgacaacctcgacagcatcaccgccgtggtcctcggcggcaccagcctcttcggcggacgcggatcggtcctgggcaccttcatcggcgtcctcatcgtcggcgtgttccgcaacggcctccagctgatgggcgtcgcctccatctaccagaccctgatcaccggagtcctggtgatcctcgcggtgaccgtcgaccagctctcccggaagaaggcccga

SEQ ID NO: 5684 - DNA, 1020 bp, Streptomyces avermitilis
  CDS (1)..(1020)
atgtctcgcaccactcgcctgtcctcctcgctcctcagagccgccgcggtcacgggcgtcgcggccctcactctgacggcctgcggctccggctccggctccggttcgggctccaagagctccggctcgggcagcgtcaaggtcggtctgatcaccaagaccgacaccaacccgttcttcgtgaagatgaaggagggcgcggagaaggccgccaaggagaacggtgtccaactgtccaccgcggcgggcaagttcgacggggacaacgccgggcaggtcaccgccatcgagaacatggtcgccgccggggtgaagggcatcctgatcaccccgagcgactccaaggcgatcgtgcccgccattcagaaggcccgcgccaagggtgtcctggtcatcgccctggacaccccgaccgagccggaaagcgcggtcgacgcactcttcgccaccgacaacctcaaggccggccagctgatcggcgagtacgccaaggccgtcatgaagggcaagaaggcgaagatagccgccctcgacctggcgccgggcgtctccgtcggcgtccagcggcacaacggtttcctgaagggcttcggcgccaccgacaaggacgtcgtgtgcgcccaggacaccggcggcgaccaggccaagggccagaccgcgatggagaactgcctgcagaaggcgcccggcatcaacgtcgtctacaccatcaacgaaccggccgccctgggcgcgtacaccgcgctgaaggccaagggccgggagaaggacgtgctgatcgtctccgtcgacggcggctgcaccggcacccaggccgtcaaggacggcaagatcgccgcgacgtcgcagcagtacccgctgaagatggccgccgagggcgtcaaggccgtcgtgacgtacgccaaggacggcaagaaggcgtccggttacaccgacaccggcgtcaccctgatcaccgacaaggcgcaggacggcgtcacggcgaaggacaccggctacggcctggagaactgctggggc

SEQ ID NO: 5685 - DNA, 960 bp, Streptomyces avermitilis
  CDS (1)..(960)
atgagcccgcgtcagatcactgttctgggagagtgcgtcgcggacgccttcaccgaaccggcaaacgcctcgaacgaacttgctctgcgggtgctgcctggcggcggacccgcgaatacggcggtggccctggccaggctgggcacgccggcccgcttcctggcgcggctgtccggggatgtgttcggccgcctgttccgggcccacctggaggagtccggcgtcgacctgtcgtacgccgtcgccgccgccgagcccagcacgctggccgtggcggagctggatgccaccgggcaggccgcgttctcgttccacgcgcagaacacggccgactggcagtggactccaggggaactggcgggggtggatctgtccgaaacggcctgtgtgcacaccgggtcgctggcgctggtccgtgaacccggcggggcggcggtggaggagttcctggcagcggcggctccgcgggccaccatcagcatcgatcccaacgtccggccgctgctggtgcgccccgaggtctaccgcgcccggctggcgcactggtgcgctctcgccgacatcctgcgcctgagcgaggacgacctggaactcctcctgccgggcaccccgcccgagcaggcgtgcgacatctggcatgccgcgggggtgcggctcgtcgtgatcacgctcggcgccggcggcgccctggcctcgctcgacggcgaacgactgcgggtgcccgctgtggccacgcgggtggtcgacacggtcggcgcgggggactccttcaccgccggcctgctgcatcacctcggcgcccgcggactcctcggtggccggctgaccgatctcggtctcgacgaggtcgcggaagcctgccggttcggtgcccgggtcgcggccctgacctgctcggtcgccggtcccaatccgccgtggcgtgaccagttggcacagctgacgaccgccggtggcgcc

SEQ ID NO: 5686 - DNA, 291 bp, Streptomyces avermitilis
  CDS (1)..(291)
gtgaagaagaccctgctcgccgagttcaccgcccgcgagggagcgcaggacgaggttgcccgcctgatcggcgactacgccctgaaggtgcgcgaggaagaaggcaacatcaccttcgacgtctacaccaaggcagccgccccgcgcgcctactggatcttcgaggtgtaccgggacgaggacgccttccaggcgcacctgaacgccccgtacggcggccctttcaacgccgccctcattccgctgatcgaagaggacgcctcggtgctgaccttcctcgatccgctggcg

SEQ ID NO: 5687 - DNA, 567 bp, Streptomyces avermitilis
  CDS (1)..(567)
ttgcacgcccgcaccaccatctgcgccgtcgttctgctgctcgccgccaccgcttgcgcaggtcccggccacaccgacgagccggatgccaggccgaagcaggccacggccaagcccgtacccgccgccggggcgctcaagatcggcgtcggacaccactggagcgacacggacaccgacggcagccacatcagtggcaccacgaccgtcatgggctacacccagccggcgaagggcgccaccctgtccgacgacgtcaccgacgtcccgcaccccgtgtgggccaccctcgacgtccggctctgcgccgacgcgaccagcaccacggtgatggcttcccagacaccctggtccctcggcttccccgacgggacccggggccgggccccgctgttcagcggatccggcgtgccgaagcctgagtaccccaccggaagtgccgccgtgcggcccggctcgtgccttcgcgggaagatcacgttcgctgtcgaacggggcacccgtcccgaccaggtgatctacgacgtcgaaagccgcgaccccgtcgggtgggctgtgcccgcggca

SEQ ID NO: 5688 - DNA, 246 bp, Streptomyces avermitilis
  CDS (1)..(246)
gtgagcgagtcgccctcttccgggccggtcggggtcatcctttcggtcgaccccgaccggttcgcggaggtggtcgaggccgcgcgaggggccgggctgacggtcacgggcgagcaggcgatcctcggcacgctctccggcaccatcgcggaggaccggatcccggccctgaaggcggtcgccggcatcgaatccgtcgacagggaccgcaccgtccacctccccccgcccgacgccccgatccag

SEQ ID NO: 5689 - DNA, 1332 bp, Streptomyces avermitilis
  CDS (1)..(1332)
atggcgaacggacccatggacaggcgcgccttcggcgagcagccggatcggcccgatgcccccttcacgggacggggcgcggagtacaccgggcggtacgtgatcctgctcgaccagagcaaccaggagagcggattggaggccctgcgtgcctccgccgacatcgcgccggtggagcgtatacgcgggaccgacgccgcgaacgtcgccgaactcctggagcgccccgacgtctcggtgctcttcgaagaactgggcgccgccgtcgtcgaagtgcggcccgaccagcgccacgcgctggtgaccacggccgaggcggagccctcgatcatcgcggccgagccggagcgcatggtctacgcctcggtgatcaccgctccccagcaggcgccgaccgcgttcttcccggcctaccgcagcgacgagggagtggtggaacgccacaccaaggccgaaatcgccgcggcccagggcccggcttgggacgagcggaactggacctggggcctccaggcgatccgggccaacatgtccagcctgaccgggcgcggtgtgaagatcgccgtgctcgacaccggcgtggacaccgaccacccggacctcgccgggcgcatagacgagacggtctccttcgtgcccggcgagaccgtcgaggacggccatggccacggcacgcactgcatcggcaccgccgccggtccggccagtccccagcaggggccccgctacggcgtggcaagcgaggcccgggtactcgccgcgaaggtgctcagcaacgcgggcagcggtaccgacggccagatcctggcggccatggcctgggccgtcgcccacggcgcgcgggtgatctccatgtcgctcggcgccgcggtccagccgggtgagctcttcccccagacctacgagcagctggcccagcgtgcgctccagcgcgggacagtgatcgtcgccgccgcgggcaacgaaagcagccgcccccaggccatcaggccggtcggccgacccgccaactgtccctccatcctcgcggtggcctcgctggacagggcactcacggtgtcgtccttctcctccgcgggcatcaacggccagggcggcgaggtcaacatcgccgcgcccggcagggccgtgcactcggcggcccctggcggcgggtaccagtcgatgtcgggcaccagcatggccacaccgcacgtcgcgggtgtcctcgcgctgctcgcccaggccgcccccaacgcctctgcggaggatctcaaggccagtctgctgtccagtgcgttcccgctgacgcagcccgtcagggacgtcggctcgggcctgctccaggccccg

SEQ ID NO: 5690 - DNA, 630 bp, Streptomyces avermitilis
  CDS (1)..(630)
atgcgtttccgggatcgccggcaggccggccgggagctggccgccgaactcctgaggcgggcggagaagggcgagctgaccgacccgctcgtcctggccctgccccgtggcggtgtccccgtcgccgccgagatcgcccacgccctcaaggccccgctggacgtgctggtggtgcgcaagatcggagcgccgggccgtccggagtccgggatcggtgccgtcgcgggcgacgatccgccgttcttcgacaagagctcgctcgccgttctggggctcaccgaggcgcagctcactcaggccgtggccgatcagcgggcggaggtccaccgccgcgaggagcgctaccgcgccggacgccccgcgccgcggatccgcggccgcaccgtgatcctcgtggacgacggactcgccaccggtgtcaccgcccgggccgcccttcgtcacctgcgcggacagggggccgccggcctgatcctcgccgtaccggtcggctcccgcgccgtcgagacgctgcacgaggaggccgacgacgtcatctgcctctacgagccggaactcttctacgccgtcggagagtggtacgaggacttcgagcagctctccgacgacgaggtgatcgacaccctgcgc

SEQ ID NO: 5691 - DNA, 954 bp, Streptomyces avermitilis
  CDS (1)..(954)
ttgggcaggcatcgggcagcgtgttctcggcccatgggccgagggagggggagcgctgtgcagactcagacgcgcatgctcgaccaggtccggacgacggacggacgactgctcaaggtcgagatctcgggggatccacgcggccggccggtgttcctgctgcacggcatgcccggcagccgcgtcggcccccggcctcgcccgatgttcctctaccagcgcggcgcccgcctgatcagctacgaccgccccggctacgggggctcggaccgcaaggcgggccgccgcgtcgccgatgtcgtccaggacgtggccgaagtcgcggacgcgctggagctggaccggttcgccgtggccgggcgctccggcggggcgccgcacgcgctggcctgtgccgcgctgctgcccgaccgggtcacccgggccgccgccctggtcacgctcgccccgcgggacgcgaaggggctcgactggttcgcgggcatggccccgtccaacgtccatgagttccgcaccgcgttcaacgatcccgagcggttcgtggcccggctcatcccgcgctcggccaagatccgcagcaatccggcacggctgctcgaagagctgcgcggcgacctgacggccgacgaccggcagatcgtcgcggacggcgccatccgctccatgctgctgcgcaactaccacgaggcgctgcgcagttcgccctacggctgggtcgacgacgcgctcgcgctgaccggcccctgggggttcgacccggccgacatccgggtgccggtgctgctgtggcacggcgcgcaggacgtcttctcgccggccgcgcactccacctggctggccggccgtatcccgcgcgccaccgcggtcctcgaacccgcggcggcgcacttcgcggccctgcgtgccctgccggcggtcctgacctggctcctggcggacgccgcgcggcagggc

SEQ ID NO: 5692 - DNA, 3942 bp, Streptomyces avermitilis
  CDS (1)..(3942)
atgacggccgcgcaggacggacggatcatcacgttctactcgtacaagggcggcaccgggcgcacgatggccctcgccaacacggcgtggatcctggccgccaacggcaaacgggtcctggcggtcgactgggacctggaggcgccgggcctggaccgcttcttccgcccgttcctcgacccccacgcgctcgcggccacctccgggatcatcgacatcatcaacgagtacgcctgggccgcgaccagcggcagccagcgttccggggcctggcaccaggagtacgcccacgtcgagcagcacgccgtctcactcacccccgagcggcacggtctgcgcttcgcgaagggcggctcgctcgacttcctctccgccgggcgccaggaccgctcgtactcggcgaccgtgtcctccttcgagtgggacaacttctacgagcggctcggcggcggtctcttcctggacgcgctgcgcgacgacatgaaggcgtcgtacgagtacgtcctgatcgactcccgcaccggcctgtccgacaacgccgacatctgcaccatccagatgcccgacatgctggtggactgcttcacgctcagcgaccagtccctggacggcgcggcggccgtggcgcgcagcgtcgaggacggctaccgcaagcgcaagatccgggtgctgccggtgccgatgcgcatcgacgagggcgagaaggagaaggtcgacgccggacgggcgctggcccggctgaagttcgacggactgcccaagggcctcggcggcgaggacctcagccccgaggagctgtcccagtactggggcgccgtcgagatcccgtaccgcccctactacgcgtacgaggagacactcgcgacggtcggcgacgagagcgggatcgccaactcgctgctgtcggcgttcgagcggctgaccaacgtcatctccgacggcgaggtcgcctcgctgccgccggtgcccgagccggtgcggctgcgctgcctggacgcgttcacccggcgccggccgctgaccacggcggccgacgtcgtcgtcgcgtacgcggccgagaaccgcatgtgggccgactggatcgaggccgtcctcaagcactccggctgcaacgtcacgctgtacgacgtgtccgccggcccggtcgaacgccccgacgcggcgacccgcgcgctcgtcctgctgtcgaacgccttccagaagtcccggtacggggaggacgtctggcgcgccttcaccggcggcgacccggacggcgcccaccccgcgctggtcccgctgcgcgtcgacgaggtgcggctgcccgactcctacctcgcccacgagcccgtcgatctgcaccgcctcgaagaggcccagtgcgtcgccggcctgctcagcgccctggagctgcccgcccagcccaccgacggcgccccggcggccccccgcttcccgggcagcaccccggccacctggaacgccccccagcgcaaccagaccttcaccggccgcaacgtcatcctcacgcaggtccgcgagcagctgcgctccggcatgtccgtcgtgcttccgcagccgcaggccctgaccggcctcggcggcgtcggcaagacgcaggtggcgctggagtacgtgcaccggttcatggccgactacgacctggtgtggtggacgtccgccgagtccgtggacaacgtcgtcgcctcgctcgccgagctgggcgcccgcatcggcgcgcccggcggcgaggacatggccctggtcagccgcgagaccgtgcagatgctcgcccgcggggtgcccaccaagcgctggatcctgatcttcgacaacgccgacaaccccgagcagctcacccgctacttcccggccgggggcggcgggcacatcctcgtcacctcccgcaaccaggcgtgggcgacccagggccagtccctgcccgtcgacgtgttcctgcgccaggagagcatcgagcacctctcccgccgtgcgccggggctcaccgcccacgaggccgaccgggtggcgaccgcggtgggcgacctgccgctggccgtggaacaggcggcggcgtggctggccgagaccgccaccccgatcgaggactatctgcgacagctggccgagcagaccactgacgtcctcgacctcaaccagcccgccgactaccccgagacggtggccgcgacctggaacatctccatcgcccgcctcaaggaccgctcgcccgcctcggtacggctgctgcaactgtgcgcgttcctggcgcccgagccgatctcctcccatctgctctacagcaaggagatgatcgacgagctgcgcaaggtcgaccccaccctccaggagagcctgctcctcggccgggtcatccgggagatcgcccgtttcgcgctcgccaaggtcgaccaggtcagcaacagcatccaggtgcaccggctggtccaggcggtgatccgctcgcagctgacgcaggaggagcagcggcacgcccggcacgtcgtccacacggtcctggccggtgcccggccggacggtgacgagccgatcgacgacccggagacctggccgcggttcggcgtcatctggccgcacctgagcgcctccgacgtccgcaactgcaccgagaacgaaccacgccgtctgctcatcgaccgcgtccgctacctgtggaagcgcggtgacttcccggcggcgcagcagctcgccgaggacctgctcggacactggaagccactgctgggcgaggaggacgtgcagtacctgtatctgcgctgccagctcgccaacgtgatgcgctcccaggggcgttacgtggagtcccgggcgatcaacaccgagctgctcgagcagcagcgccgggtgctcggggccgcacatccgcacacgtacgtcaccatgtccagcctcgccagcgacctcgccgcgctcggcgagtacaccctggcggtggaactggcgcgcgaggcgcacgacgggttcagccagatcttccacgaatcccaccggcgcaccctcagcgcggccaacaacctcgccctcgcgctgcggatggtcggccgctacggcgacgcgcgctccctcgaccaggacacctacgaccgccgtatggaggtgctcggccccgaccacccgtacacgctggcctcggcgggccgcctggggcgcgacctgcgcgaggtcggccggtacgaggactcggtgtccctgctgtcgcgtgcgtacgacgcccacaagcgcatcctcggcaagggcttccccggcacgctgagctgcgccaagtccctcgccgtgtcactgcgcaggacgggccgcctcgaggacgcccgccggctgacgacggcgacccgcgcccagtaccggacccagtacgacgcccacaccccggactcgctcgcctgtgacctgaacatggcggccgacctgtacgcggccgacgagcgggaggcggcgcgcgaggtcgccaaggaggcgctgaccgagtacatgaaggtgccgggcgaggaacacccctacacccaggccgcgctgaacaacctgggcatcttccactggggctgcggggacgcggtcgaggcggaggccgtgttccggcaggtactgcccaggatgtcggacgtgctcggcgaccggcatccgcacaccctgttcacggaggccaacttcgccaacgtactggccgatcagggccgtctggaggaggcctgggcgctggagaagcgggccatggacaccctgcgcacggtgctgggaccgcagcacccggagaccctggccgtggtcagcaactgcgcgctgacgctgggcgccctgggccgtacggacgaggcgcgccggctgcgcgaggagacgctggccgaactgaaccgccaggggcggcagttgggcgagaacaacgggatcatccagctgacggggcatgagcggcggatctaccgggacctggagccgctggcggtg

SEQ ID NO: 5693 - DNA, 1332 bp, Streptomyces avermitilis
  CDS (1)..(1332)
gtggacgcagttgaacggacttcggacaacaggccgtacttttttctcagttatgcccacacgccgtcctggggttcgggcggcccgaaccccgaccactgggtgcacgtcctgttcgccgacctgtgcaacgacatcatggcgctcaccgatctgccgggcggggcacccgcgggtttcatggaccgggagatgcgctccggggacggctggccggagaagctcagcgagaacctggccacctgccgggtattcgtacccctgttctcgccgaggtacttcaccagcgagatgtgcgggcgcgagtggttcgccttccacgagaggatcctgcgggcccgcgccaccggttcaggggcggtgcccgcgatcgtgccggccttgtggacacacgtcgaatacagccaactccccgactccgtaaggcacatacacgtggaccacgccgccttcggggaccgttacgcggcccagggattctacggtctgatcaaactcaaccggtttcacgacgagtacaaggaaaccgtcctcggtctcgcccagcgcatcgtgcaggtcgcccacgactccccgctgccctccagccggccccgcccctacgagtccacgcccagcgccttcaaaccgcgcggcgagggaccccggcgcatacatctgacggtggccgcacccacccgggacaccatccccgagcaccgcgacgcccgcccttacggggaggacgcccaggactggaacccgtaccactcggagtccacccgggcgctcccctcactggccgaggagctgatccgctcgctggactaccgcaccaccgtctcctccttcgacgacgaggacccgaccggcgacatcccggccgcctcggtcaccgaggacggcgaggacgccgccgacaaggtgccgccgacccgccccggcatcctgctcgtcgaccgctgggcgctcctcgacgaggaacggcggcacagactcaaggagttcgacgcgggcgcccggccctgggtcagcgcgatcgtgccctggaaccgcgccgacctccagtgccacggcgaggagggccgccagctcaccgaggagctggaccgcaccctgccgctgatccttgagcggggccggcgcaccgactgccggatggccgtcaccggcgtacccaccctgaagaccttcatcgacctgctcccggccgtggtcgcccacaccacccggcagtacctgaaacacgcggaagcccatccgccttcgggcccccacctgcccaggccccgactgatgggccccatccacccgcagcccccggacgcgggacccgacaacggaggagaggca

SEQ ID NO: 5694 - DNA, 771 bp, Streptomyces avermitilis
  CDS (1)..(771)
atgactgacgtgcggcaactgagttcgttgtgcgatgagttgggggtgcgctccggcggcaccctgctggtccacgcctccctcggcgggaccgggctgcgcgacaccgatgtccgggacgcccttctcggcgcgctcggcccgcacggcacactcgtcgtccccacgttcacgcccgagaactcggacacctcccgcgcgtaccgggcgctcaccgaggggatggacgagcgggagaaggcggcgttccgggcgggcatgcccccgtacgagcccgacgtcaccccctgccccaccatgggcgtgctcgccgagtgcgtacggacgacgcccggtgccgtccgcagcgcgcacccgcagacctcgctggccggactcgggccgcgcgccgccgagctgctgtcgcaccacgacccgacctgccacctcggcgaacgctcaccgctggccaggctgtacgccgccggggcccaagtcctgttgctgcgcgtggggttcgaggtgtgcagcgcgctgcatctggccgagtaccggatgacaccggtgccgccgacgcgcacgtaccgctgtgtggtcgaagagcggggaaactggacctcgtacgaggatctcgccctgaatgacggcgacttcgcgtcgatcggggcgctgctgccgcgtgatcttctgtcggaacgggcattttcgggaaagacggccgttctgttcgccatgcgggacgtcgtcgacgcggcgactgttcggatgtccggatatcgctatgaaatgacg

SEQ ID NO: 5695 - DNA, 2169 bp, Streptomyces avermitilis
  CDS (1)..(2169)
gtgacggacacggacagggattcctcgatccagcagctggttctgaaaatccatagcaggtgcaatctcgcatgtgatcactgctatgtgtacgagcatgaggaccagagctggcaggcacgcccggtcctgatcgccgaggaaaccctcgacaaagtcgcccaccggctcgccgcatacacggtggaccggaaactcgaatcggtttccgtgatccttcacggcggcgaaccgctcctcgtgggaccgacccgactgcggaacatctgtgcgcagctccggagcgttctggacccactgaccaccctggatctccgaattcacaccaatggcgtgcggctgaacagggcgcatctggagatcctgaaggaattcgacgtcaaggtcggtatctcgctcgacggtgaccgggcggccaatgaccgtcatcgcctcgaccaccggggccgcagcagttacgaccgggtcgtccaggccgtcgaacttctgcgcaccgaggaataccgccatctctacctgggccttttgtgcacggtggatgtggccaatgatccggtcgtggtacatgacgcgctgtcggcgctggacccgccgcgtatcgactatctgcttccgcattccacctgggacaatccgccgccctccggcccgtccggttcgcccactccgtacgccgactggctgctgaagatcttcgaccggtggctggagcaggggcgtacggtcccggtgcgcaccttcgactccgtcctcagcaccctgcgcggcgggcccagcctcaccgaggcgatggggctcgccccctccgacctcgcggtggtggagacggacggcacgttcgaacaggcggactccctgaagaccgcgtacgacggcgccccggccaccggatacgacgtcttccggcacacgttcgaggagttcgcgcggcatcccggcgtccgggcccggcagctgggcatcgagggcgtcagcgagacctgccgcggctgccccgtcgtccagtcgtgcggcggcggcctctacgcccaccgctacagcaccgaacggggattcgacaatccgtccgtgttctgtgcggatctgcgggccttcgtggacggggtggccgagcggatcacggagcgggagctgtcccccgcggtgcgtggcggggacgaactccggctggcgcagctcaggctggggcgagaggtgctggcgcgggcgcacgaccgcctcgccggcgatccggacgccgacgaggcctggcgggcgctcgtacgtctggacacggacgacgccaccgccccgcatctcaactccgtcctcgcccacccctatctgcgcccctcgctgcacggctcctgggacgggcgcgccggtctcgcccggttcatgacggtggccgcggcggccgcggtgcacgcggaggccggcgtgaccctcgcctggcaccagcccgaccgggaactgcaccttccgacgctggggacggtacggctggcgcggccggggcgggtcgagctcacggtgacgcgggacggcttccgcatccgcggcgccgacgccacgcccgacgagccgcccgccgaatggcgcccgctggagaccctgccgctcacggacggcacgtctttcctcatcgacgacgccgacccgcaccgcgactgctaccccgtccccgtcgctccgcccctcggctccagcgacctgcgcgtcttccgcaagcggctgcgcgccgcgtacgagctcctcgacgagcgcgagcccggccggcgtgaccgcgtggacgcgctcgtcgtcaccacggtcaccccgctgatggccggaacgggcgtgcggctcggcgaccacggcatcggcgccctgggcgtggccgtcgacttcgaaccggaggagttcgtccgcgaactgtcccgcgccggacgccgggcccggctcacggcgctgcggcaggtggcggatctgagcgtgccgggcaaccgggccggacggctgctcgaagaggcgagcgaacagctcggtaccgcctcgtactggcggcaggagcccgagctgcgggccgaggcactggcaggggccgaccgcgccctgcggaccctggccgcccttccggaacgggacctgaccgagagcggcgccgtcttcgcggcccagctgcggacggagtggcagcgcctccatgac

SEQ ID NO: 5696 - DNA, 180 bp, Streptomyces avermitilis
  CDS (1)..(180)
atgaacctcacggtcaccaagacgaagcgcggttcggccgccgctcagccgacccacaagaagctcgcgcccctctcggccatcaacacccacgaggccgccgccctgcggtcgaccggccgagtgaccgatattccaggcaggcgccccaccaaaccgatcacattcgactcggcactg

SEQ ID NO: 5697 - DNA, 918 bp, Streptomyces avermitilis
  CDS (1)..(918)
gtgtcaatgcgcgcggtgacgcccggaccgagtacgacgctcaccgaggacgacctgccgccgctctatgccgtcaacgatcgccgcgcgttgagccggcagagtgagtcgttccgcgccgtccgtacccaactggtcgttctgctgctcgccaccggtaccgcaatgctcgccgagcgactgaacagtcatattccggcagcatgtgcggcggtcctttatgcgttgacgatcgccgtcggcctgcactcctcccgccgccgggcgcgcgcccactggcaggcgcaccgtgcggcggccgagaccctcaagtcgctggcgtggatgtacatggtccacggcggccccttccactccggtgtcacccacccggacgccctgttcgccgagcggctggaggagcggctccgggaactgcgcaaggtggggtgggaggactcccgggacggaccggcgacggtcggggcggggcagatcaccccggtgatgcgggccgttcgggccaagccgttcggggcgcgccgggacctctatctgcgcgagcgggtcctggagcagctgacctggtacggcaaccgggcctcccaggcccaccgctcgtccgtgcgctggtcctccgtcacggccctgctgacgctgctcgcgctgatcgcggccgtgctcagggccgccggggtgatcggccgctgggacctgaccgggctgctcagcgcgtccgcggcggcgggcgtcgcctggcaggaggtccgcagacaccgcccgctcacctacgcgcacaagctgatagagcaggacctggacaccctgcggatcgcgatggggacgacggtcacggaggaggggtgggccgagtcggtcgcggaggcggagcggctggtgagcccccagcacacggactggctggtgcggttcggttcc

SEQ ID NO: 5698 - DNA, 474 bp, Streptomyces avermitilis
  CDS (1)..(474)
gtgactcggatcggcgtcaccgggcatcgccggatccccgccgtcgtcctgcccgccgtgctcgcgggcatcaccggggaactccgccgtcacgccgccgtcgaggcgctcagctgcctcgcggccggcgccgaccagctcttcgccgacctcgccctggacagcggcgtcccgctgaccgccgtgatccccggcatggactacgaggcccatctcggcggcgacgaggtgcaggcgtcgtaccgcaggctcctcaagtcctgtacggcgcgcgtggatctgcccgtcgaaccgacgcacgaggaggcgtactacgcggcgggccgctggatcgtcgaccacgcggaccggctggtcgccgtctgggacgggcagccggcccgggggctgggcggcacggccgacgtggtggcgtacgcccggcgcacgggcgtcccggtccgcgtcctgtggagctcgggcgtcctgcggagc

SEQ ID NO: 5699 - DNA, 1539 bp, Streptomyces avermitilis
  CDS (1)..(1539)
atggagacggttccccgcctgcccgtccccctgctgagggccgtcctcggcgtgggcaccgacctcgaactggagcccacgctccagcacatcgtggacagcgccgccgagctgaccggcgcccggtacgcggcgctcgcgacggccgaccccgggcacgaagaactcgcccgggtgcaccgggcgggaccggcgcggggcggcccggcaccccacggtccggcccgccccggccgcggtgacgactggctcggcgtcccgatccacgtccacgaccaggagttcggcaccctctacctcaccggcaagtccggcggccccttcaccgacaaggacgaacggatgctgtgcgtcctggccgcccaggcgggcatcgccatcgacaacgtccggctgtacgcgacggcccggcagcgcgaacggtggatcgagggcgccgccgccgtcaccaccgcgctgctcaccggccagaacgccaccgacgcgctgatgacggtcgccgagcgggcccggatcctcgccggcgcggccgccggggtcatcctgaagcccacccccgagggcggcatggagatcgtcacggcgtccacgcccgacgaccccggcgacatcgtcggtacgaccatcgagccgggcagcccggtcctcgcccaactcctcggcggggaagcggtgttcatcgacgacacggcgaccgacccgcgtatgacgacgcgggtacggcaccggttcgggcccagcatgatgctccccctcgaagcggagggccggctcatcggcacgctcgcgctcccccgccgccgcggcggccgcccgtacaccccggtcgaacagcagctcgccgcgcagttcgcctcgcaggccgcgctggcgctggtcctcgcggacatgtggcacagccggaagcggctggcggtgtacgaggaccgcgatcgcatcgcccgcgatctccacgatctggtcgtccagcggctgttcgcgaccggcatgatgctggagtccacccagcgccgggccgccgaggaggacgtgcacgagacgctcggccgggcggtcgacgccctgcggtccaccgtccaggaggtccgtacggcgatcttcgcgctccagcagccgcccgccgacgcgcccaccacgttccgcggcaaggtgctgcgcgagacggcgggcgcggccggggtgccggggttccggccgagcacgcggttcatcggcccggtggacagcctggtcccggaggcggtcgccggtcatctcctcgccgcgctgcgccgcgccctggccgccgcgtcccaccgcccgggcgtcgcccgcgtcgaggtcacggtcgacgcgacggccaccctcccggacggccgcgccggcgtccggctgacggtgcacgacgacggggtgccggacgaccacgaaggggtgccgaaggagcgcgagggggtgccggagaacgacggccgggcggccgagcacggcgacggcgcctcgcgcggcaccggcaccggcaccggcaccggcaccacggtcacctggcagtaccctctc

SEQ ID NO: 5700 - DNA, 1035 bp, Streptomyces avermitilis
  CDS (1)..(1035)
atgaccgtcagtctggaccgactgcgccgctgtcacttcgccgtcgacctcggggccgccaggacccgtgtctatgtgaagggcgccgggctggtcgtggaccagccgagtgccgccgcgatcaacacgcggaccggcgcgctgatcgcggtcggggagttcgccgagaagatgacggggcgtacgcccgcatacatccgggtcgtgcggcccgtgtccggcggtaccgtcgtcgacatcgagatggcccagcgcatgctgcgtcatctgctcggcgagaagctccgccgtgccctgcgccgcaagccccggctgcgggccgccgcctgcaccccgcacgacgccgatccgctggcccagcgcgcgacgatcgagacgctggtcgggctcggcgcgcggcgggtcgaactggtcgacacgctcgtcgccgccgccgtggggtgcgggctgcccgtcgagcggcccgaggcgtcgatgatcatggtgtgcggggccgcggccacccagatcgcggtgctgtcgctggggtccatcgtgaccgccgaccggatccccgtgggcggcgaggccgtcgaccacgcgatcgtgcagcatctgcggcaccagcacgagctgatgctgccgagtcagtccgtacggccgctccagatcgccttgtccgggaacgggctcacgccccacgggccgacctcgaccgagatccacggacgcgacgtggccaccgggctcgcccgttccgtgctggtcgacaccgccgccgtacgcaacgccatccagaccccgctcacggccgtgctcgacggcatcggcaaggtgctgcgggactgcccgcccgacctggtggccgacctcgccgaccgcgggatcatgatggtgggcggcagtgccctgctgccggggctcgaccagatgctgcggcaggcaaccggtatgccggtgtccatcgccgagcggcccgacgtatgcgccatacagggtctcggggccatgctggagggccggatcgagccgctgctcctcgaacgggtcgccggc

SEQ ID NO: 5701 - DNA, 3624 bp, Streptomyces avermitilis
  CDS (1)..(3624)
atgaccagaggaccagcgagacgcggggcggcactgctgtcggccgggctcgtgttcgccctgctgcccatggggcgggcggccgcgcgggacgccggcaccccgccgtccccgcaacccgcctccaccgcccgcaccgtcacccttgtcaccggtgacaccgtgaccgtcaccgacctccccggcgggaagaagaccgtcaccgtcgagcggccccgaggggccaccggagcggtgcgcacccaggtcgtgggcggcgccgtcagcgtcgtacccgacgaggccctgccctatctgcgggccggcacgctcgaccggcggctgttcgacgtgagcgcgctgatccggcaggggctcagcgatcggaagaccggcgagaccccgctgatcgtgggctacggcaagggcgcgcgggccgtcacaccgagcggtgccaccaggacgcgctcgctcacgagcatcggcgccgccgccgtcgacgccgacaaggggcggaccttctggcggtcctggacccggcagggcggcatcgagcacgtctggctcgacgcgcgggtcgaggccgacatggccgagagcaacgcgcagatcggtacgcgggccgcgtgggacgccgggctcacgggcgacggcgtcaccgtcgccgtgctcgacaccggcgtcgacaccactcaccccgacctcgccggccgggtgtcccggagcaagagcttcatcgacggggaggaggtcgccgaccgcaacggccacgggacccacgtcacctcgaccgtcggcggcagcggcgccgcctccgacggcacggagcgcggcgtcgcgcccggtgccacgctcgccgtcggcaaagtgctcagcgaccagggcgcgggaagcgagtcccagatcatcgcgggcatggaatgggccgcgcgggacgtgcgtgccaggatcgtctcgatgagcctcggatcgaccgaggccagcgacgggaccgaccccatggccgaggccgtcgacaccctctccgaggagaccggcgccctcttcgtcgtcgccgcgggaaacaccggtgccccctcctcgatcggctcgcccggcgccgccgactccgcgctgaccgtcggcgccgtcgactcatccgaccgggccgcctacttcaccagcgccggcccgcgccacggcgacaacgccctcaagcccgacctcgccgcacccggcgtcgacatccgcgccgcccgctcccagctcgcccccggcaccggctactacacctccatgagcggtacgtcgatggcgacgccccatgtcgcgggggtcgccgcgctcctcgccgagcagcaccccgactggaccggcgcgcggctcaaggacgcgctgatgtccacgtccgagcaactcgacgcctccgtatatcagttgggggcgggtcgggtcagtgtgccggacgccgtcggcgcccgcgtcaccgcgacgggcagcgccgacctcggcttccaccgctggccccatgacgccgatcgacccgtcacgaagacggtcacctactccaactcctccgacacgacggtcgagttgagcctcgccgtgcggggcgcgcccgccggtgtcgccaccctcgccgacaccgcactcaccgtgcccgcccacggcaccgccgccaccaccgtgaccggcgacggctccaaggctccggtgggagagacgagcgggcagatcgtcgcctcggccggcggcgcgcccgtcgcgcacaccgccttcgggctggtcaaggaggcggagcggtactccctcaccgtgcacgtcaaggaccgcgccggggccgcgaccgccgccggcctcgtggtgcagcggctggccgccgggaccgacccctatccggcgtccgtcggtgattccggcaccctcgcgctgcggctcgcaccgggaacgtacagcctgacctccttcctcgacgtgcgcggcggccacggcgccgactcgctcggcctcggcttcctcgccgcgcccgagatcaccctcgaccgggaccgtgccatcaccctggacggcagcaggctgcgggaggtcgaggccgacgtcgaccggcgcaccgagacccggcagctgctcatggagtacgaccgcagcggcggcggctccgacctgttcggcgccgtacaggtgcccctcacgtacgacagcgtcttcgccgcgcccaccccgaaggtcaccgagggcagcttcgagtaccggaccgtgtggcggctcgggaagccgctcctggaggtcagggggatacgggaggcggtcgtgcagtccggcggcacactgaccgaagggcgcagccggccgccgctcgtcgatgtcgggtccttcaccggcggcgtgctcaccggcgtccggggcagggccgtgctcgcgcggctcggcgacggcgtcgagcccaccgccctcgcccaggccgcccaggacgccggcgccaaggccctgttcgtgaccgacgacagcgccggacgcctgaccgcctggtgggggacggacgacaacgcggaccggccgttgcagatcgccacggtgaacgcggcggacgcggcccggctgcgggcggccggggggaggatcgacatgaccgggacgccgaacacgccctatgtgtacgacctctcggaaggtcaccgggggcggattcccgaccgtgacctgacctatcggccgggcaggcgtgaactcgccacagtgcgggccaggttccacgccgtgcggccggtgggcggcggcgagttccggtactcgctcacggacgccttccccgtcgggatcggcttccgggagcggatcgactacccggccgagcgaacggaccacgtgtccaccggccccggtcagctgtggcacgagtcggtgacggtcggggacggcacgctggaggagcgcggcgggctcaaccgctaccagggcggggcgcacacggccctcgactggttcaagccggtctggcatccgtggctcggcaccgggctcggctgggggcaggagcgctccggcgccatgatgcggttcaacacgcccggctggggggactccgggcccgaccacaccggcttcggcgacgtgtggagcgacgacagcggcatgacccaggtcaccgccgtccaccaggacggcacgctcgtcgaccggcggaccggctccggcgcctacgtgtgggacgcgccggccgacgagcacacctacaaggtcgtcacggacaccaccctggacccggaccgctggaagctgtccacgaagggccacgccgagtggaccttcaggtcctccgccacccccgacgaccgctggaccttcctgccgctgctcaacctcgccttcgacatcggcaccggcctcacgggcgacgtgcggggcggcggccgggtgccggtcgggctcttcgcctcctacgtcgcgggcgccccggacaccgggaccatcggcgccgggcacctcgaagtgtcgtacgacgacgggacgtcctggcagccggtccgcctctcgggcggcaccgcctcctggcacgggacgctcaccgtgcccggcaccgcccaccacatctccctgcgcgcctcggcgcgcgacgaccggggcggctcggtcgagcaggagatcatccgggcggtgggggtgagg

SEQ ID NO: 5702 - DNA, 1395 bp, Streptomyces avermitilis
  CDS (1)..(1395)
atggctgaccggctctcggcccgcgaagccatcgccctcctcagcgacgacttcgaccggctccccgtcgcggaaggcgcgtacgcacccgacggccccctgtcctggcagggctacgacgcctcgcgcgcccgcgccaccgagcgcaccggcgaggacgagtccgtcgtctgcggccgggcgaggatcgacggcaccccggcggtgctgatcgcgttcgagttcggcttcctcggcggctcgctcggcgagcgcaccggggaccggctggaggcggcgtacacctacgccagggcgcaccggctgcccgtggtctcgctcgtcgcgacgggcggcagccggatgcaggaggggatgctcgcgctcacccaactccagcgcgtggcacggcagtcggcgctcacccgcgcggccgggctgccgcagctcgcggtcctgcgggatccgacgacgggcggcggctgggccacgctgggcgcgggcgccgatgtcgtcctggccctgccgggcgtccaggtcggcttcgccggctcccgggtccgcccgcccgacgcggatccggccgcgtacacggctcaggcacagctggcggcgggctcgatcgacgcggtcgtccggcctcaggagctgcgggagacggtcggcctgtggctggccctgctcacggcaccgtcgacggagcccgcgccgcctccgcccgcgctcggcacctccgacaggctcccggacaccggctggagcgccgtccagcgtgcccgttctcccgaacgaccccgcgcgcaggcctatttggacgcgtacttcacgcgccgggccgccatcgccggggaccgctgcggcggcaccgacgacgggatgctctgcggattcggcttcagctccggctccggctccggctccggctccggcgagcacggcgggcgggtcgtcgcgtacgccgcccagaccggcaccgccacccgccccgccggctaccgcaccgccacccggctgatccggctggcggaccgactcggcatccccgtactcacgttggtggacacacctggtgcggccaacgacgccgaggcggagcggcagggcgtcggtgccgcgatcgcggagctgttcggcgcggtggcgaccgcccgtacgcccctcaccacgctgttgatcggcgagggcggctcgggcggcgcgctcgccctggccgcgcccggcaacacctgggccacgccggacagttacttctcggtcatagcccccgaactggcggccgcgatcctcaaacgcccgcccgaggaggcgcccggcaccgccgaccagctccgcgtccgcccccaggacctggtcgccctgggggtcgtacgcggcatcgtgcccggtggcgccgctacctcacccccaccgcccgga

SEQ ID NO: 5703 - DNA, 1467 bp, Streptomyces avermitilis
  CDS (1)..(1467)
gtgtcctccctcttcccggccctgtcaggcggtgcggccgagcggcggcccgccctgcgtttcggcgaccgcgcactgacctacgcggaactcgccgcggccgcgggttgtctggcggcccggatcagcggctcggggcgggtcgccgtctgggcgacccccactctggagaccgccgtcggcgtcgtggccgcgctgctcgccggggtgcccgccgtaccgctcaaccccaggtcgggagagagcgagctcgggcacatcctcgccgacagcgcgccgtccctgatcctggccgcggccggggacgaactcccgtccgccgtacggggactggagcgcgtcgacgtcgaggtgaacgcacccgccgccggcgcccccgccccggccaccgggagcgtcacggacgacgcccccgcgctcatcgtctacacctccggcaccaccggcccgcccaagggtgccgtcctcccccgccacgccatcgccacgaccctggacgcgctggccgacgcctggcagtggaccgccgacgacgtcctcgtgcatgcgctgcccctgttccatgtgcacgggctgatcctgggcatcctcggtccgctgcgccgcggcggctccgtacggcacctcgggcggttcggcacggacggtgtggcgcgcgagctgaacgacggcgcgaccatggtcttcggcgtccccaccatgtaccaccggatcgccgaagccctccccgacgaccccgggctggccaaggcgctgggccgggcccggctgctggtctccggttccgccgcgttgcccgtccacgaccacgagcggatcgccgccgcgaccgggcgccgggtcatcgagcggtacggcatgacagagaccctcatgaacaccagcgtccgcgcggacggagaaccgcgcgccggtaccgtcggcgtgccgctgccgggcgtccagctgcggctggtcgaggaggacggctcgcccgtcccgtcctgcgacggcgagagcgtcggcgagatccaggtccgcggcccgaacctcttcaccgagtacctcaaccggcccgacgccaccgccgccgcgttcaccgaggacggctggttccgcaccggcgacatggcggtgcgcgacgccgacgggtacgtacgcatcgtgggccgcaaggccaccgacctcatcaagagcggtggctacaagatcggcgccggcgagatcgagaacgcgctcctggagcacccaggggtgcgcgaggtggccgtcaccggggagcccgacgacgatctgggcgagcggatcgtcgcctgggtggtgcccgcggaccccggcaccccgccggacgccgacgagctggccggccatgtggcccgccgcctcgccccgcacaagcggccccggaccgtgcgcttcctcgactcgctgccccgcaacgacatggggaagatcatgaagcgggcgctgccgcagggaagcgggcac

SEQ ID NO: 5704 - DNA, 576 bp, Streptomyces avermitilis
  CDS (1)..(576)
atgtccatccagacgcgtcgggaacgcgaacgagcggagcgcgagcggctgatcatcaccgccgcgcgggagctggccgagaccgagggctgggacgcggtgaccacgcgtcgcctcgccgccgagatcgagtacagccagcccgtcctctacagccacttcaagggcaaggacgccatcatggccgccgtcgccgtgcagggcttcgccgagctggcggtcgaactgagcgcggcccgcgccgcggcggacggcacgcacgggaccctcgccgccgtcgccacggcctacgccgcgttcgccgagcgccgcccggccctgtacgacgcgatgttcacccacgccgtcgacctgccgttcgcgacacccgaggcgcccgccgccctccagggcgcgttcgccgggctgctgcacgccgtcgaaccgctcgccggcgacgacgacccgggcctgctcaccgagaccttctggagcggtctgcacggcctggtcacgctcatgcgcagcggccgcctgccccgcgaggcccatgcccgccgcctcaccctcctgatcgaccgcttcacaccgccccgg

SEQ ID NO: 5705 - DNA, 369 bp, Streptomyces avermitilis
  CDS (1)..(369)
atgctcaccgccaccgcctacggcctcgccgccgtcctcgacctgttcgttctgttcatcggcgcccgtttcctgttgcggccccggcccgcggcggccggctacggcgtccccgccaagccggacggggacgccgcctacctcgagatcaagggcctgcgcgacgccaccttcggcatcctgggcctggtcctgctggttttcgccggtgcccgccccgaggcgtggttcatgctcgtcgtcgcgctggcgccgctcggcgacacactgatcgtgctgcgccacggcggcaccagggcggtcgcgttcggcatccacttcgccaccgccgtcgtcgtcctcgccagtgcggccctgctgttcgccgtc

SEQ ID NO: 5706 - DNA, 489 bp, Streptomyces avermitilis
  CDS (1)..(489)
atgacgctcatcgtgccggacttcgacgagtccgtgatcgtccgttccgtggacgccgaggtcgtgggccgggcccccaccaccgtccggctgctggccgacagcagctcgaccggcggcgcgctgtccatgcagcgggtcacgctcaccaacggcgccgacggcgccaggccgcatcaccacgcgggctccgccgagctgttctatctgctcgacggcaccgcccagatcctgtccggcgagcaggtcgtcaccctggagcgcggcgacctggccgtcgtaccgcccggcctgccgcacgccttcgccgccgcgcccggctgcgacgccgacatcctcatcgtcatcacgcccggcgtcgaacggttcgagtacttccgccatttggagcgcatcgcctacggcaaggtgccgccggagagcctgctggaggtccaggagctgtacgacacccacttcctgaagagcccggcctgggacgagcgacgc

SEQ ID NO: 5707 - DNA, 1143 bp, Streptomyces avermitilis
  CDS (1)..(1143)
atgctcacgatcggagccttcgcgaaggcgtgccggctctcgccgaaggcgctgcggctgtacgacgaactggacctgctgcgccccgcccgggtcgacccggacaccggctaccgctactacgcgcccgagcagctggagcgggcacgtctggtggcgtggctgcggcggctcggcatgccgctggcccgcatccggcaggtgtgcgcgctggacccgggcggggcggcgcgggagatccgggcgtactgggcccgggtcgaggccgagacgaccgcgcgccgggacctggccctgtttctcgtggaccacctcacccagtcgtcgcaggcgccccaggcgtcgcagtcgtccgcgtcatccccgtcgcctcagtcatctcagtcatctccgtcatcgaggaaggacaccatcatgctggagctgcgttactcagccctttccgacatcggcctggtccgcgacgcgaaccaggacaccgcctacgcgggcgcccgcgtcctcgccgtggccgacggctgcggcgcgggcggcgcgtcggccagtacggcggcggtggaggccctgaagttcctggacgaggagccgctccccgccgggggcgtcctcaacatcctggaggacgcggtccagggcgcgggccgggcggtccaggacgtggccgccgccgtgggcggctccgcccgggacgagatcggcaccaccctcaccgcggccgtgtggaccggctcccagctcgccctcgtccacatcggcgactcccgcgcgtatctgctccgcgacggcgagctgttcctgatcacccacgatcacacggtcgtgcagtcgctggtcgacgagggccggctgacgcccgaggaggccaccgtccacccccaacgcgctttgcttctgaaggcgttgggtggcggcccggtgccggaccccgacctgaagctgcacgacgcccgcccgggcgaccgttatctgctctgctcggacggcctgtccaccgtcgtaccgaccgaggagatccggcggctcctggccgccgctcccgttccccaggcggcggctcgggccctggtcgacgcggcgaacgccgccggcggtccggacaacgtcagttgtgtggtggcggacgtggtggaggccgggcggcag

SEQ ID NO: 5708 - DNA, 870 bp, Streptomyces avermitilis
  CDS (1)..(870)
gtggcccgtatcgcgctcgtcacctaccggcccgacgagggcgagaccagcgcggaccgcgacctcccggtgctggtcgaggccttgcgggcggccggggccgacgcggcgtcccggtactgggacgatccggacgccgactggggctcgtacgacctcgtggtgatccgctccacgtgggactacagctggcgggcggcggagttcgtggcctgggccgagcggtgcggacagctcacccgcctcgccaatccggcggcggtcgtgcgctggaacaccgacaagcggtacctcggggagctggcgggggcaggggttcccgtcgtcccgacccggtatctcgcgccgggtgaccccctcggcctgcccgacgaccacgagtacgtcgtgaagcccacctcaggcgcgggcgcccggctcgccgcccgctacaccccgggcgagcgggagacggccgtacgacagctcgcgcggatgcacgagcaggggctcaccgcgatggtgcagccgtacctcacccacatcgacaccaccggcgagcgggcgctccagttcttcggcggtcgctttctgcacgccagccgaaagggggccgtactcgcccccggcacgccctacgacgccgacaagatcccccacccccggctgcggccctggcagccgaccccggacgaactcgccgtcgccgaaagcgcgttggccgccgtaccggacgcccccgaactgctctacgcgcgcgtggacctcgtcgacgacgaaaagggccgtccggtcgtcatggagctggaactcgtcgaaccgaacctcttcctgtggctgcacccaaactcgctgcccgtggtcgtggacgcggtcatcgcggctgcccgg

SEQ ID NO: 5709 - DNA, 660 bp, Streptomyces avermitilis
  CDS (1)..(660)
atggaccgcatgccctccgcaaagcgacccgaccgatccggtcctccccctaggcccgctcggtccaccggagccgccggatccgccggcccgttcacgtctctcgacttccagctggtcctgctgcgccgcatggccgaccacaacccggacctcgtcgacgacgcccgccggaaactgggcgtctcggccgccgacatgcgcgaggcgaaccgccgctggcaggcgatgctgcacgcgccgcgcgggcgggccgccgcctcgcgctaccgctcggtcctcggcacccccgaatccgtgaccgagcgccggatcggcgacctgacctgcgaggcctggcagtggccgctccccctctggcccgacctgcgcttcgaggtcctggtggcccagaagggcgcggtctggaacgagtggctggtacgggcaccgggcgcgccggcccctgagctgcgcacgtcggcggacctgcgcccctggtgctgcacggtcgacgaggtggcccgcgccttcgcccccgcccgcccgctggagggcacggcccccacccgctggggcctgtcgttcacggccgcggacgcggagggcgtccgacgggagtgcgcggcggagttcacctgggggctgcttcagcgggtgtcggtcaccgggcagccgcga

SEQ ID NO: 5710 - DNA, 837 bp, Streptomyces avermitilis
  CDS (1)..(837)
atgaccctcacactggccgcccggctcgccccgttcctgcccacccgcctggtcgcggcggccgcccggctcctctaccctcgcttcgaaccggaactcgcccgcctcggcgacctctgcccgccggactgccgcacggcggtggacgtcggcggctggtacggcccctggacgcgcctcatgtcgagacgggccgaccgggtcgtcaccatcgaaccggtcccccacctggcgcggctgctggccgccgtcgccccgcccaacgtccgcgtggtccgggccgccgcgtccgaccgtccgggcacggcccctctctggctgccgccggacgacgcgggcgaccggggcgtctcctccctggtccgccgggacatccacgcccgcgcgctggaggtcccgtgcgtcaccctcgacggcctgggcctgcgcgacgtcggcttcgtcaagatcgacgtggacggcaacgagctggcggtcctgcggggcgcgaccaccctactcacccgcgaccggccggccctgttcatcgaactggagaccaggatccagccgatcggcccggtcgtcgacttcctcgccggcctcggctacgcgggctgggtcctccccggccggacctggctgccgctggaccgggcgatcctggaggcgcaccaggcccggacgtcgtacgtggtctcgcacggcctgctgcgccgggccctccccttccgcggcccgcgctatgtgaactcggcgctcttcctcccggacggccgccgcccgggcgcccggcgggtgcgcgacgatggaccgcatgccctccgcaaagcgacccgaccgatccggtcctccccc

SEQ ID NO: 5711 - DNA, 219 bp, Streptomyces avermitilis
  CDS (1)..(219)
gtgaaccccgacgacccgctgctgaagatactggcctgcccgctggacaagggtccgctgcacctgctcgtaccggactccgagaaggacggggtgctctacaacccgcgcctgcaccgccgttaccccatcgtcgacggcatcccgcagctgctgccgtcctcgggcgaacaggtcaccgaggacgagcacgaggagctgctgaggcggatgacccca

SEQ ID NO: 5712 - DNA, 918 bp, Streptomyces avermitilis
  CDS (1)..(918)
gtgtggtggggagtggccgcggccctgctggcgaacgtcctctacagcaccgggttcgtcctggagaagcgggcgctcgcgagcctgcctgaggtggacatccgccgccccgcccgactgctgcgcctggtcctgggcagcccgctgtggatcggcggctcgctgtccctggccgccggattcggggcccagctcgcggtctaccgcaccctgccgatcgccgccgcccagggcatcttcgtctccggcctggtcctcctggtcctgctctccgcgcgcctgctcggcgaggagacgacaggccgcgagcggtacgcgctcggcgccatcctcgccgcgttgctgatggtggtgctgtcgctgcgcgagggctcggacaaggtcagccgaagcgcccccgttccgctgatcctcctcgtctgcgtgccgtcgctggcgatgggcgtctggctgtacgggtccgccgagcgccgcgcccgccatcggcaccggatgcccacgaccggggtcgaatacggcgtggcggtgggcctgttgtacggggtcagctcgctggcgatcaagggggtgtcgagctatctgacgccggccgacgggctgggcggggcggtggtcggcctgctgcgctccccctacccgtacctcctgctcttcaccggcgtgttcggcctggtcatgtcgcaggcggcgctccagcgctgccgggcctcgctgatcgtgcccgtgtgcaccacggtgacgtgtctgttcacggcggtgctcggcacgctcgcgttcggcgaggcgctgccgcacgaaccgctgcggctggctctgcgcctggcgggcacggcgctcgcggtctccgtcctgctggccatgccgaagcacgacaccgcaccccaaccctccgccgcgccaaaggagttgacgccaccg

SEQ ID NO: 5713 - DNA, 732 bp, Streptomyces avermitilis
  CDS (1)..(732)
atgacgacaaccacccccgtacgcaatggacttcgggacttctatgaggatcccgccgtccccgtcgcctccggcaccccgcgcagcctgcggcaggcccgcatgctggccgccgccctcggcccggccaccgcgggcgcgaagaccgttctcgacatcggctgcggcgacggcaccgcggccgccaccgcggccccgttcctcgccgggcaccggctcgtcggtgtcgactggtcccaggacgccctcaggcgcgcgcacacccggctgccgtacgccgtgcgcggtgaactcaccgacggggggctgccgttcgcgtccgccaccgccgacgccgtcctgttcagcgaggtgatcgagcatctcgtggacccggacggcgccctcgacgagatccgccgcgtgctgcgccccggaggtcatctcatgctctccaccccgaacctggccgcctggtacaaccgggcgctgctgctcgccggcgtacagcccgtcttctcggaggtcagcctgcgcgcgatccacggccgcccgggcaccgaggtggtgggccatctgcggctgtgcaccgcccgtgcgctgcgggagctgatgacggcatcgggcttcgaggtcgtacggctgcggggtgcgcccttccacggcgtaccgcgccccctgcgcccgctggaccgcctcgcctgcgcggtcccgtcggcggcctcgctgctgcttctgcacgcccgaaggacg

SEQ ID NO: 5714 - DNA, 1323 bp, Streptomyces avermitilis
  CDS (1)..(1323)
atgaccgcggtggagcacccggcacgcgacggcacgaacggccccgcgcggcggccgcggcgcatcccgttccccgtggtcgacgaggtggcccggcactgtctccaggaggaggagccggagacggtccacatcgaggtgcatctgccgggccgcctggacccggcccgcctgcgcacggcgttcacgcgggccctgcaccgccacccccgcatcctgatgcgcgaggccgagggcccctggtaccgccgtcgctacgagtgggagctgacgccggacccggacgtggacgtggtgtcgttcccgccgccggaccgggacgccctcaaacacgcccgggaccgcgccctgggcgccgccccgccgctcaccgcctcgccgccgatccgcctcgaagtggtcgacgaggacgacccgtcgcacggcaccgtcctcttcctcaccatcaaccacaccgccctggacggccccgcgtgcctgcgcgtcctggccaccgcggcggagctgtacggcggccgcgacaactccccgtcggcgcctcccgtacggacgccggacgctcccctggagcaggtggacaccccgtcgacctggaccccgcccgcccgcgtggcccacggcgctcccgagccctcccccggcaacggcgtactcgtcaccgaactgtccgtcccgcaccgccccaagggcgccccctacaccgtgaacgaccagctcatggtcgccacggccctgatgatcgcccactggaaccgggaacacggcgcccgcccccgccccctgcgcatcaccatgcccgtcgacgaccgcccgcgcggcacggacatgcccatcggcaacggcacccgcctggtcgaagtccccttcgctcccgcggagttgacctccgtcgaccgcggttccatgcccgacctgctccgccgcaccgccgaccgcacccgcgccctcaaatcccttccgcgcccccaactggggcacggtgctgctctgttgaccgcgcccgtggtccccgtcccctggcgcgcggccctgacccgcggtctgcgcagggccgccgcaccctggacgtcgaccaccctgctgagcaacatcggccgcatcccgtacgccctggacttcggcgacacggcgggccgggcccgcgcggtgtggttctcggcgcccgcgcggatgccccggggcctgacggtcaccaccgcctccaccgccggccgcctccatctggccctgcgctggtcgcgcaccctgctcagccacggcgacggcgcccacctccgcgatctgttcgagcagagtctgcacgccacgcaggagcgccaccca

SEQ ID NO: 5715 - DNA, 4551 bp, Streptomyces avermitilis
  CDS (1)..(4551)
gtgtccaccatgacgagcacggtccaggcccctcctcccgcgccggtacgacctgtagggaccgccgaggggccgccggaaggcccgcggtcgcggcgctggctgctggggttctgggccgtggtgttcgtcctgttcctggccgtgcaccccgggcggacgacgttcgacaccaagctgggtgtcgccctcgatccttggcagttcctgtccgacctggggcagctgtggcacgaccggggcggcttcggcggcatccaggaccagtacgtcggctacgcctggccgatgctgccgtactacgggctgtgcaagctgatccacctcccggtgtggctcgcggagcggctgtggttctccctcgtcgtgtccgtcgccttctggggcgcgctgcggctggccgagcggctgcggatcggcaccggcccggcacggctgctcgccgccgtggcgtacgcgctgtggccggtgttcacggtcgtcgtcggctcgacctcggccgccgcgctgcccggcgcgttcctcccgtgggtgctgctgccgctgacgaacgagcggcacagcgcccgggtcgcggccttccgctcggccctgttcatcccgttcatgggcggcgtcaacgccgccgcgaccctcgcctcgctcctgcccgtcggcctctacctgctgtcccgcccgcgcggaccacgccggcgcaagctgatcggctggtgggtcctcggcgtgctcctggcgacggcctggtgggtggtcccgctgctgatgctcggcatctacggcgagaacttccttccctacgtggagactgcgcggaccacgacggacaccatgtcggcggtcgagtcgctgcgcggcgccgggaactgggtggcgtatctgcacttcggcgaggcctggctgccggccggctggaccgtcgcgtcctccgtcctcgtgatcgtctgctcggcgctcgcggccggcctcggtctcgccgggctcgccagacgggatctgcccgagcgtcgctggctggtgctgaccgtgctggcggtcgcgctcatcaccctggccgggtacggcggttcgttcggcgcgcccttccacggggtcgtccaggactggctgaacggctggctcgtccccttccgcaacatctacaagttccagacggggctcgctctcgcgctcgtgttcggcctggcccatctgctgggggtcgccgcgcaggcccgcggggcgcgtcccgtgcgcggccgccggttcgctccgctgatcgccgccgtgctgatccttccgggactcgcctggccctacctcaacggctcggtcctgcagcccggctccttccaggaactcccccggtactggcacacgacggccgactggctgaagaagtactcgcccgactcccgggcgctcgtcgtcccggccaccgcgcacggcatctacacctggggctcccccatcgaccagcccctcgacgtgctcgccgactcccgctgggcccagcgtgactacgtgcccttcggcacccccggcaaccggcgcgcgctggacgcggtcgagcaggccctgatgacgggtggcgaagtcccgggcctggccgactacttgagccgggccgggctctactacgtcgtcgtacgcaacgacctggaccccgaccagatcggctatgtaccgaccacgaccgtgaagcgcacgctggagcagtccggcttccagcgtgtcaccggcttcggcccggtcatgaccgggggacggatcgcggacgacacccccatgcaggtcgagggcctgtatccgcgccagcgcgccgtggagatctacgagccgggcacggacgtaccccggcccgggcaggccgggctcacccccgtcgcgggcaccgccgtcgtctccggcggcccggagtcgctgctgccgctgtccgccgaccccgcgatgcgcgaccgggcggccgtgctgaccggcgacagccaccccggcctcggcgccccggagatgcaggtggtgggcgacgggctgcgcagggcggacacccgcttcgggctggtcaactccaacacctcgtacacgtatacgcgtgacgagcggaacgcgagcgacagcgcccaggatcccggcaggccaccgcaccagatcctgccggccaagggcctcgaccgtcagacggtggccgaactgcgcggggcccgctcggtgacggcgtcctccagcggcaactggctgttccacctcccgcagtacgacccggtgaacgcgttcgacggcaacccggacacggcgtgggcggagggcgcggcgggctcggccgacgggcagtggctgcggatcgccttcaccgggtccgtggacctgccgtcgtcgttcaaggtgaccccgctgccgcagggcggggtgcggtcggcggcgacgcgggtgcgcgtggagacggagaagggttccgtcaccagttatctccagcccgacggcatgacccagaagatcaacgtccgtcccggctcgacgagttggctgaagatcacgatcctcgactcggtggagcggcggaccgggctcaccggagcgggcttctcggagatccggatcccgggtgtgcaggtgacccggatgctccggctccccacggacgcctccgggtccgacgccgcggccgagatcgtgtcgctgcaccgcgccgccgaccccaccggcctctccccgacgggcacggaggcgggcctgcaccgccgcttctcgacggcggcggcggggacgtacgaggtgaaggcgagcgcggtgccgatcgcgggcgaggggctggaccggctgctgtacgaggtggctccggaccagcggagccggatcaccgcgacggccggctcgacggcgaagctcggcgccggcctgtcggcgcgcaatctcaccgacggggatctgaccaccgcgtggatcgccggggacaacccgacgatccagctgagctggccgggcaagcaagcggtcggctccctcgtcctcgccccggcgggcgggctctcgtcccgtccgacgaaggtgtcgatcagctccccggacggggcggcgatcgccggggtcgacgagaacggctgggtccgcttcgacccgatcaccaccgatcggctggacatcaccgtcacggagacggcccccgtcacggtgcacaacccggtcgcggacgacgacctgcaactccccgtgggcctcacggaggcgtacatcccggccctcgaccagtaccggacgccgcagccgtcgagcacccggacgttctcgctgccgtgtgggaaggggccggtgctcgcgatcgacggcaagctgtacgagacgagcgcgagggggaccgtacgggatctggtcgagcgccggggcatcgagctgacgctctgccggaaggggcgtgcgagcgcggcggtggacctcggctcgggagcgcaccgggtcgaggccggggacgcggggccgctggcggtgacggacgtgacgctgacccgtgggacggtcaccgaggccgcggccgccgggcgggcgctgcggatcgccgactggctgggcgaccgccgcgcggtgacggtcgaggggggcgcggcctcgtacctgacgacgtacgagaactacaacgacggctgggaagccaccctgaacggcaggaaactcacgccggtacggctcgacggctggcagcagggctggcgcgtcccggccggcgcgggcggcacggtcaagctgtcgtacgcgccctcgacgacgtacgaggccgggctgatcggcggcggggccggtgtggcggccctcgtgggcctcgccctgtggcggcgccgcgcccccaacgccgacgagccgcagccgctgccgccggcgcccggcctctggctcggcacggtggcgctgacgctggtcggcgtcgtgatcgccgggttcttcgccctgctggtgccggtgctggcgctgctggcgtggaaacggcacgcgctgctcgtaccgatcgcgttcctggcgctcgcgggggcggggatcgcggcggcgacgggggccgggtcgccggtgtcggcgagcgagggcgcgttcggtccggtggctcaactgctcgcgctgatcgggctgttcgccggtctggtgagcatcccggagccggttgcctccggcggtgacgggacgacgcaccggggcgctgcctccggcggtgacgggacgacgcaccggggcggagtaccgcccggggcgcaggccccggcggagccgttgcggacggagccgttgccgcggcggcctcgcggcgggagcctcctgggcaagaagccgggggcgaagcccagcgaggagaagccgggggccacgggcgcaccgggcgccgaggccgcaagcgcaccgggcgccgggcccgcaaggacaccgcatgccgagcccgcgggctcgccgcagggtgagcccgcggccggccacaccgtctccgcgcgcggtcccggccgccaggagcccgatccgccgacggcacgtccgccgctgcgcgggccggggttcagggacgccgcgccggacgacgacacggggaagggagatacccca

SEQ ID NO: 5716 - DNA, 723 bp, Streptomyces avermitilis
  CDS (1)..(723)
atgaaggatccctcgatacgccgctccctcgccctcttccgtgccttccggcacgagcaggaggaccccgaggcctgctactccctgctcgcccgggacgccgccgaccaggtggaggcgtacggcggcccggtgaaggcccgtaccgtcgtcgacgtcggcggcgggggcggctacttcaccgaggagttccggcggcgcggggccggcgcctacctcttcgagccggacgtaggggagctcggcccgaagccccccgccgggtccgtcgtcgcggacggatatctgctccccctcgcggacgcggtcgccgacgtctgcttctcctccaacgttctcgaacacgtggccgatccgcagaccttcctcagcgagatggtgcgggtgacccggcccggcgggctgatctacgtgtcgttcaccaactggctgtccccgtggggcggtcacgagtgggcgccatggcactacctgggcgccgagcgggcccgcgcccgctaccgccggcgcaccggacggcccgccaagcacaccctcggcgagaacctcttcgccgtgcacatcggacccaccctgcggcaggtgcgcgcccgcgacgacgtcacggtcgtctcggcgcgctcccgctactggccgttcctcgcggaagccgtcgcgaaggcgccggggctgcgcgagttcgccacctggaacctcctcctcatcctccggcggtgtccacca

SEQ ID NO: 5717 - DNA, 1233 bp, Streptomyces avermitilis
  CDS (1)..(1233)
atgccccagcacgtgccgtcctcactgcgcgacgccttcccgcctgccgcgcagtaccctccggaccctccggcgctccccccacagccgcgccgtatcgtcttcctcgcccatcgcgatctcggcaatcccgcggcgggcggctccgaactgctcgtcgaccggctcgccgacggactgacccgcctcggacatcaggtcaccctgctgtgcggcggaccggcctccccggggctcccggctcctcccccgggctctcggcctcgctcgaacggggacccccatgagcggggaggtaccccccggcacgactaccgcgtcgtctcggcgggcggcgacctcggccattacctgcgcgcccggtccgccttccaccgccgggtcggcgcctgcgacctgctcgtcgaggtgtgcaacggcatgccgtacctggctccgctgtggcatcgcgggccgaccctgtgcctggtcaaccacgtccacacggacctgtggcggatgcggttcggcgggcccctggcgccggccgcgcggctgggccgaagactcgaacactgggcactggccggtgcgcagcgccggaacctgctggtcgccgtctcgccgtcgacggcacacgcgttgcgcgcgatcggcgtcgagcgcgagcgcatccgggtcgtgcacaacggggtcgaggaaccggggccgcgcgcgccgcgttcgcccgagccgctgttcgtggcgatgggacggctcgtcgagtacaagcggatcgatctgctgctgcggctgtgggagcgggtacggccggtcaccggcggccgcctggtgatcgtgggcgacggacccgaacgggcgcgcctggagcagctcgcggggcccggcgtggagttcgccgggcatgtctccgaggccgagaagcaccggctgctgtgcgcggcctggctcctgctgcacccctcggcggtcgagggctggggcctggtggtgaccgaggccgccgcccgtgagaccccggcgatcgccttcgacgtacccggtctcagggactccgtggccgacggcgagacgggagtgctggcccgcggcgagtcgtccttcgcggcggcctggtgcgccctcgcgctctcctcccaccgccgtgaactgatgggcaaggcggcccgcgaccgcgccgcccagtaccgctggaagcacacggtccgccagttcagagcggtggcggcggaggcggtgaggggccggacccca

SEQ ID NO: 5718 - DNA, 1050 bp, Streptomyces avermitilis
  CDS (1)..(1050)
gtggacatgcatatccacccgtaccatccgcctcacctggtgtgtcgagccgtctcacgcccctggagtgcccggatgcgccgaaccgcctcacccgtctccttgatcctgctgggcctcgggacgttcctcctcgtgctggccccgctgctcgcctggtacgtgaaaccgcgtgccgccgtgaatccgatcgacatcgacaccaccgccgtctacaccggcaccggcagcgtcttcgacgtcgacaaggtcgacaccgtggccggccagaagatcaccgtcacccagcgcgtgcgcgggaacgtcgccgacagcgagcgcagcggcaaggcggtctgggacgtgacgaccaccgtcgacacggacaagtcgctgccggccgccgacccgcacgacgcgctggagttcatgccgggccgctgggtcaccgaccggaagaccaaccggccggcgcactgctgccgggagaagccctacttcgagggcgacgcctatctgaagttccccttcgacgtgcgcaaacacgcctaccgctggtgggacaactccctcggcgcgaccgtgaccctcacctactcgggcgtcaagaagatccagggctacgagggttaccgcttcaccggcaccgtgcccgcgacgcggaccggaacccgcctggtgccgggcgccctggtgggccgcccgaagagcagccaggtactggccgaggagtggtacgccaatcacgggatcgaactggtcgccgaccagcgcaccggacgggtgctctacgcccaggtcgggccccgcaagacgctgcgggcgccgggcgcgaagaaggacgcggtcgtcctcctcgacagccggaagatcgccttcaccgcggccacccagaaggaccaggtcgagcaggcgaagaaggagagtggtcaactgcgcatggtggggcggacgttgcccatcggtgccggtgtggcgggattcgtcctcgctgtggtgggtgccgttttggtggtacgcgggcgctcacatcccgatacgtccgagtcctccccgcctccgcccacgata

SEQ ID NO: 5719 - DNA, 186 bp, Streptomyces avermitilis
  CDS (1)..(186)
gtggggacgacctccgacagagaggctcaccctgcgatgtccagactgcttgccgccgctctcaccgtcgtggccgccaccgcactcgccgtgggcgccgcgctcggcatcgtcgccctgctcgacgcgaccccggaccagccgaacaccccactgatcacatacgagcacaccggccaggagcgc

SEQ ID NO: 5720 - DNA, 1239 bp, Streptomyces avermitilis
  CDS (1)..(1239)
gtgaccgcccgtccgtcggccctgccgacccgttcggcctggcgggatgtgccgcgtctccaggtgcggcagttcgcggcgctcgcgatggccgaggcacccttgctcgccgaggagatcctgtgcgagatccgccgtgagtacccgcatctgcccgtcgttctcgacgactccggcgagcccatggcactggtcggcatccgccgcgccatcgaggtcttcgtccagcacctggagaccgccgagggccgcccccgcgtccctcccgaggtcttccaggagttcggccgcggcgagggactgaacggccgcagcctcgactccctccaggcgatctaccggctcggcgtacgcctggcctggcgccgcttcgcggagatcggccagcaggtcgagatcccgcctccggcgatgtacgaactggtcgacgcgggctacgagtatctggacggcctggtggaccagtccgtacgcggctacgccgaggccgcggcccggcaggcgggcgagcgcctgcgccttcagcggcgtctcatggagctgctgctcgccgagcaccaccgcggcgacccggccgacgcgctcgccgagcgggccgcccgggtgggctggccgctgcccgacaaggtcgccgtgggcgtactgctgcgtccggcgcgcgaggccgtcgcccccgcggtcgggcagggtgtactgctcgacatggagtacgagcagccccacatggtcgtgccggagccggacgccgccgggcgtccggagctgctgcaccgcgccctgaccggctgggcgggcgcgatcggcccgcccgtccccctggccgaggcggcgaagtcgctgcgctgggcggaggcggcggtacggctcatggagcgcgggctgctgccgggcggcgaggtgctgcactgcacgcagcacacggaggcgctcgtcctgttgcagccggaggagctgatcgacgacctggcgtcacggtgcctggcaccgctggcccactgcggccccacgcaccagcgccgcctcgcggagacactgctggcctggctggagacccggggcggggctccggaggtcgcggcccgcctgggcgtccacccgcagaccgtccgctaccgcctccggcagatccgcgaactgtggggcggcgagatcgacgaccccgaccgccgcttcgagctggagctggtgctgcggacacagcggctgcgcggcgaactcggcggccccagggcccgccgg

SEQ ID NO: 5721 - DNA, 771 bp, Streptomyces avermitilis
  CDS (1)..(771)
gtgggacgcctcgtacctgccgtgacccgggctctcgacattctcgagctcttcctcgacggggacggcacgctctccgcccccgacatcgtgcgcagactccagctgccacgcaccaccgtgcacgagctggtcaccacgctcgccgcccgctcctacatcgtccaggtgccggggcagccgggacgctaccgcctcggcgtccggccgtaccagctcggcagccgctacgccgagcagctggacctcgccgcagagggccagcaggtcgcccgctccgtcgccgagacctgcgacgagaccgtgcacgtggcgatcctggagggcaccgacgtcatctacatcgccaaggtggactccacgcacgcggtgcgcatggtctccgccgccggccggcgcctgcccgcccactgcacgtccgtgggcaagatgctcctcgcctccctctccgacccggagctgacctcgcgggtcccggacggcgtcgaactggccgcgatgacaccgaacagcatcacggatccggccgtcctgcgcgaggccctcgccgagatccgcagccggggcgtggccgtggagaaccgggagtccaatccggacgtcagctgcgtcgccgcgcccgtgcgcgaccgggcggggcaggtcgtcgccgcgctgtccatctccatcccgatgatccgctggagcgacgagcgccgggtggagctggagcagctcgccgtgaagggcgcggccgagctgtcggagcggctcgggcaccggagcgtgggg

SEQ ID NO: 5722 - DNA, 858 bp, Streptomyces avermitilis
  CDS (1)..(858)
gtgaccggcctcgacgtcgcggtacgcgcgcatgcggccctcggcgaagggccgacctgggacaccgccgcccagcggctgatctgggtcgacatcctcgggtccagggtgcacacctacgaccccgcctccggccgtcgtacggtcctggcgaccgaacagcacgtgggcgccgccaagccgcgcgcgggcggcggcctggtggtgaacctccgcgacggcgtcggcctctacgggcccgagggccccgggggccgcgacttccggtggctgcaccgcgagcccgtccccggccgccggggcaacgacgcggcggtcgcggccgacggctcgctgtgggcggggacgatgcgctacgacgaggcgccgggcggcggcacgctgtcccgcctcgcccccgacggcacggcccggacggtgctggacgacgtcaccatcagcaacggcgtcggctggagccccgacggacggctgatgtacttcaacgacacgcccacccgtcggatcgacgtcttcgacgtggacgaggacgggcgcccggtcggccggcggacgctggcgaccgtcgaggagggcgccggattcccggacggcctcaccgtcgacgccgacggctgtgtgtgggtggcgctgtgggacggcggcgtggtccgccgctacacgccgtccggcgcgctggaccgcgtgctcgaactccccgtgcgccgcccgacggcctgcgcgttcggcggcgccggcctgaccgacctgtacatcacgacggcccgtacgggcctggccgccccgcacccgatgtccggttcgctgctggtactccccggcgccggaaagggcctgccgcaaccggcgttcgccggc

SEQ ID NO: 5723 - DNA, 1509 bp, Streptomyces avermitilis
  CDS (1)..(1509)
atgcgcactgcccgcttcgccctcgaccccgccttcaccgtcggcgaggtcgacccccgtctcttcggatccttcgtcgaacacctcggccgctgcgtctacaccggagtcttcgagccgggccatcccgcggccgacgaggcgggtctgcgcaccgatgtgctggacctcgtacgggagttgggagtcaccgcgatccgctatcccggcggcaacttcgtctccggctacaagtgggaggactcggtcggcccggtcgacgagcgcccccgccgcctcgacctcgcctggcgctccaccgagaccaaccgcttcggcctctccgagtacgtcgccttcctgaagaaggtcggcccgcaggccgagccgatggtggccgtcaacctcggcacgcgcggggtcgccgaggccctggaactccaggagtacgccaaccacccctcgggcaccgccctgtcggacctgcgcgcggcccatggcgacaaggaccccttcggcatcaggctgtggtgcctcggcaacgagatggacgggccctggcagaccggccacaagaccgccgaggagtacggccgcctcgccgccgagaccgcccgcgccatgcgccagatcgacccctccgtcgaactggtcgcctgcggttcttcgggccagtccatgtccaccttcgcggagtgggaggcgacggtcctggcggagacgtacgacctggtcgaccacatctccctgcacgcgtattacgaacctctcgacggcgatgtggactccttcctcgcctccgccgtcgacatggagtcgttcatcgagaacgtcgtcgcgacctgcgaccacgtgggcgcgaagctcaagtcgaagaagaggatcaatctctccttcgacgagtggaacgtctggtacctgtcccgccacgaggagtccgccctggccgacccgctggactggcccgaggccccgcgcctcctggaggacaactacagcgtgctggacgcggtcgtcttcggctcgctcctgatcgcgctgctgcggcacgcggaccgggtgaccgtcgcgtgcctcgcccagctcgtcaacgtcatcgcgccgatcatgaccgagccgggcggcgcgtcctggcggcagacgacgttcttcccgttcgcccaggccgccaggtacgggcgcggacaggtcctcgacgtacgggtggactcgccgcggtacgagacgaagaagtacggcgaggcggacctgctgcacgccacggcggtccgcgcggacgacggcacggtcacggtgttcgcggtcaaccgcagccgcaccgagccgctgccgctcgaagtggccctgaacggcctggagttgacgtcggtcgtcgaacacagcgtgctgacggacaccgacccggacgcccgcaacaccctcgacgaccaggagcgggtcgccccgcgaacggtctccgggaccgcactccaggacggcaccctgaccgctgccctcgcgccgctgtcgtggaacgtgatccggctggcg

SEQ ID NO: 5724 - DNA, 1683 bp, Streptomyces avermitilis
  CDS (1)..(1683)
atgttcaccctcgccttgcctacgccgccgccactcgcccaggcccggggctccggattgagtgccgcgttcgcggcaggggccgtcattcccgtgggcgacacccccgggggaatcgctctcacacccactgggacccgcgcttacgtggccaatcacggctcgaacacggtgagtgtgctcgacaccgtcaccgacaccgtcatcgacaccatcgccacagggggcgggcccaacgccgtagcgttcagcccggacggtacccgggcgtatgtgaccgtcgccgacgacggcctcgtcagcgtgatcgacaccgccacgaacaccatcgtcacggacatcgccgtcggggcgggagcgacgggggtggccgtcactccggatggcagtcgcgtctacgtgaccctgcagagttcggacacggtgggtgtgatcgacaccgccaccaacaccgtcacggcctccatcccggccgcgggcacgccactcggactggtcatcaccccggacgggacgcgcgcctacgtcgcatgtctgttcgcgaatgccgtcagagtgatcgacaccgccaccaacaccgtcatcgccacgatccccgtcggtccggttcccatcctgctggcggtcagccccggtgggacacacgtctacgtcacgaacgtcggcaactcgacggtgagcgtgatcgacacggccacgagcgccgtcatcgccaccgtcggcgtcagtgctcagccgcgcttcgcggcagtgagcccggacggcttccacgtgtacgtggcgaactccggcccggacacggtgagtgtgatcgacaccgccacccagaccgtcgtcgagaacatcggcgtgggagacggtcccaccggcatcgcgctcctgcccgacggaacgcgcgcctacgtgaccaacgcggtggcgggcacggtcggtgtcatggcgacgaccgtgattcccgaccagggctcgacggcaggcgggaccaccgtgaccctcaccggtcaccacctggccaacgccaccgccgtgcacttcggcaccgcccaggctgtcatcaccgccaacacggcgacctcgatgaccgtcaccgctcccgccggatccggtgccgttcccgtgacggtcaccaccgcgggtggcaccggcaccctcggacacttctactacgtgccggtccccgccctcagcggcatcaaccccgcagcgggtcccgtcgcgggcagcgatgacgagatcgtcctcaccggccgtcatctcgccggagccatcgacgtgtacttcggcaccacccgagccgtcatccaaaccgtctccgacaaccaggtcaccgtcagggccgccggcgcccccgcaccgggcggcaccgccgtcaccgtgatcaccgccggtgggagcgcgggcggcctgtcctacacgtacctcgacccgtccaccgtcaccggcgtcagccccgactcgggaccgaccaccggcggcaccgaggtgaccatcaccggcaccggcctggccggcaccgagcaggtcaccttcaacggcatcccggcagccttcaccgtcgtctccgacagcaccctgaccgccaccaccccgcccagtggcgccgccggccccgtcggcgtcaccgtcacaggccccggcggcgccccggccggaacgttcacctacgtctccgaacccgacatc

SEQ ID NO: 5725 - DNA, 1407 bp, Streptomyces avermitilis
  CDS (1)..(1407)
atggcgtctcctgcttccggtcgggtacgccctcaagccaagccgcccggcccaccccgggtcagtagcgcacggttccgaccccggggtggtgccaggtacaccccggccctgaaccccactgcatggcaccgccctgacctggccgtctacggttgtctcatgccaaccaacggcccgcggcggcgcgcactcgactgggccgcggcacacgcgccctggtcggcctgggcgtggcgcaacaccgctttcgtcaccgccgggttacccctggcgctgcccgcggcggccgccctctggctcgccctgtgcgccccctggaagaccggaaccgccctcctgctgatgctgctcgccagcggggtgctcaccgccctgcaacgcggccgcttctggtcgctcctcgaactcgacgtgccacgcgtcccggcgcccgcgccctggtacacctggcgcggagtgaccggccggctgcgtgcggagtcgacgtggcggcagtgcgcctatcacctggtggctgcgcccctggccgccgtcggaggtgtcgtggtggtcgccgcctggggcgtgggactggtctgcacgctggtgctgtcgtggctgtgggcggtgccgctgcgggcctcgatgcccgactggtcccggcagtatgtaccgctcacggtcctcggtgtcctgctgctgcttctcaccccgtgggtggcggccgccgtggtccggctcgacaccggtgcggcggcggcgctgctcggccccagccgggccggtgaactgcggcgccgggtcgaggacctggccgtcagccgggccggagccctcgacgcggccgatgccgaacgccggcgcatcgagcgggacctgcacgacggggcccagcagcggctggtctccctggcgatgaacctggggctcgcccgcgccaccctcaccgatctgccgccggaggcgaggcgggtcatcgacgaggcgcaccgcgaggccaaggaggccatcgaggagctcaacaacctggtgcgcggcctgcatccggcggtgctcgacgaccggggactggacgccgcgctctccgggatcgccgcccgcgccccgctgcccgtggagctgaccgtcgacatggccgagcggccctcgcccacggtggaggccgtcgcctacttcgtcgtctcggagacgctcaccaacgtcgccaagcacgcgcgggccacccgggtcggcgtgcggttgcggcgccgggccgaccggctgcggatcaccgtccacgacgatgggaccggcggcgcggatccggcgcacggcaccggactggccggcctggtcaaacgcgtagggtcggtcgacgggaccatcgagatcgacagccccccggggggcccgaccctcatcaccgtggagctgccgtgcgtgctg

SEQ ID NO: 5726 - DNA, 468 bp, Streptomyces avermitilis
  CDS (1)..(468)
atgtccacccttgtgacgccgccccgttgtgcgacgcccgcccgctctctgccggccgccgggggtccgctgtccacggcgctggtgtgcgggggtgccgctcttctgccgtggatggtggtgctcgccaggacgctgcccgcgacggcggaggtacggaactggtcttcggcatgggtgggcctggacgcggccctcgccgtcgggctggccggtacggggctgttgctgcggcgccgtgaccggcgtcatgtcctggctgcggcggccacgtcggcgctgctagtgatggacgcgtggttcgacgtcctgacggcccgggcgggcgtcgagttgctgacggccggcctgctggccgtctgtgtcgagctgccgttggcgggggtgtgcgcgcggatcgcggtacggggactgccgggccgggatgcacgctccctggccggcccgcaccggctcccggtagagcga

SEQ ID NO: 5727 - DNA, 645 bp, Streptomyces avermitilis
  CDS (1)..(645)
gtgcgtgctgtgatcgccgaggactcggtcctgctgcggatcgggctggtcaaggtgctggagatggccgggttcgaggtggccgccgaaaccggtgacgccgagggcctgttgaccgcggtcgaggaacaccggccgcagctggcgctggtcgacgtccggatgccgcccggcttcaccgacgagggggtacgagccgccctgctgatcagacggcagtggcccgagacggccgtactgctgctctcccagtatgtcgaggagcgctacgccgctgatctgctctccgcgcaggcgggcggcatcggctacctcctcaaacaacgcgttgccgacgtcgaggagttcatcgacgcgctgcgccgggtggcgggcggcggtaccgcgctcgacccgcaggtcgtcgcccagctcctgctgcgccgcggcggtgccgacccgttggagcggctcaccccacgtgagcgcgaggtgctggcgctgatggcggaaggccggtcgaacgccggtatcgccggggaactcgtggtgagcgagagcgcgatcgccaaacacatcaacagcatcttctccaagctcgatctgccccacgcggacggcgcccaccgccgggtcctggcggtgctgcggttcctggacggcgta

SEQ ID NO: 5728 - DNA, 804 bp, Streptomyces avermitilis
  CDS (1)..(804)
atgagtctgccgtcgcgtccccgccaccggggcctgtggatcaccgtcgcggtcatcagcgccctcttcgtcctggcccctctcggcagtgaggcgtacgggcagttcgcccgccagacccgctcgacccacgtgaccgagaccagcgaacggcaccggatcggatccgtcgacgtggaggcgggcagcgcggaggtcagcgtaggcccgggccgggacggcggcatccgcatccagcagcgactgtcctggtcgctgagccgtccccccaaggtcgaacggtggtgggtcggcgaccggttgaagatacgcaccgcgtgcgacggcacgttcgccatgaccagcatgggctgccggatcgcgctggaccttcaggttcccgacggcacaccggtgcacgtggtgagcgactccggcacggtccgggccagcggactcaccggcccgctggacatccgcacgggctcgggcacggtcaagctgtacgcggtccacggccccgtcaccgcccacgccggctcggggtccgtgaccggcacggtgctgttctcccccgagatgcacgcccgggccgactccggcacggtggaactggacttcggcgccgcaccccgccgggtcaccggcacggtcgactccggttccctgaccgtcacggtcccaccgggttcccgctaccgcgtccgtggccatgccggttcgggccgggtacacatcgacgaccagctccagcagcccgcgtcgcaccggtccgtcgaggtgtcggccgactcggggtcggtgagcgtggggtatcccgggtgg

SEQ ID NO: 5729 - DNA, 465 bp, Streptomyces avermitilis
  CDS (1)..(465)
ttgggggtgtgggtggctgtcggcttgggcgctcgttgggttggcgtggggagcagagttgagttgcgcccacgggccgcacggatggtacggatggtggagactgggtggatgtcccacgaccccggcgcagtcctgttcatagcgctcggcctcgtacttgtcgccgccggacttgtctggaaggggcgcgtcctgcgccccctctcagcaaaacggtcccaggcggccctggcccgggaccgatccaggaatctgctgcgcgccgcggacatggcgatcgccgaggctcgccggagggccgcacacgacgaaccggttgtcgtcacggtcggcgacgtgatcagcgtggcgcgtcagcactacgggcacgtctctgtggagcgcgaacaggcggctgccgccctccgccgacgctacgaggccgccaggtgccgggcggactgcgtgacggacgctttcaac

SEQ ID NO: 5730 - DNA, 2505 bp, Streptomyces avermitilis
  CDS (1)..(2505)
gtgatcaagccggaggcgattccgcagttcacggggaatctggaacagctggagaaggactacggcagtctgaagacggttgccgggagtattcggaccaccggcaaggacgtgcactcgcagttccaggggttgtcggcgtattacacggcgccggaggcggagcagttgttcgcgtcgacgaagccggtggccgatcgcgcggacggtttcgcggacgatctggagaaggtgtccggtgccctgtcgtcgtatgcgaccgaggtgcgtccgctggtccagaagctggagcagctgaagctggacgcgacgaagttcgtcagctcggtcgagggtgacgacgactgggagtacgacgaggacaagatcgacgagcacaacaagatccgggatgacgtgacggcgacggtcgcggcgttctgggcggcggagcggacgtgtcacaacgcgatcaccaagctgttcggtgggacgcagatggtggcgggtgacggttcggaccgtaaggaccagtacgggttcaacgcggacgacctgaagaacgcgaagcttccctggggtgacccgatggaggagaagcatcacgtctgggaggtcgggcactgggtcaagtcgttcgtgtgggacggcctgatcgtggacggcgtctggggcaccatcaagggtctgggcacgctggtcgggttcggcggctgggacgcgatggggcaggcctggaagggcctcgcacagctcgcgaccggtctggcgatctcctcgattccgggtgcgagcgcgctgttctggactctgccggacgacaagctgccctcctggctgcgggattcgcgtaccgcgatgaaggagaccggcaaggcgctggtggcgtgggacgagtggggcaagaaccccgggcgtgctgccggtgcggtcaccttcaacgtgctgaccaccgtgttcaccggtggtgcgggcggggcggcggccggtgccgggaaggcgggcgcggtcgcgaaggtgctgtccgtcgcgggcaaggcgggcaagttcatcgacccgatgacgtacatcaccaagggcgcgggcgcggggctgtcgaagatcggtgacatcgcgaagggtctgaaggggatcgggaacatcgagatccccaagctccccgacaacgcgatcactctcccggagggcgcgctcaaactccccgacgggtcggtgcatatcccggagggcgcggcgattccggagggcgcggtcaagctgcccgacggcaacttcaaactccccgacgacaccccggcgttccccgagggcacgacgaaactgccgaccgagccgggtgccccggcccagtacctggacccgaagggcaacatcctcgaccaccagggcaacgtggtcgacagcgtcgacaacgcgcccaccgacgtggtcgacaagccgtccgccggcggtaacccggcggacggttcggacgtgccgcacacgccctctccggtcagggaaccggcgctggtcggagcgggctcgcacaccgcggacaacgccgctcacgtcggcgacaacgccggccagacggtccgcctcggcgacagcctgggcgatgacctcggcgacgtaggccgcaccggagacaacgcgggcaccccgaccgtgcacgcgggcgacagtctccccggccaggcgggccacgatctgtccggcggacgtgctgacgacgtggactccactcccaccgccggccacgacatgccgggcggatccaccacggacacactgcctggcggcggccacgaggttccgcacaagggcagtggcctggatgacgcaggtcgcataggggaggatgcgagccataccggtgaccatgcgcctggtgagcacgggcaccacggcgcaggcgctgaggtcgcccacggcggacatgatccggtggatcacggaataccggacggcaatccggcgcatcccttcgacgaccacgcggttccgcacgcgagtgcaccccacgacgggcccggactcgaaggcaggggcacgcctacgcccactccacagacgcattctctggggctgaaacgggacggcttctccatgatgcggccggatgacgccttctaccgggaagccttgaagtcgaagccgcttcccgggcattacgacgtcgtggctcatggcacgccacacaacacgttgatggacacggccggaggacgggaactcaatcctcggcagttggcggacatcgttcgaaggcgagccgactacgctcctgggacacccattaggcttctgtcatgcaacacgggccatgtggacgggtcgttcgcctcgcaactcgcacgcgatttggacgcacccgtcatcgctcccgacggcttcctctacgccgaccagtggggacgcttcggagtgcaccgtgaccttcttctgttcgtcaacagcgtgccagcacttccgaataccttctaccgctaccatcccggtggctacgtcgaggaaatcccccgctctgagtgggctgtggat

SEQ ID NO: 5731 - DNA, 249 bp, Streptomyces avermitilis
  CDS (1)..(249)
atgctgatgtctgcggggaacatcattgaccccctcggcgtggagaaggggcctgtcgttccctttggtttctcaaccgatggggagtgggcgtggccgacgtactgggcgtactttgtccgcgagtacggagtctcggccccggatgactttatggagcacgtcaagtctcgcggatttgtgccgacggatctcacggacgagcaagcgcagcaggcggctgacggtattcagaaggcgctgtacgga

SEQ ID NO: 5732 - DNA, 240 bp, Streptomyces avermitilis
  CDS (1)..(240)
atgagcaccgacctggcctggttcaaaagcagctacagcagcggttccggcgacgactgcgtggaggtcgccctctcctggcgcaagtccagctacagcagcagcggcgacggcgactgcgtcgagatcgccacctgcccctccaccatccacatccgcgactccaagaacacccagggcccccgcctcaccctctcccccaccgcctgggcggacttcgtcacccacaccgcccggccc

SEQ ID NO: 5733 - DNA, 840 bp, Streptomyces avermitilis
  CDS (1)..(840)
atggcggtcgatggtgcggtggggacgggcggcggcgagccggacgcgtcggacagtctgcggacgttcggggcggttgtccaggcgctgcgggagcatgcggggctgagccgggaggagttcggggagcgggtgcggttctccaaacacacggtggcgtcggtggagttgggccgacgcatgccggatccgacgttcgtggagcgggcggaggaggtactggggaacacgggggcgttacggaaggcggtggggcatctggcgcggcagccggggttggcggcgtggttcaggcagtgggcgcggttggaagcgaacgcgatcaccctgtatacgtacgaatgccggatggttccggggttgttgcagccggaggcgtacgcgcggcaactgttcgcggatgagttgccgccgctggacgacgaacaggtcgaagctcagtgggcggcgcgggcggaccgtcagcggctgttgcgggaccgcccgaatagcgcgttcagcttcatcctcgaagagcacctgctcctgcgacggacaggcggtgtgggggtcacacgagggctcatcgaccacatcatggaggtcgcgcagctgcgaaacgtcgagatccagatcatgccgttggtgcgggagtcgcatgccgggctacatggtccgatccgactgctggagaccccagagaaccagtggttcgcttacaacgagggccagcaaagcgggctgttgatctccgactcaaaagtggtcagcgtgctcaagcagcggtatgccaggatgcgttcacaggctctcaccttggtggactccttgagcctgctggaacggatgcgaggagaacta

SEQ ID NO: 5734 - DNA, 456 bp, Streptomyces avermitilis
  CDS (1)..(456)
atgaccgcaccatccgtcccccaaagcccggttaccgtacgtgtgttcacccagcgcctcagtgccaccccgctcggcgcccgcctcgcccggcatctcgccctgaaccagctgcacgcctggggcatcccgcacggctcgcgcgcgtccgacaccgtcgccgtgatcgtcgccgagctggcggcgaacgccgtgacccacggccgcgtaccgggccgcgacttcgaactgcggctctcgctcgtcccgggcagcgtccgtatcgaggtcaccgacacccgcgacgaactgcgcccgcccggccccggcgacgtacggtcgccggagcccttcgaggagtccgggcgcgggctcctcctcgtcgaggcgctcgccgaccggtgggaggtgctggaccgcgacccgcccggcaagaccgtacgagccgaggtcgacgtgccgcgcggaaagcgggcg

SEQ ID NO: 5735 - DNA, 2928 bp, Streptomyces avermitilis
  CDS (1)..(2928)
gtgtacgccgccgccaccgcccccaccggcccggcccccggccccccggccccggacggccgcccgcacacggtgggcttcgaccagtactccctgctcatcgacggcaagcgggtcgtcctgtggtccggcgaggtgcaccccttccggctgccgagcccgtccctgtggcgggacgtcctgcagaagatgcgcgcccacggctacaacgccgtcagcatctacgtctcctggaactaccactcccccgcccccggctcgtacgacttcaccggtgtccgcgacctcgacctgttcctgcgcatcgccgccgagaccggcctgtacgtcatcctgcgaccgggcccgtacatcaacgccgaggtcgacgctggcggcttccccggctggctgaccgccaccgagggcacggcccgcacctccgacccgacctacctgtcgtacgtggacgagtggctgacggccgtcgaccggatcgcggcccggcacctgttcacccggggcgacggcacgatcgtcctctaccaggtggagaacgagtacgccgaccacgtcaccagtcccctcggccgcgactacatggcccacctgtacgccaaggtccgcgctgacggcatcgacgtccccctcttccacaacgacaagggccggaacggacattgggcgcccggcaccttcgacacgggcggcgagaccgggcgttggctgtacggcttcgacggctatccttccccctccgcgccgccgcccgactgggggtacttcggcgtcggcggggtgaagggcgggtcgacggccagcccccggaccccggggttcgtccccgagttcggcggcggctggttcgatccctggggcggggccgagttcgacggcaaggggtacgccgagtcgcgccggacgcgggacgcggcgtacgagcggcgcttctatctcaccaacctcgccaacggcatcaagctccacaacgtctacatgaccttcggcggcacatcctggggctggctgcccgcgccgatcgtctacacgtcgtacgactacggagccgccctcgacgaggcccggcagccgaccgcgaagctggtcccgatgcatcagctcgggcatctgctccagtccgtgcccgagctggcgaagctggaccgggcggacgacgtcacgatcgacgaggcgggcggcgaggggggcgccgacctggggatcaaggggattgagggaatcaaggcgtaccacctcgtcaacccggacacgaaggcgcacttccacgtgctgcgcaacgacacatccgacgaccgccgcgtctccctccacctcgactccgagacgtccgtcaccgtgcccgtgcccggcctcgacgcccggctgatcgccaccggaatcgcgctcgggcgccgcaggctgcggtactccagcgcccagcccatgctgtggctcaccgccgggcgccaggacatcgccgtgttcaccggccggccgggcgatccgacggagacgctgctggagtgcgcgagcaagccgaaggtcacggtgctggaggggacggcccgctacgcgtacacggacggcgcgctacgggtggacgccgaacccggcgccgcggcaagggtgttggtggagggcggcggcgccaccgcccctctcctcctgctcttcgccgacgacgaggcctccgcgcggctgtggcggtacgacaccccgtcggggtcggtcctggtacgcggcccggcgctgctgcggacggcgacggtacgcggcaccaccgtgcacctcgccggggacacggtgaaggacgcggacctggaggtgtgggcgccgcgcggggtgtccgacgtggtgtggaaccggcgcacggtgcggacgcgcgccacggcctccggcagtctgcgggccgtgcggcggttgcccggcgctccgaaggtgacgctgcccgcgctcaccggctggcgccgacaggccgagaacccggagtccgccgccgacttcgacgactcggcatggcggacggccgaccggacgtcgtcgtacagcacgacgcccgtacccaccggcgggccggtcctcttctccgacgactacggcttccactacggggacgtctggtaccggggccgtttcgagggcggctccgttgccgacacggtgtccttctcctatgtcacgggcacgcaggggctgctgatggcgtggctggacgggaagccgctgggcacgcaccggatgccggtgccggacaagaagacggtgcggaaggggacctggtcggcgacggcgaccttcccggtcgaggtgagggagacgacggacgccggcccgcacgtccttgccgtcctcgtccgccggatgcagcacgacgaggacggcaaggcgaacgacagccacaaggcggggcggggtctgtcctcggtgaccttcaatggcgcctcaccggaggtgagttggcgcattcagggtgaggcggcccccgacccggtgcgggggcctttgaacaacggcggtctgtacggggagcgcaacggctggcacctgcccgggttcgctgacggccgctggccggcggccgacttcccgcgcagcgagcgtcggcagggcgtgacctggtaccggacgggcttccggctgaccgtggacccggaggtggacgcctcgatcggactgaccctcacggacgacgaccccgcccgcgcctaccgcgtacagatcttcctcaacggctggaacatgggccagtacatcaacgacgtaggtccccagcacaccttcgtcctgccgaacggggtactgaacacacgtgggccgaacacactcgccctcgccgtcctgtccgacgggacgacgtcgtcggggccggggaaggtggaactgacgctgctgggacgggcggccggcggggtcccggtgacgctggtggactctccgggtcggaggaac

SEQ ID NO: 5736 - DNA, 456 bp, Streptomyces avermitilis
  CDS (1)..(456)
atgaggatctcggcacgagcggattacgcggtacgggcggtactggaactcgccgtccgcgaggacgacggcccggtgaaggcggaggccatcgccgccgcgcaggacattccgcacaagttcctggaggggatcctcggcgatctgcgccgcggcggcctggtcgccagccggcgcggcggcaacggtggctaccgcctcgcgcgcgccgccgacacgatcaccgtcgccgacgtcatccgcgcggtcgacggcccgatcgtgtccgtacgcggtgaacggcccaccggcctcacctacaccggctccgccgaaccgctgctgccgctgtgggtggccctgcgcgccaatgtgcgcaagatcctggagggcgtcacgctcgccgacatcgcggcggacgcactgcccgcaccggtacgggaactggccgcggaaccggcggcctgggagaacccg

SEQ ID NO: 5737 - DNA, 867 bp, Streptomyces avermitilis
  CDS (1)..(867)
atgtccatgactgagaaccaagcgcaacacgagcagaacgacaacaacgtcccgcagcccgcgagccaccgtcgggacaagagtgttcagcggcgccgtatcctcatcggcggcggcaccatggcagtggcgggcggactcgccatcgcgggcatggcctcggccgacccggtcacggacagcacgacgaaggccgacacatcaggttccgcgaccacgtccgcctccacgtccgccaccacctcctccggcgtctgcaccctgaacgccgaggtcaccgagggcccgtactccctcgacggcgccctcgtccgcgaggacatccgggaggacaaggagggcgtcgaggtccagtacaccctcaccgtcgtcgacaccgcgaacgactgcgccccgctcgccgacgccctcgtcgagatctggcactgcgacgcgctcggcgagtactccggtttcgtcggccgcaacggccacaccgaggaggacgacggcaccttcctgcgcggcgggcagctgaccgactccgacggccaggtcaagctcatctccatctggcccgggcactacgtctcgcgggccgtgcacgtccacatgcgggtgcacaccgatgtgacgctcaccgacgactcgtacaccggcggcgaggtcatccacaccggccagctgttcttcgacgccgacatcaacaccgagatccaggccatctcgccgtactcggacaacaccacgaaggagacccagctcgacgacgactccatctacgacgacggcggcgcgtcgagtggtctgctgacgctgaccgcgctcggctccagtgtgtcggacggttacaaggcgacactgaccgtgggtgtcgacagctccagc

SEQ ID NO: 5738 - DNA, 1188 bp, Streptomyces avermitilis
  CDS (1)..(1188)
atgtccacgcacgcatccgcgcacggatccacccacacatccacccaccaccccatagccgtcatcggcgccggtctcggcggtctcgccgcggcccgggtcctgcacgtccacggcatcgaagcggcggtctacgaagccgacgcgtccccgaccgcccgccaccagggcgggatgctcgacatccacggggagtcggggcaggccgcactgcgggccgccgggctctacgaggagttccgggcgatcgtgcaccccggaggcgaggcgacccgcatcctcgacaaggacggcacggtccggcacgaggagggcgaccgtccggaggagggcgaccgccccgaggtggaccgcaacgatctgcgccgcatcctcctcgactcgctgcccgagggcacgatccgctggggcgcgaaggtgacgggcgcgcgggcgctgggcgggggccgtcacgaggtgacgctcgcggacggcagcgtgttcacgacggacgtactgatcggcgcggacggggcctggtcacggatccgcccgctgctctccccggccacccccgcctacacgggcatctccttcgtcgaggccgacctgcacgaggcggccacccggcaccgtgcggcggccgaactggtcggcggcggatcgatgttcgcgctcgccgaggggaaggggatcctcacccacctggagaccgacggctcggtgcacgcgtacgtcgccctcaaggccgacgaggactggttgtcgaccatcgacttcaccggcaccgacaccgacaccgccaagaagaccctcctgacgcacttcgaggactgggacgaccgtctgcgcgccctgatcaccgacgccgacggagcgctggtcccgcgcctgatccacgccctgcccgtcgaccaccgctgggagcgcaccgcgggcgtgacgctcctcggcgacgcggcccacctgatgtccccgttcgccggcgagggcgcgaatctcgccctgctggacggcgcggaactggccacggccctggccgcccaccccgccgacccggagtccgccctcacggcctacgagcggtccctgttcccccgcagccaccgggccgccggcgagtccgcggcgaacctcaccttcatgttcggcccgaacgccctggaggaactggtcggcatgatgagtgggcacgagccgtccgaccgc

SEQ ID NO: 5739 - DNA, 876 bp, Streptomyces avermitilis
  CDS (1)..(876)
gtgatctcgtccctgcgcgacatcgcgaacgaacatgttcgctacgtccttgttcgtagcgaacatgttcgttactgtcttcgtatgacaccgcactccccctccccccgaagccgccgcgagcggcccgccaaaccggccctgacccgggccgggatcgtcgcgaccgccgtcgagctgatgcgcgccgaggggctggagcgggtcaccatgcgacgcctggcccaggagctcgacacgggcccggcgtcgctgtacgtgtacgtccgcaacaccgcggagctgcacgcggccgtcctggacgagctgctgggcgaggtggacctgtcccccgtccggtccgcgggcgactggcgcgaccggctcgcacgcctgctgacgtcgtacgtggaggtgctgttcgagcacccggcgctcgcccgctcggcgctggtggcccgcccgtccggggagcactacctcgacctggtggaggcggtcctcgcgctgctcgccgagggcggggcggcgccggagcgggcggcctggggcctggacctgctgctccagtacgggacggcgacggcggccgagcactccacgcgggccgagagcgccgacgcgcagcgggaccgggaggcactgaccgccgtactggacaactcctcgccggaccggcacccgcagatcaccgcccttggccccgacctgatcgccggggccggcgaagcccgcctggcctggggtttccaggtgctgctcagcggaatcgtgacggcaccggacccggacacgaccccggccgcgggcacgggcgcggacgcgggcacgggcgcgggcgcgggcgcgggcgcggacaagaactcagccccggacacggccacggacaccacaccg

SEQ ID NO: 5740 - DNA, 813 bp, Streptomyces avermitilis
  CDS (1)..(813)
ttgcccaacgcacagcgcttcaacaggaagtgttcctacggtgccgtgttcatgacagacacttcagagccctcgatcgggcgtcgcaccgtactgatcgcgaccggcgccacggccgtcaccctggccgtgagcgccgccgccgcgactgaagcccccacagccgacgcgaaggacgcggcccccgccgccgcggcggccgtctgcaccctcacgaaggagatgaccgaaggcccctactacctcgacggcgccctcgtccgcgccgacatcaccgagggcaaggcgggcataccgctcaagctcgcgctcaccgtcgtcgacgactccacctgcgcccccatcagcaacgcgctcgtggagctctggcactccgacgcgctcggcgagtactccggattcgtcggcaacaacggccactcggagccggacaacggcaagttcctgcgcggcggcgtgctgacgaactccagcggcgtcgcgaacatcacctcgatctaccccggctggtaccgcggccgctgcgtccacatccacgtcaaggtgcacaccggcgtcacgctcacctccgacggctcgttcacgggcggccaggagctgcacaccggccagttgttcttcaacgagacggtgacgacggcggtcgcgaagatctccccgtactcgaccaacacggtcacccgcaccacgctcgcgcaggactccatctacgacgacggaggcgccgcgtccggcctgctcacgctcacggcactgggcagctcgacgtcatcggggtacgccgggacgctcacgctgggggtcgaccagggc

SEQ ID NO: 5741 - DNA, 186 bp, Streptomyces avermitilis
  CDS (1)..(186)
atgcaggtgcgggtcgagggctacgactggagccgctacaacggcaagcagaagaagtccgtccccctcgacaagctgaactgggacggcgccgcccttcacaccgacgacgcgtacatacgcgtctgccgtgacaagggctcactgaaccctgacaactgctcgccgaccaagcactaccagagg

SEQ ID NO: 5742 - DNA, 720 bp, Streptomyces avermitilis
  CDS (1)..(720)
ttgggggaagccaacagcatgtcagaaattcttactgctacgggagttgacctctcctacggcaatcagccggccgttcgcgacgctcacctctcggtctcccccggggaagtcgtggcgatcaccgggcagagcggttccggcaaatcctcgctgctgtattgtctcgccggcgtcctgcccgccacccgcggtcaggtgcggttcgaagggcgggcactcggcgacctcgccgacgaggagatcagcgtgctccgccgggagcgcttcggattcgtctttcaatacggcgagttgctcccggaactcaccgtcgaggagaacaccgccctgccgctccgcttggccgggcagcgcaagggacccgcgctcgcggcagccggcgaggtgctcgaacgtctcggactcggcggactgcgtgagcgtcggcccgcacaggtctccggcgggcagagccagcgcgtcgctgtcgcgcgttctctggtccaccgacagtgcgcccaagtcgtgctgccgctgggtttcggcctggttctggcactcgtcacgggcaaactcgccgagtccagttacctgatcaccgggggcggcacggtccgctgggatctgcccggcgtcccactgctggcactcgccgcggcaggcgtggtagcggctgcggcggcgagctcgctgccactggtaggccgccgtgtcgacccggaactgatccgccgcgac

SEQ ID NO: 5743 - DNA, 831 bp, Streptomyces avermitilis
  CDS (1)..(831)
gtgcgccgtaccccgacctgcgttctgagcgacgcggctccccccgacgtcggcgacggtcatgccctggaccgtttcgtcgaaatcggctcgctcaccaaggtcgtcaccggcaccgcactgacccgcatggccgcggccggggtgctcgagctcgacgatcccgtcgagcggtggcttcccgcggcccccggtaccgggatcacgctccggcacctggcccagcacacctccggcctcccccgtctgccgccccgcgtctcccgtcgggacccgtacgcggagttcgaccgtcccgcgctgcaccggctgctgcaccggctcgacgcgatcgccacccgccctgccggccgtcaggaggagtactccaacctcggctacgccgtcctcggcgaggccctgagcgccgcggccggcaccggctacgaggagctggtgaccgagtacgtccttcgtccgctggacttggcggaggtgaccgcgcacccggacccgagcaggcgcctgcccgccccggggctcttcggttggccccgcaggccgtggacgatgcacggcgcgatcctgcccgcgggaggcctgtgggccaccccgcgcgcggcggccgacctggtcgtacgcctcctggtggaacgccggctgggggagcccgcgccgacctggcagacggcgggccccctgcgctggcacaacggggccacgcgtgacgcctcggtcttcgccggagcgctggacgacggccgctgggtgctgatccaccgcctcaacgcggcgccggacgacaccgaccgggccggcatcgaggcgctcaagcggagccgggccgcctcc

SEQ ID NO: 5744 - DNA, 1647 bp, Streptomyces avermitilis
  CDS (1)..(1647)
atggccgaaaacgtcacctcgctgttccgcagcacgtcggcgcacagcccgtcgatggccgcgctgacgcgggagagcgacggggccggcccggtggacttctgtattccctgcaacccgtacttcccgacgcccgccatgttcgacgacctggccggccggttgcgggagatcatcacgtactacccgagcagcgcggacaccatcacggccgagctgtgcaatctgctccagctgccgccgcagtgcgtcgcgatgggcaacggatccaccgaactcatcacctggatcgaccatctgctggtccgcgagtccctcgccatccccgtccccaccttcggccgctggaccgaccagccgatggagaccggcaagcgcgtcgacatgttcccgctccaggagtccagcggcttcgccctcgacctcgcccagtacgccgagttcatacgggcccgcggcacccgggtcgccgtcatctgcaacccgaacaaccccgacggcggcttcatcccccgccagtcgctgatccagttcatggacgcgatggcggacctggacctgatcgtcatcgacgagtcgttcctggagttcgccgacgcggagaacgaaccgagcgtggtcgaggacgcggtgatgcgccccaacgtcatcgtgctgcgcagcctcggcaagaacttcggcctgcacggcatccgcttcggctatctcgtcgccaaccctgccctcgcgggcaaggtgcgttccatgctgcccaagtggaacctcaactccttcgcggagaccgtggtgttcatgctcaaggagcacggcgccgaatacctggagagcctgcacatggtccgccgggaccggctcgacatggcccgccagctctccgcgctgcccggtctgacggtctacccgtcgcagggcaacttcctcttcgtgcgcctccccgtgggcgccgaaggcaccgtggtccgggaccgactgctcaccgagcaccgcatcctggtccgcgagtgcggcaacaagatcggttcatccagccgcttcctgcgactcgtggtgcgcccccaggtggacgtgcgtcgcctggtgtccggcctggaacaggtgctctacgggaccaggaggggagccgccgtgcccgagctgggcacagggaccagctacagctcgggtacggcggcggtggaccggttggtgggggagacgaacggggcggggatgccgggtctggcggcccaggcggcggggatgcagtccctggcaccgggggccgcccaggcgcagaacccctacccgccgcagtctccgtacccgacaccggccccggccgcgatgccggcgcccgctcccatgcccgcccccgcgatgcccgcgccggcccccatgccgtacgccgcgccggccgcggccatgccgagcatggctcccgcccccaacgcgcccatgccgggcatggcccccgccccggccgccgggctgacggcggtggcgcagaccggcatgcccggtctcgccagcgccgcacagaacaaccgccggggcatgggcgccgcacagggcctgaccgccgcccaggtcagaggccgcacccagccggaaccgacaccggagccgacgggctggccggccgcgggggcgatgtacaaccaggtcggc

SEQ ID NO: 5745 - DNA, 1149 bp, Streptomyces avermitilis
  CDS (1)..(1149)
atggaactgaacagacgcacactcatcgcgggcaccgcggccgcgggcatcgcggcgaccacgctcggcgggacggcacaggccgccccgggaagcggaaggccggtgaaggagctcttcggcaagctcgccgacgggacgaagatctaccgctggtcgctggagaacggcggcacccggctgaaggtcctgtcgtacggcggcatcgtccagtccctggagatcccggaccggcacggccgctacaagaacgtgtcgctgggcttcgccaccatcgaggactacgtcgcgaagaccccgtacttcggcgcgctcatcggccggtacggaaaccgtatagccaagggccggttcgacctcgacggcaagtcctaccagctgtccgtcaacgacggggtcaacagcctgcacggcggcgccaagggcttcgacaagcgcccctgggacatcgagggcttcacctccggttcggacgtgggcctgcacctgtactacacgagcgtcgacggcgagatgggctacccgggcacgctcaaggcgaaggtcacctacacgctgaccaggcacggcgactggcgcatcgactacgaggccaccaccgacaaggccaccgtcgtcaacctcaccagccatgtctactggaacctggcgggcgagggcagcggctcgatctacgaccacgaactgaagatcgccgccgcccgctacacccccgtcgactcgggcctgatccccaccggtgagctggccaaggtcgcgggcacccccttcgacttccgccgtacgaagaccgtcggcgaggacatccgagaggcgaaccagcagctcctgtacggcaagggcatcgaccacaactgggtcctcgacaaggggatcacggcgaagcccgcgcacgtcgcgacgctccgggacccgtcctcgggccgcacgctgaggatcgcgacgaccgagccgggccttcagttctactccggcaacttcctggacggcacactggtcggccccggcgggcacatctaccgccagggcgacgcgctgtgcctggagacccagcacttccccaactcgccgaaccagccggcgttcccgtcgacggtgctgcggccgggcgagacctaccgcagctcgacggtgcactcgttcgacgcc

SEQ ID NO: 5746 - DNA, 1242 bp, Streptomyces avermitilis
  CDS (1)..(1242)
atgagtgccaatgtcacggccaagacaccggccgaagcgtcacccgggggaagtccctccggatccggtcccggcctgctccggctgctggtcgacggcatgcgcagcaacatgcgccagtacggcatgctgatcgccctcggggtgatcgtggccctgttcgcggtgtggacgggtggcgacctgctcctgccgcgcaacgtgtccaacctcgtgctgcagaacagctacatcctgatcctcgcgatcggcatgatgatcgtcatcatcgcgggccacatcgacctgtcggtcggctcgatcaccgccttcgtgggcggtgtggccgcggtgctgatggtcaaccacgacgtgccctggccgctcgcggtgctgctgtgcctggccgtgggagcggccgcgggggccgcgcaggggttcatgatcgcctatctgggcatgccgtcgttcatcgtgacgctcgccggcatgctgatcttccgcggtctgaccgaggtcttcctcaagggccagacgctcggcccgttcccggagggccttcagaaggtcgccaacggcttcctgcccgaggtcggcccgaagaccaactaccacaacctcacgctgctgctcggtctcgcactggtcggcttcgtgatctggcgtgagatgaaggaccgcaagcggcaggcggagtactccctcgaggtgctgcccgccaacctgttcgcggtgaagctcgccctgctgaccgcggcgatcatcgccctcaccatggagctcggcagctacaagggcgcgccggtcgtcctgctggtcctggcggtgctcctggtcggcttcggctacgtcatgcgcaacgtggtggtcggtcgccacgtgtacgcgatcggcggcaacctgccggcggccaggctgtcgggcgtcagggacaagaaggtcaccttcctcgtcttcctcaacatggggatgatggccgcgctcgcgggcctggtcttcgcggcgcggttcaacggagcctcgccgaaggccggcgtcaacttcgaactcgaggccatcgccgcgtcgttcatcggcggtgcctcgatgagcggcggcgtgggcaccatcctcggcgccatcatcggcggcctggtcctcggtgtgctcaacaacggcatgaacctcgtcggcgtcggcaccgactggcagggggtcatcaagggcctcgtgctgctcgcggcggtcggcttcgacgtgtggaacaagcgcaaggtcggttcg

SEQ ID NO: 5747 - DNA, 1539 bp, Streptomyces avermitilis
  CDS (1)..(1539)
atggcgggacccgtcctggaaatgcgctcgatcgtcaagacctttcccggcgtcaaggcgctctcggacgtcaccctgaccgtccgtccgggcgaggtccacgccatctgcggggagaacggcgccggcaagtccaccctgatgaaggtgctctccggcgttcacccgcacgggagttacgagggcgaggtcctcttcgagggggagacctgccgcttcaaggacatccgggcgagcgagcagcacggcattgtgatcatccaccaggagctggcgctggtgccgtacctctccatcgcggagaacatcttcctcggcaacgaacacgccgcgcgcggggtcatcagctggaacgacacgctgaagcacgcgagccggctgatgcgccgggtcggtctcgacgatcacccgcagacccgtgtcgccgacatcggcgtgggcaagcagcagctcgtcgagatcgcgaaggccctggcgaaggaggtgaagctgctgatcctcgacgagccgaccgcggcgctcaacgacgaggacagcggcaaactcatcgatctcatcctggagttgaagaaccagggcatcacctcgatcatcatctcccacaagctcaacgagatcgagcgggtcgccgactcggtgacgatcctccgggacggccggaccatcgagaccctcgatgtgaaggccccggagaccaccgaggagcggatcatcaacggcatggtcggccgtgacctcgaccaccgcttcccggagcgcaccccgcaccagccggaagcggacgcggcaccggccctggagatccgcaactggaccgtgcaccacccgatcgaccagcagcgcaaggtggtcgatgatgtgtcactctccgtgcggcgcggggagatcgtcggcatcgcgggtctgatgggcgcgggccgcaccgagctcgcgatgagcgtcttcgggcgcacctacggccggtacgcgcagggcaccgtcctcaaggacggcaaggagatccgtacgaagaccgtccccgaggcggtcgcccacggcatcgcgtacgtcaccgaggaccgcaagcactacgggctcaacctcatggacaccatcggccgcaacatctcgctcagcgcgctgggcaaggtcgccaaacggggtgtcgtcgacgaccacgaggaacgcaaggtcgccgagggcttccggaagtccatgaacatcaaggcacccaccgtcttcgagccggtcggccggctgtcgggcggcaaccagcagaaggtcgtcctcagcaagtggatcttcgcgggtcccgatgtgctgatcctggacgagccgacccgcgggatcgacgtgggcgccaagtacgagatctacacggtcatcgaccagctggccgccgagggcaaggcggtcgtcttcatctcctccgaactccccgaactgctcggcatgtgcgaccgcatctacaccatggcagccgggcggctcaccggtgaggttccgcgttccgaagcgacgcaggaagtgctgatgcgccacatgaccaaggacaagagg

SEQ ID NO: 5748 - DNA, 1110 bp, Streptomyces avermitilis
  CDS (1)..(1110)
atgcgcaatcgcagagccgccctcgccgtcatagcctccgccgcctccctcgccctcacgctgtccgcctgcgggcagaacagcgagggcggcagcaaggacgagaagaagagcgccaagggctccacggtgggtatcgccatgcccaccaagtcctcggaacgatggatcgccgacggcgccaacgtggagaaggacctgaaggcggccggctacaagacgaagctggtgtacggcgaggacgaccccgacacccaggtctcgcagatcgagaacatgatcacccagggtgtctcggccctgatcatcgcggccatcgacaacaagtccctggacaacgtgctccagcaggcggccgacgcgaagatcccggtgatctcctacgaccgcctgatcctcggcaccaagaacgtcgactactacgcctccttcgacaacgagaaggtcggcgagctccaggccacgtacatcgtcgacaagctcggtctgaaggacggctccaagaagggcccgttcaacatcgagctgttcgcgggctcgaacgacgacaacaacaccaagtacttcttcaacggcgcgatgaaggtcttcaagccgtacctcgacgacaagaagctggtcgtcaagtccggccagagcgcgctgaaccaggtcaccaccctgcgctgggacggcggcaccgcgcagaagcgcatggacgacctgctgacctcgacgtactcgaaggcccgggtcgacgcggtgctctcgccctacgacggcatctccatcggcatcctgtcggcgctcaagtccgacgactacggctcgaagtccaagccgctgccggtcgtcaccggccaggacgccgaggtcgcctcggtgaagtcgatcatcgcgggtgagcagacgcagaccgtctacaaggacatccgcaagctcgccgaggtcgccacgaacatggtcgactccgcgctcaacgacaagaagccggagatcaacgacaccaagtcgtacgacaacggcgacaaggtcgtcccggcgtacctgcttcagccggtgagcgtcgacaagagcaactacaagcaggagctcatcgactcgggatacctgaaggcgagcgacgtccag

SEQ ID NO: 5749 - DNA, 966 bp, Streptomyces avermitilis
  CDS (1)..(966)
gtgaccgacgcttcccctacggcgccccgtcgacccggtgagcaggcactcgccgcgctcggcctgggcgcgcccgccctctcccccgccgacgcctcgccgcacaccttcccggggggcggccgctggcgcaccgaggtgccctccgtcgagggccccgaagcgctcgccgtggtcctcaaggagtcctcgcggctcgatgtgccgatccaccggatcagccagggcagcggcatctggatgctgaccgacgccgagatcaccgagatggtcgaggccaccgccgcacgcgacatcgaactctgtctgttcacgggcccgcgcggcacctgggacatcggcggctccacccgcagcgactcgcgcggcggcggactgcgcgcccggggccacgacgcggtggccggctgtgtcgaagacgccgtccgcgccaccgagttgggcgtcaagtgcctgctcgtcgccgacgagggcgtgctgtggaccctgcaccgggcgcgcgtcgcgggcatcatcccggccgacacgaccctcaaggtctcggcgctgatcggtcccgtcaacccggccgcgtacgccgtgtacgagaacctcggcgccgactccgtcaacgtaccgagcgatctgacgctcgctcacctcacggagatccggcgggtttccgccgcccccatggacatgtacatcgaggcccccgacgatctcggcggctatgtgcggatgtacgaggtcgccgagttgatccggcgcggcgcaccgctctacctgaagttcggcctgtccaaggcgcccgggatctacccgtacgggcaccacctgcgggacctgaccctgaacaccgcccgggagagagtgcggcgcggccggctcgccctggacctgctcgcgcggcacggagcggacggcgacatggcgccgctcggttcgcggctgcccggcacgctcagacggttcgacacctcctca

SEQ ID NO: 5750 - DNA, 1002 bp, Streptomyces avermitilis
  CDS (1)..(1002)
gtgagcggcgcggtcgtcatcgaggcgccgggcgagtaccggatcgtcgcgcacgagccgacggccccggccgccggcgaggccctggtccgtgtccacgcgtccggcatctgcggcagcgaccgcgaggtctaccagggcaaccggcccgaggggtacgtccgttacccgctcacccccggccacgagtggtccggcacggtcgaggcggtgggtgccggggtgccggggaccctggtcggccgcaaggtggtcggcgagggcttccgcaactgccaggtctgcgaccgctgccacgcgggcgagaccacgctgtgcaccgccgggtacgaggagacgggcttcacccagccgggcgcgatggccgccaccctgaccctgccggcgcggctgctgcacgtcctgccggacgacgccgacctgaccgccgccgcgctcctggagcccgcggcctgcgtcgcggcggccgccctcaaggcgaacgcccggcccggcgagcgggtcgcggtggtcggcacgggcacgctcgggatgttcgcggtgcagttcctcagggcgggctcccccgccgaactgctggtggtgggcacccgcccggaccgcgagaagctctcccgggacttcggcgccaccggcttccgtacgaaggaccaggagctgcccgccgacttcgacgtcgtgatcgagaccgccgggtccgcgtccgccgcgcgcaccgccgcctccctgctcaggcgcggcggacgcctggtcctgacgggcatcccggcgccgggcgccgaagggctcgaccccaccgatctcgtcgtacggcagctggaggtgcacaccgtgttcggggcgccgccggacgcctgggcgcacacggtccgggtgttcggggcagggctcctcgacccgctgccgctggtcacgcacgaactgccgctcgtcgagttcccccgggccatcgagctggtgggctccggcgacccggaggtcggaaaagtccttctccgcccc

SEQ ID NO: 5751 - DNA, 1155 bp, Streptomyces avermitilis
  CDS (1)..(1155)
gtgcgcatcaccggaatcagcacacatgtggtcggaacgccgtggcgcaacctgacctatgtccaggtgcacaccgacgaggggatcacgggtgtcggcgagacccggatgctgggccacaccgacgcactgatcggctatctgcgggaggccgaggccaatcacattctcggctccgatcctttcgccgtcgaggacctcgtacggcgtatgaagtacggcgactacggccgggccggcgagatcgtgatgtcgggcatcgccgtgatcgagatggcctgctgggacatcaagggcaaggccctcggggtgccggtgtggcagctgctcggcggcaaggtcaccgacaaggtcaaggcgtacgccaacggctggtacaccaccgagcgcaccccggaggcgtaccacaaggccgcacaggaagtgatcgcgcgcggctacaaggcactgaagatcgaccccttcggaaccggccacttcgagctcgaccacgacgcgaccctctactcggtctccctcatcgaggccgtgcgcgacgccatcggcccggacgccgagctgatgctggagatgcacggccgcttctcccccgccaccgccgtccgcctcgcccgcgaactcgcgcccttcaagccggcctggctggaggagccggtgccgccggagaacctgaaggcgctggagaaggtggccgcgaaggtcgacatcccggtggccaccggcgagcgcatccacgaccggatcgagttccgcgagctgttcgagagccagtcggtggacatcatccagcccgacgtcggccacatcggcggcatctgggagacccgcaagctggccgcgaccgccgaggcccactacgtcctcgtggcgccgcacaacgtcggcggcccggtactgacggccgcgagtctccaggtcggcttcacctccccgaacttcaagatcctggagcacttcaacgacttcgcggacgcggagatcaagaaggtggtgaagggcgcgccgcaggtcgtcgacggctacttccacctctccgacgcgcccggcctcggcgtcgagctggacaccgacgcggctgccgagttcccccagcagcaggcccggttcgacctgtgggcggacggctgggagcagcgcaagccgaaggggagcaag

SEQ ID NO: 5752 - DNA, 741 bp, Streptomyces avermitilis
  CDS (1)..(741)
atggactactgcgacccgtgccgaaggcacctcaacggcgccctcgcctgcccggggtgcggcaccccgatcgaagagctgcgcgcgtacgcggacgaggccggcgcacgcccggacgccgaggacgcggacgcgtcgtcggccgagggtgccgcggcggacggggcgcggcccggccgggccgagagccggcgggggaccaaggggcgcggtgggcgcggcgaccgcggggcaccacgggccggccggcgtgaccgcaaggccgccgcacaccgcaggcgccgtcgcacggcactgctcgtcggtgcggggctgctgctggccgcgggcggtctgagcctcgccgaactcggcatcgaggcgccgggctccactcccaaggccaccgcggccggcggtgcgacggccgacgggtcgtcctcctccgcggcgaccacggccgagccgatcggcgacaccgcgggcggtgacggcacctcggcctccggctcaccggacgcctccgcctccccctcggcctccgagtccggcaaggacaagaagtccggcaaggacaagaagaaggacgaggacgagcagtcggtggccacgtccgccgcgcccggcacggcgacgtcggcgcccgccgccacgcccccgccgcagacgagcacggccccgtccgcgaaccccacaccggcggacccgaccccggccccgtcgacctccaagccgtgcaaccgcttcctgtggtggtgcacg

SEQ ID NO: 5753 - DNA, 801 bp, Streptomyces avermitilis
  CDS (1)..(801)
gtgagcaattctctgcgtctgtccggcgccgtcctggccgccgcgttcctcctggggaccgcggcctgcggcacgtcgtcaccctcccccgcggcctcccccgcgaccggcacgtccgcacccggcgagaaaccgtccgggagcggtgggctcgtcctccaggtgcgggacggcggcggcctcgtcccggtctcccccgcggccaacatcccccgcttctcgctgtacgaggacggcaccctggtcacctcgcccgcaacgaagcggtccggtctgcccggcctgcgggtggcccacctctccgccgccgaggtccgtacggtggtcggcgccgcgcacgacgcgggcctcccgcactccggccccctcggccccgccccgcccgcggacgggcccgtccggtcgtacacgctcgacgggaagctcaccacgacggtcgcgcccgccctgcgcgactgcacacggcaacgcgagctgtgcgccctggacaagcggctcgactccctcgccgagccgtccgggacctaccgctactcggtcatggccgccgtcttcaacgagagcggcaagggccgctcccccggggccgcgacctggcccctgggccgcctctccacagcgggcgagccgacctcggccgggcggtgcctgctgctgcgcggcacggatctgaagcgggtgcgggaggcggcccgtacggcgacgtcgagcgcgtggacggacggcacggcgacctaccggatggcactgcgcccactgctgcccggcgaggactcgtgcgcggacgtggtcgccacggac

SEQ ID NO: 5754 - DNA, 429 bp, Streptomyces avermitilis
  CDS (1)..(429)
atggccacccagaagacccgccccgatgctctgaccctggaggtcgtcgacctgatcggcacggtcgtggcgcgctaccacgaggagttcgaggaggcggcggcggagcacgcgctgacgggcgcgcaggcacggctcgtcagccttctctccctggagccgctacccatgcggcgcctggccgaaaagctgaagtgcgagccgtcgaacgtcacggggatcgtggaccggctggaggcgcgggggctcgtggagcgccgcccggaccccgcggaccgccgggtcaagctggccgcctgcacggcggagggccaccgggtcgcccgcgggctgcgggactcgctggacttcgcgcgcgagccgctggcgggactgtcccacgaggagcggctgtccctgcgggcgctgctgctgcgcatgctggaggct

SEQ ID NO: 5755 - DNA, 1020 bp, Streptomyces avermitilis
  CDS (1)..(1020)
atgaccgtcacgccccagctccccgccgtcagccgcgaatggcacctggcaagccgcccggtcggctggcccaagcccgaggacttcgccctggtcgaggcggaggtccagcagccgggtgagggccaggtcctcgtgcggaacaagttcgtctccgtcgacccgtacatgcgcggcaggatgtcggcggccaagtcgtacgtcgcccccttcgagctgaaccagccgatgcagggcggcgcggtcggcgaggtcgtcgtctccaacgccgaggggatcgaggccggtgaccacgtcctgcacttcctgggctggcgcgagtacgccgtcgtcgacgccaagcaggccgtcaaggtcgacccggaggccgcgccgctgagcgcgtacctcggtgtcctgggcatgaccggcctcaccgcgtacgcgggcctgctgcgcaccgcctccttcaaggagggcgactcggtgttcgtgtcgggcgccgccggtgccgtcggcagccaggtcggccagatcgccaagctgaagggcgcctcgcgcgtcatcggctcggcgggctcggacgacaaggtcaagctgctggtcgaggagtacggcttcgacgccgcgttcaactacaagagcggcccggtgaacgagcagctgcgcgaggccgcccccgacggcgtcgacgtgtacttcgacaacgtgggcggcgaccacctcgaagccgccatcggccagctcaaccgggacggccggatcgccgtctgcggcatgatctccgtctacaacgacaccgagccggcgcccggcccgaagaacctcgcccgcctcatccagacccgcggccgcatccagggcttcctcgtcggcgaccactacgacctccagtcgcagttcgtccaggaggtcggcggctggatccgctccggcgagctgaagtaccgcgagacggtcgtcgagggcatcgagaacaacctggaggcgttcctcggggtcctgcgcggcgacaacaccggcaagatgatcgtcaagctc

SEQ ID NO: 5756 - DNA, 291 bp, Streptomyces avermitilis
  CDS (1)..(291)
gtggtcgcgggccaccacgtcgtacccgacggagtggatctgcccgaacaccccgagggtgtccggcttcaggtgtgcgggcccgacgggaacgcgtcgaacaccgcctgctgctcgggcggcgggtccatctgctgtacggagtggaaacgcggctcgtgctcctcgggcagccccaggaagaagtcgagcccgtacggggcgcgcacccgctcctcgtacatctcctggagcgtgcggccggtgacccgccgcacgacctcgcccgtcagcgcgccgatcaccagggcg

SEQ ID NO: 5757 - DNA, 237 bp, Streptomyces avermitilis
  CDS (1)..(237)
gtgcaggacggcacgctggagctggaccgcgaagtcgcctcctactggccggagttcgcggccgagggcaagggggcggtgaccctgcgggagctgctcgcgcaccgcgccgggatcgtcggcgccgacaccgggttcacggccggggaactggccgacgaccgggtgacgccgagcggatggcgggccagcggccgttctggcggccgggtacggccttcggctatcacgccctgg

SEQ ID NO: 5758 - DNA, 960 bp, Streptomyces avermitilis
  CDS (1)..(960)
atggccggccgtccgcgtgcccggatgcccggttggtgcctccccggcgggccggacggggcatgctggacgcggcatcgtgcgaggcgaggagaccccatgtccccgattccgtcgctccccagcagggatgacgtggtgcgcatggcgcgcagcaccacggacatcaccggccaactcctggacaccgcagggaacatcacgaaaatcgccatcaacacgttcgacccgcgcgacgggtcgggggccgaggcgctgcgcgtgctgcggcagaccacggcggagctggccgaggcgagcgcgtcgccgcaggcccaggaggcgttctaccggatcgtcgacaccctgacccggctcggcaccagcggcgcgccactggccgtccacccggtgagcgaaccggcacaggcgctgctcgccgccctcggcgacactctgctgccggtcctggacgcggtggagccggcggtgcgggaggcctcggcggcgctgggcgaactggtcgacgcgacctccccgctgctgcccgcggcggcgggcgcggccgcggggacactgctcgcgctgaccccgctgatccgggccgccgccgacgtcctgcgcgactcctcgcccgaactccgccgtgtcgcggacgcgctcacggcggccctgaccccgctgctcccgctccaggtggccctggcggagcgcgcggccgccgccggagcgggcgtggtccgcgcggcactcccgccgctggccgacttgacggaagcggcggcgacgaccgcgaaggccgcgcgcccgctgctgatcgcgggcgaggaacgcctggtcgccggcctggaacagatccagccactcctcgtggcgacggcctcgcgcacggggagggccgcgcgagcggtggcggtacgcgtgtcggcggcggtgtccccggcggcggaccagggcgtggtggtggcggtcacgccggtt

SEQ ID NO: 5759 - DNA, 714 bp, Streptomyces avermitilis
  CDS (1)..(714)
atgcgtgatcttggggcgggattcggctatctcctgaagggccagcgttgggtggcccggcacggcaagcagtacggtttcgggctgctgcccggcctgataaccctggtgctctacgccgccgccctcgtcgccctggccttctggggcgaggacttcgtcgcctgggccacgcccttcgccgacgactggtccagcccctggcagggcctgttccgcggcttcctcaccgtcgtcctgttcgccctctccctcctcctgtccgtcctcaccttcacggcggtcacgctcctcgtcggccagcccttctacgagagcctctccgagaaggtcgaccaggacgtgtccccggacggcacggcccccgagtccggcctcccgctctggcgcgagctgtggatctcggcacgggacagcctccggatcgtcgtacgggccgtgctgtggggcatcctcctcttcgccctcggcttcatcccgttcgtcggccagaccgtcgtccccgtgatcggcttcttcgtcaccggcttcttcctgacggaggagctgacggcggtggcactccagcgccgcagcgtccagctccgcgagcgcctcgccctgctccgctcccgcaagctcctggtctggggcttcggcacccccctgggcctggccttcctggtccccttcgtcgccgtgttcctgatgccgggagcggtcgcggcgccaccc

SEQ ID NO: 5760 - DNA, 1329 bp, Streptomyces avermitilis
  CDS (1)..(1329)
ttgacctccatacgtgttcggatcggcatccccccactggcactgctggccctgctgacggggctcgtgaccccggggaccgcgaccgcggacgcggctcccacgacgaccgtcgaggagcggcgcctcgacaaggccgtaccccaggagatcctgcggcgttccggtttcgactccgtggcaccgggcttcgcgcgggcgctcggctcggcgcactcgtacgcgcaggcccggcggatcgtcgtacagcaggggtcccggctgtggcagcgggccgtcgaccgggcgcaggggcgggggccggcgggcggcgacctgagccgggacgacgaccggccgctgtactgggcccgcctcgggatgacacgtgaggtacgcctctgggagccggagttcgccctgtcggacacccagcgtgcccggctgctttccggactggaggtgtcctcacgcggtcagaacgccgtccgctacccgcacggcaggggtgtgaagcggatcctggtcaccggcttcgacccgttcacgctcgaccgtgacatccgtatctccaacccgtcaggcgccaccgcgctcgccctcgacggcacgacgatcgagacggcggacggcccggcgcgcatcgagaccgccgtcttcccggtgcgctggcaggacttcgccgacggcacggtggagcgggcgctgcggccgcagctgccccgggtcgatctgttcacgacggtgagccagggccgggtgggccgcttcgacgtcgagcggaccaacggggcctggcggggcggcttcccggacaacgacaccatcggcaggaccgagaccgtcccggtcaccgacccggcctcgcagccgcagtggacgacgacgacgctgccgtaccgggcgatcgtggccgcggacaccggccgtttccccgtgtacgacaacacgagcgtgaccgagatcccggcgggtggcacggcggaggtcgtgcgccccgacgggccgaccccgggctccacggcccgcgccgggggcggcgggaactacctctccaacgagatcgcctaccgcgcgacgctcctgcgcgaccggctcggcctgcacgacagtctccccggcggccatgtccacaccccggtgctggagttcggcacgggcaacacggacccggcgaccgggacggtcacggacccggagttcatccggaacaggctggacatcatcgggcaggtgcggtcgatcctgaccgtcgcggcggactcggtcggggccggctcggtcgcgacggacccggtcggaacggacccggtcggaacggactcagtcgcgacggagcgcgcgcgaggc

SEQ ID NO: 5761 - DNA, 978 bp, Streptomyces avermitilis
  CDS (1)..(978)
atgagtgaacttttcggcacacttctcgacggcgcggcggtccgtcggtggacgctggagcggggcggcgtgcgggtgcgggtcctgtcgtacggcgggatcgtgcagtcggccgaggttccggaccgggacggccgtacggcggacgtggtgctgggcttcgacggtctcgacggctatctggcgcatccggagccgtacttcggggcgctggtcgggcggtacgcgaaccggatcgcgggcggccgcttctcgctcgacggccgcgagtaccggctggcgcggaacaacgggcccaactccctgcacggtggcgagcgcggcttcgacaagcgcgtgtgggaggcggagccggtcgagcacggcgtacggctgtcccgggtgagcccggacggtgaggagggcttcccgggccgtctggagatctccgtgacgtacaccctcggcgcggacgccgcgctgcggatcgcgtacgaggcggtcacggacgcgccgacggtggtgaacctgacgaaccactcgtactggaacctggcgggttcggggaacgcgggcggtcacgcgctgcggatcgccgcgtcccggctgacgccggtggacgggaacctcatccccagcggcgcgttcgacgacgtgtccggcacgcgcttcgacttccggcggccgcggaaggcgggctcggggtacgaccacaacttcgccctggacaagggggtgacgcgggctcccgagccggtcgcggaactgcacgatccctcctcgggccgggtcctgaccgtggcgaccacggaaccgggcctccagctctacaccgcggaccacctcgacgcgtccgtccccttcgccccgggcgacggcatcgccctggagacccagcacttccccgactccccgaaccacccggacttcccgacgacccagctgcgcccgggcgaggtgttccggtcggagacggtgtacgggttcggggtgcgcgac

SEQ ID NO: 5762 - DNA, 900 bp, Streptomyces avermitilis
  CDS (1)..(900)
atgcggaaccgaggccatcggtcatgggctgtcctcgccaccgtggcggcggttctgctgggcggggccggctgtgacgcggtcggcggtgacgcgagcggtgcgcacagcaccggcacgaagggccgtccgtccccgaagcccacgcccgtctgggaccgcagcccggcgtccctcgccgctgtcggggactccatcacccgcggtttcgacgcctgcgcggtgctgtccgactgccccgaggtgtcgtgggcgacgggcagtgacgccgacgtcgacagtctcgccgtgcggctgctggggccggtcggggcggccgagcgcagctggaactacgcggcgaccggtgcgcgtatggcggatctgcccgagcagatggagcgggcggtggccaggaagccggagctggtgacggtgatggtgggcgccaatgacgcgtgccgggcgtccgcctcggcgatgacctccgtggcggacttccgcgccgacctcgaggacgcgatggcgacggtgcgtcaggcgctgcccaagacgcaggtgtacatgtcgagcgtgccgaatctgaagcggctgtggtcccagggccgcaccagtgcgctcggcaagcaggtgtggaagctgggcatctgcccgtcgatgctgagcgacgcggacgtggtggacgcgacggcgaccaagcggcgcgacaaggtgcaggcccgggtggaggcgtacaacgcggtcctgaaggacgtgtgcgccaaggaccggcgctgccgcttcgacgggggcgcggtcttcgactaccgcttcggcacggcgcagctgagccactgggactggttccacccgagcaagaacggtcaggcgcagctcgccgcgatcgcgtaccgcaccatcacggcgaggcgtgccgtgtcc

SEQ ID NO: 5763 - DNA, 492 bp, Streptomyces avermitilis
  CDS (1)..(492)
gtgacgacacgtggagttctgtacgtgcactccgcgccgcgtgcgctgtgcccgcacgtcgagtgggccgtcgcgagcgtgctcggtacgcgcgtcagcctcgactggatccggcagcccgccgcccccggcacctggagatccgagttctcctggcagggtgaggccggcacggcctccaagctggcctcggcgctgcgcggctggcagctgctgcgcttcgaggtcaccgcggaaccctgcccgaccgccgagggcgagcgctacagctgcacccccgacctgggcatcttccacgcggtcaccggcatccacggcgacatcctgatccccgaggaccggctgcgcgccgccctggtccgctcccagcgcggcgagacggacctggaggccgaactctccaagctcctcggcaagccctgggacgacgaactggagcccttccggtacgccggcgaaggcgccccggtccgctggctgcaccaggtcgtc

SEQ ID NO: 5764 - DNA, 1269 bp, Streptomyces avermitilis
  CDS (1)..(1269)
gtgagcccgaccaatcgcaccgtggtcgtcaccggtatcggcgcaaccacaccgctgggtggcgacgtagcctctacctgggagggcctggtcgccggacgttccggtgtccgtcccctggagcaggagtgggccgccgagcaggcggtccgcatcgcagcacagatcgccgtggagcccggcgaggtcattccccgtccgcaggcccgccgcctcgaccgctcggcgcagttcgcgctgatcgcggccaaggaggcctgggcggatgccggtttcaccgacaaggcgggcgccgacccggccgtcgacccggaccgcctcggcaccgtgatcgcctccggcatcggtggtgtgacgactctgctcgaccagtacgacgtgctgaaggagaagggcgtacgccgtgtctccccgcacaccgtgccgatgctgatgccgaacggcccgtccgccaacgtgggcctcgccgtgggcgcccgcgccggtgtgcacaccccggtctccgcctgcgcgtcgggcgccgaggccatcggctacgcgatcgagatgatccgcaccgggcgcgccgacgtcgtcgtcgccggtggtacggaggcggcgatccacccgctgcccatcgccgcgttcggcaacatgatggcgatgtccaagaacaacgacgacccgcagggcgcctcgcgtccctacgacgtcgcccgggacggcttcgtcctcggcgagggcgccggcgtcatcgtgctggagtcggccgagcacgccgcgaagcgcggtgcccgcgtgtacgcggaggcggtcggccagggcatctccgccgacagccacgacatcgtgcagccggagcccgagggccggggcatctcgcacgccctgcagaacctgctcgacagcaccgacctgaaccccgccgagatcgtgcacgtcaacgcgcacgccacctcgacgccggccggtgacgtcgccgaactgaaggcgctgcgcaaggtgttcggcgacgacgccgaccacttcgcggtctccgccaccaagtcgatgaccggtcacctcctcggcggcgccggcggtgtcgagtcggtcgcctcggtgctcgccctgtaccaccgggtggcgccgccgaccatcaacgtcgacaacctcgaccccgaggccgaggccaacgccgacatcgtccgcggcgaggcgcgcaagctccccgtcgagggccgcatcgccgcgctgaacgactcgttcggcttcggcgggcacaacgtggtgctggcgttccggacggtc

SEQ ID NO: 5765 - DNA, 246 bp, Streptomyces avermitilis
  CDS (1)..(246)
atggccgccactcaggaagagatcgtcgaaggtctcgccgagatcgtgaacgagatcgccgggatccccaccgaggacgtccagctggacaagtccttcaccgacgacctggacgtcgactcgctgtccatggtcgaggtcgtcgtcgccgccgaagagcgcttcgacgtcaagatccccgacgaggacgtcaagaacctcaagaccgtcggtgacgccgccgactacatcctcaagcaccaggcc

SEQ ID NO: 5766 - DNA, 1065 bp, Streptomyces avermitilis
  CDS (1)..(1065)
atgtcgaagatcaaggcaaggaagggcgccccgtacgcgcgcattctgggcgtcggcggctaccgtccggtccgggtcgtgcccaacgacgtgatcctggagaagatcgactcctccgacgagtggatccgctcgcgctccggcatcgagacccggcactgggcctccgacgaggagaccgtcgccgcgatgtcgatcgaggcgtccggcaaggcgatcgccgacgccgggatcaccgcctcgcagatcggcgcggtcgtcgtctccaccgtctcgcacttcagccagaccccggccatcgccaccgagatcgcggacaagctcggcacgaacaaggcggccgccttcgacatctcggcgggctgcgcgggcttcggctacggactgaccctcgccaagggcatggtcgtcgagggctccgcggagtacgtcctcgtcatcggcgtggagcggctgtccgacctgaccgacctggaggaccgcgcgacggccttcctgttcggcgacggcgcgggcgcggtcgtggtgggcccctccgaggagccgcacatcggcccgacggtctggggctccgagggcgacaaggccggcacgatcaagcagaccgtgccgtgggaccgttacctcccccactctcggcttcgctcgagcgggggcacccccaccggcgacgtctccccgctcccgctcgacagcgagggcaatgtcaagttccctgcgatcacgcaggagggccaggcggtgttccgctgggccgtgttcgagatggcgaaggtcgctcagcaggcgctggacgcggccggaatcacctcggacgacctggacgtcttcatcccgcaccaggcgaacgagcggatcatcgactcgatggtgaagactctcaaactgccggagcacgtcacggtcgcccgtgatgtgcgcaccaccggtaacacctcggccgcctcgattccgctcgctatggagcggcttctggcgaccggcgaggcgaagagcggcgacaccgcgctcgtcatcggattcggggcggggctcgtctacgccgccacggtcgttaccctcccc

SEQ ID NO: 5767 - DNA, 948 bp, Streptomyces avermitilis
  CDS (1)..(948)
gtgctcgtactcgtcgctcccggccagggcgctcagacgcccggcttcctgactccttggctcgaactccccggcgccgccgaccgcgtcgccgcctggtcggacgccatcgggctggaccttgcccactacggcacgcaggccgacgcggacgcgatccgcgacacgtccgtggcccagccgctgctcgtcgcggcggggatcctctcggcctcggcgctcggtgacgtcgcgcccggtgccgtcgcgggtcacagcgtcggtgagatcaccgccgccaccttcgcgggcgtcatcgacgacaccgccgcgctgacgctcgtccgcacgcggggtctcgcgatggccgaggccgcctcgctcacgccgaccgggatggcggccctgctcggcggggaccccgagacgacgattccgcatctggagaagctcggtctcaccccggcgaacgtgaacggcgcgggccagatcgtggccgccggcaccctggagcagctcgccgccctggaggcggagaagcccgagggcgtccgcaaggtcatcgcgctgaaggtcgcgggcgcgttccacacgcctcacatggcgcccgcggtcgacgcgctggcgcgggccgccgaagccctcacgcccgccgacccggtggtctcgtacgtctccaacaaggacggccaggaggtcgccaccggcgccgagatcctgtcccgcctggtcggccaggtcgccaacccggtccgttgggacctgtgcatggagaccttcaagaagctgggcgtgacgacgctcgtcgaggtgtgccccggcggcaccctgaccggcctcgccaagcgcgcgatgccgggcgtgaagaccctcgcgctgaagacccccgacgacctcgacgccgctcgcgagctcatcgccgaggcggtgacgtccgccgctgtaccggcgggcgtccgagaaggagcc

SEQ ID NO: 5768 - DNA, 1203 bp, Streptomyces avermitilis
  CDS (1)..(1203)
gtgcccgaaccccaatccagcagtcccgagcccgcagcacgcgacgcccactcccatgccgcgaccctgaagcggctggagaaatcgtccggaagcctcgccgcgcaggccatcacgcgcatggacgagacgctgccgtggtaccgggcgatgcccccggagaaccgttcctggatcggcctggtggcccaggccggtatcgccgccttcaccgagtggttccggcacccggacaccccgcaggccatctcgaccgacgtcttcggcaccgcgccccgcgaactgaccagggcgatcaccctgcgccagaccgtggagatggtgcgtacgacgatcgaggtcatggagtccgcgatcgacgaggtcgcggcgcccggcgacgagtccgtgctgcgtgaggcgctgctcgtgtacgcccgcgagatcgccttcgccaccgcccaggtgtacgcccaggccgcggaggcacggggcgcctgggacgcgcggctcgagtcgctggtggtgaacgccgtcctgtccggggaggccgacgagggcgccgtgtcccgggccgccgcgctcggctggaactctcccgaccatgtctgcgtggtgctcggcacggcacccgagggcgacagcgagctgacggtggaggcgatccggcgggccgcccggcacgccaagctccaggtcctcaccggcgtcctcggcaaccggctcgtcgtgatcgccggcggcagcgacaatccgctcgccgtcgccaagtcgctgatcggcccgtacgcggcaggcgccgtggtggcggggcccgtcgtgcccgacctgctcgccgcgacccggtccgcgcaggccgccgcagccgggctgaaggcgtgtttcgcctggcaggacgccccgcgcccggtactggcggacgatctgctcccggagcgcgcgatcgccggagacccgagcgcgcgcgagcagctggtggaggagatctacagaccgctcgaggaggccggctccgcgctgctcgaaacgctcagtgtctacctcgagcaggcgagcagcctcgagggcgcggcccgtatgctcttcgttcaccccaacaccgtgcgctaccggcttcgacgtgtgactgacgtcaccggttggtcgccctcggatgtacgctccgcgttcacgttgcggatcgcgctcatcctggggcgcttggccggtggagatccccagacg

SEQ ID NO: 5769 - DNA, 651 bp, Streptomyces avermitilis
  CDS (1)..(651)
gtgacggacgtacggcgcgccggcgagcgctatcgcggaggggacccggcggccgggatctcctccctccacgccttctccttcggcccgcactacgatccggacaatctccgcttcggcgcggtgatcgcctgcaacgaggagcggctcgccccgggcgcgggcttcgacgaacatccgcacagccacacggagatcgtcacgtgggtggtcgagggcgtgctgacccaccgcgactccacgggccacgagtcgctggtccgccccggcgacgtgcagcggctcagctcggccggcggcgtccgtcacgtggagcgcaacgacggcccggacccgctgaccttcgtccagatgtggctggccccgctggagcccggcggcgaggcgtcctacgaggtggtccacggcatcgcggactccaccccgtacgcggtcccggaggcggcggcgatgctccacgtgcgccggctgtcggcgggggaacgcacggccgtcccggacgcggcgtccgtgtacgtccatgtcgtccgcggcgaagtgcgcctggacggcgaggagttgaggccgggtgacgcggcccggatcacggccgcgaaggacctggaggcggaggcggtgacggcggcggagctgctgctgtgggagatggcc

SEQ ID NO: 5770 - DNA, 828 bp, Streptomyces avermitilis
  CDS (1)..(828)
atgtccctgcagagcctggcgctgatcgagaactggcccgtttccaccgccgccgcggccgtcgtccgggcggacggtaccgtgctcgccgcgcacgggccggtcgaccaccgcttcccgctggcctcggtcaccaagccgctcgccgcgtacgcggtgctcgtcgcgtacgaggagggggcggtggagctggacgagccggccgggccccccggctcgacggtccgccatctgctcgcgcacacctccggtctcgccttcgacgagcaccgggtgacgtcggcgcccggggagcggcggctgtactccaacgcggggttcgaggtgctcggcgaccacatcgccaaggcgacggacatcccgttcgcggagtatctgcgccaggcggtcctcgagccgctgggcatgacgcggacctcgctcgacggctcaccggccagggacggcgtctccacggtcgccgacctggtgcgcttcgcggccgaggtccaggcgccgcgcctgctcgacccccgtacggtcgcggaggcgatgaccgtgcagtacccaggcacgaagggcgtcctgccgggctacggccaccagaaccccaacgactggggcctcggcttcgagatccgtgacgccaagtcgccgcactggacggggacttcctcctcgccggggaccttcgggcacttcgggcagtcgggtacgttcctgtggatcgacccggtcgcccgggtcgcgtgcgccgcgctgacggaccgcgcgttcggaccgtgggccgccgaggcgtggaccccgttcacggacgcggtactgaccgagctccgggccggccgggcc

SEQ ID NO: 5771 - DNA, 480 bp, Streptomyces avermitilis
  CDS (1)..(480)
atgacggtgatggagagcacggccgaggcagcggggaccggcaccacgaccgatgtctgtgccgcgccgccccagcggcaccgccgccccgacggccaggacagctacacgatcagcgaggtcgtcgccttcaccggcctgacggcgcacaccctgcgctggtacgagcggatcggcctgatgccccacatcgaccgctcgcacaccggccagcgccgctacagcaaccgcgacctcgactggctcgccttcgtcggcaagctccggctcaccggcatgccggtcgccgacatggtgcggtacgcggaaatggtgcgcgagggagacggcacctacacccagcgctacgagatcctcgaatcgacgcgccgggacgtcctggcccggatcgccgaactccaggacacgctcgcggtactcgaccacaagatcagtttctacgcggacgcagggcgcgccctgacgtcggagaggtcccga

SEQ ID NO: 5772 - DNA, 1014 bp, Streptomyces avermitilis
  CDS (1)..(1014)
atgacggacagcaggatcgccacggcccagctcggaaccgacggccccacggtcggtgtgcagggccttggctgcatgggcatgagcttcgcgtacggccccgcggacgccggggagtcgcgggccaccctggagcgggccctggagctcggtgtcacgttctacgacaccgcggacgcgtacggcgccggtgagaacgagaagttcctgtccccgttcttcaaggcgcaccgcgacgaggtcgtcatcgcgacgaagttcgccctgtcgatcccgccgggcgagccgacgaagcgggtcatacgcaacgaccggccgtacatccgccaggccgtcgaggcgagcctgaagcgcctggacgtcgatgtgatcgacctctattacatgcaccgccgcgatgtgaacgtcccgatcgaggagaccgtcggggccatggccgagctggtgcgcgagggcaaggtcaagcacctggggctgagcgaggtcaccggcggcgagctgcggaccgcgcaggccgtgcacccgatcgccgcggtgcagtcggagtggtcgctgttcagccgcgacatcgaggccggcgtggtcccggccgcccgggagctcggcgtggccctggtgccgtactcaccgctcggccgcggtttcctcaccgggtccttcgcgaacgcggagaaggacctgaccgcggacgacttccggcgtcttcagccccgcttcacgggcgacaacgcggcggcgaacgcggcgctgctggagccggtacgcgcggtcgcgaaggcccatgacgcctcgctcggacagatcgccctggcctgggtgcagcagcagggggcggtgcacggtctgccggtcgtaccgatcccgggcacgagcaagcgcgcccgggtcgaggagaacgcgacggcgacccggatcgtgctcacggaggaggagctggggctcctggagccgatcgccgccaaggtggcgggcgaccgctacgcggacatgacgttcacgtcggcgggccgggag

SEQ ID NO: 5773 - DNA, 861 bp, Streptomyces avermitilis
  CDS (1)..(861)
atgggtgacgtactggccggatttcatgccgcctgggagttcgagtccgactccgtgctcatccgcttcgaacggggaatccgttcgccgaagctgttccaggcgctcggtgaacgtcgtgtcccgctggaggcgatcgcgggggtcacactgacgccggggaagcgggggacggtcgtcctgcacgccgtgccgcgcgcgggcgccgaccccttgatggaggcggccgccggtcagctgaaggacacctgtgacccctaccggctggtgctgcccgccgagcgcgagaccctcgccgagtactacgccgacgaactgcgcgcgcggctcgccgacgacgacacccccgccgagcggtatctggtggcgccgcccgaggctccgctccagttcaaggcgtacgacgggaaggcgtccttcgacggtaagcgggtgtcgttccgctggtcgtggacgggggcctcgtcggcgaagtggaaggccggcgaccagaacttcccggtcaccggcctcagcggggtcgagtggcgctcccccgaggtgttcgagggccatctgcggctgctgccccgcgagccggccggggcgaagccggatcagccggggcagcccgaccaggacccggccgcggtcgtgttcgggctcgggtacgggcccgtccacgagtcgctgccgttcgccgcggcggtgctggcggcggtgcgctccgccggaggcggggcgccggcgctcgcctcggtgccgcggcgcgatccggccgacatcgccgagcgcattcgtcacctcggtgaattacaccgcgccgggctggtcacggacagcgagttcgccacgaagaaggcggagttgctggcggagttg

SEQ ID NO: 5774 - DNA, 1206 bp, Streptomyces avermitilis
  CDS (1)..(1206)
gtgacttccttcgacgcctcccccccactgaacgtctggcgcgcactgctcgcgctggccgtggtcttcgtgatgctggcgaccaccggctggaccgcggtgcacagccaccggcgggacacccccctccaggcatcgcgctccgcgtggcagcacggcagcatcggcgggcgccacctgccggacgcgaactcggcgccgggccgcatcgcccgcttcttcgcctccctcgacgcctcccagcggtcccggctcgcccaccgctatccgctcgcggtcggcaacatgaacggagcgccggtcaagctgcgctaccgggcgaaccacatcgccctcggccagcagcgcaaggtcgaacgcggccgcatgcacgacaaccggctctcgacggtcggccagcaggacgcgggcagccgtatgcaccgcttcgaagcgctcatgggcaagaagcggcagatcctcgccttcgatcccgagggctcgggccggatcgccgaggtctacggaaagctggacaaggcgcagcggatctcggtcgtcgtccccggcgtcgacaccgatctgctcacgttccagcgcacgttccgcaagtactcggcgccggtcggcatggcgcgctcgctgtacagggccgagcgggccgcgagcccgacgacgcgtacggccgtgatcgcctgggccgactacacctcgcccagcgggctcggcatcgactcggccacggccatgcgcgccgcggacggggcggtgcggctggacgcgctggtgcgggccctgcccggccgctcgccggtcgcgctgtactgccacagctacggctccgtgctgtgcgggatcgccgcgcgctcgctgccgtcgcgggtgtcggacatcgcggtcgcgggcagccccggcatgcgtgccgagaaggtctcggggctgggcacctcggcccgggtgtgggcgatgcgggactccgacgactggatccaggacgtgccgcacctcgaggtcggcggcctcggccacggcgccgacccggtgtcccgggcgttcggggcacggctgctgtccgcgacgaccgcgaagggacacggcggctatttcgagccgggcaccgacagcctgcgcaacttcgccgagatcggcgttggcgcgtatcactcggtgcgctgcgccgacgatgatgacgtctgccgggctggtttgtccggcggggcgacggcc

SEQ ID NO: 5775 - DNA, 678 bp, Streptomyces avermitilis
  CDS (1)..(678)
atggacacggcggcacggccggggctgcgtgagcgcaagaagcggcgcacccgggacgcgctgctgcgggccgccctggagctgttcctcgcccaggggtacgagcggacgaccgtcgacgagatcgccgaggccgtggacgtctcgcagcgcaccttcttccgctacttcgccggcaaggaggaggccgccttcctcacccagcggatcgccgagtcgcacttcgtcgccgcggtgcgcgaacgcccgccgcacgaggccccgctggaggcgctgcgccgggcggtgctggagagctgggagaccatcggcgaggccatcgagcaggtcgtcccggtcgaactccacatgcgtacctaccagttgatcgagtcgacgcccgcgctgctcgccgtccatctgcggcactccgccgaactggaggaggagctggcccgcatcatcgccgggcgcgaggggctcgacgtggacgccgatccgcggccacgcgtcgcggtggccgtcttcggcggggtgatccgggtgaccggacggctgtggggtgcgggcgggaacctcagcgtgaaggcgatccgcgagcagaccgtcgcacacctcgacgcggtggggcccgtactggcggagaagtggggcacgcaggcacccccgcgcccggcggatgatccactgcccgtggag

SEQ ID NO: 5776 - DNA, 1620 bp, Streptomyces avermitilis
  CDS (1)..(1620)
atgactagtcagaccaccatcgacacgacggggccgggggacaaggcgccgctcgctccgtcggacaaggcgccggccaaggggctgcgcggccatccgtggtacaccctcataaccgtggccgtcggagtcatgatggtggccctcgacggcaccatcgtggccatcgccaacccgacgatcaaggcggacctgggcgccagcttcgccgacgtccagtggatcaccaacggctacttcctcgcgctcgcggtcacgctgatcaccgcgggcaagatcggtgaccggttcggccaccggcagaccttcctcatcggcgtggtcggcttcgccgcggcctcgggggccatcgggctgtccgacagcatcgccctggtgatcaccttccgggtgttccagggtctgttcggcgcgctgctcatgccggccgcgctcggcctgctgcgggccaccttcccggccgagaagctgaacatggcgatcggcatctggggcatggtcatcggcgcctcgaccgcgggcggcccgatcctcggcggcgtgctggtccagcacgtcagctggcagtccgtcttcttcatcaacgtgccggtcggcgcgctcgcgctcgtcctcggtctgctgatcctgctggaccaccgcgccgagaacgccccgcgctccttcgacatcctcggcatcgccctgctgtccggcgccatgttctgtctcgtctgggcgctcatcaaggccccgacctggggctggggcgacggcaagacctgggcgttcctgatcgcgtccctggtcggcttcgcgctgttcgggttctgggagacgcgggtccgcgagccgctgatcccgctcgccctcttccgctcggtgccgctgtcggcgggcgtcgtcctcatggtcctgatggcgatcgccttcatgggcgggctcttcttcgtgaccttctacctgcagaacgtgcacggcatgagcccggtcgacgcgggtctgcacctgctgccgctcaccggcatgatgatcgtcggctcgccggtcgcgggcatgctcatcaccaagaccggcccgcgcatcccgctggccggcggcatggcgctcaccgcgatcgccatgtacggcatgtcgacgctggagacggacacgagcggcgcggtcatgtcgctctggttcgccctcctcggcctcggcctcgctcctgtcatggtcggcgccaccgaggtcatcgtcggcaacgccccgatggagctctcgggtgtcgcgggcggtctccagcaggccgcgatgcagatcggcggcagcctgggcacggccgtcctcggcgccgtgatggcctccaaggtcgacaacgacctcgcgggcaactgggcggacgcgaagctgccgccgctcaccggtgcgcagctggaccaggcctcggaggcggtccaggtcggagtggcaccggtgcccaaggggacgcccgccgcgatagccgagcagatcacgggcgtcgcccacgacaccttcatctcggggatgagtctcgcgtccctggtcgcctcgggggtcgccgccgtggcgatcctggtcgcgatgctcacgaagcgcggcgagaacgcggacgccgcgggcgcgggggccgggcacatc

SEQ ID NO: 5777 - DNA, 309 bp, Streptomyces avermitilis
  CDS (1)..(309)
ttgatgatggcgggcttcggacacggaacgcgcaggtacccccgttcacgcggccggacgtggtcgcggaccgggccggatcgcgcaaccctcggaatcgtgggcctcgtctgcgcgatcgccgggttcttcgtgctggggatcatcctcggcccggtggcgatcgtctgcggctggctcggcatgggccgaagctgggcgggagcccgcccactcccggcactgatcgcgttggtcctgggcgcgatagacacgctgctggcggtcatctggctgatcgggatggccagtccgggcaacggacttctc

SEQ ID NO: 5778 - DNA, 825 bp, Streptomyces avermitilis
  CDS (1)..(825)
gtggatgtccgcgggtcgcgggggggctgggcagccggctccccgcgacccttgcggggagccctgggcacctacgatgcgggcatgaaggaacaatcggcgcaggcccgctgggagcagcacacccagcggcccctgctggcgctcgcggtggcgttcgccgtcgcgtatgccgtgccgatcgtggacagcgacgcgagccgttcgctgaccggcgtgtgcacggcggtggagtgggtggtgtggggctctttcgccgccgactacctcgtacggctggcgatcaccgcggagcgccgggagttcgtccgtacgcactggctcgacctgtgcgcggtggtgctgccgatcctccagccgctgcggctgctgcggctcgtctccacgctgatgctgctggggcggcgggcgcggatggcctcgcagatccggctgacgacgtatgtcgcgggctcggtgatcgggctgctgatgttcggctcgctcgcggtgctctcggtggagcgggattcgccgaacgggaacatccgcacgctgggcgacgcggtgtggtggtcgttcacgacgatgacgaccgtcgggtacggagatcatgctccgacgaccggtctggggcgcatgatcgcggtcgggctgatgctctccggcatcgccctgctcggtgtcgtcaccgccaatatcgccacgtggttcatctctcggttcgagaaggacgacgtggaggagcggcggcagacggcggcgatcgaggcgctgacggaggaggtgcgggcccttcgggcggaggtggcggcactcagcggggcggccgagaagcagccgcgt

SEQ ID NO: 5779 - DNA, 2745 bp, Streptomyces avermitilis
  CDS (1)..(2745)
gtggcttccggatccgatcgcaacccgatcatcattggcggccttccgagtcaggttcctgacttcgatcccgaagagacccaggagtggctcgactccctcgacgccgccgtcgacgagcggggccgggagcgggcccgctatctgatgctgcgcctgatcgagcgagcccgcgagaagcgcgtggccgtgcccgagatgcgcagcacggactacgtcaacaccatcgccaccaaggacgagccgttcttccccggcaacgaggagatcgagcgcaggatcctgaacgcgacccgctggaacgccgcggtcatggtctcgcgcgcccagcggccgggcatcggggtcggcggccacatcgccaccttcgcctcctccgcctcgctctacgacgtgggcttcaaccacttcttccgcggcaaggacgagggcgacggcggcgaccagatcttcttccagggccatgcctcgccgggcatctacgcccgcgcgttcctcctggaccggctggacgagcggcagctcgacgccttccggcaggagaagtcgaaggcgccgtacgggctgtcctcgtacccgcacccgcggctgatgccggacttctgggagttcccgaccgtctccatgggcctcggcccgctcggcgcgatcttccaggcgcggatgaaccgctacatggaggcgcgcggcatcgcggacacctccaagtcgcacgtctgggcgttcctcggtgacggcgagatggacgagccggagtcgctcggccagctgtcgatcgcggcgcgcgagggcctcgacaacctgaccttcgtcgtcaactgcaacctccagcgcctcgacggcccggtgcgcggcaacggcaagatcatccaggagctggagtcgcagttccggggcgccggctggaacgtgatcaagctggtctgggaccgcacctgggacccgctgctcgcccaggaccgcgacggcgtgctggtcaaccggctgaacaccacgccggacggccagttccagacgtacgccaccgagaccggcgactacatccgtcggcacttcttcggtgacgaccaccggctgcgggcgatggtcgagcacatgaccgacgaccagatcctgcacctggggcgcggcggtcacgaccacaagaagatcttcgcggcgttctcggcggccaaggcgcacaagggccagccgacggtgatcctggcgcagacggtcaagggctggaccctcggcccgaacttcgagggccgcaacgccacgcaccagatgaagaagctgacggtcgccgacctcaagggcttccgcgaccgcctgcacctgccgatctccgacaagcagctggagtccggcccgccgccgtactaccacccgggccgcgactcggaggagctccagtacatgcacgaccgccgcaaggggctcggcgggtacgtcccgacgcgcgtcgtgcggtcgcagccgctggccctgccggacgacaagacgtacgcgggtgtgaagaagggctccggtcagcagtcgatcgccacgaccatggcgttcgtacggctgctcaaggacctcatgcgggacaaggagatcggcaagcggttcgtgctgatcgcgcccgatgagtaccgcaccttcggcatggactcgttcttcccgagcgcgaagatctacaacccgctcggccagcagtacgaggccgtggaccgcgacctgctgctcgcgtacaaggagtcgccgaccggccagatgctgcacgacggcatctcggaggcgggctgtacggcctcgctgatcgccgcgggttcggcgtacgcgacgcacggcgaaccgctgatcccggtgtacgtcttctactcgatgttcggtttccagcgcaccggcgaccagttctggcagatggccgaccagatggcgcgcggtttcgtgctgggcgcgaccgccgggcgcacgaccctgaccggtgagggtctccagcacgcggacggccactcccagctgctcgcctcgaccaacccgggctgcgtcgcgtacgaccccgcgttcggcttcgagatcgcgcacatcgtgcaggacggcctgcgccggatgtacggctcgtccgaggagtacccgcacggcgaggacgtcttctactacctcaccgtctacaacgagccgatccagcaccccgccgagccggagaacgtggacgtcgagggcatcctcaagggcatccaccgcttcagcgaaggcacggcgggctcgatcccggcgcagatcatcgcgtccggcgtcgccgtcccgtgggccgtcgaggcgcagcggatcctcgccgaggagtggaacgtcaaggcggacgtctggtcggcgacctcctggaacgagctgcggcgcgaggccgtcgaggtggagcggcacaatctgctgcaccccgaggaggagcagcgcgtcccctacgtgacgcagaagctgagcgccgccgagggtccgttcgtggcggtgtccgactggatgcggtcggtgcccgaccagatctcgcggtgggtgccggggacgtaccagtccctgggcgcggacggcttcggcttcgcggacacccgtggggcggcacggcgcttcttccacatcgacgcgcagtcgatcgtggtcggggtgctgaccgagctggcgcgcgagggcaaggtcgaccggtcggtgctgaagcaggcgatcgaccgctaccagctgctcgacgtggcggcggccgacccgggcgcggcgggcggcgacgcg

SEQ ID NO: 5780 - DNA, 477 bp, Streptomyces avermitilis
  CDS (1)..(477)
gtggctgaagacatctaccaagacatgatcaggaggcaacccgtgagcgcgaccgcggaccacgcggaggagcggacgaaccctgccgcaaggctggggttccagcccgagcaggtggtccaggagatcggcttcgacgacgacgtcgaccaggagctccgcgaggccattgaagaagtcatcggcagcgagctcgtggacgaggagtacgacgacgtcgcagatgccgtggtgctgtggttccgcgacgaggacggcgacctgaccgacgccctggtggacgccaccacgtacgtcgaagagggcggcaccattctgctgctgacgccgaagacgggccgtgacggctacgtcgagccgagcgacatctctgaagccgcgacgactgcgggcctgtcccagacgaagagcgtcagtgtgggcaaggactggagcggcagccggctggcgacgcccaaggcggccaagtcgaagcgg

SEQ ID NO: 5781 - DNA, 456 bp, Streptomyces avermitilis
  CDS (1)..(456)
atggcgatccaggtcggcgacaaggcccctgacttcgagctcaaggacaaccacggcgccaccgtgcggctgtccgacttccgtggtgagaagaacgtggtgctgctcttctacccgttcgccttcaccggcgtgtgcaccggcgagctgtgcgcgctgcgcgacgaactgccgaagttcgtcaacgacgacgtgcagctgctcgcggtgtccaacgactccatccacaccctgcgcgtcttcgccgagcaggagggcctcgagtacccgctgctgtccgacttctggccgcacggcaacacctcgcgcgcctacggcgtcttcgacgaggacaaggggtgcgccgtgcgcggcaccttcatcatcgacaaggagggcgtcgtgcgctggaccgtcgtcaacggtctgccggacgcgcgcgacctcaacgagtacgtgaaggcgctcgacaccctg

SEQ ID NO: 5782 - DNA, 573 bp, Streptomyces avermitilis
  CDS (1)..(573)
gtgggagtcagcctcagcaagggcggcaacgtatcgctgaccaaggaggcgcccggcctgaccgcggtcatcgtgggcctgggatgggacgtccgtaccaccacgggtaccgacttcgacctcgacgccagcgcgctgctgacgaacgtggagggcaaggtcgccaacgaccagaacttcgtgttcttcaacaacctcaagagccccgacggctcggtcgagcacaccggcgacaacatcaccggtgagggcgagggcgacgacgagcagatcaaggtcgacctcgcgacggtcccggccgacgtcgacaagatcgtcttcccggtgtcgatctatgacgccgagaaccgccagcagtccttcggccaggtgcgcaacgcgttcatccgcgtggtgaaccaggcaggtggcgcggaaatcgcccgctacgacctgagcgaggacgcctcgacggagaccgccatggtcttcggcgagctgtaccgcaacggcccggagtggaagttccgcgccatcggccaggggtacgcctcgggcctgcgcggcatcgcccaggacttcggcgtcaacgtc

SEQ ID NO: 5783 - DNA, 573 bp, Streptomyces avermitilis
  CDS (1)..(573)
atgggcgtcacgctcgccaagggaggcaatgtctccctgtccaaggccgcgccgaacctcacgcaggtgatgatcggcctcggctgggacgcgcgctccaccaccggagcccccttcgacctcgacgccagcgcgctgctgtgccgtgagggccgggtgctgggcgacgagtggttcgtcttctacaaccagctcaagagcccggacggctcggtggagcacaccggcgacaacctcacgggtgagggcgagggcgacgacgagtcgatcctggtcgacctctccacggtgccggcccaggtcgacaagatcgtcttccctgtctcgatccacgaggcggacaaccgcggacagaccttcggacaggtcagcaacgcgttcatccgcgtggtcaaccaggccgacggccaggagctggcccgctacgacctgagcgaggacgcctcgacggagaccgcaatgatcttcggcgaggtctaccgatacggaggcgaatggaagttccgcgcggtgggacaggggtacgcatccggactgcggggcatcgttcaagacttcggggtcagcgtctcc

SEQ ID NO: 5784 - DNA, 1143 bp, Streptomyces avermitilis
  CDS (1)..(1143)
gtgcttctgaaaaccttcggctggtcgtttgcggtcaccgcgctcggcttggtcgcagcggtgatctacggggggtggaccgccttcggcatcgtggcgatcctgtctatcctcgagatctcgctgtccttcgacaacgcggtggtcaacgccggaatcctgaagaagatgagtgccttctggcagaagatcttcctcacggtcggtgtgctgatcgccgtcttcggtatgcggctggtgttccccgtcgtgatcgtggcggtgaccgccaagaagagcccgatcgaggcggtcaacctcgcgctcaccgacaaggaccagtaccagcagctggtgaccgacgcccacccggcgatcgccgccttcggtggcatgttcctgttgatgatcttcctcgacttcatcttcgaggagcgcgacatccagtggctgcgctggatcgagcgcccgctcgccaagctcggcaaggtcgacatgctgtcggtctgcatcgcgctggtcgtgctgctggtctcctccatgacgttcgcggtccacgcccaccagcacggcggcgcgcacgtcgacaaggcgcagacggtgctgatctccggcatcgccggcctgatcacgtacatggtcgtcggcggactctccggctacttcgaggacaaactcgaggaagaggaggagcgggagcacgaggaagaggaggaggcggcgcggaccggcaagaagaagccggccgtcgtcctcgccggccaggccgcgttcttcatgttcctctacctggaagtgctggacgcctccttctccttcgacggcgtgatcggcgccttcgccatcaccaacgacatcgtcctgatggcgctcggcctcggcatcggcgccatgtacgtccggtcgctcacggtctacctggtccgccagggcaccctcgacgactacgtctacctggagcacggcgcgcactacgccatcggcgccctcgccgtgatcctcctcgtcaccatccagtacgagatccacgaggtcatcaccggtctcgtcggcgtcatcctgatcgcctggtccttctggtcctccgtgcgccgcaacaaggcccttgcggaagccgagggaaaagcgacggcctcggacaagactgaggtctcgtccggggtg

SEQ ID NO: 5785 - DNA, 732 bp, Streptomyces avermitilis
  CDS (1)..(732)
atgagcttctgggacgacctgtggcgtgggcgctcgaccgagttcgactcgggcagcgccgcgaccaacgcgatcgagctgacaaagcgccaccagcgggtctcgctcaccaagcagggcgcggccaccggcaatctgcgcatcaacctgtcctggcggatgcgcacgtccgacatcggcggccccgagcgcggcagcctgctgcgccacccgttcaggctgttcacccccgaggtcgtccaggcgcacacccagagcatggtcaacgtcgacctcgacctcggctgcatgtacgagctggccgacggcaccaagggcgtggtgcagccactgggcggcttcttcggcgaactcaacgacccgccgtacatcaagctcagcggcgacgaccgcttcggctcggggtcgggcgagacgatcttcgtcaacctcgaccaccgcgacgacatcaaacggctgctgatcttcgtctacatctacgaccagacgccggcgttcgaccggacgcacgcgatcgtcacactcttcccgagcaacggcccacgcatcgagataggcctcgacgaacgccatccgcaggcccgctcctgcgcggtcgtgctgatcgagaacgtcaagagcgaactgaccgtgcgacgcgaggtgaagttcgtgtacggcttccaggccgaactcgaccgcctctacggctggggactccagtgggggcgcggctacaagtcggccgaccgc

SEQ ID NO: 5786 - DNA, 924 bp, Streptomyces avermitilis
  CDS (1)..(924)
atgacgcacgcgatgctgaaggggtcgaacatcccgctggacgctacggcggtacgggcggtgctgcgctggaccccgggacagggtgtcccggaggtggacgcctcggcgctgctcctcggccccgacggacgtgtgcgatccgacgaggacttcgtcttctacaaccagccccgtcatccctcgggacaggtcaggctgctcggcaagaagcgggaagccgaggccctgaccgacacgatccagaccgatctgacgggtgtcgagtccgctgtcggacagattctcctggtggcttcggccgacgacgtcaccttcgaccgcgtccggtcgctgcgcgtcctgctgtacgacgccgccgccccggacggcgaaccgctggcgtacttcgacatcaagccgcagacgggccaggaaaccgcgctgatctgcggtgaactgtacaggcgcggcgagggctggaagttccgggcgctcggcgagggctacctgaacggtttgcagggcctcgcgaccgatttcgggatctcggtggacgagtcggaccccacggccggatccgcaccctcgggcccaaaatccgctcccgcggccacggccggagcggccccctccgcctggtccgggccggtgtccgcggcacccgaggcctccgtgccgctgccgcccgagcagcccgcgccgatgcctcagcagtccacgtacggctatccgccggagcccacgcagcagccgcccgcgcagccggcgtacggctacccgcagccggccgccgcagcacccacgacccagcccgcctacggctacccgcagccgcagacggcggccgcggtaccgcccgcgtacggctacccgcaggcggtgggcgccgcgcccgacccggacttccggctgccgccgcaggggccgcagttcatcggccgg

SEQ ID NO: 5787 - DNA, 1161 bp, Streptomyces avermitilis
  CDS (1)..(1161)
atgcgtcatttcgggcacatcgcccctgaggagcgacagcgcctcttctaccgggagccggccgtcttcagcgccgattcccccgcccgcgtgctcgcggcggccctgggggccaccctctacagcccggcgacccggccgcagctggccgacgacgtcgtcaagcaggccggccgcggggtggtctccatggtgttgtgcctggaggattccatcgacgacgcggacgtcgtggacgccgaggagaacctggtccggcagttcaccgacctcgccggacgctcggacgtaccgcttccgctgctcttcgtccgggtcaggacccccgagcagatcccggacctcgtgcggcggctcggcccggccgttcgggtgctgtccggattcgtactgccgaagttcaccgaggagcggggcgttccgttcctggaggcgctcaccgcggccgagaccgcgagcgggcggcgcctgttcgccatgccggtgctcgaatcgcccgatctgctgcacctcgagtcgcgccgggagaccctggccgggatcttccgcacggtcgacaagttccgcgaaagggtcctcgcgctgcgcctgggcgtcaccgacttctgctcctcgtacgggctgcgccgggcgcccgacatgaccgcgtacgacgtccagatcgtcgcctccgtgatcgccgacgtggtcaatgtcctcgggcgggccgacggcaccgggttcacggtgaccggcccggtctgggagtacttccggctccaggagcggatgttcaagccccagctgcgccgcagccccttcaccccggaggccgagcagctgcgcgacacgctcatcgagcacgacatggacggcctgctgcgggagatcgccctcgaccgggccaacggcctgctcggcaagacctgcatccacccctcgcacgtgctgcccgtgcacgcgctctccgtcgtcagccacgaggagttcagcgacgcccaggacatcctgcggcccgagcggggcggcgggggcgtgctgcgctccgcgtacacgaacaagatgaacgaggtgaagccgcatcgcgcctgggccgagcggaccctccagcgcgccgaggttttcggggtggccaacgaggacatcggcttcgtggagctgctggccgcgggactgcccgac

SEQ ID NO: 5788 - DNA, 2466 bp, Streptomyces avermitilis
  CDS (1)..(2466)
gtgcggcgccgtacagacaaggaatcgatgaacaacgtggtctggtccgggacgtgggtcgccgagcggctcggtgtcgagctcgtcggcgacgagaagctgagcgacctgctggggctcgcgctgcggcgcaaccccaagcgggcgcatctgctcgtctcgaacgtgctcggcaagcacgtaccgcagtcgccgtccgtggtgtacgggtacggcgtcgccctcgggcgccgggtgcgggagctccttggcgccgacgaggcccgtacggcggtcgtcctcggctacgcggagacggccaccgggctcggccattcggtcgcggacggggtgggcctcgcgccctacctccactcgacccgccgctccgtcgccggcgtcgcgcgggcgggcggcttcgaggagtcccactcccacgcgacctcccacctgctgctgcccgaggacccggcgctgctggcgggcgacggcccgctggtcctggtcgacgacgagttctccaccggcaacacggtcctcaacaccatccgcgacctgcacgagcgctatccgcgcggccggtacgtcgtcgtcgccctcgtggacatgcgctccccggccgacctcgggcgcctggacgagttcgcgcgcgagatcggtgcccgggtggacctgatcacggccgcctcggggacggtgaagctgcccgagggcgtgctggagaaggggcaggagctggtcgcccggcacgagagggccgtaccggcggagcccgccccgcgcgacctcgggccggtcacccgggtcgctctcggctggccccgggacctccccgacggcggccggcacggcttcacacccgagcaccgcgcccgcctggacagggccctgcccgccatggcggcgcggctcgccgaggcgatacccggcgaggcccgccgcatactcgttctcgggttcgaggaactgatgtacgcgccgctgcggctggcccacgagctggaacaggccgtccgcggcgaggtgcggtactccacgaccacccgctcacccgtgctcgcggtggacgaccccggctacgcgatacgcagccgcatcgtcttccccgcccacgaccatccggacgacggacccggcgagcgctacgcgtacaacgtcgccggggccggcttcgacgccgtcgtcgccgtcgtcgactcggccgccgacacccccgcgctgcacgcccccgacggactgctggcccagctcgccgcgcacaccccgagcgtgctgctggccgtcgtcccctcgtacgttcccggaccatcgcacggacccgaaaggccccccatgctccccgagcctctccgtggccccgccttctcctcgtacgcgccggacgaggtcggctggctgctccaggacctctcggatgtgacgctggaagcgccgaccgaggagcgcgaggaggcgatccagcgcggcggcgcccactacgcggagtcgctgccggtggagtaccagccgagcgagcagtaccaggcgctgttccaggccgcgctcgacgactcggccacccgtatcgccgaggcggtcggcgccgtcacggagatcgtgctcgccgagcggtcgccccgtcccgttctggtctctctcgcccgcgccggtacccccgtcggggtcctgatgcgccgctgggcccagcaccggcacgggctcgacctgccgcactacgccgtctccatcgtccgcggccgcggcatcgacgccaacgcgctgcgctggctggccgaccggcacgacccggccgacgtcgtcttcgtcgacggctggaccggcaagggcgcgatcacccgcgaactcgccgacgccatacgggagttcgaggaatccgacggcatctcgggcttcgacccggagatcgcggtcctcgccgacccgggctcctgcgtacgcacgtacggcacccgcgaggacttcctcatcccctccgcctgcctcaactcgaccgtctccggcctgatttcgcgcacggtgctgcgcgccgacctggtcggcccgcacgacttccacggcgcgaagttctaccgcgaactcgccggtgccgatgtgtccgtggacttcctcgacgccgtctcggcccgcttcgccgaggccgaggacacggtcgacgcccgcgtcaaggaactgctctccgccgaccgcgccccgacctgggagggctgggcggcggtcgagcggatcagcgaggagtacgagatccacgacgtgaacctcgtcaagccgggcgtcggcgagaccacgcgcgtactgctgcgccgcgtcccctggaagatcctcgcccgcgccggagcgggcgccgacctcgaccacgtccggctgctcgccgagcagcgcggggtgcccgtcgaggaggtcgccgaactcccgtacacctgcgtggggttgatccaccccaagtacacgcggggcgccacaggtgccgacggcaaggcggtgacggtc

SEQ ID NO: 5789 - DNA, 816 bp, Streptomyces avermitilis
  CDS (1)..(816)
atggcccggcccacggtgctcgtcgccagcgacctcgaccgcacgctgatctactcggccgccgcactcgcgctgaccatgccggacgcgcgggcgccccggctgctctgcgtcgaggtgcacgagaacaagccgctgtcctacatgaccgagaccgcggccgggctgctcaccgagctcggcgacgcggcggtgttcgtgccgaccacgacccgtacccgtaagcagtaccagcggatcaacctgccgggccccgtcccgaagtacgcgatctgcaccaacggcgggcagttgctggtcgacggcgtgccggacccggactggcacgatgtggtcaccgggcggctcgccgacgagtgcgcgccgctggacgaggtgcaggcccacctggccgagaccgccgacccggtgtggctgcgcaagcagcgcgtcgccgaggacctcttcgtctatctcgtcgtcgagcgcgagctgctgcccgaggcgtgggtgaaggaactcgcggtgtgggcggagaaccgcggctggacggtctccctccagggccgcaagctctacgccgtgccgaagccgctgaccaagagcgcggcgatgcgcgaggtcgcccgccgcaccggcgccggactcacgctcgcggccggggactccctgctggacgccgacctgctgctggccgcggaccgcggctggcggccggggcacggcgaactggccgacgcggagtgggctgcgccggcggtcgcggctctgtcggagcggggtgtgctggcgggggagcggattctgcgggagttcttgcggggggtgcgggagggg

SEQ ID NO: 5790 - DNA, 225 bp, Streptomyces avermitilis
  CDS (1)..(225)
gtgcgcatgcctcgctacgagtaccgctgccggacctgcggcgacacgttcgaactgagccgcccgatggcggagtccgccgcccccgcggcctgcccggccggccacgacgacacggtgaaactcctgtcgacggtcgcggtgggcggctcggccccggccccgtctccggcaccgcgggcgggcggaggcggtggcggttgctgcggcgggggctgctgcggg

SEQ ID NO: 5791 - DNA, 678 bp, Streptomyces avermitilis
  CDS (1)..(678)
atggccacccacacccacggactgcgccggggatcacaacggtcgcgacggtcgcgacggaccagaaggatcaacctcgacgagcatctgccggtcgaccacggcctcagcaagttctaccgggtcggcgcggggctgatggggctcgtgctcctcgccttcggcgtcctcggcctgatcaaccggatcggcttcttcaacacccacggagacacggtcgcgggcctgaacaccaacggcgcactgagcgcgctgtcgatctgcgtcgggctgctgctgttcgtcggaatggtgatcggcgggaacgtcgcgtctacgctcaacatggtgctcggcatcctgttcatcctcagcggcttcgtgaacctcgcgctcctcgacaccggcttcaacttcctcgcgttccacatccagaacgtgctgttcagctttgtggtgggcgtcctgctgatgttcttcgggatgtacgggcgggtcggctcggccctgccgcacgacaacccgtactggcgggcccgccaccccgaacaggtggagcgggagcagcggatgcggacgtcgtcggtggagtcgctgcggcgggcgcacgacgtgcggcagctggcgacgctgcgggaggccgaggtgcggcggcgggcgaaggcgtccggggcgctgcggccgccgggcgacgccggt

SEQ ID NO: 5792 - DNA, 1422 bp, Streptomyces avermitilis
  CDS (1)..(1422)
gtgacggcgacaccttcacagccgtacacgccgtttgcgccacgcgcacaccgaccaggcgggccgctcgggcccggcggtcgctcccgacggatctcgtccggcgccgtccgcgacgtgctcaccctcgtcgccctccccctcgtcgccgctctcgccctgcccgcggccttcgccggcggcgggacccggcggtggttcggcgggcgggccgaggggcagcgggccgaggcccaggccgcgaaggacgccgccgcggccgcgttctacgagctcgacaccgcccagcgtgacctgcgcatctcgatagagaccatcaccgccgtcgacgactcccccgccgcgcgccgcgcggtctccgacttcgagacgctcgggcggcggatcgacgaggccagccaccagtacatcgaggccgtcgacgcacacgatctcgaccgggtcgacctggaggccgccaccgcctcgcgcgcccgcgccgagctgaccgccgctcgcgacgagctgggccgggtcaagcaggagctggatcgtttcgagcaggggctcgggccgctgctcggcaaggccgagacccagctggcccggctcgccccggccgtcgaacgcgcccgccaggccctgctcgccgcgagcaacgcgctggacgccgtacgggagtcggggctgaaggccgacgacctcgccgcccgtctcgccgccctcgccccggagctgaccaagctcaaccagggcgccggacagcacggtgtgccggggaccctggagcgcgccgagcgggtcgcccggaacgcggaggcggtacgcgcggaggcggagcggctgccggagcgggccgccgagatcgaccaccggctggtgtccctgcggacccgcgcccaggcgctgaccacgcgcgccgggcaggtggatccgatgctgagcgagctgcggcgccggttctcggccgcgtgctggcaggacctccagcacgtgccggaacacaccgcggagaacgtacggcaggccgagctgaagctgaaagaggctcaggccgcgcgggacgcccagcgctggccggacgcgacctcgctgctgtccaccgtgcgggcactgctgaacaacacggacgaggcggtgtcggcggccggggaccggctgcggcggctcaacgccgtcgcgaaggacccgcagcaggagatcgaccgtacgcgcttcgcgatccgcgacgcgcagcggctggccatggcgggccgcaacacgcccgacccgcggcatgcccgccccctcgacgactccgtcgcccggctcgaccgcgccatcggcacgctggaggggcgccaccccgactactggcacttcctgaccgagctggaggcggtgcggcagtcggtcgcgcgggtggtgtcccagatccgcgaggagcggggcacgggcggaccg

SEQ ID NO: 5793 - DNA, 798 bp, Streptomyces avermitilis
  CDS (1)..(798)
atggctggcacagtgcgcacccgtcctgcccgaggtaccgcacgtatccggcgtacccgggcactcgccgtcaccggtgtcgtcgccgtgctggtcgccacggccgccgcctgtggggccgacgcgacggaggacaaggatccggagcaccggtccttcgccctccccgggcgcacactcaccgtcgactccgacgactcggcgctcgaagtcgtctcggccgacgtcgacaaggtcgaggtcacccggtggttccgcggcagcgtgatggtcggcagggatcccagggtgacgtggaccatgaagggcaaccggctcgtgctgcggatgaagtgctcggggatggtcgcggactgcgccgcgaagcaccggatcgaggtgccgcgcggggtcgccgtcaccgtcgaggacggcgacgggagcgtgcgcgcgcggggcttcaaggaggcgctccgcgtcagtacgtcggacggttcggtgcgggtgaccgactccacggggccgctcacgctgcacaccgccgacggttcgatcagcgcggccggcgtcggttcgcaccgggtggaggccgacagccaggacggttcgatccacctcgaactgggcgtggtgcccgacctggtgaagtccaggagccaggacggctcgatcagcatcacgctgccgcacgccgcgtaccgcgtgacaaccggcagcgacgacggaagcgtgcatgtgtccgtgcccagggacgagaccagctcccatgtggtcgacgcacacacgaaggatggagcggtcacggtacggacggcaggt

SEQ ID NO: 5794 - DNA, 426 bp, Streptomyces avermitilis
  CDS (1)..(426)
atgaggcgcttgccgtcgtggctccacacgtgcgggccgttgccgtccaaggcgtccgggagacggatcgcgaagaccgcggaacacctggccgagtacgcgagtgccggccgaaccgggctcgtcttcgtcggtgcccgtggtggtgtcctgcggcgcaacaacttccggcggatctggctccgagcgctcgacgcgaccggtctcggtgacgtccatttccacgatctccggcacaccgggaacacgctcgctgccaccggcggcgccaccacccgcgagctgatgcaccgcatgggccactcctccgtgcgggccgcgctgatctaccagcacctcgtcaacggccgtgaccaccagatcgccgactacgtcgacggtcagatcaggaaggtgaagcggcccccgcgcggcccatctggcacg

SEQ ID NO: 5795 - DNA, 318 bp, Streptomyces avermitilis
  CDS (1)..(318)
gtggctgagacctatgacttcccgagtgacctccgcgccggtcaggaggagttgcaccaggtccgggccgagcttctggccctgctgaagcgacttccctggtcggtggaacagctggacggattcagcgacaccaacggctggcgcaaggtggagcgccccgcctcgccggactggaccgaggacgaacaggccgaggtggagaagctccggcagcgcgaacgggaactcgcggtcttcgtgacctgccaccgcttctgggcggagatcgcaccggagaagaaggtcgacgcccggatgaaactgaagcacgcccgc

SEQ ID NO: 5796 - DNA, 954 bp, Streptomyces avermitilis
  CDS (1)..(954)
gtgcggaggccccggcgagaagatgggggaatcatgacgaacagcgaactcacggtggcggtactgggcccgggcggtgtcggggggctgctcgccgcgctgctggcacgctccgggcaccgcgtgatctgcctggccggcgacgacaccgcgcgggcgctgcgcgagcacggcatccaggtgcgcagccggcagttcggcgagttcacggcacgggtcgaggcggacacggaactgcgcgagccggtcgacgcggtgctggtcgcggtgaagcacacggcgctggaggccgccctggagcgcgtaccggcgaaggcgctgggagacggtgccgaggccggcctggtcgtaccgctgctgaacggcgtcgagcatccggccgcgctgcgcgcccgctacggcggcgagcacgtggcgccggccgtcatccgtgtcgagtcgacgcgcgtggcgcccggggtgatcgagcacagcagtccgttcgccgaggtcgatctgaccggcgcgagcgtgccccgtgagcgcttggaccggctggccggggccctggagtcggcggggctgcgggtgcgcgtgtcggccgacgggaacgacgaggcggccacgctgtgggcgaagatgtcgttcctgacgccgttcgccctgctcacgacccggtacggggtgcccctcggcgaggtccgcacgcaccaccgcgaggagttggtggcgttgaccgaggagatcacggcggtgagccgggcatgcggatccccggccgacgcggcggcggccctggcccgctacgacgccttcccgccggagaccaggtcgtcgatgcagcgcgacgcggaggcgggccgcccgctggaactggacgcgatcggcggggcgttgctgcgggcggcggagcagcacggggtggcggtaccggtggcggcacggctgatccgggaggtgggagacggggtgcgc

SEQ ID NO: 5797 - DNA, 408 bp, Streptomyces avermitilis
  CDS (1)..(408)
gtgaccgccgtgcccgcgctgcacggccccgagggctccgagccgatcgtgggcgaggtcaccggtttcgtcctgtccggcgaagggctgcccacggtgtacgtcagcggcgacaacgcctccctcgacgtggtccgggcgatcgccggccggctcggcccgttcgacgtggccgtgctcttcgcgggcgccgcccgcaccccgctggtgccggacgcgccgctgaccctcaccagtgaggcggccgcgcgggccgcggagatcctcggcgcccgccatgtcgtgccgctccacttcgagcactggggccacttcacccaggacggtgccacgctcacgaaggcgttcgctcaggcggggctgacggagcggctgcacctgctggagccgggcggttcggtacggctc

SEQ ID NO: 5798 - DNA, 261 bp, Streptomyces avermitilis
  CDS (1)..(261)
gtgcagagcatgaccacagtggagatcctctatgtcggcggccccacggccgttgtcgaactcggcggcgtacgcctgttgacggacccgacgttcgacgcccccggcgagtaccccgtcggctcgcggaagctggtgaagacggcgggccccgcgctgccgccgacggacctcgccccggtcgacgccgtcctcctctcgcacgaccagcaccccgacaacctcgacggcgcgggccgtgcgtacctcaccgaggccccc

SEQ ID NO: 5799 - DNA, 252 bp, Streptomyces avermitilis
  CDS (1)..(252)
atgtgccgcagtatcaagacgctccgtccgcccgtactccccgaagaggccaccgaggaggagatccgggccgccgcgctccagtacgtgcgcaaggtgtccggcttccgcgcgcccgccgcgcacaaccgtgaggtgttcgagcacgcggtggaggcgatcgccgtggccaccgccgacctgctcgggggcctggaggtacggggtggcgcccgtactcccgccgctactcctgcaacgccgggcggcgca

SEQ ID NO: 5800 - DNA, 609 bp, Streptomyces avermitilis
  CDS (1)..(609)
gtgcttgaaagtgtggggtcgctgaccggcagcccttggatctacgccgtcgtggccgcatcggtcctcctcgacgtcttcctgccggtcctgccgagcggcgtcctggtcatcacggcggcgacggcggcagcggcgggctcggccacgaaggcggtgccgcacgacgcgcccgacatcctggcgctcaccctctgcgcggtcaccgcgtcggtggccggcgacctggtcgcgtaccgcctggcctggcgcggcggcgaccgcctggaccgcgccatcgcccgctcccgccgtctgagcagcgcgcaggaacgtctcggcgcggcgctctcgcggggcggcggcaccctggtggtgctggcccgcttcgcccccgcgggacgctcggtcgtctccctgggcgcgggcgccgcccaccgccgtgtccgcgagttcctgccctggtcggtcctggcgagtgtcagctgggccgtgtacagcgtcgccctgggctatttcggcgggcagtggctgggtgccacctggctcgcgacgggcgtgtccgtggcagcgctgttcggggcgggcgcgggcgcggcgtacttcatgcgccgcccggcgttgcaggag

SEQ ID NO: 5801 - DNA, 453 bp, Streptomyces avermitilis
  CDS (1)..(453)
atgaccggacgcctcaacagcgcccagcccttcgccatcggcctgttccgcatcgtcgtcggcctgctcttcgcctgccacggagccgcctcgctcttcggcgtcctcggcggcgccatgggcagcaacggcggcaccatccccgccggcacctggcccggctggtacgcggccgtcatccagctggtcggcggctccctggtggcgctcggcctcggcacccgtgccgccgcgttcatctcgtcgggctcgatggcgtacgcgtacttcgacgtccaccagtccgcggccctgtggccgatccagaacggcggcgaactgtcggccctgttctcctggtcgttcctgctgctggtcttcaccggctccggcgccttcggcctcgaccggctcctcgccggccgctcggccgcggccgaggagagcaagccggcctcggagcccgtcgccgcc

SEQ ID NO: 5802 - DNA, 1992 bp, Streptomyces avermitilis
  CDS (1)..(1992)
ttgcgccccactcgcccgggagtcacccttttgtcttcagcgaccgtgtcatccgtgccggtctccgtcgccctcgtcggcgcgggaccgcgcggaacgagcgtcctggaacgcctctgcgcctccgcaccggagctcctcgcgcccggcgtgcgcctgacggtccacgtggtcgaccccgcgccaccgggccccggccgcgtctggcgtaccgcgcagtcccctgagctgctgatgaacacggtcgcctgccaggtcaccctgttcaccgacgagagcgtggagtgcgcggggccgatccgcccgggaccgagcctgtacgagtgggcgagtggcggcggcatcggtgccggtgtcggtgtcggcgaggagctggggcccgacgactatccgacccgcgcccagtacggccgctatctggagtgggtgttcgccgaggcggtgcgcggcgcgccgcccgccgtgcgggtcgaggtgcatccggcccgggcggtgcgcctcgacgacgcccccgacggccgccagacgctcacgctcgccacgggccgcaccctggagggcctcgcggcggtggtcctggcgcagggccacctgcccacggtcgccgacccggcggcgcggcgtctcgccgcgcaggcggcccggcacggactgcgccacatcccgcccgccaacccggccgacgtcgacctctcccctctcgcccccggcgaaccggtcctgctgcgcggcctcggcctcaacttcttcgaccacatggccctgctgacgacggcccgcggcggccggtacgagcggacggcgcgagggctggtctaccggccctccggccgcgaaccgaagctctacgccggctcccggcgcggcattccgtatcaggcccgcggcgacaacgcgaagggcccctacggccgccaccgcccactcctcctcaccgacgaggtgatggcccgctttcgcaaacgcgcggactccggcgaggccccggacttcctggccgagatatggccgctggtggcgaaggaggtcgaaacggtctactacgagtgtctgttgaaccgccgcgaccgccttccggagcacccggcctcccctccggaccgcccggccttccgggaccgtttcctcgccgccgccctcggcagccccgaggagagcgcggtcctcgacgagttcggcgtccggggcgccgaccgctggtcctgggaccgcatctcccgtccgtatacgggccacaccttcgacggccccgccgcatggcggagttggctgctcgcccggttgcgcgaggacgccgagcaggccgcgctcggcaatgtcgaaggacccctcaaggcggccctcgacgtgctgcgcgacctgcgcaacgagctccggctgatcgtggaccacggcggcctgtcgggcgcctcgcgccgggaccacctggaccgctggtacaccccgctgaacgccttcctctccatcggcccgccccgccgccgcatcgaggagatgaccgccctgatcgaggcgggcgtcctggacgtactgggcccccgcctggaggtgcgcgccgaggacggggcgtgggtggcccgctcccccgacgtccccggctcggccgtgcgggccatcacactcgtcgaggcccgcctgccggaaccggacctgcggcgcaccgccgacgaactgctggccggactgctgaagacgggccgctgccgcccccacaccgtcgatggttacgaaaccgggggcctcgacgtaacaccgcgcccctatcgtctgattgatcgtcaaggcgccgtgcacgcaaggcggttcgcgttcggggtgccgacggaaggcgtccactgggtgaccgcggcgggggcccgtccaggtgtggattcggtcacgctttcggacgccgatgcgatggcgcgagcggttctacgtgcggctgcgtccgtggcgggaccggaaacggaaccggacccatggctgaatgttgaacttgcaagcattgat

SEQ ID NO: 5803 - DNA, 1632 bp, Streptomyces avermitilis
  CDS (1)..(1632)
atggcggggctgcgcctgggaccactgctgagatatatcgacgactcgtccgcgaccgtctgggtcgaggcgagccgtccgtgcaccgccgaggtgcggtgcccgggcggcgccggcggcacggcccgcaccttccagatcgccgggcaccactacgcgatcgtgccggtgagcgggctcgcgccggccaccgacacctcgtacgaggtgctcctcgacggcacgcccgtctggccgctgcccgactcacccttcccgccgtccgtcatccgtaccccggacgggggcacggtccgtgtcgccttcggctcctgccgctgggccgcgccggccgaggacgagaaggacaccgtcggccccgacgccctggacacactggccacccgcatcgccgccgcacccgagggcgaacgcccggatgtgctcctgctgctcggcgaccaggtgtacgcggacgagacctcccaggccacgcagcactggctcgccgcccgccgggacctcgccgagcccccctggaagcaggtcgcggactacgaggagtacacccacctctacgacgaatcgtggctcgaccccgagatccgctggctgctgtccaccgtccccagctgcatgatcttcgacgaccacgacatcgtcgacgactggaacaccagcgccgcctggctcgccgagatgcgcgcgaccccgtggtggcgcgagcgcctgatgggcggcctcatgtcgtactgggtctaccagcacctgggcaatctctccccggcggaactggccgacgaccccctgtacgccgccgtccgcgccaccccggacggcacggacgtactgcgcgcctactccgcccaggccgacgccgaccccgcctcggtccgctggagctaccgccgcgacttcggccgcgtacgcgtgctgatgctggacacccgggcggcccgggtcctcgacgaacagaaccgctcgatgctcgaccccggagaggcccggtggctgcgggagcaggcgtgcgcggatcccggctcgtacgaccacctcctcatcggcacctccctgccctggctgctcccccacctcgtgcacgacgccgagacgtggaacgccgcgctgtgccgtggaaaccggggcgcacgctggacccgcttcggcgaacgcctgcgcagacgggccgacctggagcactgggcggccttccctgagtcgttcgaggcgctggcggcggtgatcgccgaggtgggagcgggggcggacgcaccggcgaccgtgtgcgtactgtcgggcgacgtccatcacgcgtacgtcgccgagcccacctggcccgggccggggcccgacgcccgtgtgctccagctgacctgctcccccgtgcacaactccgtcccgctgtccatcagactcggcttccgcttcggctggagcggcctcggccggatcctggggcgccgtctggtccgccacggccgctgggagcacaccgccctcggttggcgcaagacgggcggcccctggttcggcaatcagctcatgatgctgaccctgcgcggccgttcggcatcactgcggctcgaacaggcgcgggccgaccggaacgggggcgcccgcctggacgcggtcacggagtccgtactcaccgaa

SEQ ID NO: 5804 - DNA, 642 bp, Streptomyces avermitilis
  CDS (1)..(642)
atgccaaaggtctacgcgcgtcgacggctgagcatactcgcagccttcaccggcctgatagccctggccgggattttcaacggcccggccgcctccgccgcgctgcccaccccggtcagcgccgccaccgcccgcacctacctcgcctccctcaccgtggcgacggagaaccgcaccggctacgaccgcgatctgttccccacctggatcacgatcagcggcacctgcaacacccgtgagtacgtcctcaagcgcgacggttcgaacgtcgtcaccaactccgcctgcacggccaccagcggcagctggtactcggtctacgacggcgccacctggaccgccgcctccgacctggacatcgaccacctcgtgccgctggccgaggcctgggactccggcgccagcgcctggaccaccgcgcagcgccagggcttcgccaacgacgtgacccgcccgcagctcatcgccgtcacggacaacgtgaaccagtcgaagagcgaccaggacccggccgagtggatgcccccgctcagctcgtacacctgcacctacgtgcgcgcctgggtgcaggtgaagtactactacaacctctcggtcgactcggccgagaagtccaagctgtcctcggtcctcagcggctgc

SEQ ID NO: 5805 - DNA, 579 bp, Streptomyces avermitilis
  CDS (1)..(579)
ttgatcagcttcagtgtcatggcgctcgtcttcggcgtcgtcttcctggccgaactgccggacaagaccgccctggccggacttgtcctcggcacgcgctaccgcgcctcgtacgtcttcgccggcgtcgccgccgccttcgccctccatgtcgccctcgccgtcgcggcgggcagtgtgctgacgctgctgccgcagcagatcgtgcacgcgctcaccggtgtgctcttcctcggtggtgccgccgtgctgctgatgaagaagggcgagggcgaggaggagatccgcaagcccgagaaccagagcttctggaaggtctcgagcgcgggcttcatgctcatcctggtcgccgagttcggtgacctcacgcagatcatgacggccaacctcgcggcccgttacgacgatccgctctccgtcggcctgggcgcggtgctcgcgctgtgggcggtggccgggctcggcatcgtcggcggcagggcgctgatgaagagggtgccgctgaggctcatcaccaaggtcgcggccctgctgatgctggcgctcggcgcgtggagtctgtacgaggcggtggccggc

SEQ ID NO: 5806 - DNA, 660 bp, Streptomyces avermitilis
  CDS (1)..(660)
atgccggccgccgccaccgttctgaccgcccgggcccttctgctggacatggacggcaccctcgtcaactccgacgcggtcgtggagcgttgctggcgccgctgggccgaccggcacgggctggacgccgacgaggtgatgaaggtcgtgcacgggcggcaggggtacgcctccatggcggtgctgctgccggaccggcccatggagcagaacttcgccgacaatgcgcgcatgctcgccgaggagaccgccgacatggacggcgtggtcgagatcccgggtgccttcgcgttcctcgcctccctcgccgggctgccgcacgccctcgtgacctcggcggacgtgggactgtccacggcccggatggcggcggccgggctggagctgcccgacgtacgggtcacggccgagtccgtcggggccagcaagccggaccccgagggctttctgaagggcgccgccgaactgggcgtcgcgcccgaggactgtgtcgtcttcgaggactccggggcgggaatcgaggcggggcgctccgcggggatgcgggtcgtgggggtcgggccacgggcggccgcgcaccggccggatgtggtggtgcgggacctgacacaggtgcgggtcgaaagcgcgacggacgggacgatccggctgcacgtgggc

SEQ ID NO: 5807 - DNA, 1002 bp, Streptomyces avermitilis
  CDS (1)..(1002)
gtgagcggatcgaacggacacgcctgtccggagtgcggagcacctcggcagccgaacggcacgccgtcctgcggatgcacccggcgggcctccgacgcgctccgtgacgcccgtacggcgcaggcggcagcggcggaggacttcgatccgctgcggatccggccctatgtggagctggggggcgcggcggcgggagcgaaacccgcggggccgtcggacgagaccgtgccgatggtggccgtaccggcggaggcgggcgcgtccggcgccggcctcttcccggagggcgacgttccggacggcgacttcccggtcggcgacttcccggagggcgccgcggagcccgggtacgggtcttccggtcccggcgccccggtgccgcccgcccgggacgagccgccgctgcgtcggcggcgtaccgtactgctggcttcggggggtgttctcgccgccgtggtggccgccgcggggctggccgggggtttcttctcctacgacgctccgcagcgcgacggggcactgccggacgacgtccgggcgagcgtgccggaggcgtcgtccaccgcggcgtccgtgtcggcggccgggagcgagtcggcggcgcggccgtcggcggggagcgcgagcccttcgccgagcgcgagttcgtcgccgtcggcttcggcgtcgagcagggcaccgtcgcggtccgggccggccacgccgagcggaacgccgacgaccgcgcgggccaccggctcggtacggccgacctcgggcaacgaccgggaccagccggcctccccggtcctgcaacgcggtgacaagggtccggaggtcacggaactccagctccgcctgagccagttgctcctctacaccggcaacgccgacggcacctacagcagccaggtcgagacctccgtacgcaactaccaactggcccgcggcatcacgaccgacgaccagggcgtgtacggggcggcgacgcgggcgagcctggagtcggagacgtcggagcct

SEQ ID NO: 5808 - DNA, 2085 bp, Streptomyces avermitilis
  CDS (1)..(2085)
atgaccggggatgcgcagggcacgccgggagagcggcagcacgcggcggcgaccgccgtccgacggcgcccggcaccggacggcgtacccggcagcgtcctcgtgcccatcggcgcgctgctcctcggcctgctgctcgccgccctggaccagacgatcgtgtcgaccgcgctgcccaccatcgtcagcgacctcggcggcctggaacacctctcctgggtggtcaccgcgtatctgctcgcctccaccgcggccaccccgctgtggggcaagctcggtgaccagtacggccggaagaagctgtttcagacggcgatcgtgctcttcctgatcggctcggcgctgtgcggcatggcgcggaacatgcccgaactcatcgccttccgcgcggtgcagggactcggcggcggcgggctcatcgtgctgtcgatggcgatcgtcggtgacatcgtcccgccgcgcgaacgcggcaagtaccagggcctgttcggcgcggtcttcggcgcgaccagtgtgctcgggccgctgctcggcggcctgttcaccgagcacctcagctggcgctgggtcttctacgtcaacctgcccgtcggagtcgccgcgctcgccgtgatcgccaccgccctgcacatcccgaagcgctccgcgcggcacgtcatcgactacctcggcaccttcctcatcgcctccgtcgccacctgcctggtcctggtcgcctcactcggcggcaccacctggggctggagctcgccgcagatcatcggcctcgcggtgctcggcgtggtcctggtggcggcgttcgtggccgccgaacgccgggccgccgaacccgttctgccgctcaagctcttccgcgtacgcaccttcacgctcgccgccgtgatcagtttcatcgtgggcttcgcgatgttcggcgcgatgacgtacctgccgacgttcctccaggtcgtccagggcgtgacgccgaccatgtccggtgtgcacatgctgcccatggtggcgggcatgctcatctcctccaccgcctctggacagatcgtcagccgcaccggccgctggaaggtgttccccgtcacgggcaccggggtcaccgccctcggcctgctcctgctccaccagctcgacgagcacagctccaccggccggatgagcgtctacttcttcgtcttcggcctgggcctcggcctggtcatgcaggtcctggtcctgatcgtgcagaacgcggtgtcgtacgaggacctgggcgtcgccacctccggcgccaccttcttccgctccatcggcgcctcgttcggcgtcgccatcttcggctcggtcttcgcgagccgtctcggcgacaagctgacggcggcgctcagcggccgcccgctcccggcgggcatcaccccggacaccctgaagtcagacccgcgcggcatcgcgaacctcccctcctcgttgcgcccgtccgtcctccaggcgttcgccgcctcgatcaccgacgtcttcctgtacgcggctccggtcgccctgctgggcttcgtgctggcgtggttcctgcacgaggaccggctgcgcggctccgtcacggcgccggacgtcaccgagaccctggcgagcaacccggtggaacgttcgtcgtacgacgaggtgtgccgggccctgtcgctgctcggctcgcgcgaggggcagagcgcgatctacgagaagatcaccgcgcgggccggctacgacctgctgcccgcggcgagctggctgctgctgcggatcaagaagtacggctgggccgagccggcgcagctcgccgaggacagctccgtaccgctgaccgtcgtgctcgacgcggcgcgccagatcgaggagcggcatctcgtgctgcgcgaggggctcgacctcgtcctcaccgaagggggccgggaggtcgccggcaagctgtccgaggcccgtgcggagtccctggccgaactgctcggcgactggtggggccccgaccgccccaccgacctgaccagtctggtcgaggaactgaacaccgaactgtgcggctcggacgcggaacgcccgcgcgccgaggggacgacgtcccggccctacggtgggcccgcc

SEQ ID NO: 5809 - DNA, 540 bp, Streptomyces avermitilis
  CDS (1)..(540)
atgatgcgtacgacacccggatggaccgttgccccggagcccttcgactcacctgtcgccgccgcgctgtggcgggcgtactacacggaggtcagcgaccgctggtaccagctccacgaggggcacgcgaccgaccccgccgagctggagcgcgagatcgccgcggacccgggtgcgtatctggcgccgccggacggggtgttgctggtcgcgcggtacgagggcgagcccgtggggacggcgggcgtgcggctgctggcggcgaacaccgccgaactgaagagggtgttcctgttgaaggagacgcgcggccggggcggcgccgccccgctcgtcgccgccgcggaggacgcggcccgcgcactcggcgcggagcgcatcgtgctcgacacccgcggcgacctggtggaggcgcgcgccctgtacgcgaggctcggctacgccgagaccgagccgcacaacgacgagatctacgccgaccactggttcggcaagtcgctggtccaggcgggccaggcgggccaggcgggccaggcgggc

SEQ ID NO: 5810 - DNA, 732 bp, Streptomyces avermitilis
  CDS (1)..(732)
atgtccacaggcgtgatcatcgctctgatcgtgatcgtggcggccgtcgtcgttgtcgcggccgccctgctccttcgcgcccgtaggccgcagggtgggcgcagcctgcagcggcgcttcgggcccgagtacgaccgcaccctcgcccggcacgacggcgacgccaaggccgccgagcgcgacctcgccgagcgggtgaggcggcacggttcgctggagacgcgtcccctggaacccgcggcccgcgaacagtacgcggcccgctggacggcggcccaggagcgcttcgtcgactcgccgcgggacgcggtggcggaggcggaccagctgctcgccgaactggccggcgagcgcggcttcccggacggaggccgctacgaggagcagctcgaggcgctgtccgtgcaccatgcgcaccacgtccacggctaccgcagggtgcaccggttcgcgcaggccgacaccgccggcgcgccggagaacggggccggtacggaggagatgcgcgaggccatgatcgaggcccgcgccctcttcgaggacctggtgagcacgaatggccaccgagcgggcatcggcgcgaagaccgagcagtcgcagaccggcacgaagtccgcgacggacacgagggccgtcgagggcgcctcggcaccggcccacaccgaccggacggccgccggcggccgcaccaatctgtcgtgggcattcaacaggcgtcacgcgaaggggagt

SEQ ID NO: 5811 - DNA, 768 bp, Streptomyces avermitilis
  CDS (1)..(768)
gtgacacccgacgagggcgcggtacgccgcgagccgacgaggatcgacgaggcgaaggccggaccggggcgcggacgcgaggcacgcgacctgcgcgatacgcgtgagacgcgtacgagcggcatcgcaccgacccacggcgacgggttcggcgacggcgtcggcggcgccgagggccggccggcggggagcccgcgggacaccggccgccaggccgacggcccgggggccgggagccgggccgcgggtgccgggaccgggagcgccaagcccgggatccctcaggcccagagcccgcagccggagaatctccggacggggataccccaggagcaggccccgcagccgaagagtctccgcaccaagatcccccagtcggacctcccccagtcagaccgttcccagtcggaccgcccccggtccgaccgcctccactccgacggctcccacccgcagcaccccggggccaccgcccacgaagcccctttcctcccccatgacgagtgcgacaagctctccctgcggctgcaccacgccgtcgccggattcgtcgatgagccccgtgccgccgtggaagaggccgatcacgtgctcgaagaggtcgccgcgcggttcgcggacgccgtggcccggcagcggcgcaccctgcgaacctcttggtccgccgccggcgagtccggctccggcgggcaccccaccgtcgacaccgaacagctccgtctcaccctgcgcgactatcgcgagatgacggagcggctgctgcacatg

SEQ ID NO: 5812 - DNA, 411 bp, Streptomyces avermitilis
  CDS (1)..(411)
atgaccgagcgcaagccacccggcgtcagcttcgagtccttcgtcgacaaacagatccgcgacgcggaggcgcgcggggagttcgcgcacctccccggcgcgggcaaaccgtcgcccgccgtcacgggcacgtcctacgacgaactgtggtggatcaagcagaagatggcccgcgagggcctcgccgtgctgccgccgacgctcgcgctgcgcaaggaggcggaggacacgctggccgcggcggccggggcgccgtccgagcgggtcgtacgccgtctcctcgaggagatcaacgtcaagatccgcgacatgatgttcaagcccccgccgggaccgccgctggggctgaagccgtacgacgtcgaagagatcgtccgggagtggcgcgagcgccgggccgggcagactccg

SEQ ID NO: 5813 - DNA, 459 bp, Streptomyces avermitilis
  CDS (1)..(459)
atgcggcggcggggtgccgaccacggcgcaacggccgctggacatccggtactcgaaggagcgcacgtgctcgaactcaccatggcctcggtttccggggcggacgccggggcgacggccggcatgctcatggccgacgcgcccagcgagcccggcgccgtgctgcgggtgggccgggacaaggccgtgtgccggctggcgacccccgacgactggctgttcgtctcccgtgtccacctggagttcctctgcggtccggacggcacctggcaggtcacctggctgcgcggctcccacgccgagccctcctccgaggtggtgctgaccctggccggtctccagccccagcccctcccgtacggcggcacggccaagctgcccgggggcggatccggcgaactcgtcgtccaggaccgctccgagccccgcagcgtcaacgtgggcttctatcacgatgcc

SEQ ID NO: 5814 - DNA, 672 bp, Streptomyces avermitilis
  CDS (1)..(672)
atgagcgagtcgcaacagctctgggacgacgtcgacgactacttcaccaccctgctcgccccggaggacgaggcgctcaccgcggcgctgcgcgacagcgacgcggccgggctgccgcacatcaacgtcgcaccgaaccagggcaagctgctccagctcctcgccgagatccagggcgcgcgccgcatcctggagatcggcacgctcggcggctacagcacgatctggctgggccgcgcgctgccgcgggacggccggctgatctccttcgagtacgacgccaagcacgcggaggtcgcccgccgcaacctcgcccgagcgggcctggacgggatcagcgaggtgcgggtgggccccgccctggagtcgctgcccaagctcgccgacgagcggcccgagccgttcgacctggtcttcatcgacgcggacaaggtcaacaacccgcactacgtcgagtgggcgctcaaactgacccgccccggcagcctgatcgtcgtcgacaacgtcgtccgcggcggcggggtcaccgacgcgggcagcacggacccgagcgtgcgcggcacccggtccgccctcgaactaatcgccgagcaccccaagttgagcggcacggcggtccagacggtgggcagcaaggggtacgacggcttcgcactggcccgcgtgctgccg

SEQ ID NO: 5815 - DNA, 1194 bp, Streptomyces avermitilis
  CDS (1)..(1194)
gtgccgtctgagaccctgtccgacagcacgacggaggggtcacgggggatgtgggatttcgtgcgaggggtcgtacgggggcgcgtactggtcgtcgtactggcgctgtcggcgttccagctggggtccctgctggcaccggcgtacgcctgcggctgtggcgcgatggtgccggacggccggcagtacgtcaccgtgaaccgcgaggtgtccgccgtccgctgggacgacggacgggaacagatcgcgatgagtctgacggtctccggggacgcgcggcgggccgcgtggatcatgccggtcccgcaccgggcgaccgtgcggctcggcgaccgcgcgctgttcgaccagctcgccgaggcgacggcaccggagtaccgcacccgccactacttctggccccgggacggcgactggccgttcgacaagagcgacaacgcggccgccgccccgggagcgggcgcggcggcaccgcccgtgggtgtggtcgaccgcgagcggctcggcccgttcgacgtggcccggctgacggccaccgaccccggcgccctcggcacctggctcaccgacaacggcttccatctgcccgaccgcctcgaccgggcactgcgcccgtacgtcgaccagggctgggagtacgtggcggtccggctcgccccgaagagcgcggacgccgccctcggcggcaccctggacccgctgcgtctcaccttcgccagcgaccggccggtctacccgatgcggctgtcccggctcgcccggaccccgcagtcgctgcgcctgtacatcctcgccgcgcaccgcacggagccgcgttcggcgatcggcggcgaccggccgcgggtctggttcgcgggccgggtgacggccgcgtccggccccctggcggggctcaccgagggcggcacggacttcctcaccacggtcgaccaggagttcccgcggccgtcacggatctccggcgaccacgaactgcggcgcacggccgcggacaccacgcgccgccagatcatctaccgcgacgaactgctgacggcgggcgggatccccgtctggcagctgacggtggcgggcgccctggcagtggcggtcatggtgctgctggtgctgctgcgaagccggaggcgacgcccggtaccgcccccgccgccggtcatgccgcccccgccggcccacgccccgcccccgatcggc

SEQ ID NO: 5816 - DNA, 1470 bp, Streptomyces avermitilis
  CDS (1)..(1470)
atggtcgcttttcggctcacttccggtgagcggcccccggtccgccccagcggccctgtccctgtccccgacgaaaggcaggcgagcggagtcttgaccctcgcaccagcagcacccgtagcaccccccgtcccttcgacgacggatgtcaccgtcacggaccccgccctggtcaaacgcgccgtcaaggccgccgcactgggcaacgccatggagtggttcgacttcggcgtctacagctacatcgcggtgacgctgggcaaggtcttcttcccgtcgggcaaccccacggcgcagctgctctccaccttcggcgccttcgccgcggccttcctcgtccgcccgctcggcggcatggtcttcggcccgctcggcgaccggatcggccggcagaaggtcctcgccctcaccatgatcatgatggcggcgggcacgttcgcgatcggtctgatcccgtcgtacgccacgatcggcgtgggggcgccgctgctgctcctgctggcccgcctggtccagggcttctcgaccggcggcgagtacgcgggcgcgtccacgttcatcgccgagtactcgcccgacaagaagcgcggcttcttcgggagctggctggagttcggcacgctcgccgggtacatcggcggcgcgggcctggtcaccctgatgaccgccctgctgtcctccggcgacctgctgtcctggggctggcgcatcccgttcctgatcgcgggcccgatgggcatcatcggcctctacctgcggatgcgtctcgaggagacgccggccttcgcggcggagctggcgaaggcctcgaagaaggagcaggaccgcccgaaggtgccgctgcgcgccatgctctccggccagtggcgcgcgctgctcctgtgcatgggcctggtgctcgtcttcaacgtcaccgactacatgctgctctcgtacatgccgagctatctgacgagcgagctgaagtacgacgagacgcacggcctgctggtcgtgctcggcgtgatggcgctgatgatgatcgtgcagcccttcgcgggtgcgctgacggaccggatcggccgccgcccggtgatcgccgcgggctgcgtgggcttcctgttcctgtcggtcccggccatcctgctgatccgtcagggcagcctgctcgccgtcgcgctcggcatgggcgcgctgggcctgctgctggtctgcttcacctccgcgatgccggccgcgctgcccgcactgttcccgacgaaggtccgctacggctcgctgtccatcggcttcaacgtctccgtctcgctcttcggcggtacgaccccgctggtggtcacggcgctgatcggggcgaccgggaacatgatgatgcccgcgtactacatgatggcggcggccgtgatcggcggcgccgcggtgtggttcatggcggagtcggcgggccgcccgctgccgggctcggcgccttcggtggagcccgccgaacgc

SEQ ID NO: 5817 - DNA, 903 bp, Streptomyces avermitilis
  CDS (1)..(903)
gtgggtctctggctgatcgccgcggtcctggcgatgcgacaggtcgccgtcgtcctcggcaccccccggggagagcggctcacggagctggagacctgggtcggcccggacggcgtcctgcatgtgaaggggtcgctgtacgactcgacgcagttcaccggtacccccttcgggggcctcgtcctgaaacccctcaccaaggcggccgagcaggccctcggctggggctgggccttcggcacgctcctgctggtcgtcgcgctcggcctggtcgccgcgcgtgccctgccgcagcccgtgacccggcgcacctccctgctcgccgcaccggtcgcgatcagcctgctgatgttgtcgctgtcggtccgcaacaccctctacctcggccagaccagcgtcatcccggtcctgctcgtcctgctcggctgcttcaccgtgcgtggggagcgggcgagcggtgtgctgatcggcgtcggtgcggcgctccagccgacggtgctgctcttcgcgccgctgctgtggttcaccgggcgcagccgcgccgccgtgtccacggggggcacgttcgccgcgtgcacggcgctcgcctgggccgcgctgccgcacgactcgtacacgtactgggtgcaccacgtggcgggcgtcggcctcggcggcaacgcggacgacctcgccaaccagtccctgcacggcgcgctgctgcggctcggcctcgaaggcccgctggagatcggcctgttcctgttgctcggcgcggtcgtcgcggtcctcggcctgcgccgcgcggtgcactgcgcggcggacgggcagctgctgctcgccgtggcgatcaccggttgtgtcgcggtcgccgtctcgcccacgacctggcagcaccgtgcgaggcccggtcactgcgtgcgc

SEQ ID NO: 5818 - DNA, 1242 bp, Streptomyces avermitilis
  CDS (1)..(1242)
atgccctgtccagcgctgcccgacgggttcgacctcaccgaccccgatctgctgcaccagcgcgtacccctcccggagttcgccgagctgcgccggaccgcgccggtgcactgggtcccgcaacagcacgggctcgccggcttccaggacgacggctactgggccgtcacccggcacgctgacgtcaagtacgtctccacgcaccccgaactcttctcctcctacctcaacaccgcgatcatccgcttccacgagacgatgcaacgcgaacagatagacgcccagcggctgttcatgctcaacatggacccgccggagcacaccagggtccgccagatcgtgcagcgcggcttcactccgcgcgccatccgcgccctcgaggacaccctgcgcaggcgcgcccgctcgatcgtcgagaccgcgctcgcggacgccggcccggacggctccttcgacttcgtcacccaggtcgcctgcgaactgcccctccaggccatcgccgaactcatcggcatcccgcaggacgaccgcgcgaagatcttcgactggtccaacaagatgatcgcgtacgacgatccggagtacgcgatcaccgaggaggtcggcgccgagtcggccaccgaactcatcgcctacgccatgaacatggccgccgaccgcaagcagtgcccggccaaggacatcgtcagcacgctggtcgccgccgaggacgtgggcaacctcgcctcggacgagttcggcttcttcgtgctgatgctggccgtcgccggcaacgagacgacgcgcaacgccatcacgcacggcatgcacgccttcctcacccaccccgaccagtgggacctctacaagcgggagcgcccggcgaccgccgccgaggagatcgtccgctgggcgaccccggtcgtctccttccagcgcacggcgacccaggacaccgaactgggcggcaaacagatcaggaagggcgaccgcgtcggcatcttctactcctccgccaaccacgaccccgaggtcttcgagcacccggacgtcttcgacatcacccgcgaccccaacccgcacctcggcttcggcggcggaggcccgcacttctgcctcggcaagtcgctggccgtggtggagatcgacctcatcttcggcgcgatcgcggacgtcatgcccggtctgcgcctgaccggcgacccgcgcaggctgcgctcggcctggctgaacggggtcaaaggcctccaggtgagcgccggt

SEQ ID NO: 5819 - DNA, 1167 bp, Streptomyces avermitilis
  CDS (1)..(1167)
atggccgcggaacccgtgatcgtcgaagccgtacgcacccccatcggcaagcgcggtggcgcgctcgcccatctgcaccccgcctatctcctgggcgagacctaccgtgaactcctcggccgcaccggcatccacgccgactgcgtcgagcagatcgtcggaggcacggtgacccacgcgggcgagcagtcgatgaaccccgcgcgcacggcctggctcaccatggggcttccgtacgagacggccgcgacgacggtcgactgtcagtgcgggtcctcgcagcaggcctcgcacatggtcgccaacatggtcgcggcgggagtgatcgacgtcgggatcagctgcggggtcgaggcgatgtcgcgggtgccgctcgggtccgggtccaagcacgggccggggaagccgttcccggacgagtggaacgtggatctgccgaatcagttcgaggcggcggagaggatcgcgcggaaccggggtctgacgcgggagaacgtcgactcgctcggactgatctcgcaggagcgggccggggccgcgtggtcggaggagcgcttcaagcgcgagacgttcgccgtgcaggtgcccacgacggaggaggaacagcgggccgggcagggcatgtggcggctggtcgaccgggacgaagggctgcgcgacacgtccatggaggcgctggccggactgaagccggtgatgccgacggcggtccacacggcgggcaactcgtcacagatctcggacggggccgccgcgatcatgtgggcgtccaaacggatggcgcgtgcgctgaagctgcggccacgggcgcggatcgtggcgcaggcactggtcggggcggacccgcacttccacctggacgggccgatcgacgccacgcgggcggtgctcgggaaggcgggcatgtcgctgaaggacatcgacctcgtcgagatcaacgaggcgttcgcctccgtggtgctgagctgggcgcaggtcttcgagcaggacctggggaaggtgaacgtgaacgggggcgcgatcgccctcgggcatccggtcggggccacgggggcgcggctcatcacgaccgcgctgcatgaactggagcggcgcgacaaggagttcgcgctgatcacgatgtgtgcgggcggcgcgctggccaccgggacgatcatccagcggttg

SEQ ID NO: 5820 - DNA, 738 bp, Streptomyces avermitilis
  CDS (1)..(738)
gtggacttgagtgcaccgtgcccgtccccgccgaccggaggttccatgagcgcagagagcactgagacgcagccgcacgacccggaggcacgcgggctgcgcctggtgacggtgctgctggggctgaccgtggtcagcgggctgatcgacgccgtgagctatctggggctcgggcacgtcttcacggcgaacatgaccggcaacgtggtggtgctgggcttcgccgccgcgggggcgccgggcttctcggtgccccacacgctgacctcgctggtctccttcctggtgggcgcggtggccgggggacgcgtcgcggtgcggttcggcggcggctcccgccgggcctgggcgcggggcacgctcgccgtggaggcggtactggtcggcgcggcctcggcggtggccttcgcggcgccgggcgccacgggcacgaagtacacactgatcgccctcacggccttcgcgatgggtctgcgcaacgccacggtccgcaagctcggcgtgcccgatctgacgacgacggtgctgacgatgacgctgacgggcctcgcctccgactcccgcgtggcgggcggcggcgcccacccccgttccccccgccgcaccgcctccgtggtcgcgatgttcgccggcgccctgctcggcgcgtggctggtgatccaccacggcctgggcattccgctggtgatcgcggcggtgatggcgggggtgttcgcgctgaccgcgtcggggcgggag

SEQ ID NO: 5821 - DNA, 1248 bp, Streptomyces avermitilis
  CDS (1)..(1248)
atgagagacgacacgcgcaaaacccatgaaacacggaccagttggcggaccaggaggggactcgccggaggggcggccctgctgctcaccgggatcgccgtggcacccgtcgccgcggccggggagcgctccgccccggggacccggcgcggcgcactcgtctccgtcacccccgtcgccgaccgcgacgcgggagaggtcagggcgttcctcgccgggcgcgacatcgccaccgactccgtgcgctacggcgtccgggcgtaccggctgacgtaccggaccgtcgacccgtacgggaagcccaccacggccaccgggctgctcacgctcccggccggcggcggtcaccggctcgacctcgtgtccgacacgcacggcacgatggtcaaccgcggctacgcgccctcggcgggcgacgacttcgggcgcgtgccgtcctatctgaacgccggcgcgggccgcgccgtggccgcacccgactacctgggcctgggtgagggtcccggccggcacccctatatggacacccgttcctcggtgacggcgtccgtcgacatgctgcgcgcctcccgcaccgcggcccggcagctgggccggccgctcaccggcgacgtctacgcgaccggcttctcccagggcggccaggtggccatggcgctgggccgggcgctgcgacagggcgccgaccacaccttccggctgaaggccctcgcgcccatcagcggcccgtacgacctggagggccaggagatcccggcgctgtacgacggccgggtcaacgacgtcagcggcgtcttctacacctcgtactggctggtcgcccagaaccggctgcactcgatctaccaggacccggccgaggtgttccgcgcgccctacgcgagccgggtcgagggcctgtacgacgggacgcacgaggaggaggagatcgtcacggcgctgccgcgctcggtgaaggaactgctcacgcccgccttctacgagcggatgcggcaccccacgggcggcctgctggcggcgatgcgggtcaacgaccacacctgcgactggaagccggacgtgccggtgcggctgtacacggggacgggtgacaccgacgtacccatcgggaacacgcacagctgcgtggcgcaactggcggaacgggggaagcgggcgcggctggtgaaccagggggacgtggaccacttcggcgtgttcaaggagtcggcgccccaggtggtgcggtggttcgacgccgtacgggac

SEQ ID NO: 5822 - DNA, 459 bp, Streptomyces avermitilis
  CDS (1)..(459)
gtgggcaagcgtgcgactccttgttcccgaagaaaggctctccgcgtgaccgtctccgtcatccgccgcatcgcgtccccgaagaaggccctcgccggtttcgccgtggccgccgccacgaccggcatggtgttcgccgcggctcccgcccaggccgccacccccacctcgggctcctccgcccaggcggtcgcgcacaagatgattccggacgccgcgcagtacaacgccttcagcaagatcgtcgagcacgagagcggctggaaccccgccgccacgaactcctcctccggcgcctacggcctggtccaggcgctgcccgcgtcgaagatggcgtccgccggcgccgactggaagaccaacccggccacccagatcaagtggggcctggactacatgaactcccgctacggcagcccgaccgccgcctggagcttctggcaggccaacggctggtac

SEQ ID NO: 5823 - DNA, 963 bp, Streptomyces avermitilis
  CDS (1)..(963)
atgaaccggcaccccgccgagcccctcccccaggcacattctcaggcgcattcccagccccggccccagccccggccccagatccagtcccggcccatccgcctgggcccccgctccatagccgccctcgccctggtcagcgcggtgggcgtcgccggtttcggctggcccctggtcgccgggccgggttcgcagctcagcgcccacgcacaggacgctccctggttgttcgccgggctgctcgtgctgctggtcggggtcgtgacggcgacgatctccgagtcggggctcgggcccaaggccgtcgccatgctgggcgtgctcgccgcgaccggcgccgccctgcggcccatcggcgccggcaccgcggggatcgagcccatgttcttcctgatggtgctgagcggacgggtgctcgggccggggttcggattcgtgctcggcgcgatcacgatgttcgcgtccgcgctgctgaccggcggggtcgggccgtggatgccgttccagatgctgtccatggggtggttcgccatgggggccggactgcttccgggaccgatgggggtcccccctgctcgagcgaagccgagagcttgggggaggctgcgggggcgcggcgaggtgggcatgctcgcggcgtacgggttcgtcgccgccttcgcgtacggcaccgtcatgaacctcgcgggctggcccttcatggactcgctggcctcgaccgtcgcgttcgatccgcacgacggcctcggcggcaacctcgcccgcttcctcgcgtactgcctggccacctccctcggctgggacctgggccgggccgtcgtcaccgtcgtgctgaccctcgccctgggcccgaccctcctcaaggcgctgcgccgggccacccggcgggcggctttcgagagcccggtcacattcgaaccgggccgaagtgcggcccccgtcacacccgacgatcgcaccccg

SEQ ID NO: 5824 - DNA, 1683 bp, Streptomyces avermitilis
  CDS (1)..(1683)
atgatccgcttcgaggacgtctcggtgacgtacgacggggcggccgaaccgaccgtccggggtgtggacttcacggtcccggagggtgaactggtgctgctggtcggcccgtccggggtcggcaagtcgacggtgctcggcgcggtgagcggtctggtgccgcacttcacgggcggcaccctgcgcggccgggtgaccgtcgccgggcgggacacgcgcacgcacaagccgcgcgaactcgcggacgtggtgggcacggtggggcaggatcccctgtcccacttcgtgacggacacggtcgaggacgaactcgcctacggcatggagtcgttggggatcgcgccggacgtgatgcggcgccgggtcgaggagaccctggacctgctggggctcgccgaactgcgcgaccggccgatctccaccctctccggcggccagcagcagcgcgtcgcgatcggctcggtcctcaccccgcacccgaaggtcctggtcctcgacgagccgacgtccgcgctggacccggcggcggccgaggaggtcctcgcggtcctccagcgcctcgtccacgatctcggtacgacggtcctgatggccgagcaccggctggaacgggtcgtgcagtacgcggaccgggtggccctgctgccggcgccgggcgccccgctgaccctcggcaccccgcccgaggtgatggcggcctccccggtgtacccgccggtggtggacctgggccggctggccggctggtccccgctgcccctgacggtgcgggacgcccggcgccgcgcgggcgcgctgcgggagcggctggcggcaacggagacacccacaccgacggcaacggcaacggcaacggcggcccccgccccttccccctcgcgtccccgccgcccccgcctcctccgcaagcgcgctcccgtcccgtcggccgccctccccgtggccgccgtcgaagccctcgcggtccgtcgcggtcgggtcgaagccctccgccgcgtcgacctcaccgcctcccccggcgagatcatcgccctgatgggccgcaacggcgccgggaagtccaccctgctcggggccctcgtcgggctcgtcccaccggccggcgggtccgtacgggtgggcggcgcggtaccgcaccgcacggccccgcgcgacctcgtacgccgcgtgggcctcgtaccgcaggagccgcgggatctgctgtacgcggacacggtcgccgccgagtgcgtggcggcggacggcgacgcgggcgccgagccgggcacctgccgggcactggtgtccgaactgctgcccggtgtcgccgacggcacgcacccgcgggatctgtcggaagggcagcggctggccctcgccctggccgtcgtcctcaccgcccgccccccgctgctgctgctcgacgaaccgacccgcggcctcgactacgcggcgaagggccgcctggtcacgctgctgcgcgcgctcgccgccgacgggcacgccatcgtcctggccacccatgacgtggagctggcggcggaactcgcccaccgggtggtgatcctcgcggccggcgaggtcgtcgccgacggcccgacggccgaggtggtcgtcgcgtcaccgtcgttcgccccccaggtgacgaagatcctggccccgcagcactggctcaccgtcacccaggtccgggaggcactcgca

SEQ ID NO: 5825 - DNA, 1143 bp, Streptomyces avermitilis
  CDS (1)..(1143)
gtggggaccatgactgccgccaccgccgcggaccgccgccgcgcgcggcgggaccgatgggcgcagccgacggcgaaccggaccaacgccctccacccgggggcctggtggctctgggccctcggcctgggcaccgccgcctcccgcaccaccaaccccctgctgctcgccctcctcgtcgccgtgtccgcctacgtcgtcgcggcccggcgcaccagcgccccctgggcccgctcctacaacgccttcgtcagactcgcgctcgccgtcctcggcatccgcctcggcttcgccgtcttcctcggctcccccatccccggcacgcacaccgtcgtcgtgctccccgaagtcccgctcccgcactgggcccagggcatccgcgtcggcggccgggtcaccgcggaggggctggtcttcgccctgtacgacggtctgaagctggccacgctcctcatctgcgtgggcgccgccaacaccctcgcgaacccggcgcgcctgctcaagtcgctcccgggcgccctgtacgaggccggagtcgccgtggtcgtcgcgctgaccttcgccccgaacctgatcgccgacgcccagcggctgcgggcggcccgtcggctgcgcggccgcccggaccgggggctgcgcggtctgctgcacgtcggactcccggtcctggagggcgcgttggaacgttcggtcgccctcgcggcggcgatggacgcgcgcggctacggccgcagtgccgaggtcccgcccgccgtgcgccgcacgacggccgcgctgacgctgggcggtctggtcggcgtctgcgcgggcacgtacggactgctgaccgcggagggcggcggctacggtctgcccgtgctgggcgccggcctcgccgcggcgctcggcggtctgtggctgggcggccgccgctccctgcgcacgcgctaccggccggacgtgtggggcgtacgggcgtggctggtcgcggggtgcggggtcgcggtggcggcgctgctgatcgtctccgccgcgtacgacccggccgccctgcaccccggtgtcgtacccctgacggcgccggcgctccccctcctgcccgcggcggcgatcctgctcggtctgctccccgccttcgtctcgcccgctccgaaggagtccgca

SEQ ID NO: 5826 - DNA, 672 bp, Streptomyces avermitilis
  CDS (1)..(672)
gtgagcctccgcgggacgtccgccctggtcctggccgtgctcctgctggtcctcggcgacgcgggccgggcgggggccaccggctaccgctactggtccttctgggaccgcgtcggcggcagctggacgtacgcgacccaggggccgtccaccgcacgcccctccgacggcgacgtccagggcttccgcttctcggtcagcgccgactcgcaggactcggcgaaaccgcgcgggacggcgggcttcgccgtgatctgcgcgaggacgcccgcgcgggagggcaggaagcgggtggcgctggtcctcgacttcggcacgcgcgctgacgccccgcggggcgagaccccttcggcgccgcgtacggcctgcgcccgcatacccgacgacgcgacgacggcggacgccctggccgcggtggcacggcccctgcgctacgacacgaacgcgctgctgtgcgccatcgcgggctatccgcggacgggctgcggcgagcaggtgacgacgcccaaggagccgacggccaaggagccgacggccacgtccgacgagcccacggccacgtccgacaagaacgcgccgcggcccggtccgtcggtggggctgctcgcgggcgtggcggcggtggcgctgctgggcgccgcggccatctggcgggcccggcgccggcggggc

SEQ ID NO: 5827 - DNA, 1275 bp, Streptomyces avermitilis
  CDS (1)..(1275)
atgatagttcgccgcagcgcagcggtactggccctcaccgccgtgatcggcggcgccaccgccccggtcgcccttgccgacgacgcgtcaccgtccgcgtcaccgtcgcgggctttcccctccgccctgtacggctccacggacccgacgtacgacggtgtctggcgccagtcgctcgcgctgctcgcccagcacacggtgggggtgcggccggccgccaaggcggtggactggctgaccgggcagcagtgcgcgagcggcgccttcgcgccgtaccgcgcggacgcgagcgcgaagtgcgacgccaagacgatggtcgacaccaacagcacggcggcggcggtgcaggcgctggcggcactgggcggacacgacgccgaggtcggccaggccgtgcgctggctgaaggacgtgcagaacaaggacggcggctgggggtacacggccggtggcgcgagcgacgcgaactcgacgtccgtggtgatcggcgcgctggccgccgcgggcgacgagccgaagaagcaggtgaagaacgggaagtcgccctacgacgccctgctcgcgctctccgtgccgtgcgacaagaccggcggcggcgcgttcgccttccagcccgacaagaagggcgccctcgcggcgaacgcggacgcgacggcggccggcgtggtcggcagcctgggcaagggcttcgtcatcgaggcggccggcaaggcgtccaaggggtccggggagtccaaggcatccgggcagtccaagggatccgagtgcgcctccggtgactccttcacgcccgcggacgcggcgcacaacggcgcctcctatctcgccgcgtccctggccaaggcgccctacctgaagtccgcgatgcccggcgccaagccccagccggactacggcaacaccgcggacgcggtcgtcgccctggccgccgccgggtcgacgtcggccaccgccgggccgctcgcctggctggagaagaactccggtgtctgggcggcgaaggccggtccggccgcgtacgcgcagctgatcttcgcggcgcgcgcggcgggcgcccagccacgcgacttcggcggggtggacctcgtcgagaagctcggcgcgacgggtccggcggcgcaggcgccgtcccgcgactcggccgcgtccgagcccgacgcgaagaaggtcgaccacaagagcgcgttcaacgtctggtggctcgtcggcgtctgcctcgtcgccggcatcggcatcgggttcctgctctcccgccgcaacaagaggcagcagctg

SEQ ID NO: 5828 - DNA, 1116 bp, Streptomyces avermitilis
  CDS (1)..(1116)
gtgcggaccggacggggcacggaacggtcgacccgggctcccatcgaaacgtgttctagttatagtgaccggaacgcggcgattggggagcccatggcgcaggtgtccgaccacggcggaggcgtacggtccatcaaggtccccatcccggacaatcccctcggccacacgctcgtgtacgtcgtcgacaccgaccgcggaccggtcctgatcgacacgggctgggacgaccccgcctcctgggacaccctcaccgagggcctgacggcgtgcggcacctcggccgccgagatccacggggtggtcatcacccatcaccaccccgaccaccacggcctctcgggccgggtgcgcgaaatgtccggggcctggatcgcgatgcacgcggcggacaccgcggtggtgcggcgcacccgcgaggcccgccccgagcgctggttctcctacatgaccgccaagctcatggcggccggcgcccccgaggcgcacgtggcgcccctgcgcgccgcccgtccgcgcgctctgccgggcctgtcccccgcgctccccgaccgcgagatcgtccccggcgacctcgtcggcctccccggccgccgactgcgcgcgatctggacaccggggcacacccccggacatgtgtgcctccacctggaggaggagcatcccgctcaactccccggccacggacgcctgttctccggcgaccatctcctcccccggatcaccccgcacatcggcctgtacgaggacccggacgacaccacggtcactgatcccctcggcgactatctcgactccctggagcgcgtcggccggctcgggcccgccgaggtgctcccggcccaccagcacgccttcaccgacgcgcccgcccgcgtacgggaattgctcacgcaccacgaggagcggctgaccggactgctcaccctcctggacaccccgctcacgccctggcagctcgccgagcgcatggagtggaaccggccctgggagcacatcccccacggctcacggaacatcgcggtctcggaggccgaggcccatgtacgccgcctggtcaaactggggcgcgcggaggcggtaccggggagcgacccggtgacgtacgtggcggtg

SEQ ID NO: 5829 - DNA, 1506 bp, Streptomyces avermitilis
  CDS (1)..(1506)
gtgcgtcccgggaggcagtcggccatgaccgagctcgtggaacacggacagctgttcatcggcggggtgttggcggacccgctgggcaaggacgtcatcgaggtgatctccccgcacaccgaggaggtcatcggacgggtgccgcacgcctccacggcggacgtggaccgcgcggtcgccgtcgcgcgcaaggcgttcgacgagggcccctggccgcgcgcgaccctcgacgagcgcatcgaggtcgtcacccggatcaaggacgccatcgcggtacggcacgaggagatcgcccgggtcatctcctccgagaacggttcgccgtactcctggagcgtcctcgcgcaggccctcggcgcgatgatggtgtgggacgcggcgatcacggtcgcgcggaacttcacctacgaggagacccgcgacggagtcctcgggaagatcgtggtgcggcgcgagccggtgggcgtggtcgcggccgtggtcccgtggaacgtgccgcagttcgtcgccgccgccaagctcgcccccgcgctgctgaccggctgcacggtcgtactgaagccgtcgcccgaatcgcccctggacgcctatctgctgggcgagatcgcccgggaggccgggctgccggaaggcgtgctgtcgatcctgccggcggaccgcgaggtgagcgagtacctggtcgggcaccccgggatcgacaaggtctccttcacgggatcggtggccgcgggcaggcgcgtgatggaggtcgcctcccgcaatctcacccgggtgaccctggagctgggcggcaagtcggcggcggtggtcctgccggacgcggacatcacgacctcggtgccggggatcgtctccgcggcctggatgaacaacgggcaggcctgcgtggcccagacgcgcatcctcgttccgcgctcgcgctacgacgagttcgcggacgcgttcgcggcggcggcgagcgccctggtggtcggtgacccgctggacccggcgacccaggtcggcccgctggtggcgaggcggcagcagcggcgcaacctcgactacatccgcatcggccaggaggagggcgccaagatcctgacgggcggcgggcgtccaccgggactcgaccgcggctggtacgtggagccgaccctcttcggcgacgtcgacaactccatgcggatcgcgcgggaggagatcttcgggccggtcatctgcctgctgccctacggcgacgagaccgaggccgtgaagatcgccaacgactccgactacgggctgagcggcagtgtctggacggccgacgtggagcacggcatcgacgtcgcacgccgggtccgtacgggcacgtactccgtgaacaccttcagcctcgacatgctcggcccgttcggcggctacaagaactcgggtctcgggcgggagttcgggcccgaggggtacggcgagttcctggagcacaagatgatccacctgccggccgggtacgaggctcccacgggcgtggagggggccggggcc

SEQ ID NO: 5830 - DNA, 231 bp, Streptomyces avermitilis
  CDS (1)..(231)
atgggcgaccgctggcacatcgaggtcgaccgctccgtctgcatcggctccgcccagtgcgtccaccacgcctccgtcgccttccgcctcgactccgcccggcagtcccggccggccgaaccggagaccgacgccaacgagcagatcctggcggcggcggagagctgccccgtggaggcgatcgtcatcagggtgctggggagcggggagccggtgttcccaccggaggag

SEQ ID NO: 5831 - DNA, 654 bp, Streptomyces avermitilis
  CDS (1)..(654)
atgcctgcggaagccaaggtggaagccagtaccggagccagagccgcacgaccggccgttcagcccgcctcgccgccgctgacggagcggcaggaggcgcgccgccgccggatcctgcacgcgagcgcgcaactggccagccggggcggcttcgacgcggtgcagatgcgtgaggtcgcggagtcctcgcaggtggcgctgggcacgctgtaccgctacttcccctccaaggtgcatctgctggtggccacgatgcaggctcagctggagcacatgcacggcacgctgcgcaagaagccgccggccggggacacggcggccgagcgggtggccgagacgctgatgcgggcgtttcgcgcgttgcagcgggagccgcatctggccgacgcgatggtccgcgccctgacgttcgcggaccgcagcgtctcccccgaggtcgatcaggtgtcccggcagacgacggtgatcatcctggacgcgatgggtctggacgaccccacgcccgagcagctctcggccgtccgcgtcatcgagcacacctggcactcggccctcatcacctggctgtccggccgcgcctcgatcgcccaggtgaagatagacatcgagacggtgtgccgcctgatcgacctgacggaagccgacgagacgccg

SEQ ID NO: 5832 - DNA, 1473 bp, Streptomyces avermitilis
  CDS (1)..(1473)
gtgaccgctgaggccatggaggcgggtccccaggagggctcggccgctgacggcgacgtgccgttgcgcatcgcgctcctcacttacaagggcaacccgttctgcggcggccagggcgtctacgtacgacacctctcgcgcgagctggcccgcctcggccaccgggtcgaggtcatcggctcccagccctacccggtgctggacgaaggcctgcccggcctgagcctcaccgaactgcccagcctcgacctgtaccgccagccggatccctttcgcacccccgggcgtggcgagtaccgggactggatcgacgccctcgaggtcggcacgatgtggaccggcggcttccccgagcccctgaccttctcgctgcgcgcccgccgcgagctgcgcgcccgccgcggcgacttcgacgtcgtgcacgacaaccagaccctcggctacggcctgctgggcgacgtcggcgcaccgctggtcaccaccatccaccaccccatcaccgtggaccggcagttggagctggacgcggccgagggctggcagcgcaaggcgtccgtacgccgctggtacgcgttcacccgcatgcagaagcgggtggcgcgccggctgccgtcggtcctcaccgtctccggcacctcccgccaggagatcgtcgaccacctgggtgtctcccaggaccacgtccacgtcgtgcacatcggcgccgacaccgacctcttctcgcccgatcccgcggtgccccaggtgccgggccggatcgtcaccacctccagcgcggacgtgccgctcaaggggctggtcttcctcatcgaggcgctggcgaaggtacggaccgagcaccccggggcgcacctcgtcgtcgtcggcaagcgcgccgaggacggccccgtcgcccaggccatcgagcggtacgggctgcacggcgccgtcgagttcgtgaagggcatctcggacgcggaactcgtcgccctcgtacggtcggcggaggtcgcgtgcgtgccttcgctgtacgaggggttctcgctgccggccgcggaggcgatggcgacgggtacgccgctggtggccacgaccggcggcgcgatcccggaggtcgcgggcccggacggagagacgtgcctggcggtgccgccgggcgacgcgggggcgctggccgccgggctgagccggctcctgggcgacccggcgctgcggacgcggctcggctccgccgggcgggaacgggtgctggcgcggttcacatgggcgaaggccgccgagggcacggcggcccactaccgcgaggcgatcgcccgctccacggccccggcaggcgcgggccgcaccgccgtggccgtaggcaccgcaacagcggcgggtcccgtgaaggcggcgggtgccatgaaggcggcgggtgccggaacagcagacggcgcggcagctgaagaagcagaagaaatagtcgtatccgatcgcgaaagcagggccacgtgc

SEQ ID NO: 5833 - DNA, 744 bp, Streptomyces avermitilis
  CDS (1)..(744)
gtgctgaccgtcgacttctcccggttcccgctcgccccgggcgaccgcgtgctggacctcggctgcggagccggccggcacgcgttcgagtgctaccggcgtggggcccaggtcgtcgcgctcgaccagaacgcggaggaaatccgcgaggtcgccaagtggttcgcggcgatgaaggaggccggcgaggcgcccgccggagccaccgcgacggccatggagggcgacgccctcgcgctgccgttcccggacgcctccttcgacgtcgtgatcatctccgaggtcatggagcacatccccgacgacaagggcgtgctcgccgagatggtgcgggtgctgaagcctggcggccggatcgccatcaccgtcccgcgctacggccccgagaaggtctgctggaccctgtcggacgcctaccacgaggtcgagggcggccacatccgcatctacaaggcggacgaactgctcgccaagataagggaagccggcctcaagccctacggcacgcaccacgcccacgcgctgcactcgccgtactggtggctgaagtgcgcgttcggcgtcgacaacgacaaggcgctgcccgtgcgggcgtaccacaagctgctggtctgggacatcatgaagaaaccgctggccacccgggtcgccgagcaggcgctgaacccgctgatcggcaagagcttcgtggcgtacgccaccaagccgcacctgcccgtcgacgccgccgcggtggacgcttcg

SEQ ID NO: 5834 - DNA, 1068 bp, Streptomyces avermitilis
  CDS (1)..(1068)
gtgacgacgccccggacagaacacctcgtcctgcccggggtcctcaccgcagaggaggccggcgccaccgtgcgcggcatcctcggggtgcagcggccggacggcgccataccgtggttccgtggacaccacctcgacccgtgggaccacaccgaggccgcgatggcgctcgacgcggccggggagcacgaggcggcggagcgcgcgtacacctggctggccgcccaccagaacggcgacggctcctggtacgcggcctacgccgacggggacttcgaggacgtcaccgaccgaagccgggagaccaacttctgcgcctacgtcgcggtgggcgtgtggcaccactacctcgcgaccggcgacgacacgttcctggaccggatgtggccgacggtgtacgcggccgtggagttcgtgctgcggcttcagcagccgggcggccagatcggctggaagcgggaggacgacggaaaggccgtcgacgacgcgctgctcaccggcagctcgtcgatccaccaggcgctgcgctgcgcgctcgccatcgccgagcagcgtgaggagccgcagcccgactgggagttggcggtgggcgcgctgcggcacgcgatccggcggcaccccgagcggttccttaacaaggaccgctactcgatggactggtactacccggtgctgggcggcgcgctgaccggcgcggaggccaagtcccgtgtggaggagggctgggagcgcttcgtcgtccccggcctcggcgtccgctgcgtggtccccaacccgtgggtgaccggcggcgagtcggccgaactcgccctggccctgtgggtgatgggcgagtccgaccgcgcgctggagatcctccagtccatccagcacctgcgcgatccggagaccggcctgtactggacgggctacgtcttcgaggacgaggccatctggccccgggagctgaccagttggacggcgggctccctgctgctcgccgtggcggccctgggtggcgacgaggcgacatgcgcggtcttcagtggcgaccgcctgccgagaggtcttgacccggactgctgcgaa

SEQ ID NO: 5835 - DNA, 291 bp, Streptomyces avermitilis
  CDS (1)..(291)
atgtcccctcgatatcgcaacggttccaatcaggcggggacggtcatcgcgatcgtcgcggacgtcatggccgtcatcctcgggctgtggatcctcatgtatctgctggacgccaaccgggccaatgacctggtgcagttcgtccacgacgtggcaagctggctggccggctggtcgcgtgacctgttcaccttcgacaaggcatgggcccgcgtggtggccggctacgggctcgcggccgtcgtgtacctcttcatcggccacgccatcgccaaccgcatgcaccgccac

SEQ ID NO: 5836 - DNA, 558 bp, Streptomyces avermitilis
  CDS (1)..(558)
gtgcccgtacccatacggcgcctcatcgtggcgctcaccctctgctgcaccctgttcgtcggcgccaccgcctgcggcagtgacagcaccgatcagcagacctcggccgccgcggccaccgctactcccaccggcaccagttccgcggagaagcagaagttcgccaagacccgtttcgtggcgaacgcggggctcgccgccggggccacctaccagtggatcgtgaagccctggaaggccgggaagttcaagaagggcgcgaagggccgcaaggtcgcgctggtcaaggcgggactcgcgggcgggttctcgtacaaccggctcaaggcggccctgaagaacgcccagggcgaccccacgctcgccaaggccgtcgccccgctcaccgcgggcatcgaggcgctcaagagcctgccggccaagctccgcaagggcgactcgacggacgcggccgcgaacacctacgacgacatcatcaacaaggtgaaggacgcggggaagagcgcgggcgccgaggtgaaggaccaggtgccgtccgcatcggaactgacgaagggc

SEQ ID NO: 5837 - DNA, 648 bp, Streptomyces avermitilis
  CDS (1)..(648)
atgtcagcggcgcccaagccggagattctcgccgccttcgaggccgccaagggattcatgccccgccacgagggcctcgccctgtacgcggccgcgaccgaggcgggacggctcggtctccccctcctcgaagtcggcacgtactgcggccgctccacgatcctgctcgccgacgccgcccgcgcggccggggtcaccgcgctcacggtcgaccaccaccgcggcagcgaggagcagcagccgggctgggactaccacgacccggacacggtggacccggcgctcggcctgatggacacgctccccgccttccgccgcacccttcacacggcgggcctggaggaccacgtggtcgcgctggtcggccgctcaccgcagatcgcgaagatctggggcacccccctcggtttcgtcttcatcgacggcggtcacacggacgcacacgcgagcgccgactacgagggctgggcgccccatgtcgccgacggcggcctgctgttgatccacgacgtgttcccggacccgaaggacgagttcaccggccaggccccgtaccgcgtctacctcagggccctggagtccggcgcgttcacggaggtctcggcaaccgactcgctgcgcgtcctgcggcgaacgggcgcagggatc

SEQ ID NO: 5838 - DNA, 996 bp, Streptomyces avermitilis
  CDS (1)..(996)
gtgtcatacgtaggcccggacttcgatccaccccagccgcgccgcttccggcgcgcgcccctgaccgtcgcgctcgccgcgctcgtgccgggcgcgctgctcggctggctcgtctacgaggcggtgggcgccccgggcggcggggacggctcggacaaggcggccgggggcacgacgtcggcttcggcgtcgaagaagtcgtcggcgtcgtcgtcctcggcgggcggctccgggtcccccgcggcctccgcgacggacgacggcgagaagccgggtacgtcgtcctccacgcccgcctccccgacctccgggcccgccgcctccggcccgctccggggcaaggtcgtcgtcatcgacccgggccacaactccgggaacttccagcacacggccgacatcaaccgcaaggtgaacatcggaacgaactggaaggagtgcgacaccacaggcacgtccaccaacgccggttacaccgaagcccggttcacactcgacgtcgcgcgccggctgcgcacgatcctccagaaggagggcgccaccgtgaagttcacgcaggacggcgaccgctcatggggcccgtgcgtggacgagcgggcccgcatcggcaaccgggcgcacgccgacgcggtcgtctccatccacgccgacggctcggcggcgggcaaccgaggcttccacgtcatcctgccgggagcggtgcacgggggcgccgcggacacccgcccgatcgtcgcctcctcacgcgacctcggcgagcgcatcgcgggcaacttcgtccgcgtcacgggcagcgcgccctccaactacgtgggcgacggcaccggactcgtcacgcgtgaggacctgggcggtctcaatctgtcaacggttcccaaggtgttcatcgagtgcgccaacatgcgcgacggcaaggacgcggcacgcgtgaccagcgatgcgtggcggcagaaggcggcgcaggggatctcggacggcattgtgaatttcctgcagccg

SEQ ID NO: 5839 - DNA, 633 bp, Streptomyces avermitilis
  CDS (1)..(633)
gtgcagccagtcagacgtgagccacccacggccggatgcggctcgccgggacactccggcgagccgcgtcctggcccgatgggcaaaaggaccccgctcagctatcgctggctgtacttgaagcagacaccgatcggcttgtacgccttctttcctgtgtggaaagttatccagctgccaccggtagtgccttggacatcaaacttcttgccggagtatttcgcgtacgccttcagggtcccgtacttgccccgaggcacctccttggagccactcactgtgatactgcgggacttcgtcacatcccagccgacaccgacgctgatggcccctttggttgcgtcgatatgcttcgagagcgtggtgctcacagcctcggtctggtctatgcgcagcatcattgcgccccggccggaggcttcggcgagcggggtcttcccgcacgaggtgccgatggaccgaacgttgatcagcctctcggcaagccaaccaccaccgatctttgacacctgtgcgtccgccgtggtcgctgccgcctcacgcggcgcagcgtgcaccgtggcgttcacgcccatcaggcccagggtcattgcggcaactgccgccccacgccgaattgtttggaacttcaac

SEQ ID NO: 5840 - DNA, 795 bp, Streptomyces avermitilis
  CDS (1)..(795)
gtgaatatccgctccctcactcgaggcgacggcgtggtgatcggagcagcggtgttgctgttcatcgcgtcgtttctggacgtagccgactgcagcggcagttactgcggaagcgccgacttcccgaacgcctggagctccagcctgggtctcgggctcggcacctacatgatcggggtcgtcggagcagcgctcatcctgatcccgcgggcgttgccgcagccgcgcaaggtggcgggtctcgacatggggacggtcggcgtagctctgacggtcgcttccgcctggtcgctgctctggtggacgattgacgcgaacggcgcgggtgccggtctcatcctcggcatgatcgccgcgctgattctggccggtgccgccattgccactccactcgtcccagccctcaagaccgccctcgtcggcgcccccaggcccgtcgccccgcagccctacggcgcccagccgccgagtggttacggctacccgggtgcccagcagccggggcagccctacggcggtcagccgcagccgcagccgggccagccgttcggtggtcagccgcaggcgccccagcaggcgcaggccgcccagcccgccggtgacttctcgccgttctggttcgccgtgccggtggcgcgtccgctgtacgccgaggacggttcgccgacgccgatcgccgaactggcgccgggcacctggtacttggccgtcgagcagcgcggcgcggcgctggtcgcccagacgcaggacggccgccgcggcgtcctccaggacgcgtccgggatccagcgcggc

SEQ ID NO: 5841 - DNA, 1008 bp, Streptomyces avermitilis
  CDS (1)..(1008)
atgcggctcggtctcgcactcggctactgggggcgcggccccgacccgtcccatctgccgctggcgcgggaggcggagcggctcgggtaccactccgtgtggaccgccgagtcctggggttcggacgcgttcaccccgctgacctggatcgcggcccacacctcacggatcaggctgggcaccgccgtcgcacagatggccgcccggtcgcccaccaccaccgcgatgcacgccctcaccctcgaccacctctccggcgggcgcatgatgctcggcctcggactgtcggggccgcaggtcgtcgagggctggtacgggcgcccgttccccaggtcgccgctcaccgcgacccgggagtacgtggacgtcgtacgccaggttctccggcgggaagcgcccgtcgcactcgacgggcgctgccacccgctcccgtaccgcggcgaagacgggacgggcctcggccgggggctgaagccgatcacccatcccctgcgcgccgacctgcccgtcctgctcggcgccgaggggccgaagaacatcgcgcagacggcccggatcgcggacggctggctgccgctgtactggtcgccgacccggacggaggcgtacgaggccgcgctcgccgaccgccgtgagggcttcctcgtggcacccatggcccgcgcccgggtgtgcgacgacgtcaccgaggggctgctgcccgtgaaggcgatgctcggcttctacatcggcgggatggggcacgcggcccgcaacttccacgccgatctgatggcccgcatgggatacgaggaggaggcccggcgcatccaggaactgttcctggccggccgccgggaggacgccgtgcgagccgtcccggacgccttcgccgacgagatctccctggtcggaccgcgtgagcgcatcgccgagcggctggaatcgtggcgcaagggcccggtgacggacctgctggtgctcgccccggacccgcacaccctgcgggtgctggccgagctcaacgcg

SEQ ID NO: 5842 - DNA, 1749 bp, Streptomyces avermitilis
  CDS (1)..(1749)
atgacgcacacgtcgaccgaccagcccgcccggagagcgaccggcgccctcgtgccggtgctcgccttcgcgggcatcgttgtcgcggtgatgcagaccctgctcgtcccggtcatcaaggacctgccgacgctgctgagcacgtcacccagcaacgccacctgggtcctgacctcgaccctgctctcgggagccgttgccacgccgatcatgggccgactcggcgacctgttcggcaagcggcgcatgctgttcaccagcctggccgtgatggtggccggcgcgctggtcagcgcgctcaccagcacactgctgccgatgatcgtcggccgtacgctccagggcttcgccatgggcgcgatcccgctcggcatcggcctgatgcgcgacatgctgccccgcgagaagctcggctcggcgatggccctgatgagctcctcgatcggcgtcggcggcggactcgcgctgcccgccgcggccctggtggcccagcacaccgactggcacgccctgttctacggcgccgcgggcctcggcgtcgtctccatcgtcctcaccttcctcgtcgtgccggagtccccgatgcgcgccgagggctccttcgactatctgggcgcgctcggcctgtccgtcggcctggtcctgttcctgctgccgatcaccaagggcagcgactggggctggagctcggccaccacgctcggcctgttcggcgcggcggtcgccgtcctgctgctgtggggcctgatggagctgaaggtcgccgcgccgctggtggacctgcgcaccaccgcccgccccgcggtgctcttcaccaacctcgcctcgatcatggtcggcgtctcgttctacgtcgtctcactcgtcctgccgcagctgctccagctgcccgccgccaccggctacggcctcggccagtcgatggtcgtcgcgggcctgtgcgtggcgccgctcggcctgacgatgatgttcacggcccccgtctacgcccggatctcggcgaagtacggccccaaggtcaccctcatcatcggcatggtgatcatcgccgtcggttacggcggcggcctcggcctgatgaacgccgcctggcagaccatcgtcatctcggtggtgctgggcgcgggcatcggcctcgcctactcctcgctgcccgcgctgatcgtcggcgcggtgccggcctcggagacgggggcggccaacggcctcaacaccctgatgcggtccatcggcacgtccgtgtcgagcgccgtcatcggcatggtcctcgccaacaccgcgcaccatgtcggggacgtcgccgtcccgaccatgcacggcttccgcgtctccttcctgatcgcgacgggcgcggtggcggtcggcctggtcctggcgctcttcctgccccggcagcgccaggcgaccaagccgcagctgcgggccagcagcgaggaggacgcggcgctggagcgcgcggccgaggtgctcggcggcttccgcggccgggtcctgaacgccgggggcgacccggtcgcccgggccaaggtcacactgatcgaccgccgtggccgccaggcgggcgcgacgctctccgcggaggacggcagctacgcgctcgccgtacccgcccagggcgcgtacgtcctggccgccaaggccgcggggcacggaccgctcgcctcgtcggcgacgcacgcgggcgacgaccgtccggtcgacgtcgatctgtcgctgccgggagcggaccggaacagcggcgttcccgcc

SEQ ID NO: 5843 - DNA, 1236 bp, Streptomyces avermitilis
  CDS (1)..(1236)
atggaacgtgttctaatctttcgcggcatgaaggcctatatcgccggcgtcggcatgacgcggttcgagaagcccgagacccgtgactggcagtactgggacatggtgcgggaggcgggcggcaaggccctgggggacgcggggatcgcctacaccgaggtggaacaggttccggtcggctactgcttccaggcgtcgacggccggacagcgggccgcgtacgaactcggcctgaccggcgtgcccgtctacaacgtcaacaacaactgcgcgaccggctcgaccgcgttgatgctggcacggcagttcgtcgagggcgggatctcggactgcgtactggcgctggggttcgagaagatgacccgcggctcgctcgggagcggggccgacgggggcgacttccggagctcgccggtcgcccgccactacggcgtgatggccgcccggcacggcttcgaggcgaccccgcccaccgcgcagatcttcggcgacgcggcgcgcgagcacatggagaagtacgggacgaccgaggcgcaactggccgcggtcggggccaagaaccaccggcactcggcgcacaacccgtacgcccagttccaggacgtgtacaccgtcgacgagatcctcgcgtcgcgcccggtgcaccgcccgctgaccaagctccagtgctcacccacctcggacggagcggcggccgccgtggtcgtctccgaacgcttcgcgcagcggcacgggctgggggacagggtggtggagatcgtcgcgcaggcgatgacgacggacacggaggagtccttcgcgtcggggtcctgcatcgacgtcgtcggccggccgatgtcgcgggaggccgcccgccgggtgtacgagcgtgccgggctcggcatcgaggacgtcgacgtggtggaactgcacgactgcttctcgatcaacgagctgctgacgtacgaggcactcggcatgtgcgtggccggggagtccgggaagctggtcgagtcgggagcgacgacctacggcggccggtgggtcgtgaacccgtccggcgggctgatctccaaggggcatccgctgggcgccacgggtatcgcccagatcgccgagctgacctggcagctgcgcggcgaggcgggggcacgccaggtcccgggcgcccgggtgggtctcgcgcacaacatcggactgggcggagcggcggtggtgacgctgctgcgcgcggaccggcccgtcgcgctcggggca

SEQ ID NO: 5844 - DNA, 1452 bp, Streptomyces avermitilis
  CDS (1)..(1452)
atgacatccatgctccgagccgccgccaccgaagacagccgtactacgaccagccgtgccgcaccgcccgcctgggtggtggtcgcgctcgcctgcgccggacagttcctcgtcgtcctcgacgtgtccgtcgtgaacgtggcgctgccgtcgatgcgcgccgacctggggctgagcgctccgggactccagtgggtggtgaacgcgtacgcgatcgccttcgcggggttcatgctgctcggcgggcgggccggcgacctgtacggacgcaaccgcacgttcctcgccgggctcgccctgttcacgctcgcgtccctcggcggcggtctcgcccaggagggctggcaactgctggtcgcccgggccgtgcaggggctgggggcggcggtgctcgcacccgccacgctgacgctcgtcacctccgccgtcccggagggcgccgcacgcgcacgcgccatagcgacctggaccgcggtcggcgcgggcgggggcgcggcgggcgggctcgtcggcgggctgctcgtggacggcctgacgtggcggtgggtgctgctgatcaacgtgccggtgggcgcggtcgtcctggcgggggccgcgcggtggctgccggagagccgggcccgtgacgggcgacgcctcgacctgcccggcgcgctgctggtgacggcgggcctggcgaccctcgcgtacgggatcgtgcagacggaggcggagggctggacggccgccgcgacgctcgtaccgctgtgcgccgggctcgcgctgatcgggctcttcctggcggtcgaggcgcggacgaaggaaccgctgatgccgctgaagctgctgggccggcggccggtggcgtcggcgaacgtcgccatgttcgtgaacggctccgcgatgttctgcatgtggttcttcatgacgctgtacgcgcagaacgtcctcggctacacgccgctgggcgccgggctcgcgctggtgccgagttcgctggccgtgctgctgggggcgaagctggcgccgcgtctcatgccggtggtggggccgcgcaatgtggccgcgctcggcacgctggtggcggcggccgggttcgggtggcagtcgacgatgacggcggacgggacgtacgcgaccgcgatcatgtttcccgggatcctgatgatgctgggcgggggcctcggggcgacgacgctcgcctcgctggcgacgtccggggcgtcgccgatggacgccgggctggtgtctgggctgatcaacacgtcgcggacgatgggcggttcgctcggtctcgcggtcatgtcgacgatcgcggcggcccgcacgggaagccgcgggtcggcacaggccctgacggagggctacgcactcgcgttccgcacggggggatgcgtgctgctcggcggggcgctgctgatgctgctgtggctgccgcggtcgacggtggtgacggggtcgacgggggctcgc

SEQ ID NO: 5845 - DNA, 630 bp, Streptomyces avermitilis
  CDS (1)..(630)
atgccgcaggaccaccggcccgccaagtccgtccgggtgctgctcgccgaggaccaaggcatgatgcgtggcgcccttgccctgttgctcggtctggaggaggacatcgaggtcgtggctcaggtgggcgcgggggacgcgatcgtcgacgcggccctcgctcaccggccggacgtggcgctcctcgacatcgagctgccggggatgagcgggctcgaagcggcggccgagctgcgggagcaggcgcccgggtgccgggtgctgatcctcaccaccttcgggcggcccgggtatctgcgccgggccatggaggccggggccgccgggttcctcgtcaaggacgggcccgtggaggacctggccgccgcgatccggcgcgtgctcaccggggagaccgtgatcgaccccgcgctcgccgcggccgcgctcagcgccgggcccaatccgctcaccgcccgtgagtgcgacgtcctcaaggcgtccgtggacggcgcgaccgtcgccgacatcgcggccaagctgcgcctgtccgagtccaccgtccgcaactacctctcctccgccatcggcaagacgggcacccgcaaccgcatggaggcgatgcgggaggcgcggcagcaggggtggttg

SEQ ID NO: 5846 - DNA, 1371 bp, Streptomyces avermitilis
  CDS (1)..(1371)
atgaccgggaacagcgatccgatgacctgccgcatccacgaggtgcgggaggcgcggcgtgcctggaaggaggcgtggccgccccggcgcgccgccttccgggcccggcggaagtccggggagccggcccccgaggagatgggtccgccgcacagcggtttcgccctgctgccgtggctgctgatgggcatgggcgcgttctccaaccttctgcagggcacgaccccgaacccgtggatcggcgggatgggtctgctcgccttcaactccctttacatctccgtggtgttccgcgccttcgtgaaggagaagcgggacgcgcccgcgacccgctgggtgctcgtcgcgatgctggcgatcaccagcgggctcgggatcggctacggcggcagctggctgtacttcttcccgctgctcggcctggcggtcggcgcggtcacccggggcaggacgctcccgaagctcgcgttcgccctgagcgcgctggcggggaccatagccgggttccgggacggctggggcgcggtcggcatcgggtacgccaccttcctgtccaccgcggtcacggcggcgatcctctccctctccgaggcggtacgggagctgcgcgcggcccgcgaggaactggcccggcgcgccgtcgagaaggaacgtctgcgcttctcccgcgatctgcacgacctgctcggccacacgctctccgtgatcgtcgtgaagtcggaggcggcccgccggctggcccaccgcgacctggaggcggcgctgctccaggtgaccgacatcgagtccgtcggccgtcaggcgctgacggagatccgcgaggccgtgacgggctaccgcgagggcagcctcaccacggacctggacggggcccgctcggccctgtccgcggcgagcgtcgaccccgtggtccgccggtccggcccaccgctcacgccccagacggaggcactgctcggctgggtggtccgcgaggcggtcaccaacgtcgtccgccacagcgacgccacccgctgcgagatcacggtcgacggcaccccggaccgcgtccgtctgaagatcacggacaacggcacgggcgccacggtgtccgagcccctggagggtctcggcggcacgggcctcaaaggactgaccgagcgtctggcggcggcaggcggctcactggaggcgggccgggccccgagggtcggcttcctggtcaccgcggaactcccggtggacgcgacggagccggcgaacgcggagtcggcgaacggagagttggcggacagggaaccggcgaacgcggagtcggcgagcacggaggccgactcgggcggggcgggtgcgcggggcgctacggaggtgtcggagcgggaacaactcgcg

SEQ ID NO: 5847 - DNA, 855 bp, Streptomyces avermitilis
  CDS (1)..(855)
atgcccatcgacgcagccaaggccgtcgccgcggaaccccggtccgccgagatctcctgggaccacaaggacgtactgctctaccacctgggcctcggcgcgggcatcccggcgaccggccccgacgagctgcgctacaccctggagtcccggctgcacgtgctgcccagcttcgccaccgtcgcgggcgccggctcacccggcgtgatcggcggcctgtccatgcccggcgtcgacgtcgacctcgcccgcgttctgcacggcggccagaccgtcgagctccaccgcccgatcccggtgacgggcacggcgaacgccacctcgcgcatcgcggccgtctacgacaagggcaaggccgccatcctggtcatgcgcaccgaagtctccgacgccgagggcccgttgtggacgaacgacgcccagatcttcgtccgcggagagggcggcttcggcggcgaccggggcccgtccacacgcctcgaaccgccggtggatgagcccaccgccgtggtcgagcggccgatccgcgaggaccaggccctgttgtaccgcctgtccggcgactggaacccgctgcacgccgaccccgagttcgcgaagctcgccgggttcgaccggcccatcctgcacggattgtgcacctacggcatgacgctcaaggcggtcgtcgacacccgcctcgccggggatgtgacccgcgtccgctcctaccgcacgcgcttcgccggggtcgtcttccccggcgagacgctgcgcatccgcatgtggcaacgggacggccaggtccaggtctcggtgacggccgtcgagcgggacgacgcccccgtgctggccgacaccgtcgtcgcccactcc

SEQ ID NO: 5848 - DNA, 1074 bp, Streptomyces avermitilis
  CDS (1)..(1074)
atgcgcgcagccgtactgcacgagatcggccaggacaagctcgaagtcctcgacgacgtcgagtcggtgggcttcgggcccggcagggtgaggatccgggtgcgggccaccggactgtgtcactcggacctgtccgcgatgagcggcgtactgccgcagcccgcgccgttcgtacccgggcacgagggcgccggcgagatcgtcgaggtcggcgaaggcgtcagccacctgaagcccggcgaccgggtcgtcgtgtgctggctgcccgcctgcggggtctgtcccgcctgcaagcgcggccagagccagctgtgtctggccgggttcatgaacgcgggcacgcccaacttcaggcgccccggcggtgatgtcttcggcttcgcgggcaccggcaccttcgccgaggaggtcgtcgtcgacgcgggcagcgccgtgccgatcccggacgacgtgcccttcgacatcgccgccctcatcggctgcggggtgaccacgggactgggcgccgccctcaacaccgcggacgtggcggccggttcgtcggtcgccgtcatcggctgcggcggcgtcggcatctccgccgtccagggcgcccgcctcaagggcgcggccgagatcgtcgccgtcgacccggtcgcctcccgccgtgagtccgcgctcaggttcggtgccacgcaggcggtgtcgccggacgagctggccgcggccaagcaggcggtgaccggcggcgagggcttcgactacgtcttcgaggtcgtcggcaggtcggccacggcccggaccgcgtacgagaacacccggcgcggcggcacactcgtcgtcgtcggcgcgggcgcgctggacgacttcctccagctcaacatgttcgagctgttcttcgacgagaagcggatcctgccctcgatgtacggcggcggcgacgtgctgcgctcgtacgaacggaccatcgcgctgtggcgtgccggacgcatcgacctggagggcctgatcacccaccgggtgccgctcgccgagatcaacgaggccctcgaccagatgcggacgggcaccgccctgcgtacctgcatcgagatc

SEQ ID NO: 5849 - DNA, 972 bp, Streptomyces avermitilis
  CDS (1)..(972)
atgtcactgccacttgaggggctgaccgcgatcgtcaccggcgcggggcgcgggctcggccgggccgaggcactggaactcgcccggctgggcgccgtcgtcgtcgtcaacgactacgggcagcccggacgggacggctccggcgcggcgtcgggcacgcccgccgaggaggtcgccgccgagatccgcgcggcgggcggccgggccgccgcccacaccggggacgtcgccgaccacgaacaggcccgtgcactggtcgagttgacggtcgccgagttcggaaagctggacatcctggtcaacaacgcgggcatcctgcgcgaccggatgatcttctcgatgtccgaggacgagtgggactcggtcgtccgggtgcacctcaaagggcacttcaacacgacccacttcgcgtccgtgcactggcgagcacgctccaaggcggccgacgggcccgtgtacggacggatcgtgaacacctcgtcggaggcgttcctggcgggctcggcgggccagcccaactacgccgcggcgaaaggcgggatcgtcgggctgaccacgtccacggccctggcgctcgcgaagtacggcgtgacggcgaacgtcatctgcccgcgcgcccggacccgtatgacggaggacgtgttcgcgggtttcgcggaacccgatgaagggctggacccgctcgcgcccgcacatgtcgccccgctcgtcggctacttggcctcgccggccgccgcgggcgtcaacgggcagctgctcgtcgtgcatggcggcatggtcgcgatcgtcgaacggccgcgggtggcagccaagttcgacaccaagcaggacacgttcacctacgacgaactggatgcgctgctcaccccgcactacgcggaccggccgaagggcgagacgttcgccgcggtggaggtgctggggctcaggcggggccgggacgccgcggtttccccggcctcgccgggtcgc

SEQ ID NO: 5850 - DNA, 162 bp, Streptomyces avermitilis
  CDS (1)..(162)
atgaacgacaccagcaccacctgtccaccgctgcccgaggctcaggaagccgcagatcacggccacggccggcaccggggtccggtctccgcacaggacgacgaggcaacccctcgcggccggcaccgcaagccgtccgactaccaggcggacccctggcac

SEQ ID NO: 5851 - DNA, 1329 bp, Streptomyces avermitilis
  CDS (1)..(1329)
atgacggtctgtgcctgggagtctgtggcggagagcgggaacgagcggggcgcccggcccggatgtgtgatcaccgctgacgggtcctacgcggcacgcctcgcgctggacggcgagtcctggtttccggagcgctggacgctggacggccccgagccgtacgccgtgccgctgccgggcaaccagcccgaggagcccggcaccgaggtgctgccgatgtccgacgggcgggtgctgatccaccgtgtcgcggaccggcggcacacgttctcgctgctgtatccgacggggccggccaccggtgagctgccgctcggcgcggtggagtgcccggacgaggggacccggctgcggctgctgccgcccgcgccgggcggggaccgggcgtacgccctcgcggtgggcggtggctccacggcggtgtggctggtggcggccggcgcgttcgggcccgagcatctggccgaggtgccggggcactgctcgggcggggtgtggctggacgcgacgggacggctgctggccctggaccgcacgctgaacggtcgtacgaagacggtcgtggtcgacctggagcgcggcggcgagatgtcgccgctgctccagatcgcggagcacagcgacgaccggctgctcctcgcggacgccgacagcgggctgctgctcatccgctcggacgcgccgtcgccgggacacgaccggctgggctggggcgtactggggagcacgctgccggtccgcttcccggagtccctgcggctgacgggccctccgtcccccctcggcgtgaacgggggcgcgcccctcgtgctgacaccgttcgccatccagccggggcaggtgctgacgccggagcgctgtgcggtggccctgcgcgtcgacggcccggcgggcagctgggtgggggtgtggcgccccgccgaacgccagatccaccatcttccggcgcccgaggggtggctggcgggcaccgggctgtggaccgaggacggggtgctgcatctgccgttcgcgacggcggcggtgccctgcggggtggcgcgggtggcggcaccgacggggacgggcccgggagatccggagcggtacggcccggccgcgccgacggcaggacatacgccgcccgagccgcaggccccggatccctcgggtcctgccgccccgcgtccggtgcccctgcaacaggcctcgctcgcgggccgcctgctgagacgcagcgcaccctccgcaccggcccaccccgaggagccggcgccgccgcacgccgaacactccccgcttccggccgagacaccccccgccaccccaactcccgccgtggcagcccga

SEQ ID NO: 5852 - DNA, 861 bp, Streptomyces avermitilis
  CDS (1)..(861)
gtgccccgtctgtctgaagtcatcgccgcgctcgagaacctgtggcccgccgagtgggccgagtcctgggacgcggtcggcaccgtcgtgggcgaccccgaccaggaggtcgcgcgggtcctgttcgccgtcgaccccgttcgggagatcgtcgacgaggcggtgcacctgggtgccgacctgctcgtcacccaccacccgctctatctgcgcggtacgacgacggtcgcggcgtccaccttcaagggccgcgccgtgcacaccctgatcaagaacgacatcgcgctgcacgtcgcccacaccaacgccgaccgcgccgacccgggagtcagtgacgccctcgccggagcgctggacctgcgtgtcgtacggcccctcgtgccggacccgggcgaccccgacggccgccggggactcggccgcgtctgcgcactcgaccacccggtgacggtgcgcgagttcgccgcacgcgccgccgcacggctgcccgccaccgcgcagggcatccgcgtcgcgggcgaccccgaggccctcgtccgtacggtcgccgtcagcggcggctccggcgacagcctcttcgacgacgtacgcgcggccggcgtcgacgccttcctcaccgcggacctgcgccaccacccggcgtcggaattcatggcggaccgcgcccacagtcctctcgcgctgctcgacgcggcgcactgggccacggaatggccctggtgcgagctggcagccgcccagctcgacgagatttccgaccgccacggctgggacctgcgggtccatgtgtcgaagacggtcaccgacccctggaccgcccacgcggcgtccaccaccactgattcccttggagcccccaac

SEQ ID NO: 5853 - DNA, 588 bp, Streptomyces avermitilis
  CDS (1)..(588)
gtggccgctcagaccgaggagagcgacacctcccgcgagcagaccaaggccgagcaggacgtcgaccaggtgcgccagcgcgccgtccgtgaccagcagcgcctcgactccggcgccgtcacttccccgaaggacctggagaacctccagcgcgagatcgtctcgctcgccaagcgacagggcgacctggaggacgtggtcctggagatcatggagcgccgcgagtccgcgcaggagcgggtcgccgagctgaccgggcgcgtctcctccgtgcaggcgaagatcgacgacgcgacggcccgccgggacgcggcgttcgagtcgctggacggcgaggcggcctcggtgacgaaggagcgcgaggtcatctcggcctcggtcccggccgatctcctgaagctctacgacaagctgcgcgctcagcagggcggcgtcggcgcggcccgcctctaccagcgccggtgcgagggctgccacatcgagctcaacatcaccgagctgaacgacgtccggtccgcgccgcgtgacaccgtcgtccgctgcgagaactgccgccgcatcctggtgcgcacgtccgactccggtctg

SEQ ID NO: 5854 - DNA, 1314 bp, Streptomyces avermitilis
  CDS (1)..(1314)
gtggtgcgggagttcatcgtcgaggccgacggcggttcccggggcaacccggggcccgcgggctacggcgccgtggtgatcgacgcggcgacgggcgagacgctggcggagacggccgagtacatcggcgtcgccacgaacaacgtggccgagtaccgggggctgctggccgggctgaaggcggcccgcgccctggacccggccgcccggatccgcgtccgcatggactccaaactcgtggtcgagcagatgtcgggccgatggaagatcaagcaccccgacatgaagccgctggcgagggaagcggcggcggtcttcccgccgtcacaggtcacgtacgagtggattccgcgcgagcggaacaagcacgccgaccggctcgcgaacgaggcgatggacgccggcaagcggggggagcggtggtccccgtcgacgtccaccgcggaactgtccgcccggacgccggcccccgcggcccccgagccgacggggccacccggagacgcggcggcgggcgcggccagggctcgggcggcgctggccggtggacgcgtggcgacgagccctgcggtccctgaaccgggcggcaccgctgccgacaccggcgcgcgggccgcgcgcgatgttgcctccgtgccggccgatgctgacgtgcgggccgcgcgcaacgtcgcgtccccgcccgccgacctcggcgcccccgccaccttcgtgctgttgcggcacggggagaccccgctgacgccgcagaagcggttctcggggagcggtggcagtgatccggccctctccgacgtgggccgccggcaggccgaactcgtcggtgccgccctcgccgcacgcggcaccatccaggccgtcgtgtcctcgccgctggcccgctgccgcgagaccgccgggatcgtcgccgcccgcctcggtatcgaggtgagcgtcgaggaggggctgcgcgagaccgacttcggcgcctgggaggggctgaccttcggcgaggtgcgcgagcgccaccccgaggacatgaacgcctggctggccgacccggaggccgagcccaccggcggcggggagagcttcgccgccgtcgcccggcgcgtcgccaccacccgcgacaagctcctcgccgcgtacgcgggccgcacggtcctgctcgtctcgcacgtcacgccgatcaagaccctcgtacgactcgccctcgacgcgcccccgcagtccctgttccggatggaactgtcggcggcctccgtctcggccgtggcgtactacgcggacggaaacgcgtccgtgcgtctgctgaacgacacgtcgcacctccgc

SEQ ID NO: 5855 - DNA, 657 bp, Streptomyces avermitilis
  CDS (1)..(657)
atgacctcaccgctgcctcccgccgagctgccctcctcgccgcgcgcgtccgtgctggatctcgctcccgtcgtgcccgtggtggtcgtcgaggacgccgccgacgcggtaccgctggcccgggcgctggtcgcgggcggcctgcccgcgatcgaggtgacgctgcggaccccggcggcgctggacgcgatccgggcggtcgcggcggaagtcccggacgcggtggtcggggcgggcacggtgatcacgccgacgcaggtggcggactgcgtggcggcgggcgcccgcttcctggtcagtcccgggtggacggaggaactgctggcggcgatgcaggggtccgggctgccgttcctgccgggggtgtcgaccacgtcggaggtcgtggcgctgctggagcggggggtgcgggagatgaagttcttcccggcgcgggcggcgggcggtacggactatctgcggtcgctggccgggccactgccccaggcgcgcttctgtccgacgggcgggatcgccctcgcgtccgcccccgcgtacctggcgctgcccaacgtcggctgcgtgggcgggagttggatgctgcccggggacgcggtggccgcgcgggactggctgcggatcgaggaactggcgcgcgaggcggcggcactgggccgc

SEQ ID NO: 5856 - DNA, 798 bp, Streptomyces avermitilis
  CDS (1)..(798)
gtgctcgtcctgctgccgccctccgaaggcaaggccgcctccggccgcggcgccccgctgaagccggagtcgctgtcgctgccgtcgctcggcgcggcgcgcgaggccgtgctcgacgaactggtcgagctgtgcgcggcggacgaggacaaggcacgcgaggtgctcgggctgagcgagggcctgcgcggcgaggtcgccaagaacgccggcctgcgcacggccggggcacggcccgccggggagatctacaccggcgtcctgtacgacgccctggacctggcctcgctggacccggcggccaagcgccgcgcgggcaggtcgctgctcgtcttctccggcctgtggggtgccgtgcacatcggcgaccgcatcccctcgtaccgctgctcgatgggcgtgaagctgccgggactcggggcgctgggcgcgcactggcgtacgccgatggagtcggcgcttcccgaggcggccgggggcgggctggtgctcgacctgcgttccgccgcgtacgcggcggcgtggaagccgaagggggaggtcgcggggcggacggcgaccgtgcgggtgctgcactcccagatcgtgaacggggtggagaagcgttcagtggtcagccacttcaacaaggcgacgaaggggaagatcgtccgctccctgctcgcggccgggaccgcccccaagaacccggcggagctggtggaggccctgcgggacctcgggtacgcggtggaggcgcaggcgcccgcgaaggcggggaaggcctgggcgctggacgtggtggtgacggagatccac

SEQ ID NO: 5857 - DNA, 1353 bp, Streptomyces avermitilis
  CDS (1)..(1353)
gtgcccgggaccttcccgccggaagcgctcgccgaggcggagcgggccgctacggcccccgtaccgccgtcgtacgacgcgaccgacatccccctgttcaccatcgacccgcccaccgccaccgacctcgaccaggcgatgcacctgtcccggcacggcggcggcttccgggtgcggtacgccatcgcggacgtcgccgccttcgtcgtacccggcggtgccctggacgccgaggcccaccgccgggtgaacaccctctacttcccggacgagaaggtcccgctgcatccgccccggctcggcgaaggcgccgcgagcctgctcccggaccagacctgcccggccgtcctgtggacgatcgacctcgacgcggacggccgtaccgcggcggtcgacgtccgccgcgccctcgtccgcagccgcgcccagctcgactacgagggcgtacagaagcagatcgacacggcgacggccgaggaaccgctcgccctgctcgaggacatcggacggctgcgcgagaacctcgagatcgaacgcggcggcatctccctcgacgtgcccgagcaggagatcgtcgaacacgaccacacgtacgcactcgcctaccgcgccccgctgcccgccgaccgctggaacgcacagatctccctcctcaccgggatggccgccgccgagctgatgctcgcgcacggcaccggcatcctgcggacactcccggccgcccccgacggcgcggtcggccggctgcgccgcaccgcccacgccctgcgcgtcgactggccgcaccacgtctcgtacgcgcggctcatccgctccctcgacccgcggctgccgcaccacgcggccttcctcctggagtgcacgacgctgctgcgcggcgccggctacaccaccttccgcgacggcgcgctccccgcgatcaccacccacgccgccgtcgccgcgccctacgcccactgcaccgccccgctgcgccgcctcgccgaccggtacgcgtccgagatctgcctcgcggccgtcgcgggccaggcgccgccggactgggtcctggccgccctcgacgacctgcccaaggagatggccgacggcagccaccgggccgccaccgtcgagcgggagtgcgtcgacatcgtcgaggccgcgctgctcaaggaccgcgtcggcgacgtcttcgacggctgcgtggtcgacgtgaaggagcgcgaacccaccgtcggcaccgtccagttggagtctccggccgtcgtcgcgcgtatcgacggcggcactgcgaagctgccgctgggggagcggctgcgggtgcggctcacccaggcggaccccggtacggccaaggtgcgcttcgcacctgcc

SEQ ID NO: 5858 - DNA, 846 bp, Streptomyces avermitilis
  CDS (1)..(846)
gtgggacaggaaggacgccaggtgagcgcacgtgagcaggccctgtggacccgggcgcacctcggccgctgcgggccgccgctcgacctgctgaccgcacgcttcgaccaacaccgctacgccccgcacgcccacgaggagttcaccatcggcgtctgcgtcggcggctccgagatcatcgactaccgcggcggtcacatccgcaccggccccggctccatcgtcgtactggcccccggcgagatgcacaccggcggccccggcgcctgcgacggctacgcctaccgcgccctgtacgcacagaccccactgctcaccgacggcaccctgggcggcctcccgcacttccgcgagccgctcctcgacgacccggaactggccgccgccctgcgcgccgcacacaccgaactcagtctctgccccgacccgttggaggccgagtcccggctgccgtggctgctcaccgcgctcgcccggcgccactccacggcccgccaggtcagcgacacggtgcccggcgcgggccacatcgcacacgccgtccgcgaccgcctcgccgacgaactcaccaccccgccctccctcgccgacctcgccgccgacctgggcctgtcccgctaccagctgctgcgtgccttccgtacgacgatggggataccgccgtacgcctggctcgcccagtaccgcgtggtccgggcccgcgggctcctggagtccgggctgcgaccggccgaggtcgccggcctggtggggttcgccgaccaggcccacctcacccgctggttccgccgagtgctgggggtgactccggcggcgtaccgcaacagcgttcaagacagggggtgc

SEQ ID NO: 5859 - DNA, 1074 bp, Streptomyces avermitilis
  CDS (1)..(1074)
atgactgcacgcggctggttcctgttctccctcatgggagtcctctggggcattccctatctgatgatcaaagtggcggtggacgacatgtccccgtcgatggtcgtcttcacgcgctgtgccctgggcgcggccctgctcctgcccttcgccgtacggcaaggaggactgaccagggtcgtacgggcgcactggcggcccatgctggccttcgccgtcgtggagatcatcggcccctggtggacgctgacggacgccgaacgccatctctccagctccacggcggggctgctgatcgcgggcgtcccgatcgtgggcatcccgctggcccgcttcttcggcgacacggagcggctgggggcgcgccggacgacgggtcttgcgctgggcctggcgggcgtcgtggtgctcaccgtcccccatctgaccggcggtgacgcccgttcgctggccgaggtgctgctgacggtgctgggctatgcgaccgcgccgctgatcatcgcgaggtacctcaagccggtgccgacgctccagctgatagccccgtgcctggtgctggcggcgctggtgtacgcgccggcggcggctctgacccggccgaccgcggtcccctccgcgtcggtgctggcctcgctggcgggcctgggcgtgatctgcacggccctggccttcgtggtcttcctcgaactgatccgcgaggcgggcccgaccagggcgatggtgttcacctacgtgaatccggcggtggcggtggcggccggggtggcgctcctggacgagccgctgacggccgggatcctggcggccttcggcctgatcctcctggggtcgttcctggccacggcggccacgagtccacgaccggaccccgcccccgcatccgcccccgtatccgccccggcatccgctgtggtggccgcctcgggaccgacctcgggaccgacctccggcgcgaggcgggtcgcgcgcccggtagcatggtcgacacggcagacgagccgggcggacggccgcgtgggggtccttgaggacctccccgaggaacgtccgggctccacagggcagggtggtggc

SEQ ID NO: 5860 - DNA, 1161 bp, Streptomyces avermitilis
  CDS (1)..(1161)
atgaccgacccggcatccgagcggcgccgtatggcggccgtgctctcgaacaagggcgtcctgaagtccccctggctgcgcggggccatcgagaccatcccccgcgagcagttcctccatcctggagtcttcctcgacgaggggcggacctggcggcccgtcaccgccctcggcaccgccccggacgagtggctgaagatcgcgtacagcgtcgacaccctcaccacccagctggatggccacctcaccgccgaccgggccggcggacccgtcgtgggcgtgcccacgtcgtcctcgaccgacccgaccaccgtcatcggcatgatcgaggccctggacctcacggcgggacaccgcgtcctggagatcggcacgggcaccggttactccacggccctgatgtgccactacctcggcgaggacaacgtcaccacggtcgaagtcgacccgcaggtggcggcacgcgccgatgccgccctggagtccgtcggctactcgacgtggacggtgacgggcgacgggcttctcggccatccgcaccgggcaccgtacgaccgggtcatcgccacctgcgcggtgcgtcgcatcccctacacatgggtccggcagacgaagcccggtggcatcgtcctcagcacggtcggctcctggccctggggaaccggtctcgcaaaggtcaccgtttgcgataacggcaccgccgagggcgcgatcatcgcacgctcctccttcatgcaggcacggtcccaggcagtgacgcccttggccggcgacctctccgcccgcaccgcctacgcggacagtaggcggcccgcgctggtgtctcccctcgtcctggaggagtggatgcccgcgttcctcgcgcagctcgccgcacccggtgcgcagttcgtccgcgccgcccgcagcgacggctcgcccttgcggtacctgttcgatccggagcgggaatcgttcgtcgagttcatctccgacggcgagagctggaccgtccgccagggcggccccgtggctctgtgggacggcatcgaacgctccgttgtcgcctggcaggacgccggggctccggatatcgatgcggtgcgactccgcgtcaccgaccagtcccacgagtactggatcgacagctgcccgtcgctgcgcttggaacaccggctcgcc

SEQ ID NO: 5861 - DNA, 963 bp, Streptomyces avermitilis
  CDS (1)..(963)
atgaccatgaccgacgagaggccggttctggtggccaccgaggcggacgacatcaccgccgacatggtgatcaccgagctcaaccggcgcgatgtgccggtggtccggttcaacctcgccgacatcggcgagggcctcacggtgtcggctcggttcggcacctgcccggcccctgtggtcgggcaggtgcgcacctcgtcgagaaccgccgacctgacccgcgtccgatcggtgtactggcgccgcccggagtggccttcgttcccccacctgtccccggacgactcccgtttcgcggcggcgcaggtccgctacgggctcgggggcaccctctacgccttggaccacccgctctgggtcaaccacccgttacgcatcgccgcggccgactacaaacccgctcagctcgccctcgcccagcagctcggcttcaccatcccgaccaccctcgtcaccaacgaccccgccgaggcacgcgagttcatccgcactcaaggagacgtgatcttcaagacgctgcggtggaccccgtacacgcgcgacggcgtgccggtgaccggttgggccgaccccgtcaccgccgacgagatcgacgacaacgttcgcatcaccccgcatctgttccaggcccgcgtggacaaggtcaccgacctccgcgtcctgatcgtgggccagcacaccttcgccgtacgtatcgactccgaactgctggactggcgcagggactacagcgtcctgacgtacaccgtcgaacacctccccgacagcgtggacaaggcactgcacgcctacctggaccgcctggagctggtatcggggagcttcgacctcacggtggaccgggcgggggtctactggtggctggagctgaatcccaacgggcagtgggggtggctggagaaggagaccggcctcccgatgtccgccgccttcgccgacctactcgtgcaaggagaccgccaa

SEQ ID NO: 5862 - DNA, 258 bp, Streptomyces avermitilis
  CDS (1)..(258)
atgaccgcctccgtcgcgctccccgcccccacgcgaccgtggggtgtgggccgactcgcgccctacccgacgaccatccgccagccccacgccacggtcgccatcgaccccacgacgcaactcggggtgttccgcgaccgcgccggccaggtagtcgagatgggcaagcacggcaccagctccggaactgagacctccacgacgacgaactcggactccaagaacgatcagggtcacgatcaggacagcagccaggac

SEQ ID NO: 5863 - DNA, 204 bp, Streptomyces avermitilis
  CDS (1)..(204)
gtgaacccagtcgggcccgacggctacgagcagcacccgctcctgaacacgaacgtccgcgacgtcgcctcgcgcggggagggcgttctcgtcgccgtcacgcacgagctccacagccacggcactgtccgggtcgcgcgcatccggcccgagagtggcgtcgagtggacgaccgcagccggcaacatccaggcggctcgcctc

SEQ ID NO: 5864 - DNA, 1143 bp, Streptomyces avermitilis
  CDS (1)..(1143)
ttgggaaagtggccgtgccaacaaccgcaccaacggctcaagatcgccagcctgttaggagccaccctctccgagctggaagggcttctcttcgaagaacagccggccgaaaccgccgtgcttcctgacaccccgcccctcctcgacggtgatgatgacgatatgaagcgccgcgatgtcctgggcctgctcgccgtcacgggcgcgctggtcacgctgcccggttcggacgaggccccccgaggacacacagtggcggcgctcctggagacaggggaggagctgcaccgcagcctgtggcaggtcttcaccctctcggactcaaagccgaccgtcttcccggcggtccacaagcagcttgacgtcctgacgaagggcctggccgagacgcgtaccgcagcggaccgggcccggctgtgcacgatgacggccgacctctaccagctcgccggcgaactcttcttcgacgccaaccggtacaccgacgccgctcagtgctacacgctggctgccaacgctgcccatgctggtggtgatcacgacctctgggcctgtgccatgacccgccacgcctacgtcgagctgtacgcgcgccgcgcgcccgctgcccagcccctgctggcggtggcctcccggatcgcccggcggggcgacagcgcactgtccacccgccactgggtcgccgccgtccaggcccaggtgtgcgcggccgtgggcgacatcgacggctgcgcccgagcgcttgacgaagccgagaaggtgcactccctcgacggccattcccacaacggcggttggctccgcttcgacggttcccgcctccccgaggaacgaggggcctgctacctccagctcggccgtcccgacctcgcggaagatgccctcaccgcagccctcgcccaaccgctgtccctgcgccgccgcgcagccgtactgagcgaccttgccgtcctcggggcccaccggggtgacgtcgatcaggtcgtgcagtacgcggaggcagtacttggcctggccgaccggtcgaactcgggattcgtcggaaagaagctggacggacttcgagggcgtcttgccccgctcatgtccgatggtcgagtctcggatctggatcaccgaatcgcggcgctttcgcgcaccgca

SEQ ID NO: 5865 - DNA, 351 bp, Streptomyces avermitilis
  CDS (1)..(351)
atgagtgacggtcggatcttccgcgaggcgtggatcgccggtgtgaacaagcactaccccggtgagccgaagcccggctatgtcactccgtgggacgagacgcccgtgtgggagcgcgaggctgccgccgccgtatacggacaggtgcgcgacttcatcaggatcagcgaagggcacgccacacggctcacccgcgagcagaagggccgcttcgtcgcgatctcctggaccgcccagatgttcaagcatttcgaggacccgaagcccggatacgtcgccgactgggccgacctgccgacctggcagcaggagactgactcggacatcttcgagcgcatcgagcagaccgtc

SEQ ID NO: 5866 - DNA, 315 bp, Streptomyces avermitilis
  CDS (1)..(315)
atgtcttcctcccgacagctcgccgcaccgggagcgcagttcgttcgcgccacccgcagcgacggcgcaccgttgcggtacctcttcgcccctgagcgggagtcgttcgacgagttcatcgccgacggcgagagctggaccgtccgccagggaggacaccccatggccctctgggacgccatcgagcgtgcccttgtcgcccggcaagacaacggcagtccaggtatcgagactgtgcggctccgagtcaccgacagatcgcacttgtactggatcgacagcagcccgttgctgcgctgggagcatcggctcgcc

SEQ ID NO: 5867 - DNA, 813 bp, Streptomyces avermitilis
  CDS (1)..(813)
atgagcgaccctgtgacgacgcccgagccggcaaagcagcagaagatcgacacgtcggtgccgcactccgcccgtatctggaactactggctcggcggcaaggacaactaccccgtcgacgaggcggccggtgacgcgtacaccgaggtgtttcccgggatcgtcaccatcgcccgctccagtcgtgccttcctgcgtcgcaacatcgcgtatctcgtctccgaggcgggcatccggcagttcctggacgtcggcaccggccttccgaccgcgcagaacacccacgaggtcgcccaggggctcgctcccgaggcgcggatcgtctacgtcgacaacgatccgatggtgctcgcccacgcccgtgcgctgctctactccacggacgagggcgcgaccgcctacatcgacgccaacgtgacggacccggagcacattctcgaggtcgccgccgagacgctggacttcggtcgtcccaccgcgctcatcctcagcaacatcctgggtcacgtcgccgactgcgatcaggcccgttccatcgtcacccggctgatggaagccctgccctcgggcagttacctctccatcaacgacgggtcgcgtggcatcgacccggtcttcgagcaggcccaggacgcctacaacaacagcggcgccgttccgtacaacctgcgctccatcgatgagatcaccgcgttcttcgacggtctggagcttgtcgagcccggtgtcgtctcggtgacggagtggcgtccggagcccggttcgggcgtcccggaggtcatcgccgagcacggtggacttgcgcgtaagccg

SEQ ID NO: 5868 - DNA, 537 bp, Streptomyces avermitilis
  CDS (1)..(537)
atgcgacggataggtactgcactggccgcgatgatgctggcgggcggcggtctgttggccggcacggttccggcggtggccgcgccgacggccgtggactgcgccgtgacgtgggggagcctggacaagaccggtgactccgctgcctccaggcgactgaccgacgtgagggccggacagcacgagtgcttcgaccgtctggtcttcgacgcccagggcacggcggccgacccgatcggctacacggtccgctacgtcgacgtactgcaccaggacccgagcgacgtcgtggttccgatcaagggcggagccattctggagatctcgctgttctccccgcgctacgacccggcgaccggacagccctacccgccgcttccttccgtcgacgtcaccgggtaccggaccttccgggagttcaagttcacaggtggctccgagggctacacccaggccggactgggcgtccgcgcccggctgccgttccgggtcttccagacggccaaccatctcgtggtggacgtggctcacacctgg

SEQ ID NO: 5869 - DNA, 816 bp, Streptomyces avermitilis
  CDS (1)..(816)
atgaggagtaagaccgtggcgaagacgaccacccgaagccgcggctccggtgccggatccggcaccgggcgcaccatgaccgcggccgcccgcgcggcggccaagcgcgcggagcgcggccaccgcgaaccggacccggcgtccaccgacgaggtggccccgggacggcccgaggcaccggccgccggccgcaccgtgctcatcgaggcccccgatgaggacggctgggacgacccgcccgagccctcgcctgagtgcttcgaggaggacccagcgcaggaggagggcgagcccggccgcggtacggctacgcggcacggtcggcggcggctgctcaccgccgccctgtgtgtcctgctcctggcgggtctggtcgcggccaccgttctcgggtggcgctaccgggagggcgtgcgggccgaacaggcacgcggtcaggcactcgcggccgcacgccaggcggcgccagtcgtgctgtcgtacgactacaggcacctggaccgcgacttcgccgcggcccgcgcccggctcaccggccacttccgcgacgagtaccggaagaccaccacgacggtggtcggcccgacggccaggaaataccacggggtggtgaaggcgacggtgacgcagcccaccggcggctccccggcagcctccgtgatctcggcctcggcggaccgcgccgtggtcctcctcttcgtcaaccaggtgaccacgagcacccaggtctcgggctcccgcgtggacctgaaccgggtgcggatgacggtggcccttacgtcccacggctggagggtgagcggggtcgacgcgctc

SEQ ID NO: 5870 - DNA, 531 bp, Streptomyces avermitilis
  CDS (1)..(531)
atggcaatggctactcgtcggaccgatggcatgagcagagccatgagaagtgtcctgtcgggcagggcctggtcggtggggctcgtcgtggcgaccgtcctcgccaccgcgctgacgatctggctgagcttcgggctctacaaccagcgcgaggcggagcagcggcgccaggacctcctggccgcggcccgccagtcggcgctgaacttcacctcgctcgactaccggcactacgaccgggacagcgcgaacgtcctcgagggcgccaccggcgacttcaggaagcagttcgccgcgcagacggaggagctgacgcagctggtcacccagaacaagtcggtctccgatggccaggttctggaggcgggcatcgtccggtccgacgagcactcggcccgcgtcctggtggtcgccgacagcaaggtgaccaacaccgccgcccccaagggcgaggcgcgcacctaccgcctacagctcgacctggtgcagcgaaacggccgctggctgacctccgacgtcgagttcgtcggc

SEQ ID NO: 5871 - DNA, 1275 bp, Streptomyces avermitilis
  CDS (1)..(1275)
gtgatcacacgtacggtcaaggcccagttgctcgccttcgccaccgtcaccgccgtcggggtctcgtacgtcggcgccgagtacacgggcctggtggacgacgtcctgggccgcggctacaccgtgcgggcggacttcgccgactccgggggcatcttccccggcgccgaggtcacctaccgcggggtgccggtgggccgcgtcggcgcgctgcggctgaccggctccgacggcgtctcggtcgccctcgacatcaaggacggcgtgccgcgcattcctgcggacaccctggccgtggtggcgaaccgctcggccgtgggcgagcaatacgtagatctacagccgcgaacttcgcatggcccatatctcctcgacggcagcgccatcccgcgcggcagcacccgcgtgccgctgcccaccacggacctcgtcctcagcctggaccggctggtcgactcggtcggcaaggacgacctgcgggtcaccgtcgacgagctgggcaaggcattctccggcaccggcccgaacctgagccggctggtggactcgggcaacgcgctcgtggagtcggcctccgagtcactcccccagacgatctcgctgatcgaggactcgcgaaaggtcctcaagacacaggccgaccagggctcgtccatcaagtcgttcgcgcacgatctggcggcgctcagcgcacagctgaaatcgagcgacggggacctgcgcaaactgatcggcaacgcgacgccggccgcgcaacaggtgaactccctgctgaaatccaccggcccacggctgtcggtcctgctggccaatctgatcagcggcggccaggtcacgctggcccgcctgcccggcgtggagcagtccctggtcaccttcccggcgctggtcgcgggcagctacacggtcgtcccgggcgacggcaccacccacttcggcctggtggtgaacgccgacgacccgccgccgtgcacccagggatacgggacaacacggcgtgacccctcggacaccagcacacgcgaggcgaacaccgacgcgcgctgcaccgccccgcgcggaaacaagacgtcggtgcggggcgcgcagaacgcccccggcgcgtcgaccacttccggcggtacgaaccaggcggcgtatgtcacgccgtacgacccggagaccggcaccgcgaccggcccggacggaaggcccgtcgagatcggctcgacgggcggccaacaggccgttttcggaagggagtcatggcaatggctactcgtcggaccgatggca

SEQ ID NO: 5872 - DNA, 1275 bp, Streptomyces avermitilis
  CDS (1)..(1275)
atgaacgcactgcgcaaggtcggggcggtggcgtgggccgcggtcggctcgctgctgctgtccggctgcgagttcaacggctggtacgacgtccagctgcccggcggagccgccgcggacggccacgcgtaccacgtcacggtcgagttccgcgatgtcctcgacctggtgccgcagtcggcggtgaaggtcaacaacgtcaccgtgggcgcggtcgaggaagtgcagctggacggctggcacgcgcgcgtacggctgcgggtcgccgactcggtgaagctgcccgccaacgcggtcgcggagctgcggcagaccagcatgctcggcgagaagtacgtcgcgctctccaccccgcccggcacggcccccgtgggccggctcggcgacggcgaccgcatcccgctgtcccgcagcggccgcaacccggacatcgaggaggtgctgtccgcactgtccgcgctgctcaacggcggcggagtggcccagctcaagacgatcaccgtggagctgaacaaggccctggacggccgggaggaccgggtcagatcgctgctcaaggagctgaacaccttcatcggtggcctggacggccggcgaaaagacatcatccacgccctcaaggccgtcgaccggctcgcggggcggctcggcaaggagaagaagacgatcgcccaggccgtcgacacgatgccgcccgctctgaaggtcctcgccgaccagcggcgcgatctgaccaggatgctcaccgccctgtcgaagctgggcacaacgggcaccaaggtggtcaacgcctctcacgacgacacggtcgcgaacctcaaacagctgcggccgatcctgcaacagctgaacaaggcgggcgccgatctgcccaactccctcgagctgctgaccacttacccgttcccgcgcaacgcggtggacgccgtcaggggtgactacgtcaacctcgacatcacggccgacctcgatctgtccgccctgtacaggaacttggcgggcggatccgacaagtccggcggcgggaacggcgagtccacgcagcccgagacccccgatatacccgacctcccggacctgccgaccgtcccgacccccaccgcgctgcccagcgcaccgagcctgccgtcgtccccctcgatgccgtcggccccgtcgggcggcggcggtccgttgtgcccgccggtgtgcaccagcagctacaccacccgaggagagccgcccgaggggatcgacctcgcgctcgcagagctgatgctgaagggggttcagccg

SEQ ID NO: 5873 - DNA, 1122 bp, Streptomyces avermitilis
  CDS (1)..(1122)
gtgaagaacctgaagaggcgcgtggccgtggtcaccgcactcgccctcgtcgccgcgctcacctacgtgctgtggccgcgctccgagtccgtgcacgtcaccgcgtacttcccgcgcaccgtcggcatctaccccggctcggacgtccgcgtcctcggcgtccggatcggcgaggtcgagaagatcacgccggagggcgaccgggtgcgggtggagctgaagtacgacgaaggccgcagggtgccggcggactccaaggccgccatcatcaactcctcggtggtcagcgaccgttacgtacaactgctgccggtgtaccgaaagggcccggtactgcggaacggcgccgtcatccccgagtcgcggacggccgtaccggtcgaactggaccgcgtcttcggcagcctgcacacgacggccgacgcgctcggcccccagggcgccaacaaggacggctcgctgtcgcggctgctcggggtgagcgcggacaacctcgacggccagggcgagaacctcaaccggacggtcgaggacctctcgcaggccgtcaccacgctgtccgacggccgcaaggacctgttcggcacggtgcggaacctacaggtgttcacggcggcgctgtccgccgacgacaagagcgtgcggtcgttcaacactggcctcgccgaggtcgccggacagctcgcgggcgagcgcaaggacctcgcggacgcgctcaagaacctggggacggcgctcggtgacgtgtccgccttcgtgaagaacaacaagaggtccctgaactcgaacgtgaagggcctgagcaaggtgaccaaggtgctcgtcacccaacgggccgctctggccgagctgttggaggtggctcccaccggcctgtcgaacctgaacaacgcctacaacccgtccgcgggcaccctcgacacccgcaacaacgcccagcaggcacaggatccggccgcgctgatgtgctccgtactgaagacgaccggcgacgaaggcggcaagaaccccgactgcaaggagctgaagaaactcttcgactccctgccgaaggtgcctcagggctccgcggtgacgggaacggtcgaccgcacgctcggcggcattctgggggcgagcgca

SEQ ID NO: 5874 - DNA, 1176 bp, Streptomyces avermitilis
  CDS (1)..(1176)
atgacgaagcacttccttccgcgcaggacccgtaagcgccgcccggagccgctggtcaaggtccgtatcgacccgcccaagctcccgaagattcggctgcttccgcgccgggcaccccgcccccgccgcccggaacccctggtgaaagtccgcatcgacccgcctcggatacggcttccacggatccgccgtccgcgcctcaccccgttccgtgagcgaaaccccgtggtgatcggagccgtcggcctcaccttcctcgcgctgctgaccgtggccgcgttcaacgccgacagcctgccgctgatcggcggcggcgagacgtacagtgcggccttctcggaggcgggcggcctcaagcccggcgacgaggtgcggatcgccggtgtcaaggtcggcaaggtcaaggacgtcgatctggacggtgaccacgtcaaggtcaccttcaagatcaagggcgatccggggttcggcaccgagaccggcgcctcgatccgggtcaagacgatcctcggcgcgaagtacctcgcgctgcgtcccaagggaccgggacagctgaagcccggcagcgagataccgctgaagaggacggttccggcgtacgacgtcgtacaggcgttcagcgatctcaccacgacgacggagaaggtcgacaccgaccagttggcgaaggccctggacaccatctccaccacgttccaggactcgcccgccgaggtacgggcgtccatcaagggcctgtcgaagatctcccgtacggtcgcctcgcgcgacaaggcgctgggcgaactcctcgaccacgcgaacggtgtcaccggcgtactggccgagcactccgaggacttcaccgcgctggtcaaggacggcggcaagctgttcaaggagatcagcaagcggcgcaaggcgatccacaagctgctgaagagctccgccgcgctcggcatcgagctctccggcctcgtcgaggacaacgacaaggagatcgggcccgcgctcaagggcctgaaccgcgtggtgcagatgctcgaacggaatcagtccagcctcgaccggagcgtcaagctgctcgcgccctacgtccgggtcttcaccaacgccctcggcaacggccgctggttcgacagctacgtccagaacctggtcgccgctccggtggtgccgcggacgggaggcgcgcag

SEQ ID NO: 5875 - DNA, 1089 bp, Streptomyces avermitilis
  CDS (1)..(1089)
atgaggatcacgaggatcatgaagaccgcgaagaccgcgaggactacgacgtccacgaggacgtcaggagcccggcaggccgccgccccgctgatcaagttcagcctgttcgcgctggtgacgatggtggcgacgactctgctcgccgccaccatcgtcaacatctccctcacccccgagcacacctatcgcgcggtgttcagcgacgtcacgggcctggagaagggcgacgacatccgggtggccggggtgcgggtcggccaggtcgagggcatccggatcaaggaccggacgctggctgaggtcaccttcactgtcggtgaggaccggccgctcctgaacagcaccggcgcggtcgtccgctaccggaacctggtcggacagcgatacgtcgccctgaccgagggcgcgggagacgccacccggctgaagcccggcgccacgatcccgctgtcgcgcacccagcccgcactggacctcaacgcgctgctgaacggcttcaagccactcttcgcggcgctcagcccgcaggacgtcaaccagctcgccaccgagatcatccggaccctccagggcgagggcggcaccgtcaacagcctgctcgcgcacacggcttcgctcaccacgacgctggccggccgcgacaagctgatcggttcggtgatcgacaacctcaacaccgtgctggagacgctggaccagcgcggcgcccgcttctcagggctgctcaagcagctgcggcgggtgatctcggggctgtccgccgaccgcaagcccatcgggcagtccctggtgggcatcggcgacctgacggacgccacctcggggctgctcaaggacgcgcgtccgccgctgaaggacgacatcgccgagctgaccgatctcaccggaacgctgaacaagaacgagaacaccgtggagggcgtgctgaagcggctgccgaacaagctgggcgagctgacggggacggcgtcctacggctcgtggttcaacttctacctctgcgacttcgacggccggatcgtgctgccgaagacgaagcaggtgctcactcccgagctgcacgtggcgagggcgaggtgcggcgca

SEQ ID NO: 5876 - DNA, 1245 bp, Streptomyces avermitilis
  CDS (1)..(1245)
gtgagccggatgagagtgctgagactgcggttgtacggcgtcgtgttcctcgccgtgctcgcgctgctgctgtccctgtccgtcgccgtgtaccagcaggtgttcaccccggccgtacggatcaagttggaggccgacagcctcggcaaccagctcgatccgcgcgccgacgtcaagctgcgcgggctgctggtcggcgaggtgcgcgcggtgcatgccgacgggacgaaggcgacgctcgacatcgcgctcaagccggagtacgtcgcgtccatcccgtccgacgcgcacgcacgcctgctgcccaagacgctgttcggcgagaagtacgtcgacctggtcgcgcccgcgcgctcctcggcccggcccatccgcgccggcgatgtcatcacccaggaccgcacccgcgtcggcatcgagctccagcagctgatgaacgacctgctgccgctgctgcggaccgtgcagcccggcaagctcaacgccacgctctccgcgttcgccaccgccctcgaggggcgcggcgaccggatcggcgacaacctcacgcgcgtggaggactatctgcaccgcctcaatccgcacctgccctccctcaccgaggacttcgcgcggctggccgacgtcgccgaggtgtacggcgacgcggctcccgacctgatggagatcctgcgcaacaccgtcaccaccagccgcaccctggtcgagcagcgggaccggctcgcgtccgcgctcaccacgacggccactgccgcgggcaccgcggacgacttcctcgacgcgaacggtgaccggctgatcaccctgggccgggtctcccgccccacgctcgacctcttcgcccgctactcgcccgagtacccctgcctcttcgccggcctggtgcgcgaggagcaggcatccgagcaggcgttccggggcggcaagatgcacatcacgctcgaggtagtccgacagcagggggcgtacgaacccggcgagtatccgcgctacgacgatcgatcggggcccaactgccgcgacctgccccatccgccggtgcccgcgcccggggtccacctcaacgacggttcgacgaagggaagtgcgtccggcggcccgggcggcgtctccgccacccgggccgagcagcgctccgtcggctcgctcgtcgcgcccgtcttgggtgtgcccgccgaccaggtgccgccggtcgcgaccctgctgttcggaccgatggcgcgcgggacggcggtgagcgtcgca

SEQ ID NO: 5877 - DNA, 801 bp, Streptomyces avermitilis
  CDS (1)..(801)
gtggcgctgctgaatcgtctggaggaactgggcagccagttgtccttctacggccgctcgttggcgtggacgggccgcaccgtacgccgctacaagaaggagatcctgcggctgctcgccgaggtgagcttcggacgcggcgccctcgccgtcgtgggcggcacggtcggcgtcatcgccttcctgtcgttcttcaccggcacggaggtgggcctccagggctacgccgcgctcaaccagctcggcacctcgaacttcgtggcgttcctctcggcgtacttcaacacccgggagatcgcgccactggtggcggggctcgcgctgtccgcgacggtgggcgccgggttcacggcgcagctgggcgcgatgcggatcagcgaggagaccgacgccctcgaagtcatgggcgtgccctcgctgccgttcctggtgaccacccggatgatcgccggtttcgtcgcggtgatcccgctgtacgtggtcgggctgctgtcctcgtacttcgccgcccgcaccatcaccaccggctactacgggcagtcggcgggcacctacgaccactacttccagcagtacctgccgccggtcgacgtgctgtggtccttcgggaaggtgctcgtcttcgccgtcctgatcatcctggtgcactgcttctacggctactacgcgagcggcggcccggcgggcgtcggcgtcgccgtgggccgcgccgtacgcacctcgatcgtcgcgatcaacgtcctggacttcttcctgtcgctcgcgatctggggcgccggcacgaccgtccggattgcgggg

SEQ ID NO: 5878 - DNA, 768 bp, Streptomyces avermitilis
  CDS (1)..(768)
atgagactgtcacccaccggggcgctgaggcactcggggagcctcttcgcgatggcgctggacgtcgtccggaccatcccccgacggcctttccaggcgcgggagttcatccagcaggcctggttcgtcgcgagcgtcaccatcctgccgacggcgctggtgtccatccccttcggcgcggtcatcgcgctgcagatcggcagcctgacccggcagctcggcgcccagtccttctccggggccgcctcggtcctcgcggtgctgcgggaggcctcgccgatcgtcaccgcgctgctgatcgcgggcgccggcggcacggcgatctgcgcggatctcggggcgcggaagatccgcgaggagatcgacgcgatgcaggtgctgggcatcgaccccatccaccggctggtcgtcccgcgggtcctggcgtcgatggtggtggcggtgctgctcaacggcctggtgtcggtggtgggcgtcgcgggcggctacttcttcaacgtcgtcctgcagaacggcacgccgggcgcgtatctcgcctccttcaccacgctcgcccagctctccgacctgtgggcggcggaggccaaggcgctggtgttcggggcgatcgccgcgatcgtcgcctcgtacaagggactcaccgcgaagggcggcccgaagggcgtgggcgacgcggtgaaccagtcggtggtgatcaccttcatgttgctgttcgtgacgaacttcgtgatgaccgccgtgtacttccaagtcgttccgcagaggggc

SEQ ID NO: 5879 - DNA, 978 bp, Streptomyces avermitilis
  CDS (1)..(978)
atgtcggagctgctccacggccgaagggtggaccggatgggtgtcgagatctgtgtggaagggctgaccaagtccttcggtcagcaggtcatctggcaggacgtctcgctgacgctgcccgccggggaggtctcggtcatgctcggcccctcgggcacgggcaagtcggtgttcctcaagacgctcgtcggactgctgaagccggaccggggttccgtgaaggtcgcgggccgggacgtcaccaagctgcgcgagcacgagctgtacgaggtgcggaagctgttcggggtgttgttccaggacggcgcgctgttcggctcgatgagcctgtacgacaacatcgctttcccgctgcgggagcacacccgtaagtccgagagccagatccggcgcatcgtgctggagaagatggacatggtcgggctgatcggttcggaggggaagctgcccggcgagatctccggtgggatgcgcaaacgggccgggctggcacgagcgctggtcctcgatccggagatcatcctgttcgacgaaccggactcgggcctcgacccggtgcgcgtcgcgtacctcaaccagctcatcgtcgacctcaacgcgcagatcaacgcgacgttcctgatcgtcacgcacgacatcgcctcggcccgccaggtgccggacaacatcgggctgttgttccgccgtgagctggtcatgttcgggccccgtgaggagctgctgaccagcgacgagcccgtcgtacggcagttcctgaacggccggatgcaggggccgatcgggatggcggaggagaaggacgccgcgcaggtcgagcaggagctggcgcggctcggcgacacggaccgcgaaccccgccacgtcggcaacgacatgacgccgcgcctgatgccgggccccggcatcgcccgtccggcccgctgggaggcgatcgcgagacgcgaggccgaactgcaccggaaggcggtgaccggcgca

SEQ ID NO: 5880 - DNA, 1032 bp, Streptomyces avermitilis
  CDS (1)..(1032)
atggcgacggacatgccggacatgcctgcggagatacaggcggcccacgaccgttggcagcgcatgtggagccaccgcgagcaactgctcaaggtggcccggcgcaggtcgatgagcccggaggacgccgaggacgcggtgcacgaggcgatgctgcgcgccgcggagcgccccgacttggacgacgagcgcctcggcgcctggctgacgaccgtgaccatgcggctgtgcgtcgatcggtaccgccaggtcaaccgtgaggccgaggtacaccgcagccccacgctcgccgcgccgggtccggtgcccgtcgaggaggcggtgtgcgaccgggccgaggccaggtggctggccgtgcgcagcggggagctgcccgcgcgccaggccgaggcgctccggctgaagtccgaggacctcgacgtcggccaggtcgccgtgcgcatggggctgagttatcgcaccgtcgagtcgctgctcgcccgggcccggcgcacgctgcgcagctcgctggccggaacgctgggcctcgccctgttcctgtgggggcgcggcaaaccgcgcgcgggcggacacacgcaggccgcggtggtgacgtcgacggccgcgaccctggtggtggcggggttcgtgttgccgtacgtccacaacggggacgggcagggcacagctccccgtccctccgtgtcccgcatggcccagacgaccacccagaccgtccggcccgacggcttcggcagggtggccgccccgaacggccgtgctctgtcggccgcctcgacgtctcacgcagcgacgcctacggtgccgcccggcgatcacgaccggtcgctgctgcctctgtcggtgccaccgctgccggatgcctcgctgtcaccggtgccgtccgtccccggcgtgtccgacctgccgagcgtgcccggcctctccgatctgccgaccacgtccacggtcccgacgacgcgtcgggccctcccggaggctcccgccacgccccccgcgccggccgacgtaccgaccccgaccgtactgccg

SEQ ID NO: 5881 - DNA, 1050 bp, Streptomyces avermitilis
  CDS (1)..(1050)
atggcagggcacagggtcagaggcaccaggggtacggcgatcgcggcggcgaccatggcggttctgaccgcgtcacaggcgccggcggcggtcccggcacgggcctccgtacccccgcggcaggcgcccgccgagcacgggccgagcgcgtcgggcgacacccggtaccgcaccgagctcccaccactgcggacccgggaccgcaagggcggggcgtcggtggcgggagccgcgctgccggcgagcgtgttcgccgcctaccggcacgccgaggcggagctcacgcgcaccgcgcccggctgccggctgcgctggcagttgctggccgcgatcggccaggtggagtccgggcaggcgcgcggcggtcgggtgacggcggacggtacgaccctggcgccgatcctcgggccgcggctggacggcggcgccttcgccgtcgtgcgggacaccgacggcggcgcgtacgacggggacccggcctacgaccgggcggtcggaccgatgcagttcatcccgtcgacctgggcccgctggggcacggacggcaacggcgacgggcgggccgacccggacaacgtcttcgacgcggcgctcgccgccgggcgctacctgtgtgcgggcgggcgagacctctccgacccggccgaactcgaccgggctgtcctcggctacaaccactcggaggcgtatctgcacacggtcagggcctggtacgcgtacttcctggaggggcaccgggtggtgtcggacagctccgcgaaggcgtcgacacgccccgagccgtcgcagccgaaacccacgccgaagccggcaccgtccccccgccccagagccttcccgtcccggactccgtccgcgcctgcctcgccggcccccaccaggtcacgttcggcgggcggggccgaggggaccgagcagccccaactcccccggcccggcacggacatcgagctgcccggcgacgacctgctgcccagcgacggtccgctgaccagcaacggtgtgaactcgatggcctcctccccctccacaaccgcggatactgggcgg

SEQ ID NO: 5882 - DNA, 1908 bp, Streptomyces avermitilis
  CDS (1)..(1908)
atgaccacgtccgacggcaccgttcagggccacacccagatcttcggatccgcgccgcgcaaccgggccttcaccgtcgtactgctcggtgacgggttcaccgccgcccagcagaccgacttcaacaacgcctgcgcggccttcgtcaccgcgttacgcgccactccgccctacgacgagctctcgccggccatcaacgtctggcgggtcaacgtcgcctccaccgactcgggcgccgacgatcccgccgcggccggcggcaccggcgcgacggcacgcacctatttcgacgcgagtttcggcggcaacggcatccggcgcctcctcatctgcaacaactcgacggtcctgacgacggccgccgcgcaggtgccggagttctccgtcgccatcgtcgtcgtgaattccacggtctacgggggcagcggcgggtccgtcggcacgtactccctggccggcggcgcgacggagatcgccctccacgagatcgggcacaccgcgtacggtctggcggacgaatacgcgtactacgccggcggcaacgagaccgggcacgatcaccatccggcgggcgagccggccgagccgaacgtcacactcaacacccaacgcgcttccctcaagtggggctgggcggtcgccgcgagcacggccctgccgacgatgagcaacccggactgctcgaccgtggacggccgggcgagcacggttcccgccgggacggtcggctgcttcgagggtgcgcactactaccactgcggcgcgttccggcccgagtacgactgcaagatgcgcgcgctcggcatcccgttctgccgggtgtgccggcaggtgatctggaaccggatcggcccgctcgcgacgctgcccgcccgtccccgcacaccgatcagcgtcgtcgcccgctatcccgagcatctcgacgtcttcgcggtggcggcggacgggcgcaccatgtccgactggtgggacgcgggcagtggctgggccggctggttccaggtctcgggcgggctcgcctcgcccggcggagcgggctctccggtcacctcggtggcgcggtacgcgggccatctcgacctgttcgtcgtcggcaccgacagccgggtctacagcacctggtgggaccagtcgagcggctgggccgcctggttccgggtcggcacgctcgtcgcgcggcccggttcgacggtcaatgtcgtcagccgttacagcgaccacctggatctgttcaccaccgggtccgacggccggacgatgtcgacgtggtgggacgcgcgtaccggctgggcggcggactggttccacgtcagcggcggtgtcgcggcgaacggcgcgaccgtcaccgccgtcgcgcgccacccgttccacctcgacgtgttcacggtggggacggacaaccgggtctacagcgcctggtgggacgagcgcagcggctggtcggcgtggttcgcgctgccgggcatcgtctgccggccggactccaccgtgaccgcggtggcgcgccatcgcgaccatctggacctgttcaccaccgcgtccgacggccggatcatgtcgacgtggtgggacgcgcgcagtggctgggccccgtggttccaggtgtcgggcggtgcggcgtcggcgggctcgcccgtgaccgccgtggtgcgctacacgaaccacatggacctgttcgtcgtcggtactgacaaccggatctactcgacctggtggcacgacaccacggggtgggccgcctggttcaacgtgtccggcggcgtcgccaagcccggcagccaggtcgcggcgctgtcccgggtcaccgaacacctggacgtgttcgcggtcggctcggacggcctcgtccacagcgcctggtgggacgcgtcgggcggctggtcgggctggttccagctcggcatcacc

SEQ ID NO: 5883 - DNA, 555 bp, Streptomyces avermitilis
  CDS (1)..(555)
atgagcacggcggggcgagttcccggccgcggacgggtgtcgccattgccctgtatgtcgcgggcgaggagcatcggcggggagccgagtcccagctggaggatccgcatggcagcaccgcagcagacgcccgcctcccccgccgtccgtctgatcttcgagtacgagggcgatacggtgcgcctcgtctcccaacaaccggtcgatgcggtgatcagtggcttcgacgccccgcccgaagtgcgtcccggcaacttcgtggaggtacgggacgacagtgggcggcgtctcgcccgcgtccccgcccgcggcgccttcgtggagagcgccgaggtcttcccggaggaccacgcggagccgatcacccgggtcgacgtggaggcccggggggcgttcacggtgatcctcccggcaccggccgcggccacccaggtcgccgtcgtccgggtcgcgccgacgggtcccgaggagggtgtggcgccaggcggcggcgccaccagtccaccgccgggagcggcgccggccgtcgacctcgccaccttccggctcgagcgg

SEQ ID NO: 5884 - DNA, 1449 bp, Streptomyces avermitilis
  CDS (1)..(1449)
ttggcgggcgcggctgagtcttctcgtcgacatcgagccgacgaaagggtccctgtgctggactacgtttcccccaaaggccgtcgtgcggttgccgtggccaccggagtgcttacgctcgccatcatgggaccaggtacgggaagccaggcgcgggcggcgagtttcggcacccccggcatcacactgtccgcggcgtatctgtccggcgcggtcggcgcggccggggacccggccgtgaccgtgaccgtcgcgcagagcggtgccgacgccggggcgctcacggtcaccgtcaccaagagcagcaggacctccgtggccacgaccgccgacgtcgccgtgaccggcaccggcgccacccgccgggtcgccgtcgccgcccgcggccagggctacaccgacctcacgctcaaggtcaccggcgtggacgggcagagcgcctcgaagaccctgcactacgcggcgtccgccgccgtccagcacggcgccgacacccgctacttcaccggttccagcgacgcctcggccgccgtcgacgtgggcgggggccacgtggtggtcgcggacgacgagtccaacgtccttcgtctgtacgaccgttcggtgtccggcgcgcccctgaagacctgggacttcagctcgcggatcggggtctcgaaggaggtcgacatcgagggcgccgcccgcgtcggcgacacgatctactggaccggctcgctcggcaacaacaaggacggcgagtacaagtccgcccgcaacacgctgttcacgaccaaggtgaccggttcgggcgcgagcacctccctgtcgtacggcggctcgtacgcgaagctccgcgaggacctggtggcctgggacgaggcgaacggcgaccgctacggcttcgcggcgggcaccgcggacggccaagtgcccaagcagatcgacgggttcaacgtggagggcctggagttcgcgcccggctcgaccacgaccgcgtacctcggtttccgcgccccgctggctcccgcggtgccgggcggcagggcgctcctcgtccccgtcaccaacatcgacaaggtggcgacgggctcgtccgccgtcttcggtgcgccgatcgagctggacctcggcgggctttcggtccgtgacatccgtaggaacgcggcgaaccagtacctgatcctcgccggttcctgggccgccgacgacaactccgacccgtacgccctctactcctgggacggcgtcccggcgcacgccccggtcaagcgcctcgacctgccgaccagcgatccgggcggctgggagtcggtcgtcgacgtgcccgacctcaccgtgtccggggcccgcgcccagctgctcaccgacgccggctcggcggacctgtacggcgacggcacggaggccaaggacctcacccacgacgagtggaagaaggcgcggacgacctggttcacggtcacgaac

SEQ ID NO: 5885 - DNA, 351 bp, Streptomyces avermitilis
  CDS (1)..(351)
atgagtgatcagggcatggctccggacgcatccgccgacccctgggggtcgatcgaggacctgcactcctggctggacgcccaccgggcgcacggcggtcaggagggcctcctgctgcgcgtgctgaagctgtcggaggaggtcggcgaggtcgcccaggcggtgatcggggcgacgggccagaacccgcgcaaggggacgacacacacgtgggaggacgtgcaggcggaactgtgcgacgtggtgatcacggcgatggtggcgctgcgcacgctcggcccggacgcgcgggacgtgttcgccgcgcatctggcgagggttacggagcgatcgctgggaccccgaacccct

SEQ ID NO: 5886 - DNA, 543 bp, Streptomyces avermitilis
  CDS (1)..(543)
gtgacctgtttcgaccgaagtgatctgggactgctgctgctccgtctgggcaccggcggggtactggccgcgcacggagcgcagaagctgttcgggtggttcggcggggccggactcgagggaaccggtcagttcatggagtccgtgggctacgcgccggggaaggcgagcgccacggcggcgggactcgccgaggccggcgggggcacgctcctcgcgctggggctcgcgacccccgcggcgggtgcggcggcggccggcgccatggtgggcgcggcggcggtgcatgcgcccaacgggttcttcgcgcagagcggcggctacgagtacgccgcgaccctggccctgttgggggcgggtctcgcggtgacggggccgggacggttgtccgtggaccatcggctcggtcacgccgtgaaccgcgggtggatggttccggtggcgctgggtgtgacggcggcgggcacggcggtggtggtgggggcgcgcaacaagcggctgcggcgggcggcacagggcgagcaggagatgctgttcgaggag

SEQ ID NO: 5887 - DNA, 324 bp, Streptomyces avermitilis
  CDS (1)..(324)
atgacgattcaggtagcgaaactcagtgacccggccgtccgggccttcgtcaccgcggtgaacgcccacgaccgggacgcgttccaggccctcctcgcctccggcgcgaccatgtccgacgacggggccgaccgtgacctcaccgactggaccgagcgggagatcttctcctcccacggccacatgaacgtcgacaacgagtccaagggcggccgcgccctcatcgcccgctaccgcaacgacacctggggcgagatgcgcacgaagtggagcttcgtcgtcgaggacaacggccggatctcccacttcgagaccggtcaggcc

SEQ ID NO: 5888 - DNA, 738 bp, Streptomyces avermitilis
  CDS (1)..(738)
atgtacaagctcaccggcgtcaccaagcgctacacgcggggcaaggagacggtggaggcgctgcgcggcatcgacctcgtcatcgaggacggcgaccagctcgtcatccagggccccacgggcggcggcaagtccaccctcctccagatgatcggcggcctcgaccgtccgtccgccggcagcgtcgagctggacggcgtggacctcgcctccatcagcgaggccaagctgacccggctgcgcgccgagaagatcggcatcatcttccaggcgttcaacctcattccgacgctgaccgcgcaggagaacgtcgagaccgcgctcgtgccgctgggtgtgaagcccgcggagcggcgcgagcgggccgcggacgcgctgcgctcggtgggcctcggcgagcggctcagccatgttccgaccgagctgtccggcggtcagcagcagcgtgtcgccatcgcccgcgcgctggtcaagaagccgaaggtgctgctcgccgacgagccgaccggcaacctcgacgagggcacccgcgacgacatcatgggcctgctcgaagggctgtggcacgagtacgggctgacgttcatcatggtcacccacgactcgtcgatcgcccgccgggcaccgcgcctggccaccatcaaggccgggcagctcacactgaccgagcagggcggcgggctgcggcgcgccgcggcaccccagtacgccgagcagggcggcggcccgtacgggcag

SEQ ID NO: 5889 - DNA, 1455 bp, Streptomyces avermitilis
  CDS (1)..(1455)
atgtttggcatctatctcaagcgcgagctgagccggcgcaagaaggcggctctggtcatcgccatgggtctggcgctcggtatcgccctggtcatcaccgtcaactcggtgtcggccggcatgcagcaggcacaggacaaggtcctcaagtcgctgtacgggctcggcacggacatgaccgtcaccaaggcccaggcggcgccctccggcaacgcctcgggcagacccaagttcgacttcgacgccaagtcggacagcagcgacacccagagctcggaccgggtgatgacgcagggcggtcaggccctgaagtcctcgctcgtcgagaaggtcgcggcccagaagggcgtggcgagcgcggtgggcgcgctgagcctgaacgtcaccaaggtcgacggttccttcacccagggcaaggcgaagtcgtcgaccacccagcagcagggcggcggccagggcggtcccggcggcggcaccagcaccggccagccgcaggtgcagggcggcggcgcctccttcgacgtgaactcgtactcggtggccggcgtcgacgtcacccaccaggacctcggcccgctcgccacgtcgaagatcaccaagggcaagacgttcacgacgtcgcagaccaacgcgaaggtcgcggtgctcagcaagtcgtacgccaaggagaacaagtacacggtcggcaagaccatcaagatctccggcaccaagtacacggtcatcggtatcgcgacgcccgacagcagcgagtcgaccaccgacgtctacctgccgctgaagcaggcgcagacgctcggcgactcgaagaacaaggtcaccacgatctacgtcaaggcgaccgactcgaagcagatcgacaccgtcaagacgaccatccagaagaacatcgacgggacgacggtcaccacctccgccgacctcgcggacaccgtctccggttcgctgtcgacggcctccaacctggcgaccagcgtcggcaagtggctgtccatcgcggtcctcgtcgccgcgttcctcgtcgccgcgctgctcacctcctcggcggtcagccggcgcgtccgtgagttcggcacgctgaaggcgctcggctggcccagcggcaaggtcacccggcaggtcgtgggcgagtccatcgtgaacggtctgctcggcggcgccctcggcatcgcgatcggtctcgcggcggcgtactcggtcaccgcgatcagcccgacactgaccgcgcagctcggctccggcgggggcgctatgggcggcggtcccggcggccagggcggtcccggccggcaggccgcgtccaccaccatggacatcgcgctgtccgcgccggtctcgctgaccaccatcgcgctcgccgcgggcctggccatcgccggcggtctgatcgccggtgcgataggcggctggcgcgcctcccggatgcgccccgccgacgcgctgcgcagcgtccag

SEQ ID NO: 5890 - DNA, 1338 bp, Streptomyces avermitilis
  CDS (1)..(1338)
atgaccccgcctttgccatgcctttgtcaccccgctgtgggacgccacggactcactttgtacggtccccgaatgcgtgactcctcccgcctctcccgtcgggccgtcctcggcctcgccgcggccgcgcccctggccgccgccgcccccgcgtccgcgtccgccgcaaccgtgatcggcggtgaacggctcggccgctccggtgtccaggtgagcggcgcctcgggcctgcccaagaagctgaccgcccgcgcctggctggtcgccgaccacgagagcggcgaggtgctcgcggcgtacaacgcgcaccggcggctcgcgcccgcgtccacgctgaagatgctgttcgcggacacggtgctgaagaagttcgagcgcgccgagcggcacacggtgaccgcggacgacctggtcggcatcccggcgggctccagcctcgtcggcgtccaggccggaacgacgtacaccgtcgagcagttgtggctcggcgtcttcctgcgttccggcaacgacgcggtgcacgtgctcagtcacatgaacggcggtgtcgccgagacggtcgcccagatgcaggccaaggcggaggatctgcaggccctggacacccatgtggtgagcccggacggcttcgaccacaaggggcagctgtcgtcggcgtacgacctgacgctcttcgcccggcacggtctcgccgacgccgacttccgcgactactgcgccacgcggaccgccgacttcccggccggccggaagaagaccttccagatccagaacacggaccgcctgctgaccggcgcgtggggcatggagacgtacgacggtctgatcggcgtcaagaacggttacaccagccacgcgggcaacaccttcaccggcgccgccacccgcggcggccgcacgctgctggtgaccgtgatgcatccgaagtccggcggcaacggcgtctacgaggagaccgccaagctcctcgactggggcttcgcacacgcggcgagtgccaagcccgtgggcacgctggtcgatccgatcagtgagggcggggccaccgcgacggcgaccccgagcgccgcggcggccaagccggcggccggggcgcgggcgtccacggccggcgggcactcgtcgtgggggctggtcgccggggccgggggagcggtggcgctgctggcgggcggggcggtcgccctgcgcacccgccggcgcaggacggaagccggcgcggagacgaggacgaagacgagggcgaaggcgaaggggaacgcgaagggggaagggaaagcgaaggcggcggcggagaaggagccgggggcgggggagacgaacggccgggcccggcgc

SEQ ID NO: 5891 - DNA, 819 bp, Streptomyces avermitilis
  CDS (1)..(819)
atgccggaccgcccggcctgcgtacgcacagcccctcccgcccctcccgtacgctgcgggcccatgaatgccatgcagacgaagatcgcggtggtgaccggggcggggtccggaatcggccgtgccgtggcggcggaactgctgcgcaccggctggtcggtggcgctcgcgggccgtcggccggacgccctggcggacacggcggcgctggtgcccgagggcgactccctggccgtacgcaccgacgtctcgcggccggacgacgtggcggcgctgttcgcggccgtgcgggagcggttcggccggctggacctgctcttcaacaacgcgggtacgttcggcccgggcggggtgccggtcgaggagctgtcgtacgacgcctggcgccatgtcgtggacacgaacctcaacggcgcgttcctgtgcgcgcaggcggcgtaccggcacatgaaggagcaggacccgcagggcggccggatcatcaacaacggctcgatctcggcgcacacgccccggccgcagtcggtcgcgtacacggcgaccaagcacgcgctgacgggcctgaccaagtcactgtccctggacgggcgtccgtaccggatcgcggtcggtcagatcgacatcggcaacgcggcgaccgacatgaccgagcggatgcggagcggagttctccaggcgaacggggagttggcggccgagcccgtcatggacgtggccgatgtggcgcgcacggtgcgacacatggccgaactgccactggaggcgaatgtgcagttcgcgaccgtgctggcgactgcgatgccgtacgcgggccgcggc

SEQ ID NO: 5892 - DNA, 1644 bp, Streptomyces avermitilis
  CDS (1)..(1644)
atgacacccgcaggccaccagcatccgtctcagcacgcccccgaactccgcgccgccgcccgtcacctcgggcgccgccgtttcctcaccgtcaccggcgcggccgccgcgctcgccttcgccgtcaacctgcccggcgcgggcgtggccggcgccgccgagttcgacgcggcgaagctcaccgacgacccgttcaccctcggcgtggcctccggcgacccgctgcccgactcggtactcctgtggacgcggctcgccccggcgccctaccaggccgacggcggcctgcccccggaacgcgtcgccgtgcgctgggaactggcccacgacgccaggttccgccggatcgtcagacgcgggaccgcgacggcacaccccgagttcgaccacgccgtccacgtggaggtcggccacctcgaccccgaccgggtcctctactaccgcttccgggccggcggctgggtcagtgagaccggccgcacccgcaccgcgcccgccacccgcgaccgggtcgccggcctcaggttcgccgccgtctcctgccaggcctaccacgacggctacttcaccccgtacgggcatctcgccgaggacgacgtcgacgtcgtcttccacctcggcgactacctgtacgagtacgcggtcaactcggccggcggcgcccggaagtacaccgaccgcgtcctgcccgacctcttcaaccacgagaccacgacgctggaggactaccggctgcggtacgccctctacaagtccgacccggacctgcgggccgcccacgccgcgcaccccttcgtcgtcacctgggacgaccacgagaccgagaacaactacgccggcgacatcgacgagaacgaggacccgcccgaggagttcctgctgcgccgtgccgccgcctaccgcgcgtactgggagaaccagccgctgcgccgcccccagctgccggacggaccggacgcccggatgtaccggcgtctgggctggggccgactggcccagttcgacatcctcgacacgcgccagtaccgctccaaccaggcgtacggcgacggagcgcacgtccccggcccggagtcggacgacccggcgcgcaccatcaccggcgcgacgcaggagcgctggctgatcgacggctggcgcgactcgcgggcgctgtggaacgtcgtaccgcagcaggtcaccttctcgcagcgcaagctggacctgaacgccgccgccaaggtgtccatggacgcctgggacggctaccgggcctcgcgcgaacgggtcctcgccggggcgcagtcggccggcgtcgagaacctgatggtgctcaccggtgacgtccacgtcgggtacgccttcgacatcaaggacgacttcgacgacccgtcgtcggcgacgctcggcacggagatcgtggcgacgtcggtctccagcggcaaggacggcgccgagaagccggcgaactggaacacgtacatgaccgccaacccgcatctgaagttctacaacgggcggcggggttatgtgacggtcgagctgggccgggaggcggcgcgggccgacttcaagacggtgtccgccgtgacgacgcagggagcgccgctcacgacggccgcgtcgttcgtgaccgaggtgggggagcaggggttgaagccggtg

SEQ ID NO: 5893 - DNA, 1005 bp, Streptomyces avermitilis
  CDS (1)..(1005)
gtggacatgtccagcgaacgtgtgcggtgggggattctggccaccggagggatcgcggcggcgttcgcggcggatctggtggatctgccggacgcggaggtcgtggcggtggcctcgcgcagcgaggagtcggcgaagacgttcgccgaacggttcgggataccccgggcgtacggcgagtggggcgccctcgccgaggacgaggacgtcgatgtcgtgtacgtggccaccccgcactcggcgcaccgggccgccgccgggctgtgcctggaggccgggcgcggtgtgctgtgcgagaaggcgttcacgctgaacgcgcgcgaggcggaggaactggtcgcgctcgcgcggcggcacgacggcttcctgatggaggccatgtggatgtactgcaatccgctggtgcggcggttgaaggcgctggtggacgacggggtgatcggtgaagtgcgcaccgttcaggcggacttcggcctcgcgggccccttcccgccgtcgcaccggctccgcgaccccgcgcagggcggcggagcgctgctcgatctgggcgtctatccggtctcgttcgcgcagttgctgctgggggagccctcggacgtcgcggcgagagcggtgctctcggaggagggcgtcgacctccagacgggagcgctgctctcctgggagagcggcgctctcgcttcggtgcactgctccatcagcggtggtacgcccgtctccgcctcggtcaccggttccgcgggccggatcgacatcccgcacggcttcttcttcccggaccgcttcgtcctgcaccgggacggccgcgaccccgaggagttcacggccgacccggcggccggcccccgcaacagcctcaagcacgaggcggcggaggtgatgcgtgccctgcgtgcgggcgagaccgagtcgccgctcgtccccctggacggcacgctcgcggtgatgcggacgctggacgcgatacgggaacgggtcggggtgcgttatcccggcgaggggcgc

SEQ ID NO: 5894 - DNA, 1437 bp, Streptomyces avermitilis
  CDS (1)..(1437)
atgcccgagcggggccgtaccacgcccggccaggaaggcccggcgggggacataccgaacacggcggtcgccgccccggcgcccgtaccgtccccgcgggcccggcagcccgcgcacacaccgtccccgaaggcgccgcggcccccgcggcagccgtccggtacggcgcgcggcgcggccctgcgccgtaccggtctcctcgtcacgttcgtgctcggcgggctcaccgccacgccgccgctggccatggacatgtacctgccgtcgctgccggaggtcaccaggtcgctgcacgccccggccgcgaccgtgcagctcaccctcaccgcgtgcctggcgggcatggcgttcgggcagctcgtcgtcgggccgatgagcgacaagtggggacgccggcggccgctgctcaccgggctcgtcgtctacatcgtggccaccgcgctgtgcgcgatcgcgccgaacgtcgaactgctcgtcgccttccggctcgcgcagggcctcgcgggcgccgccgggatcgtgatcgcgcgggccgtggtgcgcgacctgtacgacggcgtggcgatggcccggttcttctccaccctcatgctgatctccggggtcgccccgatcgtcgctcccctcatcggcggccagatcctgcgcgtcacggactggcggggcgtcttcgtcgtcctcaccgtcgtcggcatcgcgctcaccgcgctcgtgtggaccaggctccccgagaccctcgaccccgccgaacgccacgacgggggcgtcggcgaggccctgcgctccatgcgtacgctgctcgccgacgccgccttcaccggctacatgctcgccggcggcttcgccttcgccgcgctgttcgcgtacatctccgcctcgcccttcgtgatccaggagatctacggcgcctccccgcagaccttcagcctcctgttcggcctcaactccgtcggtctggtgatcgccggtcagatcaacggcaaggtcctggtcggccgggtcggtctcgaccgtgtcctcgcggtcggcctcggcgtcatcacgctcgccgcgaccgccctgctcctgatgtccaccggtgtcttcggccacgtcgggctcgccccggtcgccgccgcgctgttcgtcctgatgtcggcgatgggcctggccctgcccaacacccaggccctcgccctgatgcgcacccggcacgcggccggctccgcgtccgccctgctcggcacctgctccttcctcatcggcgcggtcgcctcgccgctcgtcggcatcgcgggcgagcacaccgccgtcccgatggccgtcgtccaactggcctcggcactggtggccgtcgcctgcttcatggcactgtgccgtccctggaagaggcgtgcgagcgagcagggtggggggacccccggcccgagcgcggccgagagcgtgggggaggacagc

SEQ ID NO: 5895 - DNA, 1047 bp, Streptomyces avermitilis
  CDS (1)..(1047)
gtgcgcggcctcaccgagggcgagcgcccctgggcggcgggcgccgtggtggtcgccggacgcggtccggtgatcgccgtggaggaggcggcggggtgggcggtgcgctatgcggcgtacgacgagaagaaggacgcgggcgtcgaactgccgcccgcggcacgggtgccgatgaccgtgcacacgcccttcgacctggcctcgctcaccaagctgttcaccgcggtcgccgcgatgcagcagctggagcgcggcacgctcggcatcgacgcgcgggtggcggcgtacctgccggagttccgcgcggccgcccagcacggcatcaccgtacggcagctgctcacccacacctccgggctgcggcccgaactcccgctctacgactgcccctcggacgcggcgcgcctcgcgctgctgcacgccgaaccgccgacgtcggagccggggacgtatcgctactcggacctcaacatgctcctcctccagtacgtcctggagcgcatcaccggccgctcgctcgacgtcctcgtgcgcgacggcatcacccgcccgctggggatgaccgcgacgggcttcgggccgtgcccgggggcggcggcgacggaggaccagcggcggccgtgggcgaaggcggaccgcgggatgctgcggggcgtggtccacgacgagaacgcctgggcgctcggcggagtggccggccacgcgggcctgttcgccacggcccgcgatctggcggtcttctgccgcaccctcctcgcgggcggctcgtacggccccgcccgcatcctcggcccggacttcgtcgagctgatgctcgcgccgccgggcctgggcttcgccatcgaccagccgtggttcatgggcgcgctggcgtgccggggcgcggtggggcacacgggcttcaccgggacgtcgctggtcctcgacccggcgacggacacgttcctggtgctgctggccaacacggtgcatccgcgacgccggccggcggacagcgggccgcgggcggcggcgggcacacggctggcccgagccgtgcgcgggacc

SEQ ID NO: 5896 - DNA, 996 bp, Streptomyces avermitilis
  CDS (1)..(996)
gtgaacgcccccgcctccgcaaccgacacgctgcgctccgccctcgccgggctgctcgccgggctgccgccgaagcaggccgcccaggcggtggaccggctgatcgccaactaccgggggcggaccccgacgcacgcgccggtgctgcgggaccgttccgacgtggccgcgtacgccgcgtaccggatgcccgcgacgttcgaggcggtgtgcgcggcactggacgcgttcgcggacgcggtgccgcagtggaccccggcgagccatgtggacatcggtggcggtaccggcgcggcgacctgggccgtgagtgcgacctgggacggcgagcgcccggtcacggtcctcgactgggccgagcccgcgctcgcgctgggccgtgagatcgccgccgcgaacccggcgctgaagtccgccgagtggcagcgctctcgtatcggagcggcgctcaccgtcgagagcaccgatctcgtcaccatctcctacgtcctcggcgagctgaccgaggccgaccgcaccgtggtcgtggacgccgccgcggccgccgcccaggccgtcgtgatcatcgagcccggcacgccggacggctacacccgcgtcatcgacgcccgtgagcgcctgatcgccgccggcttccgtatcgccgcgccctgcccgcacagcgccgcctgccccatcgtccccggcgaggactggtgccacttctccgcccgggtcagccgctcctccctgcaccgccaggtcaagggcggctccctgccctacgaggacgagaagttcagctatgtcgcggccgcccgcttcccggtcgcaccggcgcccacccgggtcgtacgcaagccgcagatccgcaagggccaggtgctcctcgatctgtgcggcccggacgagtccctccaccgcgagacggtgacgaaacgtcatgggccgctgtacaaggccgcccgggacgcggagtggggcgacggctggccgcccccggaggacacctccacc

SEQ ID NO: 5897 - DNA, 657 bp, Streptomyces avermitilis
  CDS (1)..(657)
atggtcaagaaagccgtccccgactccacccgccgcagtacgaggtcccgtcgcgcgatctacgacgccgccctcgccctcgtcggcgaggtcggctacccgaggaccacgatcgagggcatcgccgcccgtgccggcgtcggcaagcagaccatctaccgctggtggtcgtctaaggcggaggtgctcctggaggcgttcacggacctgagcgcccaggccgccgaggccgcggcccggcccggcccggaggagggcggccaggagggcggccagggggagaacggcatcccggacaccggcgacctcgcggccgacctcaagctcgtcctgcgggccaccgtcgatgaactcctcgatcccaagttcgacatccccgcccgggcgctggccgccgagggcgtggtcgacgaacaggtcggcgccgagttcgtgaccaagctcctcgaaccccagctccagctgtacgtgcggcggctgcgctccgcacaggagcacggcgacgtacgccccgacgtcgacccgcgcatcgcgctcgaactcttcgtctccccgctcgcccagcgctggctccagcgcaccggcccgatcacccacgcctacacggacaccctcgtcgactacgccctcaacggcctggctccgcgccggccgtcc

SEQ ID NO: 5898 - DNA, 888 bp, Streptomyces avermitilis
  CDS (1)..(888)
atggtcacatggatcacgctcacgggtgtcgggctcgcgggtctcgccggtctcactccgccggccctcaccggacacggcggcggccccgccccgctggagtggggcaccggcccgctgacggtggcctccctgccccgcgtcgtccaggtcgcccatcgcggcggcgcccgcgaggtgccggagaacagcatggcgggcctgacggcggcgtacgcgcgcggtacggcgcaggtgctcgacctcgacacccgcatgctgggcgacgggaccctggtggtgctgcacgacgcgaccctcgaccgcaccacggacacccacggcccggtgcgggaactgcggctcgccgactggcggaaggtgcgggtgcgccccgagggcagggttcccgggacctggcgggcggagcggccgccgacggtcgccgaggtgctggatcgtttcggcgggcgggtggtgctgatgctggaggccaaggacccgcagagcctcggcgcactggccgggctgatccgcggccgcggtctggcgcggtcggtgttcgtgaactccaaccggccggaggtggcccggcgcgcccacggtctcggcctggtcacccagctgtggcgctcggcggagcagctgcgcaccgaccggcccgcgcgctgggcgtcgtacgtggatctgctcgacgtcgaccacaaggcgcgggacgccgatctcgtacgggccgtacggtccgggatcccccgggtgtgggcgcacacggtggtgacgcccgcccagcgcgaccgggtgctcgcgctgggctgcaacggcgtcgtcacggacgcgccggggcggctggcccgccacccggtgaagcgcccgaaggggttcaggacggccggcgcggagccaggccgt

SEQ ID NO: 5899 - DNA, 726 bp, Streptomyces avermitilis
  CDS (1)..(726)
atgagcgcagagttcggccgccgcacgagcgggcagggcaggatctcccagtggctgcgtggacgccgcccgaaggaggccgccgacaacgccggtggccgtgaggccctgctgctcgccgctgccgacgccgggctgccgctcgcgccggccgcgcatccggccggctaccgctgttcctgcgaccgggtcggctgtcccacgcccgcccggcaccccgtctccttcgcctggcagacgcagtccacgaccgaccgcgcccagatcgagcgctgggccaggcaccagccgcaggccaacttcatcaccgccacgggcatggtgcacgacgtgctcgacctgccgcgcgaggcgggcgacgaggccctggagcggctgctcgcctccggcatcgaggtcggcccggtcgccgcgacgggcgacggacggctgctcttcttcacgctgacgcgcggtacgccggaggacgaggacgagtggtggccctgcgagctggactgccaccccgagacgatggacgagcatccgggcctgcgctggcactgccggggctcgtacgtcctcgtaccgcccgcccagctgcccggtgatctgacggtcgactgggtacgagggcccgagcaccccctgcccgacccgctgaccctcctcgaagtcctcacggacgcgtgcgcccgctacgcgggagccgacaccgaccggctcgccgcctggccgcaccagggc

SEQ ID NO: 5900 - DNA, 1068 bp, Streptomyces avermitilis
  CDS (1)..(1068)
ttgaacccggcgtccgcgcgtttccccgccccggtagggttcgcctccgggaaggggaaggtgaagtacctgatgagcagggatcgcggggctcgcgggcttcgtaagtacggccggttcgccctggcgaccggcgcggcgaccgctttgtccttgacggcgagcgggtgcgtggtggtgcacggcgagcgggaggtcctcccggcggcgaagaagagcgaggccacgcgtgccctcgccggcttcctcaccgcgtacaacaaggcacagaaggcaaacgaccgttcgctggacgcgggccgggtgaccggtgccctcgccgacatcgacggagcgaagctcgaggccggccacaagaccgccccggccgggaacacggactacacgccgctcaagctgaccgacgcgaagttcgccattcccgcgaaggcgggctggccgcgctggttcgtcgccgacaccgcctccaaccgcgacaagaaccgctgggttctggtcttcactcgcggcagcgcgaacgacgtgtggcaggtgtcgtatctgacggccctcgcgcccgccgacgtgccgcggttcaagaaggacaaggacggctgggccgagcccgtcacggcggacgacgcggcgctcgccgtacgcccccagaagctcggtgcggcctacgcgacgtatctgaagagcggcggcgacacgttcgcggacggccggttcacctccgggctgcgggcggggcgcaagaagaacgcgagcaagccggggctggcgcgccagtacatggacgagccgctgaactccggcgaccacgccccgctggggctgcgcaccacggacggcggggcgctggtcttcttcgtcacgcaccactacgagaagcagacggccgcgcagggcgtgaacatcacggtcaacgacccgaacatcaaggccctgatgacgggtgaccccaagcagtccctgaccatggagttcgtctcgaaccaggcggtactggacccggcgaagggctccggcgaccaacgggtgacgttcctgagcaaggtggcgggactgacggcggcgaagggcgag

SEQ ID NO: 5901 - DNA, 864 bp, Streptomyces avermitilis
  CDS (1)..(864)
gtgctttccaactatctgatcggcctgcgcgaggggctcgaggccagcctcgtcgtctgcatcctcatcgcgtacctggtcaagacgggccgccgggacgccctgcggccgatctggatcggtatcgccgtcgccgtcaccgtcgccctcggcttcgggtgcgtcctcgaattcggctcccaggaaatgacgttcaaggcccaggagatgctcggcggctcgctgtcgatcgtcgccgtgggcctggtgacctggatggtcttctggatgcggcgcaccgcccggcacctgaagtccgaactgcacggcaagctcgacgcggcgctggcgatgggcacgggggcgctggtcgcgaccgcgttcctggcggtgggccgggagggcctggagaccgccctgttcgtctgggcgtcggtgcacgcggcgagcgacggcaccccgcgcccgctgatcggcgtcgccctgggcctggccaccgcggtcctcctcggctggctcttctaccgcggcgccctgaggatcaacctcgccaagttcttcacctggaccggcggcatgctcgtcgtggtcgccgcgggcgtgctcgcgtacggcgtccacgacctccaggaggccgacctggtcccgggtctgacgaacctggccttcgacatcagcgccaccatccccccggacagctggtacggcaccctcctgaagggcgtcctcaacttccagccggacccgacggtcatccaggtcacggtgtggctggtgtacctgatcccgaccctcgcgatcttcctcgcgccgtcgggcctcctctcccggaaggggaacgggaagggggaggcgcagtcgcctcccgcggtccgcgaggaagtg

SEQ ID NO: 5902 - DNA, 1296 bp, Streptomyces avermitilis
  CDS (1)..(1296)
gtgagcgaggcccccatgacggacaccacgaacaccaccgaaaccaccgcagaggacgcgggcgcccctgccccgtcccggcgttcactgatcggctggggcggcgcgggcctcgcgctcggcgccgccgcggccggcggtgcggtggccatggcccgcaccggcaacgacgtggacccgaccgccgccgagacgggcgccgcgatcggtttccacggcgcgcaccaggccggcatcgccacgccggtgcaggaccggctgcacttcgccgcgttcgacgtgaagaccgacgaccgcgccgcgttcgtccagctgctgaaggactggacgcgggccgcggcccggatgaccgccgggcacgcggtcggcgagggcgcgtacggcggcctggccgaggcgccgccggacgacaccggtgaggcactgggcctcaagccgtcgcggctgacgctgacgatcggcttcggtccttccctgttcgagaagttcgggctggcggaccagcgccccgaggccctggtcgacctgccgaagttcccgggcgacaacctggagaagacccgcagcgacggcgacctgtgcatccaggcctgcgcggacgacccgcaggtcgcggtgcacgcgatccgcaacctcgcccgcatcggcttcggcaaggtcgccatccgctggtcccagctgggcttcggcaagacctcgtccacgacgccggacgcgcagaccccgcgcaacctgatgggcttcaaggacggcacccgcaacatcgcgggcaccgagacggaccggctgaagaagttcgtgtgggtgggcgaggacgacggtccccactggatgaccggtggctcgtatctcgtggcgcgccgtatccgcatgaacatcgagacctgggaccgcacttcgctccaggagcaggaggacgtcttcggccgggacaagggcgagggcgcgccggtcggcaaggccaaggagcgcgacaagccgttcctgaaggcgatgaagcccgacgcgcacgtacggctcgcgcaccccgactccaacgacggggccacgctcctgcgccgcggctactccttcacggacggcacggacggcctcggccgcctggacgcggggctgttcttcctcgcgtaccagcgtgacgtccgcaagggcttcatcccggtgcagcgcagcctgtcgcgcaccgacgcgctcaacgagtacatccagcatgtgggttcggcggtcttcgccgtcccgcccggcgtccgcgacaaggacgactggtggggccgcgcgctgttctccaaggaggcg

SEQ ID NO: 5903 - DNA, 1146 bp, Streptomyces avermitilis
  CDS (1)..(1146)
atgcgagccgtccgactctcagtcgtcaccgccgccgccaccgcggccgctctgaccgccgtcacgggctgcacggagaagagcaccgcctcgggcagcgacgcgatccaggtgaccgccgccgactccaagtgcgagacctccaccaagtcggtaccggccggccaggtcacgctgaagatcgagaacaagggctccaaggccaccgaggtcgagatcgtcttcccggacgaccggatcgtctccgagaaggagaacatcggcccgggcaccaagtacacgctgaccgccgaggtgaaggcgggctcgtacgagatcgcctgccgccccggcatgaagggccacggcgtccgccagaagctcaccgtcaccggcggcaaggtcgccaagcgggacccgcgcctggacaaggcggtcgccgcctaccgcgagtacgcgcaggagcaggccgacgagacgctgcccaaggccgaggcgttcgccaaggccgtcaaggcgggcgacatcgaggccgcgaagaaggagttcgcgacctcgcgcctgggctgggagcgcaccgagcccgtcgcggagtccttcggtgacatcgacccgaaggtcgacgtccgcgaggacggcctggaggacggtcaggatccggccacggactggaccggctggcaccggctggagaagtccctctggcaggacaagaagatcggcgaccgtgagaagaagctcgccgaccagctggtgaccgacctgaccgactggcagaagcgcgtcggcaaggccgagatcaccccctcctcgatggccaacggcgccaaggaactcctcgacgaggtggccaccggcaaggtcaccggcgaggaggaccgctactcgcacaccgacctgagcgacttcaagggcaacgtcgagggcgcgcagaaggcgtatgagctgctgaagccggtcgccaaggagaacgacgcggccctggcgacggagctcgacaagcagttcacggcgctgaacacgctgctcgacaagtaccgcacggacaagacctcctacgacttcacctcgtacgacaaggtcggcaaggccgaccgcaaggagctctcggacgcggtcaacgcgctcgccgagcccctgtccaagcttgccgccgcggtcgtgaag

SEQ ID NO: 5904 - DNA, 252 bp, Streptomyces avermitilis
  CDS (1)..(252)
atggggacagtctcaaggggcgggccggtacccgtcgagggcggcgccgggcaagggcgcacgccggtgatgcggtggtcgcggtggggcacggtccggggctcgccgtcgtccgcgcgcaccgggtcgcgattcggtgcgccgggcatgccgcggccgggggtccgtcggccgcggtcttcggtgagcggctcctcgcggcggtccaccgactttcttgactcccgcttgaccttcccatggggtctgttt

SEQ ID NO: 5905 - DNA, 873 bp, Streptomyces avermitilis
  CDS (1)..(873)
atggcaagggcacgcagggaagagcggccgcccggcggtctggtcctggacatcaggggccgccccggtccgccaccgttgcgcttcgaggcggcggacggccggatgctgctgcgccagggggagcgtcccgttctgctggggcgcgtggagccgccccgcgaaggcctgttcgtgcaccgcctcgacggctaccgctcgcccctgccgcccctccgctcggcgctgacgcgggacccgggccgcggcctgctcgaccagtacgcgcgatggctggaggactccgcgcacggcccgctccacgactcccgctggctgctgagcgaggcgcgctcgtttccgccgtacgtctggcaccacgacttcgcccggggctggcccggcatccacctcgactggtgcgggggcggctggcagggcgtcgtaccgctgcgccgcctctcgccgccggacgcgccgcgcgtgcgggcgtaccgcaagcacgcacgcgacggcacgttggcgccggtcctcctgtggtgggtgtcgtcattcgacggctggctgctcctcgacggacacgaccgggcggtggcggccctggcggagggtcgggacccggtgtgcctcgtgctgtcccgcgccccggacgacgaggcctggcggcggacggcggacgaggtgaccgcgagtcatgagcggcgggtggccgacctggcggaccgcccccgcccctgggcggaccggcagcgggccaccatggagcgcgcgtacggcgacgtcatggcgtggctgccgtacgaacacgcccccacccgctcctggcccctccccggcggccccgcggcctgggacgagctcgcggcgcgggtgatgtttgaatgccggagtgac

SEQ ID NO: 5906 - DNA, 642 bp, Streptomyces avermitilis
  CDS (1)..(642)
gtgactgactacgacgtactgcgtgtcttctgcggccccggcggcggatacggcaacgaactcggtgtcgtacgcgagggctcggtgctgccggagtgcgcggaccgccaggccctcgccgccaaactcggcttcagcgagacggtgttcgtcgacgaccccgagcgcggggtcatcgacatctacacgcccaccctgcggctgccgttcgccggacacccctgcgtcggcacggcctggctgctcgacgtgcccgaactcgtcacgcccgccggagtggtgggcacccgcctggacggcgagttcagctggatcgaggcacggccggagtgggcgccgccgcgcacgctgcgccagtacgcgacggccgccgaggtcgacgcgctgccggtgcctccgcccggcgagtgggtctacgcctgggcctgggaggacgaggccgcgggccgtgtccgcgcccgtgccttccccggccgcgacgacggcatcgaggaggacgaggcgacgggcgcggcggccctgctcctgacggaccgcctgggccgcgcgctcaacatcatccagggccggggctcacagatcctcacggcaccgcagccggcggggtgggtggaggtgggcggccgcgtcctgctggagcgc

SEQ ID NO: 5907 - DNA, 645 bp, Streptomyces avermitilis
  CDS (1)..(645)
atgaccgcgttctcgacgctcattcgcaccgcctcgcacgagcagcacgtggaggcggagacctcgacgttcatgagcgatctgctcggcggcaggctgggcgtggaggcgtacgcgcgctacaccgagcagctgtggttcgtgtaccgggcgctggaggagagcgcggagcgcctggcggaggacccggtggcggggcccttcatccagcccgagctgatgcgggtgccttcgctggagcgggacctcgcgcatctgcggggcgcggactggcggagcgggctcacggcgctgcccgcgacgcgggagtacgcgcggcgggtgacggagtgcgcgctcacctggcccggcggctacctcgcccaccactacacgcgctacctgggcgacctctccggtggccagatcatccgcgacaaggcggagaagacgtggggcttcgccaggaagggcgacggggtcaggttctacgtcttcgagcagatcgccaacccggccgcgttcaagcggggttaccgcgaactgctggacgggatccgggcggacgacctggagaagcagcggatcgtggcggagtgcaagcgggcgttcgcgctgaacaccggggtcttccgcgccctgggcgaggagttcccactgagcgcc

SEQ ID NO: 5908 - DNA, 855 bp, Streptomyces avermitilis
  CDS (1)..(855)
atgtctggccagtcgctgctcgtaccaggggagctctcccccacccgtcccgtacccggaaacatccggcgccccgagtacgtcggcaagcccgcgccgacgccgtacacgggcccggaggtgcagacgcccgagacggtcgaggcgatgcgcgtcgccgggcggatcgccgcacaggcgatggccgaggccgcgaagctgatcgcccccggcgtcaccacggacgaactggaccgggtcgcccacgcgtacatgtgcgaccacggggcctacccgtcgacgctcggctaccgcgggtaccccaagtcgctgtgcacctcggtcaacgaggtcatctgccacggcatccccgactccaccgtgctgcgggacggcgacatcgtcaacctcgacgtgacggcgtacatcggcggcgtccacggcgacaacaacgcgacctacctggtgggggacgtcgacgaggagtcgcggctgctcgtcgagcggacccgggagtcgctgaaccgcgccatcaaggcggtcaagcccggccggcagatcaacatcatcgggcgcgtcatcgagtcgtacgccaaacggttcgggtacggcgtcgtgcgggacttcaccgggcacgggatcaattcgtcgttccactccgggctgatcgtcccgcactacgacagcccgcacgcgacgaccgtcatccagcccgggatgaccttcaccatcgagcccatgctcacgctcggcacgcacgactacgacatgtgggacgacggctggacggtcgtgaccaaggaccgcaagcgtacggcccagttcgagcacacgctggtggtgacggacagcggggcggacatcctgacgctgccg

SEQ ID NO: 5909 - DNA, 234 bp, Streptomyces avermitilis
  CDS (1)..(234)
atggccctgttcaagaagcggacggtcggaaagcccggcgagtggtactactgcctggtccaccggaaggtcgaagagggccccgagtgccccgcgaaggaccgcttcggcccctacgcgagccgcgaggaggcggagcacgcgatgcagacggcgcaggagcgcaacctggagtgggagacggaccccaagtggcacgacgtgaacgagccggacgccgaggaggacaagccc

SEQ ID NO: 5910 - DNA, 606 bp, Streptomyces avermitilis
  CDS (1)..(606)
gtgcgtatggatgccgtacgggtcgcgttgctgcgcgaagtacttgccgggaccgagtggttgggcgccacccggcgcttcgcggggaccctgcggggttccgtggtgtcgcacgggggcggcctgctgctcgtgggcacggcggactacgagccgtggcatctggcggcgcatctggtggacgaggccgcctggtcggggacgccggagctgtcgccgacgctggtgcggcacggggcgcgggcctcggatccggcgcacctcgcggtgggcctgggccggatcgaggcggcgcggcgcggcgagaccctgctcgtggtgtctccgtccgcgccccaggcgccgctcctggagcgcatccacgacgcccggcgggcgggggcgacggtcctcgccctcgactccggcgaccgtgaactcggggcgatggcccatgagtccctctccgtaccgcccggtcccgagctcgacctcgacacggtccagcatctcgtcagtgccgcggcgggcgagaacgcgctgccgggtccccgcgggcaccggcggctgcgcgaccggttgtcccggctggccgaccatctgacggcaccgccgccggcacgctgg

SEQ ID NO: 5911 - DNA, 1071 bp, Streptomyces avermitilis
  CDS (1)..(1071)
atgacagaagccagtacaccgttccgcggcggccgcgaaggctatgccagttaccggatcccggcagtcgtcgcgaccggcgtgggaaccctgctcgccttctgcgagggccgggtcgactccgcgcacgaccacggcaacatcgacatcgtgctgaagcggtcgggcgacggcggccgcacctggggcccgctccaggccgtcgcgaagaacggcgacaacctcgcgggcaacccggcccccgtcgtcctcgacaccggccgggtcctcctcgtccatgtccgcagcgcggccggcgcgagcgaggacgccatcctgcgcggcaaggtgaaggccgccgacgggcggcgcgtatgggtccagcacagcgacgacgacggactgacctggtcgggcccgcgtgagatcaccggacaggtgcgcaaggcgaactggcgttggtacgccaccacacccgggcacgccctccagctcaccaccggccgcgtcgtcgtacccggcaaccacaccgtcccgcccaccggcacggacaacggcacggaggccaagtacaacagcgggcactgcctgctcagcgacgaccgcggcgcgagctggtacctcggctacctcgacgagaacaccaacggctacatcaacgtgaacgagacgacggccaccgaactccccgacgggcgggtctacttcaacacccgcaacgactccccgtcccccggcaaccgtgccgacgcgtactcgaaggacggcgggaagaccctggtcaagccgttccgcccgcaggccgggctcaccacccccgtcgtccagggcagcgtcctccagctccgcgaccccgatctgctcctgtactccgggcccgccgaccccgccttccgcgccctgatgaccgtccgcgccagtgcggacggcggcaccacctggcgcaccgcccacccgctcgacggcctgcccgccgcgtactccgatctcgtacgcgtcgaccaggacaccgtcggcctgctctacgagacgggtgacttcggcgcctacgagacgatcaccttccgtcgcatcccggtgacggccctcacg

SEQ ID NO: 5912 - DNA, 702 bp, Streptomyces avermitilis
  CDS (1)..(702)
atgacctctactgacagtgcacagaaggctcccgccaaggacccctgggaccttcccgacgtctcggggctcgtcgtcggcgtgctcggcggcaccggcccccagggcaagggcctcgcctaccgcctcgccagggccggccagaaggtgatcatcggctcgcgcgccacggaccgcgcccaggccgccgcggacgagctcggccacggtgtcgagggtgccgacaacgccgagaccgcgcgccgcagcgacatcgtgatcgtcgccgtgccctgggacggccacggcaagaccctcgagtccctgcgcggggaactggcgggcaagctcgtcgtcgactgcgtcaatccgctcggcttcgacaagcagggcgcgtacgcgctgaagccggaggagggcagcgccgccgagcaggccgccgccctgctgccggactcacgggtcaccgccgccttccaccacctgtccgcggtactgctccaggacccggagatcgccgagatcgacaccgacgtcatggtcctcggcgaggagcgcgccgacgtcgagatcgtccaggcgctggccggccgcatccccggcatgcgcggcatcttcgccgggcggctgcgcaacgcccaccaggtcgagtccctggtcgccaacctgatctccgtcaaccgccgctacaaggcgcacgccggtctgcgcgtcaccgacgta

SEQ ID NO: 5913 - DNA, 180 bp, Streptomyces avermitilis
  CDS (1)..(180)
atgccccgcctcgccctctacgccctcgtcgtctgcgtcctgtcggtcgccgcggccgtcgtctccttcgtccagggcagctggctggggatcgtgtgggtgctgatggcgggactgtcgtcgaacatgacctggtactacgcgcggcggggccgcggcgggcgcgggtccgtcacaagc

SEQ ID NO: 5914 - DNA, 798 bp, Streptomyces avermitilis
  CDS (1)..(798)
atgaccaccgccgcctcccggcgcagtgaccggaggatcagccccgtcttcatcgggatcgtggccgtcacggcggtcaccggctgggccgcgtggaccgggttcgccgcgcagccggggatcgccgtcttcctgttcgtgacggcggcgtggatcgtctcgctctgtctgcacgagtacgcgcacgcgcgcaccgccctgcacagcggtgacatctcgatcggcgcgaagggctatctgacgctcaacccgctgaagtacacgcacgccctgctgagcatcgtcctgccggtgatcttcgtgatcatgggcgggatcggtctgcccggcggcgcggtgttcatcgagcggcagcgcatccagggccgctggaagcacagcctgatctcggcggcgggcccgctcacgaacgtgctgttcgccgccgtgtgcaccgcgccgttctggctgcacgccctcgacggggtgccgagggacttccagtacgcgctggcgttcctcgcgctgctccaggtcacggcggcgatcctgaacttcctgccggtgccgggcctggacggctacggggtgatcgagccctggctgtcgtacgacatccgccgccaggtggagccgttcgcgcccttcggactgctcgccgtgttcgcgatcctgtggatcccgtcggtgaacggggtgttcttcgacgcgatcgacgcgatcctgaacggtctcgggatcgacgacatccaccgctactgcggccaggagctgtaccgcttctggcagggcgacaacgagttctgctcggtcagcttg

SEQ ID NO: 5915 - DNA, 552 bp, Streptomyces avermitilis
  CDS (1)..(552)
atggggcgttggtacgtgtactacgaggactggcagatggagtgctgcggtacgccgttctcggtgggggacgaggtgagctggccgctgctgctcatggacgcggacgacgtgctcgcgggcgactgggagcgcgagctgagcaggctcgtggggtccgtcgaggcggtacgggacgagtacggcggcgtgctcaggacgctgcggacgggtccgcccgcaggtcccgggctcacggccgcgctgaacgccgacgcggtggacgagtcaggcgcggaacccgcggagccgatccgcagggtcggcctgctgacggtcgagcggcacggcggcgagtggcccgagaccaccgggcgggtccgcgcgatccacctggtgcaccaggagtacgcggtcctcgcccccggctccctgacccgcgaaccggtgccggggacgcgctcgctggaggccgtgacgagctgcccgaagtggttcggcgagggccggtccggcgttctcgtcgaactcgacgtccccggcgccgcaccgcccgaaccccgtgaccggtcg

SEQ ID NO: 5916 - DNA, 3528 bp, Streptomyces avermitilis
  CDS (1)..(3528)
gtgacggcaccggagacaatggaccccgtgcgctatcgcgttctcggcaccacccaggcactgcgccccgacggcacgcccgtcccggtcggcggggcgcggctgcgtgccctgctgaccgtgctcgccctgcggcccgcacggaccctgcccgccgccgtcctcgtcggcgaggtgtggcacggcgacccgcccgccgacgcgaccggcgcccttcaggcactggtcgggcggctgcgcagggcgctcggcgcggacgcggtggagtccgtgcacggcggctaccgtctcgcggcggtcgccgacgacgtcgacgcgcaccgtttcgagcggctcgccggggagggcctgcgggccctggccgacggcgacccggcgaaggcggccgtcgtcctcgacgacgcgctcgccctgtggcacgggccggccctcgcggacctgccggaccgcaccgcggaggcggcccgctgggagacccgccgcctcgacgtgcgccgcgcccgcctcaccgcggcgctgtccctcggccaggcggaccagtgcctgcccgagctgaccgccctgtgcgacgtgcaccccctggacgagcccctccaggcactgcggctgcgcgccctgcgcgacaccggccgcccggcacaggccctggccgcgtacgaggacgtacgacagctgctggcggaccggctgggctccgacccgggccccgaactgcgcgccctgcacggcgagttgctgagcccggccggtgaacccacgccgggctggggcgggggacccggaacgcgcggtacgggcggcacgggtgccgtcccggccggagagcggcacggcggcacgggtgccgtcccggcgtacggcggtggcagggccgagggcgcgggtccggtggcgtacggcggtggcagggccgagggtgcgggtccgcggccggacggccttcgcggcggtgtgacggcgggcggcgcgggcggggcggccggctccgtcaggacctcccgtgcccccgccgcccccgtgcccccgggcaacctccgcgcccgcctcacctccttcgtcggccgcgacgccgacatcggcaccatccgcggcgatctcgcgtccgcgcggctcgtgacgctgctcgggcccggcggggccggcaagacgcggctgtcgcaggaggccggtgaggccgtggccgggggcatgcccgacggggtgtggctggccgagctggcgccggtggacgatccggaggtcgtgcccgaggtcgtgctcaccgcgctcggggcccgggagaccgtgctgcacggggccggcgccgaggagatgcgggccgtcgcggaacgccgggacgatcccctcgtccggctggccgagcactgcgcgcggcgccgcatgctgctcatcctcgacaactgcgaacacgtcgtggacgcggcggcgcacctcgtggcggagctgctggcgcgctgcccggggctgacggtgctggccaccagccgcgaacccctcggcgtaccgggagagttgctgcggccggtggagccgctgccggagccgtacgcgctgcggctgctcgccgaccggggcgcggcggcccggcccggcttccgggtccaggacgacccggaggccgccgccgagatctgccgccgcctcgacggcatgccgctggcgatcgagctggcggccgcccgcctccgcatgttgacgccccgtcagatagccgaccggctcgacgaccgcttccggctgctcacctcaggcagccgtaccgtgctgccccggcagcagaccctgcgggccgtcgtcgactggtcctgggagctgctcgacgccgacgaacgcggtgtgctgcgacggctgtccgtcttcgcgggcggctgcgacctggccgccgcggaggcggtgtgcggcccggccgccctggaggcgctgggctcactcgtcgacaagtccctcgtcgtcgcgtccctcgcggacggcggcggcaacgacgggatgcgctaccggctcctggagaccgtcgccgagtacgcgggcgaacggctcgacgagtccggcgagcgcaccgccgccgaacgggaccatctcacgtactaccgcgaactcgcccgcaccaccgacccgttgctgcgcggcgccggccagcgcgccgcgatcgaacggttccagctggagtacgagaacctgcgtaccgccctgcgccacgccgtcgccgcgcgggacgagcaggaggcgctctgcctggtcctgtcgctgtgctggtactggcagatgcgcgaccagcgcatcgaggcccgcacctgggccaccgcggtcatggccctcggccccgaccccttcgccgcgcccgcacggccggcccccgtgctccgcgagagctgcacggacagcccgccgccgatgcgccccgagatcctcgacgaggcccggcgcggagtgcacctcgtccatctcgcctgcatggacatggacctggagatgtgggacaccccgcgggccagagagaagctgcgggtcatcagcgagacctaccgcccgggccagccgcagatctgccgcagccccggcttcctgtggttcttcgccgtcatgctcaccggcgacctcgacagcacccgcgccgtcgtcgacgcgtccgtgcgcacctgccgcgaactcggctactcctgggagctggcccaggccctccagatgcgggccaacgtcctcgccaaccgcagcttctgggcggccgacgcgacccgtgacgcggacgaggcgctggagatcttcatccgcatcggcgatgtctggggcgcggccgaggcgctctccgcgcgcggcgaggcccgcgagcgcagcggtgactacccgcgcgccgccgccgactacgaggcggcgatcacgtacgccgaacggctgggcgcccatgcccaggcggccgtgctgggcgcccgcctgggcagcgtcctcatcgacgcgggccagggggagcggggcgagcagcttctgcgggaggtactggacgagggccagggcatggtgagcgaggccatgcccgccgcgcggctcttcctcgcgatccggctcggccgcaccggccgtctcgccgaggcccgcgagcagctgggcatgctgcgcacggacttcggagacgtccgcttcgtggtcttcgacggcttcgtggtcggtgtggaggcgtggctggacgccaccgaggggcggtacgcggaggcggtggagaaggtgcgccgggcgctggcccgggccgcggaccaggtgacccgggtgatcgcgccgcacatgttctcggtgcatctgaccaccgcggccatcgcgctcaccggcctggacggcgggctgcgcgccccggacgcggcccgttgcctggccgtctgcgaccagctgctgccaccgggacaccttccgtccgtgatggagcgcgaggtgcgtgcggaggccgaggcgggggtgcgtgccgtgctgggcgacgcggcgtacgaggccgcgtacgcggagggcggcgggctctccctggaggaggccgccgccctcgtc

SEQ ID NO: 5917 - DNA, 816 bp, Streptomyces avermitilis
  CDS (1)..(816)
atgagcgccaccactgtcccgacgcccgtagcgcacgacgagggccgcatcgggctccgcggcaatctgcgccacatcggcgccctggtccgccgcaacctgctgtggatccgccaggaccccgagtcgatgttcgacgcggtcctgatgccgatcgtcttctgtctgctgttcgtgttcgtcttcggcggctcgatcgccggcaagggccaccagcacgagtacgtcaactacgtggtcccgggcctgatggcgatgatgggcatgaacatcgccatgggggtcggcaccggtttcaaccaggacttccagacgggcgtgatggaccgtttccggtccctgccgatcgcccgcttctcggtgctgatcgccaagatcacggtcgagatcggccgcatgctggtcgccgtggcggtcctgctcacggtcggcttcatactcggcctgtccgtgtcgaacgtcctgggcctgttcgccgccgtcggactcgcgatggtcttcggctccggaatcatgtggatcttcctgaccatgggcgtggtgatgaagaacgcccaggccatccaagggatggggttccttgtgctgatgcctctgcagttcgggtcgtcgatcttcgccccgaccgacacgatgcccggctggctccaggcgttcaccgactacaacccgctctcgtcgctggcggacgccgcccgcggcctgatgaacggcggccagccggtcggccacgacgtgctggtgacactggtctggtcggtcgtcctcacggccgtcatggcaccgatcgccatccacaagttccgcaccaagagc

SEQ ID NO: 5918 - DNA, 1038 bp, Streptomyces avermitilis
  CDS (1)..(1038)
atgacgcgaatcgacaacacgccccggcaggacggagccggcccctcggcggccgtcgtcgtacgggggctggtcaagcactacggcgagaccaaggcgctggacggggtcgacctggaggtgcgcgagggcaccgtcctcggggtgctcggccccaacggcgccggcaagaccaccctggtccgctgcctgtccaccctcatcacccccgactccggccacgccgtggtcgccggctacgacgtggtgaagcagccccgggggacccgccgcgtgatcggcctcaccggccagtacgcctcggtcgacgagaaactctcgggctacgagaacctgtatctgatcggccggctcctcgacctgccccgcaaggaggccagggcacgggccgacggactcctggagcggttctcgctcaccgacgccgccaagcgcccggcgtccacgtactccggcggtatgcgccgccgcctcgacctcgccgcgtccatgatgggcaggccgtccgtcctctacctggacgagccgaccaccggtctggacccgcgcacccgcaacgaggtgtggacggaggtcaagcgcatggtcgccgagggcgcgaccgtcctgctcaccacccagtacatggaggaggccgagcaactggcctccgagctgacggtcatcgaccgcggcaaggtcatcgcgggcggccgcatcgacgaactcaaggcgcgggtcggcggccgcaccctccgcgtccgcccggcggacccgctggagctgcgcccgacagccgcggcgctcgacgacttcggtctcaccggccccggctccgcgaccgtggaccccgagaccggcaccgtggtggtgccgatcctcagcgacgagcagctgaccgccgtggtcggcgcggtcaccgcccgcggcatcaccctcgccggcatcaccaccgaactgcccagcctggacgcggtgttcctgtccctcaccggccacaaggccagtgccccgcaggacgcgtcccccgcgtcccccgaattcgcgaaggccgccgta

SEQ ID NO: 5919 - DNA, 393 bp, Streptomyces avermitilis
  CDS (1)..(393)
gtgctcggggccgtcgcgcgcggcgggtgggtctacgaggtccacgccgccggggccggcacggatctgtaccgggtctcactgctggagggctaccaggagcaacgccccctcagcgccgcggagtcggccgcgctgcccgcgctgctgcccctcgtgcacgccgagtccgcgctgtcggagatgggctacttccacggcgtgatgggctccaccgcggacacggcactggcgtacgaccgtttcgtgggccacacacggtggttcggcggcgaggacggcacccggctgctgaaccggatccggacgcgcctccagagaccagggcctgtccggttctggaacggcagcagcccgccgacgggggaagatcggcgggctgccctggtgccg

SEQ ID NO: 5920 - DNA, 861 bp, Streptomyces avermitilis
  CDS (1)..(861)
atgacgcagctttcggctgcccagaagccgtccgacagcagcaaggcactgtacggaggcaagggcacgcgtcgcatcaccatccgcgacatcaccaccgccaaggaacgcggcgagaagtggcccatgctcaccgcgtacgacgcgatgaccgcgtccgtcttcgacgaggccggcatcccggtcatgctcgtcggggactcggcgggcaactgccacctggggtacgagacgaccgtgcccgtcaccctcgacgagatgaccatgctgtcggccgcggtcgtacgcggcaccagccgcgccctgatcgtcggcgacctgcccttcggctcgtaccaggagggcccggtccaggcgctgcgctcggccacccggctggtcaaggaggccggggtcggggccgtgaagctggagggcggtgagcgctcgcaccgccagatcgagctgttggtcgagtccggcatcccggtcatggcgcacatcggtctgaccccgcagtccgtgaacgccatgggctaccgcgtccagggccgcggcgaggaggcggcccagcagctgctgcgggacgccaaggcggtccaggacgcgggcgcgttcgccgtggtcctggagctggtcccggcggaactggccgcggaggtcacgcgggtcctgcacatcccgacggtcggcatcggtgccggtccggagacggacgcgcaggtgctggtctggacggacatgctcgggctgaccggcggcaaggtgccgaagttcgtgaagaagtacgccgatctgcgcgaggtcatgggcaacgcggcgaaggcgttcgccgaggacgtcgtcggcgggacgttcccgctggaggagcactccgtccac

SEQ ID NO: 5921 - DNA, 1590 bp, Streptomyces avermitilis
  CDS (1)..(1590)
atgacaactcctgctgctccgaccgaacggcgggtccccgaagcggtgcaccggcgccgctgggcgatcctcggcgtgctgatgctcagcctgctgatcgtggtgctcgacaactccatcctgaatgtcgccatcaagaccatctccaccccggctcccaccggcctcggcgccacgcagagcgagctggagtgggccatcaactcctacacgctcgtgttcgccgggctgctcttcaccgcggggctcctcggtgaccggctgggccgcaagaagatgctcctcgccggtctcgccgtcttcggcatcggctccgcgctcgccgccgagtccggctcgccggtgcagctcatcgcgttccgcgcggtgatgggcctcggagccgccttcgtgatgcccgcgaccctcgccgtcctcatgaacgtcttcgagcgcgacgagcagcccaaggccatcggcatctgggccggcggcgtcggcatcgccatcgccatcggcccgatcaccggcggcgtgctgctcgaccacttctggtggggctcggtcttcctgatcaacgtgccgatcgtggtcatcgcgctgggcctgatggtctggctggtccccgactcccgcgacccgaaccccggccgcgtcgaccccgtcggtgtcgtcctgtccgtcatcgggctcgtccttctggtgtacggcatcatcaagggcggtcagctcgccgacttcaccgacccgcaggtcctggcgaccatcgcggccggccttgccgttctcgccgccttcgtcgtgttcgagaagcgcagcgaccacccgtccgtcgacgtcacgtacttcaagaacaaggtcttctccgcggccatcgccgccatagcactggtcttcttcgcgctgatgggcgtgaccttcttctcggtcttctacacccagagcgtgcgcggctactcgccgctccagaccggcctgctgatgctgccgctggccgccgcccagatgatcttcgcgccgcgggcccggctggtcgtcgaccggttcggcaacaaggccacgaccacggccggtctggtggtcctcgccgcgatgctcgccgcgttcgccacgctggacgcggacaccccgatctggctcctggaggtcgtcttcttcctgatgggcgccggcatggcgcacgtcatgaccccgaccagcgtggtcatcatgcaggcgctgccccgcgagaaggcgggctccgcgtccgcgctcagcaacaccttccgtcaggtcggcggcgcgctcggcatcgcgatcctcggctcggtgctgtccaccacgtaccgcgacggcatcgaggacaagctctcccagctcccgcccgccgtgcgccacaccgcgggcgagtccatcgaggcgacgctgggcgtggccgcgaagctcggcccggacggcaaggccctcgtcgcccccgccaacgacgcgttcctgcacgcgatgcacctcaccgccctgtgcggcgcgggtgtggccgtgctcggcgcggtgatcgtggcgctgttcctgccgggccggcccccggcgccccaggagggccaggaggagacggagttggtgacggcggaccac

SEQ ID NO: 5922 - DNA, 618 bp, Streptomyces avermitilis
  CDS (1)..(618)
gtgagcctcgcggacagccgagccaggcgtgagggccccgccaggggacgcccccggagcgaggccgtcgaacgctccatcatcgagggcgtgatgaagctcctcgaagacggcgtccccctcgcggacctctccatggagcgcgtcgcccgcaccgcgggcgtcggcaaggccaccatctaccgccgctggcgcgacaaggaggagctcttcgtcgacgtcctgcgcgccgccgagcccgccgaccccgaactccccggcacctcgatgcgcgacgacctcgtcgtcatgctggagtcgctgcgtcaacggggcctgctcgcccgctcgtcggcgatcctgcacaacgtctacgcacagatgaagagcagcccccggatctggaccgcctaccacgcgaccgtggtcgaaccacggcgccggctcggcgcggaggtcctgcgccgcggacaggagaacggcgagctccgggccgacctggacatcgacttcgtcaacgacctgttcgtcggccccatgctcgtgcgtaccgtcctgcgccccgacggcgatctgcccgaggagctcgccgaacagatagtcgacgccctcctgacaggactgcgcccgaccgggccg

SEQ ID NO: 5923 - DNA, 1035 bp, Streptomyces avermitilis
  CDS (1)..(1035)
atggcgcaggcgtacgtgacggagacgggcagcggcggctcggagtccgaccgcagagggtcccggctccggcgcctgtacgacagcctgcgcggcgaccgcgggatctggcgccgcggactggtcgtcgcagcctgcgcggtggtcctcgcgctggtgatggtgctgcacgcgcagatcccgaacaccatcggcaacctgggcagtctggtggagacgttcctgccctggctgggtgtcttcgtgccgctgctgctggccctcgggctcgtccgcaggtcggcgaccgccgtgatcgccgtactgctgcccacgatcgtctggctgaacctcttcggcgggctgctcaccgaccgggccggcagcggcggcgatctgaccgtcgccacccacaacgtcaacgcggacaacaccgacccgtccggcaccgcccgcgacgtggccgcctcgggagccgacgtcgtggcgctcgaggagctgacggccacggcggtgccggtgtacgagaaggcgctggcggcgacgtacaagtaccactcggtgcagggcacggtcgggctgtggagcaagtaccccctgaaggacgtccggcccgtggacatcaagctgggctggacgcgcgcgatgcgggcgacgatcgtcacaccgttcggggagatcgcgggctatgtcgcccacctgccctcggtccgggtgaaactggcggccgggttcaccgcccaccagcgcgacaagagcgccgacgcgctgggcgaggccatcgccgacgagacgctgcgggacgtcgtcctgctcggcgacctcaacggcacgatgaacgaccgctcgctcagcaacatcacctcgcagctgcgctccacccagggcgcggccggcagcggcttcggattcagctggcccgcgtcgttcccgatggcccggatcgatcagatcatggtcaagggcgtcgatccggtgacctcgtggaccctgccgaggacgggcagcgaccacctcccgatcgcggcccgcgtgaagatctccgcaactgcttcc

SEQ ID NO: 5924 - DNA, 1224 bp, Streptomyces avermitilis
  CDS (1)..(1224)
atgcccctcgccctgctggccctcgccgtgggcgccttcggcatcggcacgaccgagttcgtgatcatgggtctgctgcccgacgtcgcggacgacctgcacatatccatccccgccgccggccacctggtctcggcgtacgcgatcggcgtcgtcatcggcgccccgctcctggcggccgtcaccgcccggctgtcccgccgcaaggtcctgatcggtctgatggggctgttcgtggtcggcaacgcgctgtccgccttcgcccccgacgaccactggctcctcgcggcccgcttcctcagcggcctcccgcacggcgcgttcttcggcgtcggcgcggtcgtcgccaccaatctggtcgcgcccgagcgcaaggcccgctcggtctcgctgatgttcctcggcctgacggtcgcgaacgtcgccggtgtgccggtcgccaccctcatgggccagcacctcggctggcgggccaccttcctgggcgtgagcgcgatcggcctggccgccatcgcctcgctggccctgctggtcccgcacgaccacacccacgccacgtccggcggcctgcgcggcgagctgacggccctgcgctcgctgccggtctggctggcgctcggcacgacggtcgccggcttcggcgcgctcttctcggcgtacagctacatcacaccgatgctgacggacgccgccggctacgcccacgggagcgtcaccctgctgctcgccctgttcggcgtgggcgcgacggccggcaacctcgtcggcggccgcctggcggaccactcgctgcgcggcacgctcttcggcggcctcgtgtcgctggtcgtggtgctgtccctgttcccgctcctgatgaccacgcagtggagcgcggccctcggtgtgaccctcctcggcgcggccgcgttcgtcacgggctcgccgctccagctgatggtcatggagaaggcgtcggcggccccgtccctggcgtcctccgccaaccaggcggccttcaacctggccaacgcgggcggcgcctggatcggcggtctcgccctggccgcgggcttcggcgccacctccccggcgctcgctggagccgccctcgcggtgctgggcctggcggtcgcgggcacggcgtacgcggtggaccgccgccgcgcgctcgccgtggcggtcacgacgagtggccggctggtcgccacgcacgttccccagcgcacggagtcggcacaccgc

SEQ ID NO: 5925 - DNA, 1752 bp, Streptomyces avermitilis
  CDS (1)..(1752)
gtgcctcaactacgcctcgccctgaatcagatcgactcgaccgtcggcgacatcgccggcaacgccgaggcgatcctccgttggacccggcactccgccgagcagggagcgcatctggtggcgttcccggagatggcgctgaccgggtatcccgtcgaggacctcgccctgcgctcctcgttcgtcgaggcctcgcgcaccgcgctgagggagctggccgcccgcctggccgaggagggcttcggggagctgccggtgctcgtcggctacctcgaccggtccgagagcgcccagccgaagtacgggcagcccgcgggcgctccgcggaacgcggcggcggtgctgcaccgcggccgggtggcgctcaccttcgccaagcaccacctgccgaactacggcgtcttcgacgagttccgctacttcgtgcccggtgacacgatgccgatcgtgcggctgcacggcgtcgacatcgcgctcgccatctgcgaggacctgtggcaggacggcgggcgcgtgccggccgcgcggtcggccggggccggactgctgctctccgtcaacgcctcgccgtacgagcgcgacaaggacgacacccgtctcgagctggtgcgcaagcgggcccaggaggccggctgcacgaccgcgtatctcgcgatgatcggcggccaggacgagctggtcttcgacggggactcgatcgtcgtcgaccgggacggcgaagtcgtcgcgcgggcgccgcagttctcggagggctgcgtggtcctggacctggatctccccgccgccgaggccgagccgccgacgggggtcgtggacgacgggctgcgcatcgaccgcctcgtcatctccgaggagccgctgcccgcctacgaggcggagctggccggcggatacgcggaccggctcgacgccgacgaggaggtctactccgcgctggtggtcgggctgcgggcgtacgtcgcgaagaacggcttccgttcggtgctgatcggcctctcgggaggtatcgattcagcgctggtcgcggccatcgcgtgcgacgcgctcggcgcgcagaacgtgtacggcgtctcgatgccgtcgaagtactcctccgaccactccaagggtgacgcggccgagctggcgcggcgtacggggctcaatttccgtaccgtgtcgatcgagccgatgttcgacgcgtacatggcttcgctcgggctgaccgggctggccgaggagaacctccagtcccggctgcgcggcaccacgctgatggcgatctccaaccaggaggggcacatcgtgctggcgccgggcaacaagtccgagctggcggtcgggtactccacgctgtacggcgactcggtgggcgcgtacgggccgatcaaggacgtgtacaagacgtcgatcttccggctggccgagtggcgcaaccgggcggcggccgagcgcggccagaccccgccgatcccggaggcctcgatcaccaagccgccgagcgcggagctgcgccccggccaggtcgacacggactcgctgccggactacccggtgctggacgcgatcctcgagctgtacgtcgaccgggacacgggcgccgacgcgatcgtggcggcgggctacgaccgtgagctggtcgtcaagacgctgcggatggtcgacaccgccgagtacaagcgccgccagtacccgccgggcacgaagatctccgcgaagggcttcggcaaggaccgccggctgccgatcaccaaccgctggcgcgagcactcg

SEQ ID NO: 5926 - DNA, 1899 bp, Streptomyces avermitilis
  CDS (1)..(1899)
atggcagcgacactgccgctgctcgccggtgcgctggcgctcggcatacccgcggcccatgccgcggacggcccgagccgtgacacgctcgcgggcaccaagcccgcgtgggccacggccacggcggacaagggtgccaccgacaacggctcccaggtctccgcccgggtctacctggccggcaaggacgcggcgggcctggccgcctacgcgaaggccgtgtccgacccgaactcggcctcgtacggcaagtacctcagcgcccagcaggcgcaggcgcgtttcggcgccaccaaggcgcaggtcgccgaggtgacggactggctgaagtcggcgggcctgaaggtcaccggcagcacgcagcactacgtcaccgtgaccggcgacgtggccgccgccgagaaggcgttcggcacccagctgcacaactacgtcaagggcggcaagacctaccgcgccccggcgaagacggcttcggcccccgcggcactggacggcgccgtcctgaccgtcaccggcctggacaacgccccgcacaaggcgacccacgcggacacgctgccgccgccggacgccgtgttccacaactccgggccgtactcctcgtactacggctcgaaggtggcgacctcgctgcccaaggcgtacggcaagaagatcccgtacgcggtcaagggctacaccggcaagcagctgcgggccgcctacggcgcgggcaaggcgaccggcaagggcgtgacggtggccatcaccgacgcgtacgcctcgccgaccatcgcctcggacgcggccacctacgcgggcaagcacggtgacgcgaagtacgccaagggccagctggcccaggtgctgccgagcgactacacgaagaccgaggagtgcggggcggccggctggtacggcgaggagaccctcgacgtcgaggccgtgcacgcggtcgcccccaaggcgaacatcgtgtacgtcggcgcggcgtcctgctacgacagcgacctgctcgactcgctcaacaagatcgtcgacgggcatctggccgacatcgtctccaactcgtggggcgacatcgaggccaacgagacgccggacgtcgcggccgcctacgaccagacgttcaagctgggcgcgatcgagggcatcggcttctacttctcctccggcgacaacggcgacgaggtcgccaacaccggtacgaagcaggtcgacaccccggccaactccgcctgggtgacggcggtcggcggcacctcgctggcggtcggcaagggcgacaagtaccagtgggagaccggctggggcaccctgaaggcctcgctgtccgcggacggcaagagctggacgagcttcccgggcgcgtacagctcgggcgcgggcggcggcaccagcaagacggtggcgcagccgttctaccagcgcggagtcgtcccgaagtcgctcgccaaggcgaacggttcgacgccgatgcgcaccgtgccggacatctcggcgatcgccgacccgaacaccggtttcaaggtcggccagacgcagaccttcccggacgggacgcagaagtacgacgagtaccgcatcggcggcacctcgctcgccgctccggtgatcgcgggcgtccaggcgctcgcgcaggagcagcgcggcggccgggcgatcggcttcgccaacccggcgatctacgaccgctacggctccaagctctaccacgacgtggtggacaagccgaccggccgtgacctcgccgtggcgcgggtggacttcgccaacgggttcgacgcggccgagggtctgctgacctcggtccgcagcctcggcaaggacagctcgctgaaggccgtgaagggctacgacgacgtcaccggcgtgggctcgcccgctcccggctacgtcacctcgtaccgccgtcac

SEQ ID NO: 5927 - DNA, 624 bp, Streptomyces avermitilis
  CDS (1)..(624)
gtgacccggcacatcggctgggtcgcggggtccgcggcggccgtgctcgtcgcggccggggcgatcacgtacgcggtcgcggaggacggcggctcgtcggcgacgacgccgaccgccggctccgcggacgccggtttcgcgcgggacatggcggtccaccaccagcaggccgtcgagatgtcgtacatcgtgcgcgaccgcaccaagaacgaggaggtgcggcgcctcgcgtacgacatcgcgcagacgcaggccaaccagcgcggcatgctgctgggctggctcgacctgtgggagctgccgaaggtgtcggcggacgcgccgatgacctggatgggcatgggcgacatggcctccggcaaggacggcgcgctgatgccgggcatggcgaccaacaccgagctgaagaagctgaacacgctgagcggcgagcaggccgaggtcctctacctccagttgatgaccgaccatcacaagggcggcatccacatggcggagggctgtgtcgccaagtgcacggtcggcgtggagaagaagctcgcgcagggcatggtcgacgcgcagcagtcggagatcgacctgatggcggacatgctcaaggaacggggcgcgaaggcgcgcgac

SEQ ID NO: 5928 - DNA, 666 bp, Streptomyces avermitilis
  CDS (1)..(666)
atgggttccgccaagaacaccagcaacgcgcagcgcaaggcccgcatagaggagatgcgccgggccgaacgttctcgtgagcgccgcaaccggatactcacgatcgcggccagcgtggtggtcgtcgccggtctcgtcgtcggcggtgtcgtcctcgtcaagtctcagtcggacgacaaggacacctcggcgagtgactcgaagacttcctcgggccacttcgtgacgggtacggacggggtgaagacgtggaagggcaagctgggccgtacccacgtcaccaagaccgtggactacccgatggagcccccggtcggcggtgaccacaaccaggtctggatgaactgcaacggcgacgtctacaccaaggcggtcaacaacatgaacgccgtgcactccctggagcacggcgcggtgtgggtgacgtacaacagcaaggcgtcggacgcggacgtcaaggcgctcgcggcgaaggtcaagaagacgccgtacacgctgatgagcccggtcgacgaccagaaggccccgatcatgctcagcgcgtggggcaagcagcgcacggtgaagagcgcgagcgacccggacgtcgacaagttcttcgcggagttcgtgcagggcaagcagacgcccgagcccggtgccgcctgcaccaacggtctggctcag

SEQ ID NO: 5929 - DNA, 498 bp, Streptomyces avermitilis
  CDS (1)..(498)
atgcgcattatttacgctggcgccatgcggctgctgcgctccaccgatctcgccctgcgtgtcctgatgcggctcgccgtcacgggtgattccagccccacgacccgcgaggtcgcggcggacatggacgtgccgtacacgcatgccgcgaaggtcgtcgccgaactccagcacctcgggctgatcacggcccgccgcggccgcggcggcggcctcgcgctcatggaggcggggcgcacggcctcggtgggcgcggtcgtgcgcgccttcgagggggacggcgacgtcgtcgactgcgaggggtccacgccctgcccgctcaactccgcgtgccggctgcggggcgcgctgcggcgggcccaggaggcgttcttcgcgtcgctggacccgctgaccgtgcaggacatggtcgcggccccgaccgggccgctgctgctgggtatcaccggcgctcctcagctctcccgggcgagccagaggtcgggtccgaacacctcg

SEQ ID NO: 5930 - DNA, 1200 bp, Streptomyces avermitilis
  CDS (1)..(1200)
atgctgtccgagcagtccgccgccaccgtgcgcgccaccctccccgccgtcggcgcggccgtcggcgagatcaccgcgcgcttctacgaccggctgttcgccgcccgccccgagctgctgcgcgacctcttcaaccgcggcaaccaggcggcggggacgcagcggcaggcgctggcgggctcgatcgccgcgttcgccacgtacctcgtggaacacccggacgagcgccccgacgcgatgctggaccgcatcgcccacaagcacgcctccctgggcatcgcacccgggcagtacgcggtcgtccacgagcacctcttcgcggccatcgccgaggtcctcggcgacgcggtcacccccgaggtcgcggccgcctgggacgaggtctactggctgatggcgaacgcgctcatcgccatcgagcggcggctgtacgcgcagcacgagaacaccggtgacaccggcggccggcggccctggcgggtcgtggagcgcgtggacgagaccgccgacgtcgccgccttccggctgcgcccggccgacggccggcccctcccggacttccgccccggccagtacgtgtccgtccgcgtcgaactcccggacggcgcccgccagacccgccagtacagcctcgtcggcgcgcccggctcaccggagctgcggatcgccgtgaagcgcgtccacggcggtacgacaccggacggcgaggtctcgaaccatctccacgcgcgcgtgcgcgagggcagcgtcctggagctctccgccccgtacggcgatctcgccctggaggccacggacgtgcccctgctgctcgcctccgccggcatcggcgtgaccccgatgatcgcgatgctggagcacctcgccctgaccggccaccgcgccccggtcaccgtcgtgcacgccgaccgctcgccggccgagcacgccctgcgcgcggaccacgaggcgtacgcggccaagctcgcggacgcggccgtccacttctggtacgagcacccggagccggggcacccggccgaccgcacggggctcgtcgacctgaccggcgtgccggtctccgccggcacgcgcgcgtacctgtgcggtccgctgcccttcatgcgcgccgtccgtacccagctcatcgagaagggcgtggcacccgccgacatccactacgaggtgttcggacccgacctctggctcgcccgggagagc

SEQ ID NO: 5931 - DNA, 1359 bp, Streptomyces avermitilis
  CDS (1)..(1359)
atggacaagcagcaggagttcgtgctccggacactggaggagcgcgacatccggttcgtacgtctgtggttcacggacgtactcggcttcctcaagtcggtggccgtcgccccggccgagctggaacaggccttcgacgagggcatcggcttcgacggctcggccatcgagggcttcgcccgtgtatacgagtccgacatgatcgccaagccggacccgtcgacgttccaggtcctgccgtggcgcgccgaggcccccggcacggcccgcatgttctgcgacatcctcatgccggacggctccccgtccttcgcggacccgcgctacgtcctcaagcgcgccctcgccaagacctccgacctgggcttcaccttctacacccacccggagatcgagttcttcctgctgaaggacaagccgctggacggctcgcgcccgaccccggccgacaactccggctacttcgaccacaccccgcagaacgtcggcatggacttccgccgccaggcgatcaccatgctggagtcgatgggcatctcggtcgagttctcccaccacgagggcgcgcccggccagcaggagatcgacctgcgctacgccgacgccctctcgacggcggacaacatcatgacgttccgcctggtcatgaagcaggtggcgctggagcagggcgtgcaggcgaccttcatgccgaagccgttctcggagtacccgggcagcggcatgcacacccacctctcgctcttcgagggcgaccgcaacgcgttctacgagtccggctcggagtaccagctctccaaggtcggccgctccttcatcgccggcctgctgaagcacgcggcggagatctcggccgtcaccaaccagtgggtcaactcctacaagcgcatctggggcggctcggagcgcacggcaggcgccggcggcgaggctccgtcgtacatctgctggggccacaacaaccgctccgcactggtccgcgtcccgatgtacaagcccggcaagaccggctcggcccgcgtcgaggtccgctccctcgactcgggcgcgaacccgtacctggcgtacgcgctgctcctcgcggcgggcctcaagggcatcgaggagggctacgagctcccgccgggcgccgacgacgacgtgtgggccctctcggacgcggagcgccgcgcgatgggcatcgagcccctgccgcagaacctcggcgaggcgctggcactcatgcagcgcagcgagctggccgccgagaccctgggcgagcacgtcttcgacttcttcctgcgcaacaagaagcaggagtgggaggagtaccgctccgaggtgacggccttcgagctgcggaagaacctgccggtgctg

SEQ ID NO: 5932 - DNA, 309 bp, Streptomyces avermitilis
  CDS (1)..(309)
atggacgccttcgctttcgtgcacggtagcaacttgtatgagctacggcctaagccgggccagcgccaccaggcggcgcgcgaacacggcatgcacgctctcaggcacttctacgcctccgtccttttggacgccggcgagaacaccaaggcactgagtcactatctcggacacaacgatccgggcttcacgcttcgcgtctacacgcacctcatgccgagcagcgacgcgcgggcccggaaagccgtggacaccctctacagcgacacactttcgacgcctgacggcccgcagacggcccaggaggac

SEQ ID NO: 5933 - DNA, 237 bp, Streptomyces avermitilis
  CDS (1)..(237)
atgtcgaaccagacgctcgactggctgaaggagaacgagttcgacaatacggacgaggcactcaagggaatcgacaaggccagagacatgggccagcacaatgccatgattccgctgctgaattacgcgcagacgaacggcatgtccgacgatgagatctgggatttgtcggacgaggcggaagaggcttacaacaagggtcgcacgcgtagcgacaccaaggacgttcgaggattc

SEQ ID NO: 5934 - DNA, 657 bp, Streptomyces avermitilis
  CDS (1)..(657)
atgatgagagtttccgccagctccttggctgtggcagcgctgttcttgacggcgacgtcctgctccacggagggtgacgcgtcgacttcggcggcggacggttgcgaggaagccctgggagattcgggaatcgagtgggtcgagagccatgcggacgtggccggcggtggtgagctggacaggggcggcgtcgacttgaaggacgcgagggcgcagcactacaagcagatggagtccgggggctcggacggatcccactggtcgtccgaactgtgcaccatcactgctttcgacgcaggcaagaagaaagagctgaaggtggaattcgggccctcgtctcttcctttcgacttccagacgaagggcgccgaggaagggaccaacactccggtcaattcggacgtgaaactgcaccaggtggaggactccaggggagtcgtccggtacggcatctacgtcaagtgcaagattcccggcacgtcttcgcggcaggagaccgagactcccctggcgggcgtcatgaccgacaccctcactagcggtacatcggcccgcgaccacatgaagtacctcttgcactcggcacgggcgatggccgacgccctggagtgccggaacgaacccacgatccccgctgagccgggcgctgctatgccg

SEQ ID NO: 5935 - DNA, 1629 bp, Streptomyces avermitilis
  CDS (1)..(1629)
gtgggtgggctgcggaagctggcagtgccgtttgtcgcgtccggtccttcgggggtggcggtccgtacccggctcaagcagctcgcgcctgctgatgaggaggtgttgcggctggtgggcgcacatctgggcacgctggcctcccgtgatctgaaggcgcgctgcgcggacgctctggcgcacgacggtgaggcgtgggcggcgcgcaagcgggaaatgacgcccctgtcctcctcacgctgggcgggagccatcaccaaggccagccacgaccagtgggccctgtcccgccgctgccagctcgcccatatccagagcctggaagccggtatcagcacgatcaggcaccggctgtgcctgcctctgcgggagaagggcggcaggcgggcgccgggcggctaccacagcaggcaggagtggcacgccaaggcccgccgcctgcacgtccttgaagaccggctggagcaggctcgcacggaccgcgatgccggggtcgtgcacgtcgtacggggcggcaagcacctggcccgcacccggcaccacctggccgccgcacagctcaccgagaccgggtggcggcagcggtgggaggccgagcgctggtttttgaaggccgacggtgagtccgggaagcggtacggcaacgagaccgtccgcgtcagccccgagggtgaggtgagcatcaagctcccggccccgctcaaggagctggccaatgccccgcacggccggtacgtcctcgcctgccaggtgcacttcccgcaccgagggcaggagtgggccgaccgggtagaggccaaccgggccatcgcctaccgcatccactacgacacggcccgcgggcgctggtacctgaccgcctcctggcagatcccgcgcacccagaccgtcccgatcgaggccgcgctcacccagggcgtaatcggtgtcgacatgaacgccgaccatctcgccgcctggcgcctcgacgtccacggcaaccccgtaggagacccgcgccgcttccccttcgacctgtccggaccggctggccaccgcgacgcgcaggtccggcacgctctcaccgggctgttgcactgggccagggcctgcggcgtcacggcgatcgccgtcgaggacctggacttcaccgcggacaagacgcgcgagagacacggccgcaagcgccggttcaggcagctcatctccggcatgcccaccggcaggctccgcgcccgcctgacctccatggccgaccacaccggcatcgcgatcatcgccgtggacccggcctacaccagccgctggggcgcccagcactggcaaaagcccctcacctcaaagatcagaaagaccactcgccacgacgcggcagccgtggcgatcggaaggcgcgcccagggatatccgatccggcgacggacggcaccgcccccgcacgaccagagcgatcgtgcggggcatcggaccgtccaggccagaccgggcatcccctggcgtgagggaacccgcccccgcattcccggaccacggacacgatccgtcgggcccggacgcggagcgaacgcgggggaccagaacgcccaacaccgttcggggcattcggctgagcacgagtcctggcaacaggactcactcccactcagtctt

SEQ ID NO: 5936 - DNA, 3135 bp, Streptomyces avermitilis
  CDS (1)..(3135)
atgaccaccgagttggccctgctgtcccaagtcgcctatcacgggcgggagatcaccgcgccccggctgcgcgggctgttggcgttgctcgccggggatctgcgcaccggctgcggcaccggccgactggtggaggggctgtggccggacgagctgccggagcggccgggcaaggcggtgcaggtcctggtgtcacggctcagggcgcagctgggcgccgagctgatcgtgagcacaccgacggggtaccggctggcgctggacgaggcacaggtcgacagttccgcgctgctgctgtacgaggcggcgagtgccgagcgggcgcgggccggggatcacgaaggcgtcctggcgcaggccgaggccggcttggcgctctgggacgcgagcgtgggtgccggtgcgggcgaggatctgcacgatccggtggtggcgctgcgcgccgaccgggtccgggcgcatcgtgcgctggtccgcttccgggcactcgcgctcgcccgggtggggcggcgggaggaggcggcggcgccgctggccgggctggcccgggagctgccgcgggacgaggagctgctggcggagctgctgcggtgtgaggccgcgaccgccgggcgggcggcggcgctgacccggtacgacgcctaccgccgcaggctgcgggacgagctggggaccgatccggggcccggcctgcggtccgtgtaccaggagttgctgcgggcggacgtgccgacggtccggcacggtgtgccgcacgagccgaatccgctgctggggcgggacgccgacgtcgccgccgtgagcgggctgctgcgcgaggcgcgggtggtcacggtcgtcggtcccggcgggctgggcaagacccggctctcccacgcggtgagccgggcggccgcgcagcccgtggtgcatttcgtcaccctggccggtgtcctcgccgatgacgacgtggccggtgaggtcgcctcggcggtcggtgccggggagggccggttcggcggggacgcggtgggcggcatagtcgccgcgctgggcgccgggcccgcgctgctggtgctggacaactgcgagcaggtgatccccggtgcggcggacctcgtacaggccctggtgtcgcggtcgaaggagctgcgggtcctggccaccagccgggccccgctggggctgacctcggagtcggtgtacgccctgccggagctttcgccggcgacctcggtcgagctgttcacgcagcgggcgcgggccgccagacccggcgtggaactgcccgccgaccaggtggccgagatctgccgccatctggacgggctgccgctggccgtcgaactcgccgcggcccgggtacgggtgctctccgtggccgacatctcgcgccggctccgggaccgcttctcgctgctgcgcggcggcgcccgcgacgcgcccgaacggcatcgcacgctgcaggcggtggtcgagtggagctggaatctcctggaggccgacggccgggccgcgatgcgcgcgttgtcggtgttccccggcgggttcaccgaggacgccgcgcagtacgcgcttggcgagagtgcggacgcgctgacgctgctggagcagctggcggggcagtccctgatcaaggtcggggacaccccttccgggctgcgcttccacatgctggagacgctgcgggagttcagtgccgcccggcgcgcggaggccggcgaggaggaggcggtgaccgcccggttcctgctctgggcccgggacttcgggcgggcgcaccacgacgtgctgttcagcggcggtccgcggcgcccgtggatccgcatccgggccgagcaggacaacctcgtcctggccctgcggtacgcgctggcccgcgccgacgggcccaccaccgcggctctcaccgcagcgctgggctcgctctggtccaccggctccaactacgcccggctcgccgtcctcgccgaggagaccggcgggccgctgtcccatttccgtcccggtcccgagaacgccgaggacgtcgagacggcgcgcagcgcggcgacggtgtgcacggcctgcctcttcatgggccgcggcccccacgcagtacgccatctcgtcacgctccgccggctgccgcccgccccgccggacacgctggcgcgggcgctggccatcgtgctgtgcgccttcccggagatgcacccgccgcagtacacgcggctgcgggaactctgcgacgccgacgcgcccatgctggcgggcatggcggcaggcgtcgccagttacgtgtgggagaccgagcacgagacggagcgcgcgctggagtgcgcccgccggatgcttgacaccctggggtcgctcgagaatccggccatgcggctgatcagtcatgggcggatcagcgagttgtgcctgaagtccgggcatggcgcggaggcgtacgaccatctgcgggccgcgctgagcgcgctcgacgaggtcggcgactggtcggacacgatcggcgtccgctgggggctggtgctggcctgtctccagcgcggggaggtcgacgaagcggagtactggctgggactcgcggccctggagcagcagccggagtccgccgagtccttcagcaccgatctgccggcccgcgcggagatcgcactggcccgcgggctgaccgaggtcgggctggggctgtggcgccaggcggtggagcggatacgggagggcagcctgctgcacgccgacgatccgttcgtggatccgtggtcactggagatccagtcggccgcgctcgcggcgcacgcgcagcgcggccggctggagccggtggccgggctggccgagcggctgcgggaacggctgctcgggatgctgtcccgctcttcgggcgacggttccccggcggaactgccggtgtacggcacggtgttgctggcgctcggcttcgccgggctggcggggggcgatccggcggccgtacggctggtggcgctggcggagcggatgccggcggtgcgggagttccccaccttgtcctcggccaggtcccggcaggctgccgagaacgccgacagggcggcctacgacgacgcgaggtcgacgtacgccaccctgaagcgggaggaactgcgggcggccgcgctgcacgagctcagtgccgcggctcgcggt

SEQ ID NO: 5937 - DNA, 792 bp, Streptomyces avermitilis
  CDS (1)..(792)
atgagcaccgcgtcctacgccttccgcgacaacctcaccatgctccggcgcaacctcctgcacgcccgccgctacccctccctcaccctgaacctcctgctcaccccggtcatcctgctgctgctgttcgtgtacgtcttcggcaacgtgatgagcgccggcatcaacggcggccacgcgaaccgcgccgactacgtcgactacctcgtccccggcattcttctgctgaccgtggccatgacctcgctcggcaccgcggtagccgtgtgcaccgacatgaccgagggcatcatggcccggttccgcaccatggcgatctcccgcgcctccgtgctgatcggccacgtgatcggcagcgtgctccagacgctgatggctctggtgctggtcctgggcatcggactggccatcggcttccggcccgacgcgtcaccggtggagtggatcgcggcggccgctctgatggctctgaccagcctcgcgatgacctggctcgcggtcggcatcggtctggtcagccccaaccccgagggggccagcaacatcgggacgccgctggtgatgctgccgttcctgtccagcgcgttcgtgccggtggacgccatgccgggctggttccgctggttcgccgagtaccagccgttctcgcccctcatcgagaccctgcgcgggctgctgctgggcagcgggatcggcaccaggaacgcggtgctggccgtcgcctggtgcctggggctgtcgctgctgggctacctgtggtccaaggcgcggttcaaccgcgagccgcggcac

SEQ ID NO: 5938 - DNA, 996 bp, Streptomyces avermitilis
  CDS (1)..(996)
atgacgacgacgaaccacgaacccgcgatcgcggccaccgggctgcggaagtcctacggggacaagaccgtcctcgacggcatagacatccaggtgcccgccggcacgatcttctccctcctcgggccgaacggggcgggcaagaccacggtggtcaacatcctctcgacgctgatctccgccgacggcggacaggcgcggatcgccggacacgacctcgccgccgaggcccaggccgttcggtccgccatcggtgtcaccggtcagttctccgcggtggacggcctgatcaccggcgaggagaacatgctcctgatggccgacctgcaccacctctcccgcgccgagggccgacgggtgaccgccgcactgctggagcgcttcgacctggtcgaggccgcgaagaagcccgcgtccacctactccggcgggatgaagcgccgcctcgacatcgccatgaccctggtcggcagcccgcggatcatcttcctcgacgaaccgaccaccggcctcgacccgcgctcccgccacaccatgtggcagatcatccgcgagctggtctccggcggtaccaccgtcttcctcaccacccaatacctggacgaggccgaccagctcgccgaccgcatcgcggtgctcaacggcggcaagctcgtcgccgagggcagtgccgaggaactcaagcggctcgtccccggcggccacgtacggctgcggttctccgacccggtggcgtacgagcgggcggcgaccgcactgcgcgagaccaaccgcgacgacgaggcgctcaccctgcagatccccagcgacggaagccagcgcgagctgcgcgccatcctcgactggctggacgccgccggcatcgaggccgacgagctgtccgtgcacaccccggacctggacgacgtgttcttcgccctgaccggcagccccgtccccgccgacaccaacgccggcaaagacaccgacaacgacaacgccaaggagaccgtccga

SEQ ID NO: 5939 - DNA, 939 bp, Streptomyces avermitilis
  CDS (1)..(939)
atgcaccagccggaagaaacgaacgcccccgcccagcaagacacccagcaagccacccaggacgacgcgcgggcgatacgcgccctgtgggccgagatggcccgtggctgggcggccggtgacgccgcgctcttcgccgcgagcttcgcggaagactgcgacttcacgaccgtacgaggcgacaagccgtccggccggaccggcatcgaggccggacacgacgccctcttccacgggccgtacgccggaaccgtcctcgacgctcgcgtcgtggccgtccgattcctccgccccgacctggccacggtcgaggcggagtcgaccatcaccgcgccggacggcgagccgctggccaccacgcacgcgttggccgtcgtggaacggacggcggagcggcgctggtcgatcagggcgtttcacaacatgctccccgcgccccgtccggcacagcaggcccccggcccgagggagtccaccgcgcacgaacccgccgtgaacgaacccgccgcgcacgaacccaccgcgaacgaacccgccgcgaacgaacccgccgcccgcccgaaactccgccacctggccatcgtggcccgcgatccggagaagctggccgagttctactcctcggtcttcgcgatggaactcttccaccgcgatccggacggcagttgcttcctctccgacggctatctgtccctcgccctgatcaaacatcggctcgacggtgacaccccggtcggcttcaaccacttcggtttccacatcgaggacacggcggccacctccgaggcgctggtggcggccggtactccgaagccggccgaacgcttcaccaaccgccccttcgccgagtaccgggccatggatccggagggcaactggttcgacctctcggaacacggcttcggcggcccacgcccaccgtccgactccaccgggtcc

SEQ ID NO: 5940 - DNA, 654 bp, Streptomyces avermitilis
  CDS (1)..(654)
atgtccgctgcgacaaacgcattcggctccggtctgccggacgcccgatgtagcacccccgctcctaccgtcctgatggacgaccaggccctcggggactttctcgacgcggccatcggcgagtatcaactcatcaccgccgaggccccgttgccatgtttcgctctccttctcggcaacgcggaggcgacgacgtaccacgtacagcgcatcgccttcggccgtaacgcgcgtaccagtgacccagcggctcgacgggagttccgcgagacgatcgtgccgaagttcgggccggcctacgagaacgagcaccgtggctggtggatggactcccgcgacctcctccgggcgtcccgcgaggccgacgctctgggcatggacctgctcggctccatccacatgcacccggactggcaccgcctgggcccgccgtcggaacggggacagacgctcagcgagcgtccgactcccatggaccgccatctcttcggccggaccgaatggcccctcaacatcatctgctacctggagcgtcggggcggagtcttctaccacgccctggcggcctgggccccgcctccccggcgttcgtccgagggcaccgagtgcctcgaggtcgcactccggatccgtaccagttcactgacaagggcg

SEQ ID NO: 5941 - DNA, 534 bp, Streptomyces avermitilis
  CDS (1)..(534)
gtgccgacccactcgtccggcctcgccaggtactggcatacggcgttcgtcgcctgcctgctcgcgctcgcactcgcgctcacgggatgcaatccccatatgtatgacgaagtgcccgcactgcatgacgtgaagcgggcggaagtatcggggtcatggatcggctacgaccggacgaacgttgtcttccggcctgacgggaaggccgacatccgtctcttggacggacaggaatgggacttcgacgacaggtggcgcctgtcaggcacgggaacctggaagctgaccgacaagcggaccggatggaacgacggccagcatgtccaactgaccctcacctcacgcaccgcggtcgcgactcgtgcgccggagccgaacgagccgctcgacccgtcggccgaccgccccgagacacccaagacctacacctggacattcgagttgcggcgcgacgacaaggaagcgctgaagctctacttcttcttcggcgaccctgactcgcgcagcacatacatcctgcagacagacgcgcca

SEQ ID NO: 5942 - DNA, 732 bp, Streptomyces avermitilis
  CDS (1)..(732)
atgcccaccaagacgttgcggattcccaccacggacggccaggccgacgccttcgccgccttccccgaccacagcgagcggtacccaggggtgctgatgtacgcggacggcttcggcatccggcccgtgctgcgggagatggccctcgaactggccgggcacggctactacgtgctcgtccccaactccttctaccggcacggcccggcaccgctggtcgagcttcccgagtacatcggagaagggatccggcccgcggtcttcgcccagctgatgcccctgatcgaggcgcacaccgccgaacgtgtcctgagcgacgccgacgcctacctcaggttcctcaccacccaacccgaggtcggcgccggaccggtcgcggtgaccggctactgcataggcggcctctacgcgatgcgcaccgccgcggcccaccccgaccaggtggcggccgtcgccgcgttccacggcccggtgggtgtcgatggggccaatctcttctccaagctcaccgcccaggtccacctcggccacgccgaaggcgacatgacgcctgaggccctcggcgagctcaaccaggccctggatgcggcaggtgtcggctacacctccgagatctaccccggcaccatccacggcttcaccatgtccgacaccgacgcctatagcgccttcgggctgaagcgccactgggatcgcctgctcccccttctggaccgcaccctggccaacagc

SEQ ID NO: 5943 - DNA, 207 bp, Streptomyces avermitilis
  CDS (1)..(207)
atgagcgttgagtccgttcccgggggcggcacgcagctggagtggttcaagagcagctacagcagcggcgagccgggatccgactgcgtggaggtcgccaccgcccccgacaccgtccacatacgggactcgaagaacaaggagggggcgcagctcgcgttcccgaagggcccgtgggccgacttcgtggcgcacaccgccaagggc

SEQ ID NO: 5944 - DNA, 210 bp, Streptomyces avermitilis
  CDS (1)..(210)
gtgatcgtcgtgatcgctgggcatcacctggatctcgacgttcctgaactgcccgacctccaacagccgttcgagctgacgtacgcccctgacgccgagtcgggccgcggactgatcctcgtagaggcgtacgccgaccggtggggcgtcgacgacgggcccgccccttgcaagacgacctgggcggagctggacctggggcacgtctcc

SEQ ID NO: 5945 - DNA, 228 bp, Streptomyces avermitilis
  CDS (1)..(228)
gtgatgcccagcgatcacgacgatcacgcgggtctgacgggcggattccgcgtcttcaagctccggagcggcacctccctggggtacacggaggtactgcacatcacccgcctgatctccgagccgagagaggtgcagttcttggagatgcagtatggaagcatccgagcgcaggctctcacgccacgggagtcactggccttcatcgagaaagtgctgggagagaca

SEQ ID NO: 5946 - DNA, 1020 bp, Streptomyces avermitilis
  CDS (1)..(1020)
atgacccttcgtacgcgcatcctggtcctgatctcggccctcgtcgtcctggcgggcgtggccacggcctccgtcctgcacgcctcggcccgcgccgaccaacgcgaccgggcccagccgggcggcccgaggatcacggcgggcacggtcgcgctgaccggcgacagcggccgcctgatcttccggaacatggcgtggggcccgcaccgcgacgagctgacgacggtccaggcgtcggacccggcgggcccgcgcacggcgtcgacggtcaagtgcctgcgcttccacgcggcttcgggcacgggggtgtgcctccgggcggtgcacggcacggtccaggacacgtaccgggccgtcgtcctcgacgcgcaccttcacgagacggctcactacgacgtaccgggcatcccgtcccgcgcccgcgtctcgcccagcggccgtttcgccgcctggacggccttcgtcggcggcgactcgtacgcgggtacgaacttctcgacgcgggcggcgatcgtggacacgcgcacggggaaactcaccccgtccctggaggcgtaccgcatcgtcaaggacggccggacgtaccgcgcggcggacgtgaacttctggggcgtgacgttcgcggcggacgaccgcgcgttctacgcgacgctggcgacacggggcaggacctacctggtccgaggcgacctccacacccgcacggtcaccaccctccacacgaacgtcgaatgcccgtccctctcccccgacggcacgcacatcgcgtacaagaagcgcgtgaagggcctcccgaaggacgccccttggcacctgtacgtcctcgacctgcgcacgatgcgggagacggcactcgccgagccccgcagcgtcgacgaccaggcggtctggcgcgacgaccagacggtggtctacgccctcccgggcgactacggagcggacctctactcgctcccgtccgacggcacggacaccccacgccgtctgctgacggcgggggtgtcgcccgtgtacctcgac

SEQ ID NO: 5947 - DNA, 1317 bp, Streptomyces avermitilis
  CDS (1)..(1317)
atgtacgtggcggacagccgcgccggtacaccggattctccggctccggagtctgcgccggcgtccgcggaaggcgccgcccggccccgtgccgggcggcgccgcgccgcggtcgcgcccacggtgctcgcgctcggcacggtcagcctgatcaccgacgtctcctccgagatggtcacggcggtgctgccgctgtacctggtgacgggccttggcctgtccccgctgggcttcgggctgctcgacgggatctacaacggtttctcggcgctggtccggctggccgggggccatctggccgaccggggcgggggccgccacaagtgggtggcgggggccgggtacgccctgtcggcggcctgcaagcccctgctgctcctggcccacacgctcacccccatcggcctgatcctggccgccgaccgcaccggcaagggcctgcgcaccgccccgcgcgacgcgctgatctcactgtccagcacgtcacagacgcgcggacgggcgttcggcgtgcaccgggcgatggacacggcgggcgcgctgttcggcccgctcgtggccttcctgatcctgcgggccacggtcgacggctacgacgcggtgttcacggtcagtttctgcgtggccgtgtccggtgtgctggtgctggtgctgttcgtgccgggcggatccacccggccgcccgcgaccacggacactcccggccccactccccgccccaccctccgcgccgccctcgccctcctccgccgtcccgcgctccgccgcctggccgtctgcgcgctgctgctcgggctcgccacggtcagcgactccttcgtctatctcctgctccagcggcgcctcggcgtaccggaccgctggttcgcgctgctgcccctcggcacggcggccgcgttcctcctgctggccgtcccgctcggccggctcgcggaccgggtcggccggtggcgggtgttcctggcgggccacggcgccctgctgctcacgtacgggctgctgctgtcgtcctggcacgggacggcgctcccgtacgccgtcctggtcctgcacggcggcttctacgcggcgacggacggcgtgctcatggccgcggcctcggacagcgtgccggacgagctgcggtcgtccggcctggcgctggtccagacggggcaggcgctggcccggttcgtctgctcgatcggcttcggcgcggcgtggacggcgtggggcgaccgtacggcgctcaccgcgtcggcgatggcgctcgccgtctgcgcgctgttctcgctcggtctccgcccaccccgcccacctcgttcagaaggcctggca

SEQ ID NO: 5948 - DNA, 891 bp, Streptomyces avermitilis
  CDS (1)..(891)
gtgtccggcagaaacgtgtaccgccgcagtcgtgccctcgtggcatccgccgcagccttcgccgcagccgcggtcgggctctggaccgggttcgggggctcgtcccccgcgcaggccgcggccgcggccgcggtcccgtcccctgaccacgtcgtcgtcgtggtcttcgagaaccacgcctacagccaggtgatcaactcctccagcgccccgtacatcaactcgctcaggaccggcggcgccaacctctcccagtcgtacgccgagacccacccgagccagcccaactacttcgccctgttcagcggctccacgcagggcgtcaccgacgacagctgctacacgcccggcttctcctccgccccgaacctcgcctcggagctgctcgccgcgggcaagacctgggccagctacaacgagacgctgcccagccagggctcgacgacgtgcagcagcggcacctacgcgcgcaagcacaacccgtggttcgggttcagcaacgtaccgacgtcgagcgcgaagacgttcacgcagttcccgacggactacacgacgctcccgcaggtctccttcgtcgtccccaacctgtgcagcgacatgcacgactgctcggtggcgaccggtgacacctggctgaagaacaagctgggtgcctacgcgagctgggccaagacgcacaacagcctgctcgtcgtcaccttcgacgaggacaaccggctcagcggcaaccgcatcccgacggtcctgtacggccagcaggtgacggcgggttcgtcctcgtcggccacgtacaaccactacgacctgctgcgcaccctggaggacatgcacggcctgccgcacgcgggcaacgcggcctccggcaaggacatcaccggcgtctggacgtcc

SEQ ID NO: 5949 - DNA, 3000 bp, Streptomyces avermitilis
  CDS (1)..(3000)
atgacggcgccggggcgcaggagcagtaccttctcgcggctgctgcggcacggcttcaccgatccgtcggccgccgagcggctgctggagagcgccgagctggagcccgtcaaggccgaccccgtgctgctggaagccctgggcgcgaccgccgatcccgatctggcgctgctcggactcgtccgcctggtcgaggcgcaggacgaccacaccgcccgccgggagctcctcgacacgctgatcgcggccaaacccctgcgggaccggctcctcggcgtcctcggtgcctccgccgcgctcgccgaccatctcgcccgccaccccagggactggcaggcactcgtgacgtacgagccacgggatctgcacccgggggtggaggaattcgagcgcgggctcgcggaggcggccgaccccgtctcgctgcgcgtcgcctaccgacgctgtctgctgtcgatcgcggcgcgtgacgtgtgcggcaccaccgacctcgcccagaccgccgccgagctggccgacctcgccaccgccaccctgcgcgccgcgctcctcatcgcccggaccgccgcccccgacgacgcggcgatctgccggctcgcggtcatcgcgatgggcaagtgcggcggccacgagctgaactacgtgtccgacgtcgacgtcatcttcgtcggcgagccggcgaacggcgccgacgagggcaaggcggtccaggccgccacccggctcgcctcccacatgatgcgcatctgctccgagacgaccgtcgagggcaccatctggcccgtggacgccaacctgcgcccggagggccggaacggcccgctcgtgcgcaccctgagcagccacctcgcctactaccagcgctgggccaagacctgggagttccaggcactgctgaaggcgcggccggtggccggggacatcggactcggcgaggagtacgtcgccaccctcgcgcccctcgtctggcaggccgccgagcgcgacaacttcgtcgccgacgtgcagaagatgcgacgcagggtcgtcgcgaacatcccggccgccgagatagagcgtgagctgaagctcggccccggcggactgcgagacgtcgaattcgccgtgcagctcctccagttggtgcacgggcgagccgatgcgtcgctcaggagcggtaccaccctggacgcgctgaaggcgctggccgcgggcggctacgtgggccgcgccgacgcggtgcagctcgacgaggcctaccgcttcctgcggaccatggagcaccgcatacagctcttccggctgcggcgtacgcatctcgtgcccgaggacgacgccgacctgcggcgcatcggacggtcgctcgggctgcgcgccgatccgatcaccgacctgaaccgcgagtggaagcggcacgccaccgtcgtacgccggctgcacgagaagctcttctaccgcccgctgctcgacgccgtcgcccaactcgcccccggcgaggcgcggttgagtccgaacgcggcacgggagcggctggtcgccctcgggtacgccgatccggccgcggccctgcggcacctggaggcgctggcgtcgggcgtcacgcgcaaggcggcgatccagcggacgctgctgcccgtgctgctggggtggttcgcggactccgccgatccggacgccgggctgctcaacttccgcaaggtgtccgacgcgttgggcaagacaccctggtacttgcggctgctgagggacgaaggggccgccgccgagaacctggcgagggtgctgtcggcgggccggctcgctcctgacctgctgatgcgcgccccggaggcggtggcgctgctcggtgacggcgacgggggccggggtgggctcgagccgcgcgggcgggctcagctggagcaggaggtcctcgccgcggtcggccgggccgggggctccgaacaggcggtcaccaccgtgcgcggggtgcggcgccgggagctgttccgcacggcggccagggacatcgtctcctcctacggcaccgaggagacaccggccgaggcggatcagggcgcgctggtggacctggtgggcggtgccgtctcggatctgacggccgccaccctcgccgggacgctgcgggccgtggtgcgggaggggtggggggacaccctgccgacgcggttcgcggtcgtcgggatgggacggttcggggggtacgagctgggctacgggtcggacgcggacgtgctgttcgtgcacgagccgcgagaaggcgtggacgaacaggaggccgcgcgggcggcgaacgccgtggtgtccgagatgcggcggctgctacagattccgagcgcggatccgccgctgctcatcgacgcggatctgcggcccgagggcaagtccgggccgacggtgcggacgttgacgtcgtacgaggcgtactaccggcggtggtcgctggtgtgggagtcgcaggcgttgctgcgggccgaattcgtcgcgggcgacgaggagttggggcagcggttcatcgagctgatcgacccgttccggtatcccgcggaggggctcggggacgacgcggtgcgcgagatccggcggctgaaggcgcggatggaggcggagcggctgccgcgcggcgcggatcccacgctgcacaccaagctggggcggggcgggctgtcggacgtcgagtggacggtgcagctgcttcagttgcagcacgggtgggtggagccggggctgcgcacgacgcggacgcgtccggcgctggccgccgcgtgcgccgccggacttctcacgggcgaggacgccgcgatactggacgaggcgtgggtgctggccacgcgggtgcgcaacgcggtgatgctggtgcggggacgggcgggcgacacgttcccctcggacgggcgcgaactcgcggccgtgggccggtacctggggtacgggcccggacacgtgggcgacatgctcgacgactaccggcgcatcacgcgcagggcccgcgccgtggtggacgagcagttctacggcgcg

SEQ ID NO: 5950 - DNA, 987 bp, Streptomyces avermitilis
  CDS (1)..(987)
atgccaccgcagctcacgaccgcactccgtatgggcaccctggccctcctctggggctcgggcttcctctggatcaaactcgccctgaaccacggcctctcccccgcccagatcacgatcacgcgctgcgccctgggcacgctggtcctgctggcgctggcccggcgctccgcccagcgcctcccgagggaccgcgccacctgggcccgactcgccgtggcggcgctcctctgcaacgccgtccccttcgccctcttcagcgtcggcgagcagacggtcgactcgggcgtcgcgggcgtcctgaacgccacaactcccctgtggtccctgctgatcggcgtcctcctgggcacggaccgtgtgctgcacccgctccgcctgaccggcctcgtcctcggcttcgccggtacgctgctgatcttcgccccgtggcatcgctcgggcctcatgagctggggcgccctggccctgctcggcgcggcggcgagttacgcggtcgccttcgcgtacatggcccgcaagctgaccggccggggtgcgccgatggccgtctcggcggcgcagcttctgatggccaccgcctggagcaccctggccctgccggccgcgggccccgtgcacgccgacgcgacagctctgctcgccgtcaccgttctgggtgtgttcggcacgggcgtcaccttctacctcaactaccgcctgatcgccgacgagggccccaccagcgcggccaccgtcggctacctgctccccgtggtctcggtggcgctgggcgcactcgtcctgggcgagaccatcggactccgggtactcgcggggatggcggtggtgctggccggggtggcgatgacccgcggagtgggaacccgcgggggttcacctgccggcgccgacggggcggcgacaaccgggagttcgcgcaccggcgccgacgaggtgccgtccgcgtccgcccggcgccgcaccggggcggcgcctcacgcgccg

SEQ ID NO: 5951 - DNA, 891 bp, Streptomyces avermitilis
  CDS (1)..(891)
atgcttgatgtgcgacgtatgcaggtgctgcgggccgtggtgctgagcgggtcggtgaccgcggcggccgcggatctcgggtacaccccgtccgcggtgagccagtcggtcgcggcgctggagaagcagacggggacggagttgctggagcggacggggcgcggggtgcggcccaccgcggcggggctgttgctgaccgagtacgcggacgcgatcggacggcaggtcgccgaggccgagacggcgctggccgatctgcgggccgggcgcacggggcggctcgcggtgcggtacttcgccacggcgggggcgccgctggtggcgcccgcgctcgcccgcatgcgggccgaacacccgggcgtacgggtcgaggtgaagctgatcgaccccgaggacccgttgcccgacgtgaaggaggggcgggccgatctggcgctggtcgtgcggtccggcgaggccgggcatgaggggatacgactggtgcatctgctggacgatccgtaccgggtggtgctgccggaggggcatcggctggcggaccgggaggtggtcgagctgagcgagctggccgaggagccgtgggtggggagcgagtggccggggccgtgcctggacgctcagctcgacgcgtgcgccgccgcggggttcaggcccgggttcgtcgtggagagcggggactacctgaccgcgcaggggttcgtggcggcgggactcggcgtgagcctgattccccggctggggctgggtggccggcccgcgggggtcgtggtgcgggaggtccggggcccggagcccgtacggagaatctacgcggcggtacgggagacggcacccccgcagccggccctgcgggggctgctggaggccctgcgggaggcggcgggggctcac

SEQ ID NO: 5952 - DNA, 873 bp, Streptomyces avermitilis
  CDS (1)..(873)
gtgcccatgggtgagacgaccgtgacgactctggatggccgggacccagctgatccacagcccgtcgcggaagagtcgagagaccgcgcggaggagaggttcctgcgccggctgcgtgcgcctcggcggccccggttctggttcgagatcctgttgatcgcggtgagttactggacgtactcggtgattcgcaacgcggtgccggagcagagggcgcaggcgctgagcaatgcggacctgctgtggcgggtcgagcatcatctggggatcgccgtcgagaactcggtcaatcacgcggtcaactcggtgacatggctgatcgtcggcatgaactactactacgcgacgctgcacttcgtggtgacgctgggtgttctggtgtggctgtaccacagtcatccgggccggtacgcggccgcgcgcctcgcgctcttcgccaccaccgccgtggccctggtcggctactacttctatcccctggcgccgccccgcctgatgaacggcgcggccttcgtcgacacggtgctggtccaccagacgtggggttcgatggcgtcgggcgacctgaagcacatgtcgaaccagtacgcggcgatgccgtccatgcacatcggctggtcgctgtggtgcggcctgacgatcttcgcgctggcgtcggctccgtgggcgcggatcctgggcctgctgtaccccgcggggacgctgctggtcatcgtcgccaccgcgaaccacttctggctggacgcggtgggcggcatgctctgcctgtccttcggcttcctgctggcccgcctctggtacggcaccctgccgtatgcgctgccgcgctgggtcccggggactcggggggctccgctgctcccggcggagacg

SEQ ID NO: 5953 - DNA, 1032 bp, Streptomyces avermitilis
  CDS (1)..(1032)
gtgaccacacggcttgccgacatcgcagcccaggcgggggtcagtgaggcgactgtcagccgcgtcctgaacgggaagccgggcgtcgccgcgaccacccgccagtccgtactggccgcgctcgacgtgctgggctacgagcgcccggtccgtctgcggcagcgcagcgagggcctggtgggcctgataaccccggagctggagaatccgatattccctgccctggcgcaggtcatcggtcaggcgctgacgcgtcaggggtacacgccggtgctcgccacccagaccccgggcgggtcgacggaggacgagctgaccgagatgctggtcgaccgtggcgtggccggcatcatcttcgtctccggcctgcacgccgacacctcggcggacatgcagcgctacgaccagctgcgggcgcagggcgttccgttcgtgctggtggacggtttctcgcccaaggtgcaggcgccgttcatctcgccggacgaccgggccgcgatgacgctcgcggtcacccacctggtgtcgctcggccacacccggatcgggctggccctcgggcccaagcggttcgtccccgtccagcgcaagatcgagggctttgtgcgcagtgtgcaggagcagctcggactgagcccggacgacgtcgagcgggagctggtccagcactccctgtacaccctggagggtgggcaggcggcggccaccgcgctcatggaccgcgactgcacggccgtggtgtgcgcgagcgacatgatggcgctcggtgcgataagggcggcgcgccaacggggcctggacgtgccgaaggacatctcggtggtcggcttcgacgactcccccttgatcgccttcaccgacccgccgctgacgacgatccgcaagccggtgccggcgatgggtcaggcggcggtgcgtacgttgctggaggagatcggcgggacgcccgcgccccacagcgagttcgtgttcatgccggagctggtggtgcggggttcgacggcatcggcccctggggaccgaaatcgtccg

SEQ ID NO: 5954 - DNA, 1269 bp, Streptomyces avermitilis
  CDS (1)..(1269)
atgcggcgtggcatagcggccaccgcactggtggcgtccctcgccctcgcggcgacggcctgcggcggagacagcggcagtgacaaggcggacggtccggtcaccatcacctggtgggacacctccaacgccaccaatgaggcgcctacgtacaaggccctggccaagaagttcgaggctgccaactcgaacatcaaggtcaagtacgtcaacgtgcccttcgaccaggcgcagaacaagttcgacacggccgccggctccaagggcgccccggacatcctgcgctccgaggtcggctggacccccgccttcgcgaagaagggctacttcctgccgctggacggcacggaggccctcgcggaccaggacaagttccaggccagcctgatcaagcaggcccagtacgacggcaagacgtacggcgtgccgctggtcaccgacaccctggcgctggtctacaacaagaagctcttccagaaggcgggcatcggcaccgcgcccagcacctgggacgagctgaagaccgacgcggcgacgatcaagaagaagacgggcgtcgacggctactggggctcgacccaggcctactacgcgcagaccttcctctacggcgagggcaccgacacggtcgacgccaccgccaagaagatcaccgtcaagtcggccgccgcggtcaagggctacaagacctggcagagcctgttctccggcaagggcctgcacaaggccgacaccaccgccgacgcgtacgcccacatccaggacgcgttcgtcaacggcaaggtcgccgcgatcatccagggcccgtgggagatcaccaacttctacaagggctcggccttcaagacgaaggacaacctcggcatcgccaccgtcccggccggttccgccggcaaggggggcgccccgaccggcggccacaacctctcggtgtacgcgggctcggacaaggcccaccaggaggcttcgctgaagttcctgaagttcatgacctcggcgtcctcccaggaggccgtcgccctcaagaactccacgctgccgacgcgggacgacgcctacaccacgcaggtcaagtccgacccgggcatcgccggctaccagggtgtgctcgccgccgcccagccgcgtccggcgctgcccgagtacagctccctgtggggcccgctggacaccgagctgccgaagatcgcaggcggcaaggagtccctggacaagggcctgagcaacgccgagctcgcgatcgccaagctggtcccggacttcagcaag

SEQ ID NO: 5955 - DNA, 1002 bp, Streptomyces avermitilis
  CDS (1)..(1002)
atgacagtcgccatcgaccgagcgaccggcaagcgtcgcggtgaccgagcgccgcgccccgggctggtgcagcgcgtcaagaacggctaccagaagcactggtacgcctacgtgatgatcgccccggtggtgatcgtgcttggcgtactcgtcggctatccgctcgtgcggggcatctacctgaccctgaccgacgccaacagcctcaactcggcccgcacgatcggcgtcaaccacatcgacgccacgtacaagttcatcgggctggacaactacacggacatcctgttcgggccgacggcgtacgaccgtttctggtctcacttcctgtggactgtcttctggacggccgcctgtgtggccctgcactacaccatcggcctcggcctcgccctcatgctcaacgagaagctgcggggccgcaccttctaccggctgctgctggtcctgccctgggccgtgccgacctttgtcaccgtcttctcctggcgcatcatgctcgccgactccggcgtgctcaaccaggtcctcggcgcacttcacctgccccagccccagtggctggaggacaccttctggcagcggttcgccgcgatcatggtcaacacctggtgcggggtgccgttcatgatgctctcgctgctcggcggcctgcagtccatcgactcctcgctctacgaggccgccgagatggatggcgcgaacgcctggcagaggttccgccacgtcacgctgccgggcctgcgcgcggtcagctccaccgtggtcctgctcggcgtcatctggaccttcaaccagttcgccatcatcttcctgctgttcggacccacgggcgcacccgacgcccagatcctcgtcacctgggcctacttcctgggcttcggacagcagccgcgcgacttcgcccagtccgccgcgtacggcgtactgctgctgtcgatcctgaccgtcttcacctccttctacttccgctggctgaagcgcaatgaccagctcgccgtc

SEQ ID NO: 5956 - DNA, 906 bp, Streptomyces avermitilis
  CDS (1)..(906)
atgagcacgacgaccttcgagaaggcaccggccggaccggtctctgacccgcagccccgaagcggacggcccccccggcggggcgagcgccgcccgcttcgcgccgccctcctgcacggcggcctcgccgtggcgagcctcatcgcgctggccccggtggcctggctgttcttcctgtccctcggcccggacaaggacgactatctgcacccgggcaagatcctgggcaagctcagcttctccaactacagcttcgtcctggagaacaccggcttcttcgactggttcaagtcgacgatgatcgtggccctcggcaccaccctcatcggtgtcttcgtcgcggccaccaccggctacgccgtctcacgcatgcgtttccccggctacaagcagctgatgtgggtactgctgctcacccaggccttcccgatcgccatcctgatcgtgccgatgtacgagatcttcggccaactgggtctcatcgacacctactgggccctgatcgtcatcaactgcaccacggccgtgccgtacagcgcctggttgctcaagggctacttcgacaccatccccttcgagatcgacgaagcgggacgcgtggacgggctcacccccttcggcaccttcttccggctgatcctgccgctggcccgccccgggctggcagtcgcggccttctacaacttcatcaccgccgtcagcgaggtcgcgttcgcgaccaccttcatgctggacgactcgaagtacaccttcgccgtgggtctgcagaccttcgtgagccagcacgacgcccagtggaactacatggccgccaccgcggtgctgatcgcgatacccgtctccgtgttcttctacgttgtgcagaagaacctggtgaccggcctcaccgcgggcggaacgaagggc

SEQ ID NO: 5957 - DNA, 1848 bp, Streptomyces avermitilis
  CDS (1)..(1848)
gtggcggccgcggtgtcctcccccaagcatttcgagcaggggggaaccccagaccccgccggcaccgcggccgcctcacttcccgccccgtacacccgcctatacgacccgactcctcccccactctcggctgcgctcgagcggggggacccccatcgcatcaaggacgccatgagccagcactccgccgaccaggccccgacctccgctctcgccactgtcgccgcccaccgcgactggtggcgcgacgcggtgatctaccaggtctatccgcgcagcttcgccgacagcaacggcgacggcatgggcgacctggagggcgtacgttcccgactcccgtacctgcgcgacctcggcgtggacgccgtgtggctcagccccttctacgcctcgccgcaggccgacgccggctacgacgtggcggactaccgggccgtcgaccccatgttcggcaacctgctggacgccgacgcgctcatccgcgacgcccatgaactgggcctgaggatcatcgtcgacctcgtccccaaccactcctccgaccagcacgagtggttcaagcgggccctgcgcgaaggccccggctcgccgctgcgggagcgctaccacttccgccccggcaaggggaagaacggcgaactcccgcccaacgactgggagtccatcttcggcggccccgcctggacccgggtcaccgagccggacggcacccccggcgagtggtacctgcacctcttcgcccccgagcagcccgacttcaactgggagcacccggccgtcggcgacgagttccgctcgatcctgcggttctggctggacatgggcgtcgacggcttccgtatcgacgtcgcgcacgggctggtgaaggccgaggggctgcccgaccttggtgcccacgaccagctgaagctgctgggcaacgatgtcatgccgttcttcgaccaggacggcgtgcacgacgtctaccgccagtggcgcaccatcctcgacgagtacgcgggcgagcgcattttcgtcgccgaggcgtggacccccacgatcgagcgcaccgccaactacgtgcgccccgacgaactgcaccaggccttcaacttccagtacctgggcacctattgggacgcggccgaactgcgctcgtgcatcgaccgcaccctcgacgccatgcgcccggtcgccgcccccgccacctgggtgctgtccaaccacgacgtcacccggcacgccacccgcttcgccaacaaggccggcctcggcacccagatccgtacggccggcgaccgccggctggggctccggcgggcccgggcggcgaccctgctgatgctggcgctgcccggctccgcctacctctaccagggcgaggagctgggcctgcccgacgtcgtggacctgccggacgaggtgcgccaggaccccgcctacttccggggtgagggccaggacggcttccgtgacggctgccgggtgccgatcccgtggacgcgcgaggggtcgtcgtacggcttcggcagcggtggcagctggcttccgcagcccgcgggctggggcgagctgagcgtggaggcgcagcagggcgtcaccgggtccaccctggagctgtaccgcaccgcgctcgccgtccgcagcgaacggcccgacctcggcgccggcgactcggtgacctggctggaggcgcccgcgggcgtgctcgccttcaggcgcggggagttcgtctgcacggcgaacaccggcgccgcggcggtcacggtccccgcgtacgggagtgtcctggtcgccagcggtgagggcaccgtggtcgggaccgacgaggcgcagctgccggcggacaccaccgtgtggtgggcggtc

SEQ ID NO: 5958 - DNA, 1380 bp, Streptomyces avermitilis
  CDS (1)..(1380)
atggcaaggaaagcgctcgctgtctcgctcgccctcgcggcgggcctcacggtcccgcccgccgtctccccgaccactgcggcggcctcgccgcccggcaccaaggacgtcaccgccgtcctcttcgagtggaagttcgactcggtcgccagggagtgcaccaacaccctgggcccggccggctacggatacgtccaggtctccccacccgccgagcacatacagggctcgcagtggtggacctcgtaccagccggtcagctacaagatcgccgggcggctcggtgacgccaccgccttccagaacatgatcaacacctgtcatacggcgggtgtgaaggtcgtcgtcgacacggtcgtcaaccacatgtcggcgggcagcggcaccggcaccggcggctcggcgtacacgaagtacaactaccccggcctgtactcctcgtacgacatggacgactgcacggccacgatcaccgactacaccaaccgcgccaacgtccagaactgcgaactcgtcggcctcgccgacctggacacgggcgaggagtacgtccgcaagaccatcgcgggctatatgaacaccctgctcggctacggcgccgacggcttccgtgtcgacgcggtcaagcacatacccgccgccgacctcgccaacatcaagtcccggctgaccaacccctccgtgtactggaagcaggaggtcatctacgcctccggcgaggccgtccagcccaccgagtacacgggcaacggcgacgtccaggagttccggtacgcgtacgacctcaagcgggtcttcaacaacgagaacctcgcctacctgaagaactacggtgagggctggggctatctgaacagctcggtcgcgggcgtcttcgtcgacaaccacgacaccgagcgcaatggctcgacgttgaactacaaggacggggcgaactacaccctcgccaatgtcttcatgctggcgtacccgtacggcgcgcccgacatcaactccggctacgagtggtcggacgcggacgccggtccgccgggcggcggcacggtcaacgcctgctggcaggacggctggaagtgccagcacgcctggccggagatcaaggcgatggtcgccttccgcaacgcgacccgcggcgagtcggtcaccaactggtgggacaacggcggcgacgcgatcgcgttcggccgcggcgccaagggctatgtggcgatcaaccacgagtcgggctccctcacccgcacgtaccagacctcgctgacggcgggcacgtactgcaacgtccagaacaacaccggtgtcacggtcgacagttccggccggttcacggcgacgctcggcgccaacacggccctcgccctgtactccggcaagagcacctgc

SEQ ID NO: 5959 - DNA, 5418 bp, Streptomyces avermitilis
  CDS (1)..(5418)
gtggacctgataccgagagggtcggcgccccgcacgcgccgcacccaccgccacagccggaccgcggccgccgttgccgccgccgcactggccgtatcgcttgcgcaacccctcgaggcgcgggccgcgacaccgcccgcgcccccctccgacgcgaagctcgccgcggagcccgctcgccacgacgccacccgcgagcagttctacttcgtgatgccggaccgcttcgccaacggcgacacgtccaacgacaagggcggcctgacgggctcacgcctgtccaccggctacgaccccaccgacaagggcttctaccagggcggcgacctcaagggcctgacccgaaagctcgactacatcaagggcctcggcaccacctccatctggctggcgccgatcttcaagaaccagcccgtgcagggcaccggcaaggacgcctcggccggctaccacggctactggatcaccgacttcaccaaggtcgacccgcacttcggtaccaacaaggacctcgaaaccctcatctccaaggcgcacgccaagggcatgaaggtcttcttcgacgtcatcaccaaccacaccgcggacgtcgtcgactacgaggagaagtcctacggctatctctccaagggcgccttcccgtacctgaccaaggacggcaggcccttcgacgacgcgggctacacggacggccccaggaagttcccggcggtcgacggcgactccttcccgcggaccccggccgtggcggcgcggaagaagaacgccaaggtcccgtcctggctcaacgacccgacgatgtaccacaaccgcggagactccaccttcgccggtgagagctccacccacggcgacttctccggcctggacgacctgtggaccgaacgtcccgaggtcgtccggggcatggagaagatctacgagaagtgggtcagggacttcggcatcgacggcttccggatcgacaccgtgaagcacgtgaacacggagttctggacgcagtgggcgactgccctcgacgcctacgcgaagaagcggggcaaggacgacttcttcatgttcggcgaggtctactccgccgacacgtcggtcacgtcgccgtacgtcacccagggccgcctcgactccacgctggacttccccttccaggacgcggcacggtcgtacgcctcgcagggcggcagcgccaagaagctcgcctcggtcttcggcgacgactacaagtacacgaccgacaaggccaacgcgtacgagcaggtcaccttcctcggcaaccacgacatgggccgcatcgggtacttcctgaaccaggacaacccgaaggcgaccgacgccgaactgctcaggaaggaccggctggccaacgagctgatgttcctcagccggggcaacccggtcgtctactacggcgacgagcagggcttcaccggctccggcggcgacaaggacgcccgccagaccatgttcgcctccaaggtcgccgactatctcgacgacgacgagatcggcaccgaccgcggccacgcgagcgacgcgtacgacacgagcgcaccgctctacaaggagatcgccgctctctccaagctccgcaaggacaacccggctctcgccgacggcatccagaccgagcggtacgcggccgacggcgcgggcgtctacgccttctcccggacggacgccaggaccggcacggagtacgtcgtcgccgtcaacaacgccgacaaggcgagcgcggcgaccttcgccaccgggtccgcggacacggcgttcaagggaatccacggcaccgacgacgtgctgaagagcgacgccgacaagaagatcacggtcaccgtgcccgcgggcgcggccgtcgtcctcaaggcggcgggcaggccgggcacccccgccgcgaagccctcgctgaccctgaaggcgcccgacgccggtgccaccggcaccgtcgagctgagcgcggatgtggacgggggccggctcaaccgcgtcgtcttcgccgcccaggtcggcaacgccaagtggcggaccctcggttccgccgaccacgccccgtacagggtcacgcagaccatcggcaaagacgtaccggccggtaccgccctgcgctacaaggcggtcgtcatcgatgcggccgggcggaccgcgagcgccacggccgcgtccaccaccggcaccccgcccgccgcggagactcccacggcctcctcgcgggactacgcgatcgtccactacaagcgccccgacggcgactacaccgactggcggctctacgcctggggcgatctggccgacggcgagtcgacgacctggcccgccgggcacgacttcgtcggccgggacgcgtacggcgccttcgcctacgtcaagctgaagccgggcgcctccaccgtgaacttcctcgtcatcgacaaggacggcgacaaggacgtctccgccgaccgcacgatcgacgtcaccaaggccggcgaggtctgggtcgagcagggcaaggagaccgtacggaccgaacggccggactaccccgcgcaggacaagaccaaggccgtcatccactaccaccgcgccgacggcgacctcaccggctggggactgcacgtctggacgggcgccgcgacgcccacggactggtccaagcccctggagccggtgaggaccgacgcctatggcgcggtcttcgaggtgccgctcaccgacggcgccaccagcctcagctacatcatccacaagggcgacgagaaggacctctccgccgaccggtcgctcgacctcacggccgacggccatgaggtgtggctgttgaacggccaggagaaccacctgctgccgcagcccgcgggcagcgcggccgccctcgacctgaccacctccaaggcggtctggatcgaccggaacacggtcgcctggaacggctccgacgcggccgcctccacccagctgctgtcctcgcgcgacggctcgatcgccgtcaaggacggctcgctgaccagcgacgacgagcggtggctgcggctttcgaagaccagcctcaccgacgcccagaaggccgcgttcccgcacctgaagtcgtacaccgcctggtccgtcgacccacgcgaccgcgaccgggtgcgcgaggctctcgccggccaggtcgtcgcctcgcaacgagccgcgaacggagcggtgctggccgcgacgggcgtccagctcgccggcgtgctcgacgatctgtacgacgcgacgaaggcggacctcgggcccacgttccggggcgggcaccccacactcgcggtgtgggcgcccaccgcgcagtccgtgtcgctggagctcgacggcgcccacgtcaggatgaagcggaacaacgccaccggcgtctggtccgtcaccggccccgcgtcctggaagggcaagccgtaccggtacgtcgtgaaggtgtgggcgcccaccgtccggaaggtcgtcaccaacaaggtcaccgacccgtactcggtcgccctcaccaccgactccgagcgcagcctcgtcgtcgacctggacgacaggtccctcgccccgagcggctggtcgtcgctgaagaagcccaaggccgtgccgctgcgggacgcggagatccaggagctgcacatccgggacttctcggtggcggacaggaccgtcccggcgaaggaccggggcacctacctcgccttcaccgacaagaacagcgacggctcccggcacctgcggcagctggccgagtcgggcacgtcgtacgtgcatctgctgcccgccttcgacatcgccacgatcgcggagaagaagtccgggcagcaggccaccgactgcgacctcgcctcgtacgcggcggactccgagaagcagcaggaatgcctcaccgcggtcgccgcgaaggacgcgtacaactggggctacgacccctaccactacacggtccccgagggctcgtacgccaccgacgcgaacggcacccggcgcacggtcgagttccgcaggatggtcaagtcgctgaaccaggacggcctgcgggtcgtcatggacgtcgtctacaaccacaccgcggccgccggccaggccggcacctccgtgctcgaccggatcgtgcccggctactaccagcggctgctcgccgacgggtccgtggcgacgagcacctgttgcgcgaacaccgccaccgagaacgcgatgatgggcaagctggtcgtggactccctcgtcacctgggccaaggagtacaaggtcgacggcttccgcttcgacctcatggggcaccagcccaaggccaacatcctggcggtccgcaaggccctcgacgcgctcaccgtcgcgaaggacggcgtcgacgggaagaagatcatcctgtacggggagggctggaacttcggcgaggtcgccgacgacgcccgcttcgtgcaggccacccagaagaacatggccggcacgggcatcgcgaccttctccgaccgggcccgcgacgccgtacgcggaggcggccccttcgacgccgaccccggtgtccagggcttcgggtcggggctctacaccgaccccaactcctcggacgcgaacggcacaccggccgagcagaaggcccgcctgctgcactaccaggacctcatcaaggtggggctgagcggcaacctggcgaagtaccgcttcaccgactccagcggcaaggaggtcacgggctccgaggtcgactacaacggcacgggggccggctacgcggacgcgcccggcgacgccctcgcctacgccgacgcgcacgacaacgagtccctgtacgacgcgctcacctacaagctgccgaaggggaccccggcgggcgaccgggcccggatgcaggtcctggccatggcgacggccgccctcgcgcagggaccgtccctctcccaggcgggctccgacctgctgcgctccaagtccctcgaccgcaactcctacgacagcggcgactggttcaacgccatccactggaactgccaggacggcaacggcttcggacgcggactgccgatggcggccgacaacaagtccaagtggccctacgccacaccgctgttgacctccgtgaaggtgggctgcgaccagatcgagggcacctcggccggctaccaggacctgctgaggatccgtacgaccgagccggacttctcgctctccacggccggccaggtccagtcgaagctcaccttcccgctctccggcaaggacgagacgcccggagtgatcaccatgaagctcggcgacctcgtcgtcgtcttcaacgcgacgcccgaccagcaggagcagacggtcgccgcgctcgccgggaaggactacgcgctgcacccggtgcaggcggcgggcgccgaccctatcgtcaagtccgcttcctatacggcgaaatcgggcatgttcgccgttccggggcgtaccgtagcgatcttctcgcaggtcgcacgc

SEQ ID NO: 5960 - DNA, 1602 bp, Streptomyces avermitilis
  CDS (1)..(1602)
atggatgccaacggccggcagacggactccaccgtgatggtggtcgacgacgtgcccaccagccgctacgcgatgggcgccgtactgcgccgggccggacacagcgtcgtcccggtcgccagcgccggcgaggcgctcgtcgaactcgacgtactgctgcgcgcgggctccctgcccgatgtggccctcgtcgacgtcggcctgcccgacatgagcggcttcgaactgtgccgccggctcaagtcgcagccgcccacggccgccctgcccgtcgtgcacttctccgccgcggcgctcgcccccggcgaccgctgccagggcctggacgcgggcggcgacgcgtatctgtcggtgcccgccgaacccgaggagatccaggcggtcgtacgggccgcggtgcgcggcgcccggctgcgcaccggcgccgaggcgctggcacggcggctgacgctgctgtccgagacgatcgtcgccgtacaggcggcccgctgccccactgaactcgcccacgccgccgcccagggcaccgcgcggctcaccggcgacttcgcggccgtcttcgtcctcggcgaggacggcgagctgtaccccggcctgtcccggcgccgggcccgcacgtcactgccgggccccggggcgcacgaggccgtcgcccggctgatccgcggcaccacggccgggcacgcgggagtgcgcagcatcgtggtgcccgccccgctgtggcccgcgggctttctgcggcccggcgtctccgaggacgcgcgcgtggtgctggcacagacccaggagggcaagccggccgtctgcctcgccacccccgcgcacgcccgggcgcaggagaccggcgcgctcgtcgcccgcctcgcccaggccaccgcactcgccgcggaaccgctcctcatgtaccaggtggagcgccatgtcgcgctcaccctgcaacacagcttcctgccgcagaagcccgccgacctgccggggatggaggtggcggtccgctatgtgccggcctcccggcagaccgagatcggcggcgacttctacgccacgctgcgcacctcgcggggtgtgctcaccggggtcggcgacgtcgtcgggcactcgctggacgcggccaccgtcatggtggagatccggcacgcgctgcgcgcctactgcgtcgaggaccccgacccggccgtactcgtcacacggctcgaccggatgctccagcactaccaccccgaggcgaccgccacggtctgtctcgccctggtcgacccggacagcggacacgtcagcatcgccaacgcggggcacatcccgccgctgatcgtccacgacgacggcaccgcccgctaccccggcgcggcgggaccgctgctcggcctcgggctggagcgcccgccggccacggaggagttcctgacgccgaggcaccggctcctcatggtcaccgacgggctgatcgagacccggggcaccgacctctcggtctccatggaacagctgcgcatggcggcggccgacggcccgagcggtgtgggcgcactgtgcgacgccctgctggactgcttcggccgggaccgggaggacgacatcgcgctgctggccctgcggttaggg

SEQ ID NO: 5961 - DNA, 354 bp, Streptomyces avermitilis
  CDS (1)..(354)
atgccgcagatcaccgtcgactactccgccgagctcgcccccggcttcgaccggcccggtttcgcccgcgccctgcacgaggaggtcgtcaggacggcggccgcgaagcccgaggcgtgcaagacgcagttccgcaggggcgaggacaccacggtcggcgccgacggcgaggggcatgcgatcgtgcacgtcacgctcggactgctggccgggcggagcgacgagacgaaggccaggctgaccgaggcggcgctggaactgctgcgccagtacgtgaagcccgacggcggactcgccctgcacgcctccgccgaggtccgcgacctcgacccgtcgtaccggaagttcgacgcg

SEQ ID NO: 5962 - DNA, 699 bp, Streptomyces avermitilis
  CDS (1)..(699)
atgacaaccggggtacgccgcaggatgggcgtcgaggagcggcggcagcagttgatcggcgtcgccctcgacctgttcagccgacgctcgcccgacgaggtctccatcgacgagatagcctccgccgcgggcatctcgcggccgctcgtctaccactactttcccggcaaactcagcctgtacgaagccgcgttgcagcgtgcgtccgacgacctcgccgggcgtttcgtggagccgcgggagggaccgctgggggcccggctgctgcgggtgatgcgccggttcttcgacttcgtcgaggagcacgggcccggtttctcggcgctgatgcgcggcggtccggcggtcggctcgtcgacgaccaacgctctggtcgacggggtgcgccaggccgcctatgtccaaatactgtcgcatctgaaggtcacggagccgcccgtccgcctggagctggtgatccgctcgtggatctcgctcgtcgagtcgacggcgctgatctggctggacgggcggcggatcgcgcgcggcgagctggaggtccagctcgtgcacgacttcgcggcgctggcggcgatcagcgccgcgtacgacgacgagctggccgcgctgctgcgcgacgtgctcagggacgaggcacccgacggccccttcagcgacctcgtcgtccgcctgatcgcgctgacgtctcccccgacggcg

SEQ ID NO: 5963 - DNA, 1914 bp, Streptomyces avermitilis
  CDS (1)..(1914)
gtgcagtcacaggatgtcgccccgcgccccacccccgcctccggaccggtcgtcgacgtcgagcaggccgaggccgcgctcgtcgagcactacccgcgactcgtccgcctcgcctatctggtgctgccgccgagcctgggccgcaaccggcgggtactgaccgcgcacgccctcacccagcgggccctgccccgcggccgtacgtccgcggccgtgatccccgcgcaggccaagggccgcgacggcgacccggggtacgccctcgtacgcctgcacgtcgtgcgtacggcgctggaggcgggcctgccgctcgggcgcatggcgtggccgaagcgctcccagctgccgccgctgctgccccaggtgtggggcctgcggctcttcccgcgctcggggggtgccgacgaactcgccctggaccagcgcctgtccgccctgtcggggccggcccgcgccgcccatgtgctgcgtggcctggagaaactttccgaggacagcgtgcgccgggtgctcgacgcggcgggcgtcgcggacccggcggcggcgatcgccgaggcggcgaaggtgcccgcccccgacgcgctgctcgactcccccgagttcgacccctgctcgctgcacgcgcggcccaccgatctgatgcggcgcaggcagcacatgaaggccgcgctcgccgccgcggcggccgtcgccgtgtgcggcgccctgctggggctgcccggcggcggctgggctccggacggtgccgccgcgccgtcgtacgcggagaacccggcggcgcgggccgccctggatccggcccggctgacgaagacggcggccaccgcgtggaagacgtccgcgcgtaccgacttctccgtgtggcccgcgcgcggcgaccgcaccggcgacaccgcgctgctgcggcgcgcgctcgcggtgtgggcgcggccgggcgaggccgtgcgggtgtcggcgacgcccggcaccccgtcgggtgccccggccggcccgccccagctgctgtacgcgggcgacgtcgactccgcgcacgtggtgctgctgtacgacggactgcgcatcgcccgctacgccgagccgaaggacggcacgggcgccgccgcgctcgacttcgcgcgggtcgacggggcgagcggggccgaggccgaggcgctggtgctcggccgggccgacggcaacgtccgctatctgacggctccctgggtgaccggggcggccgagcgggacctgatgaagccggcgtccggcgcgatggacctgaacctgaccgacggtgtcgccgcgccactggccggctccgcccagcggaccggcgcgtgcacctcgtggaacgcgcttcagctgacggacggttcgggtacgcggctgctgaccgacctcggcgagctgatcccggcccacctcaccacggggcggccctcggcaccccgggaggcgtcgcgcacggcggcgctgcactcctgggccccgttcgcctgctcgctcgcctcggtgcgctcgcagggcgtgcggtccgtgaacgcctggcagttcgcgcagcaggcgttgccggacgggagcgggtcggcggggtgggtgtgcacgcgggccgacacctggcggggcggcggtacgcgggtgctggcgcagttccacacgccgggcggggcgtacggggcggtcgcggcgaaggccgaggactcgccggcgtgcggtgcgcgggatccgcatgtgctggcgggggtgttgtggaagtcggggacgggggcgtggtacttgctggccgcgggcagttcggacacggcctcgatccgggcgacgggcggcatcgacggggccgctgagggcaacctgctcaccgtgcggaccgagcggggagcccgggccgggctcaagggggtcctggcggacggcaggccgatctccggccttcgg

SEQ ID NO: 5964 - DNA, 510 bp, Streptomyces avermitilis
  CDS (1)..(510)
gtggggcccgtgacgactgagaactgggacgagcgggtcgcggccgcatgggccaccttcgacgactacgccgaaaaggacgcggcggacttccgcgcggtggtcgacgccctcgtcgccgaactgccggccgacagccccttcggccccttcgagcaggcctgcgcctgggactcgacgggccactcggacaaggcggtgccgctgtaccgggaggcgctggcgcgcggcctgagcggctaccgggggcggcgggcgaagatccagctctccagttcgctgcgcaacatcgggcaggcggaggagggcgtcaagctcctcactcccgaactggagggcccgtccgacgagttggacgacgccgtacgcgcctgtctggccctgtgcctggccgacctcggccgcgaacgcgagggcctgtccctcgtactgggtgccctcgcgccccatctgccgcgctaccagcggtcgatggcgaactacgcgcggctgctcgtggagccggaggac

SEQ ID NO: 5965 - DNA, 3114 bp, Streptomyces avermitilis
  CDS (1)..(3114)
atgaacggtccgtcgcgacgtacggtgctgggcacagccggtgcaatcggcctcggaaccaccctgggaacggcgattccggcccacgccactgagagccccggcgagggccccgccttggatacggctcccgcacgctccgcgctcaatcggctgctgcccgggcatgccggacagttccggctcagtctggtcggccggacccgcgggcgcgaccgtttccgggtcaccggcggcacagggcgcatccaggtgtcgggtacgacaccggccgtgctgctcaccggggtccactggtacctgaagtacgtgtgcggggcgcacctcgcgtggaacggcggccagctggacctgccccggagactgcccgcgcccgcgcgccccctcgaacggtccaccgccctgtcccaccgcttcgcgctcaacgacaccaacgacggctacacggccccgtacgcggactggtcgtactgggagcaccagatcgacctcctcgcgctgcacggctgcaacgaggtgatggtgatcgcgggcacggaggccgtctaccaccgggtcctgaaggacttcggctactccgacaccgaggcccgcgcctggctgcccgcgccctcgcaccagccgtggtggctgttgcagaacctctccgggtacggcggcccgctctcccccgaactgatcgccgaacgcgccgggctgggccgccgcatctgcgaccggctgcgcgcgctcggcatggcgcccgtcctgcccggctactacgggcacgtccccaagggcttcgtggagcgcaacggcggtgacgcccatgtcgtcccgcagggcatctggcacggcttcgaacgtccggactggctggacccgcgcaccgcctccttcgccgcggtcgccaagtccttctaccgccaccagaaggacgtcttcgggaaggccgcccacttcaagatggacctgctgcacgagggcggcacggccggcgacgtgcccgtgccgggcgcggcccgcggcgtggagaaagccctccaggccgcccaccccggggcgacctgggtgatcctgggctgggaggccaatccgctgcccgccctcctcgacgccatcgacaagaagaagatgctgatcgtcgacggcgtctccgaccgctacacgagcgtcaccgaccgggagaaggactggggcggcaccccgtacgcgttcggcacgatccccaacttcggcggccgtacgacgatcggcgcccgcgcgcacctctggaacgagaagttcttcgcctggcgggacaaggcgggcagcgcgctcgccgggaccgcgtaccttccggaggcggccgaccgcgacccggcggccttcgagctgttctccgaactggcgtggagcgccgggaagatcgaccgcgcggcctggttctcgtcgtacgccgacttccggtacggcggacgcgacgcctcggcccagaaggcctggcgggccctgcacgacaccgcctaccagcagcacgccgtcgagcgcagcgacgcgcacgactcgctgttctgcgcccgcccggacctggccgcgaaccgcgccgccgagtacgcgccgcgcgccctcacctacgatcccggccgcttcgacgcggcgctcagcggactgctcggggtggcgggcgggctgcggggcagcgccgcgtacacctacgacctggtggacgtcgcccggcaggcgctcgcgcaccgcagccgccagtatctgccgctgttgcgggccgcgtacgccaggaaggacgcggccgccttcacctcgctggccacgctgtggctgcggctcatgggcctgtcggacgaggtcacgggcacccacccggcgttcctgctcgggccctggatcaacgacgcgcggctgctcgccaccgacgccggcgaacgcgccgagttcgagcggaccgccaaggtgctcctcacggtgtggggcgggcgcgccacctccgacgcgggtgatctgcacgagtacgcgggccgggagtggaacggtctgatggccgacttctatctcccgcgctggaagaagtggctggacgcgctggcggacgcgctcgccacggggacgccgcccgcggccgtggactggttcgcggtggaggagccgtggacgcgggagcgcaaggactatccgctgcggccggtgggcgatccgtaccggacggccgcgcgggtgcgtgacgtcctggcgcgggcgccctaccagggctccctgaaggtcaccgccgaacccgccgccttcccgcccggcgggcacgcgcgcgtgacggccgtcttcaccaacgtcaacgggctgcggtccaccggccgcgtcgacttcgcgctcaccggcatcgacgccgagccgcaggggccgacgtccctggccggagtgccggccgccgggtccggcaccgtccgctggcgggcgagcgcacccggcacccccctggaccggccgctgcgtccgctgccgtacacgatcacggtgacgtacggccccacgggcgaggaccgggtcagcggcgcgttcgacggcaccctcttcgaggcggggccgctcgccgcgggctggaagacgtacacgaacaacgcggccgtcatcggacagctcggcgaccggttcgcgatcgacggggcgggcgcggacctgtggaaagggacggcggagttcggcacggcgtaccgggcgaaggccctgcgggacgggggctcggtcacggtgaaggtggacgcgcaggccgtcacgggtgcctgggcgcgggcggggatcgtggtccgggacagcctcgccacgcccggttcggcgggcttcctcgacctcgcggtcactccggccaacggagtcgtgctctcgtacgacaccaacggcgacggcacgctcgacacgtacaagcggatcaccgggatcaaggcgccggtgctgctgcggctgacgcgggccgagggctcgtacaccggcgcctgttcgacggacgacggggcgacctggcggacggtggcgacggtgcgcgtgccgggggcggcggacacccaggacgtcgggctgttcatgagcgcgacgaacggcgggagcggggcgcgcgggaccgtggagttcagcggctggaagctcggg

SEQ ID NO: 5966 - DNA, 465 bp, Streptomyces avermitilis
  CDS (1)..(465)
atgaggttgacgcgagagaagctggtggccggagctgccgtcgccctgctggcactgaccgggtgcggcgggtcgagcgggtcggacgacggcgccgcgaaggcggttccggcgacggcgaccggcagcctggaggacctggcggccgaggtgaagtgcaagcccgacatccagacggacgccgacgagatccggcaggccgtctgcaagagcacctccaggaagttcatcctcgccaccttcgccaccgaccgcggccagcgcgagtggctcaacgaggccaaggactacggcgggttctacctcgtcggcgccaagtgggtcgccgtcggggaccagaaggtggtcaagacgctgcgcggacagctcggcgggaccatggaggagggaacttcgcacgcctcgcacagctcgggcaccggcagtgacgcgagccatgagggcacgcactcgggtcacagcggc

SEQ ID NO: 5967 - DNA, 1542 bp, Streptomyces avermitilis
  CDS (1)..(1542)
atgggacgcaacacaagaaaacgccgttcgtcactggccaacaaggccatcgccgcatcggctgccctagcgcttggcgggggcgggctcatctgggcaaatttctacgcttctgcccacgagacgaactcgaactcgtggaagaacaacacgaaagccgccgccgccacggtggccacgatcagctgccccgacatcggccagaagctcaccaaggtgccgcgcggcgccaggtccggcgtctacaaggagctggcgacgctcgacaagcagatcaccgaggcgtacgcccggctggcctcgacccgtcaggctcagacgaaggacgcgaacttcgtccagaacgccatcctcggcccgctcaagcagaagcggaccgcggtcatcggccggatcaagatcgacttcaagcgggtcggtgccgccgccccgaactcgcttgacgcgctcgccgcctgtaccggatcgggcgccaaccagacgactgccggtggccagaacaacaacggtcagcagcagaacaacggtgggcagcagcagaacggcggccagcagcagaacaacggtggccagcagcagaacggcggccagaacaacggccagcagcagggcaacggcggtcaggccggcaacggccccgtcgccgccgacttcgtcgacatcaccaaggtgcaggcgaacgtccaggcgaaggcccgggcccagggcggtggctcgaccggcacgttcacgagttcctgcggtgtgaacgccaacaagaagttcaacaccgacaacgtgatcgtggcgcccggtgtcaccaacggcgcgcaccacctgcacgactacgtcggcaaccagtcgaacgacgccttcgccaacaacgacacgttcgcggcggcccagaccagctgctccaaccagggcgacaagtcgtcgtactactggccggtcgtgcgtatccagaacggtacgcaggacttcgaccagaacaacgacggcggtggcaaggaaggcaacgtcggccagatccagcaggccaagcaggcctcgatcaagttcgtcggcaacgcgaagagcaaggtcgtcgcgatgccgaagttcctgcggatcatcaccggtgacgcgaagaccctgaccaacggtctcgcgaacgccaacgcccactggagctgcaccggcttcgagaacaaggtgcagctgaccgagcagtacccgatctgcccccagggcagcagcgtggtgcgctcgttcgccttccagagctgctgggacggccagaacatcgacagcgcgaaccaccgtacgcacgtggccttcgccgacgcccagggcaactgcgccaacgggttcaaggcgatcccgcagctgacgatgcgtctcgtgtacgacgtgcctgcgccgaccatcgagaacggtcagatcaagaacgcctacgcggtggacggattccccgaacagctgcacaaggcgagcaccgaccacgacgacttcatcaacgtcttcgacgagaacgtgatgaaccagatggtcaactgcatcaacaccggcaagaagtgcaag

SEQ ID NO: 5968 - DNA, 651 bp, Streptomyces avermitilis
  CDS (1)..(651)
gtgcgagttgtcctagccgaagacctcttcctgctgcgcgacggactggtccggctgctggaggcgtacgacttcgagatcgccgccgcggtggagagcggccccgaactcacccgggcgctggccgagttgaccccggacgtggcggtggtcgacgtacggctgccgccctcgcacacggacgaggggttgcagtgcgcgctccaggcccgccgggacagacccgggctgccggtgctcgtcctctcgcagcacgtcgagcagttgtacgcgcgggagctgctcgcggacgggacgggcggggtcgggtatctgctgaaggaccgggtgttcgacgcggagcagttcatcgacgccgtacgccgggtcgcggcgggcggcaccgcgatggatccgcaggtgatccagcagctgctgtcgcggcgttcggccggcagcaagcctcttggccggctgaccgcacgcgaactggaagtgctcgaactgatggcgcaggggcggtcgaacgcggcgatcgcgggccaactcgtggtcacggaaagggcgatcgccaaacatacctccaacatcttcgcgaaactggggcttgaggtctcggatgacgacaatcggcgcgtgctggccgtactcgcctatttggaccagggccgc

SEQ ID NO: 5969 - DNA, 1278 bp, Streptomyces avermitilis
  CDS (1)..(1278)
atggagatcagcagcggcggcagcggcatggcgacgagggcgcggggcgtcgtacgcgacgggacgagggccctcgtgctggccgtggtcgggctccccggcgccctcgtcctctacgtactggccgtcgtttcccttctcctggtgcccctcggggtcgggatcgtcaccacgccctgggtgctggccggtgtgcgcggcttcgccgactggcggcgggtggtggccgccgagtggtgcggggtgcggattccgtccggataccggcccgtccccgtggacgccaacccgtggggccggtgtttccggctgctcagtgaccgcgccacctggcgggacctcatatggctccaggtcgacatgaccgccggattcgtgaccgcgctcctgcccgccgcgctgctcttctacccgctggaggggttcgctctggcggccgggctgtggcgggtcttcaccgacggtacgtacatcgggtggtggtacgccttcgtaccggtctccgggcaggcctccgcgctcgccgccggcgccctcggcgtcgtcttcctggtcgcctcgtaccacctcaccccgtccctgctgcgtgtgcacttcctgctcacccgggccgtgctcgcccccggccagggcgaactcgccgagcgcgtccgggtgttgaccgagacccggcgtgccgccgtcgacacctccgccgccgaactgcggcgcatcgagcgggacctgcacgacggggcgcaggcgcggctcgtcgcgatgggcatggacctggggacgatcgaggcgctgatcgagaaggacccggcgaaggcgagggaactgctcgcccgggcccgcaagtcgtccgccgacgcgctcaccgagctgcgcgacctcgtgcgcggcatccatccgcccgtgctcgccgagcgtggactcggtgacgcggtacgggcgttggcgctgcgcgtcccgatcgcgagcgaggtgaacgtcgacttcgacggccgacgcgcggccgcgcccgtcgagtcggccgcctacttcgccgtcagcgaggtgctcaccaacgccgtcaagcacgcgggggccgaccgcgtctggatcgacctccggcacagcgacggcatgctgcggatcgcggtcaccgacaacggcaggggcggcgcgcggatcggcacgggttcgggcctggccgggatcgagcggcggctgggtacattcgacggcgtcctggccgtcagcagccccgcgggcggccccaccatggtcagcctggagataccgtgcgagttgtcc

SEQ ID NO: 5970 - DNA, 1017 bp, Streptomyces avermitilis
  CDS (1)..(1017)
gtggtcggcatgagacttctgatgctgggtggtaccgagttcgtgggacgcgccatggtcgaggcggctctcgggcggggctgggaggtgaccgtcttccaccggggacggcaccaacccccgcccggtgtgcggtcgttgatcggtgaccgcaccgcaccggacgggctcgccgcgctcgccgaggccgtggcggggggcgcacaggagtgggacgtcgtcgtcgacacctggtcggctgcgccgcgggccgtgcgggacaccgcgcgactgctggccggcgcggcccggcgttatgtgtatgtgtcgagctgctccgtgtacgcgtggccgccggccgccggatacacggaagaggcacccctcgtggcggacgcgtccgcggacgcggagcagaccgactacgcgcgcgacaagcggggcggggagctggccacgctcgacgcgttcggcgcggagcgttcactgctcgtgcggtccgggctgatcctcgggccgtacgagaacatcggccggctgccgtggtggctcacccggacggcccgcggcgggccggtcctcgcgcccgggccgcgggagcttccgctccagtacgtcgatgtgcgcgacctcgccgagtggactctgggggcggcggagcgcggactgaacggggcgtacaacctcatcagcccgcaggggcacacgacgacgggcgaactgctcgacgcgtgcgtgcgggtgacgggcggtgcggccgagctcaggtggaccgaccccgaggtgatcctcgatgcggggatcgagccgtggacgcagttgccggtgtgggcgccgccgaagagcgaggggcacgccgctctgcacagtgccgatgtgtcccgggcgctgcgggacgggctgcgctgccggccggtcgccgaaacggtggccgacacctgggcctggctccaggacatcggcggcgtcgcccccgggcggcccgaccggccccccgtgggcctcgaccccgaggtggaggcgaaggtgctcggggtg

SEQ ID NO: 5971 - DNA, 582 bp, Streptomyces avermitilis
  CDS (1)..(582)
atggcgaacacccgttccttctcgtccgtcgcgaccgtcccctcccccgcaccgtccccgggctcggcacggcaccgactgcgtgccgtcgaccgggacgaggtggtggacgtcgccgacttcctgccgccgggcgccacctggctgcccgcgccccagcacaccctgcccacgctgccgggccagccgccgatgatcggctatctggtgctcgtcccggccgaccagcagaccgtgctgccggtcgccgtgccggaccagcccgaggcgagcgacctcaccgccggcgacggcccgctgatccgcgtcgacaccgtgcagcgcaccgccgaggtcgacggacagccgctcgacctcacctacctggagttcgagctgctcgcgcatctcgtcgcgcatccgcaccgggtgcacacccgcgaccagctggtcaccacggtgtggggatacgggcatgtgggcgacgggcggaccgtggacgtccacatcgcccggctgcggcgcaagctcggggccgatcaccggcagacgatccagacggtgcggcgggtcggctacaagtacacgccgccgacgggtcgc

SEQ ID NO: 5972 - DNA, 207 bp, Streptomyces avermitilis
  CDS (1)..(207)
gtgcgcaacgtcaacttcacaccaaggaagcgtccaagcagtgagaggagtctcctgcccgggcccggtgtctgcttcaatgggagtatggccagcttccagaagtacaccgcgacaggtcgccacgacctcgagcccttctggccttcccgtcagcaccacgacttcgaccgggtgtgttgtcgcgcgatgaacgcgccggccctt

SEQ ID NO: 5973 - DNA, 918 bp, Streptomyces avermitilis
  CDS (1)..(918)
atggagatcgacggcgccctcgccatcaaggtcgagacggagaactggcagcggcacgcgcgcatttcggcggagcggctgcgggagctggtggggcggatcggcacggccggcgaccgctggctggtggtgcagcggataccggacatcccggatgtgttcgcccaggtgtggcacgaggagggcggcgactaccggctggagcaccggctcaccgaggacgcgttcttcggtacggacctcacggacccggatcgggtggcggacctcctgaccggctgggcgcggcaggaggcggcctgggacgcgggcgtcacctgggagccggtcgacctcgggccgcaggaagaggtgcccgagcttgcggacgacgtgcggggcaaggtcgaggaccgcgtgcggacccggctgcgctgcggctacgacgaccggaaggtgctggccgagatcgccgaggagtacctcgtcgacgggggcgaccggccggtgtcgaaggcccaggcccggcggttggtggaccggctgtggctggagcggctggccgagcaggagacctgggagggcgtcaccgaccccgagcggctcgccctcgccttcgcggcgctggaggcgagcgggatcacggcccgggagaacttcgcgtgctgccggggctgcggcatggcggagataggcgcggagcgcgaggacgcccggggcttcgtcttcttccaccagcaggtcacggagcacgccgccgacgggtacggactcacgctctactacggcgggttcgacggagccgagcagaccacggtggccgtgggacacgaggtcgtggccgcgctcaccgcggcggggctgtccgcacagtgggacgcctccccggacaaggcgatctccctcacgccgctgacctggcaaagacggctggtcggt

SEQ ID NO: 5974 - DNA, 1026 bp, Streptomyces avermitilis
  CDS (1)..(1026)
gtgaccttcaaggctgagtacatctggatcgacggcaccgagccgacggccaagctccgttcgaagacgaagatcctggcggacgatgccaagggtgccgagctgccgatctggggcttcgacgggtcctccacgaaccaggccgaggggcacgcctccgaccgcgtactcaagccggtcgccacctacccggacccgatccgcggcggcgacgacgtcctcgtcatgtgcgaggtcctgaacatcgacatgacgccgcacgagtccaacacgcgtgccacgctggccgaggtcgaggagaagttcggcgcccaggagccgatcttcggcatcgagcaggagtacaccttcttcaagggctcgcgcccgctgggcttccccgagggcggcttcccggccgcgcagggcggctactactgcggtgtcggctcggacgagatcttcggccgtgacgtcgtcgaggcgcacctggagaactgcctcaaggcgggtctgggcatctccggcatcaacgccgaggtcatgcccggccagtgggagttccaggtcggcccgctggcgccgctcgaggtctccgaccagctgtgggtggcccgctggctgctctaccgcaccgccgaggacttcggcgtctccgcgacgctggacccgaagccggtgaagggcgactggaacggcgcgggcgcgcacaccaacttctccacgaaggcgatgcgcgagggctacgacgcgatcatcaccgcgtgcgagtcgctgggcgagggctccaagccgctcgaccacgtcaagaactacggcgcgggcatcgacgaccgcctgacgggcctgcacgagaccgccccgtggaacgagtactcgtacggcgtctcgaaccgtggcgcctcggtccgtatcccgtggcaggtcgagaaggacggcaagggctacatcgaggaccgccgtccgaacgccaacgtcgacccgtacgtcgtgacgcgtctgctcgtcgacacctgctgctccgccctggagaaggccggccaggtc

SEQ ID NO: 5975 - DNA, 693 bp, Streptomyces avermitilis
  CDS (1)..(693)
atgtcgcgcaggagaactctcagcaccaagaagaagctcgcgcttctgctcagcgccgctgcggtggccggaggcggggccttcgccctggccgccacgtcgaacgcggcgtcggtgcagaacgcctcgaactcgacggtctgccagggtctggccaccgcgatcggcaacaaccagaagttcatcgacgggcagcgcgccaaaccggacgcgcagtcggaggcgcggatcgccaaccgcgaggccgtcatcgccgagatcaagcgccagcaggaagcgtccggctgcgaggtcggagagtcggctcaggcggccgacggatcggctgcggccggggggtcggctcaggactcccaagccacgcagccctcgcaggccgccaccgcgcccgcggacaacgcctcggccaccgcgcccgcggagaacgccggcggcaacgcggcctccggggagcaggtctgcaagggctcgaccgtcacgctctccggcgagggcggcgctccggccgcgtccagcaaccagttcccggccggcacgaagctgaaggtcacgaacctggacaacaacaagtccacgaccgtggaggtcacttcggtctccggcagctgcgccctgctcaacaacgcggccttcgagcaggtccgggagcctggcaagttcctgatccgccgggctgtcatcgagaaggtgggg

SEQ ID NO: 5976 - DNA, 357 bp, Streptomyces avermitilis
  CDS (1)..(357)
atggagatctggatcaatcccgcctgttcgaagtgccgcagcgccctcagcctgctcgacgcggaggacgccgagtacaccgtgcggcgctacctggaggacgtgccgagcgaggacgagatccgcggcgtgctccagcggctcggactcgagccctgggacatcacgcggaccgaggaagccgtcgccaaggagctcggcgtgaaggagtgggcccgggacgccggttcgagggaccagtgggtgcgggcgctcgccgagcaccccaagctcattcagcggccgatcatcaccgcggacgacggcaccgcgctcgtggcacgcacggaggaggcggtacgggatgccttgtcccgg

SEQ ID NO: 5977 - DNA, 306 bp, Streptomyces avermitilis
  CDS (1)..(306)
gtgcccgctgccgcactgaagccgaagccgacccagtccacatccaggaggccggtcccgctggacctcccgtaccagcccgtggaaaagcgcccgctgccgccggggcgcccccgcgagtggtacatgacccacaaccgccgcctcaaggcgatgcgcctcgccatcgccctgctcgactccggggtgtacgtcccgaaccaggcgcgcaacgagacgatccgcagcacggcggagaccatcggcgtccacccgccgtcggacacgacgtgccacatggtccgcgcgctgatcaggtacagccgc

SEQ ID NO: 5978 - DNA, 1674 bp, Streptomyces avermitilis
  CDS (1)..(1674)
atgaatgggggcatgagcgagctcctctccttcgcgtacgaacacgacggcgaacgactcagcggcatgtacggcggtgacgacgacggggacgacgccgggggcgtagagggtggccgggaatcgcccaccgtcgtgctgctgcacggcgcgggcgacgggtgcgcggggcgcctgctccccctgctcgcggaattcgtcgcgcgcggctgccggggcctcgcgttcgacttctccgggcacggccaaagcaccggcgcgctggccgagtcgagcctgcgcagacgcttcgcgcaggcggtcgcggtgatcgacgcgcgggttcccggggacggtccgctggtcctcgtcgggttcagcatgagcgggcagacggtggcggatctcgccgcgcactacggggagcgggtggcggccctgggcctgtgcgcacccgccgtgtacgcggccgcggcatggccggttccgttcggtgcgggcgacggacggttcagcgagatcatccgtgcggcggacagctggcgggagtctcccgcgctcgacgtcctgcgggcgtacgggggccgggccgtgctcgcggtgcccggtaccgacaccgtgatcccgcccgccgtgaccgcggcggtgacggccgcgctcgccacgaacgcccagttcagcctggtcgaactgcccgacgcggagcacacgctgggcctgtggttccgcgaccacgaggacgaccggcggaggttcgtggacgccgtgctcaccgggcggggcgaggggggatggacggcgacccgggcctgggtggcgaagcagctcccggcgggcaggcgcgtacgggactcggcgcggctgcggggcggctggagttcgcagatacgccgtctcactctcgacgacggcaccggcctggtgctgcgcaccttcgtgcggcccttcttccggcgccacgcgcccggactgctctcccgcgaggcgtccgtcctcgccctgctcgccgcgcaggacggcacccccgtgcccgaggccgtcgccgtcgacgcgaccggcgaacactgcgaccacccttcgctgctgatgtccctgctgcccggcgcggtacgggtcgacgaggaggatctggaccggcgcctcgacctgctcgcgcggcaactcgtccggatccacaccgtcgtaccggacgaacggccacgcccctaccaggcgtggacgtcgcccgagcgggtccgcacccccgggggcgccctgtgggaccgggccgtggcggtgctcaggcgcgaaccgcccgcgtacgaagggtgcttcctgcaccgggacttccaccccgggaacgtgctgttcgacggtgcgggcgacacgctgcggatcagcggggtcgtcgactgggtcgagacctcgtgggggcccgccgacctggacgtcgcccactgttcgacggcgctcgcgctgctgcacggggaggcgtacgggctggggttccgggagcggtacgaggcccacggcggccggcgactggcggacggggcggaccacttgtactggcggctgctggacacgctggcgtactcccccgacgccgagaagctcgcggccccctggcacgagctgggccgcaccgacctgacgcgcgaggtactgggcgcgcggctggaggcttatgtgggcgggctgttgcggcggtacggc

SEQ ID NO: 5979 - DNA, 639 bp, Streptomyces avermitilis
  CDS (1)..(639)
atggggttcctggacatcctgctcggccgtaccaagccggtggcgcccgacctcgaccggctgttcgggctgccgtcggcggccgtgaccctggaggccgcggccgggttcacccccacgggtacgggcgcggtgtgcttctcgaccgtcgagggcgcggccttcgccgaggcgcaccaggaggtgcgggccctgctcgacgcggactccgagcgacggaactcccccctgcccgagcagggccgggagctcgggggcggaccacccgtcgagctcagccgggacgagtacggctactcctggctcgtctcccggcggacgcccgacgacctgccggcgctggtgagcgatctgcacgcggtcaacagcgcgctggagggcagcggcttcgggccgcagctgctctgctccgtcgccggattccggtccgcggcaacgggccgggacggcgggctgcggcggctcgggctcgtctacctctacaagcgcggcacgttctatcccttcgcgccgctggccggtgccggccggcggcgcgacaacgcgctggaactccaggtcaaggccgcgctcgccgacgatctgcggatcgagcaggacctgacccgctggttcccgatctggggcgcgcccggcctg

SEQ ID NO: 5980 - DNA, 930 bp, Streptomyces avermitilis
  CDS (1)..(930)
gtgatgcagatgcagagccggttccagagcgatcggcgactgaccgcgcggatgacagtcacactctttctcctcggactgctgtacctggcgttcgtcgccgcgctgatcgtcctgctgaagtcctgggtgctggtcgtggtgatcgcggcggcgttcctgggggcgcagtactggttctccgaccggatcgcgctgtacgcgatgcgcgggcggatcgtggagcgcgaggagtacccccagctgcacggggtcgtcgaccggctgtccgcggtggccgacatgcccaacccgctcgtcgccgtctccgacctggagatgccgaacgcgttcgcgaccgggcggaacgccgatcacgcggtgctgtgcgtgaccaccgggctactgcgacgactggagcccgacgagctggagggcgtcctcgctcacgagctgtcgcacgtggcgcacaaggacgtcgccgtgatcaccgtcgcgtccttcctcggggtcatcgccggtctgatcgtgcggttcgcgttctactcgcagttcttcggcgtacggggacggaaggaccagaacaccgttgtgatcttcatggcggtgctggcggtgtccgcggccgtgtacgcgctcagcttcttgctcatccgggccctgtcccgctaccgcgagctggccgccgaccgggccgccgccctgctgaccgggcgtccctcggcactggcgtccgcgctgaccaaggtcaccggtgacatcgcccgcatcccgacgaaggacctgcggtcggcgcaggccttcaacgccttctacttcacgcccgccctcggcaccacgccgggcctcgagcgcctcttctccacacatccgagcctggagcagcggctcgaacaactcggccgtatctccgccgagttgggcgaggcggcgacgcccgggaaggcgcgc

SEQ ID NO: 5981 - DNA, 321 bp, Streptomyces avermitilis
  CDS (1)..(321)
gtgcctcggaaagaccgcacgggagggtggaaggaggattcacccatgaaggcacaacgcgcgaggcgtctcttcgcggtatctgccgtcggcgttctgatggccgggggcgccgcgatcggcgcagcaggtacggcctcggcagccgctccggcccaagcccccacccaagtcaccacccatggctgttccaactggggtggccgtggcttcgtgagcaactgtggcttcggcttcaacaacggcttcaacaacggcttcggcttcaacaacggcttcggcaacggcttcggtggtggagtcgtggtcattctggtgtcc

SEQ ID NO: 5982 - DNA, 1407 bp, Streptomyces avermitilis
  CDS (1)..(1407)
atgttccagaacgccgacgaggccaagaagtacatcgcggacgaggacgtcaagttcgtcgacgtccggttctgcgacctgccgggcgtgatgcagcacttcacgattccggcggaggccttcgacccggccgaggagctggccttcgacggctcctcgatccgcggcttccaggccatccacgagtccgacatggcgctccgcgccgacctgtccaccgcgcgcgtcgaccccttccgccgcgacaagacggtcaacatcaacttcttcatccacgacccgatcacgggcgagcagtactcccgtgacccgcgcaacgtggcgaagaaggccgaggcctacctcgcgtcgaccggcatcgccgacaccgcgtacttcggccccgaggccgagttctacgtcttcgacagcgtgcgcttcaagaccgcggagaacgagtccttctaccacatcgactccgaggccggcgcctggaacaccggtgcgatcgaggacaaccgcggctacaaggtccgctacaagggcggttacttcccgaccccgccggtcgaccacttcgccgacctgcgtgccgagatctccctggagctggccaactccggcctccaggtcgagcgccagcaccacgaggtgggcaccgccggccaggccgagatcaactacaagttcaacacgctgctcgccgcggccgacgacctccagctcttcaagtacatcgtgaagaacgtcgcctggcgcaacggcaagaccgcgaccttcatgccgaagccgatcttcggtgacaacggctcgggcatgcacgtccaccagtcgctgtgggccaatggcgacccgctgttctacgacgaggccggttacgcgggcctctcggacaccgcccgctactacatcggcggcatcctcaagcacgccccgtcgctgctggccttcaccaacccgacggtgaactcgtaccaccgtctggtcccgggcttcgaggccccggtcaacatggtctactcgcagcgcaaccgctcggccgcgatgcgtatcccgatcaccggctcgaacccgaaggccaagcgcgtcgagttccgcgccccggactcctccggcaacccgtacctcgccttctcggcgctgctgctcgcgggcctcgacggcatcaagaacaaggtcgagccggccgagccgatcgacaaggacctctacgagctggcccccgaggagcacgcgagcgtcgcgcaggtcccgacctcgctcccggccgtgctcagcgccctcgaggccgaccacgagtacctgctccagggcaacgtcttcacgcccgacctgatcgagacgtggatcgactacaagcgcacgaacgagatcgccccgctccagctgcgcccgcacccgcacgagttcgagctctacttcgacgtc

SEQ ID NO: 5983 - DNA, 489 bp, Streptomyces avermitilis
  CDS (1)..(489)
atgagggcgcagtaccgtggacgggtggacaacaggcaagtaatcggatcgtggctctccggcccccgcgaggccgcggaacaagccggggccgacttcggctaccggggcgaacagctcggtctgccggaggaggggccgggttcgatcgcccgcccgggccgccgcttcggcgccctcgccgtcgactggggcctgtgcctcttgatcgcatacggcctgctcacccacggctacaaccagacgaccggcaactgggcgctgctcgtcttcctcgggctcggcttcctgacggtcggcacggtgggcttcaccccgggcaagcgcctgttcggtctgcgggtggtcgccgagggcacgggccgcgtgaacccgctccgcgccgtcgtgcgcacggtcctgctgtgcctcgcgatcccggccctgatctgggaccgcgacggccggggcctgcacgaccggctggcccgcacggtcgaggtcagaatc

SEQ ID NO: 5984 - DNA, 699 bp, Streptomyces avermitilis
  CDS (1)..(699)
atggcgaggaaggaacccgcagcggacgctgcgaacccggggcgactcaagcagatcgctctcacttacaagatgacccgcaaggccgactcaaagatcggtcttgtactcgcggctgtcggaatcatcaccttcggtgtcttcctcgcgatcggcttcttgatcggccacccgtactatctcggcattctcggcctcctgctcgccttcctcgcgtcggcgatcgtcttcggacgcagggccgagcgcgccgccttcgggcagatggagggccagcccggcgcggccgcggccgtgctcgacaacatcggccgggggtggacgacgactccggcggtggcgatgaaccgcagccaggacgtggtgcaccgggcggtcggcaaggcgggcgtcgtcctggtggccgagggcaacccgaaccgggtgaagagcctgctggccgccgagaagaagaagatggcgcggatcgtggcggacgtcccggtgcacgatgtgctcgtgggcaccggcgagggccaggtggagctgaagaagctccgtacgaccctgctgaagttcccgcgcgtcctgaccggcccgcaggtcaccgcgaccaacgaccggctgcgcgcgctgggcgacctgatgagcaacatgccgttgccgaagggtccgatgccgaaggggatgcgcatgccgcgcggtgggccgaaggcccgc

SEQ ID NO: 5985 - DNA, 195 bp, Streptomyces avermitilis
  CDS (1)..(195)
atgcaggccgcgcccgtacgcgccaccgccattccgtcgttcaccgatgcactccgtgccgtcgagtcgctgctcatgagcggcggccagcgcaccgcccgtcgcaatgcctggacgtcggtccaggaggaccgccgccgtgccaaggaccgggtcgaggcgcagcgcgtgctggaagcggtgtcgacgcgtccg

SEQ ID NO: 5986 - DNA, 984 bp, Streptomyces avermitilis
  CDS (1)..(984)
gtgtccgcagtcgcacccgacggacgcaagatgctgcgcctggaggtccggaacgcccagacccccatcgagcgcaagcccgagtggatcaagacccgggcgaaaatgggtcccgaatacacgaagatgcagaacctcgtgaagagcgaggggctgcacacggtctgccaggaggcgggctgtcccaacatctacgagtgctgggaagaccgcgaggccaccttcctcatcggcggcgaccagtgcacccggcgctgcgacttctgccagatcgacaccggcaagcccgaggccctcgaccgcgacgagccgcgccgcgtcggtgagtccgtcgtcacgatggacctgaactacgccacgatcacgggcgtcgcccgcgacgacctcgaggacggcggcgcctggctgtacgcggagacggtccgccagatccacgcgcagacggcgggccgcgaggccggccgcaccaaggtcgagctgctcgcccccgacttcaacgccgagcccgaccagctggccgaggtcttctccgcgcgccccgaggtcttcgcgcacaacgtcgagacggtcccgcggatcttcaagcgcatccgccccggcttccgctacgagcgctccctgaaggtcatcacggaggcccgggactacggtctggtcacgaagtcgaacctcatcctcggcatgggtgagacccgcgaagaggtcagcgaggcgctccggcagctgcacgacgcgggctgcgagctcatcacgatcacgcagtacctgcgcccctccgtgcgccaccaccccgtggagcgctgggtcaagccgcacgagttcgtggaactcaaggaggaggccgaggagatcggcttctccggtgtcatgtcgggcccgctggtccgctcctcgtaccgggccggccgcctgtaccagatggccatggagctgcgtcagtcagccgctccgcagggcggtgcgcaggtcgcctcgcaggcggtc

SEQ ID NO: 5987 - DNA, 795 bp, Streptomyces avermitilis
  CDS (1)..(795)
gtgagtgagttgcggttcgtccacatgggattcggtgccgaggccgtcgagtaccaggcggcctgggacgagcagcgccgtgtgcatgccgcccgtttcctggacgaggtccccgacacctgtctgctcctggagcacccgccggtctacacggcgggccggcgtacggcggacaacgagcggcccctcgacggcacccccgtcgtcgacgtggaccgcggcggcaagatcacctggcacggcccgggccagctcgtcgggtatccgatccagaaactgccgcgcccggtcgacgtcgtcgcccacctccgccgcctcgaagaggtcatgatccgcgtctgcgcggagttcggcgtggccaccagccgcgtggagggccgggcgggcgtctgggtcctcggcgacccggtggagcagcgccccagcctcggcggcctctccctcgacttcgacccccgcctggccgacgacgagttcgacccccgcctcaacggccccgagtacgccccctccaacgccggccagcgccgcgaggaccgcaagatctgcgccatgggcatccgcgtcgccaagggcgtcaccatgcacggtttcgccctgaacgtgaatccggacacgtcctccttcgacaagatcatcccgtgcgggatccgcgacgcgggcgtgacgtccctcgcgtacgagctgggccgcgaggtcaccatcggcgaggtcctgccggtcgcggagaagcacctgcgggacgtactggagaacgcggacctgaagccgcgcgaggtggaacgggcctcggcc

SEQ ID NO: 5988 - DNA, 1437 bp, Streptomyces avermitilis
  CDS (1)..(1437)
atgacggaacgacccgcgcagcgcacccccaaccgacagctcgccgcgctcatcgcagaagcggggttctccaacgcaggtctcgcccgtcgcgtggaccagctcggcctcgaacacggcctggacctcagatacgacaagacctcggtgacgaggtggctgcgcgggcagcagccccggggcaccacccccgcactcatcgccgaggtgttcacccgccgcctcggccgccggctcaccgcccaggacctgggcctcgacgcgtgcgcccccgtctacgcgggcctggagttcgccgcgacgcccgaagaggccatcgacatcgtcggcgggctgtggcgcaaggactccggcagccacgccgagctgcgcaagatcgcgttcaccccggccgggctcgtcgtgcccagccgggactggctgatcggccgcgccgacgaccgggtcggccgcggcgatccgcccgccgcccgggtgcccgcgcagggccggcccgcggtgccccgccagcgcagccagaccgagcgcggccccggccagaaggtcaccggcggcgacatcgccgcgctgcgctcggtgggcgagctgttccgggcgctcgaccacgcgtacggcggcggccacgcccgccaggccctggtccgctatctggagcacgaggccgagccgatgctgcgcggcacgtacggcgagcagaccgggcgccgcctgttcgccgccgcctccgacctcacccggctcgccggctggacctcgtacgacatcggcgcgcacgggctcgcccagcggtacttcgtccaggcgttgcggctgtcccaggcggccggggaccgggcgtacggctcgtacgtcctggtcaccatgagccgccaggccgtctacctcgggcacggccgggaggccgtccagctcgcacgggtggcccagcagggggtcggggcgtcggcgccgcccgtggtgcaggcgctgctgcactccgtggaggcgcgcgggcacggggtgctgggggaggtacgggcctgcacggcgtccctggtgcgtgccgagcggtcgctggaggcggcccgccccggcgacgaagtcccttactgggcacggttcttcgacgaggcgcagctcgccgacgagttcgcgcactgccaccgggacctccagcagttccgggccgcggcacagcacgcggagcgctcgctgcaactgcgtgcgccggggtacgcccgcagccggctcttctgccgcgtcgtgctcgccacggcccggctcgggctcggagagctggaccaggcctgcctgctgggcgcggaggcggccgggcaggcggcggagatgcggtcggtacgggccatcgagtacgtccgcgacttcgagcgccgcctggagccgtaccgggacgcggcgcccgtacgcgggtaccgggaccgggtgacggcgttgcag

SEQ ID NO: 5989 - DNA, 1395 bp, Streptomyces avermitilis
  CDS (1)..(1395)
gtgcttgagtcggtgcaccaagcaagtgcgtacaccgcggatgtacaacccgcggacgtcgtcatcgtgggagccggggcggcgggactcgccgccgcccaccatctgaccagggcaggcctcaccaccgccgtcctggaggccgcgccgaacgtcggcggccgcatgtcgacggagaaggtggacggcttccggctggaccgcatgggccagttgctctccaccgcgtatccggaactccgcagcacccccggcctggacgccctgcccctgcgggagttctcccccggcgtgctggtccacagcgacggccacctccaccgcgtcggggagcccggcacaccccggagcgcaaggggcgcactcaccgctgcgcgcgccctcgcaagcgccccccgacagcagcgcacaccgcgcgccccccgcacccaaggtgcctcccgcccgggcctgctgggcagtcccgtcggccagtcccggctggccggcgcactcgcccggctcgccgccaccccgcccgaccggctgctgtcccgccccgaactcccggccgcccgggccctgtcggccctcggccttccgccccgcacgatcgacggctttctgcgccccctgctcgccgcactcctgtgcgacccggccctggagacctccagccgctgcgccgacctggccctgcgtgccttcgtgacgggccggctgtgtgtcccggagggcggcgccgacgttcttccggagctgctcgcggccacgctcccgccgggcaccgtccacacgggtgtgcgcgtcacggcggtctccaccacctccgtcacgacgaaggaccacggcgaactccgctgtcgggccgttctgctggccaccggcgcccgggccgccgcccggctgctcccgggcctgcgcgtccccggcttccacccggtgacggtcctgcaccacacgaccgacgagccgccgctcggcgacccggccctcgtcctcgacgccgagcgcggcggcccggtggcgcacaccgcggtcatcagccgggtcgacccgagcagggccccggccggccgcgcgctcgtctcctcgacggtcctcggtacgcccccgccgccggaccggctggaggcggcggtccgggcccaactggcccggctctaccggacgtcgaccgcccgctgggagctcctcgcgatccaccacgactccgaggcggtcccggcgatgcccccgccgcacgatccgcgccgccccgtacgcctgctcgcgggcctgtacatctgcggcgaccaccgcgacaccagcacggtccagggcgcgctccgctccggccgccgcgccgcccacgccctgctcacggatgtgggggcaggccagacctcactggaggagccgctcgagacggcggcc

SEQ ID NO: 5990 - DNA, 918 bp, Streptomyces avermitilis
  CDS (1)..(918)
atgaactccgatgcgccgcttcctcccggttcccgcgtcgcgatcgccggtgcgtccgggctgatcggttcggctctggcgcgctcgctcacggcggacggccacgaggtcgtacggctcgtacggcgggcgccgcgcgggaagaacgaggtccgctgggatcccggggaacagcggatcgactcggccgggctcgtggggtgtgccgcggtggtcaatctggccggggcgggcgtcgcctcgcggcggtggacggacgcgtacaagcagacgatccgctccagccgggtgctgggcaccgcgacgctggccgaggcgatcgcctcgctcgacgagccgccggcggtcttcgtcagcggcagtgcgatcggcttctacggcgacacgggcgaccgggcggtggacgagacggcgccgcccggtgacggcttcctgcccgccctgtgcgtggagtgggaggaggcggccgagccggcccaggaggccggcgtccgtacggtgttcacccggaccggcctggtggtggccgccgggggcggtgcgtggggcaggctgtttccgctcttcaaggcgggtctcggcggccgtatgggcgacggccgtcagtactggagctacatctccctgcacgacgaggtcgcggcgatccgccatgtcatcgatacggcgtccttgtcggggccggtgaacctgacggcgccgacgccgctgaccaacgcggagatcacggcggcgatgggccgggtcctgcaccgcccgacgctcttcacggccccggcgccggtgctccgcgcggcgctcggcgacatggcgggcgacatcctgggcagccagcgggtgctgccggcccgtctgctggaatcgggcttcgccttcgcgttccctggcatcgaggagaccctccgctcggcgctgcgc

SEQ ID NO: 5991 - DNA, 516 bp, Streptomyces avermitilis
  CDS (1)..(516)
gtgatcctcatgccggatccgcacatacgcttcgcgacccacgacgacgaggacgggctcgcccggctggaccgagtcacctggtccacgctgcacgccgtccagccccgcccgcaaccgccgtacgaccccttctacagcgaccggttcggcccccgcgaccacctcgtggccgagctgggcggacgcctggccggctacatccggctggggtacccgacccccctcgccgccaactcccacgtccggcagatccaggggctcgtcgtcgccgaggaggcacgcggggcgggcgtcggccgggcactcctgcgggccgtccaggagcacgccgcgcggcagggcgcacgccgcatctcgctgcgcgtgctcgggcacaacacccccgccaggaagctctacgagtcggaggggttcgaggtggaggggatcctgccggaggagttcctgctggacgggcagtacgtggacgacgtcctcatggggcgtgctctgcgacccgcggtcccgcgctca

SEQ ID NO: 5992 - DNA, 1182 bp, Streptomyces avermitilis
  CDS (1)..(1182)
gtggacctgctcgacttcctgctgttgctggtgatcctggcctacgcggcgtccggctaccggcgcgggctggtcgccgggtgtgtctcgctggccggtttcgtgggcggcgccgtcgtcggcgtatggatcctgccgtgggtgatgaagctggtgacaccgggcacgtcggcggcgacgctgacggccgtgctgacggtcctcgcgcccgccgtggtcgggcacgagctggcgggcaggctcgcgctgcggctgcgccgcgagctggaccgcgggccgctgcgggtggccgacggagtgggcggggccgccgcgaacacggtcgccgtgctgctggtcgcctgggtggcggcgagcgtcctgggcgcctcctcgacgagcatgatcacgacgtcgatccgcaattcggcgctgctgggcgcggtgcagaacacgatgccggacaccacccccacctggttctcgcgcgcgacgtcggcgctcacgcaggccggcttcccgcaggtcttcaacccgttcgagaacgagccgacgacgggtgtcgccaagccctccggggacagcgtcacgccggccgcgacgaacgccgcgaagctgtccaccgtgaaggtcgagggcatcgcgggcagccagggccgcgagggcagcggcttcgtgtacgcggggcagcacgtgatgacgaacgcccatgtggtggcgggcatcgacgagccgaccgtccgcgtgggcggggtcgggcgggcgtacgaggcccgcgtggtgctcttcgacccgaacaaggacgtggcggtgctgtacgtcccggagctgaaggcgccggtgctgcgcttcgacgacagcgcggcgcggggcggctcggcggtcgtggccggttatccgcaggacggcggcctcgacctccaggcggccacggtcgcgggccggatcaacgcgaccggccagaacatctacaactcggacaccgtcacccgcgagatctactcgatccgctccacggtccgccccggcaactcgggcggaccgctgctgaccacggacggccgggtgtacggcgtcgtgttcgcgcgctccacctcggacaacgagacggggtatgtgctgacggcggacgaggtgagcgacgacgcgcggcgcgcggcggccgcgacggatccggtgggcacgggcgacctggtcacctca

SEQ ID NO: 5993 - DNA, 951 bp, Streptomyces avermitilis
  CDS (1)..(951)
atgcgtggacctgtaaaaacgtcccggaccagggcaatggttccgccgggtggcacagcgcacatcgcggcgggccgggaccggcgccagggtgagggcatgcgtgtgttgcgaggtgcgcggcgggtcctgggccgggtacgcgttccggtacgaattccacaggtgccaggaccgggtggcgcgcgccgttcgccgtggctgcggcgcacggccctcgtcgcgctggcctgtgggcccggtctcgccgccgtcctggcgctggtgctgtgcgcggcaggtgtcgaccgcacggtggccgcgcacccggcgcccgtcgtcggccgccccgcgccggcgcacaccaccgcccggccgcccatcgtgccccgctcccgctggatcgacgaccgcacgcacaagcagccgccgccgcgctacgacgacaaggtcgtcgcggtcttcgtgcaccacaccgactcgcccaacacctacgactgcgccgacgcaccccgcatcatccgctccctgtacgcgggccagatcggcccccggcagtgggacgacctcggctacaacttcgtcgtcgaccgctgcggcacgatctacgagggccgcgcgggcggcgtcgaccgggccgtcaccggcgcccacgcccagggcttcaaccaccgcaccgcggggatcgcggcgctcggcaccttcaccgagggcacgccggtaccgcgggcggtgaccgacgccatcgccgcgctcgccgcctggaaactcggcctcgcggacgtcgacccgcgctcccgcgtccgcctcgtctccaccagcggccagagccggtacgccgccggcaccatcgccacactgcctgtcctgtccggccacaacgacggcttcccgacgacctgccccggcgcggccctcaccgcccacctcccggcactccggcaggcggccgcgcggctccagggccggacc

SEQ ID NO: 5994 - DNA, 225 bp, Streptomyces avermitilis
  CDS (1)..(225)
atgagcagcagccgtacacgcaccacggagcaggcgggcggatggaccaaggccgcgcgcagcccgtggacggtggtctgcgcggtggcgacggtcgtcctcggcccgggcgcggtcaccgcgtccgccctcgaccaggccaacgccgcgcccttgcaccacgccgtccgggccgaccatgcccaggcgtacatccccgcggacctcagccggcgccgagcggcc

SEQ ID NO: 5995 - DNA, 519 bp, Streptomyces avermitilis
  CDS (1)..(519)
gtgatggacgagacggagttctgggagctggtggacacgacccgcgaggccgccgacggcgaccccgaggaccacgccgacctgctcgtggaacggctcgtccggatggacccggactcggtgctcgacttcgcccgccacttcgagtcccgctacaaccgcgcctaccggtgggacctctggggcgccgcctgggtactgctcgacggagccagcgacgacgccttcgacttcttccgctgctggctgatcggtcagggccgggaggtgttcgagggcgccgtgcacgacccggactccctcgccgagctcctggacgagttcgacgaggagctggacggcgacggcgaggagctggggtacgcggcggacgaggcgtacgagcagctcaccggcgtcgtcgctcccgacctgggcattccgccggcggcgcccgagcccgccggaaccccgatgaacctggagaacgagtcggagctcgccgagcgctatccccggctgtgggagcgcttcaagggc

SEQ ID NO: 5996 - DNA, 969 bp, Streptomyces avermitilis
  CDS (1)..(969)
atgcgcgctgcccggctgatcaaaatggtgctgttgctccagtcccggcccaccatgaccggcgccgagctggcgcgggagctggaggtgtccgagcggacggtcacgcgggacgcgcaggcgctgtccgaggccggggtgccggtgtacgcggaccgggggcgggccgggggctaccggctggtcggcgggtaccggacgcggctgacggggctggcccggagcgaggccgaggcgctgttcctctcgggggtgccgggggcgctgcgggagatgggcctcgaggacgcggcctccgcggcccggctgaaggtgtccgccgcgcttcttccgtccctgcgggacgcctcgcggacggcggcgcagcggttccatgtggacgcgcccggctggttcaaggagcccgatacgcccgagctgctgcccgcggtggcccaggcggtgtgggacgaccgccggatcaccgcgcgctaccggcacggggacaccggtgtggagcgggagctggagccgtacgggctcgtgctgaaggcgggggtctggtacctatgcgcacgcgtgccggagccggggtccttccgggtgtaccggatcgaccggttcacggcggtcgccgccgacggggagcgtttcgggcgggacgaggacttcgacctgcccggcttctgggaggaacaggccgagcggttcgcgcggtccctcctgcgggcggaggtggtggtgcggctgtcggccctggggctgcggagactgccgtccgcccttgatccggcgtccgtgcgcctggcccggcagacgtgcggcgagcccgacgagcggggctgggtgaccgtcacgctccccgtggagtcggaggaggtggcccacagccagttgaccgccctgggcgccgaggcggaggtgctgtctccggtgaccttgcgggaacggttcgcgggggacgcggcccggcaggcggagctgtaccgg

SEQ ID NO: 5997 - DNA, 2700 bp, Streptomyces avermitilis
  CDS (1)..(2700)
atgaccgaccccaccgcaatccagccgagcgagctcgaccagctcccggaccgcgaccccgaggagaccgccgagtggcaggcctccctggacgccgtcacccaggcggccgggccgcaccgtgccgcgtacttgatgcgccgcacactggagcgcgccgagggcaacggcatcgcgctgccgaagctgctcgagacggactacgtcaacaccatccccacctccgccgagcccgtcgtggacggcgacgaggagatggagcaccggatcaccgcgtggaaccgctggaacgcggccgcgatggtcacccggggcagcaaatacggcgtgggcggccacatcgccaccttcgcctccgccgcctggctgtacgagaccggcttcaaccacttcttcaggggcaaggaggcggacggttccggtgaccagctctacatccagggccacgcctccccgggcatctacgcccgcgccttcctcgacggccggctgaccgagcaccacctcgaccacttccgccaggagtccggcggcaacggtctgccgtcgtacccgcacccgcgccgtctcccctggctgtgggagttcccgacggtgtcgatgggcctcggcccgctctccgcgatctaccaggcgcgcttcaaccgctacctgaccagccgcggcatcaaggacgtctcgcagtcccacgtgtgggcgttcctcggcgacggcgagatggacgagcccgagtcgaccgcggcactcgccctggcctcccgcgagggcctggacaacctgaccttcgtcatcaactgcaacctccagcgcctcgacggcccggtccgcgccaacttcaagatcgtgcaggagctggaggcccagttccgcggtgccggctggaacgtcgtcaagacgctgtggggctcggcctgggacgagctgttccagctcgacaccacgggcgccctcgtacgccgcctgcgcgaggtaccggacgcgcaggtgcagacgtaccagacccgcgacgccgcctacatccgccaggacttcttcggcgccgacccggccctcgtcgagatggcgaagctgatcggcgacgacaagatcctcgagtgtttccacctctcccgcggtggtcacgagtcgcgcaaggtctacgcggcctacagggcggccgtgtcccacaagggcgcgccgacggtgatcctggcccagacggtcaagggccacaccctcggcgagggcttcgcgtcgaagaacgccaaccaccagatgaagaagctgtcgacggacgagttcaagcagatgcgtgacctgctggaactgcccatctccgacagccagttcgtcgacggcgtggtgccctacggccacccgggcgccgactcccccgaggtccgctaccttcaggagcgccgcgcggccctcggcggcccggccccggcccgccgtacgcacccgctggccccgctgccggcccccgccgacaagacgttcgcgtccttcgacaagggctccggctcgcagaacgtggcgacgacgatggcgttcgtccggctggtcaaggacctggtccgcgacaagcagaccggccggcgctgggtgccgatcgtgccggacgaggcccgtaccttcggtatggagtcgctcttcccgtccctcggcatctattcgccgaagggccagacgtacgagccggtcgaccgcgaccagctgatgtactacaaggaggccaaggacggccagatcctcaacgaggggatcaccgaggccggctccatggcggacttcatcgccgcgtccaccgcgtactccacgcacggcgaagcgatgatccccttctacatcttctactcgatgttcggctggcagcgcacggccgaccagatgtggcagctcggcgaccagctgggccgcggcttcctggtcggcgcgacggccggccgtacgacgctgacgggtgagggcctccagcacgcggacggccactcgccggtcatcgccgcgaccaacccggcggcgctgacgtacgacccggcgttcgcgtacgagatcgcggtcatcgtcaaggacggtctgcgccgtatgtacggcgaggcggccccgggcgaggacccgaacgtcttctactacctcaccgtctacaacgagccggtgccgcagcccgcgaagccggccggcctcggcatcgacgagggcatcgtcaagggcctgtaccgcttcaacacggccgagtcggcggacctgtcccccgccgccaacgccccgcgcatccagctgctgggctccggcacggcgatccactgggtgcttcaggcgcagcggctgctcgccgaggagtggggtgtggccgccgacgtgtggtccgcgacctcctggaccgagctgcggcgcgacgcgctcgaggccgacgcggcgctgctgcgcggcgaggagcgggtgccgttcgtccgccaggcgctgcacggcgccgagggcccggtgctcgcggtctccgactacatgcgtcaggtcccggaccagatcgcgcagtgggtcgagcaggactactcgtcgctcggtgcggacggcttcggcctctccgacacccgtgacgcggcccgccgtcacttcggcgtggacgcggagtcgatcgtcgtcgcggccctggcccagctcgccaggcgcggcgaggtcaaggccacggcggtgaaggaggcgcgggagcgctacggcctg

SEQ ID NO: 5998 - DNA, 621 bp, Streptomyces avermitilis
  CDS (1)..(621)
atgaccgcgcccgtcgtccactcgctgcgcgaacagatccgcgagcacatcgtggaggggatcgtcagcgggcgctggaagccgggcgagcggatcgtcgagcggcggatcgcgacggagctggaggtcagccagacccccgtacgggaggcgctgcgcgagctggagtcgctgcggctgatcgagtcggcgcccaacaagggcgtacgggtgcgcaacctgaccgccgcggacctcgaggagagctaccccgtacgagccggtctggaggccatcgcggcggagctggcggccgggcggctggccgaggactgctcggccctcgaaccgcacgtcgcggcgctgtacgaggcggaccggcacgccgacgggaccgcccaggtgcggcacaccgtggccttccaccgggaactggtgcgggcggcggggaactccgtcctgctccacacctgggagggcctgggcatcgaggtcttcacggccctgtccatccgctggctggggacggtgcagcagtcgtacgcggaggagcacgaggccctcgtcgacgccttccggcgccgggacccgctgatcgcggaactcgtgaaggcgcatgtgctcgggtgcgctccgcgagcg

SEQ ID NO: 5999 - DNA, 1257 bp, Streptomyces avermitilis
  CDS (1)..(1257)
gtgctgctcgagatcgtggtcggcgaggacgagacggccgaggtcggcgcgaagctcgccgtcatcggtgcgcccggtgccgctccggcggccgccccggcgcaggccgcgcccgcgcccgccgccgccccggccgccccggctcccgccccggctgccccggctccggccgctccggctccggctccggccgccccggccccggctcaggccgcccccgcggcgcccgccgccccggctcaggccgctccggccccggccgctccgcaggccccggccgccccggcgccggcccccgtcaccccggccgcggcgcccgccgcgacctccggtgacgacggcgcctacgtgaccccgctggtgcgcaagctcgccgccgagaacggcgtcgacctggccaccgtcaagggcaccggcgtcggcggccgcatccgcaagcaggacgtcaccgccgccgccgaggccgcgaaggccgccgctccggcgcccgccgccgctccggccgccgcgaagaaggccccggccctggaggtctcccccctccgcggccagaccgtcaagatgccccgcatccgcaaggtcatcggcgacaacatggtgaaggccctgcacgagcaggcccagctctcctcggtcgtcgaggtggacatcacccgcctgatgaagctccgcgcgcaggcgaaggactccttcgcggcccgcgagggcgtcaagctctccccgatgccgttcttcgtgaaggcggcggcccaggcgctgaaggcccacccggccgtcaacgcccggatcaacgtggacgagggcacgatcacctacttcgacaccgagaacatcggtatcgcggtggactccgagaagggcctgatgaccccggtcatcaagcacgcgggcgacctcaacatcgccggtatcgccaaggccaccgccgacctggcgggcaaggtccgggcgaacaagatcaccccggacgagctgtccggcgcgaccttcaccatctccaacaccggctcgcgcggcgcgctcttcgacacgatcatcgtgccgccgaaccaggtcgcgatcctcggcatcggtgccacggtcaagcgcccggccgtcatcgagacggaggagggtacggtcatcggcgtccgcgacatgacgtacctgacgctctcctacgaccaccgtctggtggacggcgccgacgcggcccgttacctgaccgcggtcaaggcgatcctggaggcgggcgagttcgaggtcgagctcggcctg

SEQ ID NO: 6000 - DNA, 912 bp, Streptomyces avermitilis
  CDS (1)..(912)
atgccggtttccgtaacccttccggcgctcggcgagagcgtcaccgagggcactgtcacccgctggctgaaggccgagggtgaacgcgtcgaggccgacgagccgctgctcgaggtgtcgaccgacaaggtcgacaccgagatcccctcccccgccgccggcgtgctcgcgtccatcaaggtcgccgaggacgagacggtcgaggtcggcgccgagctggccgtcatcgacgacggcacgggcgcgcccgccgccgccccggccccggccgccgagcaggccgccgagcaggtcgccccgccggctcccgagccggcgccgcaggccaccccgtccaccgagcaggccgcccccgcgccggccccgaccgccgaggccgccgccggcgccggcagcgccgagggcaccgacgtcgtcctgcccgcgctgggcgaagtcggtcaccgagggcaccgtcacccgctggctgaaggaggtcggcgaggaggtctcggaggacgagccgctgctcgaggtctccacggacaaggtcgacaccgagatcccggcgcccgcctccggccgtgctgctcgagatcgtggtcggcgaggacgagacggccgaggtcggcgcgaagctcgccgtcatcggtgcgcccggtgccgctccggcggccgccccggcgcaggccgcgcccgcgcccgccgccgccccggccgccccggctcccgccccggctgccccggctccggccgctccggctccggctccggccgccccggccccggctcaggccgcccccgcggcgcccgccgccccggctcaggccgctccggccccggccgctccgcaggccccggccgccccggcgccggcccccgtcaccccggccgcggcgcccgccgcgacctccggtgacgacggcgcctacg

SEQ ID NO: 6001 - DNA, 1500 bp, Streptomyces avermitilis
  CDS (1)..(1500)
atgggttctcggcaggacagggcccccaccacagggccgaagaagagcggccggacaccagccgccgaccggtcactgacgaccggcgtggcgcacatgcatggaggacgtgacgtggcgaacgacgccagcaccgttttcgacctagtgatcctcggcggtggtagcggtggttacgccgcggccctgcgcggagcgcagctgggcctggacgtcgccctgatcgagaaggacaaggtcggcggtacctgcctgcaccgtgggtgcatccccaccaaggcgctgctgcacgcgggcgagatcgccgaccaggcccgcgagagcgagcagttcggcgtcaaggccaccttcgagggcatcgacgtaccggccgtccacaagtacaaggacggggtcatctcgggcctgtacaagggtctgcaggggctgatcgcctcccgcaaggtgacgtacatcgagggtgagggccgtctgtcctccccgacctccgtcgacgtgaacggccagcgcgtccagggccgccacgtgctcctggcgaccggctccgtgccgaagtcgctgccgggcctggcgatcgacggcaaccgcatcatctcctccgaccacgcgctggtcctggaccgcgtcccggagtccgcgatcgtgctcggcggcggcgtcatcggcgtcgagttcgcctccgcgtggaagtccttcggagccgacgtgacggtgatcgagggcctcaagcacctcgtcccggtcgaggacgagaactcctccaagcttcttgagcgcgcgttccgcaagcgcggcatcaagttcaacctgggcaccttcttctcgaaggccgagtacacccagaacggtgtcaaggtcaccctcgccgacggcaaggagttcgaggccgaggtcctgctcgtcgccgtcggccgcggcccggtctcgcagggcctcggctacgaggagcagggcgtcgccatggaccgcggctacgtcctggtcgacgagtacatgcggacgaacgtcccgaccatctccgccgtcggtgacctggtcccgacgctccagctcgcgcacgtcggcttcgccgagggcatcctggtggcggagcgtctggccggtctgaagaccgtcccgatcgactacgacggcgtgccgcgggtgacgtactgccaccccgaggtcgcctccgtgggcatcaccgaggccaaggccaaggagatctacggcgcggacaaggtcgtcgctctgaagtacaacctggcgggcaacggcaagagcaagatcctcaacaccgcgggcgagatcaagctcgtccaggtgaaggacggtgccgtggtcggcgtccacatggtcggtgaccgtatgggcgagcaggtcggcgaagcccagctgatctacaactgggaggcgctgccggccgaggtcgcccagctcatccacgcccacccgacgcagaacgaagcgatgggcgaggcccacctggccctcgcgggcaagccgctgcactcgcacgac

SEQ ID NO: 6002 - DNA, 1539 bp, Streptomyces avermitilis
  CDS (1)..(1539)
gtgactgctctcactctcagcaccgccgcagcgtccggcctgcgcgccgacgcgatcgtggtcggtgtggcgaagagcccgaagggcgacaagggactcgtcgtcgcaccgggcgccgaggccgtggacaaggggtacgacggcaagctcgccgccgtcctggagaccctcggcgcctcgggggccgagggcgaggtgaccaagctgcctgcaccgtccggcttcaaggcgcccgtcgtggtggcggtcggtctgggcgccgcgcccgaggacggccaggacaagggcacggcgttcgacgccgaagcactgcgccgcgccgccggtgccgcggcccgcgcgctcgccggtgccaagaaggccgccttcgcgctgccggtcgcggacgccgccgacgccggcacgatcggcgagggcgcgctcctcggcgcgtactccttcgacgcctacaaggagaacggcaggaacgccaagaacggcaaggccccgctcgccgaggtcgtcctgctcggcggcaagccccgcgacaaggcgttcaaggcggccgtcgagcgcgccgtcgccgtcacggaggagctcaaccgtgcccgcgacctgatcaacaccccgccgaacgacctgaacccggagtcgttcgccgccgtcgcgcaggccgcggccaaggagcacggcatcaaggtgcaggtgctcgacgagaaggccctgacgaagggcggctacggcggcatcctcggcgtcggcgccggctcggccgccggtccccggctggtgaagctgtcgtacacctcgtccaaggcgaagaagcacctcgccttcgtcggcaagggcatcacgtacgactcgggcggcatctcgctcaagccggccggccacaacgagacgatgaagtgcgacatgagcggcgcggcggcggtcttcgccgcggtcgtggccgccgcccgcctgggcctggaggtcaacgtcaccggctggctcgcgctggccgagaacatgccgtcgggtaccgcgacccgccccggcgacgtgctgcgcatgtacagcggcaagaccgtcgaggtgctcaacacggacgccgagggccggctggtcctcgccgacgcgctgtgggccgcgtccgaggagaagccggacgcgatcgtcgacgtggcgaccctgaccggcgcgatgatgctggcgctcggcaaccgcctcttcggcgtcatggcgaacgacgacgccttccgcaccgcggtcgtcgaggccgccgaggaggtcggcgaggactcctggccgatgccgctgcccgagcacctgcgcaagggcatggactcccccacggccgacatcgccaacatgggcgagcggatgggcggcggcctggtcgccggcctgttcctgcgcgagttcgtgggcgagggcatcacctgggcgcacctcgacatcgcgggcccggccttcaacgaggcggcccccttcggctacaccccgaagggcggcacgggcacggcggtccgcacgctggtccgcctcgcggagctgacggccgcgggcgacctgggc

SEQ ID NO: 6003 - DNA, 780 bp, Streptomyces avermitilis
  CDS (1)..(780)
gtgcccaagcccccgcttctcgacggtctccgtttcgccttcggcaccctgaccgtcctgccggtccgggtgacccgctgggaccgtgccgccgcgcgcggcgggatgttgtgcgcgccggtcgccggactggtggtcgggctgctcgccgcggcgctcggcacgctgctgctcctgctgggcgcgagcccgttgctcgccgccgtggccaccgccgccgtgcccgccgtcctcacccgcgggctccacctcgacgggctcgccgacaccgcggacggcctcggcagcggcaagcccgccgaggacgcgctgcggatcatgaagcagtcggacatcggcccgttcggcgtgatcactctggtgttcgtgctgctcgcccaggtggccgcgctcgcccaggcgtacgagacctcgtgggcccggggcgcgttcgcggccgtggtctcggcgggcgcggcccggctcgtactcaccctggccgcgcgcaccggcgtaccaccggcgcgtccggagggcctgggcgcggcggtcgcgggcacggtgcccgtaacgggcgcgctgctcaccgcgggcgccgtcatcgcggcggcggccggggcgggcgccctgttcgggacgtacgacgtcgtccgtacggcgctggcggtcctcctcgccgtcgccgcggcggagctgctcctgcggcactgcacgcgccgcttcggcggagtgaccggagacgtcttcggcggcctcgcggaaaccgcggcgacgacggccctcgtcgtcctgtcactcgcc

SEQ ID NO: 6004 - DNA, 762 bp, Streptomyces avermitilis
  CDS (1)..(762)
atggggcattggttgcaccgcaacatcatcgagccgggcaagttgccgctgcttctcgcgctggcctcgttcgtgctgacgttcgtgatcacccgggtcatcacccggctgatccgggccggcaagggcccgttcggcaacgtcaaggcagggggcctgcacatccaccatgtcgtgcccggtgtcgtcctgatcgtcatcggcggcttcggggccgtggccagcgaacggcacggcttcggctcggccgccttcgccgtggtgttcggcatcggagccggtctggtgctcgacgagttcgcgctgctcctgcacctcgacgacgtctactggaccgaggagggccgtaagagcgtggaggtcgtggtggtcaccgcggccctggtcggcctggccctggcgggcttcctgccgttcggggtcaacgacctcagccaggaggagctgcgcgaccgcggcggcgtcatcctgagcgtcggcctgaacttcgtcttcgcgctgctcgccctgagcaagggcaagggccgtaccgcgatcttcggggtgatcgtcccgctcgtcgccctggtcggcgcgatccgcctggcccgccccggctcaccgtgggccaggcgcttctaccgcaaacggccgcgcgcccgcgccagatccagcctgcgcgcctaccgccacgaccgccgctgggcgggcccgcgccgcaagttccaggactggatcggcggcaaacccgactccgagaacctgcctatcccgcccgcgtcc

SEQ ID NO: 6005 - DNA, 669 bp, Streptomyces avermitilis
  CDS (1)..(669)
atgagagccctcgcccggctggcccgcgccgagtggggggcgctcgccgtcaccgtgcgcacggcgctcgccgaacggcgcgggagggcgatcccgctgaccatcggggcggtgtgtctgacggccctgctccagttcgtgcagaaccagtcctggggcttcgggttcgtgcagaacatcggggccgtacgggccgaggaaccgctgtggccggccctgctgcgcaccccgctctccctcttcgtaccggcgctggatctgccggtgtggggtgcgctcgcgcagatcctcgtcgtgttcgggatcgccgagatctgcctgggctggtggcgcacactcgtcgtcgcgtacgtcgccaccctggccggcacgctctacgcgcgcgtgtgcctcaccctcgacccggagagcctgttcgggctgcccgcgacggacgcgcaggtcgtcgacaccggtccgtcggcggccgtggtcgggctcgccgtgttcgtgtgctggcggtatcgcgcctacaccacggcgggggtggtgatcgcgtcgatggtgatcgaggtcgcgctgaaggggaacctcgcgggcaaggagcacctcgccgccatcgccgcggtgctcgtgctgtgcgggatctcggcgctgcgtcaccggcgagcggtcaggacgcgggcggga

SEQ ID NO: 6006 - DNA, 1932 bp, Streptomyces avermitilis
  CDS (1)..(1932)
ttgccgccgtccggaacagcgattttcggccgaacaggccgcctaccgaccggcccacccgcccccgggacgagccgccgtatcgtgcgtcgctccgctcctccgcatgcaccccggcgccccatatcatcgcccttcatgggagatgcccgaattaccgcggaacaggaacggactccggcccggtcgggcggtggggaggggcggtccaccgggacctcgcagcgggccgcggcgttcgtcgtctggtatctgcgggctgtcacgttcatcaacttcctcagcgccgtctgggtctccctcggccaggacgtacggcggcacaaccaggagaactacttcacgccctacctgctgacggccggcttcgcgtcgggcgtgttcacgatgttcctcgccatcaccatgcggcgccgcaagcgggccgcctggatcctgaacctcgtgctcagcggcctgttcctgctgctgttcgccttcgcgatgtccttcccggagatccggcagtacgcccagaactggatctcgatcgtcctcaccgccgccttcgtcggctccctcgtcctcggccgccgggagttctacgccaagggcgaccggtcgaaccccaagctcgccgcggccgtcgcggtcggcggactgctcgcttcctcgctgctcgccgcgctcctggtgaccaccaccaaccaggcgccggacgcgtaccgttcgaccttcctggagcgctggaactacggcacccagcggctggtctcggtcgccgccgacggctcccacttcccggggatcaccactcccaactgggtcaacgtcgtcatcaacgtgctcagtacgctgctcgtgctggccgtcttctacgccgccttccgctcccgccgcgccgtcgacccgctctccgaggacgacgagaagcggctgcgcgccctgctcgacaagaacggcgaccgcgactcactgggctacttcgcgctgcgccgggagaagagcgtggtgtggtcgcccaccggcaaggccgcggtcgcctaccgcgtcgtcggcggcgtctcactggcctcgggcgatccgatcggtgacccggaggcctggcccggcgccatcgccccctggctcgacgaggcccgcgcacacggatggatcccggcggtgatgggcgcgagcgaggaggcgggcaccatctacgcccggcacgggctcgacgcgctcgaactcggcgacgaagccctcgtggagaccgccgagttcaccctggaggggcgggccatgcgcaccgtccggcaggcgtacaaccggatcgcacgcgccgggtacaaggtgcgcatccggcgccacgaggacatccccgccgacgagatggcgtacttcctgaagcgtgccgacgactggcgggacggggccaccgagcgcgggttcagcatggcgctggggcggctcggcgatcccgacgacgggcagtgcgtgatgctcgaatgcagggatgccgaaggcgagttgcgggccctgctctccttcgtgccctggggaccgcgggggctctcgctcgacctcatgcgacgcgaccgcgcctgcgagaacggactcatggagttcatggtgatcgaactcctgcgccgcgcccgggagatcaagatcactcaggtttcgctcaacttcgccatgtttcgttccgtcttcgaacgtggtgcacgcctcggcgccggaccggtgctgcggctgtggcggtccctgctcagcttcttctcgcgctggtggcagatcgagtcgctgtaccgcgccaacgcgaagtaccggcccatctgggagccccggttcctgctcttcgaaaagagcgcggacctgctgcgcatcggtgtcgccgccgcgcgtgccgaggggtttctggaggcgccggggctgccgaagtggctgcaccgcaggcacctggagtcgcacaga

SEQ ID NO: 6007 - DNA, 1125 bp, Streptomyces avermitilis
  CDS (1)..(1125)
atgagctcgctgaatctcgacgacttctccgacctgatcgagcgcccggacggcggggtgcgccgcgacgccgaggcgcgccgagagcgacagatcgtgccgcccgggtccctgggccgcctcgacgacctgggtgagtggctggccgcggcgcagtcggcggtgccggtgcggccggtcgagcgccctcgcgtggtgctcttcgcgggcgaccacggggtcgcctcgctcggcgtgtcggcgcggcccgcgggcagcgccgaccagttggtgcgggcggtgctggagggcgcgagcccggcgtcgatcctggcgcggcggctgaacgtgccggtgcgggtggtcgacatggcgttggactgcgagccggacgccctgccggagagtgtcgtacggcaccgggtgcggcgcggcagcgggcgcatcgacgtcgaggacgcgctgaccctggaggaggccgaggcggcgttccgggcgggggtcgcggtcgcggacgaggaggcggacgcggggacggatctcgtcgtactcggtgatgtgagtgtcggcgggacgaccgcggcggccgtgctgatcgccgcgctgtgcggcacggacgcgtccgtggtgaccgggcgcggggggctggccatcgacgacctcgcgtggatgcggaagtgcgcggcggtacgggacgccttgcggcgggcccggcccgtgctcggggatcagcttcagttgctggcggcggtgggcggggcggatctggcggcgatgaccgggttcctgttgcagagcgcggcgcgcaagacgccggtgattctggacggcgtggtgtcggccgcgtgtgcgctggtcgggcagcggatcgccttccgggcgccggactggtggctggccgggcagaacagcggggagccggcgcaggcgaaggcgctggaccggatggcgctggagccgctgctgaaccacggggtgacggtgggcgagggcgcgggcgcgctgctggcgctgccgctggtacaggccgcggcggcactggcggcggagctgccggagaagcccgaggagcttgaggccggggaagggccggaggccgcggaagagtcgtcgccggagccggagaacccggaagccctcgcggag

SEQ ID NO: 6008 - DNA, 1209 bp, Streptomyces avermitilis
  CDS (1)..(1209)
ttgtcgtacgccccgatgtgcacctgtcgccccacaggagctgccatgcctcccaccccgcaggcgatcgcggcgcgccgcgccgcgtacctcggcgaactcgcccagggcaccgaccggttccacgaaccgcgccgcgagaactgcccgtggtgcggctcgaagcggctgcgcacccgcctcaggacccccgacctgaggcagcacaagccgggctcgttcgtcgtcgacgagtgccgggactgcgcgcacaccttccagaacccccggctcacgaccgagggactggcgttctaccaccgcgacttccccgaggaccccgaaggccgcgacttccccgaagaccccgaaggccgtgagggccccgagggccacgagagacctgggggcttcgccgagcgcatcgtcgccgcccgcggcagcctcccccgggctctcggcttcgcccgcgcagggcgccacctccgccgtcaccgcaccgccgcccacgccatgctgtccatccccgaaccggagagctggctcgacgtcggcaccgggcacggccacttcccggagagcgcccgcgagatccacccgtacacggccttcgacgggctcgaccccaccccgcgcgtcgaaagggcccgggcggccggccgggtcgaggaggcccaccgcggccacctcaccgacccggagatcatccaacggctgcgcgcccgctacgacgtcgtcagcatgttccatcacctggagcacacgccggacccgcgcgaggaactgcgcgccgcgctcgcggtcctgcgccccggcggccatctgctgatcgaaggaccggacccggcctgcgcgttcggcaggctgctcggcaagtggtggatgccgtacggccagccccgccgtctccatctgatgcccctgagcaacctgctcgccgaactggaggcacggggctgcgtgatcgtccgcaccgaccgccgcgaaccgcacaccccgtacgacatcaccggcgcggtctccctggccctggcccgcctcctgccggccgcggacgcaccctggcgggcgaccccgccgagcgaactccggcgcaggctgcgcacggccctgctgcgcgtcaccacccccctggtggtctcggccgcggccttggaccacgcactggccccgctcctcagccgcacccgcttctcgaacacgtaccggatcatcgcgcgccgggaggag

SEQ ID NO: 6009 - DNA, 1317 bp, Streptomyces avermitilis
  CDS (1)..(1317)
atggggaacctgcctgccctctcatggggacctgcgggcccgcttgcgaggacctgcgggacctcttatggggcctcggacgcgcaggacctgcggcggcacgcgaaaatcgggtccgtggaactgactctgctcggcaccggtgctcccgcgggactcccccgccccgactgtccctgcgcggcctgtgcgaccgcgctcggcgaagcagcgcgggcggcgaccgcgctgctcgtggacggcacggtgctgctcgacctgacgcccggcgcggcattcgcggccgcgcgcgccgggcgctcgctgggcggggtacggcaggtgctcctctcgcatccgcacaacggtcccgccgtcgaggtgccggcgggactgccgcagcccgcgcgggtgcccgacgggcgggagttggcgctgctgaccgggcaccgggtgcgggcgatgccgatggacgcgccgggcacggggtacgcggtgacggggcccgacgggcagcggctgctgtatctgccgccgggcggggcgccggccgggctcgacgagacggttcagccgtacgacatggtggccgccgatgtggtcggtcggccggacgccctcgcccggctgcgcgcggtcggagccctcgggccgacgacggatgtgatcgccgtgcacctcgaccacgacgtgccgccgggcgtcgagttgcggcggcggctcgcggcggcgggggcgcgggcggtgccggacgggacgacgctgacggtgggcgtgtacgaggacgtaccggatgtgccccggcgcacgctggtgctgggcggggcccggtccggcaagtcggtggaggcggagcggcggctcgagtccttcccggacgtgctgtacgtggcgacgggcggctcccggggcggggacaccgagtgggcggagcgggtgagtgtgcaccgggagcggcgtccgggctcctggcggacggtggagacctgtgacctcgtgcccctgctgaaggaggacgggccgccgctgctcatcgactgtctgtcgttgtggctgacggacgcgatggactccgtcaacgcctgggacgacgacgagtgggcgggcggcggcgagcgggcgctgcgcgggcgggtggaggagctcacggccgcggtccgcgagaccggccgaacggtcgtggccgtctccaacgaggtcggctccgggatcgtcccggccacggcttccgggcgccggtaccgggatgaactcgggcgcctgaacgccgcgttcgccgcggagtgcgagcacctgctgctggtggtggcggggcaggcgatggtgctgcggggcggc

SEQ ID NO: 6010 - DNA, 222 bp, Streptomyces avermitilis
  CDS (1)..(222)
ttggaggcgtacatggcggcatggacgtggcggttcgagaaggccgacggggcggaggtccagcccgcggtcgcgccggaggagttcaccacgcagggggacgccgagtcatggatcggtgagtactggaaggacctcaaggagggcggcgcggaccaggtccggctgttcgaggacaccaccgagatctacggtccgatgagcctgcacgccgaggacgcg

SEQ ID NO: 6011 - DNA, 711 bp, Streptomyces avermitilis
  CDS (1)..(711)
gtggcccggcagctcgacgagcagatagccgggcggttcccggtggggcagcggctgcgggtcctcgatgtcggcatgggccagggcacgcaggcgctgcggctggcgcgggccgggcaccaggtgaccggggtcgagcaggacgcgacgatgatcgccgtggcccgcgagacgctcgccgccgagccggagggcatccggagccggatgcggctcgtgcagagcgacggccgggacacgggcgtgcacttcctgccgggcagcttcgacgtggtgctgtgccatggcgtgctgatgtacgtcgaggacccggacgctctgctggcggggctcgcgcggatgctcgcgcccggcgggctgctgtccctgctggtacggaacgcggatgcgctggcgatgcggccgggactggcgggcgactgggcgtcggcgctgacctcgttcgacacgacggcgtacacgaaccggctggggctcgacgtacgggccgaccggctggacgcgctgacatcgacgctggccgggatcggggcgccgctgcacgcctggtacggggtacgggtcttcacggacacggccgcggacggggcggaacttccggcggacgtggagacgctgctggccgccgaggagcgggccgggcggacggatccctatcggcaggtggcggccttgctgcatctgtgcggagtgcggggcggaggagccccg

SEQ ID NO: 6012 - DNA, 624 bp, Streptomyces avermitilis
  CDS (1)..(624)
atgccccgacaccccgtacccttgggttttgtgttccgtagccgtgccaaggaagagaaggcccccgccgacaaggcgccggtgaccgactccaagcagccccgtcacccgcaggcccccaaggggcgccccacgcccaagcgcagtgaggcccagacccagcgtcgcagcgtggccaacacgcagacgacgcgcaaggaggccgccaagcggcagcgcgacgagcgccgcgtccagctggagaggcagcgccaggcgctggccagcggcgacgagcgctatctcccggtccgcgacaagggtccggtgcgcaagttcgcccgggacttcatcgactcgcgcttctgcgtcgcggagttcttcctcccgctggccgtgctgatcctcgtgctgagcgtgctgaaggtggcgcagctccagaacatcgcgctgctgctgtggctcgtcgtgatcgtgctgatcgtgatcgactcgatcatcagcgcgttccgtctgaagaagcagctggacgcgcgcttccccgatgtgcccaagaagggcgccatcccctacgcactgatgcgctctctccagatgcgtcgcctccggctgccgaagccgcaggtcaagcgcggagagcggccc

SEQ ID NO: 6013 - DNA, 768 bp, Streptomyces avermitilis
  CDS (1)..(768)
atgatcttccgcgcgaaggcgaacaaggcccttgaccgggccgaggacccgcgcgaaaccctcgattactcgtatcagaagcagctggagctgctccagaaggtgcgccggggcgtcgccgacgtggcgacctcgcgcaagcgcctggagctccagctcaaccagctccagtcccagtcctcgaagctggaggaccaggggcgcaaggcgctcgcgctgggccgcgaggacctggcccgcgaggccctctcccgccgggccgcgctccagcagcaggtgacggacctggagacccagcaccagacgttgcagggcgaggaggagaagctcacccttgcggcgcagcggctccaggccaaggtggacgccttccgtacgaagaaggagaccatcaaggcgacgtacacggcggcgcaggcacagacccgcatcggcgaggcgttctccggcatctccgaggagatgggcgacgtcggcatggcgatccagcgtgccgaggacaagaccgcgcagctccaggcgcgggccggcgcgatcgacgaactgctcgcctccggtgccctcgacgaccagtccgggctggccaaggacgacatccagagcgagctggaccggctctccggtggtacggatgtagagctggaactccagcgcatgaaggcggagctggcgggcggttcgtcctcctcgcagcaggcgatcgagggcggcacgggccagtccccgtcacagcagcagccgcaggacactccgcgcttcgacaagcag

SEQ ID NO: 6014 - DNA, 276 bp, Streptomyces avermitilis
  CDS (1)..(276)
atgatcgtacggatcatgggggaggggcaggtgaggctggacgacagccacctcaccgaactgaacaagctggacgacgagctgctcgcggagatggagagcggcgacgaggaaggcttccaccggacgctggggtcgctgctgggggcggtgcgccgactgggcgacccgcttccggacgcctcgctcgagccgtcggagctgatccttccgtctccggacgcgaccttggacgaggtccgggagatgctgagcgacgacggtctgattccgggc

SEQ ID NO: 6015 - DNA, 1218 bp, Streptomyces avermitilis
  CDS (1)..(1218)
gtgagcaccctcgagcgcacccggtgcagactgcgcgcccacccgttcgcgctggacgccgtcctcgccgccggcgtcctcgcctgcatgctgagcgcctccttcgtggacccccacggtgggaacggcgccacctggggcgcccgcgccccgggcgccctcagcctcaccctcatgggactcgccgccgcggccctcgtcttccggcgccgcgccccgatggccgtcctcgccgccacgggcgccgtctccctcgtggagctggtcaccggcgacccccgcgcgcccgtcgccatgtccgccgtcgtcgccctctacaccgtggcctccaccaaggaccggcccacgacctggcgggtcggcgtgctcaccatgaccgtgctgacggcgtccgcgatgctcgcggggcctctgccctggtacgcccaggaaaacctcggcgtcttcgcctggacgggcatggccgccgccgccggcgacgccgtacgcagccggcgggccttcgtgcacgccatccgggaacgcgccgagcgagccgaacgtacgagggaggaggaggcgcggcggcgcgtcgccgaggagcggctgcgcatcgcccgcgatctgcacgacgtcgtcgcccaccacatcgccctcgtcaacgtgcaggccggggtcgcggcccatgtgatggacaagcggcccgaccaggcgaaggaggcgctcgcgcacgtacgggaggccagtcgctccgccctcaacgaactgagggccacggtcgggttgctgcggcagagcggggaccccgaggcgccgaccgagccggcccccggcctgcaccgcctcgacgaactcgccgacaccttccgcaacgccggcctccccgtcgaggtcgcccgcgccgaccacggcaccaccctgcccgccgccgtcgacctggccgcgtaccgcgtcatccaggaggccctcaccaacgtgcaaaaacacgcgggcgccggggcgaaggccgaggtcagcgtcgtacgggtggggccgaatgtggagatcaccgttctcgacaacggggcgggcacggaccaggggcccgagaacggcggtgggcacgggctgctcggcatgcgggaacgcgtcaccgcgatcgggggcacctgcaccgccggccgccgatacggaggcggcttccgggttcatgcgatcctgccggtcaagaaccgtacgaccgccccggaggagaccgta

SEQ ID NO: 6016 - DNA, 681 bp, Streptomyces avermitilis
  CDS (1)..(681)
atgaccatccgcgtcctgctcgccgacgaccaggcgctgctgcgcagcgcgttccgggtgctggtcgactccgagcccgacatggaggtcgtgggggaggcgtcggacggcgcggaggcggcgcggctggcgggggagacacaggccgacgtcgtcctcatggacatccggatgccggggaccgacgggctggccgcgacacggctgatcagcgcggatcccgggctgacgcatgtccgcgtcgtcatgctgacgaccttcgaggtcgacgagtacgtggtccagtcgctgcgcgcgggcgcgtccgggttcctggggaagggggccgagcccgaggagctgctgaacgcgatccgggtcgcggccgggggagaggcgctgctgtccccggccgccaccaagggactcatcgcgaagttcctcgcccagggggacggcctcgacgacgagcgcgatccggcgcgggccgagcgcctcgacgcgctgacgggccgggagcgcgaggtcctcgtccaggtcgccggcgggcactccaacgacgagatcgccgagcggctcgaagtcagcccgctgaccgtgaagacgcacgtcaaccgggccatggccaagctcggcgcgcgggaccgggcccagctcgtggtgatcgcgtacgagtccgggctggtccgtccaagggtggac

SEQ ID NO: 6017 - DNA, 3159 bp, Streptomyces avermitilis
  CDS (1)..(3159)
atgtcctggctgtccaggttcagcctcgcgcaacgggccctgatcgggctgatgtcgatcgtcgcgctcgccttcggagccatcgcgatccctcagctcaagcagcagctgttgcccaccatcgaactgcccatggtgtccgtgctggcgccctaccagggcgcgtccccggacgtggtcgagaagcaggtcgtcgagcccatcgaggacaacctcgaggccgtcgacggcatcacgggcgtcacttccacggcgagcgagggcaacgccgtgatccgggcgtccttcgactacggcaacgacaccaagcagctcgtcgccgacgtccagcaggccgtcaaccgcgcccgcgtccagctccccgacgctgtcgacccgcaggtcatcgccggttcgaccgacgacatcccgaccgtcgtcctggccgtcacctccgacaaggaccagcaggcactggccgatcagctcgaccggaccgtcgtccccgctctgaagagcatcggcggcgtcggccaggtcaccgtggacggcgtccgcgacctccaggtcaccgtcacgcccgacgacaagaaggccgcgaaggcgcgcgtcacctccgccgcgatcggccaggcactgcaggcgggcggcgcgaccgtcccggcgggttccttcgacgaggacggccacaaccgcaccgtccaggtcggcggcggcctcacctcgctggggcagatccgggacctgatggtcatgggcggggccggcaagaagcccgtacgcctcggtgacatcgccaccgtcgagcaggagcccgccaaggcggactccctcacgcgcaccgacggcaggcccagcctcgccgtcaacgtgaccatggaccacgacggcagcgccgtagccatctcggaagcggtcaaggacaagctgccgggcatgcgcaaggacctgggctcgggggcgacgatcaccgtcgtcagcgaccagggccccgcggtctcgaagtccatcgacggtctgacgaccgagggcgcgctcggcctgctcttcgcggtcctcgtcatcctggtcttcctggcgtcggtccgctcgaccctcgtcacggcggtgtccatcccgctgtcggtggtcctcgcgctgatcgtcctgtggacccgcgacctgtccctcaacatgctcacgctcggcgcgctgaccatcgcgatcggccgggtcgtcgacgactcgatcgtggtcctggagaacatcaggcgtcatctcgggtacggcgaggagcgccaggaggcgatcctcagggcggtccgtgaggtgtccggtgcggtcacctcgtccacgctgaccacggtcgcggtgttcctgcccatcggtctggtcggcggcatggtgggcgagctgttcggctcgttctcgctgaccgtgacggccgcgctcctcgcgtcgctgctggtctcgctgacggtcgtacccgttctgtcgtactggttcctgcgcgccccgaagggcacgcccgacgacgcggaggaagcccgccggacggccgaggagaaggaggcgaggagcaggctccaacgtgtctacgtccctgtcctgcgcttcgccacgcgccgccgcctcaccagtgtgctgatcgcggccgcgatcctgatcggcacgttcggcatggcgccgctgctgaagacgaacttcttcgaccagggcgagcaggaagtcctcaccgtcaagcaggagttgaagccgggcaccagcctggcggcgaccgacgcccaggccaagaaggtcgagaagatgctcgacggggtcaagggcgtcaaggactaccaggtcaccgtcggctcgtccggcttcctggcggccttcggcggcggcacggacaccaaccaggcgtcgtactcggtcatgctggacgactcggcgtcgtacgaggacgtgcagaacagcgtcgaggaggggctcgccaagctctccgggatcggtacgacgacggtgtcggccggtgacggattcggcagccaggacctgagcgtggtcgtgaaggcggccgacgcggacgtcctgcggaaggcctcggaccaggtccgtgccgaggtcgcgaagctggacgacgtcacggacgtgtcgagcgacatggcgcagagcgtgccgcgcctctcggtgcgggccaacgacaaggccgccgcggcgggcttcgacgacaccaccctcggcgcggccgtgacccaggcggtacggggcaccacgagcggcaaggcgctcctcgacgacaccgagcgcgacatcgtgatcaggtcggccaagccggccgagacgtcggcccagctgaggaacctgcgcctgggtgcggtgaagctgggtgacatcgcgacggtgaagctggtggacagcccggtttcgatgacccggatcgacggacggcgcgccgccaccatcacggcacggccgaccggcgacaacacgggcgccgtcagcacgaagctccagtcgaagatcgacgcgctgaagctgccgaccggtgcgacggcggagatcggcggtgtctcgcaggaccaggacgacgcgttcaagaacctgggcctggcgatgctggcggcgatcgcgatcgtgttcatgctgctggtcgccaccttccgctcgctggtccagccgctcatcctgctggtctccatccccttcgcggcgacgggcgcgatcggtctcctggtggccacgggcactccgatgggtgtcccggcgatgatcggcatgctgatgctgatcggcatcgtggtgacgaacgcgatcgtgctgatcgacctgatcaaccagtaccgcaagcagggttacggcacggtcgacgccgtgatcgagggcggccgtcaccgcctccgcccgatcctgatgacggccctggcgacgatcttcgccctgctcccgatggcgctcggcgtcacgggcgagggcggcttcatcgcccagccgttggcggtggtcgtcatcggcggtctgatcacgtccacgctgctgacgctgctgctggtcccgacgctctacacggtgatcgaggtccgtaaggagcgccgggcgaagaagaaggcggcgaagcgggcggcgaagtcggggaacccgtcctcgccgacggggacgccgacggagacagaggcggagacggacgcggacgccgggcagccggaacccgcgcaggcc

SEQ ID NO: 6018 - DNA, 1242 bp, Streptomyces avermitilis
  CDS (1)..(1242)
atgtcccgctggatcgcctccatgatccaagcgagccgcagaacagaaagggtgcgtgtcgtgaccaccgcccagccccaggagctcgacgtacagccgacgcccctcgccctgctgctgctcggccgtgaggccgacccgaggagtgagcgcggcgtcgagtgtcccggcgatctgccctcgccgtccgacccggacctggtcgagcgcgcccgcgcggccaaggagaagctcggggacaaggtcttcgtgctcggccaccactaccagcgcgacgaggtcatccagttcgcggacgtcaccggcgactccttcaagctggcccgggacgcggcggcgcgccccgaagccgagtacatcgtgttctgcggtgtgcacttcatggcggagtccgcggacatcctgacgggcgacgaccagaaggtcgtgctgccggacctggccgccgggtgctccatggccgacatggccaccgccgagcaggtcgccgagtgctgggacgtgctgaccgaggccggcatagccgagcaggtcgtacccgtctcgtacatgaactcgtccgcggacatcaaggcgttcacgggccggcacggcggcaccatctgcacctcgtcgaacgcgcagcgggcgctggagtgggccttcgagcagggctcgaaggtcctcttccttcccgaccagcacctgggccgcaacacggccgtgcgggacatggggatgtcgctcgacgactgcgtgctctacaacccgcacaagccgaacggcgggctgacggccgaggagctgcggtccgcgaagatgatcctgtggcggggccactgctccgtgcacggccgcttctcgctggactcggtgaacgacgtacgcgagcggatccccggcgtgaacgtcctcgtgcaccccgagtgcaagcacgaggtcgtggacgcggcggactacgtcggttcgaccgagtacatcatcaaggcgctggaagcggcgcccgcgggctccaagtgggccatcggtacggagctgaacctcgtacgccgcctggcgaaccgtttcgctcccgagggcaaggaaatcgtcttcctcgacaagacggtctgcttctgctcgacgatgaaccgcatcgacctgccgcatctggtgtggaccctggagtccctcgccgagggcaacctggtcaaccgcatcgaggtggaccgggagacggaacagttcgcgaagctggcgctggagcggatgctggcgctgccg

SEQ ID NO: 6019 - DNA, 354 bp, Streptomyces avermitilis
  CDS (1)..(354)
atgtccgtatcggacgagaccaccaccgtgagcgacggcatcatcctgtccgacgccgccgcggccaaggtcaaggccctgctcgaccaggaaggccgcgaggatctggcactgcgcgtcgccgttcagcccggcggctgctccggcctgcgctaccagctcttcttcgacgagcgttccctcgacggcgacgtcgtgaaggacttcgacggtgtcaaggtcgtcaccgaccgcatgagtgctccgtacctgggcggcgcctcgatcgacttcgtggacaccatcgagaagcagggcttcacgatcgacaacccgaacgcgacgggctcctgcgcctgcggcgactccttcagc

SEQ ID NO: 6020 - DNA, 1455 bp, Streptomyces avermitilis
  CDS (1)..(1455)
gtggtcgtggcctcggtggcggccgcggtgctgctcgtcgggggcggcggggcgtacttcaccgcgaccgcgaccggcggctccggcggccgttccaccggccccggcggcgacggcactcccccgccgctcgccctcgacggctacagcgagggcggcaggccgggcatcgcggtgggtgagccaaacccctacggcgcgtcctaccgggccgacggcaagctccccgacggcccggactccgcgcccgtgtaccgggcgacgggcgaggtgacgaaggacgaggtggcgcgtctcgcgcaggccctggcggtggacggcaccccgaggctgaccggggacgcctggacggtcggggcggtgaaggacgggtcggggccgacgctgcgggtgaccaagcgggcaccggggatctggacgttcagccggtacacgccggggaccgacaacctctgcacgagcaccaaggcgtgcccgagcgaatcctccggacggtcggccgccgatccggtgagcgaggccgccgccaggaaggccgccgctcccgtcctgaaggcggtgggccaggacgacgcgaagctgaacgccggccaggtcatggaccgggtacgggtggtgaacgccgagccgaaggtcggcgggctgcccacgcacggctggacgacgggcatccaggtcggcgcggacggccaggtggtcggcggcagcggcaacctgaaggcgccggtgaagagcgacacgtaccccgtcatcagtgcgcagaagacgctggacctgatgaacggttcggcgacgggggacggccgcaagggcatcggcggctgcgccagccccgtaccgctcaaggacaaggacgagacgccgtgcgaggcgtcgaccgcgacgcccacgccggagccggtggccgtcgagggcgccgtgttcgggctggcctcgcaggtggtggacgggcagccggcgctggtgccgtcctggctgttcgacgtacgtccgaagggggccgacgacaccttcaccgtgacgcatccggcggtcgacccgcggtacgtggccgcgccgggggcttcgcagcccacggagccttcgcaggcgccgagcggctcgcctgccccgcggcccagcgacgggtcgacctcggcgccgaccaagcgtgacgtcaaggtggacggctacacggccgacgggaaggacctgaccgtgagcttcacgggcggggtgtgcggggactacgcggcgtcggcgagcgagagctccgacgaggtgaaggtcaccgtgaccgagacgccctggcaggacaaggtctgcatcatgatcgccaaggagtaccaccggacgctccacctggacgcgccgctcggtgaccgcaaggtggtgggctcggacggcacgcagatcccgaaggagacggcggcggagcaccggctgccgaagtcggcccagtcggctcagccgcag

SEQ ID NO: 6021 - DNA, 207 bp, Streptomyces avermitilis
  CDS (1)..(207)
atgacgaacctgaaggtccacggctccgtcccgctcgacctggagggcgatctggcgtcgctgcgcggcgacggcgcccggatggccccgcactgggcggcacccgaccggatcaccccccgcccggtctccccgtccctcattcacggcgtgaccgtgccgcccgcctccgcgcggctcctggacgcgatgtcggactacggggac

SEQ ID NO: 6022 - DNA, 1014 bp, Streptomyces avermitilis
  CDS (1)..(1014)
gtgaactgtcaatcccttcccccgcaggagcgtgtcctcgccgtgcgtatcgcagtcaccggctccatcgccaccgaccacctcatgaccttccccggccgtttcgccgaccagctcgtcgcggaccagctgcacacggtctccctctccttcctggtcgacaatctcgacgtacgccggggtggcgtcggcgcgaacatcgccttcggcatggggcagctcggtacgtcgccgatcctggtcggcgcggcgggctcggacttccaggagtaccgcgcctggctggaccggcacggcgtcgacacggcctccgtgcgcatctccgaggtgctgcacaccgcccgcttcgtgtgcaccacggacgccgaccacaaccagatcggctccttctacacgggcgcgatgagcgaggcccggctgatcgagctcaagtcggtcgccgaccgcgtgggcgggctcgacctggtcctgatcggcgcggacgacccggaggcgatgctgcgccacacggaggagtgccggtcccgctcgatccccttcgcggccgacttctcgcagcagatcgcccgtatgaacggcgacgagatccggatactgctggacggggcgacctacctcttctccaacgagtacgagaaggggctcatcgagtccaagaccggctggagcgacgaggagatcctgtcgaaggtcggccaccgcgtgaccaccctcggcgcgcagggcgtgcgcatcgagcgggccggccaggacccgatcgaggtgggctgccccgaggaggagcgcaaggcggacccgaccggcgtcggcgacgcgttccgcgcgggtttcctgtccgccctcgcctggggcgtctccctcgagcgcgccgcccaggtgggctgcatgctcgccacgctggtcatcgagacggtcggcacccaggagtaccagctgcgccgcgcccacttcatggaccgcttcaccaaggcgtacggcgacgacgcggccgtagaggtccgccggcacctcgcc

SEQ ID NO: 6023 - DNA, 1380 bp, Streptomyces avermitilis
  CDS (1)..(1380)
gtgtcctacttcgacgccgcgtccgccgctcccctccaccccgtcgcccggcaggcccttcaggcctcgctcgacgaggggtgggccgaccccgcacgcctctaccgcgaggggcgacgggcccggctgctgctcgacgcggcccgcgaggcggccgccgaggcggtgggctgccggccggacgagctggtcttcaactcgtccggcacgcgtgcggtgcactccggggtagcgggcgcgctggcgggccggcggcgtgtcggacgccacctgatcgtgtcagcggtcgaacactcttcggtactccattcggcggaggtgttcgagacggagggcgggacggtgacccgggtcgcggtggaccgtacgggcacggtcgcgccggcctcgtacgccgaagctctgcgcccggacaccgcgctggcctgtctccagtcggcgaaccacgaggtgggcacggagcagccggtggccgcggtggccgacgtgtgccgggcggcgggggtgccgctgctggtggacgcggcgcagtcgctgggctggggccgggtggcgggtgactggtcgctgctgacggcgagcgcccacaagtggggcggcccgtcgggcgtcgggcttctcgtggtgcgtaaaggtgtgcgattcgcgccccaagggcccacggacgagcgggagtcggggcgggcggcggggttcgagaacctcccggcgatcgtggccgccgcggcgtcgctgcgggcggtgcgcgccgaggcggcggaagaggcggtacggctgcgggagctgacggaccggatccgggtacgggtgcccgagctggtcggggacgtggaggtggtcggcgacccggtccgccggctgcccggcatcgtcaccttctcgtgtctctatgtcgacggggagaccctgctgcacgagctggaccgggccggtttctccgtctcgtccggctcgtcctgtacgagcagcaccctgacgccgagccatgtgctgagggcgatgggggtgctgagcgagggcaatgtgcgggtgtcgctgccgctcggcacgccggcggaggatgtcgaccgcttcctggaggtgcttcccggcacggtgtcggcggtccgcgacaagctgggcgcgccggtgtcggcgcccgcgacggccgtacgggcggagtccctcgtcgtggactccctgggcaagcggtgcccgatcccggtcatcgagctggccaaggtcatcggggacgtgcccgtcggcggcacggtccgcgtcctgtcggacgacgaggcggcccgcctggacattcccgcgtggtgcgagatgcgcgggcaggagtacgtcggggaggagccggcggaccacggctcggcctatgtggtccgccggttgtcc

SEQ ID NO: 6024 - DNA, 957 bp, Streptomyces avermitilis
  CDS (1)..(957)
gtgagtcccaacggctccgaccgctcgccgcggcgcccgatgcggcggaagctgctgcaggcactgactgcgggcctggtcctggcgaccgctaccggttgcacatacaaggacttcccccgccttggcatgcccaccccagtcacggaagaggctccgcggatcctctccctgtggcagggctcctgggctgccgcgctcgccaccggcgtgctggtctggggcttgatcctgtgggcgaccatcttccaccggcgcagccgcaccaaggtcgaagttcccccgcagaccaggtacaacatgcccatcgaggcgctgtacacggtggtcccgctcatcatcgtctcggtgctcttctacttcacggcccgcgacgagtcgaagctcctcgacctctccaagaagcccgacgtcacggtcaacgtggtcggcttccagtggagctggggcttcaactacatcgagaacgtcgacggctcgaccggcaacgcgaagaccgacaagaacctggcggccattccggaccggttcaaggaagccttcccggcgaacgccggcggtgtctacgacgtcggcacgcccggcacgcggaacccgcagaccaacaacccgggtccgaccctctggctgcccaagggcaagacggtccgcttcgtcctcacttcgcgtgacgtcatccactccttctgggtggtgccgttcctcatgaagcaggacgtcatcccgggccacaccaactccttccaggtgacccccaacagggagggcaccttcctgggcaagtgcgccgagctctgcggcgtcgaccactcccggatgctgttcaacgtgaaggtcgtctcccccgagcgctaccagcagcatctcaaggacctcgcgaagaaggggcagaccggttacgttcccgccggcatcgcgcagacgagccacgagaagaaccgggagacgaacaacctg

SEQ ID NO: 6025 - DNA, 1737 bp, Streptomyces avermitilis
  CDS (1)..(1737)
gtgagcatcctcaacgaaccccagggtgccgccgcagctgaggactcttacgagaacgagctgccggtacggcgcaagcagcccggcaatgtcgtggtcaagtggctcaccaccaccgaccacaagacgatcggcacgctgtatctggtgacgtccttcgcgttcttctgcatcggcggcgtcatggcgctgctcatgcgcgcggaactcgcccggcccggtatgcagatcatgtcgagcgagcagttcaaccaggcgttcacgatgcacggcacgatcatgctgctgatgttcgcgacgccgctgttcgccggtttcgcgaactggatcatgccgctgcagatcggcgcgcccgacgtggcgttcccgcggctgaacatgttcgcctactggctctacctgttcggctcgctcatcgcggtcggcggcttcctcaccccgcagggcgcggccgacttcggctggttcgcctacagcccgctgtcggacgcggtccgctcgccgggcatcggcgccgacatgtggatcatgggtctggccttctccggcttcggcaccatcctcggctcggtcaacttcatcaccacgatcatctgcatgcgtgcccccggcatgaccatgttccgcatgccgatcttcgtgtggaacgtgctgctgaccggtgtgctcgtcctgctggccttcccggtcctggccgccgcgctgttcgccctggaggcggaccgcaagttcggtgcccatgtgttcgacgcggcaaacggcggagcactgctctggcaacacctcttctggttcttcggccatccagaggtgtacatcatcgccctgccgttcttcgggatcatttccgaagtgatcccggtgttcagtcgcaagccgatgttcggctacatgggtctcatcggcgccaccatcgcgatcgccggcctttccgtgacggtgtgggcgcaccacatgtacgtcacgggtggcgtactgctcccgttcttctccttcatgacgttcctcatcgccgtaccaacaggcgtgaagttcttcaactggatcggaacgatgtggaaggggtccctgagtttcgagaccccgatgctctgggcgaccggcttcctgatcaccttcaccttcggtggtctgaccggtgtcatcctggcctcgccgccgatggacttccacgtctcggactcgtacttcgtggtggcgcacttccactacgtggtgttcggcaccgtcgtgttcgcgatgttctccggcttccactactggtggccgaagttcaccggcaagatgctcgacgagcgcctcggcaagatcacgttctggacgctgttcgtcggcttccacggcacgttcctcatccagcactggctgggtgcggagggcatgccgcgtcgttacgcggactacctcgcggccgacggcttcaccgccctgaacacgatctcgacgatctgctcgttcctgctcggcctgtcgatcctgccgttcctctacaacgtgtggaagacggccaagtacggcaagccggtcggcgtcgacgacccgtggggctacggccgctccctggagtgggccacgtcctgcccgccgccgcggcacaacttcctcaccctgccgcggatccgctccgaatccccggctttcgacctgcaccacccggagatcgccgcgctcgaccagctcgagaacgccggtcacggtgagaaggccgccgtcgctggtggcaaggaggccggcaag

SEQ ID NO: 6026 - DNA, 396 bp, Streptomyces avermitilis
  CDS (1)..(396)
gtgaagatccagggcaagatgttcatctggctggccgtcttcatcctcgccatggcgatcatctatggcgtgtggtcgaaggagccggcgggcaccaccgcgctcttcctggccttcggcctgagcatcatgatcggctactacctggccttcacggcccggcgggtcgacgcgggtgcccaggacaacaaggaggccgacgtcgcggacgacgccggcgaggtgggcttcttcagcccgcacagctggcagccgctcgccctcggcatcggtggcgcgctggccttcatgggcgtcgtcttcggctggtggctgctctacttctcggccccgatcatcctgatcggcctgtggggctgggtcttcgagtactaccgcggcgagagccgcacccag

SEQ ID NO: 6027 - DNA, 1263 bp, Streptomyces avermitilis
  CDS (1)..(1263)
atgaaccactcaccgcgaaaccgcacggtcgtcagctgcaccctgctggtgatcgccctgggcgcggcgggcctcaccgcctgcacctccgacggtcacccgctctcggcgaagccgtacgacgcggcgggtcagatcgccttcaacgcccctgtcggcgacagcaagaaggccgaccccgacaagcccctggagatcaccgcctcgggctcggacggccgcatcacggacgtcacggccaccgacgcgagcggccgctacgtggcgggcgaactcgccgccgacggcagccgctggcacagcacctcaccactggccgccggcagccggtacacggtgcgggtgagcacggaggacgaggacggcgcacccggccgcaaggacatcaccttcaccaccagcgtcccgaagaccaagaaggagctgggggtggcgttcggccccgaggcgggcacgtacggcgtcggccagcccgtcaccgccacactcagtgcccccgtcaaggacaaggccgcccgtacggtcatcgagcgcgccctcaaggtcgactcgaagcccgtggtggagggcgcctggcactgggtggacgacaagacgctgcactaccgccccaaggagtactggcccacccacgccaccatcacggcgcacagcaacctgaagggcgtcaaggtcgccgagcggctctggggcggcgacgtgaagcccctgaagctcaccaccggcgacagcctgatcgccgtcacggacgccgccgcacactcgatgacggtcttccgcaacggcaaggagatcaaccagatccccgtcaccaccggcaaggccggcttcgagacccgcaacggcgtcaaggtcgtgctgggcaaggagtacttcgtacggatgcgcggtaccaccgtcggcatcgccgagggctcgtcggactcgtacgacctgccggtgtactacgcgacccgggtgacctggagcggcgagtacgtccacgcggcgccctggtcggtcggctcccaggggtccgccaacgtcagccacggctgcaccgggatgagcaccagcaacgcggagtggttcttcgacaccgtgcgggagggcgacatcgtcaaggtcgtcaactcgaacggcgacaacatggacccgttcgggaacggctacggagactggaacctcgactggaagaactggcgcacgggcagcgccctgatggccggcaccccggacgggccgagcccggcggaccgggccaagctgcggcccgagacggtg

SEQ ID NO: 6028 - DNA, 396 bp, Streptomyces avermitilis
  CDS (1)..(396)
atgcagccgaccgccacggtgctggtctacagcgacgactccaacacccgcgaacaggtccggctcgccaccggacgccgtccggcgccggacgtgcccgtggtggagttcctggagtgcgcgacgccggccgccgtgatcgcggagctggacaagggcggcatcgacgtctgcgtgctggacggcgaggccgtgccgatgggcgggatgggtctctgccggcagatcaaggacgaggtcttcaactgcccgcccgtgctgctgctgatcgggcgaccccaggacgcctggctggccacgtggagccgtgcggacgccgcggtgacgctgccggtggatccggtggagttcgcggccgcgctggcctctctgttgcgtcagaaggctctgatcggc

SEQ ID NO: 6029 - DNA, 618 bp, Streptomyces avermitilis
  CDS (1)..(618)
atgtcggtcgtggcgacagcaacgacagtagaaaccgggcacgcgcacccgtcggtcaaccggccgaacctcaccagcgtcggaaccatcatctggctgagttccgagctgatgttcttcgcggccctcttcgcgatgtacttcaccctgcgatcggtgaccgggccggagcactggaaggagatggcgagccatctcaacttcccgttctccgcgacgaacaccacgatcctggtgctttcctccctgacctgccagctcggcgtgttcgccgccgagcgcggggacgtgaagaagctccggatgtggttcatcgtcaccttcatcatgggtgcgatcttcatcggcggtcaggtcttcgaatacaccgagctggtcaagaaggacgggctctcgctctcctccgacccgtacggctcggtgttctacctgaccaccggcttccacggcctgcacgtgacgggcggtctcatcgccttcctgctggtcctcggccgcacctacgcggcccggagattcactcacgagcaggcaaccgccgccatcgtcgtgtcctactactggcacttcgtcgatgtcgtctggatcggcctcttcgccacgatctacatgatcaag

SEQ ID NO: 6030 - DNA, 807 bp, Streptomyces avermitilis
  CDS (1)..(807)
gtgaaaaagctctccgcacgacgacgccatccgctggcggcggtcgtcgtcctactcctcgcgctggcggccaccggggggctgtacgccgcgttcgctcccgcgagcaaggcgcaggccgatgacaccgcccagtccctcgccatcgacgagggcaagaagctctacgccgtaggctgcgccagctgccacggcgccggcggtcaggggaccaccgacggtccgcaactggtgggcgtgggtgccgcggccgtcgacttccaggtcggcacgggccggatgccggcccagcagcccggcgctcaggtgccgaagaagaaggtcatctacacgcaggccgagatcgaccagctcgcggcgttcatcgcctcgctcggtgccggtccctcgatcccgacgaagaaccaggtcagccccgagggcgcggacatcgccaagggcggcgagctcttccgtaccaactgcgcgcagtgccacaacttcaccggtaagggcggcgcgctgacgcacggcaagttcgcgccgagcctcgagggcgtcgacccgaagcacatctacgaggccatgcagaccggcccgcagaacatgccgtccttccccgacacgaccctgtcggagaagaacaagaaggacatcatcgcgtacctcgacgcggtcaacggtgacgaaaccgtcgagcccggcggcctcagcctgggcggcctcgggccggtcagcgagggcctgttcggctgggtcttcggcctcggcacgctgatcgccgtcgccgtctgggtcgccgctcggaccgcaaaggccaagaagtca

SEQ ID NO: 6031 - DNA, 1071 bp, Streptomyces avermitilis
  CDS (1)..(1071)
atgagtagccaagagattccagaagagaaccgtcccgctgagcgggccaccgacgaagatgcgcacggtcacggtgcggtagccgtcgcggacgagcagaacccgttcgccaacccgggtctgccgccccacgagcaccgcgtccaggacatcgacgagcgggccgcccagcggtccgagcgtgtcgtcgccttcctgttcacggtgtcgatgctggccaccgtcgccttcatcgcctcgtacgtggcgatcccgaaggaagaggcgatctatgtcttcccgatcgggcacatcagcgcgctgaacttcgcgctgggcctgtcgctcggcgtcgcgctcttcacgatcggcgcgggcgcggtccactgggcccgcaccctgatgtccgacgtggagatcgccgacgagcggcacccgatcgaggcgccgccggaggtcaaggccaaggttctggccgacttcaaggagggcgccaaggagtccgtgctcggccgccgcaagctgatccgcaacacgatgttcggcgcgctggccctgttcccgctctccggcgtcatgctgctgcgcgacctcggtccgctgcccgagaccaagctgcggcacacgatgtggcgcaagggtctccagctcgtcaacatgaacacgaacgagccgctgcgtcccgcggacgtcgcggtcggttcgctgaccttcgccaagcccgagggcctggaggagcacgacgaggacttccagaaggagatcgcgaaggcggccctgatgatcgtccggcttcagccggacaacatcaaggacaagaaggaactcgagtggtcccacgagggcatcgtggcctactcgaagatctgcacccacgtcggctgcccgatctccctgtacgagcagcagacgcaccacgtgctgtgcccgtgccaccagtccaccttcgacctctccgacggtgcccgagtgatcttcggcccggccggtcacgccctgccgcagctgcgcatcggtgtgaacgacgagggctacctcgaggcgctcggcgacttcgaagagcccgtcggtcctgcattctgggagcgcgga

SEQ ID NO: 6032 - DNA, 1644 bp, Streptomyces avermitilis
  CDS (1)..(1644)
atgagcgccacgtcaaacacaccgtcccccgactcgcgtgcgcgcgggaaggcgcccgccggtgagcgggtcgccgactgggccgacggccgcctggggatctactccctggccaagtccaacatgcgcaagatcttccccgaccactggtcgttcatgttgggtgaggtctgcctctacagcttcatcatcatcatcctcacgggtgtgtatctgacgctgttcttccacccgtcgatgaacgaggtgacgtacaacggcagctatgtcccgctccaggggcagctgatgtcggaggcgttcaactcgaccatgcacatctccttcgatgtgcgcggtggtctgctgatccggcagatccaccactgggcggcgctgatcttcctcgccggcatgttcgtgcacatgatgcgcgtcttcttcacgggtgcgttccgcaagccgcgtgaggtcaactggctgttcggcttcctgctgttcgtcctcggcatgttcaccggcttcaccggttactcgctcccggacgacctgctctccggcaccggtgtccgcttcatggagggcgcggtcctgtccgtgccgatcgtgggcacgtacctgtcgttcttcctcttcggcggcgagttcccgggcggcgacttcgtggcccgcttctactcggtccacgtcctgctgctgccgggcatcatgctcggcctggtggtcggccacctgatcctggtcttctaccacaagcacacgcagttcgcgggccccggaaagacgaacaacaacgtcgtcggcatgccgctgctgccggtctacatggccaaggccggaggcttcttcttcctggtcttcggtgtcatcgcggccatcgcggcgatcgcctccatcaacccgatctggtccatgggcccctaccgtccggacatggtgtccacgggcgcccagcccgactggtacatgggcttctccgagggcctgatccgtgtcatgccgggctgggagatcaacctctggggtcacacgctcgtcctgggcgtgttcatcccgctggtgatcttcccgctggtcctggccgcgatcgcggtctacccgttcatcgagtcctgggtcaccggcgacaagcgcgagcaccacatcctggaccgcccgcgcaacgtcccgacccggaccgggttcggcgcggcctggatcagctggtacttcgtcctgctcatcggtggcggcaacgacctctgggcgacgcacttccacctgtcgatcaactcgatcacctggttcgtccggatcggcttcttcgtcgtgccggtcctcgtgttcgtcatcaccaagcggatctgcctcggcctccagcgccgggaccgggacaaggtgctgcacggccgtgagtcgggcatcatcaagcgcctgccgcacggtgagttcatcgagatccacgagccgctcagccaggacgcgctgcacacgctcaccgcgcacgagcagtacgagccggccgcgatcggcccggtggtcgacgagaacggtgtcgagcgcaagcccaaggtgacggagaagctgcgcgccaagctcagcggcgcgtactacggggacgacaaccagatccccaagcccaccgtcgaggagtacaaggagatcacgagcggccacggccaccac

SEQ ID NO: 6033 - DNA, 1062 bp, Streptomyces avermitilis
  CDS (1)..(1062)
atgagcgctgtgaaccccgctggaggcgacatcgcggcgggccgttcctggcccgaggtgctgaacggcctgctcgacggccgcgaccagagcgcggacgacacggcctgggcgatggaccggatcatgcgcggcgaggccacggacgcgcagatcgccgggttcctggtggcgctgcgcgccaagggcgagacggtcgaggagatctccgggctggtccgggcgatgtacgagcacgcgaatctgatcgaggtgcccggagcgaccgtcgacatcgtcggcaccggcggtgacggcgcgaagaccgtcaacatctccacgatgtcgtcgatcgtcgtggccggcacgggtgccaaggtcgtcaagcacggcaaccgggccgcgtcctccgcgtccggttcctcggacgtcctggagaagctcggcatcaatcttcagctgacccccaagcgggtcgccgaggtggccgaggaagccgggatcaccatctgcttcgcggtgaagttccatccggcgctgcggcatgtggcggcggcgcgggggcagttggggatccggacgacgttcaacgtcctcggcccgctgacgaatccggcccgggtgaaggcacaggccgtcggagtcgccgacccccgcatggcccccatcgtggccggtgtcttcgccgagcgcggcaactcctcgctggtcttccgcggcgacgacggcctcgacgagctgaccaccacgtcgacctcccgggtctgggtcgtccgcgagggcaaggtcaccgaggagtccttcgacccccgcgacgtcggcctcgacctggtcccggtggaggcgctgcggggcgcggacgcggcgtacaacgcggatgtcgcccggcgcctgctgaacggcgagacggggccggtacgggacgcggtgctgctgaactcggcggcggccctggtggccctgtccccgggcgccgggaccctcgcggagcagctgcgcgcgggtatggcgcaggcggcggaggcgatcgactcgggagccgcgaagagggcgctggagcggtgggtggcggccagcaacgcc

SEQ ID NO: 6034 - DNA, 1371 bp, Streptomyces avermitilis
  CDS (1)..(1371)
atgtccgtctccaccgctgccgccgaccagaccgtttgctgtgacatttcgggacacctgcccgttctgggccgcgaggtcaccgtcccgctcgtcaccggtggcgaggtcacctacgccgccctcgactacgccgccagcgcccccgccctccagcgcgtctgggacgacgtcgccgcgtacgccccctactacggctccgtccaccggggtgccgggtatctctcccagctgtccaccgacctgttcgagaacgcccgcaggaccgtcgccgagttcctcgactgccgggacggcgaccaggtcgtcttcacccggtccaccaccgactcgctcaatctcctcgccgccgcccttccggccgactgccaggtcttcgtcttcgagaccgagcaccacgcctcgctgctgccgtggcgcgacgcccgggtgacgtacctgaacgccccgcgcaccccccagcaggccgtcgagaccctcgagcgcgccctcgccggccgtgacccgcacggtccggccctggtgtgcgtcaccggtgcctccaacgtcaccggcgagctgtggccggtacgtgaactggccgccgccgcccatgcgcacggcgcccgcatcgtcctcgacgccgcccagctcgcgccccaccaccccgtctccgtacgggagttggacgtcgactgggtcgccttctccgggcacaagctgtacgcgccgttcgggtccggtgtgctcgccggacgcgccgactggctgcgtgcggccgagccgtacctcgccggcggcggcgccagccgcaaggtcacgcggcgtacggacggcggggtggacgtggagtggcacgagagcgccgcccggcacgaggccggctcgccgaacgtcatcggcgcctactccatcgcctccgcctgcaaggcgctcaccgaggccggctacgacaacctcgtcgcccgggagcagcagctgatcggcaccgtccgcgcgggtctcgccgaggtgcccgaggtcagggtcctctccctcttcggcgacgacgccccccgcgtcggcgtcatctccttcgtcgtcgagggctggaacagctcccacttcgccgccgcgctctccgccgagtacggcatcggcgtccgcgacggcctcttctgcgcccacccgctggtgcgcaccctgctcggcagcgacccgcaggtccagggcgagtgcggcgcccccgaggcggcgcccggcgagaagtccctcaacgcgatccgcgtcagcttcggcgccggcacccccgacgagcacgtggagcgcttcgtgcgcgcggtcaaggagctcgtgcgggaaggtgcccggtggcagtaccggaccgaggacgggcgctgcgtgccggcggtc

SEQ ID NO: 6035 - DNA, 279 bp, Streptomyces avermitilis
  CDS (1)..(279)
gtgatcaccgcgatcgtgctcatcaagaccagcgtggaccggatccccgagatcgcggagtcgatcgccgccctcgactccgtcagcgaggtcttctccgtcaccggcacgtacgacctgatcgccatggtccgcgtcaaggcccacgacgacctggcggacgtcatccccggcagcatcagcaagatcccgggcgtcgaggccacggacacgcacgtggcgttccgtacgtactcccagcacgacctggaggcggcgttcgcgatcggtctcgactcg

SEQ ID NO: 6036 - DNA, 741 bp, Streptomyces avermitilis
  CDS (1)..(741)
atgctctgttccgtgatcagcaggtggagtacgacggtcggcagcgcggtccgggcacagtcggcgccggtgacgtacggactgatcggcctctgctgcctgatcttcgcgatcggccccgcggcgggactcaatcccgcccacggcaccggggaggggctgctcgccgcgcagcagacctacttcgcccgctggggcgtggtgcccgcggagctcttcagcggagccccgcgcgcggcactcaccccggccacggcgctcttcgtgcacggcagctggatccatctgctgggcaacatgctcttcctctacgtcttcggggcgatggccgaggaacgcctgggacacctcgagttcgccctgttctatctgggctgcggctatctcgccctgctcgggtacgcggcggccaacgccggctcgacgcagacgctggtcggcgcgtccggatcgatctccgcggtcctcggcgcgttcctctacctgttccccggggcccgggtgaccagtctcttcccgttcctcttcttcctgccgctgcgccttccggcctgggtcgtcctgcccttctgggccgccctccagtggctggccgcgagccgcgtcgccaccggcccgagcgtcgcctacctggcccacctggtgggcttctcgctcggcttcctctacgcgtgggtgcgctacggacggacgactagagtgaaaaccccagcagcggcccccgagggagaaaaccagccg

SEQ ID NO: 6037 - DNA, 276 bp, Streptomyces avermitilis
  CDS (1)..(276)
gtgtctgattcccggagactggaaggaacagcagccacgatgacggttcccctgccgactgccgagacccggtggcgctgcactttgtgcggcaacctcacgcgtttcgacgtgacccgctcgtcgaaggtcgtcgagtacgtacacctcgacctcgcgggcgagccgagcgtcgaggagcgcgacgtggtcagtgagaccatcgagtcggtgcgctgccgctggtgcaacgcggtggaccaggtggaactcgtggacaggccgggcgccggctcc

SEQ ID NO: 6038 - DNA, 1347 bp, Streptomyces avermitilis
  CDS (1)..(1347)
atggtggagaccacaggcggggggccgggcgacggcaccgccgaggtgctcgaccgtccgctgcccgacggcgtgcgccgcagggtcgtgcagatcgtctccgacgggttcggcgggctgaccgtcgccgagttgcccgcgcagctcaggcagtacgcccgcttcgccccgaaccggcgcgccaagttcgccggcaacgcgatggcggccgctctggagaccgacccgatcttccggcagcgcatcgccgagaagctgagagaggctcagccggagctggccggcgccctcgactccggctcgccgcccccggccgcggacccgctggacgtggcggccgcggcctatgtcctgcgccccatgggctgggtgaagctggtgaccgccgccggcgaggaggcccagcgtgccgacgccgagcgcgcggacgacgagacccgggccgagctggagcggctgcgcgaggagctggccgaggcccgcggccggacgaaggcggagaccgagcggctgcgcgccgagctggaatcgaccaagaaggaagccgaatcgctgcaccgcaagctgcgcggcgccttcagtgacgtcaagcgcggcgaggcggcgctgcgcaaggtgcagagcgagatcgaggccgtccgcgccgaggggcaggcccaggtgtccgccgccgagagcgagacccggcggctcaaggcgcggctcggtgagaccgaggcggccctggaggccagccgcaaggccgcgcgcgaggggcgcagcgtcgaggacatgcgcgtacggctgttgctcgacacggtgctcgacgcggcgcaggggctgcggcgtgaactcgccctgccgcccgtgtccgtacggcccgcggagaccgtggacgcggtcgaaccgggacgaatgaccccgaaggacatcgccgcccgtgcgctgtccgaaaacgaccccgcgatcatcgaccagctgctcgcgctgccgcaggcgcatctggtcgtcgacggctacaacgtcaccaagaccggttatccgcagatgccgttggagaagcagcgcctcagactgctcgggcagctctcgcagctcgccgcgcagaccggcgccgaggtgacgtgcgtcttcgacggggccgaactggccgctcccgtgctgctcgcgccgccgcgcggagtgcgggtgctgttctccaaagcgggcgtcacagccgacgagctgatccgtcagctggtgcgtgcggagccgcccggccggcccgtcatcgtcgtctccaccgaccgcgaggtggcggacggcatcgccaaggcgggcgcccgcccggtggcgtccgtggtgctcctcaagcgcttctcgcgcggc

SEQ ID NO: 6039 - DNA, 1038 bp, Streptomyces avermitilis
  CDS (1)..(1038)
gtggcgtcccaccgtcgacccaagcagccgagccgcacccgtgtgaccgtgctcaccaccgccgcagcggcagcagttgtcctcagcgcgaacgccgccaacgccgcgccgagtgagaagccgagcaaggacgaggtcaagtccaaggtcgacaagctctacgaagaggcggagaaggccaccgagaagctcaacggggccaaggagaagcaggacaagctcgagaagcagatcggcaccctccaggacaacgtggcccgcggtcaggaagagctcaacaacctgcgcgacggcctcggttcgctggccagtgcccagtaccgcaccggcggcatcgacccctccgtccagctcttcctctcctcgaacccggacgacttcctggacaaggcgtccacgatggaccagctgagcagtcagcaggtcgacgcgctcaagaagatccaggagaagcagcgctcgctggcccagcagcgcaaggaagcctccgagaagctcgcggaccttgccgacacccgcacggagctcagcaagaagaagaaggaagtccagggcaagctcgccgaggcgcagaaggttctcaacaccctgaccgccaaggagaaggcggccctcgccgccgagcagagccgcgccagccgcgccagcgagcgcagcgccctcgacgacagcggttccgccaagcccgcctccgggcgcgccgcgtccgcgtacgccgccgcgcagtcgaagatcggctcgccctacgtctacggcgcctccggcccctcctccttcgactgctcgggtctgacctcctgggcctacgcgcaggccggcgtctccatcccccgcacctcgcaggcgcaggccaacgccggtacccgcatctactcgcagagcgacctccaggtcggcgacctggtcatcttctacggcgaccagcaccacgtcggtttctacgcgggcaacggccaggtgctgcacgccccgcgtaccggcaccgtcgtgcgctacgaggcgatcggcaacatgccgttccagttcggcgtccgcatc

SEQ ID NO: 6040 - DNA, 1011 bp, Streptomyces avermitilis
  CDS (1)..(1011)
gtggggtcccatcgccgccttgcaccgtccggcttcaaccggggcgccggtgccgcggtctgcgcactgtccaccgcggcagcggcactcggcgccgtaccggccgacgccgccccgcacgacgacacccgggcccgggtggaccgcctgtacgaggaggccgaacgggccaccgaggcgtacaacaaggccgacgagcgcgccgacgtcctgcgcgagcaggtgtcgcaggcgcaggacgagatcgcccggcagcaggagcgcatcaacaccatgcgggacgcgctcggttcgctcgccggcgcccagtaccgctccggcggcctggacccctcgctcgccctgctcttctccgacaacccggacgactatcttgaccgggccgccgcgctccatcgcgtcagcgcccgtcaggcgacccggttgaaggacttccagcacgccatgcgtgacgtcgcccaggagcgcgcggaggccgcgggccggctggccgagctggagaagagccgcaaggccgtcgcccggcacaagcggaccgtcgagcagaagctggcggcggcgcgccggctgctcaacgcgctgccggacgcccagcgcgccgccttcgaacgggcgtcgcgggccggtcgctccggcatgcccgacctcaccggtgtcctcgcgccgggcggtcgcgcgggggccgccgtcgccgcggcccgctccgcgctcggccgcccgtatgtgtggggcgccaacgggcccggcggcttcgactgttcgggactgatgcagtgggcgtacgcgcaggccggcgtcggtctgccgcgcacctcgcaggagcagcggtacgccggccggcaggtgccgctctcccaggcgcagcccggcgatctggtcgtgtaccggtcggatgccggccatgtcgggatgtacgtcggcaacggccaggtgatccacgcgccgtacccgggggcgccggtgcgctacgacccggtcggaatgatgccggtctcgtccgtcacgaggccc

SEQ ID NO: 6041 - DNA, 1218 bp, Streptomyces avermitilis
  CDS (1)..(1218)
gtggctggtcgagggcgtacgtcaggggtgctggcgagctgtctgctgctgcttgccgccctggtcggctgcggtggccggcccgcgcgggacgcctcggcggccgaggtgcagcgggtgctcgaccggcgggccgcggcggtgctgcaccgggaccggtccgcgttcctcgcgaccgagtcgcccgtcgccccggccgccggccaactcgccacgggcgccgaggagttcggcaacctccgcggtgtcccgctggcttcctggtcgtaccgcgtcaccgccttccaccgctccggcgagcgggccacggccaccgccgaactccactaccgcctcaagggatacgaccgtgcgcccgtcacggccggccgcatgctgcgcctgacccgcggcgacggcgggtggtacgtggtgtccgacgagcccgcgaagaagtccagcgagcagctgtgggagcagggggccgtgcggatcgtccgcggtgagcacagcctcgtcctcggtgtcgggcagccggactcggtgctgcggggttacgcgaacctggcggaccgtgccgtgcccgccgcctcccaggcgtggggcgccgactgggcggggcgggtggtggtgctcgtaccgaagtcgctggacgggatggcggggctgctcggcgcgccggcgtccgggtaccgggggatcgcggcggtcaccaccggggaggcgggcggtgcggcgaaggccccggcggaccggatcgtcgtcaaccccgacgcgtacggcgtgctcggcgacttcggcaggcaggtcgtcctcacccacgaggccacccatgtcgccacccgcgcccacaccacggcggccacgcccctgtggctctccgagggctacgcggactgggtcggctaccgcggctcggggcgcacggcggcgcagatcgccccggagctggaccgggccgtgcgggaggggcagctgccggccgctctgccggccgacgcggacttcggcttcagcggggacgcggggaagctggcgaaggcgtacgagggcggctggatggcctgccggatgatcgcggaccactggggagaggtccggctcgacgacttctaccgggccgtgggggaccaccggaagcgggcgggagcggtcgagggcgccctgaaggacgtactcggcacgacgccgcggaagttcaccgcgcagtggcgggcctatctgaaggctcagctcggc

SEQ ID NO: 6042 - DNA, 1344 bp, Streptomyces avermitilis
  CDS (1)..(1344)
atgaacgcccaccgcgcccaactgatctcgctcgcccgccccgtctacttctcgctgctggcctccgtggccgccgggatcatcaacaccgtctgggtctcccggctcggcggcccggccgtggccgccgtggccgtcgccaccaacaccgagaacgtgctgctcggagtcgccctggtcttcgcctccggtacgaccgtcctggtcgcgcacgccaggggagcgcaggaccccggcgcggtgcgggcggccgtgcgcgggggatgggcgctgtgcgcggtggtcacgccggtggtcgccggctgcggatatctgctgcgcgagccgctcgcccggctggtgctgggcggcgagggcccggccctgcccctcgccgtcggctacttcgcgatctccctgccgggcatcaccgtcttctacgcgcagaacctcgtcgacggcatcctcaagggcgccggcgacacccgcaccccgatgcgcctcgccctgcttgccaacgggctgatcctggccctcgacccgttgctcatccaccggtacggcgtccggggcgccgccgtctccacggtgctgtgccgctgcgccgcgctcggcgtgggtctgctcgccctgcgccgcaacgcgctgctccgcggggccgcggccgtccggcccgccgaggccaccggcgccgccctgcgccggaccctgagcaccggcctgcccatgtccgccgacttcaccgtgcgccagggcggggcgctggtgctcgtcgcgatcgtggcccggctcggggtgaccgccgtggccgcgtactcgatcgcgtacaaggtgatgtacgtcgccaccatggccttctacgcggtgcgccaggccgcctcgatccacacggcgcacacgcgaggcgcggaccgacgggcgtcctcccgctcggccggagccgggagcgggggagagcggcgggccatcgggcggcaggccgtcgtcgtctcggggacggtgggactgctcgcctcggccctgctctgcgtgctcgccccctgggtcatgcgcgccttcggcgccgggcccgaggtcgcgcaccagggcgtgctctttctgcgctgcgtcgggccctatctgctgctgatggcctgcttcatcgcgctcggcggggtcttcgaggggagcgggggcgctcctgtgctgctgcgggtgacgctgctcggcacggcggtccagcttccgctcgcgtacgccctgtcagggctcgggctgcccgggatctgtctggccctggcgctggccatggtggtgcagtgcgccgcgctcctgcccggcgtgcgccgtcaggaggacgccagggactccctggtgcgggtggcc

SEQ ID NO: 6043 - DNA, 1230 bp, Streptomyces avermitilis
  CDS (1)..(1230)
gtggacatcgcgggcacgagaaggttcccggcctggctcctggcctcctggggcctgaccaggctggcgctgctgctgttcgtcttcaaggtgttcgtcttcccgggcccggacgtcaccggcgacgtctcggtgatctaccagggctggtacgagaccctgcgcaccggcaccttcccgctcgacgacgtcacctggcagtacccgcccgccgccgcgctcgccatcctctcccccgccctgctgcccttcctcgactacgcgtcggcgttcttcgtcctggccttcctcgccgacctggcggtcttctgtctgctccagtacacgggcctgcgcccgggcaggacgctgcgcggcgcctgggtgtgggtggtgggcgtcgccctgctcggcccgaccgtgtacgcccgctacgacgtgatggtcaccgcggtcgcggtcgccgcactgctcgcgggggcccggcatccgcgcgtgacgggggcgctgatcggcttcggggcgctgctgaaggtgtggccggtactgctgctggtgggcgccgccagacgccgggtctgggcctcggcgacggtgaccgtcgtcgcggtcgcctccctcttcgccctggccatgcccggcgccttcgccttcctgaccttccagcgcgagcggggcaccgaggtggagtcgctgggctccctggtcttccatgtcgcccggcacttcggctggaacggccaggtgctgctcaactacggctcggtggagttcctgggcccgtatgtcggcgcggtgagcaccgcggccctgttcctgaccgcggtcgccttcggctggctgctgctgtggcggctgcgcgccaagcggttcctggcgcacacgctcgcggacgcggcgttcacggcggtgctgatgttcaccgccacgagccgggtgatcagcccgcagtacatggtgtggctggtcgggctcgccgcggtctgtctgtgcttccggggcagccgcatgaccgtgcccggcgggctggtcctcgccgcgtgcttcgtgaccgtgctggagttccccgtctggttctcgcacgtggtcggcagcgactggatgggcatcacactgctgttcgcgcgcaacggcctcctgatggccgccgcgctgacggccgccctggaactgtggcgcggcacggtcctgccgccggtccccacggtgcccggtcaggccacccgcaccagggagtccctggcgtcctcc

SEQ ID NO: 6044 - DNA, 1140 bp, Streptomyces avermitilis
  CDS (1)..(1140)
atgcacaagaccttgatcgtgaccaacgacttcccgccccggcccggcgggatccaggcgttcctgcacaacatggcgctgcgcctggaccccgagcggctggtcgtctacgcctccacgtggaagcgcggccgcgagggcgtcgaggcgacggctgccttcgacgccgagcagcccttcaccgtcgtacgcgaccgcaccacgatgctgctgccgacgccgggcgccacccggcgggccgtcgggctgctgcgggagcacggctgtacgtcggtgtggttcggtgcggcggctccgctcggtctgatggcgcccgcgttgcgcagggcgggcgccgagcggctggtggccaccacgcacgggcacgaggccggctgggctcagctgcccgcctcgcgtcagctgctgcgcaggatcggcgagtccacggacacgatcacctatctcggcgagtacacgcgctcgcggatcgccgccgcgctgacgccggaagcggccggcaggatggtccagctgccgcccggcgtcgacgagaagaccttccaccccggctcgggcggcgccgaggtccgcgcccggctcgggctcaccgaccgtccggtggtcgtctgtgtctcgcggctcgttccccgcaagggtcaggacacgctgatcctcgccatgccgcacatcctcgccaaggagccggaggccgtcctgctgatcgtcggcggcgggccgtacgagaaggagctgcgcaggctcgcggacgagaccggggtcgccggctcggtccgcttcaccggggccgtgccctggtcggagctgcccgcccactacggggcgggggacgtgttcgcgatgccgtgccgtacgcgccggggcgggctcgatgtcgaagggctcgggatcgtctatctggaggcgtccgcgaccgggctgcccgtggtcgcgggcgactccggcggggcgcccgacgcggtgctcgacggcgagaccggctgggtggtgcgcggcggctccccggaagcggccgccgaccgcgtcgtcacgctcctcggcgaccccgagctgcgccgccgcatgggcgagcggggccgcgagtgggtcgaggagaagtggcgctgggacctgctggcggagaagctcaagaccctgctc

SEQ ID NO: 6045 - DNA, 1632 bp, Streptomyces avermitilis
  CDS (1)..(1632)
atgacagaaaaactgacgcatcgtcacctgactcgccgtcaaatccttggtatggccgccctccagacggcggccaccctgggcttcacccggatcggcctccagtcggcgcgggccgccgagcccgacgcggtcgagaccgcacccgccatcgtggtcggttccggctacggcgccgccgtggccgcgctccgcctcggccaggccggcctccgcacgctcgtcatcgagatgggcggactctggaacacacccggctccgacggcaaggtcttctgttccaccagcgccccggaccggagatccatgtggttccggacgcgcaccgaggcgccgctcgccgagttcctgtggctggacgtcgtcaacaaggacatcagcccgtacccgggcgtcctggaccgggtgcacttcgccaacatgtccgtgtacgtcggccggggcgtcggcggcggctccctggtcaacggcggcatggccgtcaccccgctccagtcgtacttcgccgagcagttcccgaccgtggacgccgccgagatgtacagcacgtacttcccgcgcgcccgcaccatgctcggcgtcaacacggtcgaccccgcctggttcgagtccaccgagtggtaccggttcacccggacctcgcggaaggcggccacgaacaccggcctgaagaccaccttcgtaccgaacgtctacgacttcggctacatgcagcgcgaggcggccggcaccgccaccaagtccgccctcgccggcgaggtcatctacggcaacaactacggcaagcgcagcctcgacaagacgtacctcgcctcggcgctgggcaccggcaacgtcaccatccacacactggagagggtccgcgagatacgaagggcgagcgacgggacgtacctgctgaccgccgaccggatcgacaccaccggcgcggtcgtcgagaccaagcagtacagctgcacctacctgttcctcggcggcggcagcctcggcacctccgaactcctcgtccgggcccgggagacgggcgccctgcccgccctcgacgcgagcgtgggcaccggctggggcaccaacggcaatgtgatgaccggccgggcgaaccacatctgggacaccgtcggggccaaccagtccaccatgcccgtcatgggcatcgacgactgggcgaacacctcgaaccccgtcttcgccgagatcgccccgctgcccatggggctggagcactggatcagcctctatctggcgatcaccaagaacccggagcgggcgtccttcacgtacgacgcggcgagcgactccgcgaagctcggctggagcgccgcccagagcgccgtgtccgtgagcatggccaagaagctcttcgaccggatcaactcggccaacgcgacgatctaccggtacgacctcttcggcaacaacaagaccttcgccgacgacttcacgtaccacccgctgggcggctgcgtactcgggaagtcgacggacaactacggccgggtgaaggggtattcgaagctgtacgtcaccgacggctcgctcgtccccgggtcgatcggcgtcaacccgttcgtgacgatcaccgcgctcgcggaacgcaccatggcgcgggtcctcgccgaggacaccgcgcca

SEQ ID NO: 6046 - DNA, 1794 bp, Streptomyces avermitilis
  CDS (1)..(1794)
ttgcgcgagttcagccttccggctttgtacgaggtccctgcggacggcaatctgaccgacatcgtccgcagaaacgccgcgcagcatcctgacgtcgccgtcatcgcccgcaaggtcggcggcagctggcaggacgtcaccgccaccgccttcctcgccgaggtgcgcgccgcggcgaaggggctcatcgcctcgggcgtccagccgggcgaccgggtcggcctgatgtcccgtacccgctacgagtggacgctgctcgacttcgcgatctggagcgcgggcgcgatcaccgtgccggtgtacgagaccagctcccccgagcaggtgcagtggatcctcggcgactcgggcgcgaccgcctgcgtcgtcgagctggacacgcacgcggcctcggtggagtcggtgcgcgaccggctgcccgccctcaagcacgtctggcagatcgacaccggcggcgtggaggagctggggcgcctcggcagggacgtcagcgacgccaccgtcgaggagcgcagctcgctcgccaaggccgacgacccggcgaccatcgtctacacgagcggcacgaccggccgtcccaagggctgcgtcctcacccaccgcgccttcttcgcggagtgcggcaacatcgtggagcggctgcgcccgctcttccgcacgggcgagtgttccgtcctgctcttcctgccgctcgcgcatgtcttcggacggctcgtgcaggtcgcgccgatgatggcgccgatcaagctgggctgcgtcccggacatcaagaacctgaccgacgaactggccgcgttccggccgacgctgatcctcggtgtgccgcgcgtcttcgagaaggtctacaactcggcgcgcgccaaggcgcaggcggacggcaagggcaagatcttcgacaaggcggcggacacggcgatcgcgtacagccgcgccctggacaccccgtccggcccgtccctcgggctgaagatcaaatacaagacgttcgacaagctcgtctacagcaagctgcgggccgttctcggcggcaagggcgagtacgccatctccggcggcgccccgctgggcgagcgcctgggccacttcttccgcggcatcggcttcacggtcctcgagggctacggcctgaccgagtcctgcgcggccaccgccttcaacccctgggaccgcacgaagatcggcacggtcggccagccgctgccgggctccgtgatccggatcgcggacgacggcgaggtgctgctgcacggcgagcacctgttcaaggagtactggaacaacgagggcgcgaccgccgaggcgcttgccgacggctggttccacaccggtgacatcggcaccctcgacgaggacgggtatctgcggatcaccggccgcaagaaggagatcatcgtcaccgcgggcggcaagaacgtcgccccggccgtgatcgaggaccgtatccgcgcgcacgcgctggtcgcggagtgcatggtggtcggcgacggacgcccgttcgtgggcgcgctcgtcaccatcgacgacgagttcctgggccgttgggccgccgagcacggcaagccggccggctccaccgcggcgtcgctgcggcaggatccggatctcctcgcggcggtccagagcgctgtcgacgacggcaacgccgcggtgtcgaaggcggaatcggtgcggaagttccgcattctgtcctcccagttcaccgaggagtcgggccacctcacgccgtccctgaagctcaagcgtcatgtggtggcgaaggactacgcggacgagatcgaggcgatctaccagaag

SEQ ID NO: 6047 - DNA, 795 bp, Streptomyces avermitilis
  CDS (1)..(795)
atggcactctcaccaggcggcaaccgcaggaagcgcatccatgtggtcagcgatgtgcatggcaacgcgcgtgacctggcccgggccggcgacggcgcggacgccctgatctgcctcggtgacctcgtgctcttcctcgactacgccgaccactcgcgcggcatcttcccggacctgttcggtgtggcgaacgcggaccgcatcgtcgagctgcgcaccgcccgccgcttcgaggaggcgcgggcgttcggcgccgagctgtggtccggcatcggcagcgaccgggcggccgccatcgagaaggcggtacgcaagcagtacgcggagatgttcgccgcgttcccgacgccgacgtacgcgacctatggaaacgtcgacatgccgacactgtggcgtgagtacgccggacccggcacgaccgtgctggacggcgagcgggtggagatcggcggctggaccttcggcttcgtcggcggcggactgcgcacgcccatgcggacgccctacgagatcagcgacgaggagtacgcggcgaagatcgaggcggtcggcgaggtggacgtgctgtgcagccacatcccgccggaggtgccggagctggtctacgacacggtggcgcggcgcttcgagcgcggcagccgggcgctgctggacgccatccgccgcacccgcccgcgctactccctcttcggccacgtccaccagccgctggtgcgccggatgcggatcggggcgacggagtgcgtgaacgtggggcacttcgcggggtccggcaagccgtgggcgctggagtgg

SEQ ID NO: 6048 - DNA, 441 bp, Streptomyces avermitilis
  CDS (1)..(441)
atggcggaacacaccagctcgagcatcatgatcgaggcggcaccggccgacgtcatggaagtgatcgccgacttcgcccgctacccggactggacgggcgaggtgaaggaggcggaggtcctcgggaccgacggccagggccgcgccgagcaggtccggctcgtcatggacgcgggcgcgatcaaggacgaccaggtcctggcgtacacctggacgggcgaccacgaggtgtcctggagcctggtcaagtcccagatgctccgctccctggacggctcctacctcctgaagccggcgggctcggacgcgaccgaggtgacgtaccagctcacggtcgacgtcaagatccccatgctcggcatgatcaagcgcaaggcggagaaggtcatcatcgaccgcgcgctggccggcctgaagaagagggtggagtcggaggagaag

SEQ ID NO: 6049 - DNA, 1167 bp, Streptomyces avermitilis
  CDS (1)..(1167)
atgcgcaccctcctgatcacaggccccggcggctccggccgtaccaccgtcgccgcggccacggcgctgagggcgagccgtacgggcacccggaccctcgtgctcagcgccgaccgcacggacaccctgggtgccgccctcggcgtaccgacgggcggggcccccgtcgaagccgcaccgggcctgaccgcctggcgccccgacgccgccgaccgcttccgcgcggacctcaccgccttccaggaccgcgccgccaccgccctcgacttcctcggcgccgcccgcctggacgccgaggaactcacccccctccccggcgccgaggaactcgccctgctgcgcgccctgcgcgacgccgcgctctccgaggcgtacgacctcctcgtcgtcgacctccccccggccccgcaggcgctcgccctcctcgccctccccgaggagctgcgccgctatctgcgccgcctcctcccgcccgaacgccaggcggcccgcgccctgcgccccgtgctcggccggctcgccggcgtcccgatgcccgcggactggctgtacgagacggccgcccgctgggacgtggagctcgccgcggtcgaggcggtcgtcgaggaccgcgccacgaccgtacgactggtcgccgagcccggaccggccggcgccgacgccgtccgcgccgccgccaccggcttcgccctgcgcgccgtgcgcatcgacaccctgatcgcgaaccggctcctgcccgaggaggccgacgacgcctggtcggccggcctcgccgcccagcagcgcaagttcctcgaggagtggcggggggagtaccggctccacgaactcccgcacctcggacacgacccgcgcggcgcggacgacctggccgcactcgccgtacccggcgtcaacgacgcgcctgggccggtcgagtggtccgtcgccgaccgcctcgccgacgacggggtgctcgtctggcacatcccgctgcccggcgccatacgcgacgaactcgacctcctccggcgcggcgacgaactcgtcgtcaccgcgggacagttccgccggatcgtcccgctcccgtcggccctgcgccgctgcaccgtggccggcgccgccctgcgcgagggcgagctgcggatccgcttcgcgcccgacccggacctgtggccccgcgaaagg

SEQ ID NO: 6050 - DNA, 513 bp, Streptomyces avermitilis
  CDS (1)..(513)
atgagcgaagagcgccccacgtccgacgccgctcaggaggacgcggccgacgagacgcgggttccccccggccgagcggagtcgagcgctcgcgggagcgcagccgacggcgacgcctgggccaaggcctgcgccgaggatctcgccgccgagaaggcccgccgccgcgcccagtacggcgcacagcccggctcggccgccgaggaactgcgcaagctcgtcgacgccgtcgccgagaagctgtccgggctccagtcgccgctgatcgacgcggccacctccgggacggcccagcagatggtcagccaggtggtgcgacaggccaaggccgtcgtcgagcccgtcatcgagcgcaatccggacgtcttcgaccatctggccgcggccggctccgagctgctcgccgcctaccgctccgccgtggaggcccaggagaagcgctggacggcccgggaccacgacccccgccaccggggcggggaccaggggccgggggaacacatcgacttggac

SEQ ID NO: 6051 - DNA, 951 bp, Streptomyces avermitilis
  CDS (1)..(951)
atgggactcaccatcggcgtcgacatcggcggcacgaagatcgcggccggcgtggtcgacgaggaaggcaacatcctctcgaccttcaaggtgccgacccccaccacgccgcaggccatcgtggacgcgatcgccgctgccgtggagggtgcccgcgcggggcacgagatcgtcggagtgggcatcggtgccgcgggctacgtcaaccgtcagcgctccacggtctacttcgcgccgaacatccactggcggcaggagccgttgaaggacgaggtcgaggcgcgcgtgggcctgccggtcgtcgtggagaacgacgcgaacgcggcggcctggggcgagtacaagttcggcgcgggcaagggccaccgcaacgtcatctgcatcacgctgggcacgggcctcggcggcggcatcatcatcggcaacaagctgcgccgcggccacttcggcgtggccgccgagttcggccacatccggatggtcccggacggcctgctgtgcggctgcggctcgcagggctgctgggagcagtacgcgtcggggcgcgccctcgtgcggtacgcgaagcagcgcgccaacgcgaccccggagaacgcggaggtcctgctggcgctcggcaacggcaccccggacggcatcgagggcaagcacatctcggtggccgcccgccagggcgacccggtcgcggtcgactcctaccgcgagctggcccgctgggcgggcgcgggcctcgccgacctggcctccctcttcgacccgtccgccttcatcgtcggcggcggcctgtccgacgagggcgagctggtcctcgacccgatccgcaagtcgtacaagcgctggctggtcggcggcaactggcggccggtggccgacgtcatcgcggcccagctcggcaacaaggcgggcctggtcggcgccgccgacctggcccgggagcccgacccgatcatg

SEQ ID NO: 6052 - DNA, 771 bp, Streptomyces avermitilis
  CDS (1)..(771)
ttgatcgccatgccgaccagccctgccgccagtccgctgcccccctcgcgcaccgaaccggacggttccgccgtcatccgggtgctcagctacaacatccgctcgatgcgcgacgacaccgccgcgctcgcccgggtgatcagcgcctgcgaacccgatctggtgctcgtccaggaggcgccgcggttcttccgctggcgcaagaagctggcgccgctggcgtcggcctgcggccaggtggtcctctccggcggtgccacggccgcgggccccgcgctgctgtgctcgctgcgggccacggtcgagcgcaccgaggacgtcctgctcccgctcacccccggtctgcaccggcgcggcttcgccaccgccgtcgtccgcttcggccgggcccgcctcggtgtgctgagctgtcacctctcgctccagaagaacgaacggtacgaacagggcggcatgctccttgaccacctggcccgcctcggtaccccgcacgcgatcgcgggcggcgacctcaacgaacgccccgacggccgcaccttcaagcgcctcgcctccgagctccgggactgctgggcgacggccccctggggcgccgagtacacctccacgcccgccgacccccaccagcgcatcgacgcgatcctcgccaccccgggcatcgaggtcctggcgtgcggggtgccgctcggccaccccggggtcacggaggcggacctgagggcggccacggaccacctgccggtcctggccgccctcagagtgcccgcgtcc

SEQ ID NO: 6053 - DNA, 1059 bp, Streptomyces avermitilis
  CDS (1)..(1059)
gtggcaccgatccgacggctttccgggaggcagacgcccatgcatgactcgcccgaactcgaccagctgcgcgactgggacgcgggggcacccccgctcgacgacgagacccggcaccgggtgcgcgtccgtctgttcgcagcgatgaacgacccggctccggtcgtacgacgccgccgtcccgtcgtgcgcatcgccctgaccgccaccgtggccgcggcggtcgccgccacggtcctggtggcggtacgcgacgacgacggaggtgcacggcgcaccgcgacaccgccctccagcagctccccggcgctgcggaacgtgagcgcgcggaccgtgctgtacggggcggcggcgttctcgcgcgagcacgagacggcggtcgctccgcgcgacgaccagttcatctacaccaaggagatcatcaaggagaccgagcgggagaccggagcgaagaagacctacgtcgacgagacctggcggtccgtggacgacaccaagccctcatggatcatggagatcggcaagggctggtggtcggtgccgtacaagaagcggccgggcgaccacgtggagtcggtgtccatgtggccgccgcaggactgggacacgctcaagagcctgccgaccgatccggcgaagctcatcctgaaactcaacttcggtggcaggaccccgcactcgatcgacgaaatcggggatcaggaatggtcgcagatccacttctccctcgtcgggctgctcatgctcgtgccggtgatgccggaggacctgcggcccgcggcctatgaggccctggccatggtgccgggggtgaaggcggtgccgaaccagaaggacgccgccggacggaggggtgtcgcgatcaccttcgacgatcggttctcgcaccgctccaacgccgagaccggggccggcaactccttcatcttcgacccggacacctacgaattcctgggcttccgtgacacccgcacctcgcacggcaggacctacgaccagttctcgtacctcgacagctgggccgtgaccgacaaggccaagcagcgtccccaggccggc

SEQ ID NO: 6054 - DNA, 618 bp, Streptomyces avermitilis
  CDS (1)..(618)
atgaccgtcggaccggacgtcgtcgcccgcgaggagcatcgcgaggagagtgacgcccgcgtgatcgaacggtcccgggacgagcccgagctgttcgccgccctcttcgaccgatacgccggcgccgtgcaccgttacgcggcccggcggctcggtcccgaggcggcggaggatctgacggcggagacgttcaccacggccttcaggcaacgtcacacgtacgacctcggccgggccgacgcccgcccgtggctgttcgggatcgcgaccaacctcgtggcccggcaccgaagagccgaggcgcgccgcttcaaggcgctcgcccgggtcccgcagccggtcgagcacgaggagccggtcgcggaccgcgcggtcgccagggccggcgccacaggggtgcgccgggaactggcggccgcgctgtccgggctctccgcccggcaccgtgacgtcgtgctgctggtggcctggggcggcctcgactacgaggaggcggcccaggccctgggcgtgcccgtcggcaccgtcagatcacggctgcaccgggcccgcggcagactgcgcgaagcactgggtggcaccgatccgacggctttccgggaggcagacgcccatgca

SEQ ID NO: 6055 - DNA, 642 bp, Streptomyces avermitilis
  CDS (1)..(642)
gtggctgagcacgactccgaccgcgagccggaggagaagggcgtgccgatcgacgaggaggccgcgtgggcggcgatcgtcgccgggtacggcgaggagccgccggacccgcccggcgcgaagccgttcaagtcgatagaggacctggcactcctcgatccggagaccaacgacggcgacgcgggagccggttcgggtgcggacccgggatcagaatcggatgcggacccgggatcggactccgcctcggacgccggctccgggtccgggtccgccgacaagccctcggccggtaagccgctgggcagttcggtcgccttcgcgccgggcatcggcggcggcccgcgcgactacgcggcgccggacgcgtccgaggacgacttcgacgaggacgacgagggccatttcgtaccgccggagccgccgccgctgcccgcggccgacgcgacggcgaagttcgcctggctcggggtggtgggcgggccgatcctgctcctgctggcggtccttctgggctgggacatgacctggtggctcaccacggtcggcatcggcggcttcctcggcggcttcgccacgctggtgatgcgcatgcgcacgggtgacgaggacgacgaggatccggggcggggcgcggtggtc

SEQ ID NO: 6056 - DNA, 915 bp, Streptomyces avermitilis
  CDS (1)..(915)
gtgcggtcgcgtacggtgaagtacgcctcgaagcctcggggcacgctcgtcgtgcttttcgtgatcacccccctcatgaacacccacctcatgaacaggagaccgaaggtgccggtccttcctggagccgagccgtaccgccacgagggcggggaggtcggcgtcctcctctgccacggcttcaccggttccccgcagtcgctgcgcccctgggcggagtatctcgccgagcgcggtctgaccgtgtcgctgcccctgctgcccgggcacggcacgcgctgggaggacatgcagctcaccggctggcaggactggtacgcggagctggaccgcgagctgcgcgccctgcgcgaccgctgcacacaggtgttcgtcttcggtctgtccatgggcgccgcgctggcgatgcggctggccgcgaagcacggggacgagatcagcggcctcgtgctcgtcaacccggcgaacaaggtgcacggcccggccgcgtacgcccttccggtgctgcggcacctcgtcccttccgtgaaggggatcatcagcgacatcgcgaaggagggcggcgtcgagatcggctactcccgcgtcccgctgcacgcggcccactccatgcggaacctctacgcgctggtcgacggcgagctgccccaggtcacccagccgatgctgctgctgcacagcccgcaggaccatgtggtgccgccggccgactcggcgcgcatcctcagccgggtgtcgtccacggacgtgacggagagcctgctggaacagagctaccacgtggcgacgttggaccacgacgcggaccggatcttcgaggagagctacgccttcctcggcaggctcgcacccgccgtcggcaagaagtccggggtgggacacgtggaccagcaggaagggacggccaccggtggc

SEQ ID NO: 6057 - DNA, 780 bp, Streptomyces avermitilis
  CDS (1)..(780)
ttgatctacggcgccatgaagttttccatcggggggccactgaagcttgccttcaggccctgggtggaaggcctcgagaacattcccgccgagggacccgccatcctggcgagcaatcacctgtcgttctcggactcgttcttcctgcccgcggtcctcgaccgcaaggtgaccttcatcgcgaaggccgagtacttcacgactcccggcatcaaggggcgtatgacggccgccttcttcaagggcgtcggtcagctgccggtggaccgctccggcgcgcgcggcgcgggcgaggcggccatcaagagcggcatcgaagtcatcgagcggggtgagctgttcggtatctacccggagggcacgcgctcgcccgacggccggctgtaccgcggcaagcccggcggtctcgcgcgcgtggcactcgccaccggcgcgcccgtcatcccggtcgccatgatcgacaccgagaagatccagccgcccgggaaggtgatgcccaagctgatgcgcccgggcatccgcatcggcaagccgctggacttcggccgctacagcggcatggagcacgaccgcttcgtgctgcgcgcggtgaccgacgaggtcatctacgagatcatgaagctctccggccaggagtacgtcgacatgtacgccacggccgcgaagcggcagatcgcggacgcggcgaaggccgagaagcaggcccagaaggacgccgaaaagcaggcgcagaaggaactcgaggcccggcaggccctggagaaggaacggtccggctcc

SEQ ID NO: 6058 - DNA, 1230 bp, Streptomyces avermitilis
  CDS (1)..(1230)
atggccaagcgggtcagagtcatgagtatgtcggtcgagcagccgctgtggcgtgcgctgaccggataccgcgtgctcacgatgttgtacgccgtcgggctcttcgcgaccgcgtacggcacgttcgaccgtccgtgggtcgccgtcgcctactacgccgtgctgtgcggctggaccctggcgaccctccccaaggtcgcgaacgcggcgagctgcaccaagcggttcctggccgccgacctcaccatcgcgctcgtcggcatcctcctcacgccgctcgccgacgcgcacgagcggatcgtcgcgggcgggccgacgctgccgtcgatatggaccgcggggtccgtcctggcgttcgcggtcaagggcggctggcgctgggcggccttcgcctcgacggcggtcgccgtcgccaacgtcttcgagcgccaggcccccgcccgggacaccgtgcacaacgtgatcctcgtgtgggtcgcctccatcgcgatcggctacgtcgtcgaagtcgcccgcgcctccgagcgcaccctcgcgcgcgccctggagatcgaggccgcgacccgcgagcgggagcggctcgcccgagacatccacgacagtgttcttcaggtcctcgcgatggtgcagcgccgcggtgccgtgctcggcggcgaggccgcggagctgggccggatggccggcgagcaggaggtggccctgcgcaccctggtcgccggcggtttactgccggcgtcgcgggtgtcggaggacgagtcccagggcgcggtcgtccgcgcggtggaggagcccgacgaggagggcccgctcgatctgcgcgcgctcctcgtgccgtacgccaccgcgaaggtcaccttctcggagcccggcgccccggtgcggctggcccacgccgccgcgaaggagctggcagcggcggtcggcgccgccctggacaacgtccgcaagcacgcgggggacagcgcccgcgcctggatcctggtcgaggacgagccggacgcggtgatcgtgacggtgcgcgacgacggcccgggcatcccggcggggcggctcgcccaggccgagggtgaggggcggctcggcgtggcccagtcgatccgtggcaggctgcgcgacatcggcggcacggccgagctgatctcggtcccgggccagggcaccgaggtcgaactgaaggtaccgaaggacccggggcacccgaaggctgcacgggggaaggcggagcgagga

SEQ ID NO: 6059 - DNA, 645 bp, Streptomyces avermitilis
  CDS (1)..(645)
atggtggtcgacgaccacccgatgtggcgcgacgcggtcgcccgcgacctggccgagtccggcttcgacgtggtcgccacggcgggcgacggcgagcaggcggtgcgccgggcgagggccgccgcgcccgacgtcctcgtcctggacctgaacctgcccgccaagccgggcgtccaggtctgcaaggagctggtcggcgccaacccggcgctgcgcgtcctcgtcctgtccgccagcggtgagcacgccgacgtcctggaggcggtgaagtccggcgccacgggatatctgctcaagtcggcgtccacggaggagctgaccgacgccgtgcgccgcacggccgtcggcgaccccgtcttcacgcccggactcgcgggcctggtcctcggcgagtaccgccgcctggcctccgagcccgccccggccaccggcgccggcgagcccagggccccgcagctcaccgaccgcgagaccgaggtgctgcggctggtcgccaagggcctgagctacaagcagatcgccgaacgcctggtcatctcgcaccgcaccgtccagaaccatgtgcagaacaccctgggcaagctccagctgcacaacagggtggagctcgtgcggtacgcgatagagcggggcctggacgaggcg

SEQ ID NO: 6060 - DNA, 1026 bp, Streptomyces avermitilis
  CDS (1)..(1026)
atgcgggtcggagtactgaccggaggcggcgactgccccgggctcaacgccgtcatccggggcgtcgtccgtaagggcgtgcaggagtacggctacgacttcgtcggcttccgggacggctggcggggaccactcgaaggcgacgccgtacggctcgacatccccgcggtgcgcggcatcctgccccgcggcggcacgatcctcggctcctcgcgcaccaaccccctcaagctcgacgacggcatccgccggatcaaggagaacctcgccaagcaggaggtcgacgcgctcatcgcgatcggcggcgaggacacgctcggcgtcgccgcacgcctcaccgacgagtacggcgtgcccgtcgtcggcgtcccgaagaccatcgacaacgacctgtcggccaccgactacacgttcggcttcgacacggccgtcggcatcgcgaccgaggccatcgaccgcctccacaccaccgccgagtcccacatgcgcgtcctcgtctgcgaggtgatgggccggcacgcgggctggatcgccatccactcgggcctggccggcggcgccaacgtcatcctcatccccgagcagcgcttcgacgtcgaccaggtgtgcgcctatgtgacctcgcggttcaaggcctcgtacgcgccgatcgtggtcgtcgccgagggcgcgatgcccaaggacggccagatggtcctcaaggacgagtccctcgactccttcggccacgtgcgcctctccggggtcggcgagtggctggccaaggagatcgagaagcgcaccggcaaggaggcccgcaccacggtcctcgggcatgtgcagcgcggcggcacgccgagcgcgttcgaccgctggctcgccacccgcttcggcctgcacgccatcgaggccgtccgcgacggcgacttcggcaagatggtcgccctgcgcggcacggacatcgtccgtgtcccgatcgcggaggccacggcgaagctgaagacggtcgatccgaagctgtacgaggaggtcggggtcttcttcggc

SEQ ID NO: 6061 - DNA, 1983 bp, Streptomyces avermitilis
  CDS (1)..(1983)
atgatcacgaatgatcacgagggaagaggaacgatggatctgacccgactcctgcacgaggaccgcccgttcgccctgctgcgccgccgcacgccggggcgctccaccgaggacagcgcgacggtggaggtgctgctcggccccgtcgccacctacgagcgtctcgccgacctccccgacgagggcctcgcgctcattcccttccgccagatccgcgagcgcggcttcgacgtccgcgacgacggcaccccgctgctggtgctgacgcccgaggagagccacgaaatcccgctggagcaggcgctgtcccagttgcccacgcatgacgtgcgggtcgaggacggcggcttcgacgtcgccgacgacgagtacgcggagatcgtcgggcgggtgctgcgcgaggagatcggacgcggcgagggcgcgaacttcgtgatccggcgtacgtacgagggcgagatcccgggattcggaagggccgacgtgctcgcgctgttccggcggctgctggtcggcgagcagggcgcgtactggaccttcgtcgtgcacaccggaacggggaaggggcccgcagggtcttccccggaagggcgggagacgggtgggcgcacgctggtcggggcgagccccgaggtgcatgtgcggatgtccggcgggacggtcgtgatgaacccgatcagcgggacgtaccgctatcccgccgaggggccgacgcccgaggacctcctggacttcctcgcggacggcaaggagatcgaggagctctcgatggtcgtcgacgaggagctcaagatgatgtgcacggtcggcgacatgggcggggtggtcgtcgggccccggctgaaggagatggcccatctggcgcacaccgagtacgagttgcggggccgttcgtcgctggatgtgcgggacgtcctgcgcgagaccatgttcgcggccaccgtcaccgggtcgccggtacagaacgcctgccgggtcatcgagcggtacgagcccctcgggcgggacggtgtcgggcgcgggtactacgcgggcgcgctggcgctgatcggccgggacgcgggcggggcgcagaccctcgactcccccatcctcatccggaccgccgacatcgacgcggacggccggctgcgggtgccggtgggcgccacgctcgtacgggggtcggatccggcgggcgaggtcgccgagacgcacgcgaaggcggccggggtgctggcggccctcggggtccgtccggcccggccgcggcaggagggcgtacggccgaggctggccgacgatccgcgggtgcgggcggcgctcgacggacggcgggcctcgctcgcgccgttctggctgcggatgcaggagcggacggacgcgctcaccgggcacgcgctcgtcgtggacgccgaggacaccttcacggcgatgctggcgcatgtgctgcgctcgagcgggctggaggtgaccgtgcggcgctacgacgagccggggctgcgaaaggcggtgctcgcgcacgaggggccgctggttctggggccaggacccggcgatccgaacgacccggccgaccccaagatgcggttcctgcgcgcgctcaccgccgaggtgctccgcggtcaccgccacggggtgctcggcgtctgcctcggccatgagctgatcgcggccgagctgggcctggagatcgtgcgcaaggaggtcccgtatcagggtgcgcagaccgggatcgacctgttcgggcgtaccgagaccgtcggcttctacaacagcttcgtggcgcactgcgacgacgagacggcgctggagctggcggcccatgacgtggaggtcagccgcagcggcacgggggaggtgcacgcgatgcgcggacccggcttcgcgggcatccagttccacccggagtcggtgctgtcggtcaacggcaccgcggtcgtacgggacctgctggatcagctccgcggtgccgacacgttcttcgagcggcggcccgcggtg

SEQ ID NO: 6062 - DNA, 1263 bp, Streptomyces avermitilis
  CDS (1)..(1263)
gtgtacacgacctggactccacgacgacggcgcgccgcacggccgctcacggcgctggtcgccgccacggcgctcggcgcgggcacgctgggcgccgcccaggccgccccgcggtcttccgacgacaccatccgcgtgacctaccggggctacgagttcgccgtccccgccggctgggacgtcatcgacctcgacaaggacccgggggcctgcgtccgcttcgaccagcacgccgtctatctcggcaccccgggcgaccggcaggactgcccggcgcgggcgaaggggcgcaccgaggcactgctggtgcagccggccgaggcggccacggccgaggtgaccgagaaccgcacggcgggcacctaccgggccgtcgcggaccagatcgcggtgaccgccgcgtacggacaggaccgtgagcagatccaggagatcctccggggtgccggcctgcccgtcgcctccgcacgggccgagtcgggcgccgaggtgccggccgcgccggccgtccccgacgacgccacaaccttcaagggcaagggcttcgacgcctgcaccgccccgagccaggcctccatggacgcctggaagggcacgtccgggtacggcgccatcggcgtctacgtcggcggcgtcaaccgtgcctgcgcccagccgaagctcaccgccaaatgggtgcagacccagtacgcgaacggctggcggttcttcccgctgtacgtcggccggcagccctcggccgacggcggcagctgcctgggcggctgcgcctcgatcaccgacccggagccgcagggcaaggacgccgcggacgacgcggtgcggcaggcggccgctgtcgggttcggccccgggtcggtgatctacaacgacctggagcactacgcgggcgggaccgccgtgaccacccgggtgctcacctacctcgaatcctggaccacgcgcctgcacgagctgggctaccgctccggcgcgtacggcagtgtctcgtcgctcatcaccgacctggtgaagcacgccgacgacaggacgctgcccgacgtgatccacttcgcccactggaacgacgaggcgaccaccaccgacccggtcctccccgccgatctgtgggccgatcaccagcgcatccaccagtacgcgggcaaccgcaccgagacccacggcggcgtgaagatcagcatcgaccgcaacaagctcgacgtgggctccgggaccgggaaacggtcgtcgatcgagcgcggtccgtctcaattgatgagcagg

SEQ ID NO: 6063 - DNA, 1350 bp, Streptomyces avermitilis
  CDS (1)..(1350)
gtgaccgtgaacgctaagtccagcgcgagcgctggcaacacctggcgagacctgcccgcggcgcagcagcccgagtaccccgatgccgaggctctgcgcgatgtgatcgcggacctcgagtcgtatccgccgctcgtcttcgcgggcgagtgcgaccagctgcgcgcccggttggcgtccgtcgccaagggagaggcgttcctcctccagggcggcgactgcgccgaggccttcgacggcgtgtccgccgaccacatccgcaacaagctcaagaccctgctccagatgggcgccgtgctcacgtacgccgcctcggtgccggtcgtgaaggtcggccgcatcgccggccagtactcgaagccccgctccaaggggaccgagacccgcgacggcgtgaccctgccgacgtaccgcggtgactcggtcaacggcttcgacttcaacgagaaggcccgcatcccggaccccgagcgcctgaagcggatgtacaacgcctccgcctcgacgctcaacctggtgcgcgccttcaccaccggcggctacgccgacctgcgccaggtgcacgcctggaaccaggacttcgtgaagtcgtcgccgtccggccagcgctacgagcagctggcgcgcgagatcgacaacgcgctgaacttcatgcgggcctgcggcaccgacccggaggagttcaagaccgtcgagttctacgcctcccacgaggcgctgctcctcgactacgagtcggcgctgacccgcgtggactcgcgcacgggcaagctgtacgacgtctcgggccacatggtgtggatcggtgagcgcacccggcagctggacggcgcgcacatcgagttcgcctcgaagatccgcaacccgatcggcatcaagctgggtccgacgacgacggccgaggacgcgctccagtacatcgagcgcctcgacccggaccgcgagccgggccggctcaccttcatcgtgcgcatgggcgcggacaaggtccgcgacaagctgcccgagctggtcgagaaggtcaccgcctccggtgcgaccgtggcctgggtgaccgacccgatgcacggcaacaccttcgaggcggcctcgggtcacaagacccgccgcttcgacgacgtgctcgacgaggtcaagggcttcttcgaggtccacaagggcctgggcacccacccgggcggcatccacgtcgagctcaccggtgacgatgtcaccgagtgcgtgggcggcggcgacgagatcttcgtcgacgatctgcaccagcgctacgagacggcctgcgacccgcggctgaaccgcagccagtcgctcgacctggcgttcctggtcgccgagatgtaccgggaccag

SEQ ID NO: 6064 - DNA, 261 bp, Streptomyces avermitilis
  CDS (1)..(261)
gtgaaccgcgtgtacgtctgcagctgtttcggagtgaccgaagcgcaggtgaagaagcacgcggacggcggtgcctgcaccccccggcagatagcctcggcctgcaaggcgggcacggactgcggcggctgtgtgcgtcgtatccaggagatcctgggacggggtgcgtgtccgcgccgcgagccggcggaccgggcgcagccgctgttcgcccgggccgagaaggcggacgagcgggtcgaggtactggacgaggccgcc

SEQ ID NO: 6065 - DNA, 477 bp, Streptomyces avermitilis
  CDS (1)..(477)
atgcagggcgaccccgaggtcatcgaattcctcaacgagcagctgaccgccgagctgaccgcgatcaaccagtacttcctgcacgcgaagatgcaggagaacttcggctggacgaagctcgcccagtacacgcggcgcgagtcgttcgacgagatgaagcacgcggaagtgctcaccgatcgcatcctcttcctggacggcctgccgaactaccagcgactgttccacgtccgggtcggacagacggtcaccgagatgttccaggcggaccggcagatcgaggtcgaggcgatcgaccggctcaggcgcggggtcgaggtgatgcgcgccaagggggacatcacgtccgcgaacatcttcgagtcgatcctcgaggacgaggagcaccacatcgactacctggacacccagctggagctggtggaaaagctcggcgaagcgctctacatcgcccaggtgatcgagcagccggagagc

SEQ ID NO: 6066 - DNA, 630 bp, Streptomyces avermitilis
  CDS (1)..(630)
atgggtcagccggtggagcgagaatctggagaagccgcacagtcggagcttccgccgggccagcgactgcagcgcggctggccggtcacgcactacgggcccgtacccaagttccgtcccgagcgctgggaattcagggtcttcggagccaccgccgacggcgagaagcactgctggacccacgaggagttcacggctctgccgtatgcctcggtcgtgtccgatctgcactgcgtgaccaagttcagcatgctcggtgccgaatggggtggcataccggctcgtacgatcctggagatcgccccgcccgccccgaccgtcacccacgtcatggtctgggccgaatacgggttcagttccaacctgcggctggcggacttcgcctccgaccgcacgatcttcgccacccacaaggacggcgagctgctgacggcggagcacggcttcccgcttcgtctcgtcgtaccgcatctgtacgcctggaaggggcccaagtgggtccggggcgtggagtacatgacggccgaccggcgcggtttctgggaggagcgcggctaccacaacgtgggtgacccgtggcgggagcagcgctactcctaccaggaagagcccggggaaggccccgagctc

SEQ ID NO: 6067 - DNA, 594 bp, Streptomyces avermitilis
  CDS (1)..(594)
atgggaatacccctggggggtatgacgttgcccatcggtacaggcaccaccactcactcgacgtcgggggctttcatgcggcacgacgcacacgccggacaccacggacacgccgagcccgtcggccacgaggcgcacccgcccgcccacagccccgggaaggtcggctgggccatggccgcccaggccacgctccactgcctcaccggctgcgccatcggcgaggtgctcggcatggtggtcggcaccgcgctcggctggggcaacgtgccgacgacgatcctggcgatcgtgctcgccttcttcttcggctactcgctcacgttgcgcggagtgctgaaggccggtgtcggcttccggaccgccttgcgggtcgcgctcgccgcggacaccctgtccatcgccgtgatggagctgatcgacaacggcgtgatcgcgctctggccggccgcgatggacgcccacctcgacgacgtgctgttctggggctcactggccctctcgctggtcgccgcgttcgtgatcaccgtgcccgtcaaccgatggatgatcggccgcggcaagggccacgcggtggtgcaccagtaccaccac

SEQ ID NO: 6068 - DNA, 930 bp, Streptomyces avermitilis
  CDS (1)..(930)
gtgaacaatcagcagtcccgcggcgccctcggcacgtccggcgccacccccgacctgcccgacgccacccccggtctctcccgcaaccccgtcggcggccacgtcccggtggccggtggcctccactccgtcggtctggcctacgcccgcgacctcgcggccgaggccgtgcaggtcttcgtcgccaacccgcgcggctgggcgacgcccgccggcaatccgcggcaggacgaggagttccgcgcggcctgtgccgccgagtcgatccccgcgtacgtccatgccccgtatctgatcaacttcggctcgcacaccgaggcgaccgtggagaagtccgtggagtcgctgcggcactcgctgcgcagggggcgcgagatcggcgccctgggcgtggtggtgcacaccgggagcgccaccggcggacgggagcggtccgtcgccctcgcccaggtgcgggagcatctgctgcccctgctcgacgagctgacccacgacgacgacccgtatctgctcctggagtcgaccgcgggtcagggcgcctccctgtgctcccggacctgggacttcgggccgtacttcgaggcgctggacgcccacccgaagctgggcgtgtgcctggacacgtgtcacatcttcgcggcgggccatgacctcaccgggccgagcgggatgcaccagacgctcgatctgctggtcgacacggtcggcgaggggcgtctcaagctgatccacgccaacgactccaaggacgtcgtcggcgcgcacaaggaccgccacgagaacatcggctccggccacataggcgaggacccgttccgcgctctgatgacccacccggccaccgagggcgtccctctgatcatcgagacgcccggcggaaaggagggccacgcggcggacgtggagcagctcaagaagctccgcgacggc

SEQ ID NO: 6069 - DNA, 1944 bp, Streptomyces avermitilis
  CDS (1)..(1944)
gtggcggctcgtagactcacctgcgtggatacgacccttcaggaccccctcctcgggcaggtgctcgacggccgctaccgcgtcgacgctcggatcgcggtcggtgggatggccacggtctaccgggccgtggacacccgcctggaccgtgtgctcgccctcaaggtgatgcatccgacactggccgccgacggctcgttcgtcgagcgtttcatccgcgaggccaagtcggtggcgcggctcgcgcaccccaatgtggtgcaggtcttcgaccagggcgcggacgggtcgtacgtctatctcgccatggagtacgtggccggctgcaccctgcgcgatgtgctgcgcgaccggggggcgctgcagccgcgggccgcgctcgacatcctggagccggtgctcgccgcgctcggcgccgcgcaccgcgccgggttcgtgcaccgcgacatgaagccggagaacgtcctgataggggacgacggccgggtcaaggtggccgacttcgggctcgtacgggctgtggacaccgtcacgaacaccacgggctccgtgctcggcaccgtgtcgtatctcgcgccggagcagatagagcacggcacggcggacacccgcgtcgacgtgtacgcgtgcggtgtcgtcctctacgagatgctcacgggcggcaagccgcacgccggggactccccggcccagatcctctaccagcatctgcacgaggacgtgccgccgccgtcggccgccgtgccggggctccccgcgacgctggacgagctggtctcctcggcggccgcccgcaaccccgggctgcgcccgcccgacgcggtggcgctgctcgcccaggtcctggaggcacgggcggcgctcagcaccgagcagctcgacgccgtaccgccgcaggccatagccacgcagcacggcggcgccgaggaccgtacgagtgtgattccgcgttcgctgacggtgccgcggccgctgcccgtcaacgaggacgagcagatcaaccggacgagccggttcgagtccccgcccgtttctccgcggcggcgctccgggcgcccccggcgcgggccgctcgtgatcgtcgcggccgtgctgctggtgctcggcctgggagcgggcgtctggtacatcaactccggccagttcaccaaggtcccgccggtgctcgcgaagacgcaggtcgaggccacggcgcagctggagaaggccgggctcgacgtcaagcaggtcagacacgactacagcgacacggtgaagcgcggcacggtcatcaggagcgacccgaagccgggcgcccggatccgggacaacgactccgtgacgctgaccatttccgacggcccgaggaccgtgaaggtgcccgatctcgcgggcctcccgctgagcaaggccagggcggagctcaaggcggacggcctggctccgggcatggtctcgcgcgccgtcagcgacgacgtccccaagggctccgtgatcagcacggacccggccgcgggcaccgagcggcgcgggggttcggccatcgcgttcaccgtcagcaagggcagtccggtggaggtgcccgaggtcacgggcgagtccgtggacgacgccaccgcggacctggaggacgccggcctcaaggtgcggatctcctcgcagcgggtcacgtcggcggagttcgagaagggccaggtcgtggagcagtcgccgggcgcggacgacgacaaggtcgccgagggcgacacggtgacgctcacgatctccaagggaccggagatggtcgaggtcccggacgtcgtcggcgacagcgtcgccgacgcccagcagacgctggaggacgccggcttcgaggtcgacaaggaccggggtctgctcgggttcttcggggacgaggtcaaggaccagtcggtggagggcggcgagaaggcgcccaaggggtcgacgatcacgatcaagatccgc

SEQ ID NO: 6070 - DNA, 792 bp, Streptomyces avermitilis
  CDS (1)..(792)
atggctgacgatcccttcgtcctcggcgatacgccgttctcgtcccggctgatcatggggacgggcggggcgcccagcctcgacatcctggagcgggcgctcgtggcgtccggcacggagttgacgacggtcgcgatgcggcgcgtcgacgcgggcgtccacggctccgtgctgtccgtgctcgaccggctcggcatccgggtgctgcccaacacggccggctgtttcaccgcgggcgaggccgtgctgaccgcgcgcctggcccgcgaggcgctcggcaccgacctgatcaagctggaggtcatcgccgacgagcgcaccctgctgcccgatccgatcgagctgctcgacgccgccgagaccctggtcgacgacggcttcaccgtgctgccgtacaccaacgacgaccccgtcctcgcgcgcaagctggaggacgtcggctgcgcggcggtcatgccgctcggctcgcccatcggctccgggctcggcatccgcaacccgcacaacttccagctgatcgtggagcacgcgcgcgtgccggtgatcctggacgcgggggcgggtacggcgtcggacgtggcgctggcgatggagctgggctgcgcgggtgtgatgctcgcctcggccgtgacgcgggcgcaggaaccggtgctgatggccgagggcatgcggcacgcggtggacgcgggccggctcgcgtaccgcgcgggacgcatcccacgccgccatttcgccgaggcgtcgtccccgccggaggggcgcgcacacctggatcccgagcgccccgcgttc

SEQ ID NO: 6071 - DNA, 198 bp, Streptomyces avermitilis
  CDS (1)..(198)
atgaacatctcggtcaacggcgagcgccggcggatcgcgccgggcaccgcgctcgacaccctcgtgaagacactcaccgcggctccctccggcgtggccgccgccctcaacgaaaccgtcgtcccgcgcgcgcagtggtcctccacggccctctccgagggggaccgcgtcgaagtcctcaccgccgtgcaaggaggc

SEQ ID NO: 6072 - DNA, 1164 bp, Streptomyces avermitilis
  CDS (1)..(1164)
atgtcgcctacacatacctccgacgtcctcgtcgtggggggcggaatcatcggtctggtgaccgcctggcgcgccgcgcagcgcgggttcgccacggctgtggtggaccccgaccccggtggcggggccgcccaggtggccgccgggatgctcgctgcggtcaccgagctgcactacggcgagcagaccctgctggggctcaaccttgcctccgcgcgccgctatccggacttcgccgccgagctcaccgaggcgaccgggcacgatctcggctaccgccggtgcggcacgctcgccgtcgcgctcgacgccgacgaccgtgcccagctgcgcgaactgcatgccctgcaacgccggtcggggctcgagtcggagtggctgaacggccgcgagtgccgccgtctcgagccgatgctcgcgcccggcgtacgcggggggctcagagtcgacggcgatcaccagatcgatccgcgccggctcgccaaggcgctggtggtggcctgcgagcgcgccggggtggtcttccaccgggtgtgggccgagcgcctgttcctggtgcggggccgggccgccggggtcgtgaccagggacggcgccgagctggccgcgggccagatcgtgctcgccgggggcagcctcagcgggcagctcgcgggcgtccccgacgacgtactgccgcccgtccgcccggtgaagggacaggtgctgcggctgaccgtgccgaagcggtacgcaccgttcctgagccgtaccgtgcgcgccgtcgtccgcggcagccagatctatctggtgccgcgcgagagtggcgagctggtcgtcggcgcgaccagtgaggagctgggctgggacaccacggtgaccgcgggcggggtgtacgagctgctgcgcgacgcgcacgagctggtgccggggatcaccgaactgccgctcaccgagacccgcgcgggactgcgccccggctcgccggacaacgcgccgctgctcggccccaccgagctggacgggctgctgctggccaccggccacttccgcaacggcgtcctgctcacccccgtcaccggagacgccatggcgcatgtcctgaccaccggcgagcttcccgacgaggcccgccccttcacccccaggcgtttcagcaccgccgtactcacggagcagtccgca

SEQ ID NO: 6073 - DNA, 381 bp, Streptomyces avermitilis
  CDS (1)..(381)
gtgccgtttgcctcagtaagggagcctcctgccatggcccgttcgctcgacggactcgtcctcgccccggtcacggaccaggcgccgggtcaggtgggtacccgtacccggttcacgtaccacgagaaggacggcgagatctgggccgagtacgcgggcggcgatgtcgtacgcggccacctcgtgggcaggcgtgaaggggaccgcctggacttccggtacgtgcagctgaagcacgacgggaccacatcgtccgggcactgcgtctccacggtgatcgagctggcggacggccgtgtgcgtcttcaggagacctgggagtgggagtcgcagccgggcaacgggacgagtgttgtggagcaggtcactgagcacgccccc

SEQ ID NO: 6074 - DNA, 1227 bp, Streptomyces avermitilis
  CDS (1)..(1227)
gtgagcgagcagacgcaggaacgaggccgtacggcagcgcggcgtgtcgtcgtcgtgggcgcgggcatggccggggtgcagaccgcggtcgccctgcgggagcagggcttcacgggcggagtgacgctgatcggcgcggaaccccatcagccgtacgaccggccgccgctgtccaaggccgtgctgctcggcaaggccgagggctccgccttcgacgtcgacttcgaggcgctcggcatcgagctccagctcggccgcgaggcgctcggcctgcgcccggaggaccacgaactcgacacggactcgggccccgtcccgtacgacgtcctggtcgccgccaccggtgcggaaccgatccagctgccgggcgccgagggcgtcccgggcgtgcatctgctgcgcaccctggacgacgccgagcggctgcgtcccgtcctcgcccagcagcacgacatcgtggtcgtcggggccggctggatcggcgccgagttcgccacggccgcgcgcgaggcaggctgcgcggtcacggtcgtcgaggccgcggaccggccgctcgcgggggcgctgcccgccgaggtggccgcgccgatgacggcctggtacggcgacagcggggcgcggcttctcacccacgcgcgcgtggagcgcatcgagccgggcgcggtggtgctcgacaacggctcgcgggtgcccgcgggcgccgtcgtcgtcggcatcggcgcccgtcccgccacggcctggctcgtcggctccgggatcgcgctcggcgcccaccaggaggtcctcgccgacaaccacctgcgcacctccctgccggatgtgtacgcggtcggcgactgcgcctccttcccgtcgggacgctacgaggcgcgcctgctcgtccatcactgggacaacgccttgcagggcccgcggacggtggccgcgaacatcatcggggaggccccggcggcgtacgacccggtcccgtacttctggtcggagcagttcggccggttcgtccagtacgtgggccaccacgcgaccgccgacgcgacggtgtggcgcggggacccggagggggccgcctggacggtgtgctggctgcgtgaggggcgcctggtcgcccttctggcggtgggccgtccgagggacctggcccagggccggaagctgatcgagtcgggcgcccccatgaacccggagctgctggcggacgcgtcgcgcccgctgaaggcggcggtcgtg

SEQ ID NO: 6075 - DNA, 363 bp, Streptomyces avermitilis
  CDS (1)..(363)
gtgaccgagattgacgcaaagattgatgctctcgtccccgcctggctcaccctccccgacatcgccgaacagttcggcgtcgaggtgacgcgtgtccggcagctggtcaaggagggccaggtgatcgccgtacgccgtggtgagaaccgcgcgctgcacgtccccgccgctttcatcgacggggacaaggtcgtcaagggcctgaccggcaccctgacgctcctgcgggacgacggcttctccgacgaagagatgatcgagtggctcttcacgcccgacgagagcctgcccggtacccccgcgcaggctctgagcgagaatcgtgggacggaggtgaagcgccgcgcccaggcgctcgccgtc

SEQ ID NO: 6076 - DNA, 675 bp, Streptomyces avermitilis
  CDS (1)..(675)
gtgagccaccgacaacgggggaactccaccatgcccgacaccgcccgcgaccggctcgccgacgcccgcgtctatctgtgcacggacgcccgcaggcgccagggtgacctcgccgagttcctcgacgcggccctggccggcggcgtcgacatcgtgcagctgcgcgacaagggcatggaggcggccgaggagctggagcacctccaggtcttcgcggacgcctgtcgccgccacggcaagctcctcgcggtcaacgaccgggcggacgtcgcgcacgccgtcgactccgacgtgctccacctggggcagggcgacctccccgtcccggcggcccgggcgatcctcggcgccgacgtcctcatcggccgctccacgcatgccgaggccgaggccgaggccgccgccgtccaggagggcgtggactacttctgtacgggtccctgctggcccacccccaccaagcccggccggcacgccccgggcctcgacctggtccgccacacggccgccctgggcaccgaccgcccctggttcgccatcggcggcatcgacctcggcaatctcgacgaggttctcgaagcgggcgcccgccgtgtcgtcgtcgtgcgcgcgatcaccgaggcggacgacccgaaggcggcggcggaggagttcgcgaagcggctccgtcacgcc

SEQ ID NO: 6077 - DNA, 921 bp, Streptomyces avermitilis
  CDS (1)..(921)
atggccctcggaaccgcatccaccaggactgatcgcgcacgcactgtgcgtgacatgctcgcgtccggcaagaccacgtactcgttcgagttctcggcgccgaagacccccaagggcgagcggaacctgtggagcgcgctcaggagggtcgaggcggtcgcccccgacttcgtctccgtgacctacggggccggcggttccacccgcgcgggcacggtcaaggagaccgagcagatcgtcgccgacacgacgctcaccccggtcgcgcacctgaccgcggtcaaccactccatcgcggagctgcgcaacatcatcggccagtacgcggacgccgggatccgcaacatgctcgccgtgcgcggcgacccgcccggcgacccgatgggcgagtgggtgccgcacccgagggggctgacgtacgcggccgaactggtgcgtctcatcaaggagtcgggcgacttctgcgtgggagtcgcggccttccccgaaatgcatccgcgctccgccgactgggaagccgacgtcgagcgcttcgtcgacaagtgccgggccggcgccgactacgcgatcacccagatgttcttccaccccgagtcgtatctgcggctgcgtgaccgcgtcgccgcggccggctgcgagaccccggtgatccccgagatcatgccggtgacgagtgtgaagatgctggaacggctgccacagctcagcaacgccgcgatcccgtccgttctgcaagagcggatcctcacagccaaagacgatccggcggctgtacgctccattggcatcgagttcgccacggagttctgcgcgaggttgctggccgagggagtccccggacttcacttcattacgctgaacaactccaccgcgacgctggagatctacgaaaatctgggactgcaccacccacagcaggcc

SEQ ID NO: 6078 - DNA, 915 bp, Streptomyces avermitilis
  CDS (1)..(915)
atgggctggacggtcctctacatcgcgttcggcatcgtcgcgctgtggctgctgggcgaggtgctgctgcagtacaaggcgcggctgcgctggcggctgctcgccttcggcggcttcctcggcgtggtgctcggtgtgctgatcccctccgtcatcgtcatcggcctgggcgctgccgcgttcgcggtcggacagacgtacgtcacgctttccttccgccgcggcttcgcggccggctgggccgtcggcaaccgcccgcgcgagagcggcggcagcaagcgccgccggggcgaggcagcgcgtcaggagccgacgctggaggtcaccgacctacagccgacggctgccggaacgtaccgccgggaggaggcgtacgacccggaccacgacgatgtgttcacccgcccgcagcccgccgaggccgcggccgagagcaccgccgtgtacgagccccagcccctgcccgacgacaccggttcgtacggcgtctacagcgacgccgcgtacgcggccgcgacggacccgtcctacgcggccgcggcccagacgccggaccagaacttcgcgtacgacggctacgcgggctacgaccagcagcagtacggctacgacaacggccagcagcagtacgccgcctactccgacccgtacatcggcacgcagacctacggcggcggctcctacgacgcctcgtacggcggccagcagcagtacggtcagcaggcgtacggccaggattcctacgccaccggcacctatggcggcgagactccgccgggtggcgtctgggtgccgcagcagcgcaccaccgacgacgcgtacggcggcgaactcccgcccgagcagccgtatccgtaccaggggaacggtggcggggacggcaacgcgcacgggtacgacgagcagtaccggttc

SEQ ID NO: 6079 - DNA, 1491 bp, Streptomyces avermitilis
  CDS (1)..(1491)
atggcacggattgcggtgatcggcgccgggatgggcgcgatggcggctgccgcccggctggccgtcgcgggccaccgggtggcggtgtacgagcgcgcggcgacgtacggcggagcggtgggccgcttcgcacgcgacggcttccgcttcgacacgggcccggggctgctgccgctgcccgcggtccaccgcgacctgttcgtcaagaccggcaaggagccgctggaggcgtgcgtcgagctggtccaggtggatccgtcgtcgcggcatgtcttcgcggacggcaccgcggcctcgctgccgaacgcctcacgcgcgggagtcgtcaccgcgctcgacgaggccctcggagcgggcgccggcggacgctggggcgacttcctggtccgggcccgcgaggcctgggaccggacgcgccgaccgctcctggaagagcccctgtggccgaactgggaggtgctggccgagcgcgacccctatccggcggtgccgcacaagcggctgctgcgcacccggcgggcgggcaccctcgcggacatcggcgcctgggagctgcgcgaccccaggctcgcctcgctcctggagagccacgcgctggcctacggcctggacccccgggtcaccccggcgagcgcggcggtgctgccgtacatggagcacgccttcggcacctggtacgtccgcggcgggatacgggagttggcccgcgcggtccacgagcgctgcctggcccggaaggtcgagttcgtcttcggcgcggaggtcaccgggatcgtcgagaaggacggccgggcggcagggctggagctggccgacgggacggtcgcggaggcggaccatgtggtggcgggcgtcgcacccggcgtcctggaccgcctcaccgccgggagggcggtgcggggtgacggcgatgtcggaccgcggcgcggggtgccgagccggctgacggtgctgctggcgctgcgcggcacacgccccgagggcaccgcgcaccggacggtcgtccacaccaccgaccggcagggcgagttggaccggctcttcggcgagcccgcgggactcccggcgacgcccacgctgaccgtgctgcgccccgacgaccccgggctggttcccgacggtgggcacgaggcggtcaccctgaccctcccggcgccctcgggtctgcgcgtgaccgagtccgacgtggaccggatcctgggggtcgccgagcgcgcgatacccgacctgcgcgaccgcctcctctggcacgagacccgtacgccggacgacatcgcgcaggccaccggtgcgcccggcggcgcgatcccggcgccggccctcgccgcggcggacggccgtctgctgcacccggcgaacaccacacgtatgcccgggctgttcaccgtgggcggctggtcccaccccggcggcggcctcccccacgcgggcatgtcgggcgcgctggtggccggactgatcgtggagggaccggacttccggggctcacag

SEQ ID NO: 6080 - DNA, 651 bp, Streptomyces avermitilis
  CDS (1)..(651)
atgcccaggccgtgctgttgccgactggttacgatcgcgtccgtgtccgtactccccctggtcttcaccagcggctgggccagcggcatcaacgcctacgcggtggtgctgctcctcggcgtcttcggtgcgaccggtctgagcgacgacgtccccgagtcccttcagcgccctgaggtcctgatcaccgccggggttctgttcctgtgcgaggcggtcgccgacaagatcccgtacgtggactcggcatgggacgcggcgcacaccgtgatccggccggccgccggggcctgggtgggcgcgctgctcgccgggcagagcggctcgctctccgatgtggcggcgggcgcgatcggcgggtcgaccgcgctggcgagccatgccgtcaaggccgggacccgcatggcgatcaacgcctcgcccgagccgttcagcaacgtgatcatgagcgtggccgaggatctcggggtcggcgggatcgtcacgttcgcgatgttccatccggaggcggccgccgtcatcgccggagtgctgctgctcctcgggctgctgacgctgttcttcctcgtctcgcggatcagacggttcctaaggcgcagggcccagcgacgggaggagagacggctggcgcggcggctgggaccgcccggc

SEQ ID NO: 6081 - DNA, 681 bp, Streptomyces avermitilis
  CDS (1)..(681)
gtgaccgtgcgagcgactgttcctgtgacaatcaacgccatggacagcagcaagaccaagcacggcggcaccgccacggcgggcggcggccgtcgcgaggcgacccggcagaagctctacgaggcggccgtcaccctcatcgcggagcaggggttctccgccaccacggtggacgagatcgccgagcgcgccggagtcgcgaagggcacggtctactacaacttcgcaagcaagtccgtcctcttcgaggagttgctgcggcacggcgtgggactcctcaccgcctccctccgcgaggcggcggagaagaccgcgcgtgagggcggcagcaaggtcgacgccctcgacgcgatgatccgggccggactcgtcttcatcgaccgctacccggccttcacccagctgtacgtggccgagctgtggcgtaccaaccgggcatggcagtccaccctgatggtggtcaggcaggaggccgtcgcggtcgtcgaggacgtgctgcgcgagggcgtggcgggcggcgagctcagcgacgagatcgacatccagctgacggcggccgccctggtcggcatggtcctggtggccgccctggactggcagtccttccagccggaacgctccttggacgatgtccacgcggcactgtcccggctgctccagggccgcgtcagcggcagccgc

SEQ ID NO: 6082 - DNA, 2082 bp, Streptomyces avermitilis
  CDS (1)..(2082)
atgcgctccccgaagctggccgcgcttgagctcaggcgcttcggcaggggcaagctgccccgcgccgcgctggccgcgctcatgctgctgcccctgctgtacggcgctctctacttgtggtcgttctgggatccgtacggccggctcgaccgcatccccgtggcgctcgtgaacgacgaccagggggcgaccgccgccggcaagaaggtcaccgcgggcgacgacatcaccaagggactgcgcgagagcgagaccttccagtggcacgaggtgagcgccgcggaggccaggaagggcgtggaggacgggacgtactacctgtcgctgaccatgccgtccgacttcagcaagcggatcgcctccagctccggggactcccccgagacgggcgctctccaggtgcgcacgaacgacgcgaacaactacatcgtcgggcagatctcgcggacggtgttcagcgaggtgcgcacggccgcgtccacgaaggcgtcccgctcgttcctcgacaagatcttcatctccttctcggacatccacggggagaccgagaaggcggcgaagggcgccgacaagctcaccggggggatcggcaaggccaagaagggctccaaggacctcgccgacggcctgaaggacgccaaggcgggcagcgggaagctgtcgagcggcctcaagaagctcgacacgggcgcgggtgacctccaggacggtgcacgccaggtcgcgggcggcacgcaggcgctggccgacaaggtcggcggcgcggcggaccaggtgcggcccttcttgaagaacaacggccggacgatcgccgacaccgcgaccacggtggccgattccgcgggcgtcatccgcaagcacctcgacgccttcgtcaccaccgccccgctggcagagagcggtacccgtaaagcgtccgagacgctgaacggcgtctacgaaaggcgctgcgagaaccagctcgtgcccgacccggcgtgcgacgacctcaagaaggcgaaggacgccgcggcggacgcggcgcggctcaccgcggacgtgaacacggtggtgcaggactaccacggcgacatgaccgccctcgaaaaggacctggtgacccttcagcgccaggccagggccctcgccaaggcggcaccgcatctctccgaggacctcgacgacgccgtcaccaaggtcgacgccctcaacaagggggccgccaaggtcgccaagggcgccggaacactgcacaccgggctcggcacggccaagaccggtgcggcggacctcgacacgggcgtcggcaagctgcagacgggcgcgaccgacctcaccgggggcatgtacaagctcgtcgacggctccgggaagctcgccggcggcctgcacgacggcgccgaccagatccccgactacgacaagcaggaccgcgacgcacgcacccaggtcatggccgaccccgtgcagctcgcctccagggacctgcacaacgcgcccaactacggcaccggcttcgccccgtacttcatcccgctctccctgtgggtgggcgcgatggtggcgtacatgctgatccagccgctcaaccggcgcgcgctcgcggcgggctcctcggcctggcggatcgccctcgcgggctggctgccggtggccgccgtgggcgtgctgcagaccgcggccctcatgtcggtgctgcactgggcgatcggcctggagatggcgcgggcggccgggacggtgggcttcctgttcctggtgacggcgtgcttcgcggcgatcgtgcagtggctgaacgcgcgcttcggagcggcgggccggatcctcgtcctcgccctcctgatgctccagctgacgtccgcgggcggcacctaccccgtgcagaccagtccgggcttcttcaacgcgctccaccccttcctgccgatgagttacgtcgtcgaggccctgcgcaggctcatctccggtggcggtctgggtcccgtctggcaggcgtgcgccgtgctggtggccttcaccgcgggcgccctcgcgctcaccgccctgtccgcgcgccgcaagcaggtgtggaccctcgaccggctgcacccggagctgagcctg

SEQ ID NO: 6083 - DNA, 1020 bp, Streptomyces avermitilis
  CDS (1)..(1020)
atggcggatcaaagggggcatggagggtacgtggccggggacgtgacgggggacgtggaagggggcgtggagggggacatgcgggagaacaggccggcagacacccagcgggacacgcaggcggacgcagacgcggacgcacgaacggacacacaggcggacacacaggcggacacacaaggcggcctcgacgggccaagggcacccgtcgggatcgccgtcggcgccgagaacttcgggctgaaggggccgcgcggctgggccttccgcggcgtcggcttcgacgccgcgcccggttcgctgatcgccgtcgaggggccctccgggtccggccggacctgcctgctgctggcgctcaccggacgcatgaagcccaccgaggggcacgccacggtcggctccctccgactgccgaagcagatgtcggccgtacgcctgatcagcgcgccggcccatgtccccggcgtcaccgacctcgatccggccctgaccgtcggggagcacctcggcgaacgggcgttgctggagcgacgctacggcggttcgctgcgcgggctgctgcggccgcgtgcggagcgcacgacggaggcgaagctgcggatcgacaccgcgctggccgccgccggactcgaccgggaggcgctgcccaagggctcccggaccgccgtacgcgacttggaacgccttcaggccctgcggctgtccatcgctctcgccctgatcggccgcccgcgcctgctggccgtcgacgacaccgacctcaagctctcggacgccgaacgggccgaggtctggaccctgctgacctcgctcaccgagtccgggaccacggtcgtggcggtgtgcagcgaagccccggcgggtgccgtcgtggtgtccacccggcaggccgccgagcccacccacgggacccccgacgcccacgagacccacgagacccacgcggcctccaagacacccgagacgctcgagacgaacgacaaggagacggcggatgcgctccccgaagctggccgcgct

SEQ ID NO: 6084 - DNA, 546 bp, Streptomyces avermitilis
  CDS (1)..(546)
atggccagctccaacgcagccgccgcccgtcggcgccgcgcccccggccctgcaccctcactgaccggccaggcgggcgatgtgcaccccgtgctgcgccgggccacggccccgcccgccgccctcgacctgcttgcccaggcccgcgccggtctcgaagaggcgaccggcctcgacatggccaacgagcggtatgccacggcgcatctggcagccctgcgcaccgctgccgccgtactcgcggcgcgggcgcgaccggagccgaacgcgcgacgccgcgccaggatccggagcgcctgggaagtgctccccgagatagcgccggaactcagcgagtggagcgcgctgttcgcctcgggggcgggccgccgcgcccgcgccgaggccggcatccagggcgcggcgagcaaccgcgacgccgacgacctgatacgcgacgtggcgatgttcctccgcctcgtcgagcggatgctcgtcctccagccggtcctgccccagccacgccaggacgacgaccggggtgaccgggaggtgccggacgcgggg

SEQ ID NO: 6085 - DNA, 768 bp, Streptomyces avermitilis
  CDS (1)..(768)
gtgtcggacccgatgcgcccccgcgcttctctccgtaccgccgtggtctgggaggtcctcaaggacgccctcgaccgccgcgtcaaggccacggggcgggacgcgctcgacgtcctcgacaccggaggcggcagcggcaacttcgcggtgcccgcggcccgcctcggccaccgcgtcaccgtcgtcgaccccagccccaacgcgctgttcgcgctggagcgccgggctgccgaggccggcgtcgccgaccgcgtgaagggcgttcagggcgacgcccacggcctcttcgacgtggtcgagcgcggcggctacgacgcggtgctctgccacggcgtcctggagtacgtggacgatcccgcggagggcgtccgcaacgcggtggccgcgctgcgtcccgagggtgtcctcagcctgctggccgccggactcggcggagccgtgctcgcacgcgccctcgccgggcacttcaaggaggccaaacaggcgctggaggacccgaacggccgctggggcgagggtgaccccgtgccgcaccgcttcaccgtcgagcaactgaccgctctcgtcgagggcgcgggcctgcgggtcggggccgtgcacggcgtccgggtcttcgcggacctggtccccggcgtcctcgtggacaccgagccgggagccctggacgcactgctcaagctggaggaggcggcggccgagttccccgcgttccactccgtggccacacagctccacgtactgggtgagacgcaggcggcggccgacgcc

SEQ ID NO: 6086 - DNA, 390 bp, Streptomyces avermitilis
  CDS (1)..(390)
gtgccgctctcggagcacgagcagcgaatgctcgagcagatggagcgagcgctgtacgccgaagatcccaagttcgcgacagcgcttgagggaagcgggctgcgtacgtacacccggcgacgggtttaccaggcggtcgcgggcttcctggtgggtatcgcgctcctcatggccggaatggtcgcacagcagatctggatcagtgtggtggggttcctcgtcatgctgggctgtgcggtgctcgccgtcaccggttggcgcaaggcccccaagccgggtgagcagtcggccgccggtgcgcccggggcccgccgacagccgcgccggcgccgctccatgatggaccgcatcgaacagcgctggcagcgccgtcgcgacgagcaaggccac

SEQ ID NO: 6087 - DNA, 2385 bp, Streptomyces avermitilis
  CDS (1)..(2385)
atgagcgggcgcgcccgcctggcgctgtgtgccgcggcggcgacgctgatggcatcgtgcgcgctgctgccgctggtcgatccgccgacctggctcttccaggcggcgttcctggtggcggtgcagaccggggtcggggcgctgacccggcgggtcccactggcccggccgctgaccatcgcctgccaggtgctggtcaccctgctgctgctgaccctgacgttcgcccgggaacaggccctcgccggcttcatccccgggccggacgtcttccaacgcttcggggagttgctccagtcgggcacggacgatgtcgggcgttacgcgatacccgcgccgctgtctcccgggatccggctgatgatggtcggcggcgtcctggtgatcgggctcgcggtcgacgcgctggcggtgacgttccgcaccgcggccccggccggactgccgctgctcgccctgtactcggtggccgcggggctgtccgacggcgcggccgactggctgtggttcgtggtcgcggccgcgggctatctgatgctgctgctggccgagggccgcgaccgcctctcccagtgggggcgcgtcttcggcggcgcggcccgggcgccgggcaccgactccggcggcgccgtggcacccgtgcgcaccggccggcgcatcggcgcggtcgcgctgggcgtcgccctgatcgtgccgctcggcctgcccgcgctcgacggcgggctgctggacggtgccaggaccggcgtgggcgccgggaccggcgacggcggcacgatctccgcggtgaacccgctggtgtcgctgcgcgacagtctgaacgtggatcaggaccgccaggtcatgtcgtaccgcaccaacaccgagaacacccgggacatgtatctgcggatcgtctccctggacgacttcgacggcacgtcctggaagccggcccagcggcacatcgtcggggtgccggacaccttccagacgccgatcgggctcggcaccgacatacggcggaccgagatcgagacccgtgtctcggcggcggactggtacgcgcaggactggctgccgatgccgtaccccgcgaccggtgtgcagatcaagggcaagtggcggtacgagccgatcgggcgcacgctcgtcggcgaccacggccagaacacccggggtgcgcagtacacggtcaagagcctgatcgtgcagccgaccgcggaacagctcgccctgtcacccgagccgccggcggcgctgaagcgcgagttcaccaaggtgcccgactcgctgccggccgtggtggccaggacggcacgcgaggtcacggacggctcggcgaaccactacgagcaggcggtcaagctccaggactacttcgccgtgaacggcgggttcacgtacgacacccaggtgcaggcgggcagcggctccgcggcgatcgcccggttcctgaagcagaagcagggcttctgcgtccacttctccttcgcgatggccgcgatggcgcggacgctggggataccggcccgggtcgcggtgggcttcactccgggctcgccgcaggcggacggctcgatgtcggtggggctgcgggacgcgcacgcctggcccgagctgtacttcgagggcgtgggctggacccgcttcgagccgaccccgaaccgggggacgacgccgacgtacacgcagtcggacaccccgtccggtgacagtcccgatgtgccgaagccgacgcggtcggcgtccgccgcaccgtcggccgcgccgtcggcgagtgcgagctgctcggcccaggagcggaagctggaggcgtgcccgagccagtcggcgcaggccgtggcgggctcgggcgacgccggtccgccgtggtacgggatcctgctgtggaccctggtggggctcgtggtgctggtgctgccgttcctgccgatgctgtggcggatgcgggtgcgggccgtacggctcggtacgcacggccgtacggaggagagtgcggcggcccacgccctggcggcctggcaggaggtgaccgatacggcgtgggaccacgggatcgcgccggacgagtcccagacaccgcgcaaggccgcggcccggatcgcccgtctcggtcatctggatcccgcggccgcggcagcggtgcaccggctggcggcggcggtggaacaggttctgtacgcgccgcgcccccgcccgacggcggggctggcggaggacgcccgcctcgtcgggagtgccctgaactccacggtgagccgcccgacacgcctgcgtgctctgctggcgccgcgttcagctgtccggatggcctgggcggtgtccgaccgctggacggcgctgaggacgaacctggcggcccgtcggccgaccctgccgagacggccgtcgagccagaacggt

SEQ ID NO: 6088 - DNA, 1359 bp, Streptomyces avermitilis
  CDS (1)..(1359)
gtgatgacgcaaggggcgccggcccccacccccgaggaggacaagggcgggctgcgcacggccctcgccggtctcaccacgcgcgggcgctccttcctggccgccggcatcgctgccgccatctgcgcctacgtcctggggcagagcgatctgctccgggtcggtctgctgctggccgtgctgccgctggtgtgcgcgaccgtgctgtaccgcacgcgctaccgggtcgcgggcagccgccggctgtccccggggcgcgtgcccgccggttccgaggcccgggtccatctgcggatggacaacgtctcgcggctgcccaccggactgctgatgctccaggaccgggtgccgtacgtgctcgggccgcgcccccggttcgtcctggaccgggtggaggcgggcgggcgccgcgaggtgtcctaccgcgtgcgctccgatctgcgcggccgctacccgctgggcccgctccagctgcggctcaccgacccgttcggcatgtgcgagctgacccgctccttctcgacgtacgacaccctgacggtcatcccgcgcgtggagccgctgccgcctgtacggctgagcggcgaggcgaaggggtacggcgacgggcggcagcgcgcactggcgctggcgggcgaggacgacgtgatcccgcgcgggtaccggcacggtgacgatctgcgccgggtccactggcggctgaccgcgcgctacggcgagctgatggtccgccgtgaggagcagccgcagcggtcccgctgcacggtgttcctcgacaccaggggcctcgccttccagggcgcgggcccggactcggcgttcgaatgggcggtctcgggtgcggcgtccacgctggtgcacatgctcgaacggggcttctcggtgcggctgctgacggacaccggcagttcggtgcccgccgagggggccgacgggttcgcgggcgcgagccaggagtcggccgacgcggccggactgatgatggacaccctcgcggtgatcgaccactcggacggcacgggcctgtcccacgcctacgacgtgctgcgcgggggcaacgagggcctgctggtcgccttcttcggcgacctcgacgaggaacaggccacggtggtcgccaagatgcgcccgcgcagcggtggggcggtggcgttcctgctggacagtgagagctgggtgcgcgaggcggccgatgtgccgggccccttggacaagagcgaggagcggctgcggatgctgcgcgaggcgggctggacggcgctgaaggtgccacggggagccggactcgccgacctgtggcgccaggcggaccgacagcgcatgggcatcggcgccggaagcggtacggagggacggtca

SEQ ID NO: 6089 - DNA, 1029 bp, Streptomyces avermitilis
  CDS (1)..(1029)
gtgacgacctatgacgatcgagcgagccttacagatctgaccgccactgtggagcgcgtccgcagttcggtggaaggagtgatcgaaggcaagccagaggtcgtacggctttcgctgaccgtgctgctcgccgagggacatcttctgatcgaggatgtcccgggcgtcggcaagaccatgctcgccaaggcactggcgcggtccatcgactgctcggtgcggcgtatccagttcacgcccgacctgctgccctcggacatcacgggtgtgtccatctgggaccagcagcgccgggaattcgagttcaagccgggcgcgatcttcgcgcagatcgtgatcggcgacgagatcaaccgcgcctcgcccaagacgcagtccgcgctcctggagtcgatggaggaacgccaggtcacgatcgacgggcacacctatgagctgccgagcccgttcatggtggtggccacgcagaacccggtcgagatggagggcacctacccgcttccggaggcccagcgcgaccgcttcatggcccgggtctccatcggctatccgagcgccgaggccgagctggagatgctcgacatccacggcggggtgaacccgctggacgacctccagccggtggcgcacgcgcacgagatcgtgaagctggtcgacgcggtgcgctcggtccatgtcgccgagtcggtccgcaggtacgcggtggacctggtcgcggccacgcgcacccaccccgacctgagactcggcgcctcgccgcgggccacgctgcacctgctgcgcgcggcgaaggcgtccgccgcgctcagcggccgggagtacgccctgccggacgacgtacaggcgctcgccgtggccgtcctggcccaccgcctgctgcccaccgctcaggcccagctgaaccgtcgtacggcggaacaggtcgtccaggagatccttcagcgcaccgccgtgccggcgacgccccagcagcaggcgggcttcaccacgggccgtggcgccttcggccagcagccaccccggaggctg

SEQ ID NO: 6090 - DNA, 546 bp, Streptomyces avermitilis
  CDS (1)..(546)
atgacgacttccgcatccgttcccactgaacccgaagacgccatatccaccgacggcaccgtgaccgaccgcctgatcgacgcgaaccagcggtacgccgccgcgttctccgaccccggcatggacgcgcgccccgtcctgcacgtcgccgtggtcgcctgcatggacgcccggctcgacctgcatgccgcgctcggcctggaactgggcgactgccacaccatccgcaacgcgggcggtgtggtcaccgacgacgtgatccgctccctcaccatcagccagcgggcgctcggcacccgcagcgtggtcctcatccaccacaccggctgcggtctggagtccctcaccgaggacttccggcacgagctggagatggaggtcggacagcgtccggcctgggcggtcgaggccttccgggacgtcgaacaggacgttcggcagtccatgcagcgcgtacggacctccccgttcctgctgcacaccgacgacgtgcgcggcttcgtcttcgacgtgaaaacgggccggctgcgcgagatcgaccccgcc

SEQ ID NO: 6091 - DNA, 954 bp, Streptomyces avermitilis
  CDS (1)..(954)
ttgagccagagtcgacacgtcccggtcatgctccagcggtgcctggacatgctggccccggccctcaccgagccaggagccgtcgtcgtcgactgcacccttggtctcggcggccacagcgaggcgctgctgacgcagttccccgaagcccggctcgtcgccctggaccgggacaaggaggcgctgcgcctgtccggtgagcggctcgcccccttcggtgaccgcgccaccctggtgcacgcggtctacgacgagctgcccgacgtactcgaccggctgggcgtgccccgcgtccagggcgtcctgttcgatctcggcgtctcctccatgcaactcgacgaggccgaccgcggcttcgcctacgcccaggacgcccccctcgacatgcgcatggaccagacgaccggcatcagcgccgccgaggtcctcaacacctacccgccgggcgagatcgtccggatcctgcgggcgtacggcgaggagaagcaggccaagcggatcgtctcggccatcgtgcgcgagcgcgagaaggagccgttcagcaacagcgcgcggctggtggaactgatccgtgactcgctcccgcaggccgccaagcgcaccggcggcaaccccgccaagcgcaccttccaggccctgcgcatcgaggtcaacggtgagctgtccgtcctggagagggcgattcccgcggccgtgaaggcgctcgccgtcggcggcaggatcgccgtcctgtcgtaccactcgctcgaagaccgcctggtgaagcaggtgttcgcggccggtgccgccaccaccgcgccgcccggtctgccggtggtccccgagcgctaccagccccggctcaagctcctcacgcgtggtgccgaacttcccaccgaggaagagatcgccgagaaccggcgggccgccccggcgcggctgcgcggcgcgcagcgcatccgcgaggacgccgag

SEQ ID NO: 6092 - DNA, 525 bp, Streptomyces avermitilis
  CDS (1)..(525)
atgagacgaaggggagggcgcgtgagcgggaaacctcaactgaagggccgggccgcgcggctcgcgcggctcttcccggccggcgcgggacaggccgcccgcgcccccttcgtcctgctggtcgtcctgctgctcggcggcggactcatcggcctcctggtactgaactccgcgctcagtgagggctcgttcaagctcgacgacctccagaaggagacgaagagcctcaccgacgaggagcaggcgctccagcgggacgtggacgcctactccgcccccgacgccctccagcgccgcgcccgcgaactcggcatggtccccggcggcgacccggccttcctcgatcccgacggcaccgtcaagggcgtcccccgagccgccgggcagtcctcgctgcggacctcggcggtgcgcccgcccgaggtcctctccccgtacccggcgccgccgcccgcgcagtcgcaccccctcggcgcacccgccacgaccacccagcccgcactcccctcctcgactaccggcagg

SEQ ID NO: 6093 - DNA, 1959 bp, Streptomyces avermitilis
  CDS (1)..(1959)
gtgacggaagtgtccgacagggaaccgccgcgccgccgcgtgcccggacccgccaggcccgtacgccccggcaaccagcgccgacccggcccgggcgcccgccccgcgcgccgccccgccccgtcccgcggccccgccccgcgcacgatccggctcggcagcccccggccccggctgcgcatggtcagcctggcgctcaccctggtgatgatcgccttcgtcgtacggctgctccaggtgcaggccgtcgacgcgagcacgtatgccgccaaggccgacaagaaccggtacgtcggccatgtcctgaccgccgagcgcggcggcatcaccgaccgcgggggagtggcgctcgcgatcagcgtggacgccaacgacatcacggccgaccccacgatgttcacccgcaagcagctcaagatcgacgacggtcccgagcaggccgccgcgctcctcgcgccgatcctcggccaggaccaggcgacgctcaccgagaagctcaggaccagcaacacgcagtacgtcctgctcgcccgccgtcagaccccccaggtctggaagcagatcaaggacctgaagaccgccctcaccaaaaaggccgagagcgacgggagcaccgtgaacgtcctcgcgggcgtcttccaggaccccagcagcaagcgcgtctatccgaacggcgacctcgccgccgggatactgggctgggtcaacgccgagggcaagggcggaggcgggatcgagcagcagctgaacaaggagctcaccggcaaggacggcaagatccgctacgcccagtccggcggccgtctggtgcccaccgcgggctccaccgagacccccgccgtggccggctccgacgtcgagctgaccatcgaccgcgacatccagtgggccgcgcagaacgccatcaccgagcaggtggagaagtccggggcggaccgcggctacgtgatggtgcaggacaccaggaccggcgagatcctggccatggccaactcgcccggcttcgaccccaacgacctgtccaaggccagctcggcggccctcggcaacgcggccctccaggacgcgtacgagcccggctccaccgccaaggtcatgtccatggccgccgtgctggaggagaacgtcgccacacccgagacacatgtcgtcgtgcccaaccggctgcaccgcggcgaccggctcttccaggacgacatcgaccacccgacctggaacctgacgctcaacggcgtgctcgccaagtccagcaacatcggcaccatcctggcggcgggacagctcggcaagacgcagaagcaggccaacgaggtcctgtactcgtacatgcgcaagttcggcatcggcctccccaccgggctcggcttcccgggcgagacctccggcatcctcgcgccggccgccaagtggtcgacctcgcagcagtacacgattcctttcggccagggcgtgtcgatcaacgcgatgcaggcggcctccgtctactcgacgatcgccaacggcggcgtacgcgtcgagccgacactggtgcgcggcaccaaggggcccgacggacgcttcactccggcgccccggcccaagaagaccagggtcgtgagcgagaagacggcgaagaccctcgcccagatgctggagtccgtcgtggacgacgaggagggcaccggcgccaaggcccgtatcccgggctaccgggtggcgggcaagaccggtacggccaaccgcgtggatccggccaccggcaagtaccacggctacacctcgtcgttcgccggattcgcacccgccgacaacccccggatcaccgtctactgcgccatccagaacgccacccagggcagctacttcggcggccagatctgcggtcccatctacaaacaggtcatggaattcgccctcaagaccctccaggtcccgcccaccggggccggggccgcccatctgcccgtcaccttcacaccg
